United States Patent 9,061,059 (MODIFIED POLYNUCLEOTIDES FOR TREATING PROTEIN DEFICIENCY) - sequence listing, part 80

SEQ ID NO: 154465 - DNA, 2433 bp, Artificial Sequence
  Description of Artificial Sequence: Synthetic coding sequence
atggcccaggccctgtctgaggaggagttccagaggatgcaggcccagctgctggagctgcggaccaacaactaccagctgagtgatgagctgaggaagaatggagtggagctgaccagcctgcggcagaaggtggcctacctggacaaggagttcagcaaggcccagaagagccctggcccctgcctgcccctgcaggaggtggaggtgctgctgtctgaaaatgagatgctgcaggccaagctgcacagccaggaggaggacttccggctgcagaacagcaccctgatggccgagttcagcaagctgtgcagccagatggagcagctggagcaggagaaccagcagctgaaggagggcgccgccggggccggcgtggcccaggccggccccctggtggatggagagctgctgcggctgcaggctgaaaatacagccctgcagaagaatgtggccgccctgcaggagagatatggcaaggaggccggcaagttctctgctgtgtctgagggccagggcgaccccccaggcggccctgcccccaccgtgctggcccccatgcccctggccgaggtggagctgaagtgggagatggagaaggaggagaagaggctgctgtgggagcagctgcagggcctggagagcagcaagcaggccgagaccagccggctgcaggaggagctggccaagctgtctgagaagctgaagaagaagcaggagagcttctgccgcctgcagacagagaaggagaccctcttcaatgacagcaggaacaagattgaggagctgcagcagaggaaggaggccgaccacaaggcccagctggcccggacccagaagctgcagcaggagctggaggccgccaaccagagcctggccgagctgcgggaccagaggcagggcgagcggctggagcacgccgccgccctgcgggccctgcaggaccagatccagacagccaagacccaggagctgaacatgctgcgggagcagaccaccggcctggccgctgagctgcagcagcagcaggccgagtatgaggacctgatgggccagaaggatgacctgaacagccagctgcaggagagcctgcgggccaacagccggctgctggagcagctgcaggagatcggccaggagaaggagcagctgacccaggagctgcaggaggccaggaagtctgctgagaagaggaaggccatgctggatgagctggccatggagaccctgcaggagaagagccagcacaaggaggagctgggcgctgtgcggctgcggcatgagaaggaggtgctgggcgtgcgggcccgctatgaaagagagctgcgggagctgcacgaggacaagaagaggcaggaggaggagctgcggggccagatccgggaggagaaggcccggacccgggagctggagaccctgcagcagacagtggaggagctgcaggcccaggtgcacagcatggatggagccaagggctggtttgagcggcggctgaaggaggccgaggagagcctgcagcagcagcagcaggagcaggaggaggccctgaagcagtgccgggagcagcacgccgctgagctgaagggcaaggaggaggagctgcaggatgtgcgggaccagctggagcaggcccaggaggagcgggactgccacctgaagaccatcagcagcctgaagcaggaggtgaaggacacagtggatggccagaggatcctggagaagaagggcagcgctgccctgaaggacctgaagaggcagctgcacctggagaggaagagagctgacaagctgcaggagcggctgcaggacatcctgaccaacagcaagagccgcagcggcctggaggagctggtgctgtctgagatgaacagccccagcaggacccagacaggagacagcagcagcatcagcagcttctcctaccgggagatcctgcgggagaaggagagcagcgctgtgcctgcccggagcctgagcagcagcccccaggcccagccccccaggcctgctgagctgagtgatgaggaggtggccgagctgttccagaggctggccgagacccagcaggagaagtggatgctggaggagaaggtgaagcacctggaggtgtcctctgcctccatggccgaggacctgtgcaggaagagcgccatcatcgagacctacgtgatggacagcagaattgatgtgtctgtggccgccggccacacagacaggagcggcctgggctctgtgctgcgggacctggtgaagccaggagatgagaacctgcgggagatgaacaagaagctgcagaacatgctggaggagcagctgaccaagaacatgcacctgcacaaggacatggaggtgctgagccaggagatcgtgcggctgagcaaagaatgtgtgggccccccagaccctgacctggagcccggggagaccagctag

SEQ ID NO: 154466 - DNA, 1425 bp, Artificial Sequence
  Description of Artificial Sequence: Synthetic coding sequence
atgaagagggtgctggtgctgctgctggccgtggcctttggacatgccctggagcggggccgggactatgagaagaacaaggtgtgcaaggagttcagccacctgggcaaggaggacttcaccagcctgagcctggtgctgtacagcaggaagttccccagcggcacctttgagcaggtgtcccagctggtgaaggaggtggtgtccctgacagaggcctgctgtgccgagggcgctgaccctgactgctatgacaccaggaccagcgccctgagcgccaagagctgtgagagcaacagccccttccctgtgcaccctggaacagctgagtgctgcaccaaggagggcctggagaggaagctgtgcatggccgccctgaagcaccagccccaggagttccccacctacgtggagcccaccaatgatgagatctgtgaggccttcaggaaggaccccaaggagtatgccaaccagttcatgtgggagtacagcaccaactacggccaggcccccctgagcctgctggtgtcctacaccaagagctacctgtccatggtgggcagctgctgcaccagcgccagccccaccgtgtgcttcctgaaggagcggctgcagctgaagcacctgagcctgctgaccaccctgagcaacagagtgtgcagccagtatgctgcctacggggagaagaagagccggctgagcaacctgatcaagctggcccagaaggtgcccacagctgacctggaggatgtgctgcccctggccgaggacatcaccaacatcctgagcaagtgctgtgagagcgccagcgaggactgcatggccaaggagctgcctgagcacacagtgaagctgtgtgacaacctgagcaccaagaacagcaagtttgaggactgctgccaggagaagacagccatggatgtgtttgtgtgcacctacttcatgcctgctgcccagctgcctgagctgcctgatgtggagctgcccaccaacaaggatgtgtgtgaccccggcaacaccaaggtgatggacaagtacacctttgagctgagcaggaggacccacctgcctgaggtgttcctgagcaaggtgctggagcccaccctgaagagcctgggggagtgctgtgatgtggaggacagcaccacctgcttcaatgccaagggccccctgctgaagaaggagctgagcagcttcatcgacaagggccaggagctgtgtgccgactacagcgagaacaccttcacagagtacaagaagaagctggccgagcggctgaaggccaagctgcctgatgccacccccacagagctggccaagctggtgaacaagcacagcgactttgccagcaactgctgcagcatcaacagcccccccctgtactgtgacagcgagattgatgctgagctgaagaacatcctgtag

SEQ ID NO: 154467 - DNA, 438 bp, Artificial Sequence
  Description of Artificial Sequence: Synthetic coding sequence
atgaagagggtgctggtgctgctgctggccgtggcctttggacatgccctggagcggggccgggactatgagaagaacaaggtgtgcaaggagttcagccacctgggcaaggaggacttcaccagcctgagcctggtgctgtacagcaggaagttccccagcggcacctttgagcaggtgtcccagctggtgaaggaggtggtgtccctgacagaggcctgctgtgccgagggcgctgaccctgactgctatgacaccaggaccagcgccctgagcgccaagagctgtgagagcaacagccccttccctgtgcaccctggaacagctgagtgctgcaccaaggagggcctggagaggaagctgtgcatggccgccctgaagcaccagccccaggagttccccacctacgtggagcccaccaatgatgagatctgctag

SEQ ID NO: 154468 - DNA, 1482 bp, Artificial Sequence
  Description of Artificial Sequence: Synthetic coding sequence
atgctgtggagctggagcgaggagcggggcggggccgcccggctgagcggcaggaagatgaagagggtgctggtgctgctgctggccgtggccttcggccacgccctggagcggggccgggactatgagaagaacaaggtgtgcaaggagttcagccacctgggcaaggaggacttcaccagcctgagcctggtgctgtacagcaggaagttccccagcggcacctttgagcaggtgtcccagctggtgaaggaggtggtgtccctgacagaggcctgctgtgccgagggcgctgaccctgactgctatgacaccaggaccagcgccctgagcgccaagagctgtgagagcaacagccccttccctgtgcaccctggaacagctgagtgctgcaccaaggagggcctggagaggaagctgtgcatggccgccctgaagcaccagccccaggagttccccacctacgtggagcccaccaatgatgagatctgtgaggccttcaggaaggaccccaaggagtatgccaaccagttcatgtgggagtacagcaccaactacggccaggcccccctgagcctgctggtgtcctacaccaagagctacctgtccatggtgggcagctgctgcaccagcgccagccccaccgtgtgcttcctgaaggagcggctgcagctgaagcacctgagcctgctgaccaccctgagcaacagagtgtgcagccagtatgctgcctatggagagaagaagagccggctgagcaacctgatcaagctggcccagaaggtgcccacagctgacctggaggatgtgctgcccctggccgaggacatcaccaacatcctgagcaagtgctgtgagagcgccagcgaggactgcatggccaaggagctgcctgagcacacagtgaagctgtgtgacaacctgagcaccaagaacagcaagtttgaggactgctgccaggagaagacagccatggatgtgtttgtgtgcacctacttcatgcctgctgcccagctgcctgagctgcctgatgtggagctgcccaccaacaaggatgtgtgtgaccccggcaacaccaaggtgatggacaagtacacctttgagctgagcaggaggacccacctgcctgaggtgttcctgagcaaggtgctggagcccaccctgaagagcctgggggagtgctgtgatgtggaggacagcaccacctgcttcaatgccaagggccccctgctgaagaaggagctgagcagcttcatcgacaagggccaggagctgtgtgccgactacagcgagaacaccttcacagagtacaagaagaagctggccgagcggctgaaggccaagctgcctgatgccacccccacagagctggccaagctggtgaacaagcacagcgactttgccagcaactgctgcagcatcaacagcccccccctgtactgtgacagcgagattgatgctgagctgaagaacatcctgtag

SEQ ID NO: 154469 - DNA, 669 bp, Artificial Sequence
  Description of Artificial Sequence: Synthetic coding sequence
atggccgcctctgtgcggcaggcccggagcctgctgggcgtggccgccaccctggcccctggcagccggggctaccgggcccggcccccacccaggagaagacctggcccccgctggccagaccctgaggacctgctgaccccccgctggcagctgggccccaggtatgctgccaagcagtttgcccgctacggggccgccagcggcgtggtgcccggcagcctgtggcccagccctgagcagctgcgggagctggaggccgaggagcgggagtggtaccccagcctggccaccatgcaggagagcctgcgggtgaagcagctggccgaggagcagaagaggcgggagcgggagcagcacatcgccgagtgcatggccaagatgccccagatgattgtgaactggcagcagcagcagcgggagaactgggagaaggcccaggccgacaaggagcggcgggcccggctgcaggccgaggcccaggagctgctgggctaccaggtggaccccaggtctgcccgcttccaggagctgctgcaggacctggagaagaaggagaggaagaggctgaaggaggagaagcagaagaggaagaaggaggcccgggccgccgccctggccgctgctgtggcccaggaccctgctgccagcggggcccccagcagctag

SEQ ID NO: 154470 - DNA, 1038 bp, Artificial Sequence
  Description of Artificial Sequence: Synthetic coding sequence
atggtggccgccctgctgggcggcggcggggaggcccggggcggcaccgtgcctggggcctggctgtgcctgatggccctgctgcagctgctgggcagcgccccccggggcagcggcctggcccacggccggcggctcatctgctggcaggccctgctgcagtgccagggcgagcctgagtgcagctatgcctacaaccagtatgcagaggcctgtgcccctgtgctggcccagcacggcggcggagatgcccctggagctgctgctgctgccttccctgccagcgctgccagcttcagcagccgctggcgctgccccagccactgcatcagcgccctgatccagctgaaccacacccggcggggccctgccctggaggactgtgactgtgcccaggatgagaactgcaagagcaccaagagggccatcgagccctgcctgcccaggaccagcggcggcggggccggcggccctggggccggcggcgtgatgggctgcacagaggccaggagaagatgtgaccgggacagccgctgcaacctggccctgagccgctacctgacctactgtgggaaggtgttcaacggcctgcgctgcacagatgagtgcaggacagtgattgaggacatgctggccatgcccaaggccgccctgctgaatgactgtgtgtgtgatggcctggagcggcccatctgtgagagcgtgaaggagaacatggcccggctgtgcttcggggctgagctgggcaatggacctggcagcagcggcagtgatggcggcctggatgactactatgatgaagattatgatgatgagcagaggactggaggagctggaggagagcagcccctggatgatgatgatggagtgccccaccccccccggcccggcagcggggctgctgccagcggcggccgcggggacctgccctacggccctggaagaagaagcagcggcggcggcggccgcctggcccccaggggggcctggacccccctggccagcatcctgctgctgctgctgggccccctcttctag

SEQ ID NO: 154471 - DNA, 942 bp, Artificial Sequence
  Description of Artificial Sequence: Synthetic coding sequence
atgtgcacagccctgagccccaaggtgcgcagcggccctggcctgagtgacatgcaccagtacagccagtggctggccagcagacatgaggccaacctgctgcccatgaaggaggacctggccctgtggctgaccaacctgctgggcaaggagatcacagctgagaccttcatggagaagctggacaatggagccctgctgtgccagctggccgagaccatgcaggagaagttcaaggagagcatggatgccaacaagcccaccaagaacctgcccctgaagaagatcccctgcaagaccagcgcccccagcggcagcttctttgcccgggacaacacagccaacttcctgtcctggtgccgggacctgggcgtggatgagacctgcctgtttgaaagtgagggcctggtgctgcacaagcagccccgggaggtgtgcctgtgcctgctggagctgggcagaattgctgcccgctatggagtggagcccccaggcctcatcaagctggagaaggagattgagcaggaggagaccctgagcgcccccagccccagccccagccccagcagcaagagcagcggcaagaagagcacaggcaacctgctggatgatgctgtgaagaggatcagtgaagatcctccctgcaagtgccccaacaagttctgtgtggagcggctgagccagggccgctacagagtgggggagaagatcctcttcatccgcatgctgcacaacaagcacgtgatggtgcgggtgggcggcggctgggagacctttgctggctacctgctgaagcatgacccctgcaggatgctgcagatcagccgggtggatggcaagaccagccccatccagagcaagagccccaccctgaaggacatgaacccagacaactacctggtggtgtctgccagctacaaggccaagaaggagatcaagtag

SEQ ID NO: 154472 - DNA, 942 bp, Artificial Sequence; identical to SEQ ID NO: 154471
  Description of Artificial Sequence: Synthetic coding sequence

SEQ ID NO: 154473 - DNA, 942 bp, Artificial Sequence; identical to SEQ ID NO: 154471
  Description of Artificial Sequence: Synthetic coding sequence

SEQ ID NO: 154474 - DNA, 546 bp, Artificial Sequence
  Description of Artificial Sequence: Synthetic coding sequence
atgtgcacagccctgagccccaaggtgcgcagcggccctggcctgagtgacatgcaccagtacagccagtggctggccagcagacatgaggccaacctgctgcccatgaaggaggacctggccctgtggctgaccaacctgctgggcaaggagatcacagctgagaccttcatggagaagctggacaatggagccctgctgtgccagctggccgagaccatgcaggagaagttcaaggagagcatggatgccaacaagcccaccaagaacctgcccctgaagaagatcccctgcaagaccagcgcccccagcggcagcttctttgcccgggacaacacagccaacttcctgtcctggtgccgggacctgggcgtggatgagacctgcctgtttgaaagtgagggcctggtgctgcacaagcagccccgggaggtgtgcctgtgcctgctggagctgggcagaattgctgcccgctatggagtggagcccccaggcctcatcaagctggagaaggagattgagcaggaggagaccctgagcgcctag

SEQ ID NO: 154475 - DNA, 618 bp, Artificial Sequence
  Description of Artificial Sequence: Synthetic coding sequence
atgtgcacagccctgagccccaaggtgcgcagcggccctggcctgagtgacatgcaccagtacagccagtggctggccagcagacatgaggccaacctgctgcccatgaaggaggacctggccctgtggctgaccaacctgctgggcaaggagatcacagctgagaccttcatggagaagctggacaatggagccctgctgtgccagctggccgagaccatgcaggagaagttcaaggagagcatggatgccaacaagcccaccaagaacctgcccctgaagaagatcccctgcaagaccagcgcccccagcggcagcttctttgcccgggacaacacagccaacttcctgtcctggtgccgggacctgggcgtggatgagacctgcctgtttgaaagtgagggcctggtgctgcacaagcagccccgggaggtgtgcctgtgcctgctggagctgggcagaattgctgcccgctatggagtggagcccccaggcctcatcaagctggagaaggagattgagcaggaggagaccctgagcgcccccagccccagccccagccccagcagcaagagcagcggcaagaagagcacaggcaacctgctggatgatgcctag

SEQ ID NO: 154476 - DNA, 411 bp, Artificial Sequence
  Description of Artificial Sequence: Synthetic coding sequence
atgtgcacagccctgagccccaaggtgcgcagcggccctggcctgagtgacatgcaccagtacagccagtggctggccagcagacatgaggccaacctgctgcccatgaaggaggacctggccctgtggctgaccaacctgctgggcaaggagatcacagctgagaccttcatggagaagctggacaatggagccctgctgtgccagctggccgagaccatgcaggagaagttcaaggagagcatggatgccaacaagcccaccaagaacctgcccctgaagaagatcccctgcaagaccagcgcccccagcggcagcttctttgcccgggacaacacagccaacttcctgtcctggtgccgggacctgggcgtggatgagacctgcctgtttgaaagtgagggcctgtag

SEQ ID NO: 154477 - DNA, 468 bp, Artificial Sequence
  Description of Artificial Sequence: Synthetic coding sequence
atgtgcacagccctgagccccaaggtgcgcagcggccctggcctgagtgacatgcaccagtacagccagtggctggccagcagacatgaggccaacctgctgcccatgaaggaggacctggccctgtggctgaccaacctgctgggcaaggagatcacagctgagaccttcatggagaagctggacaatggagccctgctgtgccagctggccgagaccatgcaggagaagttcaaggagagcatggatgccaacaagcccaccaagaacctgcccctgaagaagatcccctgcaagaccagcgcccccagcggcagcttctttgcccgggacaacacagccaacttcctgtcctggtgccgggacctgggcgtggatgagacctgcctgtttgaaagtgagggcctggtgctgcacaagcagccccgggaggtgtgcctgtgcctgctggagctgggccgcatctag

SEQ ID NO: 154478 - DNA, 2043 bp, Artificial Sequence
  Description of Artificial Sequence: Synthetic coding sequence
atggctgaccctgtggccggcattgctggcagcgctgccaagtctgtgcggcccttccgcagcagcgaggcctacgtggaggccatgaaggaggacctggccgagtggctgaatgccctgtatggcctgggcctgcccggcggcggagatggcttcctgaccggcctggccaccggcaccaccctgtgccagcacgccaatgctgtgacagaggccgcccgggccctggccgccgcccggcctgcccggggcgtggccttccaggcccacagcgtggtgcccggcagcttcatggcccgggacaacgtggccaccttcatcggctggtgccgggtggagctgggcgtgcctgaggtgctgatgtttgaaacagaggacctggtgctgaggaagaatgagaagtctgtggtgctgtgcctgctggaggtggccaggagaggagcccggctgggcctgctggccccccggctggtgcagtttgagcaggagattgaaagagagctgcgggccgcccccccagccccaaatgccccagctgctggggaggacaccacagaaacagccccagcccctggcaccccagcccggggccccaggatgacccccagcgacctgaggaacctggatgagctggtgcgggagatcctgggccgctgcacctgcccagaccagttccccatgatcaaggtgtctgagggcaagtacagagtgggggacagcagcctgctgatctttgtgcgggtgctgcggagccacgtgatggtgcgggtgggcggcggctgggacaccctggagcactacctggacaagcatgacccctgccgctgcagcagcacagcccacaggcctccccagccccgggtgtgcaccttcagcccccagagggtgagccccaccaccagccccaggcctgccagccctgtgcccggcagcgagcggcggggcagcaggcctgagatgacccctgtgtccctgcggagcaccaaggagggccctgagaccccaccccggccccgggaccagctgcccccccaccccaggagccgccgctacagcggggacagcgacagcagcgccagcagcgcccagagcggccccctgggcaccaggagtgatgacaccggcaccggcccccggcgggagcggcccagccggcggctgaccaccggcaccccagccagcccccggcggccccccctgcggagccagagccgggaccggctggaccggggccggcccaggggggcccctgggggccgcggggcccagctgtctgtgcccagccctgcccggcgggcccggagccagagccgggaggagcaggccgtgctgctggtgagaagagacagagatggccagcacagctgggtgccccggggccggggcagcggcggcagcggccgcagcaccccccagaccccccgggcccggagccctgctgccccccggctgagccgggtgagcagccccagccctgagctgggcaccaccccagccagcatcttccgcacccccctgcagctggacccccagcaggagcagcagctgttccggcggctggaggaggagttcctggccaatgcccgggccctggaggccgtggcctctgtgacccccaccggccctgccccagaccctgcccgggccccagaccccccagccccagattctgcctactgcagcagcagcagcagcagcagcagcctgtctgtgctgggcggcaaatgtggccagcccggggacagcggccgcacagccaacggcctgcccggccccaggagccaggccctgagcagcagcagtgatgagggcagcccctgccccggcatgggcggccccctggatgcccctggcagccccctggcctgcacagagcccagcaggacctgggcccggggccgcatggacacccagcctgacaggaagcccagccgcatccccaccccccggggcccccggcggcccagcggccctgctgagctgggcacctggcacgccctgcacagcgtgacccccagggctgagccagacagctggatgtag

SEQ ID NO: 154479 - DNA, 1014 bp, Artificial Sequence
  Description of Artificial Sequence: Synthetic coding sequence
atggctgaccctgtggccggcattgctggcagcgctgccaagtctgtgcggcccttccgcagcagcgaggcctacgtggaggccatgaaggaggacctggccgagtggctgaatgccctgtatggcctgggcctgcccggcggcggagatggcttcctgaccggcctggccaccggcaccaccctgtgccagcacgccaatgctgtgacagaggccgcccgggccctggccgccgcccggcctgcccggggcgtggccttccaggcccacagcgtggtgcccggcagcttcatggcccgggacaacgtggccaccttcatcggctggtgccgggtggagctgggcgtgcctgaggtgctgatgtttgaaacagaggacctggtgctgaggaagaatgagaagtctgtggtgctgtgcctgctggaggtggccaggagaggagcccggctgggcctgctggccccccggctggtgcagtttgagcaggagattgaaagagagctgcgggccgcccccccagccccaaatgccccagctgctggggaggacaccacagaaacagccccagcccctggcaccccagcccggggccccaggatgacccccagcgacctgaggaacctggatgagctggtgcgggagatcctgggccgctgcacctgcccagaccagttccccatgatcaaggtgtctgagggcaagtacagagtgggggacagcagcctgctgatctttgtgcgggtgctgcggagccacgtgatggtgcgggtgggcggcggctgggacaccctggagcactacctggacaagcatgacccctgccgctgcagcagcacagcccacaggcctccccagccccgggtgtgcaccttcagcccccagagggtgagccccaccaccagccccaggcctgccagccctgtgcccggcagcgagcggcggggcagcaggcctgagatgacccctgtgtccctgcggagcaccaaggagggccctgagaccccaccaagatag

SEQ ID NO: 154480 - DNA, 990 bp, Artificial Sequence
  Description of Artificial Sequence: Synthetic coding sequence
atggctgaccctgtggccggcattgctggcagcgctgccaagtctgtgcggcccttccgcagcagcgaggcctacgtggaggccatgaaggaggacctggccgagtggctgaatgccctgtatggcctgggcctgcccggcggcggagatggcttcctgaccggcctggccaccggcaccaccctgtgccagcacgccaatgctgtgacagaggccgcccgggccctggccgccgcccggcctgcccggggcgtggccttccaggcccacagcgtggtgcccggcagcttcatggcccgggacaacgtggccaccttcatcggctggtgccgggtggagctgggcgtgcctgaggtgctgatgtttgaaacagaggacctggtgctgaggaagaatgagaagtctgtggtgctgtgcctgctggaggtggccaggagaggagcccggctgggcctgctggccccccggctggtgcagtttgagcaggagattgaaagagagctgcgggccgcccccccagccccaaatgccccagctgctggggaggacaccacagaaacagccccagcccctggcaccccagcccggggccccaggatgacccccagcgacctgaggaacctggatgagctggtgcgggagatcctgggccgctgcacctgcccagaccagttccccatgatcaaggtgtctgagggcaagtacagagtgggggacagcagcctgctgatctttgtgcgggtgctgcggagccacgtgatggtgcgggtgggcggcggctgggacaccctggagcactacctggacaagcatgacccctgccgctgcagcagcactggacctggcatcagctgcccccccatcccagccccagctgccaccccaggcaccgtgaccccccagcccccaccacccagggctgcccccctggtgcctgctgtgatgacccaggccctggcccctgggggcagtgaccctgctgggggctag

SEQ ID NO: 154481 - DNA, 1614 bp, Artificial Sequence
  Description of Artificial Sequence: Synthetic coding sequence
atggctgaccctgtggccggcattgctggcagcgctgccaagtctgtgcggcccttccgcagcagcgaggcctacgtggaggccatgaaggaggacctggccgagtggctgaatgccctgtatggcctgggcctgcccggcggcggagatggcttcctgaccggcctggccaccggcaccaccctgtgccagcacgccaatgctgtgacagaggccgcccgggccctggccgccgcccggcctgcccggggcgtggccttccaggcccacagcgtggtgcccggcagcttcatggcccgggacaacgtggccaccttcatcggctggtgccgggtggagctgggcgtgcctgaggtgctgatgtttgaaacagaggacctggtgctgaggaagaatgagaagtctgtggtgctgtgcctgctggaggtggccaggagaggagcccggctgggcctgctggccccccggctggtgcagtttgagcaggagattgaaagagagctgcgggccgcccccccagccccaaatgccccagctgctggggaggacaccacagaaacagccccagcccctggcaccccagcccggggccccaggatgacccccagcgacctgaggaacctggatgagctggtgcgggagatcctgggccgctgcacctgcccagaccagttccccatgatcaaggtgtctgagggcaagtacagagtgggggacagcagcctgctgatctttgtgcgggtgctgcggagccacgtgatggtgcgggtgggcggcggctgggacaccctggagcactacctggacaagcatgacccctgccgctgcagcagcacagcccacaggcctccccagccccgggtgtgcaccttcagcccccagagggtgagccccaccaccagccccaggcctgccagccctgtgcccggcagcgagcggcggggcagcaggcctgagatgacccctgtgtccctgcggagcaccaaggagggccctgagaccccaccccggccccgggaccagctgcccccccaccccaggagccgccgctacagcggggacagcgacagcagcgccagcagcgcccagagcggccccctgggcaccaggagtgatgacaccggcaccggcccccggcgggagcggcccagccggcggctgaccaccggcaccccagccagcccccggcggcccccagcctgtgccgccagccctgagaccggctggattgctgctggccctgggggcccccaggaggccggggagcccagctgccgcagccctgccctgcccggcggccctggggcccgggccgcccggagccggctgtgctgcctgtgtgccggcatcgagaccggcagcacccacggctgccagggcgctggagctgtgggcgcccgggccggggccccaccccggctgcctgtgcctgctgccctgcagcaccctggcttccctggcagccctgcccctgtgcagagctgggccccccacaggcctgccagcagcgcccacccctgcagcagcaccaggagccgcagcagcagctgcagcggggcctggaagaggagctcctggcccatgcctggccccctgcggctgctgctggcctag

SEQ ID NO: 154482 - DNA, 1614 bp, Artificial Sequence; identical to SEQ ID NO: 154481
  Description of Artificial Sequence: Synthetic coding sequence

SEQ ID NO: 154483 - DNA, 1614 bp, Artificial Sequence; identical to SEQ ID NO: 154481
  Description of Artificial Sequence: Synthetic coding sequence

SEQ ID NO: 154484 - DNA, 417 bp, Artificial Sequence
  Description of Artificial Sequence: Synthetic coding sequence
atggctgaccctgtggccggcattgctggcagcgctgccaagtctgtgcggcccttccgcagcagcgaggcctacgtggaggccatgaaggaggacctggccgagtggctgaatgccctgtatggcctgggcctgcccggcggcggagatggcttcctgaccggcctggccaccggcaccaccctgtgccagcacgccaatgctgtgacagaggccgcccgggccctggccgccgcccggcctgcccggggcgtggccttccaggcccacagcgtggtgcccggcagcttcatggcccgggacaacgtggccaccttcatcggctggtgccgggtggagctgggcgtgcctgaggtgctgatgtttgaaacagaggacctggtgctgaggaagaatgagaagtctgtggtgctgtag

SEQ ID NO: 154485 - DNA, 432 bp, Artificial Sequence
  Description of Artificial Sequence: Synthetic coding sequence
atggctgaccctgtggccggcattgctggcagcgctgccaagtctgtgcggcccttccgcagcagcgaggcctacgtggaggccatgaaggaggacctggccgagtggctgaatgccctgtatggcctgggcctgcccggcggcggagatggcttcctgaccggcctggccaccggcaccaccctgtgccagcacgccaatgctgtgacagaggccgcccgggccctggccgccgcccggcctgcccggggcgtggccttccaggcccacagcgtggtgcccggcagcttcatggcccgggacaacgtggccaccttcatcggctggtgccgggtggagctgggcgtgcctgaggtgctgatgtttgaaacagaggacctggtgctgaggaagaatgagaagtctgtggtgctgtgcctgctggaggtgtag

SEQ ID NO: 154486 - DNA, 1614 bp, Artificial Sequence; identical to SEQ ID NO: 154481
  Description of Artificial Sequence: Synthetic coding sequence

SEQ ID NO: 154487 - DNA, 2037 bp, Artificial Sequence
  Description of Artificial Sequence: Synthetic coding sequence
atggcccccagcctgagccctggccctgctgccctgcggcgggccccccagctgctgctgctgctgctggccgcagaatgtgccctggccgccctgctgcctgcccgggaggccacccagttcctgcggccccggcagaggcgggccttccaggtgtttgaggaggccaagcagggccacctggagcgggagtgtgtggaggagctgtgcagccgggaggaggcccgggaggtgtttgaaaatgaccctgagacagactacttctacccccgctacctggactgcatcaacaagtatggcagcccctacaccaagaacagcggctttgccacctgtgtgcagaacctgcctgaccagtgcacccccaacccctgtgacaggaagggcacccaggcctgccaggacctgatgggcaacttcttctgcctgtgcaaggccggctggggcggccgcctgtgtgacaaggatgtgaatgaatgttcccaggagaatggaggctgcctgcagatctgccacaacaagccaggcagcttccactgcagctgccacagcggctttgagctgagcagtgatggccgcacctgccaggacattgatgaatgtgccgacagcgaggcctgtggggaggcccgctgcaagaacctgcccggcagctacagctgcctgtgtgatgagggctttgcctacagcagccaggagaaggcctgcagagatgtggatgaatgtctgcagggccgctgtgagcaggtgtgtgtgaacagccctggcagctacacctgccactgtgatggccggggcggcctgaagctgagccaggacatggacacctgtgaggacatcctgccctgtgtgcccttctctgtggccaagtctgtgaagagcctgtacctgggccgcatgttcagcggcacccctgtgatccggctgcgcttcaagaggctgcagcccacccggctggtggccgagtttgacttccgcacctttgatcctgagggcatcctgctgtttgctgggggccaccaggacagcacctggatcgtgctggccctgcgggccggccgcctggagctgcagctgcgctacaacggggtgggccgggtgaccagcagcggccctgtgatcaaccacggcatgtggcagaccatctctgtggaggagctggccaggaacctggtgatcaaggtgaacagagatgctgtgatgaagattgctgtggccggggacctcttccagcctgagcggggcctgtaccacctgaacctgactgtgggcggcatccccttccacgagaaggacctggtgcagcccatcaacccccggctggatggctgcatgaggtcctggaactggctgaatggagaggacaccaccatccaggagaccgtgaaggtgaacaccaggatgcagtgcttctctgtgacagagcggggcagcttctacccaggcagcggctttgccttctacagcctggactacatgaggacccccctggatgtgggcacagagagcacctgggaggtggaggtggtggcccacatccggcctgctgctgacacaggagtgctgtttgccctgtgggccccagacctgcgggctgtgcccctgtctgtggccctggtggactaccacagcaccaagaagctgaagaagcagctggtggtgctggccgtggagcacacagccctggccctgatggagatcaaggtgtgtgatggccaggagcacgtggtgacagtgtccctgagagatggagaggccaccctggaggtggatggcacccggggccagagcgaggtgtctgctgcccagctgcaggagcggctggccgtgctggagcggcacctgcggagccctgtgctgacctttgctgggggcctgcctgatgtgcctgtgaccagcgcccctgtgacagccttctaccggggctgcatgaccctggaggtgaacagaaggctgctggacctggatgaggccgcctacaagcacagcgacatcacagcccacagctgcccccctgtggagcctgctgctgcctag

SEQ ID NO: 154488 - DNA, 1875 bp, Artificial Sequence
  Description of Artificial Sequence: Synthetic coding sequence
atgtgcatgtgccaggccagccccccacctgctgccctggccggctgcctgctgagcagctgtgtgcagcctgcccgggagcacggcggggccttcagcaaggccgagtggctgagcaactgcatcaacaagtatggcagcccctacaccaagaacagcggctttgccacctgtgtgcagaacctgcctgaccagtgcacccccaacccctgtgacaggaagggcacccaggcctgccaggacctgatgggcaacttcttctgcctgtgcaaggccggctggggcggccgcctgtgtgacaaggatgtgaatgaatgttcccaggagaatggaggctgcctgcagatctgccacaacaagccaggcagcttccactgcagctgccacagcggctttgagctgagcagtgatggccgcacctgccaggacattgatgaatgtgccgacagcgaggcctgtggggaggcccgctgcaagaacctgcccggcagctacagctgcctgtgtgatgagggctttgcctacagcagccaggagaaggcctgcagagatgtggatgaatgtctgcagggccgctgtgagcaggtgtgtgtgaacagccctggcagctacacctgccactgtgatggccggggcggcctgaagctgagccaggacatggacacctgtgaggacatcctgccctgtgtgcccttctctgtggccaagtctgtgaagagcctgtacctgggccgcatgttcagcggcacccctgtgatccggctgcgcttcaagaggctgcagcccacccggctggtggccgagtttgacttccgcacctttgatcctgagggcatcctgctgtttgctgggggccaccaggacagcacctggatcgtgctggccctgcgggccggccgcctggagctgcagctgcgctacaacggggtgggccgggtgaccagcagcggccctgtgatcaaccacggcatgtggcagaccatctctgtggaggagctggccaggaacctggtgatcaaggtgaacagagatgctgtgatgaagattgctgtggccggggacctcttccagcctgagcggggcctgtaccacctgaacctgactgtgggcggcatccccttccacgagaaggacctggtgcagcccatcaacccccggctggatggctgcatgaggtcctggaactggctgaatggagaggacaccaccatccaggagaccgtgaaggtgaacaccaggatgcagtgcttctctgtgacagagcggggcagcttctacccaggcagcggctttgccttctacagcctggactacatgaggacccccctggatgtgggcacagagagcacctgggaggtggaggtggtggcccacatccggcctgctgctgacacaggagtgctgtttgccctgtgggccccagacctgcgggctgtgcccctgtctgtggccctggtggactaccacagcaccaagaagctgaagaagcagctggtggtgctggccgtggagcacacagccctggccctgatggagatcaaggtgtgtgatggccaggagcacgtggtgacagtgtccctgagagatggagaggccaccctggaggtggatggcacccggggccagagcgaggtgtctgctgcccagctgcaggagcggctggccgtgctggagcggcacctgcggagccctgtgctgacctttgctgggggcctgcctgatgtgcctgtgaccagcgcccctgtgacagccttctaccggggctgcatgaccctggaggtgaacagaaggctgctggacctggatgaggccgcctacaagcacagcgacatcacagcccacagctgcccccctgtggagcctgctgctgcctag

SEQ ID NO: 154489 - DNA, 2166 bp, Artificial Sequence
  Description of Artificial Sequence: Synthetic coding sequence
atggcccccagcctgagccctggccctgctgccctgcggcgggccccccagctgctgctgctgctgctggccgcagaatgtgccctggccgccctgctgcctgcccgggaggccacccagttcctgcggccccggcagaggcgggccttccaggtgtttgaggaggccaagcagggccacctggagcgggagtgtgtggaggagctgtgcagccgggaggaggcccgggaggtgtttgaaaatgaccctgagacagactacttctacccccgctacctggactgcatcaacaagtatggcagcccctacaccaagaacagcggctttgccacctgtgtgcagaacctgcctgaccagtgcacccccaacccctgtgacaggaagggcacccaggcctgccaggacctgatgggcaacttcttctgcctgtgcaaggccggctggggcggccgcctgtgtgacaaggatgtgaatgaatgttcccaggagaatggaggctgcctgcagatctgccacaacaagccaggcagcttccactgcagctgccacagcggctttgagctgagcagtgatggccgcacctgccaggacattgatgaatgtgccgacagcgaggcctgtggggaggcccgctgcaagaacctgcccggcagctacagctgcctgtgtgatgagggctttgcctacagcagccaggagaaggcctgcagagatgtggatgaatgtctgcagggccgctgtgagcaggtgtgtgtgaacagccctggcagctacacctgccactgtgatggccggggcggcctgaagctgagccaggacatggacacctgtgagctggaggccggctggcccctgcccaggcacagaagagacagcggccctgctgcccggcccggccgcggggcccagggcagccgctctgagggccacatcccagaccggcggggcccccggccctggcaggacatcctgccctgtgtgcccttctctgtggccaagtctgtgaagagcctgtacctgggccgcatgttttctggcacccctgtgatccggctgcgcttcaagaggctgcagcccacccggctggtggccgagtttgacttccgcacctttgatcctgagggcatcctgctgtttgctgggggccaccaggacagcacctggatcgtgctggccctgcgggccggccgcctggagctgcagctgcgctacaatggagtgggccgggtgaccagcagcggccctgtgatcaaccacggcatgtggcagaccatctctgtggaggagctggccaggaacctggtgatcaaggtgaacagagatgctgtgatgaagattgctgtggccggggacctcttccagcctgagcggggcctgtaccacctgaacctgactgtgggcggcatccccttccacgagaaggacctggtgcagcccatcaacccccggctggatggctgcatgaggtcctggaactggctgaatggagaggacaccaccatccaggagaccgtgaaggtgaacaccaggatgcagtgcttctctgtgacagagcggggcagcttctacccaggcagcggctttgccttctacagcctggactacatgaggacccccctggatgtgggcacagagagcacctgggaggtggaggtggtggcccacatccggcctgctgctgacaccggggtgctgtttgccctgtgggccccagacctgcgggctgtgcccctgtctgtggccctggtggactaccacagcaccaagaagctgaagaagcagctggtggtgctggccgtggagcacacagccctggccctgatggagatcaaggtgtgtgatggccaggagcacgtggtgacagtgtccctgagagatggagaggccaccctggaggtggatggcacccggggccagagcgaggtgtctgctgcccagctgcaggagcggctggccgtgctggagcggcacctgcggagccctgtgctgacctttgctgggggcctgcctgatgtgcctgtgaccagcgcccctgtgacagccttctaccggggctgcatgaccctggaggtgaacagaaggctgctggacctggatgaagctgcctacaagcacagcgacatcacagcccacagctgcccccctgtggagcctgctgctgcctag

SEQ ID NO: 154490 - DNA, 1140 bp, Artificial Sequence
  Description of Artificial Sequence: Synthetic coding sequence
atgttttctggcacccctgtgatccggctgcgcttcaagaggctgcagcccacccggctggtggccgagtttgacttccgcacctttgatcctgagggcatcctgctgtttgctgggggccaccaggacagcacctggatcgtgctggccctgcgggccggccgcctggagctgcagctgcgctacaatggagtgggccgggtgaccagcagcggccctgtgatcaaccacggcatgtggcagaccatctctgtggaggagctggccaggaacctggtgatcaaggtgaacagagatgctgtgatgaagattgctgtggccggggacctcttccagcctgagcggggcctgtaccacctgaacctgactgtgggcggcatccccttccacgagaaggacctggtgcagcccatcaacccccggctggatggctgcatgaggtcctggaactggctgaatggagaggacaccaccatccaggagaccgtgaaggtgaacaccaggatgcagtgcttctctgtgacagagcggggcagcttctacccaggcagcggctttgccttctacagcctggactacatgaggacccccctggatgtgggcacagagagcacctgggaggtggaggtggtggcccacatccggcctgctgctgacaccggggtgctgtttgccctgtgggccccagacctgcgggctgtgcccctgtctgtggccctggtggactaccacagcaccaagaagctgaagaagcagctggtggtgctggccgtggagcacacagccctggccctgatggagatcaaggtgtgtgatggccaggagcacgtggtgacagtgtccctgagagatggagaggccaccctggaggtggatggcacccggggccagagcgaggtgtctgctgcccagctgcaggagcggctggccgtgctggagcggcacctgcggagccctgtgctgacctttgctgggggcctgcctgatgtgcctgtgaccagcgcccctgtgacagccttctaccggggctgcatgaccctggaggtgaacagaaggctgctggacctggatgaagctgcctacaagcacagcgacatcacagcccacagctgcccccctgtggagcctgctgctgcctag

SEQ ID NO: 154491 - DNA, 1218 bp, Artificial Sequence
  Description of Artificial Sequence: Synthetic coding sequence
atggacacctgtgaggacatcctgccctgtgtgcccttctctgtggccaagtctgtgaagagcctgtacctgggccgcatgttttctggcacccctgtgatccggctgcgcttcaagaggctgcagcccacccggctggtggccgagtttgacttccgcacctttgatcctgagggcatcctgctgtttgctgggggccaccaggacagcacctggatcgtgctggccctgcgggccggccgcctggagctgcagctgcgctacaatggagtgggccgggtgaccagcagcggccctgtgatcaaccacggcatgtggcagaccatctctgtggaggagctggccaggaacctggtgatcaaggtgaacagagatgctgtgatgaagattgctgtggccggggacctcttccagcctgagcggggcctgtaccacctgaacctgactgtgggcggcatccccttccacgagaaggacctggtgcagcccatcaacccccggctggatggctgcatgaggtcctggaactggctgaatggagaggacaccaccatccaggagaccgtgaaggtgaacaccaggatgcagtgcttctctgtgacagagcggggcagcttctacccaggcagcggctttgccttctacagcctggactacatgaggacccccctggatgtgggcacagagagcacctgggaggtggaggtggtggcccacatccggcctgctgctgacaccggggtgctgtttgccctgtgggccccagacctgcgggctgtgcccctgtctgtggccctggtggactaccacagcaccaagaagctgaagaagcagctggtggtgctggccgtggagcacacagccctggccctgatggagatcaaggtgtgtgatggccaggagcacgtggtgacagtgtccctgagagatggagaggccaccctggaggtggatggcacccggggccagagcgaggtgtctgctgcccagctgcaggagcggctggccgtgctggagcggcacctgcggagccctgtgctgacctttgctgggggcctgcctgatgtgcctgtgaccagcgcccctgtgacagccttctaccggggctgcatgaccctggaggtgaacagaaggctgctggacctggatgaagctgcctacaagcacagcgacatcacagcccacagctgcccccctgtggagcctgctgctgcctag

SEQ ID NO: 154492 - DNA, 1431 bp, Artificial Sequence
  Description of Artificial Sequence: Synthetic coding sequence
atgtctggggcccgctgcaggaccctgtaccccttctctggagagagacatggccagggcctgcgctttgctgctggggagctgatcaccctgctgcaggtgcctgatggcggctggtgggagggggagaaggaggatggcctgcggggctggttccctgccagctatgtgcagctgctggagaagccaggcatggtgcccccacctcctggagaggagagccagaccgtcatcctgcccccaggctggcagagctacctgagcccccagggccgccgctactacgtgaacaccaccaccaatgagaccacctgggagcggcccagcagcagccctggcatcccagccagccctggcagccacaggagcagcctgccccccaccgtgaatggctaccacgccagcggcaccccagcccaccccccagagacagcccacatgtctgtgaggaagagcactggagacagccagaacctgggcagcagcagccccagcaagaagcagagcaaagaaaacaccatcaccatcaactgtgtgaccttcccccacccagacaccatgcctgagcagcagctgctgaagcccacagagtggagctactgtgactacttctgggccgacaagaaggacccccagggcaatggcaccgtggccggctttgagctgctgctgcagaagcagctgaagggcaagcagatgcagaaggagatgtctgagttcatccgggagcgcatcaagattgaagaagattatgccaagaacctggccaagctgagccagaacagcctggccagccaggaggagggcagcctgggggaggcctgggcccaggtgaagaagagcctggctgatgaggccgaggtgcacctgaagttcagcgccaagctgcacagcgaggtggagaagcccctgatgaacttccgggagaacttcaagaaggacatgaagaagtgtgaccaccacatcgctgacctgaggaagcagctggccagccgctatgcctctgtggagaaggccaggaaggccctgacagagcggcagagggacctggagatgaagacccagcagctggagatcaagctgagcaacaagacagaggaggacatcaagaaggcccggaggaagagcacccaggccggagatgacctgatgagatgtgtggacctgtacaaccaggcccagagcaagtggtttgaggagatggtgaccaccaccctggagctggagcggctggaggtggagcgggtggagatgatccggcagcacctgtgccagtacacccagctgcggcatgaaacagacatgttcaaccagagcacagtggagcctgtggaccagctgctgaggaaggtggaccctgccaaggaccgggagctgtgggtgcgggagcacaagacaggcaacatccggcctgtggacatggagatctag

SEQ ID NO: 154493 - DNA, 1251 bp, Artificial Sequence
  Description of Artificial Sequence: Synthetic coding sequence
atgaagccaggcatggtgcccccacctcctggagaggagagccagaccgtcatcctgcccccaggctggcagagctacctgagcccccagggccgccgctactacgtgaacaccaccaccaatgagaccacctgggagcggcccagcagcagccctggcatcccagccagccctggcagccacaggagcagcctgccccccaccgtgaatggctaccacgccagcggcaccccagcccaccccccagagacagcccacatgtctgtgaggaagagcactggagacagccagaacctgggcagcagcagccccagcaagaagcagagcaaagaaaacaccatcaccatcaactgtgtgaccttcccccacccagacaccatgcctgagcagcagctgctgaagcccacagagtggagctactgtgactacttctgggccgacaagaaggacccccagggcaatggcaccgtggccggctttgagctgctgctgcagaagcagctgaagggcaagcagatgcagaaggagatgtctgagttcatccgggagcgcatcaagattgaagaagattatgccaagaacctggccaagctgagccagaacagcctggccagccaggaggagggcagcctgggggaggcctgggcccaggtgaagaagagcctggctgatgaggccgaggtgcacctgaagttcagcgccaagctgcacagcgaggtggagaagcccctgatgaacttccgggagaacttcaagaaggacatgaagaagtgtgaccaccacatcgctgacctgaggaagcagctggccagccgctatgcctctgtggagaaggccaggaaggccctgacagagcggcagagggacctggagatgaagacccagcagctggagatcaagctgagcaacaagacagaggaggacatcaagaaggcccggaggaagagcacccaggccggagatgacctgatgagatgtgtggacctgtacaaccaggcccagagcaagtggtttgaggagatggtgaccaccaccctggagctggagcggctggaggtggagcgggtggagatgatccggcagcacctgtgccagtacacccagctgcggcatgaaacagacatgttcaaccagagcacagtggagcctgtggaccagctgctgaggaaggtggaccctgccaaggaccgggagctgtgggtgcgggagcacaagacaggcaacatccggcctgtggacatggagatctag

SEQ ID NO: 154494 - DNA, 1011 bp, Artificial Sequence
  Description of Artificial Sequence: Synthetic coding sequence
atgagcaacatggagaacagctttgatgatgtgtcctgcctgagcccccagaacctgggcagcagcagccccagcaagaagcagagcaaagaaaacaccatcaccatcaactgtgtgaccttcccccacccagacaccatgcctgagcagcagctgctgaagcccacagagtggagctactgtgactacttctgggccgacaagaaggacccccagggcaatggcaccgtggccggctttgagctgctgctgcagaagcagctgaagggcaagcagatgcagaaggagatgtctgagttcatccgggagcgcatcaagattgaagaagattatgccaagaacctggccaagctgagccagaacagcctggccagccaggaggagggcagcctgggggaggcctgggcccaggtgaagaagagcctggctgatgaggccgaggtgcacctgaagttcagcgccaagctgcacagcgaggtggagaagcccctgatgaacttccgggagaacttcaagaaggacatgaagaagtgtgaccaccacatcgctgacctgaggaagcagctggccagccgctatgcctctgtggagaaggccaggaaggccctgacagagcggcagagggacctggagatgaagacccagcagctggagatcaagctgagcaacaagacagaggaggacatcaagaaggcccggaggaagagcacccaggccggagatgacctgatgagatgtgtggacctgtacaaccaggcccagagcaagtggtttgaggagatggtgaccaccaccctggagctggagcggctggaggtggagcgggtggagatgatccggcagcacctgtgccagtacacccagctgcggcatgaaacagacatgttcaaccagagcacagtggagcctgtggaccagctgctgaggaaggtggaccctgccaaggaccgggagctgtgggtgcgggagcacaagacaggcaacatccggcctgtggacatggagatctag

SEQ ID NO: 154495 - DNA, 1248 bp, Artificial Sequence
  Description of Artificial Sequence: Synthetic coding sequence
aagccaggcatggtgcccccacctcctggagaggagagccagaccgtcatcctgcccccaggctggcagagctacctgagcccccagggccgccgctactacgtgaacaccaccaccaatgagaccacctgggagcggcccagcagcagccctggcatcccagccagccctggcagccacaggagcagcctgcccccaacagtgaatggctaccacgccagcggcaccccagcccaccccccagagacagcccacatgtctgtgaggaagagcactggagacagccagaacctgggcagcagcagccccagcaagaagcagagcaaggagaacaccatcaccatcaactgtgtgaccttcccccacccagacaccatgcctgagcagcagctgctgaagcccacagagtggagctactgtgactacttctgggccgacaagaaggacccccagggcaatggaacagtggccggctttgagctgctgctgcagaagcagctgaagggcaagcagatgcagaaggagatgtctgagttcatccgggagcgcatcaagattgaggaggactatgccaagaacctggccaagctgagccagaacagcctggccagccaggaggagggcagcctgggggaggcctgggcccaggtgaagaagagcctggctgatgaagctgaggtgcacctgaagttcagcgccaagctgcacagcgaggtggagaagcccctgatgaacttccgggagaacttcaagaaggacatgaagaagtgtgaccaccacatcgctgacctgaggaagcagctggccagccgctatgcctctgtggagaaggccaggaaggccctgacagagcggcagagggacctggagatgaagacccagcagctggagatcaagctgagcaacaagacagaggaggacatcaagaaggcccggaggaagagcacccaggccggagatgacctgatgagatgtgtggacctgtacaaccaggcccagagcaagtggtttgaggagatggtgaccaccaccctggagctggagcggctggaggtggagcgggtggagatgatccggcagcacctgtgccagtacacccagctgcggcatgaaacagacatgttcaaccagagcacagtggagcctgtggaccagctgctgaggaaggtggaccctgccaaggaccgggagctgtgggtgcgggagcacaagacaggcaacatccggcctgtggacatggagatctag

SEQ ID NO: 154496 - DNA, 1251 bp, Artificial Sequence; identical to SEQ ID NO: 154493
  Description of Artificial Sequence: Synthetic coding sequence

SEQ ID NO: 154497 - DNA, 546 bp, Artificial Sequence
  Description of Artificial Sequence: Synthetic coding sequence
atggtgcccccacctcctggagaggagagccagaccgtcatcctgcccccaggctggcagagctacctgagcccccagggccgccgctactacgtgaacaccaccaccaatgagaccacctgggagcggcccagcagcagccctggcatcccagccagccctggcagccacaggagcagcctgccccccaccgtgaatggctaccacgccagcggcaccccagcccaccccccagagacagcccacatgtctgtgaggaagagcactggagacagccagaacctgggcagcagcagccccagcaagaagcagagcaaagaaaacaccatcacagagctggagcggctggaggtggagcgggtggagatgatccggcagcacctgtgccagtacacccagctgcggcatgaaacagacatgttcaaccagagcacagtggagcctgtggaccagctgctgaggaaggtggaccctgccaaggaccgggagctgtgggtgcgggagcacaagacaggcaacatccggcctgtggacatggagatctag

SEQ ID NO: 154498 - DNA, 873 bp, Artificial Sequence
  Description of Artificial Sequence: Synthetic coding sequence
atgcctgagcagcagctgctgaagcccacagagtggagctactgtgactacttctgggccgacaagaaggacccccagggcaatggcaccgtggccggctttgagctgctgctgcagaagcagctgaagggcaagcagatgcagaaggagatgtctgagttcatccgggagcgcatcaagattgaagaagattatgccaagaacctggccaagctgagccagaacagcctggccagccaggaggagggcagcctgggggaggcctgggcccaggtgaagaagagcctggctgatgaggccgaggtgcacctgaagttcagcgccaagctgcacagcgaggtggagaagcccctgatgaacttccgggagaacttcaagaaggacatgaagaagtgtgaccaccacatcgctgacctgaggaagcagctggccagccgctatgcctctgtggagaaggccaggaaggccctgacagagcggcagagggacctggagatgaagacccagcagctggagatcaagctgagcaacaagacagaggaggacatcaagaaggcccggaggaagagcacccaggccggagatgacctgatgagatgtgtggacctgtacaaccaggcccagagcaagtggtttgaggagatggtgaccaccaccctggagctggagcggctggaggtggagcgggtggagatgatccggcagcacctgtgccagtacacccagctgcggcatgaaacagacatgttcaaccagagcacagtggagcctgtggaccagctgctgaggaaggtggaccctgccaaggaccgggagctgtgggtgcgggagcacaagacaggcaacatccggcctgtggacatggagatctag

SEQ ID NO: 154499 - DNA, 378 bp, Artificial Sequence
  Description of Artificial Sequence: Synthetic coding sequence
atgaagacccagcagctggagatcaagctgagcaacaagacagaggaggacatcaagaaggcccggaggaagagcacccaggccggagatgacctgatgagatgtgtggacctgtacaaccaggcccagagcaagtggtttgaggagatggtgaccaccaccctggagctggagcggctggaggtggagcgggtggagatgatccggcagcacctgtgccagtacacccagctgcggcatgaaacagacatgttcaaccagagcacagtggagcctgtggaccagctgctgaggaaggtggaccctgccaaggaccgggagctgtgggtgcgggagcacaagacaggcaacatccggcctgtggacatggagatctag

SEQ ID NO: 154500 - DNA, 1011 bp, Artificial Sequence; identical to SEQ ID NO: 154494
  Description of Artificial Sequence: Synthetic coding sequence

SEQ ID NO: 154501 - DNA, 1437 bp, Artificial Sequence
  Description of Artificial Sequence: Synthetic coding sequence
atggcccccaagaagaagggcaagaagggcaaggccaagggcacccccatcgtggatggcctggcccctgaggacatgagcaaggagcaggtggaggagcacgtgagccgcatccgggaggagctggaccgggagcgggaggagaggaactacttccagctggagcgggacaagatccacaccttctgggagatcacccggcggcagctggaggagaagaaggccgagctgaggaacaaggaccgggagatggaggaggccgaggagcggcaccaggtggagatcaaggtgtacaagcagaaggtgaagcacctgctgtatgagcaccagaacaacctgacagagatgaaggccgagggcaccgtggtgatgaagctggcccagaaggagcaccgcatccaggagagcgtgctgaggaaggacatgagggccctgaaggtggagctgaaggagcaggagctggccagcgaggtggtggtgaagaacctgcggctgaagcacacagaggagatcaccaggatgagaaatgactttgagcggcaggtgcgggagattgaggccaagtatgacaagaagatgaagatgctgagagatgagctggacctgcggaggaagacagagctgcacgaggtggaggagaggaagaatggccagatccacaccctgatgcagagacatgaggaggccttcacagacatcaagaactactacaatgacatcaccctgaacaacctggccctgatcaacagcctgaaggagcagatggaggacatgaggaagaaggaggaccacctggagcgggagatggccgaggtgtctggccagaacaagaggctggccgaccccctgcagaaggcccgggaggagatgtctgagatgcagaagcagctggccaactatgaaagagacaagcagatcctgctgtgcaccaaggcccggctgaaggtgcgggagaaggagctgaaggacctgcagtgggagcacgaggtgctggagcagcgcttcaccaaggtgcagcaggagagagatgagctgtacaggaagttcaccgctgccatccaggaggtgcagcagaagacaggcttcaagaacctggtgctggagaggaagctgcaggccctgtctgctgctgtggagaagaaggaggtgcagttcaatgaggtgctggccgccagcaacctggaccctgctgccctgaccctggtgtccaggaagctggaggatgtgctggagagcaagaacagcaccatcaaggacctgcagtatgagctggcccaggtgtgcaaggcccacaatgacctgctgcggacctatgaggccaagctgctggccttcggcatccccctggacaacgtgggcttcaagcccctggagacagctgtgattggccagaccctgggccagggccctgctggcctggtgggcacccccacctag

SEQ ID NO: 154502 - DNA, 1362 bp, Artificial Sequence
  Description of Artificial Sequence: Synthetic coding sequence
atgagcaaggagcaggtggaggagcacgtgagccgcatccgggaggagctggaccgggagcgggaggagaggaactacttccagctggagcgggacaagatccacaccttctgggagatcacccggcggcagctggaggagaagaaggccgagctgaggaacaaggaccgggagatggaggaggccgaggagcggcaccaggtggagatcaaggtgtacaagcagaaggtgaagcacctgctgtatgagcaccagaacaacctgacagagatgaaggccgagggcaccgtggtgatgaagctggcccagaaggagcaccgcatccaggagagcgtgctgaggaaggacatgagggccctgaaggtggagctgaaggagcaggagctggccagcgaggtggtggtgaagaacctgcggctgaagcacacagaggagatcaccaggatgagaaatgactttgagcggcaggtgcgggagattgaggccaagtatgacaagaagatgaagatgctgagagatgagctggacctgcggaggaagacagagctgcacgaggtggaggagaggaagaatggccagatccacaccctgatgcagagacatgaggaggccttcacagacatcaagaactactacaatgacatcaccctgaacaacctggccctgatcaacagcctgaaggagcagatggaggacatgaggaagaaggaggaccacctggagcgggagatggccgaggtgtctggccagaacaagaggctggccgaccccctgcagaaggcccgggaggagatgtctgagatgcagaagcagctggccaactatgagcgggacaagcagatcctgctgtgcaccaaggcccggctgaaggtgcgggagaaggagctgaaggacctgcagtgggagcacgaggtgctggagcagcgcttcaccaaggtgcagcaggagagagatgagctgtacaggaagttcaccgctgccatccaggaggtgcagcagaagacaggcttcaagaacctggtgctggagaggaagctgcaggccctgtctgctgctgtggagaagaaggaggtgcagttcaatgaggtgctggccgccagcaacctggaccctgctgccctgaccctggtgtccaggaagctggaggatgtgctggagagcaagaacagcaccatcaaggacctgcagtatgagctggcccaggtgtgcaaggcccacaatgacctgctgcggacctatgaggccaagctgctggccttcggcatccccctggacaacgtgggcttcaagcccctggagacagctgtgattggccagaccctgggccagggccctgctggcctggtgggcacccccacctag

SEQ ID NO: 154503 - DNA, 525 bp, Artificial Sequence
  Description of Artificial Sequence: Synthetic coding sequence
atggcccccaagaagaagggcaagaagggcaaggccaagggcacccccatcgtggatggcctggcccctgaggacatgagcaaggagcaggtggaggagcacgtgagccgcatccgggaggagctggaccgggagcgggaggagaggaactacttccagctggagcgggacaagatccacaccttctgggagatcacccggcggcagctggaggagaagaaggccgagctgaggaacaaggaccgggagatggaggaggccgaggagcggcaccaggtggagatcaaggtgtacaagcagaaggtgaagcacctgctgtatgagcaccagaacaacctgacagagatgaaggccgagggcaccgtggtgatgaagctggcccagaaggagcaccgcatccaggagagcgtgctgaggaaggacatgagggccctgaaggtggagctgaaggagcaggagctggccagcgaggtggtggtgaagaacctgcggctgaagctgcggcccagcatgatcagaagatag

SEQ ID NO: 154504 - DNA, 1149 bp, Artificial Sequence
  Description of Artificial Sequence: Synthetic coding sequence
atggtggaggagcacgtgagccgcatccgggaggagctggaccgggagcgggaggagaggaactacttccagctggagcgggacaagatccacaccttctgggagatcacccggcggcagctggaggagaagaaggccgagctgaggaacaaggaccgggagatggaggaggccgaggagcggcaccaggtggagatcaaggtgtacaagcagaaggtgaagcacctgctgtatgagcaccagaacaacctgacagagatgaaggccgagggcaccgtggtgatgaagctggcccagaaggagcaccgcatccaggagagcgtgctgaggaaggacatgagggccctgaaggtggagctgaaggagcaggagctggccagcgaggtggtggtgaagaacctgcggctgaagcacacagaggagatcaccaggatgagaaatgactttgagcggcaggtgcgggagattgaggccaagtatgacaagaagatgaagatgctgagagatgagctggacctgcggaggaagacagagctgcacgaggtggaggagaggaagaatggccagatccacaccctgatgcagagacatgaggaggccttcacagacatcaagaactactacaatgacatcaccctgaacaacctggccctgatcaacagcctgaaggagcagatggaggacatgaggaagaaggaggaccacctggagcgggagatggccgaggtgtctggccagaacaagaggctggccgaccccctgcagaaggcccgggaggagatgtctgagatgcagaagcagctggccaactatgagcgggacaagcagatcctgctgtgcaccaaggcccggctgaaggtgcgggagaaggagctgaaggacctgcagtgggagcacgaggtgctggagcagcgcttcaccaaggtgcagcaggagagagatgagctgtacaggaagttcaccgctgccatccaggaggtgcagcagaagacaggcttcaagaacctggtgctggagaggaagctgcaggccctgtctgctgctgtggagaagaaggaggtgcagttcaatgaggtgctggccgccagcaacctggaccctgctgccctgaccctggtgtccaggaagctggagaccttcttctgctag

SEQ ID NO: 154505 - DNA, 717 bp, Artificial Sequence
  Description of Artificial Sequence: Synthetic coding sequence
atgctgtgctgcatgaggaggaccaagcaggtggagaagaatgatgatgaccagaagattgagcaggacggcatcaagccagaggacaaggcccacaaggccgccaccaagatccaggccagcttccggggccacatcaccaggaagaagctgaagggggagaagaaggatgatgtgcaggccgctgaggccgaggccaacaagaaggatgaggcccctgtggctgatggagtggagaagaagggggagggcaccaccacagctgaggccgccccagccaccggcagcaagccagatgagcccgggaaggccggggagaccccatctgaggagaagaagggggagggagatgctgccacagagcaggccgccccccaggccccagccagcagcgaggagaaggccggcagcgctgagacagagagcgccaccaaggccagcacagacaacagccccagcagcaaggcagaagatgccccagccaaggaggagcccaagcaggctgatgtgcctgctgctgtgacagctgctgctgccaccaccccagctgctgaagatgctgctgccaaggccacagcccagcccccaacagaaacaggagagagcagccaggccgaggagaacattgaagctgtggatgagaccaagcccaaggagagcgcccggcaggatgagggcaaggaggaggagcctgaggccgaccaggagcacgcctag

SEQ ID NO: 154506 - DNA, 825 bp, Artificial Sequence
  Description of Artificial Sequence: Synthetic coding sequence
atgaccaagagctgcagcgagctgtgccacccagccctgcacttcctgccctgcctgggcggcctgaggaagaacctgcagagagctgtgcggcccagcccctacagcctgggcttcctgaccttctggatcagccgggtggagaagaatgatgatgaccagaagattgagcaggacggcatcaagccagaggacaaggcccacaaggccgccaccaagatccaggccagcttccggggccacatcaccaggaagaagctgaagggggagaagaaggatgatgtgcaggccgctgaggccgaggccaacaagaaggatgaggcccctgtggctgatggagtggagaagaagggggagggcaccaccacagctgaggccgccccagccaccggcagcaagccagatgagcccgggaaggccggggagaccccatctgaggagaagaagggggagggagatgctgccacagagcaggccgccccccaggccccagccagcagcgaggagaaggccggcagcgctgagacagagagcgccaccaaggccagcacagacaacagccccagcagcaaggcagaagatgccccagccaaggaggagcccaagcaggctgatgtgcctgctgctgtgacagctgctgctgccaccaccccagctgctgaagatgctgctgccaaggccacagcccagcccccaacagaaacaggagagagcagccaggccgaggagaacattgaagctgtggatgagaccaagcccaaggagagcgcccggcaggatgagggcaaggaggaggagcctgaggccgaccaggagcacgcctag

SEQ ID NO: 154507 - DNA, 1119 bp, Artificial Sequence
  Description of Artificial Sequence: Synthetic coding sequence
atgcccccaccccagcagggcccctgtggccaccacctgctgctgctgctggccctgctgctgcccagcctgcccctgacccgggcccctgtgcccccaggccctgctgctgccctgctgcaggccctgggcctgagagatgagccccagggcgccccccggctgcggcctgtgccccctgtgatgtggaggctcttcagaagaagagacccccaggagaccaggagcggcagcaggaggaccagccctggggtgaccctgcagccctgccacgtggaggagctgggcgtggccggcaacatcgtgcgccacatcccagacagaggagcccccacccgggccagcgagcccgccagcgctgctggccactgcccagagtggacagtggtgtttgacctgtctgctgtggagcctgctgagcggcccagccgggcccggctggagctgcgctttgctgctgctgctgctgctgcccctgagggcggctgggagctgtctgtggcccaggccggccagggcgctggagctgaccccggccctgtgctgctgcggcagctggtgcctgccctgggcccccctgtgcgggcagagctgctgggcgccgcctgggccagaaatgcctcctggcccaggagcctgcggctggccctggccctgcggccccgggccccagctgcctgtgcccggctggccgaggccagcctgctgctggtgaccctggacccccggctgtgccaccccctggcccggcccaggagagatgctgagcctgtgctgggcggcggccctggaggagcctgccgggcccggcggctgtatgtgtccttccgggaggtgggctggcaccgctgggtgattgccccccggggcttcctggccaactactgccagggccagtgtgccctgcctgtggccctgagcggcagcggcggccccccagccctgaaccacgctgtgctgcgggccctgatgcacgccgccgcccctggagctgctgacctgccctgctgcgtgcctgcccggctgagccccatctctgtgctcttctttgacaacagcgacaacgtggtgctgcggcagtatgaggacatggtggtggatgaatgtggctgcaggtag

SEQ ID NO: 154508 - DNA, 1224 bp, Artificial Sequence
  Description of Artificial Sequence: Synthetic coding sequence
atggtgctggccgcccccctgctgctgggcttcctgctgctggccctggagctgcggcccagaggagaggccgctgagggccctgctgctgctgctgctgctgctgctgctgctgctgctgctggggtgggcggggagaggagcagcaggcctgcccccagcgtggcccctgagccagatggctgccctgtgtgtgtgtggaggcagcacagccgggagctgcggctggagagcatcaagagccagatcctgagcaagctgcggctgaaggaggcccccaacatcagccgggaggtggtgaagcagctgctgcccaaggccccacccctgcagcagatcctggacctgcatgacttccagggagatgccctgcagcctgaggacttcctggaggaggatgagtaccacgccaccacagaaacagtcatctccatggcccaggagacagatcctgctgtgcagacagatggcagccccctgtgctgccacttccacttcagccccaaggtgatgttcaccaaggtgctgaaggcccagctgtgggtgtacctgcggcctgtgcccaggcctgccaccgtgtacctgcagatcctgcggctgaagcccctgaccggggagggcacagctgggggcggcggcggcggccgccgccacatccgcatccgcagcctgaagattgagctgcacagccgcagcggccactggcagagcattgacttcaagcaggtgctgcacagctggttccggcagccccagagcaactggggcatcgagatcaatgcctttgaccccagcggcacagacctggccgtgaccagcctgggccctggagctgagggcctgcaccccttcatggagctgcgggtgctggagaacaccaagaggagcagaagaaacctgggcctggactgtgatgagcacagcagcgagagccgctgctgccgctaccccctgactgtggactttgaggccttcggctgggactggatcatcgcccccaagcgctacaaggccaactactgcagcggccagtgtgagtacatgttcatgcagaagtacccccacacccacctggtgcagcaggccaacccccggggcagcgctggcccctgctgcacccccaccaagatgagccccatcaacatgctgtacttcaatgacaagcagcagatcatctacggcaagatccctggcatggtggtggacagatgtggctgcagctag

SEQ ID NO: 154509 - DNA, 1143 bp, Artificial Sequence
  Description of Artificial Sequence: Synthetic coding sequence
tgagctgctgctgctgctgctgctgctgctgctgctgctgctggggtgggcggggagaggagcagcaggcctgcccccagcgtggcccctgagccagatggctgccctgtgtgtgtgtggaggcagcacagccgggagctgcggctggagagcatcaagagccagatcctgagcaagctgcggctgaaggaggcccccaacatcagccgggaggtggtgaagcagctgctgcccaaggccccacccctgcagcagatcctggacctgcatgacttccagggagatgccctgcagcctgaggacttcctggaggaggatgagtaccacgccaccacagagaccgtcatctccatggcccaggagacagatcctgctgtgcagacagatggcagccccctgtgctgccacttccacttcagccccaaggtgatgttcaccaaggtgctgaaggcccagctgtgggtgtacctgcggcctgtgcccaggcctgccaccgtgtacctgcagatcctgcggctgaagcccctgactggagagggcacagctgggggcggcggcggcggcagaagacacatccgcatccgcagcctgaagattgagctgcacagccgcagcggccactggcagagcattgacttcaagcaggtgctgcacagctggttccggcagccccagagcaactggggcatcgagatcaatgcctttgaccccagcggcacagacctggccgtgaccagcctgggccctggagctgagggcctgcaccccttcatggagctgcgggtgctggagaacaccaagaggagcagaagaaacctgggcctggactgtgatgagcacagcagcgagagccgctgctgccgctaccccctgactgtggactttgaggccttcggctgggactggatcatcgcccccaagcgctacaaggccaactactgcagcggccagtgtgagtacatgttcatgcagaagtacccccacacccacctggtgcagcaggccaacccccggggcagcgctggcccctgctgcacccccaccaagatgagccccatcaacatgctgtacttcaatgacaagcagcagatcatctacggcaagatccctggcatggtggtggacagatgtggctgcagctag

SEQ ID NO: 154510 - DNA, 927 bp, Artificial Sequence
  Description of Artificial Sequence: Synthetic coding sequence
atgcctggccaggagctgaggacagtgaatggcagccagatgctgctggtgctgctggtgctgtcctggctgccccacggcggggccctgagcctggccgaggccagccgggccagcttccctggccccagcgagctgcacagcgaggacagccgcttccgggagctgaggaagagatatgaggacctgctgacccggctgcgggccaaccagagctgggaggacagcaacacagacctggtgcctgccccagctgtgcgcatcctgaccccagaggtgcggctgggcagcggcggccacctgcacctgcgcatcagccgggccgccctgcctgagggcctgcctgaggccagccggctgcaccgggccctcttccggctgagccccacagccagccgctcctgggatgtgacccggcccctgcggcggcagctgagcctggcccggccccaggccccagccctgcacctgcggctgagccccccacccagccagagcgaccagctgctggccgagagcagcagcgcccggccccagctggagctgcacctgcggccccaggccgcccggggcagaagaagagcccgggccagaaatggagaccactgccccctgggccctggccgctgctgccgcctgcacacagtgcgggccagcctggaggacctgggctgggccgactgggtgctgagcccccgggaggtgcaggtgaccatgtgcattggagcctgccccagccagttccgggccgccaacatgcacgcccagatcaagaccagcctgcaccggctgaagccagacacagtgcctgccccctgctgcgtgcctgccagctacaaccccatggtgctgatccagaagacagacaccggggtgtccctgcagacctatgatgacctgctggccaaggactgccactgcatctag

SEQ ID NO: 154511 - DNA, 927 bp, Artificial Sequence; identical to SEQ ID NO: 154510
  Description of Artificial Sequence: Synthetic coding sequence

SEQ ID NO: 154512 - DNA, 1290 bp, Artificial Sequence
  Description of Artificial Sequence: Synthetic coding sequence
atgtgccctggggccctgtgggtggccctgcccctgctgagcctgctggccggcagcctgcagggcaagcccctgcagagctggggccggggcagcgctggaggaaatgcccacagccccctgggcgtgcctgggggcggcctgcctgagcacaccttcaacctgaagatgttcctggagaatgtgaaggtggacttcctgcggagcctgaacctgtctggagtgcccagccaggacaagaccagggtggagcccccccagtacatgattgacctgtacaaccgctacaccagtgacaagagcaccaccccagccagcaacatcgtgcgctccttctccatggaggatgccatcagcatcacagccacagaggacttccccttccagaagcacatcctgctcttcaacatcagcatccccaggcatgagcagatcaccagggctgagctgcggctgtatgtgtcctgccagaaccacgtggaccccagccatgacctgaagggctctgtggtgatctatgatgtgctggatggaacagatgcctgggacagcgccacagagaccaagaccttcctggtgtcccaggacatccaggatgagggctgggagaccctggaggtgtcctctgctgtgaagcgctgggtgcggagtgacagcaccaagagcaagaacaagctggaggtgacagtggagagccacaggaagggctgtgacaccctggacatctctgtgcccccaggcagcaggaacctgcccttctttgtggtgttcagcaatgaccacagcagcggcaccaaggagacccggctggagctgcgggagatgatcagccatgagcaggagagcgtgctgaagaagctgagcaaggatggcagcacagaagctggggagagcagccatgaggaggacacagatggccacgtggccgccggcagcaccctggcccggaggaagaggtctgctggagctggcagccactgccagaagaccagcctgcgggtgaactttgaagatattggctgggacagctggatcatcgcccccaaggagtatgaggcctatgaatgtaaaggaggctgcttcttccccctggctgatgatgtgacccccaccaagcacgccatcgtgcagaccctggtgcacctgaagttccccaccaaggtgggcaaggcctgctgcgtgcccaccaagctgagccccatctctgtgctgtacaaggatgacatgggcgtgcccaccctgaagtaccactatgagggcatgtctgtggctgaatgtggctgcaggtag

SEQ ID NO: 154513 - DNA, 1095 bp, Artificial Sequence
  Description of Artificial Sequence: Synthetic coding sequence
atgctgcgcttcctgcctgacctggccttctccttcctgctgatcctggccctgggccaggccgtgcagttccaggagtatgtgttcctgcagttcctgggcctggacaaggcccccagcccccagaagttccagcctgtgccctacatcctgaagaagatcttccaggaccgggaggccgccgccaccaccggggtgtcccgggacctgtgctacgtgaaggagctgggcgtgagaggaaatgtgctgcgcttcctgcctgaccagggcttcttcctgtaccccaagaagatcagccaggccagcagctgcctgcagaagctgctgtacttcaacctgagcgccatcaaggagcgggagcagctgaccctggcccagctgggcctggacctgggccccaacagctactacaacctgggccctgagctggagctggccctcttcctggtgcaggagccccacgtgtggggccagaccacccccaagccaggcaagatgtttgtgctgcggtctgtgccctggccccagggcgctgtgcacttcaacctgctggatgtggccaaggactggaatgacaaccccaggaagaactttggcctcttcctggagatcctggtgaaggaggaccgggacagcggcgtgaacttccagcctgaggacacctgtgcccggctgcgctgcagcctgcacgccagcctgctggtggtgaccctgaacccagaccagtgccaccccagcaggaagagaagagctgccatccctgtgcccaagctgagctgcaagaacctgtgccaccgccaccagctgttcatcaacttccgggacctgggctggcacaagtggatcatcgcccccaagggcttcatggccaactactgccacggggagtgccccttcagcctgaccatcagcctgaacagcagcaactatgccttcatgcaggccctgatgcatgctgtggaccctgagatcccccaggccgtgtgcatccccaccaagctgagccccatctccatgctgtaccaggacaacaatgacaacgtcatcctgcggcactatgaggacatggtggtggatgaatgtggctgcggctag

SEQ ID NO: 154514 - DNA, 1506 bp, Artificial Sequence
  Description of Artificial Sequence: Synthetic coding sequence
atgaggctgcccaagctgctgaccttcctgctgtggtacctggcctggctggacctggagttcatctgcaccgtgctgggcgccccagacctgggccagaggccccagggcacccggcccggcctggccaaggccgaggccaaggagaggcctcccctggccagaaatgtgttccggcctgggggccacagctatggaggaggagccaccaatgccaatgcccgggccaagggcggcaccggccagacaggaggcctgacccagcccaagaaggatgagcccaagaagctgccccccaggcctgggggccctgagcccaagccaggccaccccccccagacccggcaggccacagccaggacagtgacccccaagggccagctgcccggcggcaaggccccacccaaggccggctctgtgcccagcagcttcctgctgaagaaggcccgggagcccggccccccccgggagcccaaggagcccttccggcccccacccatcacccctcatgagtacatgctgagcctgtaccgcaccctgagtgatgctgacaggaagggcggcaacagctctgtgaagctggaggccggcctggccaacaccatcaccagcttcatcgacaagggccaggatgaccggggccctgtggtgaggaagcagcgctacgtgtttgacatcagcgccctggagaaggatggcctgctgggcgctgagctgcgcatcctgaggaagaagcccagcgacacagccaagccagctgcccctgggggcggccgggccgcccagctgaagctgagcagctgccccagcggccggcagcctgccagcctgctggatgtgcgctctgtgcccggcctggatggcagcggctgggaggtgtttgacatctggaagctgttcaggaacttcaagaacagcgcccagctgtgcctggagctggaggcctgggagcggggccgggctgtggacctgcggggcctgggctttgaccgggccgcccggcaggtgcatgagaaggccctcttcctggtgtttggaagaaccaagaagagggacctcttcttcaatgagatcaaggcccggagcggccaggatgacaagacagtgtatgagtacctgttcagccagaggaggaagaggcgggcccccctggccacccggcagggcaagaggcccagcaagaacctgaaggcccgctgcagcaggaaggccctgcacgtgaacttcaaggacatgggctgggatgactggatcatcgcccccctggagtatgaggccttccactgtgagggcctgtgtgagttccccctgcggagccacctggagcccaccaaccacgctgtgatccagaccctgatgaacagcatggaccctgagagcaccccacccacctgctgcgtgcccacccggctgagccccatcagcatcctcttcattgattctgccaacaacgtggtgtacaagcagtatgaggacatggtggtggagagctgtggctgcaggtag

SEQ ID NO: 154515 - DNA, 1506 bp, Artificial Sequence; identical to SEQ ID NO: 154514
  Description of Artificial Sequence: Synthetic coding sequence

SEQ ID NO: 154516 - DNA, 1368 bp, Artificial Sequence
  Description of Artificial Sequence: Synthetic coding sequence
atggacaccccccgggtgctgctgtctgctgtgttcctgatctccttcctgtgggacctgcccggcttccagcaggccagcatcagcagcagcagcagcagcgctgagctgggcagcaccaagggcatgaggagcaggaaggagggcaagatgcagagggccccccgggacagtgatgctggccgggagggccaggagccccagccccggccccaggatgagccccgggcccagcagccccgggcccaggagcccccaggccggggcccccgggtggtgccccatgagtacatgctgagcatctaccgcacctacagcattgctgagaagctgggcatcaatgccagcttcttccagagcagcaagagcgccaacaccatcaccagctttgtggaccggggcctggatgacctgagccacacccccctgcggcggcagaagtacctgtttgatgtgtccatgctgagtgacaaggaggagctggtgggcgctgagctgcggctcttccggcaggcccccagcgccccctggggccccccagctggccccctgcacgtgcagctgttcccctgcctgagccccctgctgctggatgcccggaccctggacccccagggcgcccccccagctggctgggaggtgtttgatgtgtggcagggcctgcggcaccagccctggaagcagctgtgcctggagctgcgggccgcctggggcgagctggatgctggggaggccgaggcccgggcccggggcccccagcagcccccacctccagacctgcggagcctgggctttggaagaagagtgcggcccccccaggagcgggccctgctggtggtgttcaccaggagccagaggaagaacctgtttgctgagatgagggagcagctgggcagcgctgaggccgccggccctggagctggagctgagggctcctggcccccaccttctggggccccagatgcccggccctggctgcccagccctggaagaagaagaagaagaacagcctttgccagccgccacggcaagagacatggcaagaagagccggctgcgctgcagcaagaagcccctgcacgtgaacttcaaggagctgggctgggatgactggatcatcgcccccctggagtatgaggcctaccactgtgaaggagtgtgtgacttccccctgcggagccacctggagcccaccaaccacgccatcatccagaccctgatgaacagcatggaccccggcagcaccccacccagctgctgcgtgcccaccaagctgacccccatcagcatcctgtacattgatgctggcaacaacgtggtgtacaagcagtatgaggacatggtggtggagagctgtggctgcaggtag

SEQ ID NO: 154517 - DNA, 1062 bp, Artificial Sequence
  Description of Artificial Sequence: Synthetic coding sequence
atggacaccccccgggtgctgctgtctgctgtgttcctgatctccttcctgtgggacctgcccggcttccagcaggccagcatcagcagcagcagcagcagcgctgagctgggcagcaccaagggcatgaggagcaggaaggagggcaagatgcagagggccccccgggacagtgatgctggccgggagggccaggagccccagccccggccccaggatgagccccgggcccagcagccccgggcccaggagcccccaggccggggcccccgggtggtgccccatgagtacatgctgagcatctaccgcacctacagcattgctgagaagctgggcatcaatgccagcttcttccagagcagcaagagcgccaacaccatcaccagctttgtggaccggggcctggatgacctgagccacacccccctgcggcggcagaagtacctgtttgatgtgtccatgctgagtgacaaggaggagctggtgggcgctgagctgcggctcttccggcaggcccccagcgccccctggggccccccagctggccccctgcacgtgcagctgttcccctgcctgagccccctgctgctggatgcccggaccctggacccccagggcgcccccccagctggctgggaggtgtttgatgtgtggcagggcctgcggcaccagccctggaagcagctgtgcctggagctgcgggccgcctggggcgagctggatgctggggaggccgaggcccgggcccggggcccccagcagcccccacctccagacctgcggagcctgggctttggaagaagagtgcggcccccccaggagcgggccctgctggtggtgttcaccaggagccagaggaagaacctgtttgcccctggggtgcggggcctgagcctgcggggctgcatgaggctgcctgctgccctggcccctggggcccaccagcccaggcaccacccagatgctgatgagctgcacggcccccggctgcacccagcccagctgctgcgggcccaccagattgacagccaccagcacagcatccaccggcggggccagtag

SEQ ID NO: 154518 - DNA, 816 bp, Artificial Sequence
  Description of Artificial Sequence: Synthetic coding sequence
atggacaccccccgggtgctgctgtctgctgtgttcctgatctccttcctgtgggacctgcccggcttccagcaggccagcatcagcagcagcagcagcagcgctgagctgggcagcaccaagggcatgaggagcaggaaggagggcaagatgcagagggccccccgggacagtgatgctggccgggagggccaggagccccagccccggccccaggatgagccccgggcccagcagccccgggcccaggagcccccaggccggggcccccgggtggtgccccatgagtacatgctgagcatctaccgcacctacagcattgctgagaagctgggcatcaatgccagcttcttccagagcagcaagagcgccaacaccatcaccagctttgtggaccggggcctggatgacctgagccacacccccctgcggcggcagaagtacctgtttgatgtgtccatgctgagtgacaaggaggagctggtgggcgctgagctgcggctcttccggcaggcccccagcgccccctggggccccccagctggccccctgcacgtgcagctgttcccctgcctgagccccctgctgctggatgcccggaccctggacccccagggcgcccccccagctggctgggaggtgtttgatgtgtggcagggcctgcggcaccagccctggaagcagctgtgcctggagctgcgggccgcccctggccctgctgagagcggcctgcggcctgagggcgccgccagccctggggccggccctgctgggggcatccaccagatcccagctgctgcctgcccccccaactag

SEQ ID NO: 154519 - DNA, 1353 bp, Artificial Sequence
  Description of Artificial Sequence: Synthetic coding sequence
atggacctgtctgctgctgctgccctgtgcctgtggctgctgagcgcctgccggcccagagatggcctggaggccgctgctgtgctgcgggccgccggggccggccctgtgcgcagccctgggggcggcggcggcggcggcggcggcggccgcaccctggcccaggccgccggggctgctgctgtgcctgctgctgctgtgccccgggcccgggccgcccggcgggctgctggcagcggcttcagaaatggatctgtggtgccccaccacttcatgatgagcctgtaccgcagcctggccggccgggccccagctggagctgctgctgtgtctgccagcggccacggccgggctgacaccatcaccggcttcacagaccaggccacccaggatgaatctgctgctgagaccggccagagcttcctgtttgatgtgagcagcctgaatgatgctgatgaggtggtgggcgctgagctgcgggtgctgcggcggggcagccctgagagcggccctggctcctggaccagcccccccctgctgctgctgagcacctgccctggggccgcccgggccccccggctgctgtacagcagagctgctgagcccctggtgggccagcgctgggaggcctttgatgtggctgatgccatgaggaggcacagaagagagccccggcccccccgggccttctgcctgctgctgcgggctgtggccggccctgtgcccagccccctggccctgcggcggctgggcttcggctggccaggcggcggcggcagcgctgctgaggagagagctgtgctggtggtgagcagcaggacccagaggaaggagagcctcttccgggagatccgggcccaggcccgggccctgggcgccgccctggccagcgagcccctgcctgaccccggcactggaacagccagcccccgggccgtcatcggcggcagaagaagaagaagaacagccctggccggcaccaggacagcccagggcagcggcggcggggccggccggggccatggaagaagaggccgcagccgctgcagcaggaagcccctgcacgtggacttcaaggagctgggctgggatgactggatcatcgcccccctggactatgaggcctaccactgtgagggcctgtgtgacttccccctgcggagccacctggagcccaccaaccacgccatcatccagaccctgctgaacagcatggccccagatgctgccccagccagctgctgcgtgcctgcccggctgagccccatcagcatcctgtacattgatgctgccaacaacgtggtgtacaagcagtatgaggacatggtggtggaggcctgtggctgcaggtag

SEQ ID NO: 154520 - DNA, 1269 bp, Artificial Sequence
  Description of Artificial Sequence: Synthetic coding sequence
atgcccaggagcttcctggtgaagagcaagaaggcccacagctaccaccagcccaggagccctggccctgactacagcctgcggctggagaatgtgcctgcccccagcagagctgacagcaccagcaatgctgggggcgccaaggccgagccccgggaccggctgagccctgagagccagctgacagaggccccagaccgggccagcgccagcccagacagctgtgagggctctgtgtgtgagaggagcagcgagtttgaggacttctggaggcctcccagccccagcgccagccctgccagcgagaagtccatgtgccccagcctggatgaggcccagcccttccccctgcccttcaagccctacagctggagcggcctggccggcagtgacctgcggcacctggtgcagagctaccggccctgtggggccctggagagaggagctggcctgggcctcttctgtgagcccgcccctgagcccggccaccctgctgccctgtatggccccaagagagctgctgggggcgctggggccggggcccctggcagctgcagcgctggagctggggccacagctggccctggcctgggcctgtatggagactttggatctgctgctgctggcctgtatgagcggcccacagctgctgctggcctgctgtacccagagcggggccacggcctgcatgctgacaagggagctggggtgaaggtggagagcgagctgctgtgcacccggctgctgctgggcggcggcagctacaagtgcatcaagtgcagcaaggtgttcagcaccccccacggcctggaggtgcacgtgagaagaagccacagcggcacccggccctttgcctgtgagatgtgtgggaagacctttggacatgctgtgtccctggagcagcacaaggctgtgcacagccaggagaggagctttgactgcaagatctgtgggaagagcttcaagaggagcagcaccctgagcacccacctgctgatccacagcgacacccggccctacccctgccagtactgcggcaagcgcttccaccagaagagtgacatgaagaagcacaccttcatccacactggagagaagccccacaagtgccaggtgtgtgggaaggccttcagccagagcagcaacctgatcacccacagcaggaagcacacaggcttcaagcccttcggctgtgacctgtgtgggaagggcttccagaggaaggtggacctgcggcggcaccgggagacccagcacggcctgaagtag

SEQ ID NO: 154521 - DNA, 1269 bp, Artificial Sequence; identical to SEQ ID NO: 154520
  Description of Artificial Sequence: Synthetic coding sequence

SEQ ID NO: 154522 - DNA, 1269 bp, Artificial Sequence; identical to SEQ ID NO: 154520
  Description of Artificial Sequence: Synthetic coding sequence

SEQ ID NO: 154523 - DNA, 993 bp, Artificial Sequence
  Description of Artificial Sequence: Synthetic coding sequence
atgcccaggagcttcctggtgaagagcaagaaggcccacacctaccaccagccccgggtgcaggaggatgagcccctgtggcccccagccctgacccctgtgccccgggaccaggcccccagcaacagccctgtgctgagcaccctcttccccaaccagtgcctggactggaccaacctgaagcgggagcctgagctggagcaggaccagaacctggccaggatggccccagcccctgagggccccatcgtgctgagccggccccaggatggagacagccccctgagtgacagcccccccttctacaagcccagcttctcctgggacaccctggccaccacctacggccacagctaccggcaggcccccagcaccatgcagagcgccttcctggagcacagcgtgtccctgtatggcagccccctggtgcccagcacagagcccgccctggacttcagcctgcgctacagccctggcatggatgcctaccactgtgtgaagtgcaacaaggtgttcagcaccccccacggcctggaggtgcacgtgagaagaagccacagcggcacccggccctttgcctgtgacatctgtgggaagacctttggacatgctgtgtccctggagcagcacacccacgtgcacagccaggagaggagctttgaatgtaggatgtgtgggaaggccttcaagaggagcagcaccctgagcacccacctgctgatccacagcgacacccggccctacccctgccagttctgtgggaagcgcttccaccagaagagtgacatgaagaagcacacctacatccacactggagagaagccccacaagtgccaggtgtgtgggaaggccttcagccagagcagcaacctgatcacccacagcaggaagcacacaggcttcaagcccttcagctgtgagctgtgcaccaagggcttccagaggaaggtggacctgcggcggcaccgggagagccagcacaacctgaagtag

SEQ ID NO: 154524 - DNA, 993 bp, Artificial Sequence; identical to SEQ ID NO: 154523
  Description of Artificial Sequence: Synthetic coding sequence

SEQ ID NO: 154525 - DNA, 855 bp, Artificial Sequence
  Description of Artificial Sequence: Synthetic coding sequence
atgcccaggagcttcctggtgaagagcaagaaggcccacacctaccaccagccccgggtgcaggaggatgagcccctgtggcccccagccctgacccctgtgccccgggaccaggcccccagcaacagccctgtgctgagcaccctcttccccaaccagtgcctggactggaccaacctgaagcgggagcctgagctggagcaggaccagaacctggccaggatggccccagcccctgagggccccatcgtgctgagccggccccaggatggagacagccccctgagtgacagcccccccttctacaagcccagcttctcctgggacaccctggccaccacctacggccacagctaccggcaggcccccagcaccatgcagagcgccttcctggagcacagcgtgtccctgtatggcagccccctggtgcccagcacagagcccgccctggacttcagcctgcgctacagccctggcatggatgcctaccactgtgtgaagtgcaacaaggagaggagctttgaatgtaggatgtgtgggaaggccttcaagaggagcagcaccctgagcacccacctgctgatccacagcgacacccggccctacccctgccagttctgtgggaagcgcttccaccagaagagtgacatgaagaagcacacctacatccacactggagagaagccccacaagtgccaggtgtgtgggaaggccttcagccagagcagcaacctgatcacccacagcaggaagcacacaggcttcaagcccttcagctgtgagctgtgcaccaagggcttccagaggaaggtggacctgcggcggcaccgggagagccagcacaacctgaagtag

SEQ ID NO: 154526 - DNA, 855 bp, Artificial Sequence; identical to SEQ ID NO: 154525
  Description of Artificial Sequence: Synthetic coding sequence

SEQ ID NO: 154527 - DNA, 993 bp, Artificial Sequence; identical to SEQ ID NO: 154523
  Description of Artificial Sequence: Synthetic coding sequence

SEQ ID NO: 154528 - DNA, 855 bp, Artificial Sequence; identical to SEQ ID NO: 154525
  Description of Artificial Sequence: Synthetic coding sequence

SEQ ID NO: 154529 - DNA, 1623 bp, Artificial Sequence
  Description of Artificial Sequence: Synthetic coding sequence
atgaccaccagcctgcaggacggccagagcgctgccagcagagctgctgcccgggacagccccctggccgcccaggtgtgtggggccgcccagggcagaggagatgcccatgacctggccccagccccctggctgcacgcccgggccctgctgcccctgcctgatggcacccggggctgtgccgctgacaggaggaagaagaaggacctggatgtgcctgagatgcccagcatccccaaccccttccctgagctgtgctgcagccccttcacctctgtgctgtctgctgacctcttccccaaggccaacagcaggaagaagcaggtgatcaaggtgtacagtgaagatgagaccagccgggccctggatgtgcccagcgacatcacagccagagatgtgtgccagctgctgatcctgaagaaccactacattgatgaccacagctggaccctgtttgagcacctgccccacatcggcgtggagaggaccattgaagatcatgagctggtgattgaggtgctgagcaactggggcatcgaggaggagaacaagctgtacttcaggaagaactatgccaagtatgagttcttcaagaaccccatgtacttcttccctgagcacatggtgtcctttgccacagagaccaacggggagatcagccccacccagatcctgcagatgttcctgagcagcagcacctacccagagatccacggcttcctgcacgccaaggagcagggcaagaagtcctggaagaagatctacttcttcctgcggcgcagcggcctgtacttcagcaccaagggcaccagcaaggagcccaggcacctgcagttcttcagcgagtttggaaacagcgacatctacgtgtccctggccggcaagaagaagcacggggcccccaccaactacggcttctgcttcaagcccaacaaggccggcggcccccgggacctgaagatgctgtgtgccgaggaggagcagagcaggacctgctgggtgacagccatccggctgctgaagtatggcatgcagctgtaccagaactacatgcacccctaccagggccgcagcggctgcagcagccagagcatcagccccatgaggagcatcagcgagaacagcctggtggccatggacttcagcggccagaagagccgggtgattgagaaccccacagaggccctgtctgtggccgtggaggagggcctggcctggaggaagaagggctgcctgcggctgggcacccacggcagccccacagccagcagccagagcagcgccaccaacatggccatccacaggagccagccctggttccaccacaagatcagcagagatgaggcccagaggctcatcatccagcagggcctggtggatggagtcttcctggtgcgggacagccagagcaaccccaagacctttgtgctgtccatgagccacggccagaagatcaagcacttccagatcatccctgtggaggatgatggagagatgttccacaccctggatgatggccacacccgcttcacagacctgatccagctggtggagttctaccagctgaacaagggcgtgctgccctgcaagctgaagcactactgtgcccgcatcgccctgtag

SEQ ID NO: 154530 - DNA, 1362 bp, Artificial Sequence
  Description of Artificial Sequence: Synthetic coding sequence
atgagcctgagcgcccggcgggtgaccctgcctgccatcacccccatcatcctgcagaagagggtcatcaaggtgtacagtgaagatgagaccagccgggccctggatgtgcccagcgacatcacagccagagatgtgtgccagctgctgatcctgaagaaccactacattgatgaccacagctggaccctgtttgagcacctgccccacatcggcgtggagaggaccatcgaggaccacgagctggtgattgaggtgctgagcaactggggcatcgaggaggagaacaagctgtacttcaggaagaactatgccaagtatgagttcttcaagaaccccatgtacttcttccctgagcacatggtgtcctttgccacagagaccaatggagagatcagccccacccagatcctgcagatgttcctgagcagcagcacctacccagagatccacggcttcctgcacgccaaggagcagggcaagaagtcctggaagaagatctacttcttcctgcggcgcagcggcctgtacttcagcaccaagggcaccagcaaggagcccaggcacctgcagttcttcagcgagtttggaaacagcgacatctacgtgtccctggccggcaagaagaagcatggagcccccaccaactacggcttctgcttcaagcccaacaaggccggcggcccccgggacctgaagatgctgtgtgccgaggaggagcagagcaggacctgctgggtgacagccatccggctgctgaagtatggcatgcagctgtaccagaactacatgcacccctaccagggccgcagcggctgcagcagccagagcatcagccccatgaggagcatcagcgagaacagcctggtggccatggacttcagcggccagaagagccgggtgattgagaaccccacagaggccctgtctgtggccgtggaggagggcctggcctggaggaagaagggctgcctgcggctgggcacccacggcagccccacagccagcagccagagcagcgccaccaacatggccatccacaggagccagccctggttccaccacaagatcagcagagatgaggcccagaggctcatcatccagcagggcctggtggatggagtcttcctggtgcgggacagccagagcaaccccaagacctttgtgctgtccatgagccacggccagaagatcaagcacttccagatcatccctgtggaggatgatggagagatgttccacaccctggatgatggccacacccgcttcacagacctgatccagctggtggagttctaccagctgaacaagggcgtgctgccctgcaagctgaagcactactgtgccagaattgccctgtag

SEQ ID NO: 154531 - DNA, 1599 bp, Artificial Sequence
  Description of Artificial Sequence: Synthetic coding sequence
atggagctggacctgagccccccccacctgagcagcagccctgaggacctgtgcccagcccctggcaccccacctggcaccccccggcccccagacacccccctgcctgaggaggtgaagaggagccagcccctgctgatccccaccaccggcaggaagctgcgggaggaggagcggcgggccaccagcctgcccagcatccccaaccccttccctgagctgtgcagcccccccagccagagccccatcctgggcggccccagcagcgcccggggcctgctgcccagagatgccagccggccccacgtggtgaaggtgtacagtgaagatggagcctgccgctctgtggaggtggccgccggggccacagcccggcacgtgtgtgagatgctggtgcagagggcccacgccctgagtgatgagacctggggcctggtggagtgccacccccacctggccctggagcggggcctggaggaccatgaatctgtggtggaggtgcaggccgcctggcctgtgggcggggacagcagatttgtgttcaggaagaactttgccaagtatgagctgttcaagagcagcccccacagcctcttccctgagaagatggtgagcagctgcctggatgcccacacaggcatcagccatgaagatctcatccagaacttcctgaatgccggcagcttccctgagatccagggcttcctgcagctgcggggcagcggcaggaagctgtggaagcgcttcttctgcttcctgcggcgcagcggcctgtactacagcaccaagggcaccagcaaggaccccaggcacctgcagtatgtggctgatgtgaatgaaagcaatgtgtatgtggtgacccagggcaggaagctgtatggcatgcccacagactttggcttctgtgtgaagcccaacaagctgagaaatggccacaagggcctgcgcatcttctgcagtgaagatgagcagagcaggacctgctggctggccgccttccgcctcttcaagtatggagtgcagctgtacaagaactaccagcaggcccagagccgccacctgcaccccagctgcctgggcagcccccccctgcggagcgccagtgacaacaccctggtggccatggacttcagcggccatgctggccgggtgattgagaacccccgggaggccctgtctgtggccctggaggaggcccaggcctggaggaagaagaccaaccaccggctgagcctgcccatgcctgccagcggcaccagcctgtctgctgccatccacaggacccagctgtggttccacggccgcatcagccgggaggagagccagaggctgattggccagcagggcctggtggatggcctcttcctggtgcgggagagccagaggaacccccagggctttgtgctgagcctgtgccacctgcagaaggtgaagcactacctgatcctgcccagcgaggaggagggccgcctgtacttctccatggatgatggccagacccgcttcacagacctgctgcagctggtggagttccaccagctgaacagaggcatcctgccctgcctgctgcggcactgctgcaccagggtggccctgtag

SEQ ID NO: 154532 - DNA, 1344 bp, Artificial Sequence
  Description of Artificial Sequence: Synthetic coding sequence
atggagctggacctgagccccccccacctgagcagcagccctgaggacctgtgcccagcccctggcaccccacctggcaccccccggcccccagacacccccctgcctgaggaggtgaagaggagccagcccctgctgatccccaccaccggcaggaagctgcgggaggaggagcggcgggccaccagcctgcccagcatccccaaccccttccctgagctgtgcagcccccccagccagagccccatcctgggcggccccagcagcgcccggggcctgctgcccagagatgccagccggccccacgtggtgaaggtgtacagtgaagatggagcctgccgctctgtggaggtggccgccggggccacagcccggcacgtgtgtgagatgctggtgcagagggcccacgccctgagtgatgagacctggggcctggtggagtgccacccccacctggccctggagcggggcctggaggaccatgaatctgtggtggaggtgcaggccgcctggcctgtgggcggggacagcagatttgtgttcaggaagaactttgccaagtatgagctgttcaagagcagcccccacagcctcttccctgagaagatggtgagcagctgcctggatgcccacacaggcatcagccatgaagatctcatccagaacttcctgaatgccggcagcttccctgagatccagggcttcctgcagctgcggggcagcggcaggaagctgtggaagcgcttcttctgcttcctgcggcgcagcggcctgtactacagcaccaagggcaccagcaaggaccccaggcacctgcagtatgtggctgatgtgaatgaaagcaatgtgtatgtggtgacccagggcaggaagctgtatggcatgcccacagactttggcttctgtgtgaagcccaacaagctgagaaatggccacaagggcctgcgcatcttctgcagtgaagatgagcagagcaggacctgctggctggccgccttccgcctcttcaagtatggagtgcagctgtacaagaactaccagcaggcccagagccgccacctgcaccccagctgcctgggcagcccccccctgcggagcgccagtgacaacaccctggtggccatggacttcagcggccatgctggccgggtgattgagaacccccgggaggccctgtctgtggccctggaggaggcccaggcctggaggaagaagaccaaccaccggctgagcctgcccatgcctgccagcggcaccagcctgtctgctgcctgctcctggagcggccgggtgtctggcaccccccgggccctgagcagcctgtgtgccacctgcaggaagtag

SEQ ID NO: 154533 - DNA, 1344 bp, Artificial Sequence; identical to SEQ ID NO: 154532
  Description of Artificial Sequence: Synthetic coding sequence

SEQ ID NO: 154534 - DNA, 1599 bp, Artificial Sequence; identical to SEQ ID NO: 154531
  Description of Artificial Sequence: Synthetic coding sequence

SEQ ID NO: 154535 - DNA, 1599 bp, Artificial Sequence; identical to SEQ ID NO: 154531
  Description of Artificial Sequence: Synthetic coding sequence

SEQ ID NO: 154536 - DNA, 1668 bp, Artificial Sequence
  Description of Artificial Sequence: Synthetic coding sequence
atgggcaagtggaggcctggccagggccacaccaccggctctgtgaagcccctgagctgcagtgatgccatggagctggacctgagccccccccacctgagcagcagccctgaggacctgtgcccagcccctggcaccccacctggcaccccccggcccccagacacccccctgcctgaggaggtgaagaggagccagcccctgctgatccccaccactggaaggaagctgcgggaggaggagcggcgggccaccagcctgcccagcatccccaaccccttccctgagctgtgcagcccccccagccagagccccatcctgggcggccccagcagcgcccggggcctgctgcccagagatgccagccggccccacgtggtgaaggtgtacagtgaagatggagcctgccgctctgtggaggtggccgccggggccacagcccggcacgtgtgtgagatgctggtgcagagggcccacgccctgagtgatgagacctggggcctggtggagtgccacccccacctggccctggagcggggcctggaggaccacgagagcgtggtggaggtgcaggccgcctggcctgtgggcggggacagcagatttgtgttcaggaagaactttgccaagtatgagctgttcaagagcagcccccacagcctcttccctgagaagatggtgagcagctgcctggatgcccacacaggcatcagccatgaggacctgatccagaacttcctgaatgccggcagcttccctgagatccagggcttcctgcagctgcggggcagcggcaggaagctgtggaagcgcttcttctgcttcctgcggcgcagcggcctgtactacagcaccaagggcaccagcaaggaccccaggcacctgcagtatgtggctgatgtgaatgaaagcaatgtgtatgtggtgacccagggcaggaagctgtatggcatgcccacagactttggcttctgtgtgaagcccaacaagctgagaaatggccacaagggcctgcgcatcttctgcagtgaagatgagcagagcaggacctgctggctggccgccttccgcctcttcaagtatggagtgcagctgtacaagaactaccagcaggcccagagccgccacctgcaccccagctgcctgggcagcccccccctgcggagcgccagtgacaacaccctggtggccatggacttcagcggccacgccggccgggtgattgagaacccccgggaggccctgtctgtggccctggaggaggcccaggcctggaggaagaagaccaaccaccggctgagcctgcccatgcctgccagcggcaccagcctgtctgctgccatccacaggacccagctgtggttccacggccgcatcagccgggaggagagccagaggctcatcggccagcagggcctggtggatggcctcttcctggtgcgggagagccagaggaacccccagggctttgtgctgagcctgtgccacctgcagaaggtgaagcactacctgatcctgcccagcgaggaggagggccgcctgtacttctccatggatgatggccagacccgcttcacagacctgctgcagctggtggagttccaccagctgaacagaggcatcctgccctgcctgctgcggcactgctgcaccagggtggccctgtag

SEQ ID NO: 154537 - DNA, 618 bp, Artificial Sequence
  Description of Artificial Sequence: Synthetic coding sequence
atggccgcccctggagagcggggccgcttccatggaggcaacctcttcttcctgcctggaggagcccggtctgagatgatggatgacctggccacagatgcccggggcagaggagctggaagaagagatgctgctgccagcgccagcaccccagcccaggcccccaccagtgacagccctgtggctgaagatgccagcagaagaagaccctgccgggcctgtgtggacttcaagacctggatgaggacccagcagaagagggacaccaagttccgggaggactgccccccagaccgggaggagctgggccgccacagctgggccgtgctgcacaccctggccgcctactacccagacctgcccaccccagagcagcagcaggacatggcccagttcatccacctgttcagcaagttctacccctgtgaggagtgtgccgaggacctgaggaagaggctgtgcaggaaccacccagacaccaggacccgggcctgcttcacccagtggctgtgccacctgcacaatgaggtgaacaggaagctgggcaagccagactttgactgcagcaaggtggatgagcgctggagagatggctggaaggatggcagctgtgactag

SEQ ID NO: 154538 - DNA, 285 bp, Artificial Sequence
  Description of Artificial Sequence: Synthetic coding sequence
atgaggacccagcagaagagggacaccaagttccgggaggactgccccccagaccgggaggagctgggccgccacagctgggccgtgctgcacaccctggccgcctactacccagacctgcccaccccagagcagcagcaggacatggcccagttcatccacctgttcagcaagttctacccctgtgaggagtgtgccgaggacctgaggaagaggctgtgcaggaaccacccagacaccaggacccgggcctgcttcaccgtggccgtgcccccagcccagtag

SEQ ID NO: 154539 - DNA, 1629 bp, Artificial Sequence
  Description of Artificial Sequence: Synthetic coding sequence
atgagcccctgcccagaggaggccgccatgagaagagaggtggtgaagagaattgagaccgtggtgaaggacctgtggcccacagcagatgtgcagatcttcggcagcttcagcacaggcctgtacctgcccaccagtgacatcgacctggtggtgtttgggaagtgggagaggcctcccctgcagctgctggagcaggccctgaggaagcacaacgtggccgagccctgcagcatcaaggtgctggacaaggccaccgtgcccatcatcaagctgacagaccaggagacagaggtgaaggtggacatctccttcaacatggagactggagtgcgggctgctgagttcatcaagaactacatgaagaagtacagcctgctgccctacctgatcctggtgctgaagcagttcctgctgcagagggacctgaatgaggtgttcaccggcggcatcagcagctacagcctcatcctgatggccatctccttcctgcagctgcaccccagaattgatgccaggagagcagatgagaacctgggcatgctgctggtggagttctttgagctgtatggcaggaacttcaactacctgaagacaggcatccgcatcaaggagggcggggcctacatcgccaaggaggagatcatgaaggccatgaccagcggctaccggcccagcatgctgtgcatcgaggaccccctgctgcctggaaatgatgtgggccgcagcagctatggagccatgcaggtgaagcaggtgtttgattatgcctacatcgtgctgagccatgctgtgagccccctggcccggagctaccccaacagagatgctgagagcaccctgggccgcatcatcaaggtgacccaggaggtgattgactaccgccgctggatcaaggagaagtggggcagcaaggcccaccccagccctggcatggacagccgcatcaagatcaaggagcgcatcgccacctgcaatggagagcagacccagaaccgggagcctgagagcccctacggccagaggctgaccctgagcctgagcagcccccagctgctgagcagcggcagcagcgccagctctgtgagcagcctgagcggcagtgatgtggacagcgacaccccaccctgcaccaccccatctgtgtaccagttcagcctgcaggccccagcccccctgatggccggcctgcccacagccctgcccatgcccagcggcaagccccagcccaccaccagcaggaccctcatcatgaccaccaacaaccagacccgcttcaccatccccccacccaccctgggcgtggcccctgtgccctgccggcaggccggcgtggagggcacagccagcctgaaggctgtgcaccacatgagcagccctgccatccccagcgccagccccaaccccctgagcagcccccacctgtaccacaagcagcacaacggcatgaagctgtccatgaagggcagccacggccacacccagggcggcggctacagctctgtgggcagcggcggcgtgcggccccctgtgggcaacagaggccaccaccagtacaacagaacaggctggaggaggaagaagcacacccacacccgggacagcctgcctgtgtccctgagcaggtag

SEQ ID NO: 154540 - DNA, 885 bp, Artificial Sequence
  Description of Artificial Sequence: Synthetic coding sequence
atggacctgtggcagctgctgctgaccctggccctggccggcagcagtgatgccttcagcggcagcgaggccacagctgccatcctgagccgggccccctggagcctgcagagcgtgaaccctggcctgaagaccaacagcagcaaggagcccaagttcaccaagtgccgcagccctgagcgggagaccttcagctgccactggacagatgaggtgcaccacggcaccaagaacctgggccccatccagctgttctacaccaggaggaacacccaggagtggacccaggagtggaaggagtgcccagactatgtgtctgctggggagaacagctgctacttcaacagcagcttcaccagcatctggatcccctactgcatcaagctgaccagcaatggaggcaccgtggatgagaagtgcttctctgtggatgagatcgtgcagcctgacccccccatcgccctgaactggaccctgctgaatgtgtccctgaccggcatccatgctgacatccaggtgcgctgggaggcccccagaaatgctgacatccagaagggctggatggtgctggagtatgagctgcagtacaaggaggtgaatgagaccaagtggaagatgatggaccccatcctgaccacctctgtgcctgtgtacagcctgaaggtggacaaggagtatgaggtgcgggtgcgcagcaagcagagaaattctggcaactacggggagttcagcgaggtgctgtatgtgaccctgccccagatgagccagttcacctgtgaggaggacttctacttcccctggctgctgatcatcatcttcggcatcttcggcctgactgtgatgctgtttgtgttcctgttcagcaagcagcagagccagaactag

SEQ ID NO: 154541 - DNA, 1851 bp, Artificial Sequence
  Description of Artificial Sequence: Synthetic coding sequence
atggacctgtggcagctgctgctgaccctggccctggccggcagcagtgatgccttcagcggcagcgaggacagcagcaaggagcccaagttcaccaagtgccgcagccctgagcgggagaccttcagctgccactggacagatgaggtgcaccacggcaccaagaacctgggccccatccagctgttctacaccaggaggaacacccaggagtggacccaggagtggaaggagtgcccagactatgtgtctgctggggagaacagctgctacttcaacagcagcttcaccagcatctggatcccctactgcatcaagctgaccagcaatggaggcaccgtggatgagaagtgcttctctgtggatgagatcgtgcagcctgacccccccatcgccctgaactggaccctgctgaatgtgtccctgaccggcatccatgctgacatccaggtgcgctgggaggcccccagaaatgctgacatccagaagggctggatggtgctggagtatgagctgcagtacaaggaggtgaatgagaccaagtggaagatgatggaccccatcctgaccacctctgtgcctgtgtacagcctgaaggtggacaaggagtatgaggtgcgggtgcgcagcaagcagagaaattctggcaactacggggagttcagcgaggtgctgtatgtgaccctgccccagatgagccagttcacctgtgaggaggacttctacttcccctggctgctgatcatcatcttcggcatcttcggcctgactgtgatgctgtttgtgttcctgttcagcaagcagcagaggatcaagatgctgatcctgccccctgtgcctgtgcccaagatcaagggcattgatcctgacctgctgaaggagggcaagctggaggaggtgaacaccatcctggccatccatgacagctacaagccagagttccacagtgatgacagctgggtggagttcatcgagctggacattgatgagccagatgagaagacagaggagagtgacacagaccggctgctgagcagtgaccacgagaagagccacagcaacctgggcgtgaaggatggagacagcggccgcaccagctgctgtgagccagacatcctggagacagacttcaatgccaatgacatccacgagggcaccagcgaggtggcccagccccagaggctgaagggggaggccgacctgctgtgcctggaccagaagaaccagaacaacagcccctaccatgatgcctgcccagccacccagcagcccagcgtcatccaggccgagaagaacaagccccagcccctgcccacagaaggagctgagagcacccaccaggccgcccacatccagctgagcaaccccagcagcctgagcaacatcgacttctacgcccaggtgtctgacatcaccccagctggctctgtggtgctgagccctggccagaagaacaaggccggcatgagccagtgtgacatgcaccctgagatggtgtccctgtgccaggagaacttcctgatggacaatgcctacttctgtgaggctgatgccaagaagtgcatccctgtggccccccacatcaaggtggagagccacatccagcccagcctgaaccaggaggacatctacatcaccacagagagcctgaccacagctgctggccggcccggcactggagagcacgtgcccggcagcgagatgcctgtgcctgactacaccagcatccacatcgtgcagagcccccagggcctcatcctgaatgccacagccctgcccctgcctgacaaggagttcctgagcagctgtggctacgtgtccacagaccagctgaacaagatcatgccctag

SEQ ID NO: 154542 - DNA, 1356 bp, Artificial Sequence
  Description of Artificial Sequence: Synthetic coding sequence
atggtgctggagtatgagctgcagtacaaggaggtgaatgagaccaagtggaagatgatggaccccatcctgaccacctctgtgcctgtgtacagcctgaaggtggacaaggagtatgaggtgcgggtgcgcagcaagcagaggaacagcggcaactatggagagttcagcgaggtgctgtatgtgaccctgccccagatgagccagttcacctgtgaggaggacttctacttcccctggctgctgatcatcatcttcggcatcttcggcctgactgtgatgctgtttgtgttcctgttcagcaagcagcagaggatcaagatgctgatcctgccccctgtgcctgtgcccaagatcaagggcatcgaccctgacctgctgaaggagggcaagctggaggaggtgaacaccatcctggccatccatgacagctacaagccagagttccacagtgatgacagctgggtggagttcatcgagctggacattgatgagccagatgagaagacagaggagagtgacacagaccggctgctgagcagtgaccacgagaagagccacagcaacctgggcgtgaaggatggagacagcggccgcaccagctgctgtgagccagacatcctggagacagacttcaatgccaatgacatccacgagggcaccagcgaggtggcccagccccagaggctgaagggggaggccgacctgctgtgcctggaccagaagaaccagaacaacagcccctaccatgatgcctgcccagccacccagcagcccagcgtcatccaggccgagaagaacaagccccagcccctgcccacagagggcgctgagagcacccaccaggccgcccacatccagctgagcaaccccagcagcctgagcaacatcgacttctacgcccaggtgtctgacatcaccccagctggctctgtggtgctgagccctggccagaagaacaaggccggcatgagccagtgtgacatgcaccctgagatggtgtccctgtgccaggagaacttcctgatggacaatgcctacttctgtgaggctgatgccaagaagtgcatccctgtggccccccacatcaaggtggagagccacatccagcccagcctgaaccaggaggacatctacatcaccacagagagcctgaccacagctgctggccggcccggcaccggggagcacgtgcccggcagcgagatgcctgtgcctgactacaccagcatccacatcgtgcagagcccccagggcctcatcctgaatgccacagccctgcccctgcctgacaaggagttcctgagcagctgtggctacgtgtccacagaccagctgaacaagatcatgccctag

SEQ ID NO: 154543 - DNA, 327 bp, Artificial Sequence
  Description of Artificial Sequence: Synthetic coding sequence
atgcccctgtgggtgttcttcttcgtcatcctgaccctgagcaacagcagccactgcagccccccaccacccctgaccctgaggatgagaagatatgcagatgccatcttcaccaacagctacaggaaggtgctgggccagctgagcgccaggaagctgctgcaggacatcatgagccggcagcagggcgagagcaaccaggagcggggggcccgggcccggctgggccggcaggtggacagcatgtgggccgagcagaagcagatggagctggagagcatcctggtggccctgctgcagaagcacagcaggaacagccagggctag

SEQ ID NO: 154544 - DNA, 324 bp, Artificial Sequence
  Description of Artificial Sequence: Synthetic coding sequence
atgcccctgtgggtgttcttcttcgtcatcctgaccctgagcaacagcagccactgcagccccccaccacccctgaccctgaggatgagaagatatgcagatgccatcttcaccaacagctacaggaaggtgctgggccagctgagcgccaggaagctgctgcaggacatcatgagccggcagcagggcgagagcaaccaggagcggggggcccgggcccggctgggccggcaggtggacagcatgtgggccgagcagaagcagatggagctggagagcatcctggtggccctgctgcagaagcacaggaacagccagggctag

SEQ ID NO: 154545 - DNA, 327 bp, Artificial Sequence; identical to SEQ ID NO: 154543
  Description of Artificial Sequence: Synthetic coding sequence

SEQ ID NO: 154546 - DNA, 1272 bp, Artificial Sequence
  Description of Artificial Sequence: Synthetic coding sequence
atggacaggaggatgtggggcgcccacgtgttctgtgtgctgagccccctgcccaccgtgctgggccacatgcacccagaatgtgacttcatcacccagctgcgggaggatgaaagtgcctgcctgcaggccgctgaggagatgcccaacaccaccctgggctgcccagccacctgggatggcctgctgtgctggcccacagctggcagcggggagtgggtgaccctgccctgcccagacttcttcagccacttcagcagcgagagcggggctgtgaagagggactgcaccatcaccggctggagcgagcccttccccccctaccctgtggcctgccctgtgcccctggagctgctggccgaggaggagagctacttcagcacagtgaagatcatctacacagtgggccacagcatcagcatcgtggccctgtttgtggccatcaccatcctggtggccctgcggcggctgcactgccccagaaattatgtgcacacccagctgttcaccaccttcatcctgaaggccggggctgtgttcctgaaggatgctgccctcttccacagtgatgacacagaccactgcagcttcagcacagtgctgtgcaaggtgtctgtggccgccagccactttgccaccatgaccaacttctcctggctgctggccgaggccgtgtacctgaactgcctgctggccagcaccagccccagcagcagaagagccttctggtggctggtgctggccggctggggcctgcctgtgctcttcaccggcacctgggtgtcctgcaagctggcctttgaggacatcgcctgctgggacctggatgacaccagcccctactggtggatcatcaagggccccatcgtgctgtctgtgggcgtgaactttggcctcttcctgaacatcatccgcatcctggtgaggaagctggagcccgcccagggcagcctgcacacccagagccagtactggaggctgagcaagagcaccctcttcctgatccccctgtttggcatccactacatcatcttcaacttcctgcctgacaatgccggcctgggcatccggctgcccctggagctgggcctgggcagcttccagggcttcatcgtggccatcctgtactgcttcctgaaccaggaggtgaggacagagatcagcaggaagtggcacggccatgaccctgagctgctgcctgcctggaggacccgggccaagtggaccacccccagccgctctgctgccaaggtgctgacctccatgtgctag

SEQ ID NO: 154547 - DNA, 207 bp, Artificial Sequence
  Description of Artificial Sequence: Synthetic coding sequence
atggtgcccggcacccccagccccctgctgggccggggcaaggagctgtggctggagagcctggcctgcctgcctggagctgtgaagagggactgcaccatcaccggctggagcgagcccttccccccctaccctgtggcctgccctgtgcccctggagctgctggccgaggagggctgcccctgcagcagcctggcccggggctag

SEQ ID NO: 154548 - DNA, 438 bp, Artificial Sequence
  Description of Artificial Sequence: Synthetic coding sequence
atggtgcccggcacccccagccccctgctgggccggggcaaggagctgtggctggagagcctggcctgcctgcctggagctgtgaagagggactgcaccatcaccggctggagcgagcccttccccccctaccctgtggcctgccctgtgcccctggagctgctggccgaggaggagagctacttcagcacagtgaagatcatctacacagtgggccacagcatcagcatcgtggccctgtttgtggccatcaccatcctggtggccctgcggcggctgcactgccccagaaattatgtgcacacccagctgttcaccaccttcatcctgaaggccggggctgtgttcctgaaggatgctgccctcttccacagtgatgacacagaccactgcagcttcagcacaggctgcccctgcagcagcctggcccggggctag

SEQ ID NO: 154549 - DNA, 456 bp, Artificial Sequence
  Description of Artificial Sequence: Synthetic coding sequence
atgctgcccttcagcacagccaccaccctgaccacagctgccagccccctggccgcccgggccctgcactggcacgtgggggagctgcagacaggcctgcggggccaccgggtgctgggccctggccgccacctgcccctgctggtggaccaccagagggcccactgccccctgggccgcggggagctgtgggccttcagccagtactacccccaccctggagaggagactggagccagcagcggccagcccccctaccctgtgtctgtgctggccagcctgcaggtggacaccttcccagaccccaccctgtggaacagcctgcaccacctgcagctgcctgcccggcagtgctggccaggccaccccccacctcctggggccggcaccggcttcctgcccggcctgcactgctgccaccccctgctgctgccccagcccagaggagaggactag

SEQ ID NO: 154550 - DNA, 1080 bp, Artificial Sequence
  Description of Artificial Sequence: Synthetic coding sequence
atggtgcccggcacccccagccccctgctgggccggggcaaggagctgtggctggagagcctggcctgcctgcctggagctgtgaagagggactgcaccatcaccggctggagcgagcccttccccccctaccctgtggcctgccctgtgcccctggagctgctggccgaggaggagagctacttcagcacagtgaagatcatctacacagtgggccacagcatcagcatcgtggccctgtttgtggccatcaccatcctggtggccctgcggcggctgcactgccccagaaattatgtgcacacccagctgttcaccaccttcatcctgaaggccggggctgtgttcctgaaggatgctgccctcttccacagtgatgacacagaccactgcagcttcagcacagtgctgtgcaaggtgtctgtggccgccagccactttgccaccatgaccaacttctcctggctgctggccgaggccgtgtacctgaactgcctgctggccagcaccagccccagcagcagaagagccttctggtggctggtgctggccggctggggcctgcctgtgctcttcaccggcacctgggtgtcctgcaagctggcctttgaggacatcgcctgctgggacctggatgacaccagcccctactggtggatcatcaagggccccatcgtgctgtctgtgggcgtgaactttggcctcttcctgaacatcatccgcatcctggtgaggaagctggagcccgcccagggcagcctgcacacccagagccagtactggaggctgagcaagagcaccctcttcctgatccccctgtttggcatccactacatcatcttcaacttcctgcctgacaatgccggcctgggcatccggctgcccctggagctgggcctgggcagcttccagggcttcatcgtggccatcctgtactgcttcctgaaccaggaggtgaggacagagatcagcaggaagtggcacggccatgaccctgagctgctgcctgcctggaggacccgggccaagtggaccacccccagccgctctgctgccaaggtgctgacctccatgtgctag

SEQ ID NO: 154551 - DNA, 1101 bp, Artificial Sequence
  Description of Artificial Sequence: Synthetic coding sequence
atgtggaatgccaccccatctgaggagcccggcttcaacctgaccctggccgacctggactgggatgccagccctggaaatgacagcctgggagatgagctgctgcagctgtttcctgcccccctgctggccggcgtgacagccacctgtgtggccctgtttgtggtgggcattgctggcaacctgctgaccatgctggtggtgagccgcttccgggagctgcggaccaccaccaacctgtacctgagctccatggccttcagtgacctgctgatcttcctgtgcatgcccctggacctggtgcggctgtggcagtaccggccctggaactttggagacctgctgtgcaagctgttccagtttgtgtctgagagctgcacctacgccaccgtgctgaccatcacagccctgtctgtggagcgctactttgccatctgcttccccctgcgggccaaggtggtggtgaccaagggccgggtgaagctggtgatctttgtgatctgggccgtggccttctgcagcgctggccccatctttgtgctggtgggcgtggagcatgaaaatggaacagacccctgggacaccaatgaatgtcggcccacagaatttgctgtgcgcagcggcctgctgactgtgatggtgtgggtgagcagcatcttcttcttcctgcccgtcttctgcctgactgtgctgtacagcctgattggaaggaagctgtggaggagaagaagaggagatgctgtggtgggcgccagcctgcgggaccagaaccacaagcagacagtgaagatgctggccgtggtggtgtttgccttcatcctgtgctggctgcccttccacgtgggccgctacctgttcagcaagagctttgagcccggcagcctggagatcgcccagatcagccagtactgcaacctggtgtcctttgtgctcttctacctgtctgctgccatcaaccccatcctgtacaacatcatgagcaagaagtacagagtggccgtgttccggctgctgggctttgagcccttcagccagaggaagctgagcaccctgaaggatgagagcagccgggcctggacagagagcagcatcaacacctag

SEQ ID NO: 154552 - DNA, 870 bp, Artificial Sequence
  Description of Artificial Sequence: Synthetic coding sequence
atgtggaatgccaccccatctgaggagcccggcttcaacctgaccctggccgacctggactgggatgccagccctggaaatgacagcctgggagatgagctgctgcagctgtttcctgcccccctgctggccggcgtgacagccacctgtgtggccctgtttgtggtgggcattgctggcaacctgctgaccatgctggtggtgagccgcttccgggagctgcggaccaccaccaacctgtacctgagctccatggccttcagtgacctgctgatcttcctgtgcatgcccctggacctggtgcggctgtggcagtaccggccctggaactttggagacctgctgtgcaagctgttccagtttgtgtctgagagctgcacctacgccaccgtgctgaccatcacagccctgtctgtggagcgctactttgccatctgcttccccctgcgggccaaggtggtggtgaccaagggccgggtgaagctggtgatctttgtgatctgggccgtggccttctgcagcgctggccccatctttgtgctggtgggcgtggagcatgaaaatggaacagacccctgggacaccaatgaatgtcggcccacagaatttgctgtgcgcagcggcctgctgactgtgatggtgtgggtgagcagcatcttcttcttcctgcccgtcttctgcctgactgtgctgtacagcctgattggaaggaagctgtggaggagaagaagaggagatgctgtggtgggcgccagcctgcgggaccagaaccacaagcagacagtgaagatgctgggcggcagccagagggccctgcggctgagcctggccggccccatcctgagcctgtgcctgctgcccagcctgtag

SEQ ID NO: 154553 - DNA, 666 bp, Artificial Sequence
  Description of Artificial Sequence: Synthetic coding sequence
atggcctttgtgaagagcggctggctgctgcggcagagcaccatcctgaagcgctggaagaagaactggtttgacctgtggagcgatggccacctgatctactatgatgaccagacccggcagaacatcgaggacaaggtgcacatgcccatggactgcatcaacatcagaacaggccaggagtgccgggacacccagcccccagatggcaagagcaaggactgcatgctgcagatcgtgtgcagagatggcaagaccatcagcctgtgtgccgagagcacagatgactgcctggcctggaagttcaccctgcaggacagcaggaccaacacagcctacgtgggcagcgctgtgatgacagatgagacctctgtggtgagcagccccccaccctacacagcctatgctgccccagcccctgaggcctacggctacggcccctacggcggggcctacccacctggcacccaggtggtgtatgctgccaacggccaggcctatgctgtgccctaccagtacccctatgccggcctgtatggccagcagcctgccaaccaggtgatcatccgggagcgctacagagacaatgacagcgacctggccctgggcatgctggccggggccgccaccggcatggccctgggcagcctcttctgggtgttctag

SEQ ID NO: 154554 - DNA, 1230 bp, Artificial Sequence
  Description of Artificial Sequence: Synthetic coding sequence
atgggcaacagctatgccggccagctgaagaccaccaggtttgaggaggtgctgcacaacagcattgaggccagcctgcggagcaacaacctggtgccccggcccatcttcagccagctgtacctggaggccgagcagcagctggccgccctggagggcggcagccgggtggacaatgaggaggaggaggaggagggggagggcggcctggagaccaatggaccacccaaccccttccagctgcaccccctgcctgagggctgctgcaccacagatggcttctgccaggccggcaaggacctgcggctggtgtccatcagcaatgagcccatggatgtgcctgctggcttcctgctggtgggcgtgaagagccccagcctgcctgaccacctgctggtgtgtgctgtggacaagcgcttcctgcctgatgacaatggccacaatgccctgctgggcttcagcggcaactgtgtgggctgtgggaagaagggcttctgctacttcacagagttcagcaaccacatcaacctgaagctgaccacccagcccaagaagcagaagcacctgaagtactacctggtgagaaatgcccagggcaccctgaccaagggccccctcatctgctggaagggcagcgagttccgcagccggcagatcccagccagcacctgcagcagcagcctcttccctgccctggagagcacagctgccttccccagcgagcctgtgcccggcaccaaccccagcatcctgatgggcgcccagcaggccggccctgccagtgaccaccccagcctgaatgctgccatgggccctgctgtgttcaacgggaaggacagccccaagtgccagcagctggccaagaacaacctgctggccctgccccggcccagcgccctgggcatcctgagcaacagcggcccccccaagaagaggcacaagggctggagccctgagagccccagcgccccagatggcggctgcccccagggcggcggcaacagagccaagtatgagagcgctggcatgagctgtgtgccccaggtgggcctggtgggccctgcctctgtgaccttccctgtggtggccagcggggagcctgtgtctgtgcctgacaacctgctgaagatctgcaaggccaagcctgtgatcttcaaggtgtttgtgaatggagccacccagatggtggccctgggccctgctgagcccgccagccccaggagcctgtag

SEQ ID NO: 154555 - DNA, 1374 bp, Artificial Sequence
  Description of Artificial Sequence: Synthetic coding sequence
atgggcaacagctatgccggccagctgaagaccaccaggtttgaggaggtgctgcacaacagcattgaggccagcctgcggagcaacaacctggtgccccggcccatcttcagccagctgtacctggaggccgagcagcagctggccgccctggagggcggcagccgggtggacaatgaggaggaggaggaggagggggagggcggcctggagaccaatggaccacccaaccccttccagctgcaccccctgcctgagggctgctgcaccacagatggcttctgccaggccggcaaggacctgcggctggtgtccatcagcaatgagcccatggatgtgcctgctggcttcctgctggtgggcgtgaagagccccagcctgcctgaccacctgctggtgtgtgctgtggacaagcgcttcctgcctgatgacaatggccacaatgccctgctgggcttcagcggcaactgtgtgggctgtgggaagaagggcttctgctacttcacagagttcagcaaccacatcaacctgaagctgaccacccagcccaagaagcagaagcacctgaagtactacctggtgagaaatgcccagggcaccctgaccaagggccccctcatctgctggaagggcagcgagttccgcagccggcagatcccagccagcacctgcagcagcagcctcttccctgccctggagagcacagctgccttccccagcgagcctgtgcccggcaccaaccccagcatcctgatgggcgcccagcaggccggccctgccagtgaccaccccagcctgaatgctgccatgggccctgctgtgttcaacgggaaggacagccccaagtgccagcagctggccaagaacaacctgctggccctgccccggcccagcgccctgggcatcctgagcaacagcggcccccccaagaagaggcacaagggctggagccctgagagccccagcgccccagatggcggctgcccccagggcggcggcaacagagccaagtatgagagcgctggcatgagctgtgtgccccaggtgggcctggtgggccctgcctctgtgaccttccctgtggtggccagcggggagcctgtgtctgtgcctgacaacctgctgaagatctgcaaggccaagcctgtgatcttcaagggccacggcaacttcccctacctgtgtggcaacctgaatgatgtggtggtgagccccctgctgtacacctgctaccagaacagccagagcgtgtcccgggcctatgagcagtacggggccagcgccatccagcccatcagcgaggagatgcagctgctgctgactgtgtactacctggtgcagctggcccaccagatcagaaatccagatgtgtag

SEQ ID NO: 154556 - DNA, 5850 bp, Artificial Sequence
  Description of Artificial Sequence: Synthetic coding sequence
atgggcaacagctatgccggccagctgaagaccaccaggtttgaggaggtgctgcacaacagcattgaggccagcctgcggagcaacaacctggtgccccggcccatcttcagccagctgtacctggaggccgagcagcagctggccgccctggagggcggcagccgggtggacaatgaggaggaggaggaggagggggagggcggcctggagaccaatggaccacccaaccccttccagctgcaccccctgcctgagggctgctgcaccacagatggcttctgccaggccggcaaggacctgcggctggtgtccatcagcaatgagcccatggatgtgcctgctggcttcctgctggtgggcgtgaagagccccagcctgcctgaccacctgctggtgtgtgctgtggacaagcgcttcctgcctgatgacaatggccacaatgccctgctgggcttcagcggcaactgtgtgggctgtgggaagaagggcttctgctacttcacagagttcagcaaccacatcaacctgaagctgaccacccagcccaagaagcagaagcacctgaagtactacctggtgagaaatgcccagggcaccctgaccaagggccccctcatctgctggaagggcagcgagttccgcagccggcagatcccagccagcacctgcagcagcagcctcttccctgccctggagagcacagctgccttccccagcgagcctgtgcccggcaccaaccccagcatcctgatgggcgcccagcaggccggccctgccagtgaccaccccagcctgaatgctgccatgggccctgctgtgttcaacgggaaggacagccccaagtgccagcagctggccaagaacaacctgctggccctgccccggcccagcgccctgggcatcctgagcaacagcggcccccccaagaagaggcacaagggctggagccctgagagccccagcgccccagatggcggctgcccccagggcggcggcaacagagccaagtatgagagcgctggcatgagctgtgtgccccaggtgggcctggtgggccctgcctctgtgaccttccctgtggtggccagcggggagcctgtgtctgtgcctgacaacctgctgaagatctgcaaggccaagcctgtgatcttcaagggccacggcaacttcccctacctgtgtggcaacctgaatgatgtggtggtgagccccctgctgtacacctgctaccagaacagccagagcgtgtcccgggcctatgagcagtacggggccagcgccatccagcccatcagcgaggagatgcagctgctgctgactgtgtactacctggtgcagctggccgctgaccaggtgcccctgatggaggacctggagcagatcttcctgcgctcctggagggagagccacctgacagagatccggcagtaccagcaggccccaccccagcccttccccccagcccccagcgctgctgcccctgtgaccagcgcccagctgccctggctggccagcctggccgccagcagctgcaatgattctgtgcacgtgattgaatgtgcctacagcctggccgagggcctgtctgagatgttccggctgctggtggagggcaagctggccaagaccaactacgtggtgatcatctgtgcctgccgctctgctgccatcgacagctgcatcgctgtgacaggcaagtaccaggcccgcatcctgtctgagagcctgctgaccccagctgagtaccagaaggaggtgaactatgagctggtgacaggcaaggtggacagcctgggcgccttcttcagcaccctgtgcccagagggggacatcgacatcctgctggacaagttccaccaggagaaccagggccacatcagcagcagcctggccgccagctctgtgaccaaggccgccagcctggatgtgtctggcacccctgtgtgcaccagctacaacctggagccccacagcatccggcccttccagctggccgtggcccagaagctgctgagccacgtgtgcagcattgctgacagcagcacccagaacctggacctgggcagctttgagaaggtggacttcctgatctgcatccccccatctgaggtgacctaccagcagaccctgctgcacgtgtggcacagcggcgtgctgctggagctgggcctgaagaaggagcacatgaccaagcagagggtggagcagtatgtgctgaagctggacacagaggcccagaccaagttcaaggccttcctgcagaacagcttccagaacccccacaccctgtttgtgctgattcatgaccacgcccactgggacctggtgagcagcacagtgcacaacctgtacagccagagcgaccccagcgtgggcctggtggaccggctgctgaactgccgggaggtgaaggaggcccccaacatcgtgaccctgcacgtgaccagcttcccctatgccctgcagacccagcacaccctcatcagcccctacaatgagatccactggccagccagctgcagcaatggagtggacctgtaccacgagaacaagaagtacttcggcctgtctgagttcatcgagagcaccctgagcggccacagcctgcccctgctgcgctatgacagcagctttgaggccatggtgacagccctgggcaagcgcttcccccggctgcacagcgctgtgatccgcacctttgtgctggtgcagcactacgccgccgccctgatggctgtgtctggcctgccccagatgaagaactacacctctgtggagaccctggagatcacccagaacctgctgaacagccccaagcagtgcccctgtggccacggcctgatggtgctgctgcgggtgccctgcagccccctggccgtggtggcctatgaaaggctggcccacgtgcgggcccggctggccctggaggagcactttgagatcatcctgggcagccccagcagtggagtgacagtgggcaagcactttgtgaagcagctgaggatgtggcagaagattgaagatgtggagtggaggccccagacctacctggagctggagggcctgccctgcatcctgatcttcagcggcatggacccccatggagagagcctgcccaggagcctgcgctactgtgacctgcggctcatcaacagcagctgcctggtgaggacagccctggagcaggagctgggcctggccgcctactttgtgtccaatgaggtgcccctggagaagggggccagaaatgaggccctggagagtgatgctgagaagctgagcagcacagacaatgaagatgaggagctgggcacagagggcagcaccagcgagaagaggagccccatgaagcgggagaggagccgcagccatgattctgccagcagcagcctgagcagcaaggccagcggcagcgccctgggcggggagagcagcgcccagcccacagccctgccccagggcgagcacgcccggagcccccagccccggggccctgctgaggagggccgggcccctggagagaagcagaggccccgggccagccagggccccccatctgccatcagccgccacagccctggccccaccccccagcctgactgcagcctgaggacaggccagaggtctgtgcaggtgtctgtgaccagcagctgcagccagctgagcagcagcagcggcagcagcagcagctctgtggccccagctgctggcacctgggtgctgcaggccagccagtgcagcctgaccaaggcctgccggcagccccccatcgtgttcctgcccaagctggtgtatgacatggtggtgtccacagacagcagcggcctgcccaaggccgccagcctgctgcccagccccagcgtgatgtgggccagcagcttccggcccctgctgagcaagaccatgaccagcacagagcagagcctgtactaccggcagtggacagtgccccggcccagccacatggactatggcaacagagctgagggccgggtggatggcttccacccccggcggctgctgctgagcggccccccccagatcggcaagacaggagcctacctgcagttcctgtctgtgctgagcaggatgctggtgcggctgacagaggtggatgtgtatgatgaggaggagatcaacatcaacctgcgggaggagagtgactggcactacctgcagctgagtgacccctggccagacctggagctgttcaagaagctgccctttgactacatcatccatgaccccaagtatgaagatgccagcctcatctgcagccactaccagggcatcaagtcagaagatcggggcatgagcaggaagccagaggacctgtatgtgcggcggcagacagccaggatgaggctgagcaaatatgctgcctacaacacctaccaccactgtgagcagtgccaccagtacatgggcttccacccccgctaccagctgtatgagagcaccctgcacgcctttgccttctcctacagcatgctgggggaggagatccagctgcacttcatcatccccaagagcaaggagcaccactttgtgttcagccagcccggcggccagctggagagcatgaggctgcccctggtgacagacaagagccatgagtacatcaagagccccaccttcacccccaccaccggcagacatgagcacggcctcttcaacctgtaccacgccatggatggagccagccacctgcacgtgctggtggtgaaggagtatgagatggccatctacaagaagtactggcccaaccacatcatgctggtgctgcccagcatcttcaacagcgctggggtgggcgccgcccacttcctgatcaaggagctgagctaccacaacctggagctggagaggaaccggcaggaggagctgggcatcaagccccaggacatctggcccttcatcgtcatcagtgatgacagctgtgtgatgtggaatgtggtggatgtgaacagcgctggggagaggagccgggagttctcctggagcgagagaaatgtgtccctgaagcacatcatgcagcacatcgaggccgccccagacatcatgcactacgccctgctgggcctgaggaagtggagcagcaagacccgggccagcgaggtgcaggagcccttcagccgctgccacgtgcacaacttcatcatcctgaatgtggacctgacccagaatgtgcagtacaaccagaaccgcttcctgtgtgatgatgtggacttcaacctgcgggtgcacagcgctggcctgctgctgtgccgcttcaaccgcttctctgtgatgaagaagcagatcgtggtgggcggccacaggagcttccacatcaccagcaaggtgtctgacaacagcgctgctgtggtgcctgcccagtacatctgtgccccagacagcaagcacaccttcctggccgccccagcccagctgctgctggagaagttcctgcagcaccacagccacctgttcttccccctgagcctgaagaaccacgaccaccctgtgctgtctgtggactgctacctgaacctgggcagccagatctctgtgtgctacgtgagcagccggccccacagcctgaacatcagctgcagcgacctgctcttcagcggcctgctgctgtacctgtgtgacagctttgtgggcgccagcttcctgaagaagttccacttcctgaagggggccaccctgtgtgtgatctgccaggacaggagcagcctgcggcagacagtggtgcggctggagctggaggatgagtggcagttccggctgagagatgagttccagacagccaatgccagagaagatcggcccctcttcttcctgaccggccgccacatctag

SEQ ID NO: 154557 - DNA, 1188 bp, Artificial Sequence
  Description of Artificial Sequence: Synthetic coding sequence
atgaccctgcggcggctgaggaagctgcagcagaaggaggaggccgccgccaccccagaccctgctgcccggaccccagacagcgaggtggccccagctgcccctgtgcccaccccaggccccccagctgctgctgccaccccaggccccccagcagatgagctgtatgctgccctggaggactaccaccctgctgagctgtaccgggccctggccgtgtctgggggcaccctgcccaggaggaagggcagcggcttccgctggaagaacctgagccagagccctgagcagcagaggaaggtgctgaccctggagaaggaggacaaccagaccttcggctttgagatccagacctacggcctgcaccaccgggaggagcagagggtggagatggtgacctttgtgtgccgggtgcatgagagcagccctgcccagctggccggcctgacccctggggacaccatcgcctctgtgaatggcctgaatgtggagggcatccgccaccgggagatcgtggacatcatcaaggccagcggaaatgtgctgcggctggagaccctgtatggcaccagcatcaggaaggccgagctggaggcccggctgcagtacctgaagcagaccctgtatgagaagtggggcgagtaccgcagcctgatggtgcaggagcagaggctggtgcacggcctggtggtgaaggaccccagcatctatgacaccctggagagcgtgcgcagctgcctgtatggagctggcctgctgcccggcagcctgcccttcggccccctgctggccgtgcccggccggccccggggcggggcccggcgggcccggggagatgctgatgatgctgtgtaccacacctgcttcttcggggacagcgagcccccagccctgcccccacctcctcctccagcccgggccttcggccctggccctgctgagaccccagctgtgggccctggccctggcccccgggccgccctgagccgcagcgcctctgtgcgctgtgccggccctgggggcggcggcggcggcggggcccctggggccctgtggacagaggcccgggagcaggccctgtgtggccctggcctgaggaagaccaagtaccgctccttcagaagaaggctgctgaagttcatccctggcctgaacagaagcctggaggaggaggagagccagctgtag

SEQ ID NO: 154558 - DNA, 759 bp, Artificial Sequence
  Description of Artificial Sequence: Synthetic coding sequence
atgaccctgctgcccagcaaaggaggagacaccatcgcctctgtgaatggcctgaatgtggagggcatccgccaccgggagatcgtggacatcatcaaggccagcggaaatgtgctgcggctggagaccctgtatggcaccagcatcaggaaggccgagctggaggcccggctgcagtacctgaagcagaccctgtatgagaagtggggcgagtaccgcagcctgatggtgcaggagcagaggctggtgcacggcctggtggtgaaggaccccagcatctatgacaccctggagagcgtgcgcagctgcctgtatggagctggcctgctgcccggcagcctgcccttcggccccctgctggccgtgcccggccggccccggggcggggcccggcgggcccggggagatgctgatgatgctgtgtaccacacctgcttctttggagacagcgagcccccagccctgcccccacctcctcctccagcccgggcctttggacctggccctgctgagaccccagctgtgggccctggccctggccccagggctgccctgagccgcagcgcctctgtgcgctgtgccggccctgggggcggcggcggcggcggggcccctggggccctgtggacagaggcccgggagcaggccctgtgtggccctggcctgaggaagaccaagtaccgctccttcagaagaaggctgctgaagttcatccctggcctgaacagaagcctggaggaggaggagagccagctgtag

SEQ ID NO: 154559 - DNA, 759 bp, Artificial Sequence; identical to SEQ ID NO: 154558
  Description of Artificial Sequence: Synthetic coding sequence

SEQ ID NO: 154560 - DNA, 654 bp, Artificial Sequence
  Description of Artificial Sequence: Synthetic coding sequence
atggccgcccagtgtgtgcggctggcccggcgcagcctgcctgccctggccctgagcctgcggcccagcccccggctgctgtgcacagccaccaagcagaagaacagcggccagaacctggaggaggacatgggccagagcgagcagaaggctgaccccccagccacagagaagaccctgctggaggagaaggtgaagctggaggagcagctgaaggagaccgtggagaagtacaagagggccctggccgacacagagaacctgcggcagaggagccagaagctggtggaggaggccaagctgtatggcatccaggccttctgcaaggacctgctggaggtggctgatgtgctggagaaggccacccagtgtgtgcccaaggaggagatcaaggatgacaacccccacctgaagaacctgtatgagggcctggtgatgacagaggtgcagatccagaaggtgttcaccaagcacggcctgctgaagctgaaccctgtgggcgccaagtttgacccctatgaacatgaggccctcttccacacccctgtggagggcaaggagcccggcaccgtggccctggtgtccaaggtgggctacaagctgcacggccgcaccctgcggcctgccctggtgggcgtggtgaaggaggcctag

SEQ ID NO: 154561 - DNA, 591 bp, Artificial Sequence
  Description of Artificial Sequence: Synthetic coding sequence
atggccgcccagtgtgtgcggctggcccggcgcagcctgcctgccctggccctgagcctgcggcccagcccccggctgctgtgcacagccaccaagcagaagaacagcggccagaacctggaggaggacatgggccagagcgagcagctgaaggagaccgtggagaagtacaagagggccctggccgacacagagaacctgcggcagaggagccagaagctggtggaggaggccaagctgtatggcatccaggccttctgcaaggacctgctggaggtggctgatgtgctggagaaggccacccagtgtgtgcccaaggaggagatcaaggatgacaacccccacctgaagaacctgtatgagggcctggtgatgacagaggtgcagatccagaaggtgttcaccaagcacggcctgctgaagctgaaccctgtgggcgccaagtttgacccctatgagcacgaggccctcttccacacccctgtggagggcaaggagcccggcaccgtggccctggtgtccaaggtgggctacaagctgcacggccgcaccctgcggcctgccctggtgggcgtggtgaaggaggcctag

SEQ ID NO: 154562 - DNA, 2880 bp, Artificial Sequence
  Description of Artificial Sequence: Synthetic coding sequence
atggccctgctgggcaagagatgtgatgtgcccaccaacggctgcggccctgaccgctggaacagcgccttcaccaggaaggatgagatcatcaccagcctggtgtctgccctggacagcatgtgcagcgccctgagcaagctgaatgctgaggtggcctgtgtggccgtgcatgatgaaagtgcctttgtggtgggcacagagaagggccgcatgttcctgaatgccaggaaggagctgcagagcgacttcctgcgcttctgccggggccccccctggaaggaccctgaggccgagcaccccaagaaggtgcagagaggagagggcggcggccgcagcctgcccaggagcagcctggagcacggcagtgatgtgtacctgctgaggaagatggtggaggaggtgtttgatgtgctgtacagcgaggccctgggccgggcctctgtggtgcccctgccctatgaaaggctgctgcgggagcccggcctgctggccgtgcagggcctgcctgagggcctggccttccggcggccagcagaatatgaccccaaggccctgatggccatcctggagcacagccaccgcatccgcttcaagctgaagaggcccctggaggatggcggccgggacagcaaggccctggtggagctgaatggagtgtccctcatccccaagggcagccgggactgtggcctgcacggccaggcccccaaggtgcccccccaggacctgcccccaacagccaccagcagctccatggccagcttcctgtacagcacagccctgcccaaccacgccatccgggagctgaagcaggaggcccccagctgccccctggcccccagcgacctgggcctgagccggcccatgcctgagcccaaggccaccggggcccaggacttcagtgactgctgcggccagaagcccaccggccctgggggccccctcatccagaatgtgcacgccagcaagaggatcctcttcagcatcgtgcatgacaagtctgagaagtgggatgccttcatcaaggagacagaggacatcaacaccctgagagaatgtgtgcagatcctcttcaacagccgctatgcagaggccctgggcctggaccacatggtgcctgtgccctacaggaagatcgcctgtgaccctgaggccgtggagatcgtgggcatcccagacaagatccccttcaagaggccctgcacctacggcgtgcccaagctgaagaggatcctggaggagcggcacagcatccacttcatcatcaagaggatgtttgatgagcgcatcttcaccggcaacaagttcaccaaggacaccaccaagctggagcccgccagccccccagaggacaccagcgctgaggtgtcccgggccaccgtgctggacctggccggaaatgcccggagtgacaagggctccatgtctgaggactgtggccctggcaccagcggggagctgggcggcctgcggcccatcaagattgagcctgaggacctggacatcatccaggtgacagtgcctgaccccagccccaccagcgaggagatgacagacagcatgcctggccacctgcccagtgaagattctggctacggcatggagatgctgacagacaagggcctgtctgaagatgcccggcctgaggagaggcctgtggaggacagccatggagatgtgatccggcccctgaggaagcaggtggagctgctcttcaacaccaggtatgccaaggccatcggcatcagcgagcctgtgaaggtgccctacagcaagttcctgatgcaccctgaggagctgtttgtggtgggcctgcctgagggcatcagcctgcggcggcccaactgcttcggcatcgccaagctgaggaagatcctggaggccagcaacagcatccagtttgtgatcaagaggcctgagctgctgacagagggcgtgaaggagcccatcatggacagccagggcacagccagcagcctgggcttcagccccccagccctgcccccagagcgggacagcggggaccccctggtggatgagagcctgaagaggcagggcttccaggagaactatgatgcccggctgagcagaattgatattgccaacaccctgcgggagcaggtgcaggacctcttcaacaagaagtatggagaggccctgggcatcaagtaccctgtgcaggtgccctacaagaggatcaagagcaaccctggcagcgtcatcatcgagggcctgcccccaggcatccccttcaggaagccctgcaccttcggcagccagaacctggagcgcatcctggccgtggccgacaagatcaagttcaccgtgacccggcccttccagggcctcatccccaagccagatgaagatgatgccaaccggctgggggagaaggtgatcctgcgggagcaggtgaaggagctgttcaatgagaagtacggggaggccctgggcctgaacagacctgtgctggtgccctacaagctgatccgggacagcccagatgctgtggaggtgacaggcctgcctgatgacatccccttcaggaaccccaacacctatgacatccaccggctggagaagatcctgaaggcccgggagcacgtgaggatggtgatcatcaaccagctgcagccctttgctgagatctgcaatgatgccaaggtgcctgccaaggacagcagcatccccaagaggaagaggaagagggtgtctgagggcaacagcgtgagcagcagcagcagcagcagcagcagcagcagcagcaacccagattctgtggccagcgccaaccagatcagcctggtgcagtggcccatgtacatggtggactatgccggcctgaatgtgcagctgcccggccccctgaactactag

SEQ ID NO: 154563 - DNA, 2835 bp, Artificial Sequence
  Description of Artificial Sequence: Synthetic coding sequence
atggccctgctgggcaagagatgtgatgtgcccaccaacggctgcggccctgaccgctggaacagcgccttcaccaggaaggatgagatcatcaccagcctggtgtctgccctggacagcatgtgcagcgccctgagcaagctgaatgctgaggtggcctgtgtggccgtgcatgatgaaagtgcctttgtggtgggcacagagaagggccgcatgttcctgaatgccaggaaggagctgcagagcgacttcctgcgcttctgccggggccccccctggaaggaccctgaggccgagcaccccaagaaggtgcagagaggagagggcggcggccgcagcctgcccaggagcagcctggagcacggcagtgatgtgtacctgctgaggaagatggtggaggaggtgtttgatgtgctgtacagcgaggccctgggccgggcctctgtggtgcccctgccctatgaaaggctgctgcgggagcccggcctgctggccgtgcagggcctgcctgagggcctggccttccggcggccagcagaatatgaccccaaggccctgatggccatcctggagcacagccaccgcatccgcttcaagctgaagaggcccctggaggatggcggccgggacagcaaggccctggtggagctgaatggagtgtccctcatccccaagggcagccgggactgtggcctgcacggccaggcccccaaggtgcccccccaggacctgcccccaacagccaccagcagctccatggccagcttcctgtacagcacagccctgcccaaccacgccatccgggagctgaagcaggaggcccccagctgccccctggcccccagcgacctgggcctgagccggcccatgcctgagcccaaggccaccggggcccaggacttcagtgactgctgcggccagaagcccaccggccctgggggccccctcatccagaatgtgcacgccagcaagaggatcctcttcagcatcgtgcatgacaagtctgagaagtgggatgccttcatcaaggagacagaggacatcaacaccctgagagaatgtgtgcagatcctcttcaacagccgctatgcagaggccctgggcctggaccacatggtgcctgtgccctacaggaagatcgcctgtgaccctgaggccgtggagatcgtgggcatcccagacaagatccccttcaagaggccctgcacctacggcgtgcccaagctgaagaggatcctggaggagcggcacagcatccacttcatcatcaagaggatgtttgatgagcgcatcttcaccggcaacaagttcaccaaggacaccaccaagctggagcccgccagccccccagaggacaccagcgctgaggtgtcccgggccaccgtgctggacctggccggaaatgcccggagtgacaagggctccatgtctgaggactgtggccctggcaccagcggggagctgggcggcctgcggcccatcaagattgagcctgaggacctggacatcatccaggtgacagtgcctgaccccagccccaccagcgaggagatgacagacagcatgcctggccacctgcccagtgaagattctggctacggcatggagatgctgacagacaagggcctgtctgaagatgcccggcctgaggagaggcctgtggaggacagccatggagatgtgatccggcccctgaggaagcaggtggagctgctcttcaacaccaggtatgccaaggccatcggcatcagcgagcctgtgaaggtgccctacagcaagttcctgatgcaccctgaggagctgtttgtggtgggcctgcctgagggcatcagcctgcggcggcccaactgcttcggcatcgccaagctgaggaagatcctggaggccagcaacagcatccagtttgtgatcaagaggcctgagctgctgacagagggcgtgaaggagcccatcatggacagccaggagcgggacagcggggaccccctggtggatgagagcctgaagaggcagggcttccaggagaactatgatgcccggctgagcagaattgacatcgccaacaccctgcgggagcaggtgcaggacctcttcaacaagaagtacggggaggccctgggcatcaagtaccctgtgcaggtgccctacaagaggatcaagagcaaccctggcagcgtcatcatcgagggcctgcccccaggcatccccttcaggaagccctgcaccttcggcagccagaacctggagcgcatcctggccgtggccgacaagatcaagttcaccgtgacccggcccttccagggcctcatccccaagccagatgaagatgatgccaaccggctgggggagaaggtgatcctgcgggagcaggtgaaggagctgttcaatgagaagtatggagaggccctgggcctgaacagacctgtgctggtgccctacaagctgatccgggacagcccagatgctgtggaggtgacaggcctgcctgatgacatccccttcaggaaccccaacacctatgacatccaccggctggagaagatcctgaaggcccgggagcacgtgaggatggtgatcatcaaccagctgcagccctttgctgagatctgcaatgatgccaaggtgcctgccaaggacagcagcatccccaagaggaagaggaagagggtgtctgagggcaacagcgtgagcagcagcagcagcagcagcagcagcagcagcagcaacccagacagcgtggccagcgccaaccagatcagcctggtgcagtggcccatgtacatggtggactatgccggcctgaatgtgcagctgcccggccccctgaactactag

SEQ ID NO: 154564 - DNA, 2931 bp, Artificial Sequence
  Description of Artificial Sequence: Synthetic coding sequence
atggccctgctgggcaagagatgtgatgtgcccaccaacggctgcggccctgaccgctggaacagcgccttcaccaggaaggatgagatcatcaccagcctggtgtctgccctggacagcatgtgcagcgccctgagcaagctgaatgctgaggtggcctgtgtggccgtgcatgatgaaagtgcctttgtggtgggcacagagaagggccgcatgttcctgaatgccaggaaggagctgcagagcgacttcctgcgcttctgcctgtctgctgcccagcaccgggccgccaccagccagctggagggccgggtggtgagaagagtgctgactgtggccagccgggccctgtgccccaccggcggccccccctggaaggaccctgaggccgagcaccccaagaaggtgcagagaggagagggcggcggccgcagcctgcccaggagcagcctggagcacggcagtgatgtgtacctgctgaggaagatggtggaggaggtgtttgatgtgctgtacagcgaggccctgggccgggcctctgtggtgcccctgccctatgaaaggctgctgcgggagcccggcctgctggccgtgcagggcctgcctgagggcctggccttccggcggccagcagaatatgaccccaaggccctgatggccatcctggagcacagccaccgcatccgcttcaagctgaagaggcccctggaggatggcggccgggacagcaaggccctggtggagctgaatggagtgtccctcatccccaagggcagccgggactgtggcctgcacggccaggcccccaaggtgcccccccaggacctgcccccaacagccaccagcagctccatggccagcttcctgtacagcacagccctgcccaaccacgccatccgggagctgaagcaggaggcccccagctgccccctggcccccagcgacctgggcctgagccggcccatgcctgagcccaaggccaccggggcccaggacttcagtgactgctgcggccagaagcccaccggccctgggggccccctcatccagaatgtgcacgccagcaagaggatcctcttcagcatcgtgcatgacaagtctgagaagtgggatgccttcatcaaggagacagaggacatcaacaccctgagagaatgtgtgcagatcctcttcaacagccgctatgcagaggccctgggcctggaccacatggtgcctgtgccctacaggaagatcgcctgtgaccctgaggccgtggagatcgtgggcatcccagacaagatccccttcaagaggccctgcacctacggcgtgcccaagctgaagaggatcctggaggagcggcacagcatccacttcatcatcaagaggatgtttgatgagcgcatcttcaccggcaacaagttcaccaaggacaccaccaagctggagcccgccagccccccagaggacaccagcgctgaggtgtcccgggccaccgtgctggacctggccggaaatgcccggagtgacaagggctccatgtctgaggactgtggccctggcaccagcggggagctgggcggcctgcggcccatcaagattgagcctgaggacctggacatcatccaggtgacagtgcctgaccccagccccaccagcgaggagatgacagacagcatgcctggccacctgcccagtgaagattctggctacggcatggagatgctgacagacaagggcctgtctgaagatgcccggcctgaggagaggcctgtggaggacagccatggagatgtgatccggcccctgaggaagcaggtggagctgctcttcaacaccaggtatgccaaggccatcggcatcagcgagcctgtgaaggtgccctacagcaagttcctgatgcaccctgaggagctgtttgtggtgggcctgcctgagggcatcagcctgcggcggcccaactgcttcggcatcgccaagctgaggaagatcctggaggccagcaacagcatccagtttgtgatcaagaggcctgagctgctgacagagggcgtgaaggagcccatcatggacagccaggagcgggacagcggggaccccctggtggatgagagcctgaagaggcagggcttccaggagaactatgatgcccggctgagcagaattgacatcgccaacaccctgcgggagcaggtgcaggacctcttcaacaagaagtacggggaggccctgggcatcaagtaccctgtgcaggtgccctacaagaggatcaagagcaaccctggcagcgtcatcatcgagggcctgcccccaggcatccccttcaggaagccctgcaccttcggcagccagaacctggagcgcatcctggccgtggccgacaagatcaagttcaccgtgacccggcccttccagggcctcatccccaagccagatgaagatgatgccaaccggctgggggagaaggtgatcctgcgggagcaggtgaaggagctgttcaatgagaagtatggagaggccctgggcctgaacagacctgtgctggtgccctacaagctgatccgggacagcccagatgctgtggaggtgacaggcctgcctgatgacatccccttcaggaaccccaacacctatgacatccaccggctggagaagatcctgaaggcccgggagcacgtgaggatggtgatcatcaaccagctgcagccctttgctgagatctgcaatgatgccaaggtgcctgccaaggacagcagcatccccaagaggaagaggaagagggtgtctgagggcaacagcgtgagcagcagcagcagcagcagcagcagcagcagcagcaacccagacagcgtggccagcgccaaccagatcagcctggtgcagtggcccatgtacatggtggactatgccggcctgaatgtgcagctgcccggccccctgaactactag

SEQ ID NO: 154565 - DNA, 609 bp, Artificial Sequence
  Description of Artificial Sequence: Synthetic coding sequence
atgagctgtgtgccctggaagggggacaaggccaagtctgagagcctggagctgccccaggccgccccaccccagatctaccacgagaagcagaggcgggagctgtgtgccctgcacgccctgaacaacgtgttccaggacagcaatgccttcacccgggacaccctgcaggagatcttccagaggctgagccccaacaccatggtgaccccccacaagaagtccatgctgggcaatggaaattatgatgtgaatgtcatcatggccgccctgcagaccaagggctatgaggccgtgtggtgggacaagagaagagatgtgggcgtcatcgccctgaccaacgtgatgggcttcatcatgaacctgcccagcagcctgtgctggggccccctgaagctgcccctgaagaggcagcactggatctgtgtgcgggaggtgggcggggcctactacaacctggacagcaagctgaagatgcctgagtggattggaggagagagcgagctgaggaagttcctgaagcaccacctgcggggcaagaactgtgagctgctgctggtggtgcctgaggaggtggaggcccaccagagctggaggacagatgtgtag

SEQ ID NO: 154566 - DNA, 1545 bp, Artificial Sequence
  Description of Artificial Sequence: Synthetic coding sequence
atgaagtggaggctgcaggagggccgcggggaggccgtgtaccagatcggcgtggaggacaatggcctgctggtgggcctggccgaggaggagatgagggccagcctgaagaccctgcacaggatggccgagaaggtgggcgctgacatcaccgtgctgcgggagcgggaggtggactatgacagcgacatgcccaggaagatcacagaggtgctggtgaggaaggtgcctgacaaccagcagttcctggacctgcgggtggccgtgctgggcaatgtggacagcggcaagagcaccctgctgggcgtgctgacccagggcgagctggacaatggccggggccgggcccggctgaacctcttccgccacctgcacgagatccagagcggccgcaccagcagcatcagctttgagatcctgggcttcaacagcaaaggagaggtggtgaactacagcgacagcaggacagctgaggagatctgtgagagcagcagcaagatgatcaccttcatcgacctggccggccaccacaagtacctgcacaccaccatcttcggcctgaccagctactgcccagactgtgccctgctgctggtgtctgccaacacaggaattgctggcaccacccgggagcacctgggcctggccctggccctgaaggtgcccttcttcatcgtggtgtccaagattgacctgtgtgccaagaccaccgtggagaggacagtgcggcagctggagcgggtgctgaagcagcccggctgccacaaggtgcccatgctggtgaccagtgaagatgatgctgtgacagctgcccagcagtttgcccagagccccaacgtgacccccatcttcaccctgagctctgtgtctggagagagcctggacctgctgaaggtgttcctgaacatcctgccccccctgaccaacagcaaggagcaggaggagctgatgcagcagctgacagagttccaggtggatgagatctacacagtgcctgaggtgggcaccgtggtgggcggcaccctgagcagcggcatctgccgggagggggaccagctggtggtgggccccacagatgatggctgcttcctggagctgcgggtgtgcagcatccagaggaacagaagtgcctgccgggtgctgcgggccggccaggccgccaccctggccctgggggactttgaccgggccctgctgaggaagggcatggtgatggtgtccccagagatgaaccccaccatctgcagcgtgtttgaggccgagatcgtgctgctcttccacgccaccaccttccggcggggcttccaggtgacagtgcacgtgggcaatgtgcggcagacagctgtggtggagaagatccacgccaaggacaagctgaggactggagagaaggctgtggtgcgcttccgcttcctgaagcaccctgagtacctgaaggtgggcgccaagctgctcttccgggagggcgtgaccaagggcatcggccacgtgacagatgtgcaggccatcacagctggggaggcccaggccaacatgggcttctag

SEQ ID NO: 154567 - DNA, 1809 bp, Artificial Sequence
  Description of Artificial Sequence: Synthetic coding sequence
atggacagccgggtgtctgagctgtttggaggctgctgcaggcctgggggcggccctgctgtgggcggcaccctgaaggcccggggggccggcagcagcagcggctgcggcggccccaagggcaagaagaagaatggaagaaacagaggaggcaaggccaacaaccccccctacctgcccccagaggccgaggatggcaacatcgagtacaagctgaagctggtgaaccccagccagtacagatttgagcacctggtgacccagatgaagtggaggctgcaggagggccgcggggaggccgtgtaccagatcggcgtggaggacaatggcctgctggtgggcctggccgaggaggagatgagggccagcctgaagaccctgcacaggatggccgagaaggtgggcgctgacatcaccgtgctgcgggagcgggaggtggactatgacagcgacatgcccaggaagatcacagaggtgctggtgaggaaggtgcctgacaaccagcagttcctggacctgcgggtggccgtgctgggcaatgtggacagcggcaagagcaccctgctgggcgtgctgacccagggcgagctggacaatggccggggccgggcccggctgaacctcttccgccacctgcacgagatccagagcggccgcaccagcagcatcagctttgagatcctgggcttcaacagcaaaggagaggtggtgaactacagcgacagcaggacagctgaggagatctgtgagagcagcagcaagatgatcaccttcatcgacctggccggccaccacaagtacctgcacaccaccatcttcggcctgaccagctactgcccagactgtgccctgctgctggtgtctgccaacacaggaattgctggcaccacccgggagcacctgggcctggccctggccctgaaggtgcccttcttcatcgtggtgtccaagattgacctgtgtgccaagaccaccgtggagaggacagtgcggcagctggagcgggtgctgaagcagcccggctgccacaaggtgcccatgctggtgaccagtgaagatgatgctgtgacagctgcccagcagtttgcccagagccccaacgtgacccccatcttcaccctgagctctgtgtctggagagagcctggacctgctgaaggtgttcctgaacatcctgccccccctgaccaacagcaaggagcaggaggagctgatgcagcagctgacagagttccaggtggatgagatctacacagtgcctgaggtgggcaccgtggtgggcggcaccctgagcagcggcatctgccgggagggggaccagctggtggtgggccccacagatgatggctgcttcctggagctgcgggtgtgcagcatccagaggaacagaagtgcctgccgggtgctgcgggccggccaggccgccaccctggccctgggggactttgaccgggccctgctgaggaagggcatggtgatggtgtccccagagatgaaccccaccatctgcagcgtgtttgaggccgagatcgtgctgctcttccacgccaccaccttccggcggggcttccaggtgacagtgcacgtgggcaatgtgcggcagacagctgtggtggagaagatccacgccaaggacaagctgaggactggagagaaggctgtggtgcgcttccgcttcctgaagcaccctgagtacctgaaggtgggcgccaagctgctcttccgggagggcgtgaccaagggcatcggccacgtgacagatgtgcaggccatcacagctggggaggcccaggccaacatgggcttctag

SEQ ID NO: 154568 - DNA, 735 bp, Artificial Sequence
  Description of Artificial Sequence: Synthetic coding sequence
atgaagtggaggctgcaggagggccgcggggaggccatcttcaccctgagctctgtgtctggagagagcctggacctgctgaaggtgttcctgaacatcctgccccccctgaccaacagcaaggagcaggaggagctgatgcagcagctgacagagttccaggtggatgagatctacacagtgcctgaggtgggcaccgtggtgggcggcaccctgagcagcggcatctgccgggagggggaccagctggtggtgggccccacagatgatggctgcttcctggagctgcgggtgtgcagcatccagaggaacagaagtgcctgccgggtgctgcgggccggccaggccgccaccctggccctgggggactttgaccgggccctgctgaggaagggcatggtgatggtgtccccagagatgaaccccaccatctgcagcgtgtttgaggccgagatcgtgctgctcttccacgccaccaccttccggcggggcttccaggtgacagtgcacgtgggcaatgtgcggcagacagctgtggtggagaagatccacgccaaggacaagctgaggactggagagaaggctgtggtgcgcttccgcttcctgaagcaccctgagtacctgaaggtgggcgccaagctgctcttccgggagggcgtgaccaagggcatcggccacgtgacagatgtgcaggccatcacagctggggaggcccaggccaacatgggcttctag

SEQ ID NO: 154569 - DNA, 462 bp, Artificial Sequence
  Description of Artificial Sequence: Synthetic coding sequence
tgaggcatctgccgggagggggaccagctggtggtgggccccacagatgatggctgcttcctggagctgcgggtgtgcagcatccagaggaacagaagtgcctgccgggtgctgcgggccggccaggccgccaccctggccctgggggactttgaccgggccctgctgaggaagggcatggtgatggtgtccccagagatgaaccccaccatctgcagcgtgtttgaagctgagatcgtgctgctcttccacgccaccaccttcagaagaggcttccaggtgacagtgcacgtgggcaatgtgcggcagacagctgtggtggagaagatccacgccaaggacaagctgaggactggagagaaggctgtggcccgggagcggggcgtgctgagcgccacctgcagcctgcccaccttctggaggggggccaagctgggcgtggccaggaagggccagagctag

SEQ ID NO: 154570 - DNA, 465 bp, Artificial Sequence
  Description of Artificial Sequence: Synthetic coding sequence
tgaggcatctgccgggagggggaccagctggtggtgggccccacagatgatggctgcttcctggagctgcgggtgtgcagcatccagaggaacagaagtgcctgccgggtgctgcgggccggccaggccgccaccctggccctgggggactttgaccgggccctgctgaggaagggcatggtgatggtgtccccagagatgaaccccaccatctgcagcgtgtttgaagctgagatcgtgctgctcttccacgccaccaccttcagaagaggcttccaggtgacagtgcacgtgggcaatgtgcggcagacagctgtggtggagaagatccacgccaaggtgcggggcacctggcccagcatcagccctgaggtgaggaaggagggcggcctgccccagacaggccgggagctgctggaccccaccatgggcatcaagccccacctgggctgggtggccgcctag

SEQ ID NO: 154571 - DNA, 543 bp, Artificial Sequence
  Description of Artificial Sequence: Synthetic coding sequence
atgcagcagctgacagagttccaggtggatgagatctacacagtgcctgaggtgggcaccgtggtgggcggcaccctgagcagcggcatctgccgggagggggaccagctggtggtgggccccacagatgatggctgcttcctggagctgcgggtgtgcagcatccagaggaacagaagtgcctgccgggtgctgcgggccggccaggccgccaccctggccctgggggactttgaccgggccctgctgaggaagggcatggtgatggtgtccccagagatgaaccccaccatctgcagcgtgtttgaggccgagatcgtgctgctcttccacgccaccaccttccggcggggcttccaggtgacagtgcacgtgggcaatgtgcggcagacagctgtggtggagaagatccacgccaaggacaagctgaggactggagagaaggctgtggcccgggagcggggcgtgctgagcgccacctgcagcctgcccaccttctggaggggggccaagctgggcgtggccaggaagggccagagctag

SEQ ID NO: 154572 - DNA, 951 bp, Artificial Sequence
  Description of Artificial Sequence: Synthetic coding sequence
tgacagggcggcggggcccgggaggagaacaccagcttccgcagccgggacccccgggaggagggccagaggctggacagccaggccgaggatggcaacatcgagtacaagctgaagctggtgaaccccagccagtacagatttgagcacctggtgacccagatgaagtggaggctgcaggagggccgcggggaggccgtgtaccagatcggcgtggaggacaatggcctgctggtgggcctggccgaggaggagatgagggccagcctgaagaccctgcacaggatggccgagaaggtgggcgctgacatcaccgtgctgcgggagcgggaggtggactatgacagcgacatgcccaggaagatcacagaggtgctggtgaggaaggtgcctgacaaccagcagttcctggacctgcgggtggccgtgctgggcaatgtggacagcggcaagagcaccctgctgggcgtgctgacccagggcgagctggacaatggccggggccgggcccggctgaacctcttccgccacctgcacgagatccagagcggccgcaccagcagcatcagctttgagatcctgggcttcaacagcaaaggagaggtggtgaactacagcgacagcaggacagctgaggagatctgtgagagcagcagcaagatgatcaccttcatcgacctggccggccaccacaagtacctgcacaccaccatcttcggcctgaccagctactgcccagactgtgccctgctgctggtgtctgccaacacaggaattgctggcaccacccgggagcacctgggcctggccctggccctgaaggtgcccttcttcatcgtggtgtccaagattgacctgtgtgccaagaccaccgtggagaggacagtgcggcagctggagcgggtgctgaagcagcccggctgccacaaggtgcccatgctggtgacctag

SEQ ID NO: 154573 - DNA, 684 bp, Artificial Sequence
  Description of Artificial Sequence: Synthetic coding sequence
atggacagccgggtgtctgagctgtttggaggctgctgcaggcctgggggcggccctgctgtgggcggcaccctgaaggcccggggggccggcagcagcagcggctgcggcggccccaagggcaagaagaagaatggaagaaacagaggaggcaaggccaacaaccccccctacctgcccccagaggccgaggatggcaacatcgagtacaagtacagatttgagcacctggtgacccagatgaagtggaggctgcaggagggccgcggggaggccgtgtaccagatcggcgtggaggacaatggcctgctggtgggcctggccgaggaggagatgagggccagcctgaagaccctgcacaggatggccgagaaggtgggcgctgacatcaccgtgctgcgggagcgggaggtggactatgacagcgacatgcccaggaagatcacagaggtgctggtgaggaaggtgcctgacaaccagcagttcctggacctgcgggtggccgtgctgggcaatgtggacagcggcaagagcaccctgctgggcgtgctgacccagggcgagctggacaatggccggggccgggcccggctgaacctcttccgccacctgcacgagatccagagcggccgcaccagcagcatcagctttgagatcctgggcttcaacagcaaaggagagtag

SEQ ID NO: 154574 - DNA, 1221 bp, Artificial Sequence
  Description of Artificial Sequence: Synthetic coding sequence
atggccccagcccgctgcttcagcgcccggctgaggacagtgttccagggcgtgggccactgggccctgagcacctgggccggcctgaagcccagccggctgctgccccagagggccagcccccggctgctgtctgtgggccgggctgacctggccaagcaccaggagctgcccgggaagaagctgctgtctgagaagaagctgaagcgctactttgtggactaccgccgggtgctggtgtgtggcggcaatggaggagctggggccagctgcttccacagcgagcccaggaaggagtttggaggcccagatggaggagatggcggcaatggaggccacgtgatcctgcgggtggaccagcaggtgaagagcctgagctctgtgctgagccgctaccagggcttcagcggggaggatggcggcagcaagaactgcttcggccgctctggagctgtgctgtacatccgggtgcctgtgggcaccctggtgaaggagggcggccgggtggtggccgacctgagctgtgtgggagatgagtacatcgccgccctgggcggggccggcggcaagggcaaccgcttcttcctggccaacaacaacagagcccctgtgacctgcaccccaggccagcccggccagcagagggtgctgcacctggagctgaagacagtggcccatgctggcatggtgggcttccccaatgccggcaagagcagcctgctgcgggccatcagcaatgcccggcctgctgtggccagctaccccttcaccaccctgaagccccacgtgggcatcgtgcactatgagggccacctgcagattgctgtggccgacatccctggcatcatccggggggcccaccagaacagaggcctgggcagcgccttcctgcggcacatcgagcgctgccgcttcctgctgtttgtggtggacctgagccagcctgagccctggacccaggtggatgacctgaagtatgagctggagatgtatgagaagggcctgagcgcccggccccacgccatcgtggccaacaagattgacctgcctgaggcccaggccaacctgagccagctgcgggaccacctgggccaggaggtgattgtgctgagcgccctgaccggggagaacctggagcagctgctgctgcacctgaaggtgctgtatgatgcctatgcagaggccgagctgggccagggccggcagcccctgcgctggtag

SEQ ID NO: 154575 - DNA, 747 bp, Artificial Sequence
  Description of Artificial Sequence: Synthetic coding sequence
atggccccagcccgctgcttcagcgcccggctgaggacagtgttccagggcgtgggccactgggccctgagcacctgggccggcctgaagcccagccggctgctgccccagagggccagcccccggctgctgtctgtgggccgggctgacctggccaagcaccaggagctgcccgggaagaagctgctgtctgagaagaagctgaagcgctactttgtggactaccgccgggtgctggtgtgtggcggcaatggaggagctggggccagctgcttccacagcgagcccaggaaggagtttggaggcccagatggaggagatggcggcaatggaggccacgtgatcctgcgggtggccgacatccctggcatcatccggggggcccaccagaacagaggcctgggcagcgccttcctgcggcacatcgagcgctgccgcttcctgctgtttgtggtggacctgagccagcctgagccctggacccaggtggatgacctgaagtatgagctggagatgtatgagaagggcctgagcgcccggccccacgccatcgtggccaacaagattgacctgcctgaggcccaggccaacctgagccagctgcgggaccacctgggccaggaggtgattgtgctgagcgccctgaccggggagaacctggagcagctgctgctgcacctgaaggtgctgtatgatgcctatgcagaggccgagctgggccagggccggcagcccctgcgctggtag

SEQ ID NO: 154576 - DNA, 702 bp, Artificial Sequence
  Description of Artificial Sequence: Synthetic coding sequence
atggccccagcccgctgcttcagcgcccggctgaggacagtgttccagggcgtgggccactgggccctgagcacctgggccggcctgaagcccagccggctgctgccccagagggccagcccccggctgctgtctgtgggccgggctgacctggccaagcaccaggagctgcccgggaagaagctgctgtctgagaagaagctgaagcgctactttgtggactaccgccgggtgctggtgtgtggcggcaatggaggagctggggccagctgcttccacagcgagcccaggaaggagtttggaggcccagatggaggagatggcggcaatggaggccacgtgatcctgcgggtggaccagcaggtgaagagcctgagctctgtgctgagccgctaccagggcttcagcggggaggatggcggcagcaagaactgcttcggccgctctggagctgtgctgtacatccgggtgcctgtgggcaccctggtgaaggagggcggccgggtggtggccgacctgagctgtgtgggagatgagtacatcgccgccctgggcggggccggcggcaagggcaaccgcttcttcctggccaacaacaacagagcccctgtgacctgcaccccaggccagcccggccagcagagggtgctgcacctggagctgaagacagtggcccatgctggcatggtgggcttcccctag

SEQ ID NO: 154577 - DNA, 537 bp, Artificial Sequence
  Description of Artificial Sequence: Synthetic coding sequence
atggtgggcttccccaatgccggcaagagcagcctgctgcgggccatcagcaatgcccggcctgctgtggccagctaccccttcaccaccctgaagccccacgtgggcatcgtgcactatgagggccacctgcagattgctgtggccgacatccctggcatcatccggggggcccaccagaacagaggcctgggcagcgccttcctgcggcacatcgagcgctgccgcttcctgctgtttgtggtggacctgagccagcctgagccctggacccaggtggatgacctgaagtatgagctggagatgtatgagaagggcctgagcgcccggccccacgccatcgtggccaacaagattgacctgcctgaggcccaggccaacctgagccagctgcgggaccacctgggccaggaggtgattgtgctgagcgccctgaccggggagaacctggagcagctgctgctgcacctgaaggtgctgtatgatgcctatgcagaggccgagctgggccagggccggcagcccctgcgctggtag

SEQ ID NO: 154578 - DNA, 864 bp, Artificial Sequence
  Description of Artificial Sequence: Synthetic coding sequence
cgcagcaacctgaagagagatgtggcccacctgtaccggggcgtgggcagccgctacatcatgggcagcggggagagcttcatgcagctgcagcagaggctgctgcgggagaaggaggccaagatcaggaaggccctggaccggctgaggaagaagaggcacctgctgcggcggcagaggacccggcgggagttccctgtgatctctgtggtgggctacaccaactgtgggaagaccaccctcatcaaggccctgactggagatgctgccatccagccccgggaccagctgtttgccaccctggatgtgacagcccatgctggcaccctgcccagcaggatgacagtgctgtatgtggacaccatcggcttcctgagccagctgccccacggcctgattgagagcttcagcgccaccctggaggatgtggcccacagcgacctgatcctgcacgtgagagatgtgagccaccctgaggccgagctgcagaagtgcagcgtgctgagcaccctgcggggcctgcagctgcctgcccccctgctggacagcatggtggaggtgcacaacaaggtggacctggtgcccggctacagccccacagagcccaacgtggtgcctgtgtctgccctgcggggccacggcctgcaggagctgaaggccgagctggatgctgctgtgctgaaggccaccggccggcagatcctgaccctgcgggtgcggctggccggggcccagctgtcctggctgtacaaggaggccaccgtgcaggaggtggatgtgatcccagaagatggagctgctgatgtgcgggtcatcatcagcaacagcgcctacggcaagttcaggaagctgtttcctggatag

SEQ ID NO: 154579 - DNA, 864 bp, Artificial Sequence
  Description of Artificial Sequence: Synthetic coding sequence
tgaagcaacctgaagagagatgtggcccacctgtaccggggcgtgggcagccgctacatcatgggcagcggggagagcttcatgcagctgcagcagaggctgctgcgggagaaggaggccaagatcaggaaggccctggaccggctgaggaagaagaggcacctgctgcggcggcagaggacccggcgggagttccctgtgatctctgtggtgggctacaccaactgtgggaagaccaccctcatcaaggccctgactggagatgctgccatccagccccgggaccagctgtttgccaccctggatgtgacagcccatgctggcaccctgcccagcaggatgacagtgctgtatgtggacaccatcggcttcctgagccagctgccccacggcctgattgagagcttcagcgccaccctggaggatgtggcccacagcgacctgatcctgcacgtgagagatgtgagccaccctgaggccgagctgcagaagtgcagcgtgctgagcaccctgcggggcctgcagctgcctgcccccctgctggacagcatggtggaggtgcacaacaaggtggacctggtgcccggctacagccccacagagcccaacgtggtgcctgtgtctgccctgcggggccacggcctgcaggagctgaaggccgagctggatgctgctgtgctgaaggccaccggccggcagatcctgaccctgcgggtgcggctggccggggcccagctgtcctggctgtacaaggaggccaccgtgcaggaggtggatgtgatcccagaagatggagctgctgatgtgcgggtcatcatcagcaacagcgcctacggcaagttcaggaagctgtttcctggatag

SEQ ID NO: 154580 - DNA, 891 bp, Artificial Sequence
  Description of Artificial Sequence: Synthetic coding sequence
atgaccctgaacaacgtgaccatgaggcagggcaccgtgggcatgcagccccagcagcagcgctggagcatcccagcagatggccgccacctgatggtgcagaaggagccccaccagtacagccacaggaacagacattctgccaccccagaggaccactgcagaagatcctggagcagtgacagcacagattctgtcatcagcagcgagagcggcaacacctactacagagtggtgctgattggagagcagggcgtgggcaagagcaccctggccaacatctttgctggggtgcatgacagcatggacagcgactgtgaggtgctgggggaggacacctatgaaagaaccctgatggtggatggagagagcgccaccatcatcctgctggacatgtgggagaacaagggggagaatgagtggctgcatgaccactgcatgcaggtgggagatgcctacctgattgtgtacagcatcacagaccgggccagctttgagaaggccagcgagctgcgcatccagctgcggcgggcccggcagacagaggacatccccatcatcctggtgggcaacaagagtgacctggtgcgctgccgggaggtgtctgtgtctgagggccgggcctgtgctgtggtgtttgactgcaagttcatcgagaccagcgctgctgtgcagcacaacgtgaaggagctgtttgagggcatcgtgcggcaggtgcggctgcggcgggacagcaaggagaagaatgaaagaaggctggcctaccagaagaggaaggagagcatgcccaggaaggcccggcgcttctggggcaagatcgtggccaagaacaacaagaacatggccttcaagctgaagagcaagagctgccacgacctgtctgtgctgtag

SEQ ID NO: 154581 - DNA, 891 bp, Artificial Sequence; identical to SEQ ID NO: 154580
  Description of Artificial Sequence: Synthetic coding sequence

SEQ ID NO: 154582 - DNA, 282 bp, Artificial Sequence
  Description of Artificial Sequence: Synthetic coding sequence
atgaccctgaacaacgtgaccatgaggcagggcaccgtgggcatgcagccccagcagcagcgctggagcatcccagcagatggccgccacctgatggtgcagaaggagccccaccagtacagccacaggaacagacattctgccaccccagaggaccactgcagaagatcctggagcagtgacagcacagattctgtcatcagcagcgagagcggcaacacctactacagagtggtgctgattggagagcagggcgtgggcaagagcaccctggccaactag

SEQ ID NO: 154583 - DNA, 927 bp, Artificial Sequence
  Description of Artificial Sequence: Synthetic coding sequence
atggtgatggagaagcccagccccctgctggtgggccgggagtttgtgcggcagtactacaccctgctgaaccaggccccagacatgctgcaccgcttctacggcaagaacagcagctatgtgcacggcggcctggacagcaatggcaagccagcagatgctgtgtatggccagaaggaggtggaggagcctgaggagcggcagcagaccccagaggtggtgcctgatgacagcggcaccttctatgaccaggccgtggtgtccaatgacatggaggagcacctggaggagcctgtggccgagcctgagccagaccctgagcctgagcctgagcaggagcctgtgtctgagatccaggaggagaagccacccaggcctgagagcaagccagagagccagatccccccccagaggccccagagggaccagagggtgcgggagcagaggatcaacatccccccccagaggggcccccggcccatccgggaggccggggagcagggcgacatcgagcccaggaggatggtgcgccacccagacagccaccagctgttcatcggcaacctgccccatgaggtggacaagtctgagctgaaggacttcttccagagctatggaaatgtggtggagctgcgcatcaacagcggcggcaagctgcccaactttggatttgtggtgtttgatgacagcgagcctgtgcagaaggtgctgagcaaccggcccatcatgttccggggggaggtgcggctgaatgtggaggagaagaagaccagggctgcccgggagggggacagaagagacaaccggctgcggggccctgggggcccccggggcggcctgggcggcggcatgaggggccccccccggggcggcatggtgcagaagccaggcttcggcgtgggccggggcctggccccccggcagtag

SEQ ID NO: 154584 - DNA, 1401 bp, Artificial Sequence
  Description of Artificial Sequence: Synthetic coding sequence
atggtgatggagaagcccagccccctgctggtgggccgggagtttgtgcggcagtactacaccctgctgaaccaggccccagacatgctgcaccgcttctacggcaagaacagcagctatgtgcacggcggcctggacagcaatggcaagccagcagatgctgtgtatggccagaaggagatccacaggaaggtgatgagccagaacttcaccaactgccacaccaagatcagacatgtggatgcccacgccaccctgaatgatggagtggtggtgcaggtgatgggcctgctgagcaacaacaaccaggccctgcggcgcttcatgcagacctttgtgctggcccctgagggctctgtggccaacaagttctacgtgcacaatgacatcttccgctaccaggatgaggtgtttggaggctttgtgacagagccccaggaggagagcgaggaggaggtggaggagcctgaggagcggcagcagaccccagaggtggtgcctgatgacagcggcaccttctatgaccaggccgtggtgtccaatgacatggaggagcacctggaggagcctgtggccgagcctgagccagaccctgagcctgagcctgagcaggagcctgtgtctgagatccaggaggagaagccagagcctgtgctggaggagacagccccagaagatgcccagaagagcagcagccctgccccagctgacatcgcccagacagtgcaggaggacctgcggaccttctcctgggcctctgtgaccagcaagaacctgccccccagcggggctgtgcctgtgacaggcatcccccctcatgtggtgaaggtgcctgccagccagcccaggcctgagagcaagccagagagccagatccccccccagaggccccagagggaccagagggtgcgggagcagaggatcaacatccccccccagaggggcccccggcccatccgggaggccggggagcagggcgacatcgagcccaggaggatggtgcgccacccagacagccaccagctgttcatcggcaacctgccccatgaggtggacaagtctgagctgaaggacttcttccagagctatggaaatgtggtggagctgcgcatcaacagcggcggcaagctgcccaactttggatttgtggtgtttgatgacagcgagcctgtgcagaaggtgctgagcaaccggcccatcatgttccggggggaggtgcggctgaatgtggaggagaagaagaccagggctgcccgggagggggacagaagagacaaccggctgcggggccctgggggcccccggggcggcctgggcggcggcatgaggggccccccccggggcggcatggtgcagaagccaggcttcggcgtgggccggggcctggccccccggcagtag

SEQ ID NO: 154585 - DNA, 1401 bp, Artificial Sequence; identical to SEQ ID NO: 154584
  Description of Artificial Sequence: Synthetic coding sequence

SEQ ID NO: 154586 - DNA, 318 bp, Artificial Sequence
  Description of Artificial Sequence: Synthetic coding sequence
atggtgatggagaagcccagccccctgctggtgggccgggagtttgtgcggcagtactacaccctgctgaaccaggccccagacatgctgcaccgcttctacggcaagaacagcagctatgtgcacggcggcctggacagcaatggcaagccagcagatgctgtgtatggccagaaggagatccacaggaaggtgatgagccagaacttcaccaactgccacaccaagatcagacatgtggatgcccacgccaccctgaatgatggagtggtggtgcaggtgatgggcctgctgagcaacaacaaccaggccctgtag

SEQ ID NO: 154587 - DNA, 369 bp, Artificial Sequence
  Description of Artificial Sequence: Synthetic coding sequence
atggtgatggagaagcccagccccctgctggtgggccgggagtttgtgcggcagtactacaccctgctgaaccaggccccagacatgctgcaccgcttctacggcaagaacagcagctatgtgcacggcggcctggacagcaatggcaagccagcagatgctgtgtatggccagaaggagatccacaggaaggtgatgagccagaacttcaccaactgccacaccaagatcagacatgtggatgcccacgccaccctgaatgatggagtggtggtgcaggtgatgggcctgctgagcaacaacaaccaggccctgcggcgcttcatgcagacctttgtgctggcccctgagagcctgaagaagaagtag

SEQ ID NO: 154588 - DNA, 354 bp, Artificial Sequence
  Description of Artificial Sequence: Synthetic coding sequence
atggtgatggagaagcccagccccctgctggtgggccgggagtttgtgcggcagtactacaccctgctgaaccaggccccagacatgctgcaccgcttctacggcaagaacagcagctatgtgcacggcggcctggacagcaatggcaagccagcagatgctgtgtatggccagaaggagatccacaggaaggtgatgagccagaacttcaccaactgccacaccaagatcagacatgtggatgcccacgccaccctgaatgatggagtggtggtgcaggtgatgggcctgctgagcaacaacaaccaggccctgcggcgcttcatgcagacctttgtgctggcccctgagtag

SEQ ID NO: 154589 - DNA, 369 bp, Artificial Sequence; identical to SEQ ID NO: 154587
  Description of Artificial Sequence: Synthetic coding sequence

SEQ ID NO: 154590 - DNA, 321 bp, Artificial Sequence
  Description of Artificial Sequence: Synthetic coding sequence
atggtgatggagaagcccagccccctgctggtgggccgggagtttgtgcggcagtactacaccctgctgaaccaggccccagacatgctgcaccgcttctacggcaagaacagcagctatgtgcacggcggcctggacagcaatggcaagccagcagatgctgtgtatggccagaaggagatccacaggaaggtgatgagccagaacttcaccaactgccacaccaagatcagacatgtggatgcccacgccaccctgaatgatggagtggtggtgcaggtgatgggcctgctgagcaacaacaaccaggccctgaggtag

SEQ ID NO: 154591 - DNA, 855 bp, Artificial Sequence
  Description of Artificial Sequence: Synthetic coding sequence
atggaggagcacctggaggagcctgtggccgagcctgagccagaccctgagcctgagcctgagcaggagcctgtgtctgagatccaggaggagaagccagagcctgtgctggaggagacagccccagaagatgcccagaagagcagcagccctgccccagctgacatcgcccagacagtgcaggaggacctgcggaccttctcctgggcctctgtgaccagcaagaacctgccccccagcggggctgtgcctgtgacaggcatcccccctcatgtggtgaaggtgcctgccagccagcccaggcctgagagcaagccagagagccagatccccccccagaggccccagagggaccagagggtgcgggagcagaggatcaacatccccccccagaggggcccccggcccatccgggaggccggggagcagggcgacatcgagcccaggaggatggtgcgccacccagacagccaccagctgttcatcggcaacctgccccatgaggtggacaagtctgagctgaaggacttcttccagagctatggaaatgtggtggagctgcgcatcaacagcggcggcaagctgcccaactttggatttgtggtgtttgatgacagcgagcctgtgcagaaggtgctgagcaaccggcccatcatgttccggggggaggtgcggctgaatgtggaggagaagaagaccagggctgcccgggagggggacagaagagacaaccggctgcggggccctgggggcccccggggcggcctgggcggcggcatgaggggccccccccggggcggcatggtgcagaagccaggcttcggcgtgggccggggcctggccccccggcagtag

SEQ ID NO: 154592 - DNA, 4359 bp, Artificial Sequence
  Description of Artificial Sequence: Synthetic coding sequence
atggtgaagctggacatccacaccctggcccaccacctgaagcaggagcggctgtatgtgaacagcgagaagcagctgatccagaggctgaatgctgatgtgctgaagacagctgagaagctgtacagaacagcctggatcgccaagcagcagaggatcaacctggacaggctcatcatcaccagcgctgaggccagccctgctgagtgctgccagcacgccaagatcctggaggacacccagtttgtggatggctacaagcagctgggcttccaggagacagcctacggggagttcctgagccggctgcgggagaaccccaggctcatcgccagcagcctggtggccggggagaagctgaaccaggagaacacccagagcgtcatctacacagtgttcaccagcctgtatggcaactgcatcatgcaggaggatgagagctacctgctgcaggtgctgcgctacctgattgaatttgagctgaaggagagtgacaacccccggcggctgctgcggcggggcacctgtgccttcagcatcctcttcaagctgttcagcgagggcctcttcagcgccaagctgttcctgacagccaccctgcacgagcccatcatgcagctgctggtggaggatgaggaccacctggagacagaccccaacaagctgattgagcgcttcagccccagccagcaggagaagctgtttggagagaagggcagtgaccgcttccggcagaaggtgcaggagatggtggagagcaatgaggccaagctggtggccctggtgaacaagttcatcggctacctgaagcagaacacctactgcttcccccacagcctgcgctggatcgtgtcccagatgtacaagaccctgagctgtgtggaccggctggaggtgggggaggtgcgggccatgtgcacagacctgctgctggcctgcttcatctgcccagctgtggtgaaccctgagcagtatggcatcatcagtgatgcccccatcaatgaggtggcccgcttcaacctgatgcaggtgggccgcctgctgcagcagctggccatgacaggcagcgaggagggggaccccaggaccaagagcagcctgggcaagtttgacaagagctgtgtggccgccttcctggatgtggtgattggaggccgggctgtggagaccccacccctgagctctgtgaacctgctggagggcctgagcaggacagtggtgtacatcacctacagccagctgatcaccctggtgaacttcatgaagtctgtgatgtctggggaccagctgcgggaggacaggatggccctggacaacctgctggccaacctgcccccagccaagccaggcaagagcagcagcctggagatgaccccctacaacaccccccagctgagccctgccaccaccccagccaacaagaagaaccggctgcccatcgccaccaggagccgcagcaggaccaacatgctgatggacctgcacatggaccacgagggcagcagccaggagaccatccaggaggtgcagcctgaggaggtgctggtgatcagcctgggcaccggcccccagctgaccccaggcatgatgtctgaaaatgaggtgctgaacatgcagctgagtgatggcggccagggagatgtgcctgtggatgagaacaagctgcacggcaagccagacaagaccctgcgcttcagcctgtgcagcgacaacctggagggcatcagcgagggccccagcaacagaagcaacagcgtgagcagcctggacctggagggggagagcgtgtctgagctgggcgccggccccagcggcagcaatggagtggaggccctgcagctgctggagcacgagcaggccaccacccaggacaacctggatgacaagctgaggaagtttgagatccgggacatgatgggcctgacagatgaccgggacatcagcgagaccgtgtctgagacctggagcacagatgtgctgggcagtgactttgaccccaacattgatgaggaccggctgcaggagattgctggagctgctgctgagaacatgctgggcagcctgctgtgcctgcccggcagcggctctgtgctgctggacccctgcaccggcagcaccatcagcgagaccaccagcgaggcctggagcgtggaggtgctgcccagcgacagcgaggccccagacctgaagcaggaggagcggctgcaggagctggagagctgcagcggcctgggcagcaccagtgatgacacagatgtgcgggaggtgagcagccggcccagcaccccaggcctgtctgtggtgtctggcatcagcgccaccagcgaggacatccccaacaagattgaggacctgcggtctgagtgcagcagtgactttggaggcaaggacagcgtgaccagcccagacatggatgagatcacccatggagccagcgctgtggtgcggcccaaggtgcactacgcccggcccagccaccccccaccagacccccccatcctggagggcgctgtgggcggcaatgaggcccggctgcccaactttggcagccacgtgctgaccccagctgagatggaggccttcaagcagaggcacagctacccagagcggctggtgcgcagccgcagcagtgacatcgtgtcctctgtgcggcggcccatgtctgaccccagctggaacagaagacctggaaatgaggagcgggagctgcccccagctgctgccatcggggccaccagcctggtggccgccccccacagcagcagcagcagccccagcaaggacagcagcagaggagaaacagaggagaggaaggacagtgatgatgagaagagtgacaggaaccggccctggtggaggaagagatttgtgtctgccatgcccaaggcccccatccccttcaggaagaaggagaagcaggagaaggacaaggatgacctgggccctgaccgcttcagcaccctgacagatgaccccagcccccggctgagcgcccaggcccaggtggccgaggacatcctggacaagtacagaaatgccatcaagaggaccagccccagtgatggagccatggccaactatgagagcactggagacaaccacgaccgggacctgagcagcaagctgctgtaccacagcgacaaggaggtgatgggagatggagagagcgcccatgacagccccagagatgaggccctgcagaacatctctgcagatgacctgcctgattctgccagccaggccgcccacccccaggacagcgccttctcctacagagatgccaagaagaagctgcggctggccctgtgcagcgctgacagcgtggccttccctgtgctgacccacagcaccagaaatggcctgcctgaccacacagatcctgaggacaatgagatcgtgtgcttcctgaaggtgcagattgctgaggccatcaacctgcaggacaagaacctgatggcccagctgcaggagaccatgagatgtgtgtgccgctttgacaacagaacctgcaggaagctgctggccagcattgctgaggactacaggaagagggccccctacatcgcctacctgacccgctgccggcagggcctgcagaccacccaggcccacctggagcggctgctgcagagggtgctgcgggacaaggaggtggccaaccgctacttcaccaccgtgtgtgtgcggctgctgctggagagcaaggagaagaagatccgggagttcatccaggacttccagaagctgacagctgctgatgacaagacagcccaggtggaggacttcctgcagttcctgtatggagccatggcccaggatgtgatctggcagaatgccagcgaggagcagctgcaggatgcccagctggccatcgagaggtctgtgatgaaccgcatcttcaagctggccttctaccccaaccaggatggagacatcctgcgggaccaggtgctgcacgagcacatccagaggctgagcaaggtggtgacagccaaccaccgggccctgcagatccctgaggtgtacctgcgggaggccccctggcccagcgcccagagcgagatccgcaccatcagcgcctacaagaccccccgggacaaggtgcagtgcatcctgaggatgtgcagcaccatcatgaacctgctgagcctggccaatgaagattctgtgcctggagcagatgactttgtgcctgtgctggtgtttgtgctgatcaaggccaaccccccctgcctgctgagcacagtgcagtacatcagcagcttctacgccagctgcctgagcggggaggagagctactggtggatgcagttcaccgctgctgtggagttcatcaagaccattgatgacaggaagtag

SEQ ID NO: 154593 - DNA, 1494 bp, Artificial Sequence
  Description of Artificial Sequence: Synthetic coding sequence
atggtgaagctggacatccacaccctggcccaccacctgaagcaggagcggctgtatgtgaacagcgagaagcagctgatccagaggctgaatgctgatgtgctgaagacagctgagaagctgtacagaacagcctggatcgccaagcagcagaggatcaacctggacaggctcatcatcaccagcgctgaggccagccctgctgagtgctgccagcacgccaagatcctggaggacacccagtttgtggatggctacaagcagctgggcttccaggagacagcctacggggagttcctgagccggctgcgggagaaccccaggctcatcgccagcagcctggtggccggggagaagctgaaccaggagaacacccagagcgtcatctacacagtgttcaccagcctgtatggcaactgcatcatgcaggaggatgagagctacctgctgcaggtgctgcgctacctgattgaatttgagctgaaggagagtgacaacccccggcggctgctgcggcggggcacctgtgccttcagcatcctcttcaagctgttcagcgagggcctcttcagcgccaagctgttcctgacagccaccctgcacgagcccatcatgcagctgctggtggaggatgaggaccacctggagacagaccccaacaagctgattgagcgcttcagccccagccagcaggagaagctgtttggagagaagggcagtgaccgcttccggcagaaggtgcaggagatggtggagagcaatgaggccaagctggtggccctggtgaacaagttcatcggctacctgaagcagaacacctactgcttcccccacagcctgcgctggatcgtgtcccagatgtacaagaccctgagctgtgtggaccggctggaggtgggggaggtgcgggccatgtgcacagacctgctgctggcctgcttcatctgcccagctgtggtgaaccctgagcagtatggcatcatcagtgatgcccccatcaatgaggtggcccgcttcaacctgatgcaggtgggccgcctgctgcagcagctggccatgacaggcagcgaggagggggaccccaggaccaagagcagcctgggcaagtttgacaagagctgtgtggccgccttcctggatgtggtgattggaggccgggctgtggagaccccacccctgagctctgtgaacctgctggagggcctgagcaggacagtggtgtacatcacctacagccagctgatcaccctggtgaacttcatgaagtctgtgatgtctggggaccagctgcgggaggacaggatggccctggacaacctgctggccaacctgcccccagccaagccaggcaagagcagcagcctggagatgaccccctacaacaccccccagctgagccctgccaccaccccagccaacaagaagaaccggctgcccatcggcaaggagaacttctcctactggagcttcctgctgaacctgatcttccactag

SEQ ID NO: 154594 - DNA, 4437 bp, Artificial Sequence
  Description of Artificial Sequence: Synthetic coding sequence
atggtgaagctggacatccacaccctggcccaccacctgaagcaggagcggctgtatgtgaacagcgagaagcagctgatccagaggctgaatgctgatgtgctgaagacagctgagaagctgtacagaacagcctggatcgccaagcagcagaggatcaacctggacaggctcatcatcaccagcgctgaggccagccctgctgagtgctgccagcacgccaagatcctggaggacacccagtttgtggatggctacaagcagctgggcttccaggagacagcctacggggagttcctgagccggctgcgggagaaccccaggctcatcgccagcagcctggtggccggggagaagctgaaccaggagaacacccagagcgtcatctacacagtgttcaccagcctgtatggcaactgcatcatgcaggaggatgagagctacctgctgcaggtgctgcgctacctgattgaatttgagctgaaggagagtgacaacccccggcggctgctgcggcggggcacctgtgccttcagcatcctcttcaagctgttcagcgagggcctcttcagcgccaagctgttcctgacagccaccctgcacgagcccatcatgcagctgctggtggaggatgaggaccacctggagacagaccccaacaagctgattgagcgcttcagccccagccagcaggagaagctgtttggagagaagggcagtgaccgcttccggcagaaggtgcaggagatggtggagagcaatgaggccaagctggtggccctggtgaacaagttcatcggctacctgaagcagaacacctactgcttcccccacagcctgcgctggatcgtgtcccagatgtacaagaccctgagctgtgtggaccggctggaggtgggggaggtgcgggccatgtgcacagacctgctgctggcctgcttcatctgcccagctgtggtgaaccctgagcagtatggcatcatcagtgatgcccccatcaatgaggtggcccgcttcaacctgatgcaggtgggccgcctgctgcagcagctggccatgacaggcagcgaggagggggaccccaggaccaagagcagcctgggcaagtttgacaagagctgtgtggccgccttcctggatgtggtgattggaggccgggctgtggagaccccacccctgagctctgtgaacctgctggagggcctgagcaggacagtggtgtacatcacctacagccagctgatcaccctggtgaacttcatgaagtctgtgatgtctggggaccagctgcgggaggacaggatggccctggacaacctgctggccaacctgcccccagccaagccaggcaagagcagcagcctggagatgaccccctacaacaccccccagctgagccctgccaccaccccagccaacaagaagaaccggctgcccatcgccaccaggagccgcagcaggaccaacatgctgatggacctgcacatggaccacgagggcagcagccaggagaccatccaggaggtgcagcctgaggaggtgctggtgatcagcctgggcaccggcccccagctgaccccaggcatgatgtctgaaaatgaggtgctgaacatgcagctgagtgatggcggccagggagatgtgcctgtggatgagaacaagctgcacggcaagccagacaagaccctgcgcttcagcctgtgcagcgacaacctggagggcatcagcgagggccccagcaacagaagcaacagcgtgagcagcctggacctggagggggagagcgtgtctgagctgggcgccggccccagcggcagcaatggagtggaggccctgcagctgctggagcacgagcaggccaccacccaggacaacctggatgacaagctgaggaagtttgagatccgggacatgatgggcctgacagatgaccgggacatcagcgagaccgtgtctgagacctggagcacagatgtgctgggcagtgactttgaccccaacattgatgaggaccggctgcaggagattgctggagctgctgctgagaacatgctgggcagcctgctgtgcctgcccggcagcggctctgtgctgctggacccctgcaccggcagcaccatcagcgagaccaccagcgaggcctggagcgtggaggtgctgcccagcgacagcgaggccccagacctgaagcaggaggagcggctgcaggagctggagagctgcagcggcctgggcagcaccagtgatgacacagatgtgcgggaggtgagcagccggcccagcaccccaggcctgtctgtggtgtctggcatcagcgccaccagcgaggacatccccaacaagattgaggacctgcggtctgagtgcagcagtgactttggaggcaaggacagcgtgaccagcccagacatggatgagatcacccatggagcccaccagctgaccagcccccccagccagagcgagagcctgctggccatgtttgaccccctgagcagccatgagggcgccagcgctgtggtgcggcccaaggtgcactacgcccggcccagccaccccccaccagacccccccatcctggagggcgctgtgggcggcaatgaggcccggctgcccaactttggcagccacgtgctgaccccagctgagatggaggccttcaagcagaggcacagctacccagagcggctggtgcgcagccgcagcagtgacatcgtgtcctctgtgcggcggcccatgtctgaccccagctggaacagaagacctggaaatgaggagcgggagctgcccccagctgctgccatcggggccaccagcctggtggccgccccccacagcagcagcagcagccccagcaaggacagcagcagaggagaaacagaggagaggaaggacagtgatgatgagaagagtgacaggaaccggccctggtggaggaagagatttgtgtctgccatgcccaaggcccccatccccttcaggaagaaggagaagcaggagaaggacaaggatgacctgggccctgaccgcttcagcaccctgacagatgaccccagcccccggctgagcgcccaggcccaggtggccgaggacatcctggacaagtacagaaatgccatcaagaggaccagccccagtgatggagccatggccaactatgagagcactggagacaaccacgaccgggacctgagcagcaagctgctgtaccacagcgacaaggaggtgatgggagatggagagagcgcccatgacagccccagagatgaggccctgcagaacatctctgcagatgacctgcctgattctgccagccaggccgcccacccccaggacagcgccttctcctacagagatgccaagaagaagctgcggctggccctgtgcagcgctgacagcgtggccttccctgtgctgacccacagcaccagaaatggcctgcctgaccacacagatcctgaggacaatgagatcgtgtgcttcctgaaggtgcagattgctgaggccatcaacctgcaggacaagaacctgatggcccagctgcaggagaccatgagatgtgtgtgccgctttgacaacagaacctgcaggaagctgctggccagcattgctgaggactacaggaagagggccccctacatcgcctacctgacccgctgccggcagggcctgcagaccacccaggcccacctggagcggctgctgcagagggtgctgcgggacaaggaggtggccaaccgctacttcaccaccgtgtgtgtgcggctgctgctggagagcaaggagaagaagatccgggagttcatccaggacttccagaagctgacagctgctgatgacaagacagcccaggtggaggacttcctgcagttcctgtatggagccatggcccaggatgtgatctggcagaatgccagcgaggagcagctgcaggatgcccagctggccatcgagaggtctgtgatgaaccgcatcttcaagctggccttctaccccaaccaggatggagacatcctgcgggaccaggtgctgcacgagcacatccagaggctgagcaaggtggtgacagccaaccaccgggccctgcagatccctgaggtgtacctgcgggaggccccctggcccagcgcccagagcgagatccgcaccatcagcgcctacaagaccccccgggacaaggtgcagtgcatcctgaggatgtgcagcaccatcatgaacctgctgagcctggccaatgaagattctgtgcctggagcagatgactttgtgcctgtgctggtgtttgtgctgatcaaggccaaccccccctgcctgctgagcacagtgcagtacatcagcagcttctacgccagctgcctgagcggggaggagagctactggtggatgcagttcaccgctgctgtggagttcatcaagaccattgatgacaggaagtag

SEQ ID NO: 154595 - DNA, 4464 bp, Artificial Sequence
  Description of Artificial Sequence: Synthetic coding sequence
atggtgaagctggacatccacaccctggcccaccacctgaagcaggagcggctgtatgtgaacagcgagaagcagctgatccagaggctgaatgctgatgtgctgaagacagctgagaagctgtacagaacagcctggatcgccaagcagcagaggatcaacctggacaggctcatcatcaccagcgctgaggccagccctgctgagtgctgccagcacgccaagatcctggaggacacccagtttgtggatggctacaagcagctgggcttccaggagacagcctacggggagttcctgagccggctgcgggagaaccccaggctcatcgccagcagcctggtggccggggagaagctgaaccaggagaacacccagagcgtcatctacacagtgttcaccagcctgtatggcaactgcatcatgcaggaggatgagagctacctgctgcaggtgctgcgctacctgattgaatttgagctgaaggagagtgacaacccccggcggctgctgcggcggggcacctgtgccttcagcatcctcttcaagctgttcagcgagggcctcttcagcgccaagctgttcctgacagccaccctgcacgagcccatcatgcagctgctggtggaggatgaggaccacctggagacagaccccaacaagctgattgagcgcttcagccccagccagcaggagaagctgtttggagagaagggcagtgaccgcttccggcagaaggtgcaggagatggtggagagcaatgaggccaagctggtggccctggtgaacaagttcatcggctacctgaagcagaacacctactgcttcccccacagcctgcgctggatcgtgtcccagatgtacaagaccctgagctgtgtggaccggctggaggtgggggaggtgcgggccatgtgcacagacctgctgctggcctgcttcatctgcccagctgtggtgaaccctgagcagtatggcatcatcagtgatgcccccatcaatgaggtggcccgcttcaacctgatgcaggtgggccgcctgctgcagcagctggccatgacaggcagcgaggagggggaccccaggaccaagagcagcctgggcaagtttgacaagagctgtgtggccgccttcctggatgtggtgattggaggccgggctgtggagaccccacccctgagctctgtgaacctgctggagggcctgagcaggacagtggtgtacatcacctacagccagctgatcaccctggtgaacttcatgaagtctgtgatgtctggggaccagctgcgggaggacaggatggccctggacaacctgctggccaacctgcccccagccaagccaggcaagagcagcagcctggagatgaccccctacaacaccccccagctgagccctgccaccaccccagccaacaagaagaaccggctgcccatcgccaccaggagccgcagcaggaccaacatgctgatggacctgcacatggaccacgagggcagcagccaggagaccatccaggaggtgcagcctgaggaggtgctggtgatcagcctgggcaccggcccccagctgaccccaggcatgatgtctgaaaatgaggtgctgaacatgcagctgagtgatggcggccagggagatgtgcctgtggatgagaacaagctgcacggcaagccagacaagaccctgcgcttcagcctgtgcagcgacaacctggagggcatcagcgagggccccagcaacagaagcaacagcgtgagcagcctggacctggagggggagagcgtgtctgagctgggcgccggccccagcggcagcaatggagtggaggccctgcagctgctggagcacgagcaggccaccacccaggacaacctggatgacaagctgaggaagtttgagatccgggacatgatgggcctgacagatgaccgggacatcagcgagaccgtgtctgagacctggagcacagatgtgctgggcagtgactttgaccccaacattgatgaggaccggctgcaggagattgctggagctgctgctgagaacatgctgggcagcctgctgtgcctgcccggcagcggctctgtgctgctggacccctgcaccggcagcaccatcagcgagaccaccagcgaggcctggagcgtggaggtgctgcccagcgacagcgaggccccagacctgaagcaggaggagcggctgcaggagctggagagctgcagcggcctgggcagcaccagtgatgacacagatgtgcgggaggtgagcagccggcccagcaccccaggcctgtctgtggtgtctggcatcagcgccaccagcgaggacatccccaacaagattgaggacctgcggtctgagtgcagcagtgactttggaggcaaggacagcgtgaccagcccagacatggatgagatcacccatgacttcctgtacatcctgcagcccaagcagcacttccagcacatcgaggccgaggccgacatgaggatccagctgagcagcagcgcccaccagctgaccagcccccccagccagagcgagagcctgctggccatgtttgaccccctgagcagccatgaaggagccagcgctgtggtgcggcccaaggtgcactacgcccggcccagccaccccccaccagacccccccatcctggagggcgctgtgggcggcaatgaggcccggctgcccaactttggcagccacgtgctgaccccagctgagatggaggccttcaagcagaggcacagctacccagagcggctggtgcgcagccgcagcagtgacatcgtgtcctctgtgagaagacccatgtctgaccccagctggaacagaagacctggaaatgaggagcgggagctgcccccagctgctgccatcggggccaccagcctggtggccgccccccacagcagcagcagcagccccagcaaggacagcagcagaggagaaacagaggagaggaaggacagtgatgatgagaagagtgacaggaaccggccctggtggaggaagagatttgtgtctgccatgcccaaggcccccatccccttcaggaagaaggagaagcaggagaaggacaaggatgacctgggccctgaccgcttcagcaccctgacagatgaccccagcccccggctgagcgcccaggcccaggtggccgaggacatcctggacaagtacagaaatgccatcaagaggaccagccccagtgatggagccatggccaactatgagagcacagaggtgatgggagatggagagagcgcccatgacagccccagagatgaggccctgcagaacatctctgcagatgacctgcctgacagcgccagccaggccgcccacccccaggacagcgccttctcctacagagatgccaagaagaagctgcggctggccctgtgcagcgctgacagcgtggccttccctgtgctgacccacagcaccagaaatggcctgcctgaccacacagatcctgaagataatgaaattgtgtgcttcctgaaggtgcagattgctgaggccatcaacctgcaggacaagaacctgatggcccagctgcaggagaccatgagatgtgtgtgccgctttgacaacagaacctgcaggaagctgctggccagcattgctgaggactacaggaagagggccccctacatcgcctacctgacccgctgccggcagggcctgcagaccacccaggcccacctggagcggctgctgcagagggtgctgcgggacaaggaggtggccaaccgctacttcaccaccgtgtgtgtgcggctgctgctggagagcaaggagaagaagatccgggagttcatccaggacttccagaagctgacagctgctgatgacaagacagcccaggtggaggacttcctgcagttcctgtatggagccatggcccaggacgtcatctggcagaatgccagcgaggagcagctgcaggatgcccagctggccatcgagaggtctgtgatgaaccgcatcttcaagctggccttctaccccaaccaggatggagacatcctgcgggaccaggtgctgcacgagcacatccagaggctgagcaaggtggtgacagccaaccaccgggccctgcagatccctgaggtgtacctgcgggaggccccctggcccagcgcccagagcgagatccgcaccatcagcgcctacaagaccccccgggacaaggtgcagtgcatcctgaggatgtgcagcaccatcatgaacctgctgagcctggccaatgaagacagcgtgcctggagcagatgactttgtgcctgtgctggtgtttgtgctgatcaaggccaaccccccctgcctgctgagcacagtgcagtacatcagcagcttctacgccagctgcctgtctggagaggagagctactggtggatgcagttcaccgctgctgtggagttcatcaagaccattgatgacaggaagtag

SEQ ID NO: 154596 - DNA, 2514 bp, Artificial Sequence
  Description of Artificial Sequence: Synthetic coding sequence
tgaaactgcatcatgcaggaggatgagagctacctgctgcaggtgctgcgctacctgattgaatttgagctgaaggagagtgacaacccccggcggctgctgcggcggggcacctgtgccttcagcatcctcttcaagctgttcagcgagggcctcttcagcgccaagctgttcctgacagccaccctgcacgagcccatcatgcagctgctggtggaggatgaggaccacctggagacagaccccaacaagctgattgagcgcttcagccccagccagcaggagaagctgtttggagagaagggcagtgaccgcttccggcagaaggtgcaggagatggtggagagcaatgaggccaagctggtggccctggtgaacaagttcatcggctacctgaagcagaacacctactgcttcccccacagcctgcgctggatcgtgtcccagatgtacaagaccctgagctgtgtggaccggctggaggtgggggaggtgcgggccatgtgcacagacctgctgctggcctgcttcatctgcccagctgtggtgaaccctgagcagtatggcatcatcagtgatgcccccatcaatgaggtggcccgcttcaacctgatgcaggtgggccgcctgctgcagcagctggccatgactggaagtgaggagggggaccccaggaccaagagcagcctgggcaagtttgacaagagctgtgtggccgccttcctggatgtggtgattggaggccgggctgtggagaccccacccctgagctctgtgaacctgctggagggcctgagcaggacagtggtgtacatcacctacagccagctgatcaccctggtgaacttcatgaagtctgtgatgtctggggaccagctgcgggaggacaggatggccctggacaacctgctggccaacctgcccccagccaagccaggcaagagcagcagcctggagatgaccccctacaacaccccccagctgagccctgccaccaccccagccaacaagaagaaccggctgcccatcgccaccaggagccgcagcaggaccaacatgctgatggacctgcacatggaccacgagggcagcagccaggagaccatccaggaggtgcagcctgaggaggtgctggtgatcagcctgggcaccggcccccagctgaccccaggcatgatgtctgaaaatgaggtgctgaacatgcagctgagtgatggcggccagggagatgtgcctgtggatgagaacaagctgcacggcaagccagacaagaccctgcgcttcagcctgtgcagcgacaacctggagggcatcagcgagggccccagcaacagaagcaacagcgtgagcagcctggacctggagggggagagcgtgtctgagctgggcgccggccccagcggcagcaatggagtggaggccctgcagctgctggagcacgagcaggccaccacccaggacaacctggatgacaagctgaggaagtttgagatccgggacatgatgggcctgacagatgaccgggacatcagcgagaccgtgtctgagacctggagcacagatgtgctgggcagtgactttgaccccaacattgatgaagatcggctgcaggagattgctggagctgctgctgagaacatgctgggcagcctgctgtgcctgcccggcagcggctctgtgctgctggacccctgcaccggcagcaccatcagcgagaccaccagcgaggcctggagcgtggaggtgctgcccagcgacagcgaggccccagacctgaagcaggaggagcggctgcaggagctggagagctgcagcggcctgggcagcaccagtgatgacacagatgtgcgggaggtgagcagccggcccagcaccccaggcctgtctgtggtgtctggcatcagcgccaccagcgaggacatccccaacaagattgaggacctgcggagtgaatgttccagtgactttggaggcaaggacagcgtgaccagcccagacatggatgagatcacccacggggccagcgctgtggtgcggcccaaggtgcactacgcccggcccagccaccccccaccagacccccccatcctggagggcgctgtgggcggcaatgaggcccggctgcccaactttggcagccacgtgctgaccccagctgagatggaggccttcaagcagaggcacagctacccagagcggctggtgcgcagccgcagcagtgacatcgtgtcctctgtgagaagacccatgtctgaccccagctggaacagaagacctggaaatgaggagcgggagctgcccccagctgctgccatcggggccaccagcctggtggccgccccccacagcagcagcagcagccccagcaaggacagcagcagaggagaaacagaggagaggaaggacagtgatgatgagaagagtgacaggaaccggccctggtggaggaagagatttgtgtctgccatgcccaaggcccccatccccttcaggaagaaggagaagcaggagtag

SEQ ID NO: 154597 - DNA, 2493 bp, Artificial Sequence
  Description of Artificial Sequence: Synthetic coding sequence
tgactgcggcggggcacctgtgccttcagcatcctcttcaagctgttcagcgagggcctcttcagcgccaagctgttcctgacagccaccctgcacgagcccatcatgcagctgctggtggaggatgaggaccacctggagacagaccccaacaagctgattgagcgcttcagccccagccagcaggagaagctgtttggagagaagggcagtgaccgcttccggcagaaggtgcaggagatggtggagagcaatgaggccaagctggtggccctggtgaacaagttcatcggctacctgaagcagaacacctactgcttcccccacagcctgcgctggatcgtgtcccagatgtacaagaccctgagctgtgtggaccggctggaggtgggggaggtgcgggccatgtgcacagacctgctgctggcctgcttcatctgcccagctgtggtgaaccctgagcagtatggcatcatcagtgatgcccccatcaatgaggtggcccgcttcaacctgatgcaggtgggccgcctgctgcagcagctggccatgactggaagtgaggagggggaccccaggaccaagagcagcctgggcaagtttgacaagagctgtgtggccgccttcctggatgtggtgattggaggccgggctgtggagaccccacccctgagctctgtgaacctgctggagggcctgagcaggacagtggtgtacatcacctacagccagctgatcaccctggtgaacttcatgaagtctgtgatgtctggggaccagctgcgggaggacaggatggccctggacaacctgctggccaacctgcccccagccaagccaggcaagagcagcagcctggagatgaccccctacaacaccccccagctgagccctgccaccaccccagccaacaagaagaaccggctgcccatcggccagcagctggccgccatcacagcctgggacagcagcgccaccaacatcaccagccacatcaccgtggtgaccccatttgccaccaggagccgcagcaggaccaacatgctgatggacctgcacatggaccacgagggcagcagccaggagaccatccaggaggtgcagcctgaggaggtgctggtgatcagcctgggcaccggcccccagctgaccccaggcatgatgtctgaaaatgaggtgctgaacatgcagctgagtgatggcggccagggagatgtgcctgtggatgagaacaagctgcacggccccagcaacagaagcaacagcgtgagcagcctggacctggagggggagagcgtgtctgagctgggcgccggccccagcggcagcaatggagtggaggccctgcagctgctggagcacgagcaggccaccacccaggacaacctggatgacaagctgaggaagtttgagatccgggacatgatgggcctgacagatgaccgggacatcagcgagaccgtgtctgagacctggagcacagatgtgctgggcagtgactttgaccccaacattgatgaagatcggctgcaggagattgctggagctgctgctgagaacatgctgggcagcctgctgtgcctgcccggcagcggctctgtgctgctggacccctgcaccggcagcaccatcagcgagaccaccagcgaggcctggagcgtggaggtgctgcccagcgacagcgaggccccagacctgaagcaggaggagcggctgcaggagctggagagctgcagcggcctgggcagcaccagtgatgacacagatgtgcgggaggtgagcagccggcccagcaccccaggcctgtctgtggtgtctggcatcagcgccaccagcgaggacatccccaacaagattgaggacctgcggagtgaatgttccagtgactttggaggcaaggacagcgtgaccagcccagacatggatgagatcacccacggggcccaccagctgaccagcccccccagccagagcgagagcctgctggccatgtttgaccccctgagcagccatgaaggagccagcgctgtggtgcggcccaaggtgcactacgcccggcccagccaccccccaccagacccccccatcctggagggcgctgtgggcggcaatgaggcccggctgcccaactttggcagccacgtgctgaccccagctgagatggaggccttcaagcagaggcacagctacccagagcggctggtgcgcagccgcagcagtgacatcgtgtcctctgtgagaagacccatgtctgaccccagctggaacagaagacctggaaatgaggagcgggagctgcccccagctgctgccatcggggccaccagcctggtggccgccccccacagcagcagcagcagccccagcaaggacagcagcagaggagaaacagaggagaggaaggacagtgatgatgagaagagtgacaggaaccggccctggtggaggaagagatttgtgtctgccatgcccaaggcccccatccccttctag

SEQ ID NO: 154598 - DNA, 516 bp, Artificial Sequence
  Description of Artificial Sequence: Synthetic coding sequence
atggtgcagtggcccaggatgtcctatggcaagaccagggtgatgaaccgcatcttcaagctggccttctaccccaaccaggatggagacatcctgcgggaccaggtgctgcacgagcacatccagaggctgagcaaggtggtgacagccaaccaccgggccctgcagatccctgaggtgtacctgcgggaggccccctggcccagcgcccagagcgagatccgcaccatcagcgcctacaagaccccccgggacaaggtgcagtgcatcctgaggatgtgcagcaccatcatgaacctgctgagcctggccaatgaagacagcgtgcctggagcagatgactttgtgcctgtgctggtgtttgtgctgatcaaggccaaccccccctgcctgctgagcacagtgcagtacatcagcagcttctacgccagctgcctgtctggagaggagagctactggtggatgcagttcaccgctgctgtggagttcatcaagaccattgatgacaggaagtag

SEQ ID NO: 154599 - DNA, 354 bp, Artificial Sequence
  Description of Artificial Sequence: Synthetic coding sequence
atggtgaagctggacatccacaccctggcccaccacctgaagcaggagcggctgtatgtgaacagcgagaagcagctgatccagaggctgaatgctgatgtgctgaagacagctgagaagctgtacagaacagcctggatcgccaagcagcagaggatcaacctggacaggctcatcatcaccagcgctgaggccagccctgctgagtgctgccagcacgccaagatcctggaggacacccagtttgtggatggctacaagcagctgggcttccaggagacagcctacggggagttcctgagccggctgcgggagaaccccaggctcatcgccagcagcctggtggccggctag

SEQ ID NO: 154600 - DNA, 2967 bp, Artificial Sequence
  Description of Artificial Sequence: Synthetic coding sequence
atggtgaagctggacatccacaccctggcccaccacctgaagcaggagcggctgtatgtgaacagcgagaagcagctgatccagaggctgaatgctgatgtgctgaagacagctgagaagctgtacagaacagcctggatcgccaagcagcagaggatcaacctggacaggctcatcatcaccagcgctgaggccagccctgctgagtgctgccagcacgccaagatcctggaggacacccagtttgtggatggctacaagcagctgggcttccaggagacagcctacggggagttcctgagccggctgcgggagaaccccaggctcatcgccagcagcctggtggccggggagaagctgaaccaggagaacacccagagcgtcatctacacagtgttcaccagcctgtatggcaactgcatcatgcaggaggatgagagctacctgctgcaggtgctgcgctacctgattgaatttgagctgaaggagagtgacaacccccggcggctgctgcggcggggcacctgtgccttcagcatcctcttcaagctgttcagcgagggcctcttcagcgccaagctgttcctgacagccaccctgcacgagcccatcatgcagctgctggtggaggatgaggaccacctggagacagaccccaacaagctgattgagcgcttcagccccagccagcaggagaagctgtttggagagaagggcagtgaccgcttccggcagaaggtgcaggagatggtggagagcaatgaggccaagctggtggccctggtgaacaagttcatcggctacctgaagcagaacacctactgcttcccccacagcctgcgctggatcgtgtcccagatgtacaagaccctgagctgtgtggaccggctggaggtgggggaggtgcgggccatgtgcacagacctgctgctggcctgcttcatctgcccagctgtggtgaaccctgagcagtatggcatcatcagtgatgcccccatcaatgaggtggcccgcttcaacctgatgcaggtgggccgcctgctgcagcagctggccatgacaggcagcgaggagggggaccccaggaccaagagcagcctgggcaagtttgacaagagctgtgtggccgccttcctggatgtggtgattggaggccgggctgtggagaccccacccctgagctctgtgaacctgctggagggcctgagcaggacagtggtgtacatcacctacagccagctgatcaccctggtgaacttcatgaagtctgtgatgtctggggaccagctgcgggaggacaggatggccctggacaacctgctggccaacctgcccccagccaagccaggcaagagcagcagcctggagatgaccccctacaacaccccccagctgagccctgccaccaccccagccaacaagaagaaccggctgcccatcgccaccaggagccgcagcaggaccaacatgctgatggacctgcacatggaccacgagggcagcagccaggagaccatccaggaggtgcagcctgaggaggtgctggtgatcagcctgggcaccggcccccagctgaccccaggcatgatgtctgaaaatgaggtgctgaacatgcagctgagtgatggcggccagggagatgtgcctgtggatgagaacaagctgcacggcaagccagacaagaccctgcgcttcagcctgtgcagcgacaacctggagggcatcagcgagggccccagcaacagaagcaacagcgtgagcagcctggacctggagggggagagcgtgtctgagctgggcgccggccccagcggcagcaatggagtggaggccctgcagctgctggagcacgagcaggccaccacccaggacaacctggatgacaagctgaggaagtttgagatccgggacatgatgggcctgacagatgaccgggacatcagcgagaccgtgtctgagacctggagcacagatgtgctgggcagtgactttgaccccaacattgatgaggaccggctgcaggagattgctggagctgctgctgagaacatgctgggcagcctgctgtgcctgcccggcagcggctctgtgctgctggacccctgcaccggcagcaccatcagcgagaccaccagcgaggcctggagcgtggaggtgctgcccagcgacagcgaggccccagacctgaagcaggaggagcggctgcaggagctggagagctgcagcggcctgggcagcaccagtgatgacacagatgtgcgggaggtgagcagccggcccagcaccccaggcctgtctgtggtgtctggcatcagcgccaccagcgaggacatccccaacaagattgaggacctgcggtctgagtgcagcagtgactttggaggcaaggacagcgtgaccagcccagacatggatgagatcacccatggagcccaccagctgaccagcccccccagccagagcgagagcctgctggccatgtttgaccccctgagcagccatgagggcgccagcgctgtggtgcggcccaaggtgcactacgcccggcccagccaccccccaccagacccccccatcctggagggcgctgtgggcggcaatgaggcccggctgcccaactttggcagccacgtgctgaccccagctgagatggaggccttcaagcagaggcacagctacccagagcggctggtgcgcagccgcagcagtgacatcgtgtcctctgtgcggcggcccatgtctgaccccagctggaacagaagacctggaaatgaggagcgggagctgcccccagctgctgccatcggggccaccagcctggtggccgccccccacagcagcagcagcagccccagcaaggacagcagcagaggagaaacagaggagaggaaggacagtgatgatgagaagagtgacaggaaccggccctggtggaggaagagatttgtgtctgccatgcccaagtag

SEQ ID NO: 154601 - DNA, 4437 bp, Artificial Sequence; identical to SEQ ID NO: 154594
  Description of Artificial Sequence: Synthetic coding sequence

SEQ ID NO: 154602 - DNA, 2271 bp, Artificial Sequence
  Description of Artificial Sequence: Synthetic coding sequence
atggtgaagctggacatccacaccctggcccaccacctgaagcaggagcggctgtatgtgaacagcgagaagcagctgatccagaggctgaatgctgatgtgctgaagacagctgagaagctgtacagaacagcctggatcgccaagcagcagaggatcaacctggacaggctcatcatcaccagcgctgaggccagccctgctgagtgctgccagcacgccaagatcctggaggacacccagtttgtggatggctacaagcagctgggcttccaggagacagcctacggggagttcctgagccggctgcgggagaaccccaggctcatcgccagcagcctggtggccggggagaagctgaaccaggagaacacccagagcgtcatctacacagtgttcaccagcctgtatggcaactgcatcatgcaggaggatgagagctacctgctgcaggtgctgcgctacctgattgaatttgagctgaaggagagtgacaacccccggcggctgctgcggcggggcacctgtgccttcagcatcctcttcaagctgttcagcgagggcctcttcagcgccaagctgttcctgacagccaccctgcacgagcccatcatgcagctgctggtggaggatgaggaccacctggagacagaccccaacaagctgattgagcgcttcagccccagccagcaggagaagctgtttggagagaagggcagtgaccgcttccggcagaaggtgcaggagatggtggagagcaatgaggccaagctggtggccctggtgaacaagttcatcggctacctgaagcagaacacctactgcttcccccacagcctgcgctggatcgtgtcccagatgtacaagaccctgagctgtgtggaccggctggaggtgggggaggtgcgggccatgtgcacagacctgctgctggcctgcttcatctgcccagctgtggtgaaccctgagcagtatggcatcatcagtgatgcccccatcaatgaggtggcccgcttcaacctgatgcaggtgggccgcctgctgcagcagctggccatgacaggcagcgaggagggggaccccaggaccaagagcagcctgggcaagtttgacaagagctgtgtggccgccttcctggatgtggtgattggaggccgggctgtggagaccccacccctgagctctgtgaacctgctggagggcctgagcaggacagtggtgtacatcacctacagccagctgatcaccctggtgaacttcatgaagtctgtgatgtctggggaccagctgcgggaggacaggatggccctggacaacctgctggccaacctgcccccagccaagccaggcaagagcagcagcctggagatgaccccctacaacaccccccagctgagccctgccaccaccccagccaacaagaagaaccggctgcccatcgccaccaggagccgcagcaggaccaacatgctgatggacctgcacatggaccacgagggcagcagccaggagaccatccaggaggtgcagcctgaggaggtgctggtgatcagcctgggcaccggcccccagctgaccccaggcatgatgtctgaaaatgaggtgctgaacatgcagctgagtgatggcggccagggagatgtgcctgtggatgagaacaagctgcacggcaagccagacaagaccctgcgcttcagcctgtgcagcgacaacctggagggcatcagcgagggccccagcaacagaagcaacagcgtgagcagcctggacctggagggggagagcgtgtctgagctgggcgccggccccagcggcagcaatggagtggaggccctgcagctgctggagcacgagcaggccaccacccaggacaacctggatgacaagctgaggaagtttgagatccgggacatgatgggcctgacagatgaccgggacatcagcgagaccgtgtctgagacctggagcacagatgtgctgggcagtgactttgaccccaacattgatgaggaccggctgcaggagattgctggagctgctgctgagaacatgctgggcagcctgctgtgcctgcccggcagcggctctgtgctgctggacccctgcaccggcagcaccatcagcgagaccaccagcgaggcctggagcgtggaggtgctgcccagcgacagcgaggccccagacctgaagcaggaggagcggctgcaggagctggagagctgcagcggcctgggcagcaccagtgatgacacagatgtgcgggaggcctag

SEQ ID NO: 154603 - DNA, 921 bp, Artificial Sequence
  Description of Artificial Sequence: Synthetic coding sequence
atgggcggcaggaagatggccacagatgaagaaaatgtgtatggcctggaggagaatgcccagagccggcaggagagcacccggcggctcatcctggtgggccgcactggagctgggaagagcgccactggaaacagcatcctgggccagaggcgcttcttcagccggctgggcgccacctctgtgacccgggcctgcaccaccggcagccgccgctgggacaagtgccacgtggaggtggtggacaccccagacatcttcagcagccaggtgtccaagacagaccccggctgtgaggagcggggccactgctacctgctgagcgcccctggcccccacgccctgctgctggtgacccagctgggccgcttcaccgcccaggaccagcaggccgtgcggcaggtgcgggacatgtttggagaagatgtgctgaagtggatggtgattgtgttcaccaggaaagaagacctggccggcggcagcctgcatgactatgtgagcaacacagagaacagagccctgcgggagctggtggccgagtgtggcggccgggtgtgtgcctttgacaacagagccaccggccgggagcaggaggcccaggtggagcagctgctgggcatggtggagggcctggtgctggagcacaagggggcccactacagcaatgaggtgtatgagctggcccaggtgctgcgctgggccggccctgaggagcggctgcggcgggtggccgagcgggtggccgcccgggtgcagaggcggccctggggcgcctggctgagcgcccggctgtggaagtggctgaagagccccaggtcctggaggctgggcctggccctgctgctgggcggggccctgctcttctgggtgctgctgcaccggcgctggagcgaggccgtggccgaggtgggccctgactag

SEQ ID NO: 154604 - DNA, 681 bp, Artificial Sequence
  Description of Artificial Sequence: Synthetic coding sequence
atgtcctgggtgcaggccgccagcctcatccagggccctggggacaagggagatgtgtttgatgaggaggctgatgagagcctgctggcccagcgggagtggcagagcaacatgcagaggagagtgaaggagggctacagagatggcattgatgctgggaaggctgtgaccctgcagcagggcttcaaccagggctacaagaagggagctgaggtgatcctgaactacggccgcctgcggggcaccctgagcgccctgctgtcctggtgccacctgcacaacaacaacagcaccctcatcaacaagatcaacaacctgctggatgctgtgggccagtgtgaggagtatgtgctgaagcacctgaagagcatcaccccacccagccacgtggtggacctgctggacagcattgaggacatggacctgtgccacgtggtgcctgctgagaagaagattgatgaggccaaggatgagcggctgtgtgagaacaatgctgagttcaacaagaactgcagcaagagccacagcggcatcgactgcagctatgtggagtgctgcaggacccaggagcacgcccacagcgagaaccccagccccacctggatcctggagcagacagccagcctggtgaagcagctgggcctgtctgtggatgtgctgcagcacctgaagcagctgtag

SEQ ID NO: 154605 - DNA, 990 bp, Artificial Sequence
  Description of Artificial Sequence: Synthetic coding sequence
atggccgcccagtatggctccatgtccttcaaccccagcacccctggggccagctatggccctggccggcaggagcccaggaacagccagctgagaattgtgctggtgggcaagacaggagctgggaagagcgccaccggcaacagcatcctgggcaggaaggtgttccacagcggcacagctgccaagagcatcaccaagaagtgtgagaagaggagcagctcctggaaggagacagagctggtggtggtggacaccccaggcatctttgacacagaggtgcccaatgctgagaccagcaaggagatcatccgctgcatcctgctgaccagccctggcccccacgccctgctgctggtggtgcccctgggccgctacacagaggaggagcacaaggccacagagaagatcctgaagatgtttggagagcgggcccgctccttcatgatcctgatcttcaccaggaaggatgacctgggggacaccaacctgcatgactacctgcgggaggcccctgaggacatccaggacctgatggacatctttggagaccgctactgtgccctgaacaacaaggccaccggggctgagcaggaggcccagagggcccagctgctgggcctcatccagagggtggtgcgggagaacaaggagggctgctacaccaacaggatgtaccagagagctgaggaggagatccagaagcagacccaggccatgcaggagctgcaccgggtggagctggagcgggagaaggcccgcatccgggaggagtatgaggagaagatcaggaagctggaggacaaggtggagcaggagaagaggaagaagcagatggagaagaagctggccgagcaggaggcccactatgctgtgcggcagcagagggccaggacagaggtggagagcaaggatggcatcctggagctgatcatgacagccctgcagatcgccagcttcatcctgctgcggctgtttgctgaggactag

SEQ ID NO: 154606 - DNA, 786 bp, Artificial Sequence
  Description of Artificial Sequence: Synthetic coding sequence
atggccgcccagtatggctccatgtccttcaaccccagcacccctggggccagctatggccctggccggcaggagcccaggaacagccagctgagaattgtgctggtgggcaagacaggagctgggaagagcgccaccggcaacagcatcctgggcaggaaggtgttccacagcggcacagctgccaagagcatcaccaagaagatcctgaagatgtttggagagcgggcccgctccttcatgatcctgatcttcaccaggaaggatgacctgggggacaccaacctgcatgactacctgcgggaggcccctgaggacatccaggacctgatggacatctttggagaccgctactgtgccctgaacaacaaggccaccggggctgagcaggaggcccagagggcccagctgctgggcctcatccagagggtggtgcgggagaacaaggagggctgctacaccaacaggatgtaccagagagctgaggaggagatccagaagcagacccaggccatgcaggagctgcaccgggtggagctggagcgggagaaggcccgcatccgggaggagtatgaggagaagatcaggaagctggaggacaaggtggagcaggagaagaggaagaagcagatggagaagaagctggccgagcaggaggcccactatgctgtgcggcagcagagggccaggacagaggtggagagcaaggatggcatcctggagctgatcatgacagccctgcagatcgccagcttcatcctgctgcggctgtttgctgaggactag

SEQ ID NO: 154607 - DNA, 456 bp, Artificial Sequence
  Description of Artificial Sequence: Synthetic coding sequence
atggccgcccagtatggctccatgtccttcaaccccagcacccctggggccagctatggagagcgggccttcagcgccccccagacccggctgcagggcggccctggccggcaggagcccaggaacagccagctgagaattgtgctggtgggcaagacaggagctgggaagagcgccaccggcaacagcatcctgggcaggaaggtgttccacagcggcacagctgccaagagcatcaccaagaagtgtgagaagaggagcagctcctggaaggagacagagctggtggtggtggacaccccaggcatctttgacacagaggtgcccaatgctgagaccagcaaggagatcatccgctgcatcctgctgaccagccctggcccccacgccctgctgctggtggtgcccctgggccgctacacagaggaggagcacaaggccacagagaagatctag

SEQ ID NO: 154608 - DNA, 924 bp, Artificial Sequence
  Description of Artificial Sequence: Synthetic coding sequence
atgggcggcttccagaggggcaagtatggcaccatggccgagggccgctctgaggacaacctgagcgccaccccaccagccctgcgcatcatcctggtgggcaagacaggctgtgggaagagcgccactggaaacagcatcctgggccagcctgtgtttgagagcaagctgcgggcccagagcgtgaccaggacctgccaggtgaagacaggcacctggaatggaaggaaggtgctggtggtggacacccccagcatctttgagagccaggccgacacccaggagctgtacaagaacatcggggactgctacctgctgagcgcccctggcccccacgtgctgctgctggtgatccagctgggccgcttcaccgcccaggacacagtggccatcaggaaggtgaaggaggtgtttggcaccggggccatgagacatgtggtgatcctcttcacccacaaggaggacctgggcggccaggccctggatgattatgtggccaacacagacaactgcagcctgaaggacctggtgagagaatgtgagcggcgctactgtgccttcaacaactggggctctgtggaggagcagaggcagcagcaggccgagctgctggccgtgattgagcggctgggccgggagcgggagggcagcttccacagcaatgacctcttcctggatgcccagctgctgcagaggactggagctggggcctgccaggaggactaccggcagtaccaggccaaggtggagtggcaggtggagaagcacaagcaggagctgcgggagaatgaaagcaactgggcctacaaggccctgctgcgggtgaagcacctgatgctgctgcactatgagatctttgtgttcctgctgctgtgcagcatcctcttcttcatcatcttcctgttcatcttccactacatctag

SEQ ID NO: 154609 - DNA, 1032 bp, Artificial Sequence
  Description of Artificial Sequence: Synthetic coding sequence
atggagctgagcgccccagcccacggcagcagcctgacagccagcgcccagccccccagcgtgacagccaccctggaggaccgggcccagcagcccttcctggagaggatgggcggcttccagaggggcaagtatggcaccatggccgagggccgctctgaggacaacctgagcgccaccccaccagccctgcgcatcatcctggtgggcaagacaggctgtgggaagagcgccactggaaacagcatcctgggccagcctgtgtttgagagcaagctgcgggcccagagcgtgaccaggacctgccaggtgaagacaggcacctggaatggaaggaaggtgctggtggtggacacccccagcatctttgagagccaggccgacacccaggagctgtacaagaacatcggggactgctacctgctgagcgcccctggcccccacgtgctgctgctggtgatccagctgggccgcttcaccgcccaggacacagtggccatcaggaaggtgaaggaggtgtttggcaccggggccatgagacatgtggtgatcctcttcacccacaaggaggacctgggcggccaggccctggatgattatgtggccaacacagacaactgcagcctgaaggacctggtgagagaatgtgagcggcgctactgtgccttcaacaactggggctctgtggaggagcagaggcagcagcaggccgagctgctggccgtgattgagcggctgggccgggagcgggagggcagcttccacagcaatgacctcttcctggatgcccagctgctgcagaggactggagctggggcctgccaggaggactaccggcagtaccaggccaaggtggagtggcaggtggagaagcacaagcaggagctgcgggagaatgaaagcaactgggcctacaaggccctgctgcgggtgaagcacctgatgctgctgcactatgagatctttgtgttcctgctgctgtgcagcatcctcttcttcatcatcttcctgttcatcttccactacatctag

SEQ ID NO: 154610 - DNA, 879 bp, Artificial Sequence
  Description of Artificial Sequence: Synthetic coding sequence
atggaggaggaggagtatgagcagatcccccaggagaaccccccagaggagctgagccaggaccctgtgctggagctgagcggcggcctgcgggagaaggagcagaagaccccccggcggctgcggctcatcctgatgggcaagacaggcagcggcaagagcgccaccggcaacagcatcctgggcagagatgtgtttgagagcaagctgagcaccaggcctgtgaccaagaccagccagaggaggagccgggagtgggccggcaaggagctggaggtgattgacacccccaacatcctgagcccccaggtgtccccagaggtggctgatgccatctgccaggccatcgtgctgagcgcccctggcccccatgctgtgctgctggtgacccagctgggccgcttcacagatgaggaccagcaggtggtgcggcggctgcaggaggtgtttggagtgggcgtgctgggccacaccatcctggtgttcaccaggaaggaggacctggccggcggcagcctggaggactatgtgcgggagaccaacaaccaggccctggcctggctggatgtgaccctggcccggcggcactgcggcttcaacaacagagcccagggcgaggagcaggaggcccagctgcgggagctgatggagaaggtggaggccatcatgtgggagaatgaaggagactactacagcaacaaggcctaccagtacacccagcagaacttccggctgaaggagctgcaggagcggcaggtgtcccagggccagggctctgaagatgtgcctggagaggagagctggctggagggcctgagccagatccagaaggagagcgaggaggcccaccgctgcctgctgggcaaggctgacctgtag

SEQ ID NO: 154611 - DNA, 1062 bp, Artificial Sequence
  Description of Artificial Sequence: Synthetic coding sequence
aagccctggtactgggtgtcctggtgcagcatcggccaggtgtccctcttcttcctgggcagcgccctggccctgggagaaaatgtgcagccccacctgcagggctgcggccccaggatggtggcccagcgctggttccagggccgctgctggagcttcaccatctgcccctgcagcctgggcgtgcaccctgaggcccctggagatgacaagatgggctacatgggcccctaccccagcagcctgtgcttcctgtggatcttcctgggcctgcgggagaaggagcagaagaccccccggcggctgcggctcatcctgatgggcaagacaggcagcggcaagagcgccactggaaacagcatcctgggcagagatgtgtttgagagcaagctgagcaccaggcctgtgaccaagaccagccagaggaggagccgggagtgggccggcaaggagctggaggtgattgacacccccaacatcctgagcccccaggtgtccccagaggtggctgatgccatctgccaggccatcgtgctgagcgcccctggcccccatgctgtgctgctggtgacccagctgggccgcttcacagatgaggaccagcaggtggtgcggcggctgcaggaggtgtttggagtgggcgtgctgggccacaccatcctggtgttcaccaggaaagaagacctggccggcggcagcctggaggactatgtgcgggagaccaacaaccaggccctggcctggctggatgtgaccctggcccggcggcactgcggcttcaacaacagagcccagggcgaggagcaggaggcccagctgcgggagctgatggagaaggtggaggccatcatgtgggagaatgaaggagactactacagcaacaaggcctaccagtacacccagcagaacttccggctgaaggagctgcaggagcggcaggtgtcccagggccagggctctgaagatgtgcctggagaggagagctggctggagggcctgagccagatccagaaggagagcgaggaggcccaccgctgcctgctgggcaaggctgacctgtag

SEQ ID NO: 154612 - DNA, 189 bp, Artificial Sequence
  Description of Artificial Sequence: Synthetic coding sequence
atggaggaggaggagtatgagcagatcccccaggagaaccccccagaggagctgagccaggaccctgtgctggagctgagcggcggcctggcccggggcggccgccgctacctgcccagccacaggctcatccggccccgggccccccggcgggcccctggggacaccactggacctgtgcatggatag

SEQ ID NO: 154613 - DNA, 1266 bp, Artificial Sequence
  Description of Artificial Sequence: Synthetic coding sequence
atgcgctggatcctcttcatcggggccctgattggcagcagcatctgtggccaggagaagttcttcggggaccaggtgctgcgcatcaacgtgagaaatggagatgagatcagcaagctgagccagctggtgaacagcaacaacctgaagctgaacttctggaagagccccagcagcttcaacagacctgtggatgtgctggtgcccagcgtgtccctgcaggccttcaagagcttcctgcggagccagggcctggagtatgctgtgaccatcgaggacctgcaggccctgctggacaatgaagatgatgagatgcagcacaatgaaggccaggagaggagcagcaacaacttcaactacggggcctaccacagcctggaggccatctaccacgagatggacaacattgctgctgacttcccagacctggccaggagagtgaagattggccacagctttgagaaccggcccatgtatgtgctgaagttcagcactggaaaaggagtgcggcggcctgctgtgtggctgaatgccggcatccacagccgggagtggatcagccaggccacagccatctggacagccaggaagatcgtgtctgactaccagagggaccctgccatcaccagcatcctggagaagatggacatcttcctgctgcctgtggccaacccagatggctacgtgtacacccagacccagaaccggctgtggaggaagaccaggagcaggaaccctggcagcagctgcattggagctgaccccaacagaaactggaatgccagctttgctgggaagggggccagtgacaacccctgcagcgaggtgtaccacggcccccacgccaacagcgaggtggaggtgaagtctgtggtggacttcatccagaagcacggcaacttcaagggcttcatcgacctgcacagctacagccagctgctgatgtacccctacggctacagcgtgaagaaggccccagatgctgaggagctggacaaggtggcccggctggccgccaaggccctggcctctgtgtctggaacagagtaccaggtgggccccacctgcaccaccgtgtacccagccagcggcagcagcattgactgggcctatgacaatggcatcaagtttgccttcacctttgagctgcgggacaccggcacctacggcttcctgctgcctgccaaccagatcatccccacagctgaggagacctggctgggcctgaagaccatcatggagcacgtgcgggacaacctgtactag

SEQ ID NO: 154614 - DNA, 927 bp, Artificial Sequence
  Description of Artificial Sequence: Synthetic coding sequence
atggtgcactgcagctgtgtgctcttcagaaaatatggcaacttcatcgacaagctgcggctcttcacccggggcggcagcggcggcatgggctacccccggctgggcggggagggcggcaaaggaggagatgtgtgggtggtggcccagaacaggatgaccctgaagcagctgaaggaccgctaccccaggaagagatttgtggccggcgtgggcgccaacagcaagttccccaatgctgggaagagcagcctgctgagctgtgtgtcccatgccaagccagccatcgctgactatgccttcaccaccctgaagccagagctgggcaagatcatgtacagcgacttcaagcagatctctgtggccgacctgcccggcctcatcgagggcgcccacatgaacaagggcatgggccacaagttcctgaagcacattgaaagaacccggcagctgctgtttgtggtggacatcagcggcttccagctgagcagccacacccagtacagaacagcctttgagaccatcatcctgctgaccaaggagctggagctgtacaaggaggagctgcagaccaagccagccctgctggccgtgaacaagatggacctgcctgatgcccaggacaagttccacgagctgatgagccagctgcagaaccccaaggacttcctgcacctgtttgagaagaacatgatccctgagaggacagtggagttccagcacatcatccccatctctgctgtgactggagagggcatcgaggagctgaagaactgcatcaggaagagcctggatgagcaggccaaccaggagaatgatgccctgcacaagaagcagctgctgaacctgtggatcagtgacaccatgagcagcacagagccccccagcaagcatgctgtgaccaccagcaagatggacatcatctag

SEQ ID NO: 154615 - DNA, 711 bp, Artificial Sequence
  Description of Artificial Sequence: Synthetic coding sequence
atgtctgcccccagcgccacccccatctttgcccctggagagaactgcagccctgcctggggcgccgccccagctgcctatgatgctgctgacacccacctgcgcatcctgggcaagcctgtgatggagcgctgggagaccccctacatgcacgccctggccgccgccgccagcagcaagggcggccgggtgctggaggtgggcttcggcatggccatcgccgccagcaaggtgcaggaggcccccattgatgagcactggatcatcgagtgcaatgatggagtcttccagaggctgcgggactgggccccccggcagacccacaaggtgatccccctgaagggcctgtgggaggatgtggcccccaccctgcctgatggccactttgatggcatcctgtatgacacctaccccctgtctgaggagacctggcacacccaccagttcaacttcatcaagaaccacgccttccggctgctgaagccaggcggcgtgctgacctactgcaacctgacctcctggggcgagctgatgaagagcaagtacagcgacatcaccatcatgtttgaggagacccaggtgcctgccctgctggaggccggcttcagaagagagaacatcagaacagaggtgatggccctggtgcccccagctgactgccgctactatgccttcccccagatgatcacccccctggtgaccaagggctag

SEQ ID NO: 154616 - DNA, 810 bp, Artificial Sequence
  Description of Artificial Sequence: Synthetic coding sequence
atgtctgcccccagcgccacccccatctttgcccctggagagaactgcagccctgcctggggcgccgccccagctgcctatgatgctgctgacacccacctgcgcatcctgggcaagcctgtgatggagcgctgggagaccccctacatgcacgccctggccgccgccgccagcagcaagggcggccgggtgctggaggtgggcttcggcatggccatcgccgccagcaaggtgcaggaggcccccattgatgagcactggatcatcgagtgcaatgatggagtcttccagaggctgcgggactgggccccccggcagacccacaaggtgatccccctgaagggcctgtgggaggatgtggcccccaccctgcctgatggccactttgatggcatcctgtatgacacctaccccctgtctgaggagacctggcacacccaccagttcaacttcatcaagaaccacgccttccggctgctgaagccaggcggcgtgctgacctactgcaacctgacctcctggggcgagctgatgaagagcaagtacagcgacatcaccatcatgtttgaggtgcggcccccagaggtgccccacggcagccctggcagtgacctgggctggggctgggagggcgctgctggggccaccctgctgcctggagagggccccttcctgaccccctgggtgggctggacagtgctggtgcacctggagatcaaggtgctgtgcctggcccagtggctgcctggagctgtggcccaggtgtacaaccccagcacagtggagggccggggcggccagatcgcctag

SEQ ID NO: 154617 - DNA, 1416 bp, Artificial Sequence
  Description of Artificial Sequence: Synthetic coding sequence
atgtgtgccgcccagatgccacccctggcccacatcttccggggcacctttgtgcacagcacctggacctgccccatggaggtgctgcgggaccacctgctgggcgtgtctgattctgggaagatcgtgttcctggaggaggccagccagcaggagaagctggccaaggagtggtgcttcaagccctgtgagatccgggagctgagccaccacgagttcttcatgcctggcctggtggacacccacatccacgccagccagtacagctttgctggcagcagcattgacctgcccctgctggagtggctgaccaagtacaccttccctgctgagcaccgcttccagaacatcgactttgctgaggaggtgtacaccagggtggtgcggaggaccctgaagaatggcaccaccacagcctgctactttgccaccatccacacagacagcagcctgctgctggccgacatcacagacaagtttggccagagggcctttgtgggcaaggtgtgcatggacctgaatgacaccttccctgagtacaaggagaccacagaggagagcatcaaggagacagaaagatttgtgtctgagatgctgcagaagaactacagccgggtgaagcccatcgtgaccccccgcttcagcctgagctgcagcgagaccctgatgggagagctgggcaacatcgccaagacccgggacctgcacatccagagccacatcagtgaaaatagagatgaggtggaggccgtgaagaacctgtaccccagctacaagaactacacctctgtgtatgacaagaacaacctgctgaccaacaagacagtgatggcccacggctgctacctgtctgctgaggagctgaatgtgttccacgagcggggggccagcatcgcccactgccccaacagcaacctgagcctgagcagcggcttcctgaatgtgctggaggtgctgaagcatgaggtgaagattggcctgggcacagatgtggccggcggctacagctacagcatgctggatgccatccggcgggctgtgatggtgagcaacatcctgctgatcaacaaggtgaatgagaagagcctgaccctgaaggaggtgttccggctggccaccctgggcggcagccaggccctgggcctggatggagagatcggcaactttgaggtgggcaaggagtttgatgccatcctgatcaaccccaaggccagtgacagccccatcgacctcttctatggagacttctttggagacatcagcgaggccgtcatccagaagttcctgtacctgggagatgacagaaatattgaggaggtgtatgtgggcggcaagcaggtggtgcccttcagcagctctgtgaaggagaccatccacctgcctgccagcagcccccaccccccacccttcccctag

SEQ ID NO: 154618 - DNA, 1365 bp, Artificial Sequence
  Description of Artificial Sequence: Synthetic coding sequence
atgtgtgccgcccagatgccacccctggcccacatcttccggggcacctttgtgcacagcacctggacctgccccatggaggtgctgcgggaccacctgctgggcgtgtctgattctgggaagatcgtgttcctggaggaggccagccagcaggagaagctggccaaggagtggtgcttcaagccctgtgagatccgggagctgagccaccacgagttcttcatgcctggcctggtggacacccacatccacgccagccagtacagctttgctggcagcagcattgacctgcccctgctggagtggctgaccaagtacaccttccctgctgagcaccgcttccagaacatcgactttgctgaggaggtgtacaccagggtggtgcggaggaccctgaagaatggcaccaccacagcctgctactttgccaccatccacacagacagcagcctgctgctggccgacatcacagacaagtttggccagagggcctttgtgggcaaggtgtgcatggacctgaatgacaccttccctgagtacaaggagaccacagaggagagcatcaaggagacagaaagatttgtgtctgagatgctgcagaagaactacagccgggtgaagcccatcgtgaccccccgcttcagcctgagctgcagcgagaccctgatgggagagctgggcaacatcgccaagacccgggacctgcacatccagagccacatcagtgaaaatagagatgaggtggaggccgtgaagaacctgtaccccagctacaagaactacacctctgtgtatgacaagaacaacctgctgaccaacaagacagtgatggcccacggctgctacctgtctgctgaggagctgaatgtgttccacgagcggggggccagcatcgcccactgccccaacagcaacctgagcctgagcagcggcttcctgaatgtgctggaggtgctgaagcatgaggtgaagattggcctgggcacagatgtggccggcggctacagctacagcatgctggatgccatccggcgggctgtgatggtgagcaacatcctgctgatcaacaaggtgaatgagaagagcctgaccctgaaggaggtgttccggctggccaccctgggcggcagccaggccctgggcctggatggagagatcggcaactttgaggtgggcaaggagtttgatgccatcctgatcaaccccaaggccagtgacagccccatcgacctcttctatggagacttctttggagacatcagcgaggccgtcatccagaagttcctgtacctgggagatgacagaaatattgaggaggtgtatgtgggcggcaagcaggtggtgcccttcagcagctctgtgtag

SEQ ID NO: 154619 - DNA, 1182 bp, Artificial Sequence
  Description of Artificial Sequence: Synthetic coding sequence
atgttcctggaggaggccagccagcaggagaagctggccaaggagtggtgcttcaagccctgtgagatccgggagctgagccaccacgagttcttcatgcctggcctggtggacacccacatccacgccagccagtacagctttgctggcagcagcattgacctgcccctgctggagtggctgaccaagtacaccttccctgctgagcaccgcttccagaacatcgactttgctgaggaggtgtacaccagggtggtgcggaggaccctgaagaatggcaccaccacagcctgctactttgccaccatccacacagacagcagcctgctgctggccgacatcacagacaagtttggccagagggcctttgtgggcaaggtgtgcatggacctgaatgacaccttccctgagtacaaggagaccacagaggagagcatcaaggagacagaaagatttgtgtctgagatgctgcagaagaacagccacatcagtgaaaatagagatgaggtggaggccgtgaagaacctgtaccccagctacaagaactacacctctgtgtatgacaagaacaacctgctgaccaacaagacagtgatggcccacggctgctacctgtctgctgaggagctgaatgtgttccacgagcggggggccagcatcgcccactgccccaacagcaacctgagcctgagcagcggcttcctgaatgtgctggaggtgctgaagcatgaggtgaagattggcctgggcacagatgtggccggcggctacagctacagcatgctggatgccatccggcgggctgtgatggtgagcaacatcctgctgatcaacaaggtgaatgagaagagcctgaccctgaaggaggtgttccggctggccaccctgggcggcagccaggccctgggcctggatggagagatcggcaactttgaggtgggcaaggagtttgatgccatcctgatcaaccccaaggccagtgacagccccatcgacctcttctatggagacttctttggagacatcagcgaggccgtcatccagaagttcctgtacctgggagatgacagaaatattgaggaggtgtatgtgggcggcaagcaggtggtgcccttcagcagctctgtgaaggagaccatccacctgcctgccagcagcccccaccccccacccttcccctag

SEQ ID NO: 154620 - DNA, 1233 bp, Artificial Sequence
  Description of Artificial Sequence: Synthetic coding sequence
atggaggtgctgcgggaccacctgctgggcgtgtctgacagcggcaagatcgtgttcctggaggaggccagccagcaggagaagctggccaaggagtggtgcttcaagccctgtgagatccgggagctgagccaccacgagttcttcatgcctggcctggtggacacccacatccacgccagccagtacagctttgctggcagcagcattgacctgcccctgctggagtggctgaccaagtacaccttccctgctgagcaccgcttccagaacatcgactttgctgaggaggtgtacaccagggtggtgcggaggaccctgaagaatggcaccaccacagcctgctactttgccaccatccacacagacagcagcctgctgctggccgacatcacagacaagtttggccagagggcctttgtgggcaaggtgtgcatggacctgaatgacaccttccctgagtacaaggagaccacagaggagagcatcaaggagacagaaagatttgtgtctgagatgctgcagaagaacagccacatcagcgagaacagagatgaggtggaggccgtgaagaacctgtaccccagctacaagaactacacctctgtgtatgacaagaacaacctgctgaccaacaagacagtgatggcccacggctgctacctgtctgctgaggagctgaatgtgttccacgagcggggggccagcatcgcccactgccccaacagcaacctgagcctgagcagcggcttcctgaatgtgctggaggtgctgaagcatgaggtgaagattggcctgggcacagatgtggccggcggctacagctacagcatgctggatgccatcagaagagctgtgatggtgagcaacatcctgctgatcaacaaggtgaatgagaagagcctgaccctgaaggaggtgttccggctggccaccctgggcggcagccaggccctgggcctggatggagaaattggcaactttgaggtgggcaaggagtttgatgccatcctgatcaaccccaaggccagtgacagccccatcgacctcttctacggggacttcttcggggacatcagcgaggccgtcatccagaagttcctgtacctgggagatgacaggaacatcgaggaggtgtatgtgggcggcaagcaggtggtgcccttcagcagctctgtgaaggagaccatccacctgcctgccagcagcccccaccccccacccttcccctag

SEQ ID NO: 154621 - DNA, 588 bp, Artificial Sequence
  Description of Artificial Sequence: Synthetic coding sequence
atgaccctcttccagaacacccggcggcccctgaggaacagaagcaggaagctgcgggactgccacagcgtgacccaggccggcgtgcagtggagggacctgagcagcctgaagcccccacctcctgtgttcaagcgcttcagctgcctgagcctgcccagctcctgggactacagatttgtgtctgagatgctgcagaagaactacagccgggtgaagcccatcgtgaccccccgcttcagcctgagctgcagcgagaccctgatgggagagctgggcaacatcgccaagacccgggacctgcacatccagagccacatcagtgaaaatagagatgaggtggaggccgtgaagaacctgtaccccagctacaagaactacacctctgtgtatgacaagaacaacctgctgaccaacaagacagtgatggcccacggctgctacctgtctgctgaggagctgaatgtgttccacgagcggggggccagcatcgcccactgccccaacagcaacctgagcctgagcagcggcttcctgaatgtgctggaggtgctgaagcatgaggtgaagattggcctgggcacctag

SEQ ID NO: 154622 - DNA, 540 bp, Artificial Sequence
  Description of Artificial Sequence: Synthetic coding sequence
gagcggggggccagcatcgcccactgccccaacagcaacctgagcctgagcagcggcttcctgaatgtgctggaggtgctgaagcatgaggtgaagattggcctgggcacagatgtggccggcggctacagctacagcatgctggatgccatccggcgggctgtgatggtgagcaacatcctgctgatcaacaaggtgaatgagaagagcctgaccctgaaggaggtgttccggctggccaccctgggcggcagccaggccctgggcctggatggagagatcggcaactttgaggtgggcaaggagtttgatgccatcctgatcaaccccaaggccagtgacagccccatcgacctcttctatggagacttctttggagacatcagcgaggccgtcatccagaagttcctgtacctgggagatgacagaaatattgaggaggtgtatgtgggcggcaagcaggtggtgcccttcagcagctctgtgaaggagaccatccacctgcctgccagcagcccccaccccccacccttcccctag

SEQ ID NO: 154623 - DNA, 1365 bp, Artificial Sequence; identical to SEQ ID NO: 154618
  Description of Artificial Sequence: Synthetic coding sequence

SEQ ID NO: 154624 - DNA, 1143 bp, Artificial Sequence
  Description of Artificial Sequence: Synthetic coding sequence
atgcctggcctggtggacacccacatccacgccagccagtacagctttgctggcagcagcattgacctgcccctgctggagtggctgaccaagtacaccttccctgctgagcaccgcttccagaacatcgactttgctgaggaggtgtacaccagggtggtgcggaggaccctgaagaatggcaccaccacagcctgctactttgccaccatccacacagacagcagcctgctgctggccgacatcacagacaagtttggccagagggcctttgtgggcaaggtgtgcatggacctgaatgacaccttccctgagtacaaggagaccacagaggagagcatcaaggagacagaaagatttgtgtctgagatgctgcagaagaactacagccgggtgaagcccatcgtgaccccccgcttcagcctgagctgcagcgagaccctgatgggagagctgggcaacatcgccaagacccgggacctgcacatccagagccacatcagtgaaaatagagatgaggtggaggccgtgaagaacctgtaccccagctacaagaactacacctctgtgtatgacaagaacaacctgctgaccaacaagacagtgatggcccacggctgctacctgtctgctgaggagctgaatgtgttccacgagcggggggccagcatcgcccactgccccaacagcaacctgagcctgagcagcggcttcctgaatgtgctggaggtgctgaagcatgaggtgaagattggcctgggcacagatgtggccggcggctacagctacagcatgctggatgccatccggcgggctgtgatggtgagcaacatcctgctgatcaacaaggtgaatgagaagagcctgaccctgaaggaggtgttccggctggccaccctgggcggcagccaggccctgggcctggatggagagatcggcaactttgaggtgggcaaggagtttgatgccatcctgatcaaccccaaggccagtgacagccccatcgacctcttctatggagacttctttggagacatcagcgaggccgtcatccagaagttcctgtacctgggagatgacagaaatattgaggaggtgtatgtgggcggcaagcaggtggtgcccttcagcagctctgtgtag

SEQ ID NO: 154625 - DNA, 2082 bp, Artificial Sequence
  Description of Artificial Sequence: Synthetic coding sequence
atggccctgtgcaatggagacagcaagctggagaatgccggcggggacctgaaggatggccaccaccactatgagggcgctgtggtgatcctggatgctggggcccagtatggcaaggtgattgacagaagagtgcgggagctgtttgtgcagagcgagatcttccccctggagaccccagcctttgccatcaaggagcagggcttccgggccatcatcatcagcggcggccccaacagcgtgtatgcagaagatgccccctggtttgatcctgccatcttcaccatcggcaagcctgtgctgggcatctgctacggcatgcagatgatgaacaaggtgtttggaggcaccgtgcacaagaagtctgtgagagaagatggagtcttcaacatctctgtggacaacacctgcagcctcttccggggcctgcagaaggaggaggtggtgctgctgacccatggagacagcgtggacaaggtggctgatggcttcaaggtggtggcccggagcggcaacatcgtggccggcatcgccaatgaaagcaagaagctgtatggagcccagttccaccctgaggtgggcctgacagaaaatggcaaggtgatcctgaagaacttcctgtatgacattgctggctgcagcggcaccttcaccgtgcagaaccgggagctggagtgcatccgggagatcaaggagcgggtgggcaccagcaaggtgctggtgctgctgagcggcggcgtggacagcacagtgtgcacagccctgctgaacagagccctgaaccaggagcaggtgattgctgtgcacatcgacaatggcttcatgaggaagcgggagagccagagcgtggaggaggccctgaagaagctgggcatccaggtgaaggtgatcaatgctgcccacagcttctacaacggcaccaccaccctgcccatcagtgatgaggacaggacccccaggaagaggatcagcaagaccctgaacatgaccaccagccctgaggagaagaggaagatcatcggggacacctttgtgaagatcgccaatgaagtcatcggggagatgaacctgaagccagaggaggtgttcctggcccagggcaccctgcggccagacctgattgagagcgccagcctggtggccagcggcaaggccgagctgatcaagacccaccacaatgacacagagctgatcaggaagctgcgggaggagggcaaggtgattgagcccctgaaggacttccacaaggatgaggtgcgcatcctgggccgggagctgggcctgcctgaggagctggtgagccgccaccccttccctggccctggcctggccatccgggtcatctgtgccgaggagccctacatctgcaaggacttccctgagaccaacaacatcctgaagatcgtggccgacttcagcgcctctgtgaagaagccccacaccctgctgcagagggtgaaggcctgcaccacagaggaggaccaggagaagctgatgcagatcaccagcctgcacagcctgaatgccttcctgctgcccatcaagacagtgggcgtgcagggcgactgccgcagctacagctatgtgtgtggcatcagcagcaaggatgagccagactgggagagcctcatcttcctggcccggctcatccccaggatgtgccacaacgtgaacagagtggtgtacatcttcggcccccctgtgaaggagcccccaacagatgtgacccccaccttcctgaccaccggggtgctgagcaccctgcggcaggccgactttgaggcccacaacatcctgcgggagagcggctacgccggcaagatcagccagatgcctgtgatcctgacccccctgcactttgaccgggaccccctgcagaagcagcccagctgccagaggtctgtggtgatccgcaccttcatcaccagtgacttcatgacaggcatcccagccaccccaggaaatgagatccctgtggaggtggtgctgaagatggtgacagagatcaagaagatccctggcatcagccgcatcatgtatgacctgaccagcaagcccccaggcaccacagagtgggagtag

SEQ ID NO: 154626 - DNA, 1929 bp, Artificial Sequence
  Description of Artificial Sequence: Synthetic coding sequence
atgctggaggagaccctgaggatggccaccaccaccatcaaggagcagggcttccgggccatcatcatcagcggcggccccaacagcgtgtatgcagaagatgccccctggtttgatcctgccatcttcaccatcggcaagcctgtgctgggcatctgctacggcatgcagatgatgaacaaggtgtttggaggcaccgtgcacaagaagtctgtgcgggaggatggagtcttcaacatctctgtggacaacacctgcagcctcttccggggcctgcagaaggaggaggtggtgctgctgacccacggggacagcgtggacaaggtggctgatggcttcaaggtggtggcccggagcggcaacatcgtggccggcatcgccaatgaaagcaagaagctgtatggagcccagttccaccctgaggtgggcctgacagaaaatggcaaggtgatcctgaagaacttcctgtatgacattgctggctgcagcggcaccttcaccgtgcagaaccgggagctggagtgcatccgggagatcaaggagcgggtgggcaccagcaaggtgctggtgctgctgtctggaggagtggacagcacagtgtgcacagccctgctgaacagagccctgaaccaggagcaggtgattgctgtgcacatcgacaatggcttcatgaggaagcgggagagccagagcgtggaggaggccctgaagaagctgggcatccaggtgaaggtgatcaatgctgcccacagcttctacaacggcaccaccaccctgcccatcagtgatgaggacaggacccccaggaagaggatcagcaagaccctgaacatgaccaccagccctgaggagaagaggaagatcattggagacacctttgtgaagatcgccaatgaggtgattggagagatgaacctgaagccagaggaggtgttcctggcccagggcaccctgcggccagacctgattgaaagtgccagcctggtggccagcggcaaggccgagctgatcaagacccaccacaatgacacagagctgatcaggaagctgcgggaggagggcaaggtgattgagcccctgaaggacttccacaaggatgaggtgcgcatcctgggccgggagctgggcctgcctgaggagctggtgagccgccaccccttccctggccctggcctggccatccgggtcatctgtgccgaggagccctacatctgcaaggacttccctgagaccaacaacatcctgaagatcgtggccgacttcagcgcctctgtgaagaagccccacaccctgctgcagagggtgaaggcctgcaccacagaggaggaccaggagaagctgatgcagatcaccagcctgcacagcctgaatgccttcctgctgcccatcaagacagtgggcgtgcagggcgactgccgcagctacagctatgtgtgtggcatcagcagcaaggatgagccagactgggagagcctcatcttcctggcccggctcatccccaggatgtgccacaacgtgaacagagtggtgtacatctttggacctcctgtgaaggagcccccaacagatgtgacccccaccttcctgaccactggagtgctgagcaccctgcggcaggccgactttgaggcccacaacatcctgcgggagagcggctacgccggcaagatcagccagatgcctgtgatcctgacccccctgcactttgaccgggaccccctgcagaagcagcccagctgccagaggtctgtggtgatccgcaccttcatcaccagtgacttcatgacaggcatcccagccaccccaggaaatgagatccctgtggaggtggtgctgaagatggtgacagagatcaagaagatccctggcatcagccgcatcatgtatgacctgaccagcaagcccccaggcaccacagagtgggagtag

SEQ ID NO: 154627 - DNA, 2082 bp, Artificial Sequence; identical to SEQ ID NO: 154625
  Description of Artificial Sequence: Synthetic coding sequence

SEQ ID NO: 154628 - DNA, 1146 bp, Artificial Sequence
  Description of Artificial Sequence: Synthetic coding sequence
atgtctggagtggtgaggaccctgagccgctgcctgctgcctgctgaggccggcggggcccgggagaggagagctggcagcggggccagagatgctgagcgggaggcccggcggcgcagccgggacattgatgccctgctggcccgggagaggagagctgtgcggcggctggtgaagatcctgctgctgggcgctggggagagcggcaagagcaccttcctgaagcagatgaggatcatccacggccgggagtttgaccagaaggccctgctggagttccgggacaccatctttgacaacatcctgaagggcagccgggtgctggtggatgcccgggacaagctgggcatcccctggcagtacagtgaaaatgagaagcacggcatgttcctgatggcctttgagaacaaggccggcctgcctgtggagcccgccaccttccagctgtatgtgcctgccctgagcgccctgtggagggacagcggcatccgggaggccttcagcagaagaagtgagttccagctgggggagagcgtgaagtacttcctggacaacctggacagaattggccagctgaactacttccccagcaagcaggacatcctgctggccaggaaggccaccaagggcatcgtggagcatgactttgtgatcaagaagatccccttcaagatggtggatgtgggcggccagaggagccagaggcagaagtggttccagtgctttgatggcatcaccagcatcctcttcatggtgagcagcagtgaatatgaccaggtgctgatggaggacaggaggaccaaccggctggtggagagcatgaacatctttgagaccatcgtgaacaacaagctgttcttcaacgtgtccatcatcctcttcctgaacaagatggacctgctggtggagaaggtgaagacagtgtccatcaagaagcacttcccagacttccggggggacccccaccggctggaggatgtgcagcgctacctggtgcagtgctttgacaggaagagaagaaacagaagcaagcccctcttccaccacttcaccacagccatcgacacagaaaatgtgcgctttgtgttccacgctgtgaaggacaccatcctgcaggagaacctgaaggacatcatgctgcagtag

SEQ ID NO: 154629 - DNA, 702 bp, Artificial Sequence
  Description of Artificial Sequence: Synthetic coding sequence
atgatctaccccctcatcgtgctgcccctgtgtgcctcctggcactggggcctcatcagaaaaggaattgtgctcttctggggcgagagcgtgaagtacttcctggacaacctggacagaattggccagctgaactacttccccagcaagcaggacatcctgctggccaggaaggccaccaagggcatcgtggagcatgactttgtgatcaagaagatccccttcaagatggtggatgtgggcggccagaggagccagaggcagaagtggttccagtgctttgatggcatcaccagcatcctcttcatggtgagcagcagtgaatatgaccaggtgctgatggaggacaggaggaccaaccggctggtggagagcatgaacatctttgagaccatcgtgaacaacaagctgttcttcaacgtgtccatcatcctcttcctgaacaagatggacctgctggtggagaaggtgaagacagtgtccatcaagaagcacttcccagacttccggggggacccccaccggctggaggatgtgcagcgctacctggtgcagtgctttgacaggaagagaagaaacagaagcaagcccctcttccaccacttcaccacagccatcgacacagaaaatgtgcgctttgtgttccacgctgtgaaggacaccatcctgcaggagaacctgaaggacatcatgctgcagtag

SEQ ID NO: 154630 - DNA, 867 bp, Artificial Sequence
  Description of Artificial Sequence: Synthetic coding sequence
atgaggatcatccacggccgggagtttgaccagaaggccctgctggagttccgggacaccatctttgacaacatcctgaagggcagccgggtgctggtggatgcccgggacaagctgggcatcccctggcagtacagtgaaaatgagaagcacggcatgttcctgatggcctttgagaacaaggccggcctgcctgtggagcccgccaccttccagctgtatgtgcctgccctgagcgccctgtggagggacagcggcatccgggaggccttcagcagaagaagtgagttccagctgaactacttccccagcaagcaggacatcctgctggccaggaaggccaccaagggcatcgtggagcatgactttgtgatcaagaagatccccttcaagatggtggatgtgggcggccagaggagccagaggcagaagtggttccagtgctttgatggcatcaccagcatcctcttcatggtgagcagcagtgaatatgaccaggtgctgatggaggacaggaggaccaaccggctggtggagagcatgaacatctttgagaccatcgtgaacaacaagctgttcttcaacgtgtccatcatcctcttcctgaacaagatggacctgctggtggagaaggtgaagacagtgtccatcaagaagcacttcccagacttccggggggacccccaccggctggaggatgtgcagcgctacctggtgcagtgctttgacaggaagagaagaaacagaagcaagcccctcttccaccacttcaccacagccatcgacacagaaaatgtgcgctttgtgttccacgctgtgaaggacaccatcctgcaggagaacctgaaggacatcatgctgcagtag

SEQ ID NO: 154631 - DNA, 1080 bp, Artificial Sequence
  Description of Artificial Sequence: Synthetic coding sequence
atgaccctggagagcatgatggcctgctgcctgagtgatgaggtgaaggagagcaagaggatcaatgctgagattgagaagcagctgcggcgggacaagagagatgcccggcgggagctgaagctgctgctgctgggcactggagagagcggcaagagcaccttcatcaagcagatgaggatcatccatggagctggctacagcgaggaggacaagaggggcttcaccaagctggtgtaccagaacatcttcaccgccatgcaggccatgatccgggccatggagaccctgaagatcctgtacaagtatgagcagaacaaggccaatgccctgctgatccgggaggtggatgtggagaaggtgaccacctttgagcaccagtatgtgtctgccatcaagaccctgtgggaggaccccggcatccaggagtgctatgacagaagaagagagtaccagctgagtgacagcgccaagtactacctgacagatgtggacagaattgccaccctgggctacctgcccacccagcaggatgtgctgcgggtgcgggtgcccaccaccggcatcatcgagtacccctttgacctggagaacatcatcttcaggatggtggatgtgggcggccagaggagtgaaagaaggaagtggatccactgctttgaaaatgtgaccagcatcatgttcctggtggccctgtctgaatatgaccaggtgctggtggagagtgacaatgaaaataggatggaggagagcaaggccctcttccgcaccatcatcacctacccctggttccagaacagcagcgtcatcctcttcctgaacaagaaggacctgctggaggacaagatcctgtacagccacctggtggactacttccctgagtttgatggcccccagagagatgcccaggccgcccgggagttcatcctgaagatgtttgtggacctgaacccagacagcgacaagatcatctacagccacttcacctgtgccacagacacagagaacatccgctttgtgtttgctgctgtgaaggacaccatcctgcagctgaacctgaaggagtacaacctggtgtag

SEQ ID NO: 154632 - DNA, 1059 bp, Artificial Sequence
  Description of Artificial Sequence: Synthetic coding sequence
atggctgacttcctgcccagccgctctgtgctgtctgtgtgcttccctggctgcctgctgaccagcggggaggccgagcagcagaggaagagcaaggagattgacaagtgcctgagccgggagaagacctacgtgaagaggctggtgaagatcctgctgctgggcgctggggagagcggcaagagcacctacagcaatgtcatcaagggcatgagggtgctggtggatgcccgggagaagctgcacatcccctggggagacaacagcaaccagcagcacggggacaagatgatgagctttgacacccgggcccccatggccgcccagggcatggtggagaccagggtcttcctgcagtacctgcctgccatccgggccctgtgggccgacagcggcatccagaatgcctatgacagaagaagagagttccagctgggggagagcgtgaagtacttcctggacaacctggacaagctgggggagccagactacatccccagccagcaggacatcctgctggcccggcggcccaccaagggcatccacgagtatgactttgagatcaagaatgtgcccttcaagatggtggatgtgggcggccagaggtctgagaggaagcgctggtttgagtgctttgacagcgtgaccagcatcctcttcctggtgagcagcagcgagtttgaccaggtgctgatggaggaccggctgaccaaccggctgacagagagcctgaacatctttgagaccatcgtgaacaacagagtcttcagcaatgtgtccatcatcctcttcctgaacaagacagacctgctggaggagaaggtgcagatcgtgtccatcaaggactacttcctggagtttgaaggagacccccactgcctgagagatgtgcagaagttcctggtggagtgcttcaggaacaagagaagagaccagcagcagaagcccctgtaccaccacttcaccacagccatcaacacagagaacatccggctggtgttcagagatgtgaaggacaccatcctgcatgacaacctgaagcagctgatgctgcagtag

SEQ ID NO: 154633 - DNA, 1134 bp, Artificial Sequence
  Description of Artificial Sequence: Synthetic coding sequence
atggctgacttcctgcccagccgctctgtgctgtctgtgtgcttccctggctgcctgctgaccagcggggaggccgagcagcagaggaagagcaaggagattgacaagtgcctgagccgggagaagacctacgtgaagaggctggtgaagatcctgctgctgggcgctggggagagcggcaagagcaccttcctgaagcagatgaggatcatccacggccaggactttgaccagagggcccgggaggagttccggcccaccatctacagcaatgtcatcaagggcatgagggtgctggtggatgcccgggagaagctgcacatcccctggggagacaacagcaaccagcagcacggggacaagatgatgagctttgacacccgggcccccatggccgcccagggcatggtggagaccagggtcttcctgcagtacctgcctgccatccgggccctgtgggccgacagcggcatccagaatgcctatgacagaagaagagagttccagctgggggagagcgtgaagtacttcctggacaacctggacaagctgggggagccagactacatccccagccagcaggacatcctgctggcccggcggcccaccaagggcatccatgaatatgactttgagatcaagaatgtgcccttcaagatggtggatgtgggcggccagaggtctgagaggaagcgctggtttgaatgttttgattctgtgaccagcatcctcttcctggtgagcagcagcgagtttgaccaggtgctgatggaggaccggctgaccaaccggctgacagagagcctgaacatctttgagaccatcgtgaacaacagagtcttcagcaatgtgtccatcatcctcttcctgaacaagacagacctgctggaggagaaggtgcagatcgtgtccatcaaggactacttcctggagtttgaaggagacccccactgcctgagagatgtgcagaagttcctggtggagtgcttcaggaacaagaggcgggaccagcagcagaagcccctgtaccaccacttcaccacagccatcaacacagagaacatccggctggtgttcagagatgtgaaggacaccatcctgcatgacaacctgaagcagctgatgctgcagtag

SEQ ID NO: 154634 - DNA, 849 bp, Artificial Sequence
  Description of Artificial Sequence: Synthetic coding sequence
atgagggtgctggtggatgcccgggagaagctgcacatcccctggggagacaacagcaaccagcagcacggggacaagatgatgagctttgacacccgggcccccatggccgcccagggcatggtggagaccagggtcttcctgcagtacctgcctgccatccgggccctgtgggccgacagcggcatccagaatgcctatgacagaagaagagagttccagctgggggagagcgtgaagtacttcctggacaacctggacaagctgggggagccagactacatccccagccagcaggacatcctgctggcccggcggcccaccaagggcatccacgagtatgactttgagatcaagaatgtgcccttcaagatggtggatgtgggcggccagaggtctgagaggaagcgctggtttgagtgctttgacagcgtgaccagcatcctcttcctggtgagcagcagcgagtttgaccaggtgctgatggaggaccggctgaccaaccggctgacagagagcctgaacatctttgagaccatcgtgaacaacagagtcttcagcaatgtgtccatcatcctcttcctgaacaagacagacctgctggaggagaaggtgcagatcgtgtccatcaaggactacttcctggagtttgaaggagacccccactgcctgagagatgtgcagaagttcctggtggagtgcttcaggaacaagagaagagaccagcagcagaagcccctgtaccaccacttcaccacagccatcaacacagagaacatccggctggtgttcagagatgtgaaggacaccatcctgcatgacaacctgaagcagctgatgctgcagtag

SEQ ID NO: 154635 - DNA, 1068 bp, Artificial Sequence
  Description of Artificial Sequence: Synthetic coding sequence
atggccggctgctgctgcctgtctgctgaggagaaggagagccagaggatctctgctgagattgagcggcagctgcggcgggacaagaaggatgcccggcgggagctgaagctgctgctgctgggcactggagagagcggcaagagcaccttcatcaagcagatgaggatcatccacggcagcggctacagtgatgaggacaggaagggcttcaccaagctggtgtaccagaacatcttcaccgccatgcaggccatgatccgggccatggacaccctgcgcatccagtatgtgtgtgagcagaacaaggaaaatgcccagatcatccgggaggtggaggtggacaaggtgtccatgctgagccgggagcaggtggaggccatcaagcagctgtggcaggaccccggcatccaggagtgctatgacagaagaagagagtaccagctgagtgacagcgccaagtactacctgacagacatcgacagaattgccacccccagctttgtgcccacccagcaggatgtgctgcgggtgcgggtgcccaccaccggcatcatcgagtacccctttgacctggagaacatcatcttcaggatggtggatgtgggcggccagaggagtgaaagaaggaagtggatccactgctttgagagcgtgaccagcatcatcttcctggtggccctgtctgaatatgaccaggtgctggctgaatgtgacaatgaaaataggatggaggagagcaaggccctcttcaagaccatcatcacctacccctggttcctgaacagcagcgtcatcctcttcctgaacaagaaggacctgctggaggagaagatcatgtacagccacctgatctcctacttccctgagtacacaggccccaagcaggatgtgcgggccgcccgggacttcatcctgaagctgtaccaggaccagaacccagacaaggagaaggtgatctacagccacttcacctgtgccacagacacagacaacatccgctttgtgtttgctgctgtgaaggacaccatcctgcagctgaacctgcgggagttcaacctggtgtag

SEQ ID NO: 154636 - DNA, 1125 bp, Artificial Sequence
  Description of Artificial Sequence: Synthetic coding sequence
atggcccggagcctgacctggcgctgctgcccctggtgcctgacagaagatgagaaggctgctgcccgggtggaccaggagatcaaccgcatcctgctggagcagaagaagcaggacagaggagagctgaagctgctgctgctgggccctggagagagcggcaagagcaccttcatcaagcagatgaggatcatccacggggccggctacagcgaggaggagaggaagggcttccggcccctggtgtaccagaacatctttgtgtccatgagggccatgattgaggccatggagcggctgcagatccccttcagcaggcctgagagcaagcaccacgccagcctggtgatgagccaggacccctacaaggtgaccacctttgagaagagatatgctgctgccatgcagtggctgtggagagatgctggcatccgggcctactatgaaagaagaagagagttccacctgctggacagcgctgtgtactacctgagccacctggagcgcatcacagaggagggctacgtgcccacagcccaggatgtgctgcggagcaggatgcccaccaccggcatcaatgagtactgcttctctgtgcagaagaccaacctgcgcatcgtggatgtgggcggccagaagtctgagaggaagaagtggatccactgctttgaaaatgtgattgccctgatctacctggccagcctgtctgaatatgaccagtgcctggaggagaacaaccaggagaacaggatgaaggagagcctggccctgtttggcaccatcctggagctgccctggttcaagagcaccagcgtcatcctcttcctgaacaagacagacatcctggaggagaagatccccaccagccacctggccacctacttccccagcttccagggccccaagcaggatgctgaggccgccaagcgcttcatcctggacatgtacaccaggatgtacacaggctgtgtggatggccctgagggcagcaagaagggggcccggagcagaagactcttcagccactacacctgtgccacagacacccagaacatcaggaaggtgttcaaggatgtgcgggacagcgtgctggcccgctacctggatgagatcaacctgctgtag

SEQ ID NO: 154637 - DNA, 1065 bp, Artificial Sequence
  Description of Artificial Sequence: Synthetic coding sequence
atgggctgcaccctgtctgctgaggagagagctgccctggagaggagcaaggccatcgagaagaacctgaaggaggatggcatctctgctgccaaggatgtgaagctgctgctgctgggcgctggggagagcggcaagagcaccatcgtgaagcagatgaagatcatccatgaagatggcttcagcggggaggatgtgaagcagtacaagcctgtggtgtacagcaacaccatccagagcctggccgccatcgtgcgggccatggacaccctgggcattgaatatggagacaaggagaggaaggcagatgccaagatggtgtgtgatgtggtgtccaggatggaggacacagagcccttctctgctgagctgctgagcgccatgatgaggctgtggggagacagcggcatccaggagtgcttcaacagaagccgggagtaccagctgaatgacagcgccaagtactacctggacagcctggacagaattggagctgctgactaccagcccacagagcaggacatcctgcggaccagggtgaagaccactggaattgtggagacccacttcaccttcaagaacctgcacttccggctgtttgatgtgggcggccagaggtctgagaggaagaagtggatccactgctttgaagatgtgacagccatcatcttctgtgtggccctgagcggctatgaccaggtgctgcatgaagatgagaccaccaacaggatgcatgagagcctgatgctgtttgacagcatctgcaacaacaagttcttcatcgacaccagcatcatcctcttcctgaacaagaaggacctgtttggagagaagatcaagaagagccccctgaccatctgcttccctgagtacacaggccccaacacctatgaagatgctgctgcctacatccaggcccagtttgagagcaagaacagaagccccaacaaggagatctactgccacatgacctgtgccacagacaccaacaacatccaggtggtgtttgatgctgtgacagacatcatcatcgccaacaacctgcggggctgcggcctgtactag

SEQ ID NO: 154638 - DNA, 1065 bp, Artificial Sequence
  Description of Artificial Sequence: Synthetic coding sequence
atgggctgcaccctgtctgctgaggagagagctgccctggagaggagcaaggccatcgagaagaacctgaaggaggatggcatctctgctgccaaggatgtgaagctgctgctgctgggcgctggggagagcggcaagagcaccatcgtgaagcagatgaagatcatccatgaagatggcttcagcggggaggatgtgaagcagtacaagcctgtggtgtacagcaacaccatccagagcctggccgccatcgtgcgggccatggacaccctgggcattgaatatggagacaaggagaggaaggcagatgccaagatggtgtgtgatgtggtgtccaggatggaggacacagagcccttctctgctgagctgctgagcgccatgatgaggctgtggggagacagcggcatccaggagtgcttcaacagaagccgggagtaccagctgaatgacagcgccaagtactacctggacagcctggacagaattggagctgctgactaccagcccacagagcaggacatcctgcggaccagggtgaagaccactggaattgtggagacccacttcaccttcaagaacctgcacttccggctgtttgatgtgggcggccagaggtctgagaggaagaagtggatccactgctttgaagatgtgacagccatcatcttctgtgtggccctgagcggctatgaccaggtgctgcatgaagatgagaccaccaacaggatgcatgagagcctgaagctgtttgacagcatctgcaacaacaagtggttcacagacaccagcatcatcctcttcctgaacaagaaggacatctttgaggagaagatcaagaagagccccctgaccatctgcttccctgagtacacaggccccagcgccttcacagaggccgtggcctacatccaggcccagtatgagagcaagaacaagagcgcccacaaggagatctacacccacgtgacctgtgccacagacaccaacaacatccagtttgtgtttgatgctgtgacagatgtgatcatcgccaagaacctgcggggctgcggcctgtactag

SEQ ID NO: 154639 - DNA, 1146 bp, Artificial Sequence
  Description of Artificial Sequence: Synthetic coding sequence
atgggctgcctgggcggcaacagcaagaccacagaggaccagggcgtggatgagaaggagcggcgggaggccaacaagaagattgagaagcagctgcagaaggagcggctggcctacaaggccacccaccggctgctgctgctgggcgctggggagagcggcaagagcaccatcgtgaagcagatgaggatcctgcacgtgaatggcttcaaccctgaggagaagaagcagaagatcctggacatcaggaagaatgtgaaggatgccatcgtgaccatcgtgtctgccatgagcaccatcatcccccctgtgcccctggccaaccctgagaaccagttcagaagtgactacatcaagagcatcgcccccatcacagactttgagtacagccaggagttctttgaccacgtgaagaagctgtgggatgatgaaggagtgaaggcctgctttgagaggagcaatgagtaccagctgattgactgtgcccagtacttcctggagagaattgattctgtgtccctggtggactacacccccacagaccaggacctgctgcgctgccgggtgctgaccagcggcatctttgagacccgcttccaggtggacaaggtgaacttccacatgtttgatgtgggcggccagagagatgagaggaggaagtggatccagtgcttcaatgatgtgacagccatcatctacgtggccgcctgcagcagctacaacatggtgatccgggaggacaacaacaccaaccggctgcgggagagcctggacctgtttgagagcatctggaacaaccgctggctgcggaccatcagcatcatcctcttcctgaacaagcaggacatgctggccgagaaggtgctggccggcaagagcaagattgaggactacttcccagaatatgccaactacacagtgcctgaagatgccaccccagatgctggggaggaccccaaggtgacccgggccaagttcttcatccgggacctcttcctgcgcatcagcacagccactggagatggcaagcactactgctacccccacttcacctgtgctgtggacacagagaacatccggcgggtcttcaatgactgccgggacatcatccagaggatgcacctgaagcagtatgagctgctgtag

SEQ ID NO: 154640 - DNA, 1377 bp, Artificial Sequence
  Description of Artificial Sequence: Synthetic coding sequence
atgggcctgtgctacagcctgcggcccctgctgtttggaggccctggagatgacccctgtgccgccagcgagccccctgtggaggatgcccagcctgccccagccccagccctggcccctgtgcgggccgccgcccgggacacagcccggaccctgctgccccggggcggggagggcagccctgcctgtgcccggcccaaggctgacaagcccaaggagaagaggcagaggacagagcagctgtctgctgaggagcgggaggccgccaaggagcgggaggccgtgaaggaggccaggaaggtgtcccggggcatcgacaggatgctgcgggaccagaagagggacctgcagcagacccaccggctgctgctgctgggcgctggggagagcggcaagagcaccatcgtgaagcagatgaggatcctgcacgtgaatggcttcaaccctgaggagaagaagcagaagatcctggacatcaggaagaatgtgaaggatgccatcgtgaccatcgtgtctgccatgagcaccatcatcccccctgtgcccctggccaaccctgagaaccagttcagaagtgactacatcaagagcatcgcccccatcacagactttgagtacagccaggagttctttgaccacgtgaagaagctgtgggatgatgagggcgtgaaggcctgctttgagaggagcaatgagtaccagctgattgactgtgcccagtacttcctggagagaattgacagcgtgtccctggtggactacacccccacagaccaggacctgctgcgctgccgggtgctgaccagcggcatctttgagacccgcttccaggtggacaaggtgaacttccacatgtttgatgtgggcggccagagagatgaaagaaggaagtggatccagtgcttcaatgatgtgacagccatcatctacgtggccgcctgcagcagctacaacatggtgatccgggaggacaacaacaccaaccggctgcgggagagcctggacctgtttgagagcatctggaacaaccgctggctgcggaccatcagcatcatcctcttcctgaacaagcaggacatgctggccgagaaggtgctggccggcaagagcaagattgaggactacttcccagaatatgccaactacacagtgcctgaagatgccaccccagatgctggggaggaccccaaggtgacccgggccaagttcttcatccgggacctcttcctgcgcatcagcacagccactggagatggcaagcactactgctacccccacttcacctgtgctgtggacacagagaacatcagaagagtcttcaatgactgccgggacatcatccagaggatgcacctgaagcagtatgagctgctgtag

SEQ ID NO: 154641 - DNA, 1146 bp, Artificial Sequence; identical to SEQ ID NO: 154639
  Description of Artificial Sequence: Synthetic coding sequence

SEQ ID NO: 154642 - DNA, 1146 bp, Artificial Sequence; identical to SEQ ID NO: 154639
  Description of Artificial Sequence: Synthetic coding sequence

SEQ ID NO: 154643 - DNA, 525 bp, Artificial Sequence
  Description of Artificial Sequence: Synthetic coding sequence
atgtttgatgtgggcggccagagagatgaaagaaggaagtggatccagtgcttcaatgatgtgacagccatcatctacgtggccgcctgcagcagctacaacatggtgatccgggaggacaacaacaccaaccggctgcgggagagcctggacctgtttgagagcatctggaacaaccgctggctgcggaccatcagcatcatcctcttcctgaacaagcaggacatgctggccgagaaggtgctggccggcaagagcaagattgaggactacttcccagaatatgccaactacacagtgcctgaagatgccaccccagatgctggggaggaccccaaggtgacccgggccaagttcttcatccgggacctcttcctgcgcatcagcacagccactggagatggcaagcactactgctacccccacttcacctgtgctgtggacacagagaacatcagaagagtcttcaatgactgccgggacatcatccagaggatgcacctgaagcagtatgagctgctgtag

SEQ ID NO: 154644 - DNA, 963 bp, Artificial Sequence
  Description of Artificial Sequence: Synthetic coding sequence
atgaggatcctgcacgtgaatggcttcaaccctgaggagaagaagcagaagatcctggacatcaggaagaatgtgaaggatgccatcgtgaccatcgtgtctgccatgagcaccatcatcccccctgtgcccctggccaaccctgagaaccagttcagaagtgactacatcaagagcatcgcccccatcacagactttgagtacagccaggagttctttgaccacgtgaagaagctgtgggatgatgagggcgtgaaggcctgctttgagaggagcaatgagtaccagctgattgactgtgcccagtacttcctggagagaattgacagcgtgtccctggtggactacacccccacagaccaggacctgctgcgctgccgggtgctgaccagcggcatctttgagacccgcttccaggtggacaaggtgaacttccacatgtttgatgtgggcggccagagagatgaaagaaggaagtggatccagtgcttcaatgatgtgacagccatcatctacgtggccgcctgcagcagctacaacatggtgatccgggaggacaacaacaccaaccggctgcgggagagcctggacctgtttgagagcatctggaacaaccgctggctgcggaccatcagcatcatcctcttcctgaacaagcaggacatgctggccgagaaggtgctggccggcaagagcaagattgaggactacttcccagaatatgccaactacacagtgcctgaagatgccaccccagatgctggggaggaccccaaggtgacccgggccaagttcttcatccgggacctcttcctgcgcatcagcacagccactggagatggcaagcactactgctacccccacttcacctgtgctgtggacacagagaacatcagaagagtcttcaatgactgccgggacatcatccagaggatgcacctgaagcagtatgagctgctgtag

SEQ ID NO: 154645 - DNA, 1065 bp, Artificial Sequence
  Description of Artificial Sequence: Synthetic coding sequence
atgggctgcaccctgtctgctgaggacaaggctgctgtggagaggagcaagatgattgacaggaacctgagagaagatggagagaaggccgcccgggaggtgaagctgctgctgctgggcgctggggagagcggcaagagcaccatcgtgaagcagatgaagatcatccatgaagctggctacagcgaggaggagtgcaagcagtacaaggctgtggtgtacagcaacaccatccagagcatcatcgccatcatccgggccatgggccgcctgaagattgactttggagacagcgcccgggcagatgatgcccggcagctgtttgtgctggccggggctgctgaggagggcttcatgacagctgagctggccggggtcatcaagaggctgtggaaggacagcggcgtgcaggcctgcttcaacagaagccgggagtaccagctgaatgattctgctgcctactacctgaatgacctggaccgcatcgcccagcccaactacatccccacccagcaggatgtgctgcggaccagggtgaagaccaccggcatcgtggagacccacttcaccttcaaggacctgcacttcaagatgtttgatgtgggcggccagaggtctgagaggaagaagtggatccactgctttgaaggagtgacagccatcatcttctgtgtggccctgagtgactatgacctggtgctggccgaggatgaggagatgaacaggatgcatgagagcatgaagctgtttgacagcatctgcaacaacaagtggttcacagacaccagcatcatcctcttcctgaacaagaaggacctgtttgaggagaagatcaagaagagccccctgaccatctgctacccagaatatgccggcagcaacacctatgaggaggccgccgcctacatccagtgccagtttgaggacctgaacaagaggaaggacaccaaggagatctacacccacttcacctgtgccacagacaccaagaatgtgcagtttgtgtttgatgctgtgacagatgtgatcatcaagaacaacctgaaggactgtggcctcttctag

SEQ ID NO: 154646 - DNA, 72 bp, Artificial Sequence
  Description of Artificial Sequence: Synthetic coding sequence
atgggctgcaccctgtctgctgaggacaaggctgctgtggagaggagcaagatgattgacaggaacctgtag

SEQ ID NO: 154647 - DNA, 909 bp, Artificial Sequence
  Description of Artificial Sequence: Synthetic coding sequence
atgaagatcatccatgaagctggctacagcgaggaggagtgcaagcagtacaaggctgtggtgtacagcaacaccatccagagcatcatcgccatcatccgggccatgggccgcctgaagattgactttggagacagcgcccgggcagatgatgcccggcagctgtttgtgctggccggggctgctgaggagggcttcatgacagctgagctggccggggtcatcaagaggctgtggaaggacagcggcgtgcaggcctgcttcaacagaagccgggagtaccagctgaatgattctgctgcctactacctgaatgacctggaccgcatcgcccagcccaactacatccccacccagcaggatgtgctgcggaccagggtgaagaccaccggcatcgtggagacccacttcaccttcaaggacctgcacttcaagatgtttgatgtgggcggccagaggtctgagaggaagaagtggatccactgctttgaaggagtgacagccatcatcttctgtgtggccctgagtgactatgacctggtgctggccgaggatgaggagatgaacaggatgcatgagagcatgaagctgtttgacagcatctgcaacaacaagtggttcacagacaccagcatcatcctcttcctgaacaagaaggacctgtttgaggagaagatcaagaagagccccctgaccatctgctacccagaatatgccggcagcaacacctatgaggaggccgccgcctacatccagtgccagtttgaggacctgaacaagaggaaggacaccaaggagatctacacccacttcacctgtgccacagacaccaagaatgtgcagtttgtgtttgatgctgtgacagatgtgatcatcaagaacaacctgaaggactgtggcctcttctag

SEQ ID NO: 154648 - DNA, 1020 bp, Artificial Sequence
  Description of Artificial Sequence: Synthetic coding sequence
atggagtatgccggccacctgcctgccagcagcgcccagggcaccatcctggcctgcaccagctgcacaggagctggggagagcggcaagagcaccatcgtgaagcagatgaagatcatccatgaagatggctacagcgaggaggagtgccggcagtacagagctgtggtgtacagcaacaccatccagagcatcatggccatcgtgaaggccatgggcaacctgcagattgactttgctgaccccagcagagcagatgatgcccggcagctgtttgccctgagctgcacagctgaggagcagggcgtgctgcctgatgacctgtctggagtcatccggcggctgtgggccgaccatggagtgcaggcctgcttcggccgcagccgggagtaccagctgaatgacagcgctgcctactacctgaatgacctggagagaattgcccagagcgactacatccccacccagcaggatgtgctgcggaccagggtgaagaccactggaattgtggagacccacttcaccttcaaggacctgcacttcaagatgtttgatgtgggcggccagaggtctgagaggaagaagtggatccactgctttgagggcgtgacagccatcatcttctgtgtggccctgagcgcctatgacctggtgctggctgaagatgaggagatgaacaggatgcatgagagcatgaagctgtttgacagcatctgcaacaacaagtggttcacagacaccagcatcatcctcttcctgaacaagaaggacctgtttgaggagaagatcacccacagccccctgaccatctgcttccctgagtacaccggggccaacaagtatgatgaggccgccagctacatccagagcaagtttgaggacctgaacaagaggaaggacaccaaggagatctacacccacttcacctgtgccacagacaccaagaatgtgcagtttgtgtttgatgctgtgacagatgtgatcatcaagaacaacctgaaggactgtggcctcttctag

SEQ ID NO: 154649 - DNA, 1068 bp, Artificial Sequence
  Description of Artificial Sequence: Synthetic coding sequence
atgggctgcaccgtgtctgctgaggacaaggctgctgctgagaggagcaagatgattgacaagaacctgagagaagatggagagaaggccgcccgggaggtgaagctgctgctgctgggcgctggggagagcggcaagagcaccatcgtgaagcagatgaagatcatccatgaagatggctacagcgaggaggagtgccggcagtacagagctgtggtgtacagcaacaccatccagagcatcatggccatcgtgaaggccatgggcaacctgcagattgactttgctgaccccagcagagcagatgatgcccggcagctgtttgccctgagctgcacagctgaggagcagggcgtgctgcctgatgacctgtctggagtcatccggcggctgtgggccgaccatggagtgcaggcctgcttcggccgcagccgggagtaccagctgaatgacagcgctgcctactacctgaatgacctggagagaattgcccagagcgactacatccccacccagcaggatgtgctgcggaccagggtgaagaccactggaattgtggagacccacttcaccttcaaggacctgcacttcaagatgtttgatgtgggcggccagaggtctgagaggaagaagtggatccactgctttgagggcgtgacagccatcatcttctgtgtggccctgagcgcctatgacctggtgctggctgaagatgaggagatgaacaggatgcatgagagcatgaagctgtttgacagcatctgcaacaacaagtggttcacagacaccagcatcatcctcttcctgaacaagaaggacctgtttgaggagaagatcacccacagccccctgaccatctgcttccctgagtacaccggggccaacaagtatgatgaggccgccagctacatccagagcaagtttgaggacctgaacaagaggaaggacaccaaggagatctacacccacttcacctgtgccacagacaccaagaatgtgcagtttgtgtttgatgctgtgacagatgtgatcatcaagaacaacctgaaggactgtggcctcttctag

SEQ ID NO: 154650 - DNA, 1020 bp, Artificial Sequence
  Description of Artificial Sequence: Synthetic coding sequence
atgacagagggcgtgaagaccctgggctggaccaagcagaagggcggctgccactggggccgctctgagggcgctggggagagcggcaagagcaccatcgtgaagcagatgaagatcatccatgaagatggctacagcgaggaggagtgccggcagtacagagctgtggtgtacagcaacaccatccagagcatcatggccatcgtgaaggccatgggcaacctgcagattgactttgctgaccccagcagagcagatgatgcccggcagctgtttgccctgagctgcacagctgaggagcagggcgtgctgcctgatgacctgtctggagtcatccggcggctgtgggccgaccatggagtgcaggcctgcttcggccgcagccgggagtaccagctgaatgacagcgctgcctactacctgaatgacctggagagaattgcccagagcgactacatccccacccagcaggatgtgctgcggaccagggtgaagaccactggaattgtggagacccacttcaccttcaaggacctgcacttcaagatgtttgatgtgggcggccagaggtctgagaggaagaagtggatccactgctttgagggcgtgacagccatcatcttctgtgtggccctgagcgcctatgacctggtgctggctgaagatgaggagatgaacaggatgcatgagagcatgaagctgtttgacagcatctgcaacaacaagtggttcacagacaccagcatcatcctcttcctgaacaagaaggacctgtttgaggagaagatcacccacagccccctgaccatctgcttccctgagtacaccggggccaacaagtatgatgaggccgccagctacatccagagcaagtttgaggacctgaacaagaggaaggacaccaaggagatctacacccacttcacctgtgccacagacaccaagaatgtgcagtttgtgtttgatgctgtgacagatgtgatcatcaagaacaacctgaaggactgtggcctcttctag

SEQ ID NO: 154651 - DNA, 912 bp, Artificial Sequence
  Description of Artificial Sequence: Synthetic coding sequence
atgaagatcatccatgaagatggctacagcgaggaggagtgccggcagtacagagctgtggtgtacagcaacaccatccagagcatcatggccatcgtgaaggccatgggcaacctgcagattgactttgctgaccccagcagagcagatgatgcccggcagctgtttgccctgagctgcacagctgaggagcagggcgtgctgcctgatgacctgtctggagtcatccggcggctgtgggccgaccatggagtgcaggcctgcttcggccgcagccgggagtaccagctgaatgacagcgctgcctactacctgaatgacctggagagaattgcccagagcgactacatccccacccagcaggatgtgctgcggaccagggtgaagaccactggaattgtggagacccacttcaccttcaaggacctgcacttcaagatgtttgatgtgggcggccagaggtctgagaggaagaagtggatccactgctttgagggcgtgacagccatcatcttctgtgtggccctgagcgcctatgacctggtgctggctgaagatgaggagatgaacaggatgcatgagagcatgaagctgtttgacagcatctgcaacaacaagtggttcacagacaccagcatcatcctcttcctgaacaagaaggacctgtttgaggagaagatcacccacagccccctgaccatctgcttccctgagtacaccggggccaacaagtatgatgaggccgccagctacatccagagcaagtttgaggacctgaacaagaggaaggacaccaaggagatctacacccacttcacctgtgccacagacaccaagaatgtgcagtttgtgtttgatgctgtgacagatgtgatcatcaagaacaacctgaaggactgtggcctcttctag

SEQ ID NO: 154652 - DNA, 957 bp, Artificial Sequence
  Description of Artificial Sequence: Synthetic coding sequence
atgagaggagctggggagagcggcaagagcaccatcgtgaagcagatgaagatcatccatgaagatggctacagcgaggaggagtgccggcagtacagagctgtggtgtacagcaacaccatccagagcatcatggccatcgtgaaggccatgggcaacctgcagattgactttgctgaccccagcagagcagatgatgcccggcagctgtttgccctgagctgcacagctgaggagcagggcgtgctgcctgatgacctgagcggggtcatccggcggctgtgggccgaccacggcgtgcaggcctgcttcggccgcagccgggagtaccagctgaatgattctgctgcctactacctgaatgacctggagcgcatcgcccagagcgactacatccccacccagcaggatgtgctgcggaccagggtgaagaccaccggcatcgtggagacccacttcaccttcaaggacctgcacttcaagatgtttgatgtgggcggccagaggtctgagaggaagaagtggatccactgctttgaaggagtgacagccatcatcttctgtgtggccctgagcgcctatgacctggtgctggccgaggatgaggagatgaacaggatgcatgagagcatgaagctgtttgacagcatctgcaacaacaagtggttcacagacaccagcatcatcctcttcctgaacaagaaggacctgtttgaggagaagatcacccacagccccctgaccatctgcttccctgagtacacaggagccaacaagtatgatgaagctgccagctacatccagagcaagtttgaggacctgaacaagaggaaggacaccaaggagatctacacccacttcacctgtgccacagacaccaagaatgtgcagtttgtgtttgatgctgtgacagatgtgatcatcaagaacaacctgaaggactgtggcctcttctag

SEQ ID NO: 154653 - DNA, 825 bp, Artificial Sequence
  Description of Artificial Sequence: Synthetic coding sequence
atggccatcgtgaaggccatgggcaacctgcagattgactttgctgaccccagcagagcagatgatgcccggcagctgtttgccctgagctgcacagctgaggagcagggcgtgctgcctgatgacctgagcggggtcatccggcggctgtgggccgaccacggcgtgcaggcctgcttcggccgcagccgggagtaccagctgaatgattctgctgcctactacctgaatgacctggagcgcatcgcccagagcgactacatccccacccagcaggatgtgctgcggaccagggtgaagaccaccggcatcgtggagacccacttcaccttcaaggacctgcacttcaagatgtttgatgtgggcggccagaggtctgagaggaagaagtggatccactgctttgaaggagtgacagccatcatcttctgtgtggccctgagcgcctatgacctggtgctggccgaggatgaggagatgaacaggatgcatgagagcatgaagctgtttgacagcatctgcaacaacaagtggttcacagacaccagcatcatcctcttcctgaacaagaaggacctgtttgaggagaagatcacccacagccccctgaccatctgcttccctgagtacacaggagccaacaagtatgatgaagctgccagctacatccagagcaagtttgaggacctgaacaagaggaaggacaccaaggagatctacacccacttcacctgtgccacagacaccaagaatgtgcagtttgtgtttgatgctgtgacagatgtgatcatcaagaacaacctgaaggactgtggcctcttctag

SEQ ID NO: 154654 - DNA, 1086 bp, Artificial Sequence
  Description of Artificial Sequence: Synthetic coding sequence
atgggctgcaccgtgtctgctgaggacaaggctgctgctgagaggagcaagatgattgacaagaacctgagagaagatggagagaaggccgcccgggaggtgaagctgctgctgctgggcgctggggagagcggcaagagcaccatcgtgaagcagatgaagatcatccatgaagatggctacagcgaggaggagtgccggcagtacagagctgtggtgtacagcaacaccatccagagcatcatggccatcgtgaaggccatgggcaacctgcagattgactttgctgaccccagcagagcagatgatgcccggcagctgtttgccctgagctgcacagctgaggagcagggcgtgctgcctgatgacctgtctggagtcatccggcggctgtgggccgaccatggagtgcaggcctgcttcggccgcagccgggagtaccagctgaatgacagcgctgcctactacctgaatgacctggagagaattgcccagagcgactacatccccacccagcaggatgtgctgcggaccagggtgaagaccactggaattgtggagacccacttcaccttcaaggacctgcacttcaagatgtttgatgtgggcggccagaggtctgagaggaagaagtggatccactgctttgagggcgtgacagccatcatcttctgtgtggccctgagcgcctatgacctggtgctggctgaagatgaggagatgaacaggatgcatgagagcatgaagctgtttgacagcatctgcaacaacaagtggttcacagacaccagcatcatcctcttcctgaacaagaaggacctgtttgaggagaagatcacccacagccccctgaccatctgcttccctgagtacaccggggccaacaagtatgatgaggccgccagctacatccagagcaagtttgaggacctgaacaagaggaaggacaccaaggagatctacacccacttcacctgtgccacagacaccaagagcaggaagctgttccgggagaactacctgaagctgagtgaccctgaccagcagcccccaccagcccccctgcccagcgacagcgtgccctag

SEQ ID NO: 154655 - DNA, 1065 bp, Artificial Sequence
  Description of Artificial Sequence: Synthetic coding sequence
atgggctgcaccctgtctgctgaggacaaggctgctgtggagaggagcaagatgattgacaggaacctgagagaagatggagagaaggccgccaaggaggtgaagctgctgctgctgggcgctggggagagcggcaagagcaccatcgtgaagcagatgaagatcatccatgaagatggctacagtgaagatgagtgcaagcagtacaaggtggtggtgtacagcaacaccatccagagcatcatcgccatcatccgggccatgggccgcctgaagattgactttggagaggccgcccgggcagatgatgcccggcagctgtttgtgctggccggcagcgctgaggagggcgtgatgaccccagagctggccggggtcatcaagaggctgtggagagatggaggagtgcaggcctgcttcagccgcagccgggagtaccagctgaatgattctgccagctactacctgaatgacctggaccgcatcagccagagcaactacatccccacccagcaggatgtgctgcggaccagggtgaagaccaccggcatcgtggagacccacttcaccttcaaggacctgtacttcaagatgtttgatgtgggcggccagaggtctgagaggaagaagtggatccactgctttgaaggagtgacagccatcatcttctgtgtggccctgagtgactatgacctggtgctggccgaggatgaggagatgaacaggatgcatgagagcatgaagctgtttgacagcatctgcaacaacaagtggttcacagagaccagcatcatcctcttcctgaacaagaaggacctgtttgaggagaagatcaagaggagccccctgaccatctgctacccagagtacacaggcagcaacacctatgaggaggccgccgcctacatccagtgccagtttgaggacctgaacagaaggaaggacaccaaggagatctacacccacttcacctgtgccacagacaccaagaatgtgcagtttgtgtttgatgctgtgacagatgtgatcatcaagaacaacctgaaggaatgtggcctgtactag

SEQ ID NO: 154656 - DNA, 2652 bp, Artificial Sequence
  Description of Artificial Sequence: Synthetic coding sequence
atggctgaaaattctgtgctgaccagcaccactggaagaaccagcctggccgacagcagcatctttgacagcaaggtgacagagatcagcaaggagaacctgctgattggcagcaccagctatgtggaggaggagatgccccagatcgagaccagggtcatcctggtgcaggaggccggcaagcaggaggagctgatcaaggccctgaaggacatcaaggtgggctttgtgaagatggagagcgtggaggagtttgagggcctggacagccctgagtttgaaaatgtgtttgtggtgacagacttccaggacagcgtcttcaatgacctgtacaaggctgactgcagggtcatcggcccccctgtggtgctgaactgcagccagaagggggagcccctgcccttcagctgccggcccctgtactgcacctccatgatgaacctggtgctgtgcttcaccggcttcaggaagaaggaggagctggtgcggctggtgaccctggtgcaccacatgggcggcgtcatcaggaaggacttcaacagcaaggtgacccacctggtggccaactgcacccagggcgagaagttccgggtggccgtgtccctgggcacccccatcatgaagccagagtggatctacaaggcctgggagaggagaaatgagcaggacttctacgccgctgtggatgacttcagaaatgagttcaaggtgccccccttccaggactgcatcctgtccttcctgggcttcagtgatgaggagaagaccaacatggaggagatgacagagatgcagggcggcaagtacctgcccctgggagatgagcgctgcacccacctggtggtggaggagaacatcgtgaaggacctgccctttgagcccagcaagaagctgtatgtggtgaagcaggagtggttctggggcagcatccagatggatgcccgggccggggagaccatgtacctgtatgagaaggccaacaccccagagctgaagaagtctgtgtccatgctgagcctgaacacccccaacagcaacaggaagagaagaaggctgaaggagaccctggcccagctgagccgggagacagatgtgagccccttcccccccaggaagaggccttctgctgagcacagcctgagcatcggcagcctgctggacatcagcaacaccccagagagcagcatcaactacggggacacccccaagagctgcaccaagagcagcaagagcagcacccctgtgcccagcaagcagagcgcccgctggcaggtggccaaggagctgtaccagacagagagcaactacgtgaacatcctggccaccatcatccagctgttccaggtgcccctggaggaggagggccagaggggcggccccatcctggcccctgaggagatcaagaccatcttcggcagcatcccagacatctttgatgtgcacaccaagatcaaggatgacctggaggacctgattgtgaactgggatgagagcaagagcattggagacatcttcctgaagtacagcaaggacctggtgaagacctaccccccatttgtgaacttctttgagatgagcaaggagaccatcatcaagtgtgagaagcagaagccccgcttccacgccttcctgaagatcaaccaggccaagccagaatgtggccggcagagcctggtggagctgctgatccggcctgtgcagaggctgcccagcgtggccctgctgctgaatgacctgaagaagcacacagcagatgagaacccagacaagagcaccctggagaaggccatcggcagcctgaaggaggtgatgacccacatcaatgaagacaagaggaagacagaggcccagaagcagatctttgatgtggtgtatgaggtggatggctgcccagccaacctgctgagcagccacaggagcctggtgcagagggtggagaccatcagcctgggggagcacccctgtgacagaggagagcaggtgaccctcttcctgttcaatgactgcctggagatcgccaggaagaggcacaaggtgattggcaccttccgcagcccccacggccagacccggcccccagccagcctgaagcacatccacctgatgcccctgagccagatcaagaaggtgctggacatccgggagacagaggactgccacaatgcctttgccctgctggtgcggcccccaacagagcaggccaacgtgctgctgtccttccagatgaccagtgatgagctgcccaaggagaactggctgaagatgctgtgcagacatgtggccaacaccatctgcaaggcagatgctgagaacctgatctacacagctgaccctgagagctttgaggtgaacaccaaggacatggacagcaccctgagccgggccagccgggccatcaagaagaccagcaagaaggtgacccgggccttctccttcagcaagacccccaagagggccctgcggcgggccctgatgaccagccacggctctgtggagggccgcagccccagcagcaatgacaagcacgtgatgagccggctgagcagcaccagcagcctggccggcatccccagccccagcctggtgtccctgcccagcttctttgagcggcgcagccacaccctgagccgcagcaccacccacctgatctag

SEQ ID NO: 154657 - DNA, 1053 bp, Artificial Sequence
  Description of Artificial Sequence: Synthetic coding sequence
atgggcgctggggccagcgctgaggagaagcacagccgggagctggagaagaagctgaaggaggatgctgagaaggatgccaggacagtgaagctgctgctgctgggcgctggggagagcggcaagagcaccatcgtgaagcagatgaagatcatccaccaggacggctacagcctggaggagtgcctggagttcatcgccatcatctacggcaacaccctgcagagcatcctggccatcgtgcgggccatgaccaccctgaacatccagtatggagacagcgcccggcaggatgatgccaggaagctgatgcacatggctgacaccatcgaggagggcaccatgcccaaggagatgtctgacatcatccagaggctgtggaaggacagcggcatccaggcctgctttgagcgggccagcgagtaccagctgaatgattctgctggctactacctgagtgacctggagcggctggtgaccccaggctacgtgcccacagagcaggatgtgctgcggagccgggtgaagaccaccggcatcatcgagacccagttctccttcaaggacctgaacttcaggatgtttgatgtgggcggccagaggtctgagaggaagaagtggatccactgctttgaaggagtgacctgcatcatcttcatcgccgccctgagcgcctatgacatggtgctggtggaggatgatgaggtgaacaggatgcatgagagcctgcacctgttcaacagcatctgcaaccaccgctactttgccaccaccagcatcgtgctcttcctgaacaagaaggatgtgttctttgagaagatcaagaaggcccacctgagcatctgcttcccagactatgatggccccaacacctatgaagatgctggcaactacatcaaggtgcagttcctggagctgaacatgagaagagatgtgaaggagatctacagccacatgacctgtgccacagacacccagaatgtgaagtttgtgtttgatgctgtgacagacatcatcatcaaggagaacctgaaggactgtggcctcttctag

SEQ ID NO: 154658 - DNA, 1065 bp, Artificial Sequence
  Description of Artificial Sequence: Synthetic coding sequence
atgggcagcggggccagcgctgaggacaaggagctggccaagaggagcaaggagctggagaagaagctgcaggaggatgctgacaaggaggccaagacagtgaagctgctgctgctgggcgctggggagagcggcaagagcaccatcgtgaagcagatgaagatcatccaccaggacggctacagcccagaagaatgtctggagttcaaggccatcatctatggaaatgtgctgcagagcatcctggccatcatccgggccatgaccaccctgggcattgattatgcagagcccagctgtgctgatgatggccggcagctgaacaacctggccgacagcattgaggagggcaccatgcctcctgagctggtggaggtgatccggcggctgtggaaggatggaggagtgcaggcctgctttgaaagagctgctgagtaccagctgaatgattctgccagctactacctgaaccagctggagcgcatcacagatcctgagtacctgcccagcgagcaggatgtgctgcggagccgggtgaagaccaccggcatcatcgagaccaagttctctgtgaaggacctgaacttcaggatgtttgatgtgggcggccagaggtctgagaggaagaagtggatccactgctttgaaggagtgacctgcatcatcttctgtgccgccctgagcgcctatgacatggtgctggtggaggatgatgaggtgaacaggatgcatgagagcctgcacctgttcaacagcatctgcaaccacaagttctttgctgccaccagcatcgtgctcttcctgaacaagaaggacctgtttgaggagaagatcaagaaggtgcacctgagcatctgcttcccagaatatgatggcaacaacagctatgatgatgctggcaactacatcaagagccagttcctggacctgaacatgaggaaggatgtgaaggagatctacagccacatgacctgtgccacagacacccagaatgtgaagtttgtgtttgatgctgtgacagacatcatcatcaaggagaacctgaaggactgtggcctcttctag

SEQ ID NO: 154659 - DNA, 1068 bp, Artificial Sequence
  Description of Artificial Sequence: Synthetic coding sequence
atgggctgccggcagagcagcgaggagaaggaggccgcccggcgcagcagaagaattgacagacacctgcggtctgagagccagaggcagaggcgggagatcaagctgctgctgctgggcaccagcaacagcggcaagagcaccatcgtgaagcagatgaagatcatccacagcggcggcttcaacctggaggcctgcaaggagtacaagcccctcatcatctacaatgccatcgacagcctgacccgcatcatccgggccctggccgccctgagaattgacttccacaacccagaccgggcctatgatgctgtgcagctgtttgccctgactggacctgctgagagcaaaggagagatcaccccagagctgctgggcgtgatgaggcggctgtgggccgaccccggggcccaggcctgcttcagccgcagcagcgagtaccacctggaggacaatgctgcctactacctgaatgacctggagagaattgctgctgctgactacatccccaccgtggaggacatcctgcggagccgggacatgaccactggaattgtggagaacaagttcaccttcaaggagctgaccttcaagatggtggatgtgggcggccagaggtctgagaggaagaagtggatccactgctttgagggcgtgacagccatcatcttctgtgtggagctgagcggctatgacctgaagctgtatgaggacaaccagaccagcaggatggccgagagcctgcggctgtttgacagcatctgcaacaacaactggttcatcaacaccagcctcatcctcttcctgaacaagaaggacctgctggccgagaagatccgccgcatccccctgaccatctgcttccctgagtacaagggccagaacacctatgaggaggccgctgtgtacatccagaggcagtttgaggacctgaacagaaacaaggagaccaaggagatctacagccacttcacctgtgccacagacaccagcaacatccagtttgtgtttgatgctgtgacagatgtgatcatccagaacaacctgaagtacatcggcctgtgctag

SEQ ID NO: 154660 - DNA, 912 bp, Artificial Sequence
  Description of Artificial Sequence: Synthetic coding sequence
atgaagatcatccacagcggcggcttcaacctggaggcctgcaaggagtacaagcccctcatcatctacaatgccatcgacagcctgacccgcatcatccgggccctggccgccctgagaattgacttccacaacccagaccgggcctatgatgctgtgcagctgtttgccctgactggacctgctgagagcaaaggagagatcaccccagagctgctgggcgtgatgaggcggctgtgggccgaccccggggcccaggcctgcttcagccgcagcagcgagtaccacctggaggacaatgctgcctactacctgaatgacctggagagaattgctgctgctgactacatccccaccgtggaggacatcctgcggagccgggacatgaccactggaattgtggagaacaagttcaccttcaaggagctgaccttcaagatggtggatgtgggcggccagaggtctgagaggaagaagtggatccactgctttgagggcgtgacagccatcatcttctgtgtggagctgagcggctatgacctgaagctgtatgaggacaaccagaccagcaggatggccgagagcctgcggctgtttgacagcatctgcaacaacaactggttcatcaacaccagcctcatcctcttcctgaacaagaaggacctgctggccgagaagatccgccgcatccccctgaccatctgcttccctgagtacaagggccagaacacctatgaggaggccgctgtgtacatccagaggcagtttgaggacctgaacagaaacaaggagaccaaggagatctacagccacttcacctgtgccacagacaccagcaacatccagtttgtgtttgatgctgtgacagatgtgatcatccagaacaacctgaagtacatcggcctgtgctag

SEQ ID NO: 154661 - DNA, 1188 bp, Artificial Sequence
  Description of Artificial Sequence: Synthetic coding sequence
atgtgtgaccagaccttcctggtgaatgtgtttggcagctgtgacaagtgcttcaagcagagggccctgcggcctgtgttcaagaagagccagcagctgagctactgcagcacctgtgccgagatcatggccacagagggcctgcatgaaaatgagaccctggccagcctgaagtctgaggccgagagcctgaagggcaagctggaggaggagcgggccaagctgcatgatgtggagctgcaccaggtggccgagcgggtggaggccctgggccagtttgtgatgaagaccaggaggaccctgaagggccacggcaacaaggtgctgtgcatggactggtgcaaggacaagaggcgcatcgtgagcagcagccaggacggcaaggtgattgtgtgggacagcttcaccaccaacaaggagcacgctgtgaccatgccctgcacctgggtgatggcctgtgcctatgcccccagcggctgtgccatcgcctgtggcggcctggacaacaagtgcagcgtgtaccccctgacctttgacaagaatgaaaacatggccgccaagaagaagtctgtggccatgcacaccaactacctgagcgcctgcagcttcaccaacagcgacatgcagatcctgacagccagcggagatggcacctgtgccctgtgggatgtggagagcggccagctgctgcagagcttccacggccacggggctgatgtgctgtgcctggacctggcccccagcgagaccggcaacacctttgtgtctgggggctgtgacaagaaggccatggtgtgggacatgaggagcggccagtgtgtgcaggcctttgagacccatgaaagtgacatcaacagcgtgcgctactaccccagcggagatgcctttgccagcggcagtgatgatgccacctgccgcctgtatgacctgcgggctgaccgggaggtggccatctacagcaaggagagcatcatctttggagccagctctgtggacttcagcctgagcggccgcctgctgtttgctggctacaatgactacaccatcaacgtgtgggatgtgctgaagggcagccgggtgtccatcctgtttggacatgaaaatagagtgtccaccctgcgggtgtccccagatggaacagccttctgcagcggctcctgggaccacaccctgcgggtgtgggcctag

SEQ ID NO: 154662 - DNA, 1062 bp, Artificial Sequence
  Description of Artificial Sequence: Synthetic coding sequence
atggccacagagggcctgcatgaaaatgagaccctggccagcctgaagtctgaggccgagagcctgaagggcaagctggaggaggagcgggccaagctgcatgatgtggagctgcaccaggtggccgagcgggtggaggccctgggccagtttgtgatgaagaccaggaggaccctgaagggccacggcaacaaggtgctgtgcatggactggtgcaaggacaagaggcgcatcgtgagcagcagccaggacggcaaggtgattgtgtgggacagcttcaccaccaacaaggagcacgctgtgaccatgccctgcacctgggtgatggcctgtgcctatgcccccagcggctgtgccatcgcctgtggcggcctggacaacaagtgcagcgtgtaccccctgacctttgacaagaatgaaaacatggccgccaagaagaagtctgtggccatgcacaccaactacctgagcgcctgcagcttcaccaacagcgacatgcagatcctgacagccagcggagatggcacctgtgccctgtgggatgtggagagcggccagctgctgcagagcttccacggccacggggctgatgtgctgtgcctggacctggcccccagcgagaccggcaacacctttgtgtctgggggctgtgacaagaaggccatggtgtgggacatgaggagcggccagtgtgtgcaggcctttgagacccatgaaagtgacatcaacagcgtgcgctactaccccagcggagatgcctttgccagcggcagtgatgatgccacctgccgcctgtatgacctgcgggctgaccgggaggtggccatctacagcaaggagagcatcatctttggagccagctctgtggacttcagcctgagcggccgcctgctgtttgctggctacaatgactacaccatcaacgtgtgggatgtgctgaagggcagccgggtgtccatcctgtttggacatgaaaatagagtgtccaccctgcgggtgtccccagatggaacagccttctgcagcggctcctgggaccacaccctgcgggtgtgggcctag

SEQ ID NO: 154663 - DNA, 852 bp, Artificial Sequence
  Description of Artificial Sequence: Synthetic coding sequence
atggccacagagggcctgcatgaaaatgagaccctggccagcctgaagtctgaggccgagagcctgaagggcaagctggaggaggagcgggccaagctgcatgatgtggagctgcaccaggtggccgagcgggtggaggccctgggccagtttgtgatgaagaccaggaggaccctgaagggccacggcaacaaggtgctgtgcatggactggtgcaaggacaagaggcgcatcgtgagcagcagccaggacggcaaggtgattgtgtgggacagcttcaccaccaacaagatcctgacagccagcggagatggcacctgtgccctgtgggatgtggagagcggccagctgctgcagagcttccacggccacggggctgatgtgctgtgcctggacctggcccccagcgagaccggcaacacctttgtgtctgggggctgtgacaagaaggccatggtgtgggacatgaggagcggccagtgtgtgcaggcctttgagacccatgaaagtgacatcaacagcgtgcgctactaccccagcggagatgcctttgccagcggcagtgatgatgccacctgccgcctgtatgacctgcgggctgaccgggaggtggccatctacagcaaggagagcatcatctttggagccagctctgtggacttcagcctgagcggccgcctgctgtttgctggctacaatgactacaccatcaacgtgtgggatgtgctgaagggcagccgggtgtccatcctgtttggacatgaaaatagagtgtccaccctgcgggtgtccccagatggaacagccttctgcagcggctcctgggaccacaccctgcgggtgtgggcctag

SEQ ID NO: 154664 - DNA, 582 bp, Artificial Sequence
  Description of Artificial Sequence: Synthetic coding sequence
atgagcaagctgctgatcctgatcctgacagccagcggagatggcacctgtgccctgtgggatgtggagagcggccagctgctgcagagcttccacggccacggggctgatgtgctgtgcctggacctggcccccagcgagaccggcaacacctttgtgtctgggggctgtgacaagaaggccatggtgtgggacatgaggagcggccagtgtgtgcaggcctttgagacccatgaaagtgacatcaacagcgtgcgctactaccccagcggagatgcctttgccagcggcagtgatgatgccacctgccgcctgtatgacctgcgggctgaccgggaggtggccatctacagcaaggagagcatcatctttggagccagctctgtggacttcagcctgagcggccgcctgctgtttgctggctacaatgactacaccatcaacgtgtgggatgtgctgaagggcagccgggtgtccatcctgtttggacatgaaaatagagtgtccaccctgcgggtgtccccagatggaacagccttctgcagcggctcctgggaccacaccctgcgggtgtgggcctag

SEQ ID NO: 154665 - DNA, 1023 bp, Artificial Sequence
  Description of Artificial Sequence: Synthetic coding sequence
atgtctgagctggaccagctgcggcaggaggccgagcagctgaagaaccagatcagagatgccaggaaggcctgtgctgatgccaccctgagccagatcaccaacaacattgatcctgtgggccgcatccagatgaggaccaggaggaccctgcggggccacctggccaagatctatgccatgcactggggcacagacagccggctgctggtgtctgccagccaggacggcaagctgatcatctgggacagctacaccaccaacaaggtgcacgccatccccctgcggagctcctgggtgatgacctgtgcctatgcccccagcggcaactacgtggcctgtggcggcctggacaacatctgcagcatctacaacctgaagacccgggagggcaatgtgcgggtgtcccgggagctggccggccacacaggctacctgagctgctgccgcttcctggatgacaaccagatcgtgaccagcagcggggacaccacctgtgccctgtgggacattgaaacaggccagcagaccaccaccttcaccggccacactggagatgtgatgagcctgagcctggccccagacacccggctgtttgtgtctggggcctgtgatgccagcgccaagctgtgggatgtgcgggagggcatgtgccggcagaccttcaccggccatgaaagtgacatcaatgccatctgcttcttccccaatggaaatgcctttgccactggaagtgatgatgccacctgccgcctgtttgacctgcgggctgaccaggagctgatgacctacagccatgacaacatcatctgtggcatcacctctgtgtccttcagcaagagcggccgcctgctgctggccggctatgatgacttcaactgcaatgtgtgggatgccctgaaggctgacagagctggggtgctggccggccatgacaacagagtgtcctgcctgggcgtgacagatgatggcatggctgtggccaccggctcctgggacagcttcctgaagatctggaactag

SEQ ID NO: 154666 - DNA, 1023 bp, Artificial Sequence; identical to SEQ ID NO: 154665
  Description of Artificial Sequence: Synthetic coding sequence

SEQ ID NO: 154667 - DNA, 597 bp, Artificial Sequence
  Description of Artificial Sequence: Synthetic coding sequence
tgaggctacctgagctgctgccgcttcctggatgacaaccagatcgtgaccagcagcggggacaccacctgtgccctgtgggacattgaaacaggccagcagaccaccaccttcaccggccacactggagatgtgatgagcctgagcctggccccagacacccggctgtttgtgtctggggcctgtgatgccagcgccaagctgtgggatgtgcgggagggcatgtgccggcagaccttcaccggccatgaaagtgacatcaatgccatctgcttcttccccaatggaaatgcctttgccactggaagtgatgatgccacctgccgcctgtttgacctgcgggctgaccaggagctgatgacctacagccatgacaacatcatctgtggcatcacctctgtgtccttcagcaagagcggccgcctgctgctggccggctatgatgacttcaactgcaatgtgtgggatgccctgaaggctgacagagctggggtgctggccggccatgacaacagagtgtcctgcctgggcgtgacagatgatggcatggctgtggccaccggctcctgggacagcttcctgaagatctggaactag

SEQ ID NO: 154668 - DNA, 444 bp, Artificial Sequence
  Description of Artificial Sequence: Synthetic coding sequence
atgtctgagctggaccagctgcggcaggaggccgagcagctgaagaaccagatcagagatgccaggaaggcctgtgctgatgccaccctgagccagatcaccaacaacattgatcctgtgggccgcatccagatgaggaccaggaggaccctgcggggccacctggccaagatctatgccatgcactggggcacagacagccggctgctggtgtctgccagccaggacggcaagctgatcatctgggacagctacaccaccaacaaggtgcacgccatccccctgcggagctcctgggtgatgacctgtgcctatgcccccagcggcaactacgtggcctgtggcggcctggacaacatctgcagcatctacaacctgaagacccgggagggcaatgtgcgggtgtcccgggagctggccggccacacaggcacctgcccctag

SEQ ID NO: 154669 - DNA, 327 bp, Artificial Sequence
  Description of Artificial Sequence: Synthetic coding sequence
atgtctgagctggaccagctgcggcaggaggccgagcagctgaagaaccagatcagagatgccaggaaggcctgtgctgatgccaccctgagccagatcaccaacaacattgatcctgtgggccgcatccagatgaggaccaggaggaccctgcggggccacctggccaagatctatgccatgcactggggcacagacagccggctgctggtgtctgccagccaggacggcaagctgatcatctgggacagctacaccaccaacaaggtgcacgccatccccctgcggagctcctgggtgatgacctgtgcctatgcccccagctag

SEQ ID NO: 154670 - DNA, 405 bp, Artificial Sequence
  Description of Artificial Sequence: Synthetic coding sequence
atgtctgagctggaccagctgcggcaggaggccgagcagctgaagaaccagatccgcatcaccaacaacatcgaccctgtgggccgcatccagatgaggaccaggaggaccctgcggggccacctggccaagatctatgccatgcactggggcacagacagccggctgctggtgtctgccagccaggacggcaagctgatcatctgggacagctacaccaccaacaaggtgcacgccatccccctgcggagctcctgggtgatgacctgtgcctatgcccccagcggcaactacgtggcctgtggcggcctggacaacatctgcagcatctacaacctgaagacccgggagggcaatgtgcgggtgtcccgggagctggccggccacacaggcacctgcccctag

SEQ ID NO: 154671 - DNA, 723 bp, Artificial Sequence
  Description of Artificial Sequence: Synthetic coding sequence
atgacctgtgcctatgcccccagcggcaactacgtggcctgtggcggcctggacaacatctgcagcatctacaacctgaagacccgggagggcaatgtgcgggtgtcccgggagctggccggccacacaggctacctgagctgctgccgcttcctggatgacaaccagatcgtgaccagcagcggggacaccacctgtgccctgtgggacattgaaacaggccagcagaccaccaccttcaccggccacactggagatgtgatgagcctgagcctggccccagacacccggctgtttgtgtctggggcctgtgatgccagcgccaagctgtgggatgtgcgggagggcatgtgccggcagaccttcaccggccatgaaagtgacatcaatgccatctgcttcttccccaatggaaatgcctttgccactggaagtgatgatgccacctgccgcctgtttgacctgcgggctgaccaggagctgatgacctacagccatgacaacatcatctgtggcatcacctctgtgtccttcagcaagagcggccgcctgctgctggccggctatgatgacttcaactgcaatgtgtgggatgccctgaaggctgacagagctggggtgctggccggccatgacaacagagtgtcctgcctgggcgtgacagatgatggcatggctgtggccaccggctcctgggacagcttcctgaagatctggaactag

SEQ ID NO: 154672 - DNA, 984 bp, Artificial Sequence
  Description of Artificial Sequence: Synthetic coding sequence
atgacagccccctgccccccacctcctccagacccccagtttgtgctgcggggcacccagagccctgtgcacgccctgcacttctgtgagggcgcccaggcccagggccggcccctgctcttcagcggcagccagagcggcctggtgcacatctggagcctgcagaccaggagagctgtgaccaccctggatggccacggcggccagtgtgtgacctggctgcagaccctgccccagggccggcagctgctgagccagggccgggacctgaagctgtgcctgtgggacctggccgagggccgctctgctgtggtggacagcgtgtgcctggagagcgtgggcttctgccgcagcagcatcctggccggcggccagccccgctggaccctggccgtgcccggccggggcagtgatgaggtgcagatcctggagatgcccagcaagacctctgtgtgtgccctgaagcccaaggcagatgccaagctgggcatgcccatgtgcctgcggctgtggcaggccgactgcagcagccggcccctgctgctggccggctatgaagatggctctgtggtgctgtgggatgtgtctgagcagaaggtgtgcagccgcatcgcctgccacgaggagcctgtgatggacctggactttgacagccagaaggcccggggcatcagcggcagcgctgggaaggccctggccgtgtggagcctggactggcagcaggccctgcaggtgcggggcacccatgagctgaccaaccctggcattgctgaggtgaccatccggccagacaggaagatcctggccacagctggctgggaccaccgcatccgggtcttccactggaggaccatgcagcccctggccgtgctggccttccacagcgctgctgtgcagtgtgtggccttcaccgcagatggcctgctggccgccggcagcaaggaccagaggatcagcctgtggagcctgtacccccgggcctag

SEQ ID NO: 154673 - DNA, 984 bp, Artificial Sequence; identical to SEQ ID NO: 154672
  Description of Artificial Sequence: Synthetic coding sequence

SEQ ID NO: 154674 - DNA, 639 bp, Artificial Sequence
  Description of Artificial Sequence: Synthetic coding sequence
atgacagccccctgccccccacctcctccagacccccagtttgtgctgcggggcacccagagccctgtgcacgccctgcacttctgtgagggcgcccaggcccagggccggcccctgctcttcagcggcagccagagcggcctggtgcacatctggagcctgcagaccaggagagctgtgaccaccctggatggccacggcggccagtgtgtgacctggctgcagaccctgccccagggccggcagctgctgagccagggccgggacctgaagctgtgcctgtgggacctggccgagggccgctctgctgtggtggacagcgtgtgcctggagagcgtgggcttctgccgcagcagcatcctggccggcggccagccccgctggaccctggccgtgcccggccggggcagtgatgaggtgcagatcctggagatgcccagcaagacctctgtgtgtgccctgaagcccaaggcagatgccaagctgggcatgcccatgtgcctgcggctgtggcaggccgactgcagcagccggcccctgctgctggccggctatgaagatggctctgtggtgctgtgggatgtgtctgagcagaaggtgtgcagccgcatcgcctgccacgaggagcccggcctgtag

SEQ ID NO: 154675 - DNA, 1023 bp, Artificial Sequence
  Description of Artificial Sequence: Synthetic coding sequence
atgtctgagctggagcagctgcggcaggaggccgagcagctgaggaaccagatcagagatgccaggaaggcctgtggggacagcaccctgacccagatcacagctggcctggaccctgtgggccgcatccagatgaggaccaggaggaccctgcggggccacctggccaagatctatgccatgcactggggcacagacagccggctgctggtgtctgccagccaggacggcaagctgatcatctgggacagctacaccaccaacaaggtgcacgccatccccctgcggagctcctgggtgatgacctgtgcctatgcccccagcggcaactttgtggcctgtggcggcctggacaacatctgcagcatctacagcctgaagacccgggagggcaatgtgcgggtgtcccgggagctgcccggccacacaggctacctgagctgctgccgcttcctggatgacaaccagatcatcaccagcagcggggacaccacctgtgccctgtgggacattgaaacaggccagcagacagtgggctttgctggccacagcggagatgtgatgagcctgagcctggccccagatggccgcacctttgtgtctggggcctgtgatgccagcatcaagctgtgggatgtgcgggacagcatgtgccggcagaccttcatcggccatgaaagtgacatcaatgctgtggccttcttccccaacggctacgccttcaccactggaagtgatgatgccacctgccgcctgtttgacctgcgggctgaccaggagctgctgatgtacagccatgacaacatcatctgtggcatcacctctgtggccttcagccgcagcggccgcctgctgctggccggctatgatgacttcaactgcaacatctgggatgccatgaagggggacagagctggggtgctggccggccatgacaacagagtgtcctgcctgggcgtgacagatgatggcatggctgtggccaccggctcctgggacagcttcctgaagatctggaactag

SEQ ID NO: 154676 - DNA, 1023 bp, Artificial Sequence; identical to SEQ ID NO: 154675
  Description of Artificial Sequence: Synthetic coding sequence

SEQ ID NO: 154677 - DNA, 1023 bp, Artificial Sequence; identical to SEQ ID NO: 154675
  Description of Artificial Sequence: Synthetic coding sequence

SEQ ID NO: 154678 - DNA, 459 bp, Artificial Sequence
  Description of Artificial Sequence: Synthetic coding sequence
atgtctgagctggagcagctgcggcaggaggccgagcagctgaggaaccagatcagagatgccaggaaggcctgtggggacagcaccctgacccagatcacagctggcctggaccctgtgggccgcatccagatgaggaccaggaggaccctgcggggccacctggccaagatctatgccatgcactggggcacagacagccggctgctggtgtctgccagccaggacggcaagctgatcatctgggacagctacaccaccaacaaggtgcacgccatccccctgcggagctcctgggtgatgacctgtgcctatgcccccagcggcaactttgtggcctgtggcggcctggacaacatctgcagcatctacagcctgaagacccgggagggcaatgtgcgggtgtcccgggagctgcccggccacacaggctacctgagctgctgccgcttcctgtag

SEQ ID NO: 154679 - DNA, 723 bp, Artificial Sequence
  Description of Artificial Sequence: Synthetic coding sequence
atgacctgtgcctatgcccccagcggcaactttgtggcctgtggcggcctggacaacatctgcagcatctacagcctgaagacccgggagggcaatgtgcgggtgtcccgggagctgcccggccacacaggctacctgagctgctgccgcttcctggatgacaaccagatcatcaccagcagcggggacaccacctgtgccctgtgggacattgaaacaggccagcagacagtgggctttgctggccacagcggagatgtgatgagcctgagcctggccccagatggccgcacctttgtgtctggggcctgtgatgccagcatcaagctgtgggatgtgcgggacagcatgtgccggcagaccttcatcggccatgaaagtgacatcaatgctgtggccttcttccccaacggctacgccttcaccactggaagtgatgatgccacctgccgcctgtttgacctgcgggctgaccaggagctgctgatgtacagccatgacaacatcatctgtggcatcacctctgtggccttcagccgcagcggccgcctgctgctggccggctatgatgacttcaactgcaacatctgggatgccatgaagggggacagagctggggtgctggccggccatgacaacagagtgtcctgcctgggcgtgacagatgatggcatggctgtggccaccggctcctgggacagcttcctgaagatctggaactag

SEQ ID NO: 154680 - DNA, 891 bp, Artificial Sequence
  Description of Artificial Sequence: Synthetic coding sequence
atgaggaccaggaggaccctgcggggccacctggccaagatctatgccatgcactggggcacagacagccggctgctggtgtctgccagccaggacggcaagctgatcatctgggacagctacaccaccaacaaggtgcacgccatccccctgcggagctcctgggtgatgacctgtgcctatgcccccagcggcaactttgtggcctgtggcggcctggacaacatctgcagcatctacagcctgaagacccgggagggcaatgtgcgggtgtcccgggagctgcccggccacacaggctacctgagctgctgccgcttcctggatgacaaccagatcatcaccagcagcggggacaccacctgtgccctgtgggacattgaaacaggccagcagacagtgggctttgctggccacagcggagatgtgatgagcctgagcctggccccagatggccgcacctttgtgtctggggcctgtgatgccagcatcaagctgtgggatgtgcgggacagcatgtgccggcagaccttcatcggccatgaaagtgacatcaatgctgtggccttcttccccaacggctacgccttcaccactggaagtgatgatgccacctgccgcctgtttgacctgcgggctgaccaggagctgctgatgtacagccatgacaacatcatctgtggcatcacctctgtggccttcagccgcagcggccgcctgctgctggccggctatgatgacttcaactgcaacatctgggatgccatgaagggggacagagctggggtgctggccggccatgacaacagagtgtcctgcctgggcgtgacagatgatggcatggctgtggccaccggctcctgggacagcttcctgaagatctggaactag

SEQ ID NO: 154681 - DNA, 723 bp, Artificial Sequence; identical to SEQ ID NO: 154679
  Description of Artificial Sequence: Synthetic coding sequence

SEQ ID NO: 154682 - DNA, 699 bp, Artificial Sequence
  Description of Artificial Sequence: Synthetic coding sequence
atgtctgagctggagcagctgcggcaggaggccgagcagctgaggaaccagatcagagatgccaggaaggcctgtggggacagcaccctgacccagatcacagctggcctggaccctgtgggccgcatccagatgaggaccaggaggaccctgcggggccacctggccaagatctatgccatgcactggggcacagacagccggctgctggtgtctgccagccaggacggcaagctgatcatctgggacagctacaccaccaacaaggtgcacgccatccccctgcggagctcctgggtgatgacctgtgcctatgcccccagcggcaactttgtggcctgtggcggcctggacaacatctgcagcatctacagcctgaagacccgggagggcaatgtgcgggtgtcccgggagctgcccggccacacaggctacctgagctgctgccgcttcctggatgacaaccagatcatcaccagcagcggggacaccacctgtgccctgtgggacattgaaacaggccagcagacagtgggctttgctggccacagcggagatgtgatgagcctgagcctggccccagatggccgcacctttgtgtctggggcctgtgatgccagcatcaagctgtgggatgtgcgggacagcatgtgccggcagaccttcatcggccatgaaagtgacatcaatgctgtgtag

SEQ ID NO: 154683 - DNA, 891 bp, Artificial Sequence; identical to SEQ ID NO: 154680
  Description of Artificial Sequence: Synthetic coding sequence

SEQ ID NO: 154684 - DNA, 756 bp, Artificial Sequence
  Description of Artificial Sequence: Synthetic coding sequence
atgtctgagctggagcagctgcggcaggaggccgagcagctgaggaaccagatcagagatgccaggaaggcctgtggggacagcaccctgacccagatcacagctggcctggaccctgtgggccgcatccagatgaggaccaggaggaccctgcggggccacctggccaagatctatgccatgcactggggcacagacagccggctgctggtgtctgccagccaggacggcaagctgatcatctgggacagctacaccaccaacaaggtgcacgccatccccctgcggagctcctgggtgatgacctgtgcctatgcccccagcggcaactttgtggcctgtggcggcctggacaacatctgcagcatctacagcctgaagacccgggagggcaatgtgcgggtgtcccgggagctgcccggccacacaggctacctgagctgctgccgcttcctggatgacaaccagatcatcaccagcagcggggacaccacctgtgccctgtgggacattgaaacaggccagcagacagtgggctttgctggccacagcggagatgtgatgagcctgagcctggccccagatggccgcacctttgtgtctggggcctgtgatgccagcatcaagctgtgggatgtgcgggacagcatgtgccggcagaccttcatcggccatgaaagtgacatcaatgctgtggccttcttccccaacggctacgccttcaccactggaagtgatgatgccacctgcaggtag

SEQ ID NO: 154685 - DNA, 828 bp, Artificial Sequence
  Description of Artificial Sequence: Synthetic coding sequence
atgtctgctgaggtgaaggtgacaggccagaaccaggagcagttcctgctgctggccaagagcgccaagggagctgccctggccaccctcatccaccaggtgctggaggcccctggggtgtatgtgtttggagagctgctggacatgcccaacgtgcgggagctggccgagagtgactttgccagcaccttccggctgctgactgtgtttgcctacggcacctacgccgactacctggccgaggccaggaacctgccccccctgacagaggcccagaagaacaagctgcggcacctgtctgtggtgaccctggccgccaaggtgaagtgcatcccctatgctgtgctgctggaggccctggccctgagaaatgtgcggcagctggaggacctggtgattgaagctgtgtatgcagatgtgctgcggggcagcctggaccagaggaaccagaggctggaggtggactacagcatcggccgggacatccagaggcaggacctgagcgccatcgcccggaccctgcaggagtggtgtgtgggctgtgaggtggtgctgagcggcatcgaggagcaggtgtcccgggccaaccagcacaaggagcagcagctgggcctgaagcagcagattgaaagtgaggtggccaacctgaagaagaccatcaaggtgaccacagctgctgctgctgctgccaccagccaggaccctgagcagcacctgacagagctgcgggagcccgcccctggcaccaaccagaggcagcccagcaagaaggccagcaagggcaagggcctgcggggcagcgccaagatctggagcaagagcaactag

SEQ ID NO: 154686 - DNA, 387 bp, Artificial Sequence
  Description of Artificial Sequence: Synthetic coding sequence
atgaccagcctgtttgcccaggagatccggctgagcaagagacatgaggagatcgtgtcccagaggctgatgctgctgcagcagatggagaacaagctgggggaccagcacacagagaaggccagccagctgcagacagtggagacagccttcaagaggaacctgagcctgctgaaggacattgaagctgctgagaagagcctgcagacccgcatccaccccctgcccaggcctgaggtggtgtccctggagacccgctactgggcctctgtggaggagtacatccccaagtgggagcagttcctgctgggccgggccccctacccctttgctgtggagaaccagaatgaagctgagaacaccatccagaatgaggcccagaggtag

SEQ ID NO: 154687 - DNA, 1023 bp, Artificial Sequence
  Description of Artificial Sequence: Synthetic coding sequence
atgtctgagctggagcagctgcggcaggaggccgagcagctgaggaaccagatccaggatgccaggaaggcctgcaatgatgccaccctggtgcagatcaccagcaacatggattctgtgggccgcatccagatgaggaccaggaggaccctgcggggccacctggccaagatctatgccatgcactggggctatgacagccggctgctggtgtctgccagccaggacggcaagctgatcatctgggacagctacaccaccaacaagatgcacgccatccccctgcggagctcctgggtgatgacctgtgcctatgcccccagcggcaactacgtggcctgtggcggcctggacaacatctgcagcatctacaacctgaagacccgggagggcaatgtgcgggtgtcccgggagctgcccggccacacaggctacctgagctgctgccgcttcctggatgacagccagatcgtgaccagcagcggggacaccacctgtgccctgtgggacattgaaacagcccagcagaccaccaccttcaccggccacagcggagatgtgatgagcctgagcctgagcccagacatgaggacctttgtgtctggggcctgtgatgccagcagcaagctgtgggacatcagagatggcatgtgccggcagagcttcaccggccacgtgtctgacatcaatgctgtgtccttcttccccaacggctacgcctttgccactggaagtgatgatgccacctgccgcctgtttgacctgcgggctgaccaggagctgctgctgtacagccatgacaacatcatctgtggcatcacctctgtggccttcagcaagagcggccgcctgctgctggccggctatgatgacttcaactgcaatgtgtgggacaccctgaagggggacagagctggggtgctggccggccatgacaacagagtgtcctgcctgggcgtgacagatgatggcatggctgtggccaccggctcctgggacagcttcctgcgcatctggaactag

SEQ ID NO: 154688 - DNA, 240 bp, Artificial Sequence
  Description of Artificial Sequence: Synthetic coding sequence
atgtctgagctggagcagctgcggcaggaggccgagcagctgaggaaccagatccaggatgccaggaaggcctgcaatgatgccaccctggtgcagatcaccagcaacatggattctgtgggccgcatccagatgaggaccaggaggaccctgcggggccacctggccaagatctatgccatgcactggggctatgacagccggctgctggtgtctgccagccaggacggcaagctgtag

SEQ ID NO: 154689 - DNA, 204 bp, Artificial Sequence
  Description of Artificial Sequence: Synthetic coding sequence
atggaggagtgggatgtgccccagatgaagaaggaggtggagagcctgaagtaccagctggccttccagcgggagatggccagcaagaccatccctgagctgctgaagtggattgaagatggcatccccaaggaccccttcctgaacccagacctgatgaagaacaacccctgggtggagaagggcaagtgcaccatcctgtag

SEQ ID NO: 154690 - DNA, 216 bp, Artificial Sequence
  Description of Artificial Sequence: Synthetic coding sequence
atggccagcaacaacacagccagcatcgcccaggccaggaagctggtggagcagctgaagatggaggccaacatcgaccgcatcaaggtgtccaaggctgctgctgacctgatggcctactgtgaggcccacgccaaggaggaccccctgctgacccctgtgcctgccagcgagaaccccttccgggagaagaagttcttctgtgccatcctgtag

SEQ ID NO: 154691 - DNA, 309 bp, Artificial Sequence
  Description of Artificial Sequence: Synthetic coding sequence
atgcagggcaagctgcagccccccatggagcgggaggccagagatggagtgcccagcggcaaggtgttcctgaaggacctgagcagcacccccatggccagcaacaacacagccagcatcgcccaggccaggaagctggtggagcagctgaagatggaggccaacatcgaccgcatcaaggtgtccaaggctgctgctgacctgatggcctactgtgaggcccacgccaaggaggaccccctgctgacccctgtgcctgccagcgagaaccccttccgggagaagaagttcttctgtgccatcctgtag

SEQ ID NO: 154692 - DNA, 216 bp, Artificial Sequence; identical to SEQ ID NO: 154690
  Description of Artificial Sequence: Synthetic coding sequence

SEQ ID NO: 154693 - DNA, 216 bp, Artificial Sequence; identical to SEQ ID NO: 154690
  Description of Artificial Sequence: Synthetic coding sequence

SEQ ID NO: 154694 - DNA, 216 bp, Artificial Sequence; identical to SEQ ID NO: 154690
  Description of Artificial Sequence: Synthetic coding sequence

SEQ ID NO: 154695 - DNA, 216 bp, Artificial Sequence; identical to SEQ ID NO: 154690
  Description of Artificial Sequence: Synthetic coding sequence

SEQ ID NO: 154696 - DNA, 333 bp, Artificial Sequence
  Description of Artificial Sequence: Synthetic coding sequence
atggtgtacctgcaggccaagacccgcatccctgagcacaggaaggtgacccagctgatcaagtgctggagcccagacctgaaccctgtgttcctgaaggacctgagcagcacccccatggccagcaacaacacagccagcatcgcccaggccaggaagctggtggagcagctgaagatggaggccaacatcgaccgcatcaaggtgtccaaggctgctgctgacctgatggcctactgtgaggcccacgccaaggaggaccccctgctgacccctgtgcctgccagcgagaaccccttccgggagaagaagttcttctgtgccatcctgtag

SEQ ID NO: 154697 - DNA, 207 bp, Artificial Sequence
  Description of Artificial Sequence: Synthetic coding sequence
atgagcggcagcagctctgtggccgccatgaagaaggtggtgcagcagctgcggctggaggccggcctgaacagagtgaaggtgtcccaggccgctgctgacctgaagcagttctgcctgcagaatgcccagcacgaccccctgctgactggagtgagcagcagcaccaaccccttccggccccagaaggtgtgcagcttcctgtag

SEQ ID NO: 154698 - DNA, 207 bp, Artificial Sequence; identical to SEQ ID NO: 154697
  Description of Artificial Sequence: Synthetic coding sequence

SEQ ID NO: 154699 - DNA, 225 bp, Artificial Sequence
  Description of Artificial Sequence: Synthetic coding sequence
atgcctgtgatcaacatcgaggacctgacagagaaggacaagctgaagatggaggtggaccagctgaagaaggaggtgaccctggagaggatgctggtgtccaagtgctgtgaggaggtgcgggactatgtggaggagaggtctggagaggaccccctggtgaagggcatccctgaggacaagaaccccttcaaggagctgaagggcggctgtgtgatctcctag

SEQ ID NO: 154700 - DNA, 225 bp, Artificial Sequence; identical to SEQ ID NO: 154699
  Description of Artificial Sequence: Synthetic coding sequence

SEQ ID NO: 154701 - DNA, 210 bp, Artificial Sequence
  Description of Artificial Sequence: Synthetic coding sequence
atggcccaggacctgtctgagaaggacctgctgaagatggaggtggagcagctgaagaaggaggtgaagaacacccgcatccccatcagcaaggccggcaaggagatcaaggagtatgtggaggcccaggccggaaatgaccccttcctgaagggcatccctgaggacaagaaccccttcaaggagaagggcggctgcctgatctcctag

SEQ ID NO: 154702 - DNA, 210 bp, Artificial Sequence; identical to SEQ ID NO: 154701
  Description of Artificial Sequence: Synthetic coding sequence

SEQ ID NO: 154703 - DNA, 210 bp, Artificial Sequence; identical to SEQ ID NO: 154701
  Description of Artificial Sequence: Synthetic coding sequence

SEQ ID NO: 154704 - DNA, 210 bp, Artificial Sequence; identical to SEQ ID NO: 154701
  Description of Artificial Sequence: Synthetic coding sequence

SEQ ID NO: 154705 - DNA, 210 bp, Artificial Sequence; identical to SEQ ID NO: 154701
  Description of Artificial Sequence: Synthetic coding sequence

SEQ ID NO: 154706 - DNA, 1080 bp, Artificial Sequence
  Description of Artificial Sequence: Synthetic coding sequence
atgaccctggagagcatcatggcctgctgcctgtctgaggaggccaaggaggcccggcgcatcaatgatgaaattgagcggcagctgcggcgggacaagagagatgcccggcgggagctgaagctgctgctgctgggcactggagagagcggcaagagcaccttcatcaagcagatgaggatcatccacggcagcggctacagtgatgaggacaagaggggcttcaccaagctggtgtaccagaacatcttcaccgccatgcaggccatgatccgggccatggacaccctgaagatcccctacaagtatgagcacaacaaggcccacgcccagctggtgcgggaggtggatgtggagaaggtgtctgcctttgagaacccctacgtggatgccatcaagagcctgtggaatgaccccggcatccaggagtgctatgacagaagaagagagtaccagctgagtgacagcaccaagtactacctgaatgacctggacagagtggccgaccctgcctacctgcccacccagcaggatgtgctgcgggtgcgggtgcccaccaccggcatcatcgagtacccctttgacctgcagagcgtcatcttcaggatggtggatgtgggcggccagaggagtgaaagaaggaagtggatccactgctttgaaaatgtgaccagcatcatgttcctggtggccctgtctgaatatgaccaggtgctggtggagagtgacaatgaaaataggatggaggagagcaaggccctcttccgcaccatcatcacctacccctggttccagaacagcagcgtcatcctcttcctgaacaagaaggacctgctggaggagaagatcatgtacagccacctggtggactacttcccagaatatgatggcccccagagagatgcccaggccgcccgggagttcatcctgaagatgtttgtggacctgaacccagacagcgacaagatcatctacagccacttcacctgtgccacagacacagagaacatccgctttgtgtttgctgctgtgaaggacaccatcctgcagctgaacctgaaggagtacaacctggtgtag

SEQ ID NO: 154707 - DNA, 474 bp, Artificial Sequence
  Description of Artificial Sequence: Synthetic coding sequence
atggtggatgtgggcggccagaggagtgaaagaaggaagtggatccactgctttgaaaatgtgaccagcatcatgttcctggtggccctgtctgaatatgaccaggtgctggtggagagtgacaatgaaaataggatggaggagagcaaggccctcttccgcaccatcatcacctacccctggttccagaacagcagcgtcatcctcttcctgaacaagaaggacctgctggaggagaagatcatgtacagccacctggtggactacttcccagaatatgatggcccccagagagatgcccaggccgcccgggagttcatcctgaagatgtttgtggacctgaacccagacagcgacaagatcatctacagccacttcacctgtgccacagacacagagaacatccgctttgtgtttgctgctgtgaaggacaccatcctgcagctgaacctgaaggagtacaacctggtgtag

SEQ ID NO: 154708 - DNA, 513 bp, Artificial Sequence
  Description of Artificial Sequence: Synthetic coding sequence
atgggagagcgctgggccgacagccagctggacagccgcagcacccacggcaccggggagagcggcaagagcaccttcatcaagcagatgaggatcatccacggcagcggctacagtgatgaggacaagaggggcttcaccaagctggtgtaccagaacatcttcaccgccatgcaggccatgatccgggccatggacaccctgaagatcccctacaagtatgagcacaacaaggcccacgcccagctggtgcgggaggtggatgtggagaaggtgtctgcctttgagaacccctacgtggatgccatcaagagcctgtggaatgaccccggcatccaggagtgctatgacagaagaagagagtaccagctgagtgacagcaccaagtactacctgaatgacctggacagagtggccgaccctgcctacctgcccacccagcaggatgtgctgcgggtgcgggtgcccaccaccggcatcatcgagtacccctttgacctgcagagcgtgtag

SEQ ID NO: 154709 - DNA, 1824 bp, Artificial Sequence
  Description of Artificial Sequence: Synthetic coding sequence
atgcccaggaagaagcccttctctgtgaagcagaagaagaagcagctgcaggacaagcgggagaggaagaggggcctgcaggacggcctgcggagcagcagcaacagccgcagcggcagccgggagcggcgggaggagcagacagacaccagtgatggagagagcgtgacccaccacatccggcggctgaaccagcagcccagccagggcctgggcccccggggctatgaccccaaccgctaccgcctgcactttgagcgggacagccgggaggaggtggagaggaggaagagagctgcccgggagcaggtgctgcagcctgtgtctgctgagctgctggagctggacatccgggaggtgtaccagcccggctctgtgctggacttccccaggaggcctccctggagctatgagatgagcaaggagcagctgatgagccaggaggagaggagcttccaggactacctgggcaagatccacggggcctacagcagcgagaagctgagctactttgagcacaacctggagacctggaggcagctgtggagggtgctggagatgtctgacatcgtgctgctgatcacagacatccgccaccctgtggtgaacttccccccagccctgtatgaatatgtgactggagagctgggcctggccctggtgctggtgctgaacaaggtggacctggcccccccagccctggtggtggcctggaagcactacttccaccagcactacccccagctgcacgtggtgctcttcaccagcttcccccgggaccccaggaccccccaggaccccagctctgtgctgaagaagagcagaagaagaggccggggctggacccgggccctgggccctgagcagctgctgcgggcctgtgaggccatcaccgtgggcaaggtggacctgagctcctggagggagaagatcgccagagatgtggccggggccacctggggcaatggcagcggggaggaggaggaggaggaggatggccctgctgtgctggtggagcagcagacagacagcgccatggagcccaccggccccacccaggagcgctacaaggatggagtggtgaccatcggctgtgtgggcttccccaacgtgggcaagagcagcctcatcaatggcctggtgggcaggaaggtggtgtctgtgtccaggaccccaggccacacccgctacttccagacctacttcctgacccccagcgtgaagctgtgtgactgccccggcctcatcttccccagcctgctgccccggcagctgcaggtgctggccggcatctaccccatcgcccagatccaggagccctacacagctgtgggctacctggccagccgcatccctgtgcaggccctgctgcacctgcggcaccctgaggccgaggaccccagcgctgagcacccctggtgtgcctgggacatctgtgaggcctgggccgagaagaggggctacaagacagccaaggccgccagaaatgatgtgtacagagctgccaacagcctgctgcggctggccgtggatggccgcctgagcctgtgcttccaccccccaggctacagcgagcagaagggcacctgggagagccaccctgagaccacagagctggtggtgctgcagggccgggtgggccctgctggagatgaggaggaggaggaggaggaggagctgagcagcagctgtgaggaggagggggaggaggacagagatgctgatgaggagggggagggagatgaggagacccccaccagcgcccctggcagcagcctggccggcaggaacccctatgccctgctgggggaggatgagtgctag

SEQ ID NO: 154710 - DNA, 1224 bp, Artificial Sequence
  Description of Artificial Sequence: Synthetic coding sequence
gtggtgaacttccccccagccctgtatgaatatgtgactggagagctgggcctggccctggtgctggtgctgaacaaggtggacctggcccccccagccctggtggtggcctggaagcactacttccaccagcactacccccagctgcacgtggtgctcttcaccagcttcccccgggaccccaggaccccccaggaccccagctctgtgctgaagaagagcagaagaagaggccggggctggacccgggccctgggccctgagcagctgctgcgggcctgtgaggccatcaccgtgggcaaggtggacctgagctcctggagggagaagatcgccagagatgtggccggggccacctggggcaatggcagcggggaggaggaggaggaggaggatggccctgctgtgctggtggagcagcagacagacagcgccatggagcccaccggccccacccaggagcgctacaaggatggagtggtgaccatcggctgtgtgggcttccccaacgtgggcaagagcagcctcatcaatggcctggtgggcaggaaggtggtgtctgtgtccaggaccccaggccacacccgctacttccagacctacttcctgacccccagcgtgaagctgtgtgactgccccggcctcatcttccccagcctgctgccccggcagctgcaggtgctggccggcatctaccccatcgcccagatccaggagccctacacagctgtgggctacctggccagccgcatccctgtgcaggccctgctgcacctgcggcaccctgaggccgaggaccccagcgctgagcacccctggtgtgcctgggacatctgtgaggcctgggccgagaagaggggctacaagacagccaaggccgccagaaatgatgtgtacagagctgccaacagcctgctgcggctggccgtggatggccgcctgagcctgtgcttccaccccccaggctacagcgagcagaagggcacctgggagagccaccctgagaccacagagctggtggtgctgcagggccgggtgggccctgctggagatgaggaggaggaggaggaggaggagctgagcagcagctgtgaggaggagggggaggaggacagagatgctgatgaggagggggagggagatgaggagacccccaccagcgcccctggcagcagcctggccggcaggaacccctatgccctgctgggggaggatgagtgctag

SEQ ID NO: 154711 - DNA, 1824 bp, Artificial Sequence; identical to SEQ ID NO: 154709
  Description of Artificial Sequence: Synthetic coding sequence

SEQ ID NO: 154712 - DNA, 795 bp, Artificial Sequence
  Description of Artificial Sequence: Synthetic coding sequence
atgggagagcgggtgctgtggcccctgcgggccggccagcactggaggcaccggcccctgcctgctggcctgcaggacggcctgcggagcagcagcaacagccgcagcggcagccgggagcggcgggaggagcagacagacaccagtgatggagagagcgtgacccaccacatccggcggctgaaccagcagcccagccagggcctgggcccccggggctatgaccccaaccgctaccgcctgcactttgagcgggacagccgggaggaggtggagaggaggaagagagctgcccgggagcaggtgctgcagcctgtgtctgctgagctgctggagctggacatccgggaggtgtaccagcccggctctgtgctggacttccccaggaggcctccctggagctatgagatgagcaaggagcagctgatgagccaggaggagaggagcttccaggactacctgggcaagatccacggggcctacagcagcgagaagctgagctactttgagcacaacctggagacctggaggcagctgtggagggtgctggagatgtctgacatcgtgctgctgatcacagacatccgccaccctgtggtgaacttccccccagccctgtatgaatatgtgactggagagctgggcctggccctggtgctggtgctgaacaaggtggacctggcccccccagccctggtggtggcctggaagcactacttccaccagcactacccccagctgcacgtggtgctcttcaccagcttcccccgggaccccaggaccccccaggactag

SEQ ID NO: 154713 - DNA, 1824 bp, Artificial Sequence; identical to SEQ ID NO: 154709
  Description of Artificial Sequence: Synthetic coding sequence

SEQ ID NO: 154714 - DNA, 1290 bp, Artificial Sequence
  Description of Artificial Sequence: Synthetic coding sequence
atggaggccgctgtggtgctggagatgtctgacatcgtgctgctgatcacagacatccgccaccctgtggtgaacttccccccagccctgtatgaatatgtgactggagagctgggcctggccctggtgctggtgctgaacaaggtggacctggcccccccagccctggtggtggcctggaagcactacttccaccagcactacccccagctgcacgtggtgctcttcaccagcttcccccgggaccccaggaccccccaggaccccagctctgtgctgaagaagagcagaagaagaggccggggctggacccgggccctgggccctgagcagctgctgcgggcctgtgaggccatcaccgtgggcaaggtggacctgagctcctggagggagaagatcgccagagatgtggccggggccacctggggcaatggcagcggggaggaggaggaggaggaggatggccctgctgtgctggtggagcagcagacagacagcgccatggagcccaccggccccacccaggagcgctacaaggatggagtggtgaccatcggctgtgtgggcttccccaacgtgggcaagagcagcctcatcaatggcctggtgggcaggaaggtggtgtctgtgtccaggaccccaggccacacccgctacttccagacctacttcctgacccccagcgtgaagctgtgtgactgccccggcctcatcttccccagcctgctgccccggcagctgcaggtgctggccggcatctaccccatcgcccagatccaggagccctacacagctgtgggctacctggccagccgcatccctgtgcaggccctgctgcacctgcggcaccctgaggccgaggaccccagcgctgagcacccctggtgtgcctgggacatctgtgaggcctgggccgagaagaggggctacaagacagccaaggccgccagaaatgatgtgtacagagctgccaacagcctgctgcggctggccgtggatggccgcctgagcctgtgcttccaccccccaggctacagcgagcagaagggcacctgggagagccaccctgagaccacagagctggtggtgctgcagggccgggtgggccctgctggagatgaggaggaggaggaggaggaggagctgagcagcagctgtgaggaggagggggaggaggacagagatgctgatgaggagggggagggagatgaggagacccccaccagcgcccctggcagcagcctggccggcaggaacccctatgccctgctgggggaggatgagtgctag

SEQ ID NO: 154715 - DNA, 1824 bp, Artificial Sequence; identical to SEQ ID NO: 154709
  Description of Artificial Sequence: Synthetic coding sequence

SEQ ID NO: 154716 - DNA, 1215 bp, Artificial Sequence
  Description of Artificial Sequence: Synthetic coding sequence
atgagcaaggagcagctgatgagccaggaggagaggagcttccaggactacctgggcaagatccacggggcctacagcagcgagaagctgagctactttgagcacaacctggagacctggaggcagctgtggagggtgctggagatgtctgacatcgtgctgctgatcacagacatccgccaccctgtggtgaacttccccccagccctgtatgaatatgtgactggagagctgggcctggccctggtgctggtgctgaacaaggtggacctggcccccccagccctggtggtggcctggaagcactacttccaccagcactacccccagctgcacgtggtgctcttcaccagcttcccccgggaccccaggaccccccaggaccccagctctgtgctgaagaagagcagaagaagaggccggggctggacccgggccctgggccctgagcagctgctgcgggcctgtgaggccatcaccgtgggcaagggcttccccaacgtgggcaagagcagcctcatcaatggcctggtgggcaggaaggtggtgtctgtgtccaggaccccaggccacacccgctacttccagacctacttcctgaccccatctgtgaagctgtgtgactgccccggcctcatcttccccagcctgctgccccggcagctgcaggtgctggccggcatctaccccatcgcccagatccaggagccctacacagctgtgggctacctggccagccgcatccctgtgcaggccctgctgcacctgcggcaccctgaggccgaggaccccagcgctgagcacccctggtgtgcctgggacatctgtgaggcctgggccgagaagaggggctacaagacagccaaggccgccagaaatgatgtgtaccgggccgccaacagcctgctgcggctggccgtggatggccgcctgagcctgtgcttccaccccccaggctacagcgagcagaagggcacctgggagagccaccctgagaccacagagctggtggtgctgcagggccgggtgggccctgctggagatgaggaggaggaggaggaggaggagctgagcagcagctgtgaggaggagggggaggaggacagagatgctgatgaggagggggagggagatgaggagacccccaccagcgcccctggcagcagcctggccggcaggaacccctatgccctgctgggagaagatgaatgttag

SEQ ID NO: 154717 - DNA, 795 bp, Artificial Sequence; identical to SEQ ID NO: 154712
  Description of Artificial Sequence: Synthetic coding sequence

SEQ ID NO: 154718 - DNA, 795 bp, Artificial Sequence; identical to SEQ ID NO: 154712
  Description of Artificial Sequence: Synthetic coding sequence

SEQ ID NO: 154719 - DNA, 795 bp, Artificial Sequence; identical to SEQ ID NO: 154712
  Description of Artificial Sequence: Synthetic coding sequence

SEQ ID NO: 154720 - DNA, 1824 bp, Artificial Sequence; identical to SEQ ID NO: 154709
  Description of Artificial Sequence: Synthetic coding sequence

SEQ ID NO: 154721 - DNA, 1824 bp, Artificial Sequence; identical to SEQ ID NO: 154709
  Description of Artificial Sequence: Synthetic coding sequence

SEQ ID NO: 154722 - DNA, 795 bp, Artificial Sequence; identical to SEQ ID NO: 154712
  Description of Artificial Sequence: Synthetic coding sequence

SEQ ID NO: 154723 - DNA, 795 bp, Artificial Sequence; identical to SEQ ID NO: 154712
  Description of Artificial Sequence: Synthetic coding sequence

SEQ ID NO: 154724 - DNA, 1824 bp, Artificial Sequence; identical to SEQ ID NO: 154709
  Description of Artificial Sequence: Synthetic coding sequence

SEQ ID NO: 154725 - DNA, 201 bp, Artificial Sequence
  Description of Artificial Sequence: Synthetic coding sequence
gtggtgaacttccccccagccctgtatgaatatgtgactggagagctgggcctggccctggtgctggtgctgaacaaggtggacctggcccccccagccctggtggtggcctggaagcactacttccaccagcactacccccagctgcacgtggtgctcttcaccagcttcccccgggaccccaggaccccccaggactag

SEQ ID NO: 154726 - DNA, 795 bp, Artificial Sequence; identical to SEQ ID NO: 154712
  Description of Artificial Sequence: Synthetic coding sequence

SEQ ID NO: 154727 - DNA, 1215 bp, Artificial Sequence; identical to SEQ ID NO: 154716
  Description of Artificial Sequence: Synthetic coding sequence

SEQ ID NO: 154728 - DNA, 789 bp, Artificial Sequence
  Description of Artificial Sequence: Synthetic coding sequence
atggagcccaccggccccacccaggagcgctacaaggatggagtggtgaccatcggctgtgtgggcttccccaacgtgggcaagagcagcctcatcaatggcctggtgggcaggaaggtggtgtctgtgtccaggaccccaggccacacccgctacttccagacctacttcctgaccccatctgtgaagctgtgtgactgccccggcctcatcttccccagcctgctgccccggcagctgcaggtgctggccggcatctaccccatcgcccagatccaggagccctacacagctgtgggctacctggccagccgcatccctgtgcaggccctgctgcacctgcggcaccctgaggccgaggaccccagcgctgagcacccctggtgtgcctgggacatctgtgaggcctgggccgagaagaggggctacaagacagccaaggccgccagaaatgatgtgtaccgggccgccaacagcctgctgcggctggccgtggatggccgcctgagcctgtgcttccaccccccaggctacagcgagcagaagggcacctgggagagccaccctgagaccacagagctggtggtgctgcagggccgggtgggccctgctggagatgaggaggaggaggaggaggaggagctgagcagcagctgtgaggaggagggggaggaggacagagatgctgatgaggagggggagggagatgaggagacccccaccagcgcccctggcagcagcctggccggcaggaacccctatgccctgctgggagaagatgaatgttag

SEQ ID NO: 154729 - DNA, 789 bp, Artificial Sequence; identical to SEQ ID NO: 154728
  Description of Artificial Sequence: Synthetic coding sequence

SEQ ID NO: 154730 - DNA, 1290 bp, Artificial Sequence; identical to SEQ ID NO: 154714
  Description of Artificial Sequence: Synthetic coding sequence

SEQ ID NO: 154731 - DNA, 1215 bp, Artificial Sequence; identical to SEQ ID NO: 154716
  Description of Artificial Sequence: Synthetic coding sequence

SEQ ID NO: 154732 - DNA, 1215 bp, Artificial Sequence; identical to SEQ ID NO: 154716
  Description of Artificial Sequence: Synthetic coding sequence

SEQ ID NO: 154733 - DNA, 789 bp, Artificial Sequence; identical to SEQ ID NO: 154728
  Description of Artificial Sequence: Synthetic coding sequence

SEQ ID NO: 154734 - DNA, 1290 bp, Artificial Sequence; identical to SEQ ID NO: 154714
  Description of Artificial Sequence: Synthetic coding sequence

SEQ ID NO: 154735 - DNA, 1290 bp, Artificial Sequence; identical to SEQ ID NO: 154714
  Description of Artificial Sequence: Synthetic coding sequence

SEQ ID NO: 154736 - DNA, 789 bp, Artificial Sequence; identical to SEQ ID NO: 154728
  Description of Artificial Sequence: Synthetic coding sequence

SEQ ID NO: 154737 - DNA, 1215 bp, Artificial Sequence; identical to SEQ ID NO: 154716
  Description of Artificial Sequence: Synthetic coding sequence

SEQ ID NO: 154738 - DNA, 1290 bp, Artificial Sequence; identical to SEQ ID NO: 154714
  Description of Artificial Sequence: Synthetic coding sequence

SEQ ID NO: 154739 - DNA, 1290 bp, Artificial Sequence; identical to SEQ ID NO: 154714
  Description of Artificial Sequence: Synthetic coding sequence

SEQ ID NO: 154740 - DNA, 789 bp, Artificial Sequence; identical to SEQ ID NO: 154728
  Description of Artificial Sequence: Synthetic coding sequence

SEQ ID NO: 154741 - DNA, 1290 bp, Artificial Sequence; identical to SEQ ID NO: 154714
  Description of Artificial Sequence: Synthetic coding sequence

SEQ ID NO: 154742 - DNA, 1215 bp, Artificial Sequence; identical to SEQ ID NO: 154716
  Description of Artificial Sequence: Synthetic coding sequence

SEQ ID NO: 154743 - DNA, 1215 bp, Artificial Sequence; identical to SEQ ID NO: 154716
  Description of Artificial Sequence: Synthetic coding sequence

SEQ ID NO: 154744 - DNA, 789 bp, Artificial Sequence; identical to SEQ ID NO: 154728
  Description of Artificial Sequence: Synthetic coding sequence

SEQ ID NO: 154745 - DNA, 2196 bp, Artificial Sequence
  Description of Artificial Sequence: Synthetic coding sequence
atggtgaagcccaagtacaagggccgcagcaccatcaaccccagcaaggccagcaccaacccagacagagtgcagggcgccggcggccagaacatgagggaccgggccaccatccggcggctgaacatgtaccggcagaaggagaggaggaacagccggggcaagatcatcaagcccctgcagtaccagagcacagtggccagcggcaccgtggcccgggtggagcccaacatcaagtggtttggaaacaccagggtcatcaagcagagcagcctgcagaagttccaggaggagatggacacagtgatgaaggacccctacaaggtggtgatgaagcagagcaagctgcccatgagcctgctgcatgaccgcatccggccccacaacctgaaggtgcacatcctggacacagagagctttgagaccaccttcggccccaagagccagaggaagaggcccaacctgtttgccagtgacatgcagagcctgattgaaaatgctgagatgagcacagagagctatgaccagggcaaggaccgggacctggtgacagaagatactggagtgagaaatgaggcccaggaggagatctacaagaagggccagagcaagaggatctggggcgagctgtacaaggtgattgacagcagtgatgtggtggtgcaggtgctggatgcccgggaccccatgggcaccaggagcccccacatcgagacctacctgaagaaggagaagccctggaagcacctgatctttgtgctgaacaagtgtgacctggtgcccacctgggccaccaagcgctgggtggccgtgctgagccaggactaccccaccctggccttccacgccagcctgaccaacccctttggaaaaggagccttcatccagctgctgcggcagtttgggaagctgcacacagacaagaagcagatctctgtgggcttcatcggctaccccaacgtgggcaagagcagcgtcatcaacaccctgcggagcaagaaggtgtgcaatgtggcccccatcgccggggagaccaaggtgtggcagtacatcaccctgatgaggcgcatcttcctgattgactgccctggggtggtgtaccccagcgaggacagcgagacagacatcgtgctgaagggcgtggtgcaggtggagaagatcaagagccctgaggaccacatcggggctgtgctggagcgggccaagccagagtacatcagcaagacctacaagattgacagctgggagaatgctgaggacttcctggagaagctggccttcagaacaggcaagctgctgaagggcggggagccagacctgcagacagtgggcaagatggtgctgaatgactggcagaggggccgcatccccttctttgtgaagcccccaaatgctgagcccctggtggccccccagctgctgcccagcagcagcctggaggtggtgcctgaggccgcccagaacaaccctggagaggaggtgacagaaacagctggggagggcagcgagagcatcatcaaggaggagacagaggagaacagccactgtgatgccaacacagagatgcagcagatcctgaccagggtgcggcagaactttgggaagatcaacgtggtgccccagttctctggagatgacctggtgcctgtggaggtgtctgacctggaggaggagctggagagcttcagtgatgaggaggaggaggagcaggagcagcagagagatgatgctgaggagagcagcagcgagcctgaggaggagaatgtgggcaatgacaccaaggctgtgatcaaggccctggatgagaagatcgccaagtaccagaagttcctggacaaggccaaggccaagaagttctctgctgtgcgcatcagcaagggcctgtctgagaagatctttgccaagccagaggagcagaggaagaccctggaggaggatgtggatgaccgggcccccagcaagaagggcaagaagaggaaggcccagcgggaggaggagcaggagcacagcaacaaggccccccgggccctgaccagcaaggagaggagaagagctgtgcggcagcagaggcccaagaaggtgggcgtgcgctactatgagacccacaacgtgaagaacagaaacagaaacaagaagaagaccaatgattctgagggccagaagcacaagaggaagaagttccggcagaagcagtag

SEQ ID NO: 154746 - DNA, 579 bp, Artificial Sequence
  Description of Artificial Sequence: Synthetic coding sequence
atgcagagcctgattgaaaatgctgagatgagcacagagagctatgaccagggcaaggaccgggacctggtgacagaggacaccggggtgagaaatgaggcccaggaggagatctacaagaagggccagagcaagaggatctggggcgagctgtacaaggtgattgacagcagtgatgtggtggtgcaggtgctggatgcccgggaccccatgggcaccaggagcccccacatcgagacctacctgaagaaggagaagccctggaagcacctgatctttgtgctgaacaagtgtgacctggtgcccacctgggccaccaagcgctgggtggccgtgctgagccaggactaccccaccctggccttccacgccagcctgaccaacccctttgggaagggggccttcatccagctgctgcggcagtttgggaagctgcacacagacaagaagcagatctctgtgggcttcatcggctacccaaatgtgggcaagagcagcgtcatcaacaccctgcggagcaagaaggtgtgcaatgtggcccccatcgccggggagaccaaggtgtccatcctgctgtag

SEQ ID NO: 154747 - DNA, 1614 bp, Artificial Sequence
  Description of Artificial Sequence: Synthetic coding sequence
atgacctgccacaagcgctacaagatccagaagaaggtgcgggagcaccacaggaagctgaggaaggaggccaagaagaggggccacaagaagcccaggaaggaccccggggtgcccaacagcgcccccttcaaggaggccctgctgcgggaggccgagctgaggaagcagaggctggaggagctgaagcagcagcagaagctggaccggcagaaggagctggagaagaagaggaagctggagaccaacccagacatcaagcccagcaatgtggagcccatggagaaggagtttggcctgtgcaagacagagaacaaggccaagagcggcaagcagaacagcaagaagctgtactgccaggagctgaagaaggtgattgaggccagtgatgtggtgctggaggtgctggatgcccgggaccccctgggctgccgctgcccccaggtggaggaggccatcgtgcagagcggccagaagaagctggtgctgatcctgaacaagagtgacctggtgcccaaggagaacctggagagctggctgaactacctgaagaaggagctgcccaccgtggtgttccgggccagcaccaagcccaaggacaagggcaagatcaccaagagggtgaaggccaagaagaatgctgcccccttccgctctgaggtgtgcttcggcaaggagggcctgtggaagctgctgggcggcttccaggagacctgcagcaaggccatccgggtgggcgtcatcggcttccccaacgtgggcaagagcagcatcatcaacagcctgaagcaggagcagatgtgcaatgtgggcgtgtccatgggcctgaccaggtccatgcaggtggtgcccctggacaagcagatcaccatcatcgacagccccagcttcatcgtgagccccctgaacagcagcagcgccctggccctgcggagccctgccagcattgaggtggtgaagcccatggaggccgccagcgccatcctgagccaggctgatgcccggcaggtggtgctgaagtacacagtgcccggctacagaaacagcctggagttcttcaccgtgctggcccagaggcggggcatgcaccagaagggcggcatccccaacgtggagggcgccgccaagctgctgtggagcgagtggacaggagccagcctggcctactactgccacccccccacctcctggaccccaccaccctacttcaatgaaagcatcgtggtggacatgaagagcggcttcaacctggaggagctggagaagaacaatgcccagagcatccgggccatcaagggcccccacctggccaacagcatcctcttccagagcagcggcctgaccaacggcatcatcgaggagaaggacatccacgaggagctgcccaagaggaaggagaggaagcaggaggagagagaagatgacaaggacagcgaccaggagaccgtggatgaggaggtggatgagaacagcagcggcatgtttgctgctgaggagaccggggaggccctgtctgaggagaccacagctggggagcagagcaccaggagcttcatcctggacaagatcatcgaggaggatgatgcctatgacttcagcacagattatgtgtag

SEQ ID NO: 154748 - DNA, 1650 bp, Artificial Sequence
  Description of Artificial Sequence: Synthetic coding sequence
atgaagaggcccaagctgaagaaggccagcaagaggatgacctgccacaagcgctacaagatccagaagaaggtgcgggagcaccacaggaagctgaggaaggaggccaagaagaggggccacaagaagcccaggaaggaccccggggtgcccaacagcgcccccttcaaggaggccctgctgcgggaggccgagctgaggaagcagaggctggaggagctgaagcagcagcagaagctggaccggcagaaggagctggagaagaagaggaagctggagaccaacccagacatcaagcccagcaatgtggagcccatggagaaggagtttggcctgtgcaagacagagaacaaggccaagagcggcaagcagaacagcaagaagctgtactgccaggagctgaagaaggtgattgaggccagtgatgtggtgctggaggtgctggatgcccgggaccccctgggctgccgctgcccccaggtggaggaggccatcgtgcagagcggccagaagaagctggtgctgatcctgaacaagagtgacctggtgcccaaggagaacctggagagctggctgaactacctgaagaaggagctgcccaccgtggtgttccgggccagcaccaagcccaaggacaagggcaagatcaccaagagggtgaaggccaagaagaatgctgcccccttccgctctgaggtgtgcttcggcaaggagggcctgtggaagctgctgggcggcttccaggagacctgcagcaaggccatccgggtgggcgtcatcggcttccccaacgtgggcaagagcagcatcatcaacagcctgaagcaggagcagatgtgcaatgtgggcgtgtccatgggcctgaccaggtccatgcaggtggtgcccctggacaagcagatcaccatcatcgacagccccagcttcatcgtgagccccctgaacagcagcagcgccctggccctgcggagccctgccagcattgaggtggtgaagcccatggaggccgccagcgccatcctgagccaggctgatgcccggcaggtggtgctgaagtacacagtgcccggctacagaaacagcctggagttcttcaccgtgctggcccagaggcggggcatgcaccagaagggcggcatccccaacgtggagggcgccgccaagctgctgtggagcgagtggacaggagccagcctggcctactactgccacccccccacctcctggaccccaccaccctacttcaatgaaagcatcgtggtggacatgaagagcggcttcaacctggaggagctggagaagaacaatgcccagagcatccgggccatcaagggcccccacctggccaacagcatcctcttccagagcagcggcctgaccaacggcatcatcgaggagaaggacatccacgaggagctgcccaagaggaaggagaggaagcaggaggagagagaagatgacaaggacagcgaccaggagaccgtggatgaggaggtggatgagaacagcagcggcatgtttgctgctgaggagaccggggaggccctgtctgaggagaccacagctggggagcagagcaccaggagcttcatcctggacaagatcatcgaggaggatgatgcctatgacttcagcacagattatgtgtag

SEQ ID NO: 154749 - DNA, 291 bp, Artificial Sequence
  Description of Artificial Sequence: Synthetic coding sequence
atgacctgccacaagcgctacaagatccagaagaaggtgcgggagcaccacaggaagctgaggaaggaggccaagaagaggggccacaagaagcccaggaaggaccccggggtgcccaacagcgcccccttcaaggaggccctgctgcgggaggccgagctgaggaagcagaggctggaggagctgaagcagcagcagaagctggaccggcagaaggagctggagaagaagaggaagctggagaccaacccagacatcaagcccagcaatgtggagcccatggagaagtag

SEQ ID NO: 154750 - DNA, 408 bp, Artificial Sequence
  Description of Artificial Sequence: Synthetic coding sequence
atgacctgccacaagcgctacaagatccagaagaaggtgcgggagcaccacaggaagctgaggaaggaggccaagaagaggggccacaagaagcccaggaaggaccccggggtgcccaacagcgcccccttcaaggaggccctgctgcgggaggccgagctgaggaagcagaggctggaggagctgaagcagcagcagaagctggaccggcagaaggagctggagaagaagaggaagctggagaccaacccagacatcaagcccagcaatgtggagcccatggagaaggagtttggcctgtgcaagacagagaacaaggccaagagcggcaagcagaacagcaagaagctgtactgccaggagctgaagaaggtgattgaggccagtgatgtggtgctggaggtgtag

SEQ ID NO: 154751 - DNA, 417 bp, Artificial Sequence
  Description of Artificial Sequence: Synthetic coding sequence
atgaagaggcccaagctgaagaaggccagcaagaggatgacctgccacaagcgctacaagatccagaagaaggtgcgggagcaccacaggaagctgaggaaggaggccaagaagaggggccacaagaagcccaggaaggaccccggggtgcccaacagcgcccccttcaaggaggccctgctgcgggaggccgagctgaggaagcagaggctggaggagctgaagcagcagcagaagctggaccggcagaaggagctggagaagaagaggaagctggagaccaacccagacatcaagcccagcaatgtggagcccatggagaaggagtttggcctgtgcaagacagagaacaaggccaagagcggcaagcagaacagcaagaagctgtactgccaggagctgaagaaggtgtcctag

SEQ ID NO: 154752 - DNA, 1038 bp, Artificial Sequence
  Description of Artificial Sequence: Synthetic coding sequence
atgcccagaattgatgctgacctgaagctggacttcaaggatgtgctgctgcggcccaagaggagcagcctgaagagcagagctgaggtggacctggagaggaccttcaccttcaggaacagcaagcagacctacagcggcatccccatcatcgtggccaacatggacacagtgggcacctttgagatggctgctgtgatgagccagcacagcatgttcaccgccatccacaagcactacagcctggatgactggaagctgtttgccaccaaccaccctgagtgcctgcagaatgtggccgtgagcagcggcagcggccagaatgacctggagaagatgaccagcatcctggaggccgtgccccaggtgaagttcatctgcctggatgtggccaacggctacagcgagcactttgtggagtttgtgaagctggtgcgggccaagtttcctgagcacaccatcatggctggaaatgtggtgactggagagatggtggaggagctgatcctgtctggagctgacatcatcaaggtgggcgtgggccctggctctgtgtgcaccaccaggaccaagacaggagtgggctacccccagctgtctgctgtgattgaatgtgccgacagcgcccacggcctgaagggccacatcatcagtgatggcggctgcacctgccctggagatgtggccaaggccttcggggccggggctgactttgtgatgctgggcggcatgttcagcggccacacagaatgtgccggggaggtgtttgaaagaaatggaaggaagctgaagctgttctacggcatgagcagtgacacagccatgaacaagcatgctggaggagtggccgagtaccgggccagcgagggcaagacagtggaggtgccctacaagggagatgtggagaacaccatcctggacatcctgggcggcctgcggagcacctgcacctacgtgggcgccgccaagctgaaggagctgagcagaagagccaccttcatccgggtgacccagcagcacaacacagtgttctcctag

SEQ ID NO: 154753 - DNA, 1230 bp, Artificial Sequence
  Description of Artificial Sequence: Synthetic coding sequence
atgccccacatcgacaatgatgtgaagctggacttcaaggatgtgctgctgcggcccaagaggagcaccctgaagagccgctctgaggtggacctgaccaggagcttctccttcaggaacagcaagcagacctacagcggcgtgcccatcatcgccgccaacatggacacagtgggcacctttgagatggccaaggtgctgtgcaagttcagcctcttcaccgctgtgcacaagcactacagcctggtgcagtggcaggagtttgctggccagaacccagactgcctggagcacctggccgccagcagcggcaccggcagcagtgactttgagcagctggagcagatcctggaggccatcccccaggtgaagtacatctgcctggatgtggccaacggctacagcgagcactttgtggagtttgtgaaggatgtgaggaagcgcttcccccagcacaccatcatggctggaaatgtggtgactggagagatggtggaggagctgatcctgtctggagctgacatcatcaaggtgggcatcggccctggctctgtgtgcaccaccaggaagaagacaggagtgggctacccccagctgtctgctgtgatggagtgtgctgatgctgcccacggcctgaagggccacatcatcagtgatggcggctgcagctgccctggagatgtggccaaggccttcggggccggggctgactttgtgatgctgggcggcatgctggccggccacagcgagagcggcggggagctgattgaaagagatggcaagaagtacaagctgttctacggcatgagcagcgagatggccatgaagaagtatgctgggggcgtggccgagtaccgctacgtgtggaggcccaggagcctggtgattgtgtggaggcagaacagctggctgctgcggggcggctggtacagcagccagaggtccatggtgaacagaggctccatgctgggctctgtggagaagagcctgggcctgagaaatcctgagggggaggacaacaaggtgttccccaccctgcgggccagcgagggcaagacagtggaggtgcccttcaagggagatgtggagcacaccatccgggacatcctgggcggcatccgcagcacctgcacctacgtgggcgccgccaagctgaaggagctgagcaggaggaccaccttcatccgggtgacccagcaggtgaaccccatcttcagcgaggcctgctag

SEQ ID NO: 154754 - DNA, 1047 bp, Artificial Sequence
  Description of Artificial Sequence: Synthetic coding sequence
atgccccacatcgacaatgatgtgaagctggacttcaaggatgtgctgctgcggcccaagaggagcaccctgaagagccgctctgaggtggacctgaccaggagcttctccttcaggaacagcaagcagacctacagcggcgtgcccatcatcgccgccaacatggacacagtgggcacctttgagatggccaaggtgctgtgcaagttcagcctcttcaccgctgtgcacaagcactacagcctggtgcagtggcaggagtttgctggccagaacccagactgcctggagcacctggccgccagcagcggcaccggcagcagtgactttgagcagctggagcagatcctggaggccatcccccaggtgaagtacatctgcctggatgtggccaacggctacagcgagcactttgtggagtttgtgaaggatgtgaggaagcgcttcccccagcacaccatcatggctggaaatgtggtgactggagagatggtggaggagctgatcctgtctggagctgacatcatcaaggtgggcatcggccctggctctgtgtgcaccaccaggaagaagacaggagtgggctacccccagctgtctgctgtgatggagtgtgctgatgctgcccacggcctgaagggccacatcatcagtgatggcggctgcagctgccctggagatgtggccaaggccttcggggccggggctgactttgtgatgctgggcggcatgctggccggccacagcgagagcggcggggagctgattgaaagagatggcaagaagtacaagctgttctacggcatgagcagcgagatggccatgaagaagtatgctgggggcgtggccgagtaccgggccagcgagggcaagacagtggaggtgcccttcaagggagatgtggagcacaccatccgggacatcctgggcggcatccgcagcacctgcacctacgtgggcgccgccaagctgaaggagctgagcaggaggaccaccttcatccgggtgacccagcaggtgaaccccatcttcagcgaggcctgctag

SEQ ID NO: 154755 - DNA, 1047 bp, Artificial Sequence; identical to SEQ ID NO: 154754
  Description of Artificial Sequence: Synthetic coding sequence

SEQ ID NO: 154756 - DNA, 1101 bp, Artificial Sequence
  Description of Artificial Sequence: Synthetic coding sequence
atgaccagctgcctgcctgccctgcgcttcatcgccaccccccggctgagcgccatgccccacatcgacaatgatgtgaagctggacttcaaggatgtgctgctgcggcccaagaggagcaccctgaagagccgctctgaggtggacctgaccaggagcttctccttcaggaacagcaagcagacctacagcggcgtgcccatcatcgccgccaacatggacacagtgggcacctttgagatggccaaggtgctgtgcaagttcagcctcttcaccgctgtgcacaagcactacagcctggtgcagtggcaggagtttgctggccagaacccagactgcctggagcacctggccgccagcagcggcaccggcagcagtgactttgagcagctggagcagatcctggaggccatcccccaggtgaagtacatctgcctggatgtggccaacggctacagcgagcactttgtggagtttgtgaaggatgtgaggaagcgcttcccccagcacaccatcatggctggaaatgtggtgactggagagatggtggaggagctgatcctgtctggagctgacatcatcaaggtgggcatcggccctggctctgtgtgcaccaccaggaagaagacaggagtgggctacccccagctgtctgctgtgatggagtgtgctgatgctgcccacggcctgaagggccacatcatcagtgatggcggctgcagctgccctggagatgtggccaaggccttcggggccggggctgactttgtgatgctgggcggcatgctggccggccacagcgagagcggcggggagctgattgaaagagatggcaagaagtacaagctgttctacggcatgagcagcgagatggccatgaagaagtatgctgggggcgtggccgagtaccgggccagcgagggcaagacagtggaggtgcccttcaagggagatgtggagcacaccatccgggacatcctgggcggcatccgcagcacctgcacctacgtgggcgccgccaagctgaaggagctgagcaggaggaccaccttcatccgggtgacccagcaggtgaaccccatcttcagcgaggcctgctag

SEQ ID NO: 154757 - DNA, 1047 bp, Artificial Sequence
  Description of Artificial Sequence: Synthetic coding sequence
atgccccacatcgacaatgatgtgaagctggacttcaaggatgtgctgctgcggcccaagaggagcaccctgaagagccgctctgaggtggacctgaccaggagcttctccttcaggaacagcaagcagacctacagcggcgtgcccatcatcgccgccaacatggacacagtgggcacctttgagatggccaaggtgctgtgcaagttcagcctcttcaccgctgtgcacaagcactacagcctggtgcagtggcaggagtttgctggccagaacccagactgcctggagagcatctggctgcctgcccaggcccaggccctgctgaccctgagctcctggaacagatcctggaagctgttccccaggaagtacatctgcctggatgtggccaacggctacagcgagcactttgtggagtttgtgaaggatgtgaggaagcgcttcccccagcacaccatcatggctggaaatgtggtgactggagagatggtggaggagctgatcctgtctggagctgacatcatcaaggtgggcatcggccctggctctgtgtgcaccaccaggaagaagacaggagtgggctacccccagctgtctgctgtgatggagtgtgctgatgctgcccacggcctgaagggccacatcatcagtgatggcggctgcagctgccctggagatgtggccaaggccttcggggccggggctgactttgtgatgctgggcggcatgctggccggccacagcgagagcggcggggagctgattgaaagagatggcaagaagtacaagctgttctacggcatgagcagcgagatggccatgaagaagtatgctgggggcgtggccgagtaccgggccagcgagggcaagacagtggaggtgcccttcaagggagatgtggagcacaccatccgggacatcctgggcggcatccgcagcacctgcacctacgtgggcgccgccaagctgaaggagctgagcaggaggaccaccttcatccgggtgacccagcaggtgaaccccatcttcagcgaggcctgctag

SEQ ID NO: 154758 - DNA, 1047 bp, Artificial Sequence; identical to SEQ ID NO: 154754
  Description of Artificial Sequence: Synthetic coding sequence

SEQ ID NO: 154759 - DNA, 1779 bp, Artificial Sequence
  Description of Artificial Sequence: Synthetic coding sequence
atggccagcgagatccacatgacaggccccatgtgcctgattgagaacaccaacggccgcctgatggccaaccctgaggccctgaagatcctgagcgccatcacccagcccatggtggtggtggccatcgtgggcctgtacagaacaggcaagagctacctgatgaacaagctggccggcaagaagaagggcttcagcctgggcagcacagtgcagagccacaccaagggcatctggatgtggtgtgtgccccaccccaagaagccaggccacatcctggtgctgctggacacagagggcctgggagatgtggagaagggggacaaccagaatgacagctggatctttgccctggccgtgctgctgagcagcacctttgtgtacaacagcatcggcaccatcaaccagcaggccatggaccagctgtactacgtgacagagctgacccaccgcatccgcagcaagagcagcccagatgaaaatgaaaatgaggtggaggacagcgctgactttgtgtccttcttcccagactttgtgtggaccctgcgggacttcagcctggacctggaggctgatggccagcccctgaccccagatgagtacctgacctacagcctgaagctgaagaagggcaccagccagaaggatgagaccttcaacctgccccggctgtgcatcaggaagttcttccccaagaagaagtgctttgtgtttgacaggcctgtgcacaggaggaagctggcccagctggagaagctgcaggatgaggagctggaccctgagtttgtgcagcaggtggccgacttctgcagctacatcttcagcaacagcaagaccaagaccctgagcggcggcatccaggtgaatggcccccggctggagagcctggtgctgacctacgtgaatgccatcagcagcggggacctgccctgcatggagaatgctgtgctggccctggcccagattgaaaattctgctgctgtgcagaaggccatcgcccactatgagcagcagatgggccagaaggtgcagctgcccacagagaccctgcaggagctgctggacctgcaccgggacagcgagcgggaggccatcgaggtgttcatccgcagcagcttcaaggatgtggaccacctgttccagaaggagctggccgcccagctggagaagaagagagatgacttctgcaagcagaaccaggaggccagcagtgaccgctgcagcgccctgctgcaggtgatcttcagccccctggaggaggaggtgaaggccggcatctacagcaagccaggcggctaccgcctgtttgtgcagaagctgcaggacctgaagaagaagtactatgaggagcccaggaagggcatccaggccgaggagatcctgcagacctacctgaagagcaaggagagcatgacagatgccatcctgcagacagaccagaccctgacagagaaggagaaggagattgaggtggagcgggtgaaggccgagagcgcccaggccagcgccaagatgctgcaggagatgcagaggaagaatgagcagatgatggagcagaaggagaggagctaccaggagcacctgaagcagctgacagagaagatggagaatgacagagtgcagctgctgaaggagcaggagaggaccctggccctgaagctgcaggagcaggagcagctgctgaaggagggcttccagaaggagagccgcatcatgaagaatgagatccaggacctgcagaccaagatgagaagaaggaaggcctgcaccatctcctag

SEQ ID NO: 154760 - DNA, 1668 bp, Artificial Sequence
  Description of Artificial Sequence: Synthetic coding sequence
atggtggtggtggccatcgtgggcctgtacagaacaggcaagagctacctgatgaacaagctggccggcaagaagaagggcttcagcctgggcagcacagtgcagagccacaccaagggcatctggatgtggtgtgtgccccaccccaagaagccaggccacatcctggtgctgctggacacagagggcctgggagatgtggagaagggggacaaccagaatgacagctggatctttgccctggccgtgctgctgagcagcacctttgtgtacaacagcatcggcaccatcaaccagcaggccatggaccagctgtactacgtgacagagctgacccaccgcatccgcagcaagagcagcccagatgaaaatgaaaatgaggtggaggacagcgctgactttgtgtccttcttcccagactttgtgtggaccctgcgggacttcagcctggacctggaggctgatggccagcccctgaccccagatgagtacctgacctacagcctgaagctgaagaagggcaccagccagaaggatgagaccttcaacctgccccggctgtgcatcaggaagttcttccccaagaagaagtgctttgtgtttgacaggcctgtgcacaggaggaagctggcccagctggagaagctgcaggatgaggagctggaccctgagtttgtgcagcaggtggccgacttctgcagctacatcttcagcaacagcaagaccaagaccctgagcggcggcatccaggtgaatggcccccggctggagagcctggtgctgacctacgtgaatgccatcagcagcggggacctgccctgcatggagaatgctgtgctggccctggcccagatcgagaacagcgctgctgtgcagaaggccatcgcccactatgagcagcagatgggccagaaggtgcagctgcccacagagaccctgcaggagctgctggacctgcaccgggacagcgagcgggaggccatcgaggtgttcatccgcagcagcttcaaggatgtggaccacctgttccagaaggagctggccgcccagctggagaagaagagagatgacttctgcaagcagaaccaggaggccagcagtgaccgctgcagcgccctgctgcaggtgatcttcagccccctggaggaggaggtgaaggccggcatctacagcaagccaggcggctaccgcctgtttgtgcagaagctgcaggacctgaagaagaagtactatgaggagcccaggaagggcatccaggccgaggagatcctgcagacctacctgaagagcaaggagagcatgacagatgccatcctgcagacagaccagaccctgacagagaaggagaaggagattgaggtggagcgggtgaaggccgagagcgcccaggccagcgccaagatgctgcaggagatgcagaggaagaatgagcagatgatggagcagaaggagaggagctaccaggagcacctgaagcagctgacagagaagatggagaatgacagagtgcagctgctgaaggagcaggagaggaccctggccctgaagctgcaggagcaggagcagctgctgaaggagggcttccagaaggagagccgcatcatgaagaatgagatccaggacctgcagaccaagatgagaagaaggaaggcctgcaccatctcctag

SEQ ID NO: 154761 - DNA, 1776 bp, Artificial Sequence
  Description of Artificial Sequence: Synthetic coding sequence
atggcccctgagatcaacctgcccggccccatgagcctgattgacaacaccaagggccagctggtggtgaaccctgaggccctgaagatcctgagcgccatcacccagcctgtggtggtggtggccatcgtgggcctgtacagaacaggcaagagctacctgatgaacaagctggccggcaagaagaatggcttcagcctgggcagcacagtgaagagccacaccaagggcatctggatgtggtgtgtgccccaccccaagaagccagagcacaccctggtgctgctggacacagagggcctgggggacatcgagaagggggacaatgaaaatgacagctggatctttgccctggccatcctgctgagcagcacctttgtgtacaacagcatgggcaccatcaaccagcaggccatggaccagctgcactacgtgacagagctgacagaccgcatcaaggccaacagcagccctggcaacaacagcgtggatgacagcgctgactttgtgtccttcttccctgcctttgtgtggaccctgcgggacttcaccctggagctggaggtggatggagagcccatcacagcagatgactacctggagctgagcctgaagctgaggaagggcacagacaagaagagcaagagcttcaatgacccccggctgtgcatcaggaagttcttccccaagaggaagtgctttgtgtttgactggccagcccccaagaagtacctggcccacctggagcagctgaaggaggaggagctgaacccagacttcatcgagcaggtggccgagttctgcagctacatcctgagccacagcaatgtgaagaccctgagcggcggcatccctgtgaatggcccccggctggagagcctggtgctgacctacgtgaatgccatcagcagcggggacctgccctgcatggagaatgctgtgctggccctggcccagattgaaaattctgctgctgtggagaaggccatcgcccactatgagcagcagatgggccagaaggtgcagctgcccacagagaccctgcaggagctgctggacctgcaccgggacagcgagcgggaggccatcgaggtgttcatgaagaacagcttcaaggatgtggaccagatgttccagaggaagctgggcgcccagctggaggccaggagagatgacttctgcaagcagaacagcaaggccagcagtgactgctgcatggccctgctgcaggacatcttcggccccctggaggaggatgtgaagcagggcaccttcagcaagccaggcggctaccgcctcttcacccagaagctgcaggagctgaagaacaagtactaccaggtgcccaggaagggcatccaggccaaggaggtgctgaagaagtacctggagagcaaagaagatgtggctgatgccctgctgcagacagaccagagcctgtctgagaaggagaaggccatcgaggtggagcgcatcaaggccgagagcgctgaggccgccaagaagatgctggaggagatccagaagaagaatgaggagatgatggagcagaaggagaagagctaccaggagcacgtgaagcagctgacagagaagatggagcgggaccgggcccagctgatggccgagcaggagaagaccctggccctgaagctgcaggagcaggagcggctgctgaaggagggctttgaaaatgaaagcaagaggctgcagaaggacatctgggacatccagatgaggagcaagagcctggagcccatctgcaacatcctgtag

SEQ ID NO: 154762 - DNA, 1776 bp, Artificial Sequence; identical to SEQ ID NO: 154761
  Description of Artificial Sequence: Synthetic coding sequence

SEQ ID NO: 154763 - DNA, 1323 bp, Artificial Sequence
  Description of Artificial Sequence: Synthetic coding sequence
atggcccctgagatccacatgacaggccccatgtgcctgattgagaacaccaacggggagctggtggccaaccctgaggccctgaagatcctgagcgccatcacccagcctgtggtggtggtggccatcgtgggcctgtacagaacaggcaagagctacctgatgaacaagctggccggcaagaacaagggcttcagcctgggcagcacagtgaagagccacaccaagggcatctggatgtggtgtgtgccccaccccaagaagccagagcacaccctggtgctgctggacacagagggcctgggagatgtgaagaagggggacaaccagaatgacagctggatcttcaccctggccgtgctgctgagcagcaccctggtgtacaacagcatgggcaccatcaaccagcaggccatggaccagctgtactacgtgacagagctgacccaccgcatccgcagcaagagcagcccagatgaaaatgaaaatgaagacagcgctgactttgtgtccttcttcccagactttgtgtggaccctgcgggacttcagcctggacctggaggctgatggccagcccctgaccccagatgagtacctggagtacagcctgaagctgacccagggcaccagccagaaggacaagaacttcaacctgccccggctgtgcatcaggaagttcttccccaagaagaagtgctttgtgtttgacctgcccatccacaggaggaagctggcccagctggagaagctgcaggatgaggagctggaccctgagtttgtgcagcaggtggccgacttctgcagctacatcttcagcaacagcaagaccaagaccctgagcggcggcatcaaggtgaatggcccccggctggagagcctggtgctgacctacatcaatgccatcagcagaggagacctgccctgcatggagaatgctgtgctggccctggcccagattgaaaattctgctgctgtgcagaaggccatcgcccactatgaccagcagatgggccagaaggtgcagctgcctgctgagaccctgcaggagctgctggacctgcaccgggtgtctgagcgggaggccacagaggtgtacatgaagaacagcttcaaggatgtggaccacctgttccagaagaagctggccgcccagctggacaagaagagagatgacttctgcaagcagaaccaggaggccagcagtgaccgctgcagcgccctgctgcaggtgatcttcagccccctggaggaggaggtgaaggccggcatctacagcaagccaggcggctactgcctcttcatccagaagctgcaggactag

SEQ ID NO: 154764 - DNA, 1788 bp, Artificial Sequence
  Description of Artificial Sequence: Synthetic coding sequence
atggcccctgagatccacatgacaggccccatgtgcctgattgagaacaccaacggggagctggtggccaaccctgaggccctgaagatcctgagcgccatcacccagcctgtggtggtggtggccatcgtgggcctgtacagaacaggcaagagctacctgatgaacaagctggccggcaagaacaagggcttcagcctgggcagcacagtgaagagccacaccaagggcatctggatgtggtgtgtgccccaccccaagaagccagagcacaccctggtgctgctggacacagagggcctgggagatgtgaagaagggggacaaccagaatgacagctggatcttcaccctggccgtgctgctgagcagcaccctggtgtacaacagcatgggcaccatcaaccagcaggccatggaccagctgtactacgtgacagagctgacccaccgcatccgcagcaagagcagcccagatgaaaatgaaaatgaagacagcgctgactttgtgtccttcttcccagactttgtgtggaccctgcgggacttcagcctggacctggaggctgatggccagcccctgaccccagatgagtacctggagtacagcctgaagctgacccagggcaccagccagaaggacaagaacttcaacctgccccggctgtgcatcaggaagttcttccccaagaagaagtgctttgtgtttgacctgcccatccacaggaggaagctggcccagctggagaagctgcaggatgaggagctggaccctgagtttgtgcagcaggtggccgacttctgcagctacatcttcagcaacagcaagaccaagaccctgagcggcggcatcaaggtgaatggcccccggctggagagcctggtgctgacctacatcaatgccatcagcagaggagacctgccctgcatggagaatgctgtgctggccctggcccagattgaaaattctgctgctgtgcagaaggccatcgcccactatgaccagcagatgggccagaaggtgcagctgcctgctgagaccctgcaggagctgctggacctgcaccgggtgtctgagcgggaggccacagaggtgtacatgaagaacagcttcaaggatgtggaccacctgttccagaagaagctggccgcccagctggacaagaagagagatgacttctgcaagcagaaccaggaggccagcagtgaccgctgcagcgccctgctgcaggtgatcttcagccccctggaggaggaggtgaaggccggcatctacagcaagccaggcggctactgcctcttcatccagaagctgcaggacctggagaagaagtactatgaggagcccaggaagggcatccaggccgaggagatcctgcagacctacctgaagagcaaggagagcgtgacagatgccatcctgcagacagaccagatcctgacagagaaggagaaggagattgaggtggagtgtgtgaaggccgagagcgcccaggccagcgccaagatggtggaggagatgcagatcaagtaccagcagatgatggaggagaaggagaagagctaccaggagcacgtgaagcagctgacagagaagatggagcgggagcgggcccagctgctggaggagcaggagaagaccctgaccagcaagctgcaggagcaggcccgggtgctgaaggagcgctgccagggcgagagcacccagctgcagaatgagatccagaagctgcagaagaccctgaagaagaagaccaagcgctacatgagccacaagctgaagatctag

SEQ ID NO: 154765 - DNA, 1692 bp, Artificial Sequence
  Description of Artificial Sequence: Synthetic coding sequence
atggcccctgagatccacatgacaggccccatgtgcctgattgagaacaccaacggggagctggtggccaaccctgaggccctgaagatcctgagcgccatcacccagcctgtggtggtggtggccatcgtgggcctgtacagaacaggcaagagctacctgatgaacaagctggccggcaagaacaagggcttcagcctgggcagcacagtgaagagccacaccaagggcatctggatgtggtgtgtgccccaccccaagaagccagagcacaccctggtgctgctggacacagagggcctgggagatgtgaagaagggggacaaccagaatgacagctggatcttcaccctggccgtgctgctgagcagcaccctggtgtacaacagcatgggcaccatcaaccagcaggccatggaccagctgtactacgtgacagagctgacccaccgcatccgcagcaagagcagcccagatgaaaatgaaaatgaagacagcgctgactttgtgtccttcttcccagactttgtgtggaccctgcgggacttcagcctggacctggaggctgatggccagcccctgaccccagatgagtacctggagtacagcctgaagctgacccagggcaacaggaagctggcccagctggagaagctgcaggatgaggagctggaccctgagtttgtgcagcaggtggccgacttctgcagctacatcttcagcaacagcaagaccaagaccctgagcggcggcatcaaggtgaatggcccccggctggagagcctggtgctgacctacatcaatgccatcagcagaggagacctgccctgcatggagaatgctgtgctggccctggcccagattgaaaattctgctgctgtgcagaaggccatcgcccactatgaccagcagatgggccagaaggtgcagctgcctgctgagaccctgcaggagctgctggacctgcaccgggtgtctgagcgggaggccacagaggtgtacatgaagaacagcttcaaggatgtggaccacctgttccagaagaagctggccgcccagctggacaagaagagagatgacttctgcaagcagaaccaggaggccagcagtgaccgctgcagcgccctgctgcaggtgatcttcagccccctggaggaggaggtgaaggccggcatctacagcaagccaggcggctactgcctcttcatccagaagctgcaggacctggagaagaagtactatgaggagcccaggaagggcatccaggccgaggagatcctgcagacctacctgaagagcaaggagagcgtgacagatgccatcctgcagacagaccagatcctgacagagaaggagaaggagattgaggtggagtgtgtgaaggccgagagcgcccaggccagcgccaagatggtggaggagatgcagatcaagtaccagcagatgatggaggagaaggagaagagctaccaggagcacgtgaagcagctgacagagaagatggagcgggagcgggcccagctgctggaggagcaggagaagaccctgaccagcaagctgcaggagcaggcccgggtgctgaaggagcgctgccagggcgagagcacccagctgcagaatgagatccagaagctgcagaagaccctgaagaagaagaccaagcgctacatgagccacaagctgaagatctag

SEQ ID NO: 154766 - DNA, 414 bp, Artificial Sequence
  Description of Artificial Sequence: Synthetic coding sequence
caggatgaggagctggaccctgagtttgtgcagcaggtggccgacttctgcagctacatcttcagcaacagcaagaccaagaccctgagcggcggcatcaaggccgaggagatcctgcagacctacctgaagagcaaggagagcgtgacagatgccatcctgcagacagaccagatcctgacagagaaggagaaggagattgaggtggagtgtgtgaaggccgagagcgcccaggccagcgccaagatggtggaggagatgcagatcaagtaccagcagatgatggaggagaaggagaagagctaccaggagcacgtgaagcagctgacagagaagatggagcgggagcgggcccagctgctggaggagcaggagaagaccctgaccagcaagctgcaggtgtccaagtgctag

SEQ ID NO: 154767 - DNA, 1923 bp, Artificial Sequence
  Description of Artificial Sequence: Synthetic coding sequence
atgggagagaggaccctgcacgccgctgtgcccaccccaggctacccagagagcgagagcatcatgatggcccccatctgcctggtggagaaccaggaggagcagctgactgtgaacagcaaggccctggagatcctggacaagatcagccagcctgtggtggtggtggccatcgtgggcctgtacagaacaggcaagagctacctgatgaaccggctggccggcaagagaaatggcttccccctgggcagcacagtgcagagcgagaccaagggcatctggatgtggtgtgtgccccacctgagcaagcccaaccacaccctggtgctgctggacacagagggcctgggagatgtggagaagagcaaccccaagaatgacagctggatctttgccctggccgtgctgctgagcagcagctttgtgtacaacagcgtgtccaccatcaaccaccaggccctggagcagctgcactacgtgacagagctggccgagctgatccgggccaagagctgccccaggccagatgaagctgaggacagcagcgagtttgccagcttcttcccagacttcatctggacagtgcgggacttcaccctggagctgaagctggatggcaaccccatcacagaagatgagtacctggagaatgccctgaagctgatccctgggaagaaccccaagatccagaacagcaacatgccccgggagtgcatccgccacttcttcaggaagaggaaatgttttgtgtttgaccggcccaccaatgacaagcagtacctgaaccacatggatgaggtgcctgaggagaacctggagcggcacttcctgatgcagagcgacaacttctgcagctacatcttcacccacgccaagaccaagaccctgcgggagggcatcatcgtgacaggcaagaggctgggcaccctggtggtgacctacgtggatgccatcaacagcggggctgtgccctgcctggagaatgctgtgacagccctggcccagctggagaacccagctgctgtgcagagagctgctgaccactacagccagcagatggcccagcagctgcggctgcccacagacaccctgcaggagctgctggatgtgcacgccgcctgtgagcgggaggccatcgctgtgttcatggagcacagcttcaaggatgagaaccacgagttccagaagaagctggtggacaccatcgagaagaagaagggggactttgtgctgcagaatgaggaggccagcgccaagtactgccaggccgagctgaagaggctgtctgagcacctgacagagagcatcctgcggggcatcttctctgtgcctgggggccacaacctgtacctggaggagaagaagcaggtggagtgggactacaagctggtgcccaggaaaggagtgaaggccaatgaggtgctgcagaacttcctgcagagccaggtggtggtggaggagagcatcctgcagagcgacaaggccctgacagctggggagaaggccatcgctgctgagcgggccatgaaggaggccgctgagaaggagcaggagctgctgcgggagaagcagaaggagcagcagcagatgatggaggcccaggagaggagcttccaggagtacatggcccagatggagaagaagctggaggaggagcgggagaacctgctgcgggagcacgagcggctgctgaagcacaagctgaaggtgcaggaggagatgctgaaggaggagttccagaagaagtctgagcagctgaacaaggagatcaaccagctgaaggagaagattgagagcaccaagaatgagcagctgcggctgctgaagatcctggacatggccagcaacatcatgattgtgaccctgcccggggccagcaagctgctgggcgtgggcaccaagtacctgggcagccgcatctag

SEQ ID NO: 154768 - DNA, 1761 bp, Artificial Sequence
  Description of Artificial Sequence: Synthetic coding sequence
atggccctggagatccacatgtctgaccccatgtgcctgattgagaacttcaatgagcagctgaaggtgaaccaggaggccctggagatcctgagcgccatcacccagcctgtggtggtggtggccatcgtgggcctgtacagaacaggcaagagctacctgatgaacaagctggccggcaagaacaagggcttctctgtggccagcacagtgcagagccacaccaagggcatctggatctggtgtgtgccccaccccaactggcccaaccacaccctggtgctgctggacacagagggcctgggagatgtggagaaggctgacaacaagaatgacatccagatctttgccctggccctgctgctgagcagcacctttgtgtacaacacagtgaacaagattgaccagggcgccatcgacctgctgcacaacgtgacagagctgacagacctgctgaaggccaggaacagcccagacctggacagagtggaggaccctgctgacagcgccagcttcttcccagacctggtgtggaccctgcgggacttctgcctgggcctggagattgatggccagctggtgaccccagatgagtacctggagaacagcctgcggcccaagcagggcagtgaccagagggtgcagaacttcaacctgccccggctgtgcatccagaagttcttccccaagaagaagtgcttcatctttgacctgcctgcccaccagaagaagctggcccagctggagaccctgcctgatgatgagctggagcctgagtttgtgcagcaggtgacagagttctgcagctacatcttcagccacagcatgaccaagaccctgcccggcggcatcatggtgaatggcagccggctgaagaacctggtgctgacctacgtgaatgccatcagcagcggggacctgccctgcattgaaaatgctgtgctggccctggcccagagagaaaattctgctgctgtgcagaaggccatcgcccactatgaccagcagatgggccagaaggtgcagctgcccatggagaccctgcaggagctgctggacctgcacaggaccagcgagcgggaggccatcgaggtgttcatgaagaacagcttcaaggatgtggaccagagcttccagaaggagctggagaccctgctggatgccaagcagaatgacatctgcaagaggaacctggaggccagcagtgactactgcagcgccctgctgaaggacatcttcggccccctggaggaggccgtgaagcagggcatctacagcaagccaggcggccacaacctcttcatccagaagacagaggagctgaaggccaagtactaccgggagcccaggaagggcatccaggccgaggaggtgctgcagaagtacctgaagagcaaggagagcgtgtcccatgccatcctgcagacagaccaggccctgacagaaacagagaagaagaagaaggaggcccaggtgaaggccgaggccgagaaggccgaggcccagaggctggccgccatccagaggcagaatgagcagatgatgcaggagcgggagcggctgcaccaggagcaggtgcggcagatggagatcgccaagcagaactggctggccgagcagcagaagatgcaggagcagcagatgcaggagcaggccgcccagctgagcaccaccttccaggcccagaacagaagcctgctgtctgagctgcagcacgcccagaggacagtgaacaatgatgacccctgtgtgctgctgtag

SEQ ID NO: 154769 - DNA, 1761 bp, Artificial Sequence; identical to SEQ ID NO: 154768
  Description of Artificial Sequence: Synthetic coding sequence

SEQ ID NO: 154770 - DNA, 1452 bp, Artificial Sequence
  Description of Artificial Sequence: Synthetic coding sequence
atggccctggagatccacatgtctgaccccatgtgcctgattgagaacttcaatgagcagctgaaggtgaaccaggaggccctggagatcctgagcgccatcacccagcctgtggtggtggtggccatcgtgggcctgtacagaacaggcaagagctacctgatgaacaagctggccggcaagaacaagggcttctctgtggccagcacagtgcagagccacaccaagggcatctggatctggtgtgtgccccaccccaactggcccaaccacaccctggtgctgctggacacagagggcctgggagatgtggagaaggctgacaacaagaatgacatccagatctttgccctggccctgctgctgagcagcacctttgtgtacaacacagtgaacaagattgaccagggcgccatcgacctgctgcacaacgtgacagagctgacagacctgctgaaggccaggaacagcccagacctggacagagtggaggaccctgctgacagcgccagcttcttcccagacctggtgtggaccctgcgggacttctgcctgggcctggagattgatggccagctggtgaccccagatgagtacctggagaacagcctgcggcccaagcagggcagtgaccagagggtgcagaacttcaacctgccccggctgtgcatccagaagttcttccccaagaagaagtgcttcatctttgacctgcctgcccaccagaagaagctggcccagctggagaccctgcctgatgatgagctggagcctgagtttgtgcagcaggtgacagagttctgcagctacatcttcagccacagcatgaccaagaccctgcccggcggcatcatggtgaatggcagccggctgaagaacctggtgctgacctacgtgaatgccatcagcagcggggacctgccctgcattgaaaatgctgtgctggccctggcccagagagaaaattctgctgctgtgcagaaggccatcgcccactatgaccagcagatgggccagaaggtgcagctgcccatggagaccctgcaggagctgctggacctgcacaggaccagcgagcgggaggccatcgaggtgttcatgaagaacagcttcaaggatgtggaccagagcttccagaaggagctggagaccctgctggatgccaagcagaatgacatctgcaagaggaacctggaggccagcagtgactactgcagcgccctgctgaaggacatcttcggccccctggaggaggccgtgaagcagggcatctacagcaagccaggcggccacaacctcttcatccagaagacagaggagctgaaggccaagtactaccgggagcccaggaagggcatccaggccgaggaggtgctgcagaagtacctgaagagcaaggagagcgtgtcccatgccatcctgcagacagaccaggccctgacagagacctag

SEQ ID NO: 154771 - DNA, 1917 bp, Artificial Sequence
  Description of Artificial Sequence: Synthetic coding sequence
atggccagcgagatccacatgcctggccctgtgtgcctgacagagaacaccaagggccacctggtggtgaacagcgaggccctggagatcctgagcgccatcacccagcctgtggtggtggtggccatcgtgggcctgtacagaacaggcaagagctacctgatgaacaagctggccggcaagaacaagggcttccccctgggctgcaccgtgaagtctgagaccaagggcatctggatgtggtgtgtgccccaccccagcaagcccaaccacaccctcatcctgctggacacagagggcctgggggacatggagaagagtgaccccaagagtgacagctggatctttgccctggccgtgctgctgagcagcagctttgtgtacaacagcatgggcaccatcaaccaccaggccctggagcagctgcactacgtgacagagctgacagagctgatccgggccaagagctgccccaggccagatgaggtggaggacagcagcgagtttgtgtccttcttcccagacttcatctggacagtgcgggacttcaccctggagctgaagctggatggccaccccatcacagaagatgagtacctggagaatgccctgaagctgatcagcggcaagaacccccagatccagaacagcaacaagccccgggagtggatccgccacttcttccccaagcagaagtgctttgtgtttgaccggcccatcaatgacaagaagctgctgctgcacgtggaggaggtgcgggaggaccagctggacagcaacttccagatgcagagcgagaacttctgcagctacatcttcacccacgccaagaccaagaccctgcgggagggcatcctggtgacaggcaaccggctgggcatgctggtggagacctacctggatgccatcaacagcggggccaccccctgcctggagaatgccatggctgtgctggcccagtgtgagaacagcgctgctgtgcagagagctgccaaccactacagccagcagatggcccagcaggtgcgcttccccacagacaccctgcaggagctgctggatgtgcatgctgtgtgtgagcgggaggccatcgctgtgttcatggagtacagcttcaaggacaagagccaggagttccagaagaagctggtggacaccatggagaagaagaaggaggactttgtgctgcagaatgaggaggccagcgccaagtactgccaggccgagctgaagaggctgtctgagctgctgacagagagcatcagccggggcaccttctttgtgcctgggggccacaacatctacctggaggccaagaagaagattgagcaggactacaccctggtgcccaggaagggcgtgaaggcagatgaggtgctgcagagcttcctgcagagccaggtggtgattgaggagagcatcctgcagagcgacaaggccctgacagctggggagaaggccatcgccgccaagcaggccaagaaggaggccgctgagaaggagcaggagctgctgcggcagaagcagaaggagcagcagcagatgatggaggcccaggagaggagcttccaggagaacatcgcccagctgaagaagaagatggagcgggagcgggagaactacatgagggagctgaggaagatgctgagccacaagatgaaggtgctggaggagctgctgacagagggcttcaaggagatctttgagagcctgaatgaggagatcaaccggctgaaggagcagatcgaggccgcagaaaatgaggagcccagcgtcttcagccagatcctggatgtggccggcagcatcttcatcgccgccctgcctggagctgccaagctggtggacctgggcatgaagatcctgagcagcctgtgcaaccggctgaggaaccctgggaagaagatcatctcctag

SEQ ID NO: 154772 - DNA, 1902 bp, Artificial Sequence
  Description of Artificial Sequence: Synthetic coding sequence
atggagagcggccccaagatgctggcccctgtgtgcctggtggagaacaacaatgagcagctgctggtgaaccagcaggccatccagatcctggagaagatcagccagcctgtggtggtggtggccatcgtgggcctgtacagaacaggcaagagctacctgatgaaccacctggccggccagaaccacggcttccccctgggcagcacagtgcagagcgagaccaagggcatctggatgtggtgtgtgccccaccccagcaagcccaaccacaccctggtgctgctggacacagagggcctgggagatgtggagaagggggaccccaagaatgacagctggatctttgccctggccgtgctgctgtgcagcacctttgtgtacaacagcatgagcaccatcaaccaccaggccctggagcagctgcactacgtgacagagctgacagagctgatcaaggccaagagcagccccaggccagatggagtggaggacagcacagaatttgtgtccttcttcccagacttcctgtggacagtgcgggacttcaccctggagctgaagctgaatggccaccccatcacagaagatgagtacctggagaatgccctgaagctgatccagggcaacaacccccgggtgcagaccagcaacttcccccgggagtgcatccgccgcttcttccccaagaggaagtgctttgtgtttgaccggcccaccaatgacaaggacctgctggccaacatcgagaaggtgtctgagaagcagctggaccccaagttccaggagcagaccaacatcttctgcagctacatcttcacccacgcccggaccaagaccctgcgggagggcatcaccgtgacaggcaaccggctgggcaccctggccgtgacctacgtggaggccatcaacagcggggctgtgccctgcctggagaatgctgtgatcaccctggcccagcgggagaacagcgctgctgtgcagagagctgctgactactacagccagcagatggcccagagggtgaagctgcccacagacaccctgcaggagctgctggacatgcatgctgcctgtgagcgggaggccatcgccatcttcatggagcacagcttcaaggatgagaaccaggagttccagaagaagttcatggagaccaccatgaacaagaagggggacttcctgctgcagaatgaggagagctctgtgcagtactgccaggccaagctgaatgagctgagcaagggcctgatggagagcatctctgctggcagcttctctgtgcctgggggccacaagctgtacatggagaccaaggagcgcatcgagcaggactactggcaggtgcccaggaagggcgtgaaggccaaggaggtgttccagcgcttcctggagagccagatggtgattgaggagagcatcctgcagagcgacaaggccctgacagaccgggagaaggctgtggccgtggaccgggccaagaaggaggccgctgagaaggagcaggagctgctgaagcagaagctgcaggagcagcagcagcagatggaggcccaggacaagagcaggaaagaaaatattgcccagctgaaggagaagctgcagatggagcgggagcacctgctgcgggagcagatcatgatgctggagcacacccagaaggtgcagaatgactggctgcacgagggcttcaagaagaagtatgaggagatgaatgctgagatcagccagttcaagaggatgattgacaccaccaagaatgatgacaccccctggatcgcccggaccctggacaacctggctgatgagctgacagccatcctgagcgccccagccaagctgattggacatggagtgaagggcgtgagcagcctcttcaagaagcacaagctgcccttctag

SEQ ID NO: 154773 - DNA, 1512 bp, Artificial Sequence
  Description of Artificial Sequence: Synthetic coding sequence
atgagcaccatcaaccaccaggccctggagcagctgcactacgtgacagagctgacagagctgatcaaggccaagagcagccccaggccagatggagtggaggacagcacagaatttgtgtccttcttcccagacttcctgtggacagtgcgggacttcaccctggagctgaagctgaatggccaccccatcacagaagatgagtacctggagaatgccctgaagctgatccagggcaacaacccccgggtgcagaccagcaacttcccccgggagtgcatccgccgcttcttccccaagaggaagtgctttgtgtttgaccggcccaccaatgacaaggacctgctggccaacatcgagaaggtgtctgagaagcagctggaccccaagttccaggagcagaccaacatcttctgcagctacatcttcacccacgcccggaccaagaccctgcgggagggcatcaccgtgacaggcaaccggctgggcaccctggccgtgacctacgtggaggccatcaacagcggggctgtgccctgcctggagaatgctgtgatcaccctggcccagcgggagaacagcgctgctgtgcagagagctgctgactactacagccagcagatggcccagagggtgaagctgcccacagacaccctgcaggagctgctggacatgcatgctgcctgtgagcgggaggccatcgccatcttcatggagcacagcttcaaggatgagaaccaggagttccagaagaagttcatggagaccaccatgaacaagaagggggacttcctgctgcagaatgaggagagctctgtgcagtactgccaggccaagctgaatgagctgagcaagggcctgatggagagcatctctgctggcagcttctctgtgcctgggggccacaagctgtacatggagaccaaggagcgcatcgagcaggactactggcaggtgcccaggaagggcgtgaaggccaaggaggtgttccagcgcttcctggagagccagatggtgattgaggagagcatcctgcagagcgacaaggccctgacagaccgggagaaggctgtggccgtggaccgggccaagaaggaggccgctgagaaggagcaggagctgctgaagcagaagctgcaggagcagcagcagcagatggaggcccaggacaagagcaggaaagaaaatattgcccagctgaaggagaagctgcagatggagcgggagcacctgctgcgggagcagatcatgatgctggagcacacccagaaggtgcagaatgactggctgcacgagggcttcaagaagaagtatgaggagatgaatgctgagatcagccagttcaagaggatgattgacaccaccaagaatgatgacaccccctggatcgcccggaccctggacaacctggctgatgagctgacagccatcctgagcgccccagccaagctgattggacatggagtgaagggcgtgagcagcctcttcaagaagcacaagctgcccttctag

SEQ ID NO: 154774 - DNA, 1815 bp, Artificial Sequence
  Description of Artificial Sequence: Synthetic coding sequence
atggagagcggccccaagatgctggcccctgtgtgcctggtggagaacaacaatgagcagctgctggtgaaccagcaggccatccagatcctggagaagatcagccagcctgtggtggtggtggccatcgtgggcctgtacagaacaggcaagagctacctgatgaaccacctggccggccagaaccacggcttccccctggacacagagggcctgggagatgtggagaagggggaccccaagaatgacagctggatctttgccctggccgtgctgctgtgcagcacctttgtgtacaacagcatgagcaccatcaaccaccaggccctggagcagctgcactacgtgacagagctgacagagctgatcaaggccaagagcagccccaggccagatggagtggaggacagcacagaatttgtgtccttcttcccagacttcctgtggacagtgcgggacttcaccctggagctgaagctgaatggccaccccatcacagaagatgagtacctggagaatgccctgaagctgatccagggcaacaacccccgggtgcagaccagcaacttcccccgggagtgcatccgccgcttcttccccaagaggaaatgttttgtgtttgaccggcccaccaatgacaaggacctgctggccaacatcgagaaggtgtctgagaagcagctggaccccaagttccaggagcagaccaacatcttctgcagctacatcttcacccacgcccggaccaagaccctgcgggagggcatcaccgtgactggaaaccggctgggcaccctggccgtgacctacgtggaggccatcaacagcggggctgtgccctgcctggagaatgctgtgatcaccctggcccagagagaaaattctgctgctgtgcagagagctgctgactactacagccagcagatggcccagagggtgaagctgcccacagacaccctgcaggagctgctggacatgcacgccgcctgtgagcgggaggccatcgccatcttcatggagcacagcttcaaggatgagaaccaggagttccagaagaagttcatggagaccaccatgaacaagaagggggacttcctgctgcagaatgaggagagctctgtgcagtactgccaggccaagctgaatgagctgagcaagggcctgatggagagcatctctgctggcagcttctctgtgcctgggggccacaagctgtacatggagaccaaggagagaattgagcaggactactggcaggtgcccaggaaaggagtgaaggccaaggaggtgttccagcgcttcctggagagccagatggtgattgaggagagcatcctgcagagcgacaaggccctgacagaccgggagaaggctgtggccgtggaccgggccaagaaggaggccgctgagaaggagcaggagctgctgaagcagaagctgcaggagcagcagcagcagatggaggcccaggacaagagcaggaaggagaacatcgcccagctgaaggagaagctgcagatggagcgggagcacctgctgcgggagcagatcatgatgctggagcacacccagaaggtgcagaatgactggctgcacgagggcttcaagaagaagtatgaggagatgaatgctgagatcagccagttcaagaggatgattgacaccaccaagaatgatgacaccccctggatcgcccggaccctggacaacctggctgatgagctgacagccatcctgagcgccccagccaagctgattggccacggcgtgaagggcgtgagcagcctcttcaagaagcacaagctgcccttctag

SEQ ID NO: 154775 - DNA, 1299 bp, Artificial Sequence
  Description of Artificial Sequence: Synthetic coding sequence
atgaagagcaccaagcccagcctgagccccagcaagccccagagcagcctggtgatccccaccagcctcttctgcaagaccttccccttccacttcatgtttgacaaggacatgaccatcctgcagtttggaaatggcatccggcggctgatgaacagaagagacttccagggcaagcccaactttgaggagtactttgagatcctgacccccaagatcaaccagaccttcagcggcatcatgaccatgctgaacatgcagtttgtggtgcgggtgcggcgctgggacaacagcgtgaagaagagcagccgggtgatggacctgaagggccagatgatctacatcgtggagagcagcgccatcctcttcctgggcagcccctgtgtggaccggctggaggacttcaccggccggggcctgtacctgagtgacatccccatccacaatgccctgagagatgtggtgctgattggagagcaggcccgggcccaggacggcctgaagaagaggctgggcaagctgaaggccaccctggagcaggcccaccaggccctggaggaggagaagaagaagacagtggacctgctgtgcagcatcttcccctgtgaggtggcccagcagctgtggcagggccaggtggtgcaggccaagaagttcagcaatgtgaccatgctgttcagtgacatcgtgggcttcaccgccatctgcagccagtgcagccccctgcaggtgatcaccatgctgaatgccctgtacaccaggtttgaccagcagtgtggggagctggatgtgtacaaggtggagaccatcggagatgcctactgtgtggccggcggcctgcacaaggagagtgacacccatgctgtgcagatcgccctgatggccctgaagatgatggagctgagtgatgaggtgatgagcccccatggagagcccatcaagatgagaattggcctgcacagcggctctgtgtttgctggggtggtgggcgtgaagatgccccgctactgcctgtttggaaacaacgtgaccctggccaacaagtttgagagctgcagcgtgcccaggaagatcaacgtgagccccaccacctaccgcctgctgaaggactgccccggctttgtgttcacccccaggagccgggaggagctgccccccaacttccccagcgagatccctggcatctgccacttcctggatgcctaccagcagggcaccaacagcaagccctgcttccagaagaaggatgtggaggatggaaatgccaacttcctgggcaaggccagcggcattgattag

SEQ ID NO: 154776 - DNA, 1875 bp, Artificial Sequence
  Description of Artificial Sequence: Synthetic coding sequence
atgttctgcaccaagctgaaggacctgaagatcaccggggagtgccccttcagcctgctggcccctggccaggtgcccaatgaaagcagcgaggaggccgccggcagcagcgagagctgcaaggccaccgtgcccatctgccaggacatccctgagaagaacatccaggagagcctgccccagaggaagaccagccgcagccgggtgtacctgcacaccctggccgagagcatctgcaagctgatcttccctgagtttgagcggctgaatgtggccctgcagaggaccctggccaagcacaagatcaaggagagcaggaagagcctggagcgggaggactttgagaagaccatcgccgagcaggccgtggccgccggcgtgcctgtggaggtgatcaaggagagcctgggggaggaggtgttcaagatctgctatgaagaagatgagaacatcctgggcgtggtgggcggcaccctgaaggacttcctgaacagcttcagcaccctgctgaagcagagcagccactgccaggaggccggcaagaggggccgcctggaggatgccagcatcctgtgcctggacaaggaggatgacttcctgcacgtgtactacttcttccccaagaggaccaccagcctcatcctgcccggcatcatcaaggccgccgcccacgtgctgtatgaaacagaggtggaggtgtccctgatgccaccctgcttccacaatgactgcagcgagtttgtgaaccagccctacctgctgtacagcgtgcacatgaagagcaccaagcccagcctgagccccagcaagccccagagcagcctggtgatccccaccagcctcttctgcaagaccttccccttccacttcatgtttgacaaggacatgaccatcctgcagtttggaaatggcatccggcggctgatgaacagaagagacttccagggcaagcccaactttgaggagtactttgagatcctgacccccaagatcaaccagaccttcagcggcatcatgaccatgctgaacatgcagtttgtggtgcgggtgcggcgctgggacaacagcgtgaagaagagcagccgggtgatggacctgaagggccagatgatctacatcgtggagagcagcgccatcctcttcctgggcagcccctgtgtggaccggctggaggacttcaccggccggggcctgtacctgagtgacatccccatccacaatgccctgagagatgtggtgctgattggagagcaggcccgggcccaggacggcctgaagaagaggctgggcaagctgaaggccaccctggagcaggcccaccaggccctggaggaggagaagaagaagacagtggacctgctgtgcagcatcttcccctgtgaggtggcccagcagctgtggcagggccaggtggtgcaggccaagaagttcagcaatgtgaccatgctgttcagtgacatcgtgggcttcaccgccatctgcagccagtgcagccccctgcaggtgatcaccatgctgaatgccctgtacaccaggtttgaccagcagtgtggggagctggatgtgtacaaggtggagaccatcggagatgcctactgtgtggccggcggcctgcacaaggagagtgacacccatgctgtgcagatcgccctgatggccctgaagatgatggagctgagtgatgaggtgatgagcccccatggagagcccatcaagatgagaattggcctgcacagcggctctgtgtttgctggggtggtgggcgtgaagatgccccgctactgcctgtttggaaacaacgtgaccctggccaacaagtttgagagctgcagcgtgcccaggaagatcaacgtgagccccaccacctacagatag

SEQ ID NO: 154777 - DNA, 2292 bp, Artificial Sequence
  Description of Artificial Sequence: Synthetic coding sequence
atgagcaggaggaagatcagcagcgagagcttcagcagcctgggcagtgactacctggagaccagccctgaggaggagggggagtgccccctgagccggctgtgctggaatggcagccgcagccccccaggccccctggagcccagccctgctgctgctgctgctgctgctgccccagcccccaccccagctgccagcgctgctgctgctgctgccacagctggggccaggagagtgcagaggagaagaagagtgaacctggacagcctgggggagagcatcagccggctgacagcccccagcccccagaccatccagcagaccctgaagaggaccctgcagtactatgagcaccaggtgattggctacagagatgctgagaagaacttccacaacatcagcaaccgctgcagctatgctgaccacagcaacaaggaggagattgaagatgtgtctggcatcctgcagtgcacagccaacatcctgggcctgaagtttgaggagatccagaagagatttggagaggagttcttcaacatctgcttccatgaaaatgaaagagtgctgcgggctgtgggcggcaccctgcaggacttcttcaatggatttgatgccctgctggagcacatccgcaccagctttgggaagcaggccaccctggagagccccagcttcctgtgcaaggagctgcctgagggcaccctgatgctgcactacttccacccccaccacatcgtgggctttgccatgctgggcatgatcaaggctgctgggaagaagatctaccgcctggatgtggaggtggagcaggtggccaatgagaagctgtgcagtgatgtgagcaaccctggcaactgcagctgcctgaccttcctgatcaaggaatgtgagaacaccaacatcatgaagaacctgccccagggcaccagccaggtgcctgctgacctgcgcatcagcatcaacaccttctgccgggccttccccttccacctgatgtttgaccccagcatgtctgtgctgcagctgggggagggcctgaggaagcagctgcgctgtgacacccacaaggtgctgaagtttgaggactgctttgagatcgtgagccccaaggtgaatgccacctttgagcgggtgctgctgcggctgagcacccccttcgtcatccgcaccaagccagaggccagcggcagcgagaacaaggacaaggtgatggaggtgaagggccagatgatccacgtgcctgagagcaacagcatcctcttcctgggcagcccctgtgtggacaagctggatgagctgatgggccggggcctgcacctgagtgacatccccatccatgatgccaccagagatgtgatcctggtgggggagcaggccaaggcccaggacggcctgaagaagaggatggacaagctgaaggccaccctggagaggacccaccaggccctggaggaggagaagaagaagacagtggacctgctgtacagcatcttccctggagatgtggcccagcagctgtggcagggccagcaggtgcaggccaggaagtttgatgatgtgaccatgctgttcagtgacatcgtgggcttcaccgccatctgtgcccagtgcacccccatgcaggtgatctccatgctgaatgagctgtacaccaggtttgaccaccagtgtggcttcctggacatctacaaggtggagaccatcggagatgcctactgtgtggccgccggcctgcacaggaagagcctgtgccacgccaagcccatcgccctgatggccctgaagatgatggagctgtctgaggaggtgctgaccccagatggccggcccatccagccccagaggtctgagctgctcttctccttccctgtgtccatccagctggtgcctgaccagcaccagagcgagacagacctgggcacagagaagatgagaattggcatccacagcggctctgtgctggccggcgtggtgggcgtgaggatgccccgctactgcctgtttggaaataatgtgaccctggccagcaagtttgagagcggcagccacccccggcgcatcaacgtgagccccaccacctaccagctgctgaagcgggaggagagcttcaccttcatccccaggagccgggaggagctgcctgacaacttccccaaggagatccctggcatctgctacttcctggaggtgaggacaggccccaagccacccaagcccagcctgagcagcagccgcatcaagaaggtgtcctacaacatcggcaccatgttcctgcgggagaccagcctgtag

SEQ ID NO: 154778 - DNA, 2199 bp, Artificial Sequence
  Description of Artificial Sequence: Synthetic coding sequence
atgagcaggaggaagatcagcagcgagagcttcagcagcctgggcagtgactacctggagaccagccctgaggaggagggggagtgccccctgagccggctgtgctggaatggcagccgcagccccccaggccccctggagcccagccctgctgctgctgctgctgctgctgccccagcccccaccccagctgccagcgctgctgctgctgctgccacagctggggccaggagagtgcagaggagaagaagagtgaacctggacagcctgggggagagcatcagccggctgacagcccccagcccccagaccatccagcagaccctgaagaggaccctgcagtactatgagcaccaggtgattggctacagagatgctgagaagaacttccacaacatcagcaaccgctgcagctatgctgaccacagcaacaaggaggagattgaagatgtgtctggcatcctgcagtgcacagccaacatcctgggcctgaagtttgaggagatccagaagagatttggagaggagttcttcaacatctgcttccatgaaaatgaaagagtgctgcgggctgtgggcggcaccctgcaggacttcttcaatggatttgatgccctgctggagcacatccgcaccagctttgggaagcaggccaccctggagagccccagcttcctgtgcaaggagctgcctgagggcaccctgatgctgcactacttccacccccaccacatcgtgggctttgccatgctgggcatgatcaaggctgctgggaagaagatctaccgcctggatgtggaggtggagcaggtggccaatgagaagctgtgcagtgatgtgagcaaccctggcaactgcagctgcctgaccttcctgatcaaggaatgtgagaacaccaacatcatgaagaacctgccccagggcaccagccaggtgcctgctgacctgcgcatcagcatcaacaccttctgccgggccttccccttccacctgatgtttgaccccagcatgtctgtgctgcagctgggggagggcctgaggaagcagctgcgctgtgacacccacaaggtgctgaagtttgaggactgctttgagatcgtgagccccaaggtgaatgccacctttgagcgggtgctgctgcggctgagcacccccttcgtcatccgcaccaagccagaggccagcggcagcgagaacaaggacaaggtgatggaggtgaagggccagatgatccacgtgcctgagagcaacagcatcctcttcctgggcagcccctgtgtggacaagctggatgagctgatgggccggggcctgcacctgagtgacatccccatccatgatgccaccagagatgtgatcctggtgggggagcaggccaaggcccaggacggcctgaagaagaggatggacaagctgaaggccaccctggagaggacccaccaggccctggaggaggagaagaagaagacagtggacctgctgtacagcatcttccctggagatgtggcccagcagctgtggcagggccagcaggtgcaggccaggaagtttgatgatgtgaccatgctgttcagtgacatcgtgggcttcaccgccatctgtgcccagtgcacccccatgcaggtgatctccatgctgaatgagctgtacaccaggtttgaccaccagtgtggcttcctggacatctacaaggtggagaccatcggagatgcctactgtgtggccgccggcctgcacaggaagagcctgtgccacgccaagcccatcgccctgatggccctgaagatgatggagctgtctgaggaggtgctgaccccagatggccggcccatccagatgagaattggcatccacagcggctctgtgctggccggcgtggtgggcgtgaggatgccccgctactgcctgtttggaaacaacgtgaccctggccagcaagtttgaaagtggcagccacccccggcgcatcaacgtgagccccaccacctaccagctgctgaagcgggaggagagcttcaccttcatccccaggagccgggaggagctgcctgacaacttccccaaggagatccctggcatctgctacttcctggaggtgaggacaggccccaagccacccaagcccagcctgagcagcagccgcatcaagaaggtgtcctacaacatcggcaccatgttcctgcgggagaccagcctgtag

SEQ ID NO: 154779 - DNA, 2073 bp, Artificial Sequence
  Description of Artificial Sequence: Synthetic coding sequence
atgttctgcaccaagctgaaggacctgaagatcaccggggagtgccccttcagcctgctggcccctggccaggtgcccaatgaaagcagcgaggaggccgccggcagcagcgagagctgcaaggccaccgtgcccatctgccaggacatccctgagaagaacatccaggagagcctgccccagaggaagaccagccgcagccgggtgtacctgcacaccctggccgagagcatctgcaagctgatcttccctgagtttgagcggctgaatgtggccctgcagaggaccctggccaagcacaagatcaaggagagcaggaagagcctggagcgggaggactttgagaagaccatcgccgagcaggccgtggccgccggcgtgcctgtggaggtgatcaaggagagcctgggggaggaggtgttcaagatctgctatgaagaagatgagaacatcctgggcgtggtgggcggcaccctgaaggacttcctgaacagcttcagcaccctgctgaagcagagcagccactgccaggaggccggcaagaggggccgcctggaggatgccagcatcctgtgcctggacaaggaggatgacttcctgcacgtgtactacttcttccccaagaggaccaccagcctcatcctgcccggcatcatcaaggccgccgcccacgtgctgtatgaaacagaggtggaggtgtccctgatgccaccctgcttccacaatgactgcagcgagtttgtgaaccagccctacctgctgtacagcgtgcacatgaagagcaccaagcccagcctgagccccagcaagccccagagcagcctggtgatccccaccagcctcttctgcaagaccttccccttccacttcatgtttgacaaggacatgaccatcctgcagtttggaaatggcatccggcggctgatgaacagaagagacttccagggcaagcccaactttgaggagtactttgagatcctgacccccaagatcaaccagaccttcagcggcatcatgaccatgctgaacatgcagtttgtggtgcgggtgcggcgctgggacaacagcgtgaagaagagcagccgggtgatggacctgaagggccagatgatctacatcgtggagagcagcgccatcctcttcctgggcagcccctgtgtggaccggctggaggacttcaccggccggggcctgtacctgagtgacatccccatccacaatgccctgagagatgtggtgctgattggagagcaggcccgggcccaggacggcctgaagaagaggctgggcaagctgaaggccaccctggagcaggcccaccaggccctggaggaggagaagaagaagacagtggacctgctgtgcagcatcttcccctgtgaggtggcccagcagctgtggcagggccaggtggtgcaggccaagaagttcagcaatgtgaccatgctgttcagtgacatcgtgggcttcaccgccatctgcagccagtgcagccccctgcaggtgatcaccatgctgaatgccctgtacaccaggtttgaccagcagtgtggggagctggatgtgtacaaggtggagaccatcggagatgcctactgtgtggccggcggcctgcacaaggagagtgacacccatgctgtgcagatcgccctgatggccctgaagatgatggagctgagtgatgaggtgatgagcccccatggagagcccatcaagatgagaattggcctgcacagcggctctgtgtttgctggggtggtgggcgtgaagatgccccgctactgcctgtttggaaacaacgtgaccctggccaacaagtttgagagctgcagcgtgcccaggaagatcaacgtgagccccaccacctaccgcctgctgaaggactgccccggctttgtgttcacccccaggagccgggaggagctgccccccaacttccccagcgagatccctggcatctgccacttcctggatgcctaccagcagggcaccaacagcaagccctgcttccagaagaaggatgtggaggatggaaatgccaacttcctgggcaaggccagcggcattgattag

SEQ ID NO: 154780 - DNA, 2073 bp, Artificial Sequence; identical to SEQ ID NO: 154779
  Description of Artificial Sequence: Synthetic coding sequence

SEQ ID NO: 154781 - DNA, 2073 bp, Artificial Sequence; identical to SEQ ID NO: 154779
  Description of Artificial Sequence: Synthetic coding sequence

SEQ ID NO: 154782 - DNA, 2073 bp, Artificial Sequence; identical to SEQ ID NO: 154779
  Description of Artificial Sequence: Synthetic coding sequence

SEQ ID NO: 154783 - DNA, 2073 bp, Artificial Sequence; identical to SEQ ID NO: 154779
  Description of Artificial Sequence: Synthetic coding sequence

SEQ ID NO: 154784 - DNA, 1860 bp, Artificial Sequence
  Description of Artificial Sequence: Synthetic coding sequence
atgtatggctttgtgaaccacgccctggagctgctggtgatcagaaattatggccctgaggtgtgggaggacatcaagaaggaggcccagctggatgaggagggccagttcctggtgcgcatcatctatgatgacagcaagacctatgacctggtggccgccgccagcaaggtgctgaacctgaatgctggggagatcctgcagatgtttgggaagatgttctttgtgttctgccaggagagcggctatgacaccatcctgcgggtgctgggcagcaatgtgcgggagttcctgcagaacctggatgccctgcatgaccacctggccaccatctacccaggcatgagggcccccagcttccgctgcacagatgctgagaagggcaagggcctcatcctgcactactacagcgagcgggagggcctgcaggacatcgtgattggcatcatcaagacagtggcccagcagatccacggcacagaaattgacatgaaggtgatccagcagagaaatgaagaatgtgaccacacccagttcctgattgaggagaaggagagcaaggaggaggacttctatgaggacctggacagatttgaggagaatggcacccaggagagccgcatcagcccctacaccttctgcaaggccttccccttccacatcatctttgaccgggacctggtggtgacccagtgtggaaatgccatctacagagtgctgccccagctgcagcccggcaactgcagcctgctgagcgtcttcagcctggtgcggccccacatcgacatctccttccacggcatcctgagccacatcaacacagtgtttgtgctgcggagcaaggagggcctgctggatgtggagaagctggagtgtgaagatgagctgactggaacagagatcagctgcctgcggctgaagggccagatgatctacctgcctgaggccgacagcatcctcttcctgtgcagccccagcgtgatgaacctggatgacctgacccggcggggcctgtacctgagtgacatccccctgcatgatgccacccgggacctggtgctgctgggggagcagttccgggaggagtacaagctgacccaggagctggagatcctgacagaccggctgcagctgaccctgcgggccctggaggatgagaagaagaagacagacaccctgctgtacagcgtgctgcccccatctgtggccaatgagctgcggcacaagaggcctgtgcctgccaagagatatgacaacgtgaccatcctcttctctggaattgtgggcttcaatgccttctgcagcaagcacgccagcggggagggcgccatgaagatcgtgaacctgctgaatgacctgtacaccaggtttgacaccctgacagacagcaggaagaacccctttgtgtacaaggtggagaccgtgggggacaagtacatgacagtgtctggcctgcctgagccctgcatccaccacgcccggagcatctgccacctggccctggacatgatggagattgctggccaggtgcaggtggatggagagagcgtgcagatcaccatcggcatccacactggagaggtggtgactggagtgattggccagaggatgccccgctactgcctgtttggaaacacagtgaacctgaccagcaggacagagaccaccggggagaagggcaagatcaacgtgtctgagtacacctaccgctgcctgatgagccctgagaacagcgacccccagttccacctggagcaccggggccctgtgtccatgaagggcaagaaggagcccatgcaggtgtggttcctgagcaggaagaacacaggaacagaggagaccaagcaggatgatgactag

SEQ ID NO: 154785 - DNA, 1656 bp, Artificial Sequence
  Description of Artificial Sequence: Synthetic coding sequence
atgtttgggaagatgttctttgtgttctgccaggagagcggctatgacaccatcctgcgggtgctgggcagcaatgtgcgggagttcctgcagaacctggatgccctgcatgaccacctggccaccatctacccaggcatgagggcccccagcttccgctgcacagatgctgagaagggcaagggcctcatcctgcactactacagcgagcgggagggcctgcaggacatcgtgattggcatcatcaagacagtggcccagcagatccacggcacagaaattgacatgaaggtgatccagcagagaaatgaagaatgtgaccacacccagttcctgattgaggagaaggagagcaaggaggaggacttctatgaggacctggacagatttgaggagaatggcacccaggagagccgcatcagcccctacaccttctgcaaggccttccccttccacatcatctttgaccgggacctggtggtgacccagtgtggaaatgccatctacagagtgctgccccagctgcagcccggcaactgcagcctgctgagcgtcttcagcctggtgcggccccacatcgacatctccttccacggcatcctgagccacatcaacacagtgtttgtgctgcggagcaaggagggcctgctggatgtggagaagctggagtgtgaagatgagctgactggaacagagatcagctgcctgcggctgaagggccagatgatctacctgcctgaggccgacagcatcctcttcctgtgcagccccagcgtgatgaacctggatgacctgacccggcggggcctgtacctgagtgacatccccctgcatgatgccacccgggacctggtgctgctgggggagcagttccgggaggagtacaagctgacccaggagctggagatcctgacagaccggctgcagctgaccctgcgggccctggaggatgagaagaagaagacagacaccctgctgtacagcgtgctgcccccatctgtggccaatgagctgcggcacaagaggcctgtgcctgccaagagatatgacaacgtgaccatcctcttctctggaattgtgggcttcaatgccttctgcagcaagcacgccagcggggagggcgccatgaagatcgtgaacctgctgaatgacctgtacaccaggtttgacaccctgacagacagcaggaagaacccctttgtgtacaaggtggagaccgtgggggacaagtacatgacagtgtctggcctgcctgagccctgcatccaccacgcccggagcatctgccacctggccctggacatgatggagattgctggccaggtgcaggtggatggagagagcgtgcagatcaccatcggcatccacactggagaggtggtgactggagtgattggccagaggatgccccgctactgcctgtttggaaacacagtgaacctgaccagcaggacagagaccaccggggagaagggcaagatcaacgtgtctgagtacacctaccgctgcctgatgagccctgagaacagcgacccccagttccacctggagcaccggggccctgtgtccatgaagggcaagaaggagcccatgcaggtgtggttcctgagcaggaagaacacaggaacagaggagaccaagcaggatgatgactag

SEQ ID NO: 154786 - DNA, 1800 bp, Artificial Sequence
  Description of Artificial Sequence: Synthetic coding sequence
atgctgatgtgcttcatcaaggaggcccagctggatgaggagggccagttcctggtgcgcatcatctatgatgacagcaagacctatgacctggtggccgccgccagcaaggtgctgaacctgaatgctggggagatcctgcagatgtttgggaagatgttctttgtgttctgccaggagagcggctatgacaccatcctgcgggtgctgggcagcaatgtgcgggagttcctgcagaacctggatgccctgcatgaccacctggccaccatctacccaggcatgagggcccccagcttccgctgcacagatgctgagaagggcaagggcctcatcctgcactactacagcgagcgggagggcctgcaggacatcgtgattggcatcatcaagacagtggcccagcagatccacggcacagaaattgacatgaaggtgatccagcagagaaatgaagaatgtgaccacacccagttcctgattgaggagaaggagagcaaggaggaggacttctatgaggacctggacagatttgaggagaatggcacccaggagagccgcatcagcccctacaccttctgcaaggccttccccttccacatcatctttgaccgggacctggtggtgacccagtgtggaaatgccatctacagagtgctgccccagctgcagcccggcaactgcagcctgctgagcgtcttcagcctggtgcggccccacatcgacatctccttccacggcatcctgagccacatcaacacagtgtttgtgctgcggagcaaggagggcctgctggatgtggagaagctggagtgtgaagatgagctgactggaacagagatcagctgcctgcggctgaagggccagatgatctacctgcctgaggccgacagcatcctcttcctgtgcagccccagcgtgatgaacctggatgacctgacccggcggggcctgtacctgagtgacatccccctgcatgatgccacccgggacctggtgctgctgggggagcagttccgggaggagtacaagctgacccaggagctggagatcctgacagaccggctgcagctgaccctgcgggccctggaggatgagaagaagaagacagacaccctgctgtacagcgtgctgcccccatctgtggccaatgagctgcggcacaagaggcctgtgcctgccaagagatatgacaacgtgaccatcctcttctctggaattgtgggcttcaatgccttctgcagcaagcacgccagcggggagggcgccatgaagatcgtgaacctgctgaatgacctgtacaccaggtttgacaccctgacagacagcaggaagaacccctttgtgtacaaggtggagaccgtgggggacaagtacatgacagtgtctggcctgcctgagccctgcatccaccacgcccggagcatctgccacctggccctggacatgatggagattgctggccaggtgcaggtggatggagagagcgtgcagatcaccatcggcatccacactggagaggtggtgactggagtgattggccagaggatgccccgctactgcctgtttggaaacacagtgaacctgaccagcaggacagagaccaccggggagaagggcaagatcaacgtgtctgagtacacctaccgctgcctgatgagccctgagaacagcgacccccagttccacctggagcaccggggccctgtgtccatgaagggcaagaaggagcccatgcaggtgtggttcctgagcaggaagaacacaggaacagaggagaccaagcaggatgatgactag

SEQ ID NO: 154787 - DNA, 1656 bp, Artificial Sequence; identical to SEQ ID NO: 154785
  Description of Artificial Sequence: Synthetic coding sequence

SEQ ID NO: 154788 - DNA, 3222 bp, Artificial Sequence
  Description of Artificial Sequence: Synthetic coding sequence
atgaagaccctgctgctggacctggccctgtggagcctgctcttccagcccggctggctgtccttcagcagccaggtgtcccagaactgccacaacggcagctatgagatctctgtgctgatgatgggcaacagcgcctttgctgagcccctgaagaacctggaggatgctgtgaatgaaggcctggagatcgtgcggggccgcctgcagaatgccggcctgaatgtgacagtgaatgccaccttcatgtacagtgatggcctcatccacaacagcggggactgccgcagcagcacctgtgagggcctggacctgctgaggaagatcagcaatgcccagaggatgggctgtgtgctgattggccccagctgcacctacagcaccttccagatgtacctggacacagagctgagctaccccatgatctctgctggcagctttggcctgagctgtgactacaaggagaccctgacccggctgatgagccctgccaggaagctgatgtacttcctggtgaacttctggaagaccaatgacctgcccttcaagacctacagctggagcaccagctatgtgtacaagaatggaacagaaacagaggactgcttctggtacctgaatgccctggaggcctctgtgtcctacttcagccatgagctgggcttcaaggtggtgctgcggcaggacaaggagttccaggacatcctgatggaccacaacaggaagagcaatgtcatcatcatgtgtggcggccctgagttcctgtacaagctgaagggggacagagctgtggccgaggacatcgtcatcatcctggtggacctcttcaatgaccagtactttgaggacaacgtgacagccccagactacatgaagaatgtgctggtgctgaccctgagccctggcaacagcctgctgaacagcagcttcagcaggaacctgagccccaccaagagggactttgccctggcctacctgaatggcatcctgctgtttggccacatgctgaagatcttcctggagaatggagagaacatcaccacccccaagtttgcccacgccttcaggaacctgacctttgagggctatgatggccctgtgaccctggatgactggggagatgtggacagcaccatggtgctgctgtacacctctgtggacaccaagaagtacaaggtgctgctgacctatgacacccacgtgaacaagacctaccctgtggacatgagccccaccttcacctggaagaacagcaagctgcccaatgacatcaccggccggggcccccagatcctgatgattgctgtgttcaccctgaccggggctgtggtgctgctgctgctggtggccctgctgatgctgaggaagtacaggaaggactatgagctgcggcagaagaagtggagccacatccccccagagaacatcttccccctggagaccaatgagaccaaccacgtgtccctgaagattgatgatgacaagaggcgggacaccatccagaggctgcggcagtgcaagtatgacaagaagagggtcatcctgaaggacctgaagcacaatgatggcaacttcacagagaagcagaagattgagctgaacaagctgctgcagattgactactacaacctgaccaagttctacggcaccgtgaagctggacaccatgatcttcggcgtgattgagtactgtgagcggggcagcctgcgggaggtgctgaatgacaccatctcctacccagatggcaccttcatggactgggagttcaagatctctgtgctgtatgacatcgccaagggcatgagctacctgcacagcagcaagacagaggtgcacggccgcctgaagagcaccaactgtgtggtggacagcaggatggtggtgaagatcacagactttggctgcaacagcatcctgccccccaagaaggacctgtggacagcccctgagcacctgcggcaggccaacatcagccagaagggagatgtgtacagctatggcatcatcgcccaggagatcatcctgaggaaggagaccttctacaccctgagctgccgggacagaaatgagaagatcttccgggtggagaacagcaatggcatgaagcccttccggccagacctcttcctggagacagctgaggagaaggagctggaggtgtacctgctggtgaagaactgctgggaggaggaccctgagaagaggccagacttcaagaagattgagaccaccctggccaagatcttcggcctcttccatgaccagaagaatgaaagctacatggacaccctcatccggcggctgcagctgtacagcaggaacctggagcacctggtggaggagaggacccagctgtacaaggccgagcgggacagagctgaccggctgaacttcatgctgctgccccggctggtggtgaagagcctgaaggagaagggctttgtggagcctgagctgtatgaggaggtgaccatctacttcagtgacatcgtgggcttcaccaccatctgcaagtacagcacccccatggaggtggtggacatgctgaatgacatctacaagagctttgaccacatcgtggaccaccatgatgtgtacaaggtggagaccatcggagatgcctacatggtggccagcggcctgcccaagagaaatggaaacagacatgccattgatattgccaagatggccctggagatcctgtccttcatgggcacctttgagctggagcacctgcccggcctgcccatctggatcagaattggagtgcacagcggcccctgtgccgccggcgtggtgggcatcaagatgccccgctactgcctgtttggagacacagtgaacacagccagcaggatggagagcacaggcctgcccctgcgcatccacgtgtctggcagcaccatcgccatcctgaagaggacagagtgccagttcctgtatgaggtgcggggggagacctacctgaagggcagaggaaatgagaccacctactggctgaccggcatgaaggaccagaagttcaacctgcccaccccacccaccgtggagaaccagcagaggctgcaggccgagttcagtgacatgattgccaacagcctgcagaagaggcaggccgccggcatccgcagccagaagccccggcgggtggccagctacaagaagggcaccctggagtacctgcagctgaacaccacagacaaggagagcacctacttctag

SEQ ID NO: 154789 - DNA, 3312 bp, Artificial Sequence
  Description of Artificial Sequence: Synthetic coding sequence
atgacagcctgtgcccggcgggccggcggcctgcctgaccccggcctgtgtggccctgcctggtgggcccccagcctgccccggctgccccgggccctgccccggctgcccctgctgctgctgctgctgctgctgcagcccccagccctgtctgctgtgttcaccgtgggcgtgctgggcccctgggcctgtgaccccatcttcagccgggcccggccagacctggccgcccggctggccgccgcccggctgaacagagaccccggcctggccggcggccccaggtttgaggtggccctgctgcctgagccctgcaggaccccaggcagcctgggcgctgtgagcagcgccctggcccgggtgtctggcctggtgggccctgtgaacccagctgcctgcaggcctgctgagctgctggccgaggaggccggcatcgccctggtgccctggggctgcccctggacccaggccgagggcaccacagccccagctgtgaccccagctgctgatgccctgtatgccctgctgcgggccttcggctgggcccgggtggccctggtgacagccccccaggacctgtgggtggaggccggccgcagcctgagcacagccctgcgggcccggggcctgcctgtggcctctgtgacctccatggagcccctggacctgagcggggcccgggaggccctgaggaaggtgagagatggcccccgggtgacagctgtgatcatggtgatgcacagcgtgctgctgggcggggaggagcagcgctacctgctggaggccgctgaggagctgggcctgacagatggcagcctggtgttcctgccctttgacaccatccactacgccctgagccctggccctgaggccctggccgccctggccaacagcagccagctgcggcgggcccatgatgctgtgctgaccctgaccaggcactgccccagcgagggctctgtgctggacagcctgcggcgggcccaggagcggcgggagctgcccagcgacctgaacctgcagcaggtgagccccctgtttggcaccatctatgatgctgtgttcctgctggcccggggcgtggccgaggcccgggctgctgctgggggccgctgggtgtctggagctgctgtggcccggcacatcagagatgcccaggtgcccggcttctgtggggacctgggcggagatgaggagcccccatttgtgctgctggacacagatgctgctggggaccggctgtttgccacctacatgctggaccctgcccggggcagcttcctgtctgctggcaccaggatgcacttcccccggggcggcagcgcccctggccctgaccccagctgctggtttgaccccaacaacatctgtggcggcggcctggagcccggcctggtgttcctgggcttcctgctggtggtgggcatgggcctggccggggccttcctggcccactacgtgcgccaccggctgctgcacatgcagatggtgtctggccccaacaagatcatcctgactgtggatgacatcaccttcctgcacccccacggcggcaccagcaggaaggtggcccagggcagccgcagcagcctgggcgcccgctccatgtctgacatccgcagcggccccagccagcacctggacagccccaacatcggcgtgtatgaaggagacagagtgtggctgaagaagtttcctggggaccagcacatcgccatccggcctgccaccaagacagccttcagcaagctgcaggagctgcggcatgaaaatgtggccctgtacctgggcctcttcctggcccggggagctgagggccctgctgccctgtgggagggcaacctggccgtggtgtctgagcactgcacccggggcagcctgcaggacctgctggcccagcgggagatcaagctggactggatgttcaagagcagcctgctgctggacctgatcaagggcatccgctacctgcaccacagaggagtggcccacggccgcctgaagagcaggaactgcatcgtggatggccgctttgtgctgaagatcacagaccacggccacggccgcctgctggaggcccagaaggtgctgcctgagccccccagggctgaggaccagctgtggacagcccctgagctgctgcgggaccctgccctggagcggcggggcaccctggccggagatgtgttcagcctggccatcatcatgcaggaggtggtgtgccgcagcgccccctatgccatgctggagctgaccccagaggaggtggtgcagagggtgcgcagccccccacccctgtgccggcccctggtgtccatggaccaggcccctgtggagtgcatcctgctgatgaagcagtgctgggccgagcagcctgagctgcggcccagcatggaccacacctttgacctcttcaagaacatcaacaagggcaggaagaccaacatcatcgacagcatgctgaggatgctggagcagtacagcagcaacctggaggacctgatccgggagaggacagaggagctggagctggagaagcagaagacagaccggctgctgacccagatgctgccccccagcgtggccgaggccctgaagacaggcacccctgtggagcctgagtactttgagcaggtgaccctgtacttcagtgacatcgtgggcttcaccaccatcagcgccatgtctgagcccatcgaggtggtggacctgctgaatgacctgtacaccctgtttgatgccatcatcggcagccatgatgtgtacaaggtggagaccatcggagatgcctacatggtggccagcggcctgccccagagaaatggccagagacatgctgctgagatcgccaacatgagcctggacatcctgtctgctgtgggcaccttcaggatgaggcacatgcctgaggtgcctgtgcgcatcagaattggcctgcacagcggcccctgtgtggccggcgtggtgggcctgaccatgccccgctactgcctgtttggagacacagtgaacacagccagcaggatggagagcacaggcctgccctaccgcatccacgtgaacctgagcacagtgggcatcctgcgggccctggacagcggctaccaggtggagctgcggggccgcacagagctgaagggcaaaggagctgaggacaccttctggctggtgggcagaagaggcttcaacaagcccatccccaagcccccagacctgcagcccggcagcagcaaccacggcatcagcctgcaggagatccccccagagaggaggaggaagctggagaaggcccggcccggccagttctcctag

SEQ ID NO: 154790 - DNA, 594 bp, Artificial Sequence
  Description of Artificial Sequence: Synthetic coding sequence
atgaggaagtaccgcagccactggagccagggcgaccgggagggctaccagaggaggagcaactactatgagggcccccacaccagccacagcagccctgctgacaggacccgggaggaggtggtgacccccaccctgcctgagcacacagccaccaggagccagatggccaccagcctggacttcaagacctacgtggaccaggcctgcagagctgctgaggagtttgtgaacatctactatgagaccatggacaagagaagaagagccctgacccggctgtacctggacaaggccaccctcatctggaatggaaatgctgtgtctggcctggatgccctgaacaacttctttgacaccctgcccagcagcgagttccaggtgaacatgctggactgccagcctgtgcatgagcaggccacccagagccagaccaccgtgctggtggtgaccagcggcaccgtgaagtttgatggcaacaagcagcacttcttcaaccagaacttcctgctgacagcccagagcacccccaacaacacagtgtggaagatcgccagtgactgcttccgcttccaggactggagcagcagctag

SEQ ID NO: 154791 - DNA, 606 bp, Artificial Sequence
  Description of Artificial Sequence: Synthetic coding sequence
atgggaaatgtgatggagggcaagtctgtggaggagctgagcagcacagagtgccaccagtggtacaagaagttcatgacagagtgccccagcggccagctgaccctgtatgagttccggcagttcttcggcctgaagaacctgagccccagcgccagccagtatgtggagcagatgtttgagacctttgacttcaacaaggatggctacatcgacttcatggagtatgtggccgccctgagcctggtgctgaagggcaaggtggagcagaagctgcgctggtacttcaagctgtatgatgtggatggaaatggctgcatcgacagagatgagctgctgaccatcatccaggccatccgggccatcaacccctgcagcgacaccaccatgacagctgaggagttcacagacaccgtcttcagcaagattgatgtgaatggagatggagagctgagcctggaggagttcattgaaggagtgcagaaggaccagatgctgctggacaccctgaccaggagcctggacctgaccagaattgtgcggcggctgcagaatggagagcaggatgaggagggcgcagatgaggccgctgaggccgccggctag

SEQ ID NO: 154792 - DNA, 606 bp, Artificial Sequence; identical to SEQ ID NO: 154791
  Description of Artificial Sequence: Synthetic coding sequence

SEQ ID NO: 154793 - DNA, 618 bp, Artificial Sequence
  Description of Artificial Sequence: Synthetic coding sequence
atggagggcaagtctgtggaggagctgagcagcacagagtgccaccagtggtacaagaagttcatgacagagtgccccagcggccagctgaccctgtatgagttccggcagttcttcggcctgaagaacctgagccccagcgccagccagtatgtggagcagatgtttgagacctttgacttcaacaaggatggctacatcgacttcatggagtatgtggccgccctgagcctggtgctgaagggcaaggtggagcagaagctgcgctggtacttcaagctgtatgatgtggatggaaatggctgcatcgacagagatgagctgctgaccatcatccagttcccccaccagtaccagaagacagccatccgggccatcaacccctgcagcgacaccaccatgacagctgaggagttcacagacaccgtcttcagcaagattgatgtgaatggagatggagagctgagcctggaggagttcattgaaggagtgcagaaggaccagatgctgctggacaccctgaccaggagcctggacctgaccagaattgtgcggcggctgcagaatggagagcaggatgaggagggcgcagatgaggccgctgaggccgccggctag

SEQ ID NO: 154794 - DNA, 606 bp, Artificial Sequence; identical to SEQ ID NO: 154791
  Description of Artificial Sequence: Synthetic coding sequence

SEQ ID NO: 154795 - DNA, 267 bp, Artificial Sequence
  Description of Artificial Sequence: Synthetic coding sequence
atgggaaatgtgatggagggcaagtctgtggaggagctgagcagcacagagtgccaccagtggtacaagaagttcatgacagagtgccccagcggccagctgaccctgtatgagttccggcagttcttcggcctgaagaacctgagccccagcgccagccagtatgtggagcagatgtttgagacctttgacttcaacaaggatggctacatcgacttcatggagtatgtggccgccctgagcctggtgctgaagggcaaggtgtag

SEQ ID NO: 154796 - DNA, 606 bp, Artificial Sequence; identical to SEQ ID NO: 154791
  Description of Artificial Sequence: Synthetic coding sequence

SEQ ID NO: 154797 - DNA, 1020 bp, Artificial Sequence
  Description of Artificial Sequence: Synthetic coding sequence
atggaccagaacaacagcctgcccccctatgcccagggcctggccagcccccagggcgccatgaccccaggcatccccatcttcagccccatgatgccctacggcaccggcctgaccccccagcccatccagaacaccaacagcctgagcatcctggaggagcagcagaggcagcagcagcagcagcagcagcagcagcagcagcagcagcagcagcagcagcagcagcagcagcagcagcagcagcagcagcagcagcagcagcagcagcagcagcagcagcaggccgtggccgctgctgctgtgcagcagagcaccagccagcaggccacccagggcaccagcggccaggccccccagctgttccacagccagaccctgaccacagcccccctgcccggcaccacccccctgtaccccagccccatgacccccatgacccccatcaccccagccaccccagccagcgagagcagcggcatcgtgccccagctgcagaacatcgtgtccacagtgaacctgggctgcaagctggacctgaagaccatcgccctgcgggccagaaatgctgagtacaaccccaagagatttgctgctgtgatcatgaggatccgggagcccaggaccacagccctgatcttcagcagcggcaagatggtgtgcaccggggccaagtctgaggagcagagccggctggccgccaggaaatatgcccgggtggtgcagaagctgggcttccctgccaagttcctggacttcaagatccagaacatggtgggcagctgtgatgtgaagttccccatccggctggagggcctggtgctgacccaccagcagttcagcagctatgagcctgagctgtttcctggcctcatctacaggatgatcaagccccgcatcgtgctgctgatctttgtgtctgggaaggtggtgctgactggagccaaggtgcgggcagagatctatgaggcctttgagaacatctaccccatcctgaagggcttcaggaagaccacctag

SEQ ID NO: 154798 - DNA, 519 bp, Artificial Sequence
  Description of Artificial Sequence: Synthetic coding sequence
atgggccaggagttctcctgggaggaggccgaggccgccggggagattgatgtggccgagctgcaggagtggtacaagaagtttgtgatggagtgccccagcggcaccctcttcatgcatgagttcaagcgcttcttcaaggtgacagatgatgaggaggccagccagtatgtggagggcatgttccgggcctttgacaagaatggagacaacaccatcgacttcctggagtatgtggccgccctgaacctggtgctgcggggcaccctggagcacaagctgaagtggaccttcaagatctatgacaaggatggaaatggctgcatcgaccggctggagctgctgaacatcgtggagtgcagaagagagctgcagacagagcagggccagctgctgaccccagaggaggtggtggaccgcatcttcctgctggtggatgaaaatggagatggccagctgagcctgaatgaatttgtggagggcgcccggcgggacaacctgctgatgcccaccctgtag

SEQ ID NO: 154799 - DNA, 630 bp, Artificial Sequence
  Description of Artificial Sequence: Synthetic coding sequence
atgggaaatggcaagagcattgctggggaccagaaggctgtgcccacccaggagacccacgtgtggtaccgcaccttcatgatggagtaccccagcggcctgcagaccctgcacgagttcaagaccctgctgggcctgcagggcctgaaccagaaggccaacaagcacatcgaccaggtgtacaacacctttgacaccaacaaggatggctttgtggacttcctggagttcatcgctgctgtgaacctgatcatgcaggagaagatggagcagaagctgaagtggtacttcaagctgtatgatgctgatggaaatggcagcattgacaagaatgagctgctggacatgttcatggctgtgcaggccctgaatggccagcagaccctgagccctgaggagttcatcaacctggtgttccacaagattgacatcaacaatgatggagagctgaccctggaggagttcatcaatggcatggccaaggaccaggacctgctggagatcgtgtacaagagctttgacttcagcaatgtgctgcgggtcatctgcaatggcaagcagcctgacatggagacagacagcagcaagagcccagacaaggccggcctgggcaaggtgaagatgaagtag

SEQ ID NO: 154800 - DNA, 591 bp, Artificial Sequence
  Description of Artificial Sequence: Synthetic coding sequence
atgggaaatggcaagagcattgctggggaccagaaggctgtgcccacccaggagacccacgtgtggtaccgcaccttcatgatggagtaccccagcggcctgcagaccctgcacgagttcaagaccctgctgggcctgcagggcctgaaccagaaggccaacaagcacatcgaccaggtgtacaacacctttgacaccaacaaggatggctttgtggacttcctggagttcatcgctgctgtgaacctgatcatgcaggagaagatggagcagaagctgaagtggtacttcaagctgtatgatgctgatggaaatggcagcattgacaagaatgagctgctggacatgttcatggctgtgcaggccctgaatggccagcagaccctgagccctgaggagttcatcaacctggtgttccacaagattgacatcaacaatgatggaaatggagccaccctgtactggatcaccttccccaccaagggcatcgacttccgccgcatctaccagtggcacggcaagaggagcggcagccctggggactgcctgcaggagctgcggctgctgcagtgtgccgagagcaacctgtag

SEQ ID NO: 154801 - DNA, 348 bp, Artificial Sequence
  Description of Artificial Sequence: Synthetic coding sequence
atgaatgccttcctgctgagcgccctgtgcctgctgggcgcctgggccgccctggccggcggcgtgacagtgcaggacggcaacttctccttcagcctggagagcgtgaagaagctgaaggacctgcaggagccccaggagccccgggtgggcaagctgaggaactttgcccccatccctggagagcctgtggtgcccatcctgtgcagcaaccccaacttccctgaggagctgaagcccctgtgcaaggagcccaatgcccaggagatcctgcagaggctggaggagattgctgaagatcctggcacctgtgagatctgtgcctatgctgcctgcaccggctgctag

SEQ ID NO: 154802 - DNA, 339 bp, Artificial Sequence
  Description of Artificial Sequence: Synthetic coding sequence
atgggctgcagagctgccagcggcctgctgcccggggtggccgtggtgctgctgctgctgctgcagagcacccagagcgtgtacatccagtaccagggcttccgggtgcagctggagagcatgaagaagctgagtgacctggaggcccagtgggcccccagcccccggctgcaggcccagagcctgctgcctgctgtgtgccaccacccagccctgccccaggacctgcagcctgtgtgtgccagccaggaggccagcagcatcttcaagaccctgcggaccatcgccaatgatgactgtgagctgtgtgtgaatgtggcctgcaccggctgcctgtag

SEQ ID NO: 154803 - DNA, 594 bp, Artificial Sequence
  Description of Artificial Sequence: Synthetic coding sequence
atgagcggccccaggcctgtggtgctgagcggccccagcggggccggcaagagcaccctgctgaagaggctgctgcaggagcacagcggcatcttcggcttctctgtgagccacaccaccaggaaccccaggcctggagaggagaatggcaaggactactactttgtgacccgggaggtgatgcagagggacattgctgctggggacttcattgaacatgctgagttcagcggcaacctgtatggcaccagcaaggtggccgtgcaggccgtgcaggccatgaaccgcatctgtgtgctggatgtggacctgcagggcgtgaggaacatcaaggccacagacctgcggcccatctacatctctgtgcagccccccagcctgcacgtgctggagcagaggctgcggcagaggaacacagaaacagaggagagcctggtgaagaggctggccgccgcccaggccgacatggagagcagcaaggagcccggcctgtttgatgtggtgatcatcaatgacagcctggaccaggcctatgcagagctgaaggaggccctgtctgaggagatcaagaaggcccagaggactggagcctag

SEQ ID NO: 154804 - DNA, 594 bp, Artificial Sequence; identical to SEQ ID NO: 154803
  Description of Artificial Sequence: Synthetic coding sequence

SEQ ID NO: 154805 - DNA, 594 bp, Artificial Sequence; identical to SEQ ID NO: 154803
  Description of Artificial Sequence: Synthetic coding sequence

SEQ ID NO: 154806 - DNA, 600 bp, Artificial Sequence
  Description of Artificial Sequence: Synthetic coding sequence
atgagcggccccaggcctgtggtgctgagcggccccagcggggccggcaagagcaccctgctgaagaggctgctgcaggagcacagcggcatcttcggcttctctgtgtcccgggagagccgggccctggtggagggctaccacgaggagcctgaggcccggcggggggagcggcagcgggaggtgatgcagagggacattgctgctggggacttcattgaacatgctgagttcagcggcaacctgtatggcaccagcaaggtggccgtgcaggccgtgcaggccatgaaccgcatctgtgtgctggatgtggacctgcagggcgtgaggaacatcaaggccacagacctgcggcccatctacatctctgtgcagccccccagcctgcacgtgctggagcagaggctgcggcagaggaacacagaaacagaggagagcctggtgaagaggctggccgccgcccaggccgacatggagagcagcaaggagcccggcctgtttgatgtggtgatcatcaatgacagcctggaccaggcctatgcagagctgaaggaggccctgtctgaggagatcaagaaggcccagaggactggagcctag

SEQ ID NO: 154807 - DNA, 729 bp, Artificial Sequence
  Description of Artificial Sequence: Synthetic coding sequence
atgagcggccccaggcctgtggtgctgagcggccccagcggggccggcaagagcaccctgctgaagaggctgctgcaggagcacagcggcatcttcggcttctctgtgagccacaccaccaggaaccccaggcctggagaggagaatggcaaggactactactttgtgacccgggaggtgatgcagagggacattgctgctggggacttcattgaacatgctgagttcagcggcaacctgtatggcaccagcaaggtggccgtgcaggccgtgcaggccatgaaccgcatctgtgtgctggatgtggacctgcagggcgtgaggaacatcaaggccacagacctgcggcccatctacatctctgtgcagccccccagcctgcacgtgctgcggctgcggcagaggaacacagaaacagaggagagcctggtgaagaggctggccgccgcccaggccgacatggagagcagcaaggagcccggcctgtttgatgtggtgatcatcaatgacagcctggaccaggcctatgcagagctgaaggaggccctgtctgaggtgggccccagcctgtgcctgcccggccagggcccccggggcggcctgggcgcccggcccctgctgtccatgaggcccctgaggaagagcaggaagctgaagggccctgcccctgaggcctgctgcctcttcagcgccccccgggcccacacaggccctggccagcagcactag

SEQ ID NO: 154808 - DNA, 657 bp, Artificial Sequence
  Description of Artificial Sequence: Synthetic coding sequence
atgctgcggcggcccctggccggcctggccgccgccgccctgggccgggcccccccagatggcatgagcggccccaggcctgtggtgctgagcggccccagcggggccggcaagagcaccctgctgaagaggctgctgcaggagcacagcggcatcttcggcttctctgtgagccacaccaccaggaaccccaggcctggagaagaaaatggcaaggactactactttgtgacccgggaggtgatgcagagggacattgctgctggggacttcatcgagcacgccgagttcagcggcaacctgtatggcaccagcaaggtggccgtgcaggccgtgcaggccatgaaccgcatctgtgtgctggatgtggacctgcagggcgtgaggaacatcaaggccacagacctgcggcccatctacatctctgtgcagccccccagcctgcacgtgctggagcagaggctgcggcagaggaacacagaaacagaggagagcctggtgaagaggctggccgccgcccaggccgacatggagagcagccctgctggcctggagagctgccccacagctgctgtgaggacagctgctggccagagccctgcctgcctgatgtggagcagcctgaccacagcctggacccggcccacccagagctag

SEQ ID NO: 154809 - DNA, 594 bp, Artificial Sequence; identical to SEQ ID NO: 154803
  Description of Artificial Sequence: Synthetic coding sequence

SEQ ID NO: 154810 - DNA, 726 bp, Artificial Sequence
  Description of Artificial Sequence: Synthetic coding sequence
atgctgcggcggcccctggccggcctggccgccgccgccctgggccgggcccccccagatggcatgagcggccccaggcctgtggtgctgagcggccccagcggggccggcaagagcaccctgctgaagaggctgctgcaggagcacagcggcatcttcggcttctctgtgagccacaccaccaggaaccccaggcctggagaagaaaatggcaaggactactactttgtgacccgggaggtgatgcagagggacattgctgctggggacttcatcgagcacgccgagttcagcggcaacctgtatggcaccagcaaggtggccgtgcaggccgtgcaggccatgaaccgcatctgtgtgctggatgtggacctgcagggcgtgaggaacatcaaggccacagacctgcggcccatctacatctctgtgcagccccccagcctgcacgtgctggagcagaggctgcggcagaggaacacagaaacagaggagagcctggtgaagaggctggccgccgcccaggccgacatggagagcaggaaccaggagagcagcaaggaccggcggctgcggctggccgtgtgcagccgccaccctggccccatccaggaccagggcagcagcattgagcccccaccctggcaggccatccggcagctgtgtgccctgggccagcacgtggagtggaggcgctgctgcccctgtggctggaacatcctgggctag

SEQ ID NO: 154811 - DNA, 594 bp, Artificial Sequence; identical to SEQ ID NO: 154803
  Description of Artificial Sequence: Synthetic coding sequence

SEQ ID NO: 154812 - DNA, 657 bp, Artificial Sequence
  Description of Artificial Sequence: Synthetic coding sequence
atgctgcggcggcccctggccggcctggccgccgccgccctgggccgggcccccccagatggcatgagcggccccaggcctgtggtgctgagcggccccagcggggccggcaagagcaccctgctgaagaggctgctgcaggagcacagcggcatcttcggcttctctgtgagccacaccaccaggaaccccaggcctggagaagaaaatggcaaggactactactttgtgacccgggaggtgatgcagagggacattgctgctggggacttcatcgagcacgccgagttcagcggcaacctgtatggcaccagcaaggtggccgtgcaggccgtgcaggccatgaaccgcatctgtgtgctggatgtggacctgcagggcgtgaggaacatcaaggccacagacctgcggcccatctacatctctgtgcagccccccagcctgcacgtgctggagcagaggctgcggcagaggaacacagaaacagaggagagcctggtgaagaggctggccgccgcccaggccgacatggagagcagcaaggagcccggcctgtttgatgtggtgatcatcaatgacagcctggaccaggcctatgcagagctgaaggaggccctgtctgaggagatcaagaaggcccagaggactggagcctag

SEQ ID NO: 154813 - DNA, 762 bp, Artificial Sequence
  Description of Artificial Sequence: Synthetic coding sequence
atggccggcagccagaaggaggagatcatgccaccccagcagggcgtgcccttccaggagagcggctgctggggctccatgggcgcccagagccgggagaggagcggccgggaccacagcggcacctggatctgtgccggcggcagccaggagaccttccacctgggcgcccctgtggagaccacctgcctggccggcatgagcggccccaggcctgtggtgctgagcggccccagcggggccggcaagagcaccctgctgaagaggctgctgcaggagcacagcggcatcttcggcttctctgtgagccacaccaccaggaaccccaggcctggagaggagaatggcaaggactactactttgtgacccgggaggtgatgcagagggacattgctgctggggacttcattgaacatgctgagttcagcggcaacctgtatggcaccagcaaggtggccgtgcaggccgtgcaggccatgaaccgcatctgtgtgctggatgtggacctgcagggcgtgaggaacatcaaggccacagacctgcggcccatctacatctctgtgcagccccccagcctgcacgtgctggagcagaggctgcggcagaggaacacagaaacagaggagagcctggtgaagaggctggccgccgcccaggccgacatggagagcagcaaggagcccggcctgtttgatgtggtgatcatcaatgacagcctggaccaggcctatgcagagctgaaggaggccctgtctgagtag

SEQ ID NO: 154814 - DNA, 516 bp, Artificial Sequence
  Description of Artificial Sequence: Synthetic coding sequence
atgagcggccccaggcctgtggtgctgagcggccccagcggggccggcaagagcaccctgctgaagaggctgctgcaggagcacagcggcatcttcggcttctctgtgtcccgggagagcaacaccaccaggaaccccaggcctggagaagaaaatggcaaggactactactttgtgacccgggaggtgatgcagagggacattgctgctggggacttcatcgagcacgccgagttcagcggcaacctgtatggcaccagcaaggtggccgtgcaggccgtgcaggccatgaaccgcatctgtgtgctggatgtggacctgcagggcgtgaggaacatcaaggccacagacctgcggcccatctacatctctgtgcagccccccagcctgcacgtgctggagcagaggctgcggcagaggaacacagaaacagaggagagcctggtgaagaggctggccgccgcccaggccgacatggagagcgagatcaagaaggcccagaggactggagcctag

SEQ ID NO: 154815 - DNA, 819 bp, Artificial Sequence
  Description of Artificial Sequence: Synthetic coding sequence
atggccggcagccagaaggaggagatcatgccaccccagcagggcgtgcccttccaggagagcggctgctggggctccatgggcgcccagagccgggagaggagcggccgggaccacagcggcacctggatctgtgccggcggcagccaggagaccttccacctgggcgcccctgtggagaccacctgcctggccgccagcctgctgacccccaggcatgtgggcccccaggcctgtggggctgagcgggccttcggctcctgggaggagcaccctgctgaggaggccgcccctggggcccagaggcacctgtggctgcagagggtgccctaccacgaggagcctgaggcccggcggggggagcggcagcgggaggtgatgcagagggacattgctgctggggacttcattgaacatgctgagttcagcggcaacctgtatggcaccagcaaggtggccgtgcaggccgtgcaggccatgaaccgcatctgtgtgctggatgtggacctgcagggcgtgaggaacatcaaggccacagacctgcggcccatctacatctctgtgcagccccccagcctgcacgtgctggagcagaggctgcggcagaggaacacagaaacagaggagagcctggtgaagaggctggccgccgcccaggccgacatggagagcaggaaccaggagagcagcaaggaccggcggctgcggctggccgtgtgcagccgccaccctggccccatccaggaccagggcagcagcattgagcccccaccctggcaggccatccggcagctgtgtgccctgggccagcacgtgtag

SEQ ID NO: 154816 - DNA, 654 bp, Artificial Sequence
  Description of Artificial Sequence: Synthetic coding sequence
atgctgcggcggcccctggccggcctggccgccgccgccctgggccgggcccccccagatggcatgagcggccccaggcctgtggtgctgagcggccccagcggggccggcaagagcaccctgctgaagaggctgctgcaggagcacagcggcatcttcggcttctctgtgagccacaccaccaggaaccccaggcctggagaagaaaatggcaaggactactactttgtgacccgggaggtgatgcagagggacattgctgctggggacttcatcgagcacgccgagttcagcggcaacctgtatggcaccagcaaggtggccgtgcaggccgtgcaggccatgaaccgcatctgtgtgctggatgtggacctgcagggcgtgaggaacatcaaggccacagacctgcggcccatctacatctctgtgcagccccccagcctgcacgtgctggagcagaggctgcggcagaggaacacagaaacagaggagagcctggtgaagaggctggccgccgcccaggccgacatggagagcagcaaggagcccggcctgtttgatgtggtgatcatcaatgacagcctggaccaggcctatgcagagctgaaggaggccctgtctgaggagatcaagaaggcccagaggactggatag

SEQ ID NO: 154817 - DNA, 915 bp, Artificial Sequence
  Description of Artificial Sequence: Synthetic coding sequence
atgaacagagccttcagcaggaagaaggacaagacctggatgcacaccccagaggccctgagcaagcacttcatcccctacaatgccaagttcctgggcagcacagaggtggagcagcccaagggcacagaggtggtgagagatgctgtgaggaagctgaagtttgcccggcacatcaagaagtctgagggccagaagatccccaaggtggagctgcagatcagcatctatggagtgaagatcctggagcccaagaccaaggaggtgcagcacaactgccagctgcaccgcatctccttctgtgctgatgacaagacagacaagaggatcttcaccttcatctgcaaggacagcgagagcaacaagcacctgtgctacgtgtttgacagcgagaagtgtgccgaggagatcaccctgaccatcggccaggcctttgacctggcctacaggaagttcctggagagcggcggcaaggatgtggagaccaggaagcagattgctggcctgcagaagaggatccaggacctggagacagagaacatggagctgaagaacaaggtgcaggacctggagaaccagctgcgcatcacccaggtgtctgcccccccagctggctccatgacccccaagagccccagcacagacatctttgacatgatccccttcagccccatcagccaccagagctccatgcccaccagaaatggcacccagcccccacctgtgcccagccgcagcacagagatcaagagggacctgtttggagctgagccctttgaccccttcaactgtggggctgctgacttccccccagacatccagagcaagctggatgagatgcaggagggcttcaagatgggcctgaccctggagggcaccgtcttctgcctggaccccctggacagccgctgctag

SEQ ID NO: 154818 - DNA, 915 bp, Artificial Sequence; identical to SEQ ID NO: 154817
  Description of Artificial Sequence: Synthetic coding sequence

SEQ ID NO: 154819 - DNA, 915 bp, Artificial Sequence; identical to SEQ ID NO: 154817
  Description of Artificial Sequence: Synthetic coding sequence

SEQ ID NO: 154820 - DNA, 504 bp, Artificial Sequence
  Description of Artificial Sequence: Synthetic coding sequence
atgaacagagccttcagcaggaagaaggacaagacctggatgcacaccccagaggccctgagcaagcacttcatcccctacaatgccaagttcctgggcagcacagaggtggagcagcccaagggcacagaggtggtgagagatgctgtgaggaagctgaagtttgcccggcacatcaagaagtctgagggccagaagatccccaaggtggagctgcagatcagcatctatggagtgaagatcctggagcccaagaccaaggaggtgcagcacaactgccagctgcaccgcatctccttctgtgctgatgacaagacagacaagaggatcttcaccttcatctgcaaggacagcgagagcaacaagcacctgtgctacgtgtttgacagcgagaagtgtgtgtccatcccagatgtggtgggctggtttgtgctcttctacaagccaggcatcgtgctgctgctggccctggccaagtacctgaagatgaacaacttcctgtag

SEQ ID NO: 154821 - DNA, 915 bp, Artificial Sequence; identical to SEQ ID NO: 154817
  Description of Artificial Sequence: Synthetic coding sequence

SEQ ID NO: 154822 - DNA, 207 bp, Artificial Sequence
  Description of Artificial Sequence: Synthetic coding sequence
atgaacagagccttcagcaggaagaaggacaagacctggatgcacaccccagaggccctgagcaagcacttcatcccctacaatgccaagttcctgggcagcacagaggtggagcagcccaagggcacagaggtggtgagagatgctgtgaggaagctgaagtttgcccggcacatcaagaagtctgagggccagaagatcccctag

SEQ ID NO: 154823 - DNA, 504 bp, Artificial Sequence; identical to SEQ ID NO: 154820
  Description of Artificial Sequence: Synthetic coding sequence

SEQ ID NO: 154824 - DNA, 585 bp, Artificial Sequence
  Description of Artificial Sequence: Synthetic coding sequence
atgacagagaacagcaccagcgccccagctgccaagcccaagagggccaaggccagcaagaagagcacagaccaccccaagtacagcgacatgattgtggccgccatccaggccgagaagaacagagctggcagcagccggcagagcatccagaagtacatcaagagccactacaaggtgggggagaatgctgacagccagatcaagctgagcatcaagaggctggtgaccaccggggtgctgaagcagaccaagggcgtgggcgccagcggcagcttccggctggccaagagtgatgagcccaagaagtctgtggccttcaagaagaccaagaaggagatcaagaaggtggccacccccaagaaggccagcaagcccaagaaggccgccagcaaggcccccaccaagaagcccaaggccacccctgtgaagaaggccaagaagaagctggccgccacccccaagaaggccaagaagcccaagacagtgaaggccaagcctgtgaaggccagcaagcccaagaaggccaagcctgtgaagcccaaggccaagagcagcgccaagagagctgggaagaagaagtag

SEQ ID NO: 154825 - DNA, 534 bp, Artificial Sequence
  Description of Artificial Sequence: Synthetic coding sequence
atgacagagaagagcacagaccaccccaagtacagcgacatgattgtggccgccatccaggccgagaagaacagagctggcagcagccggcagagcatccagaagtacatcaagagccactacaaggtgggagaaaatgctgacagccagatcaagctgagcatcaagaggctggtgaccactggagtgctgaagcagaccaagggcgtgggcgccagcggcagcttccggctggccaagagtgatgagcccaagaagtctgtggccttcaagaagaccaagaaggagatcaagaaggtggccacccccaagaaggccagcaagcccaagaaggccgccagcaaggcccccaccaagaagcccaaggccacccctgtgaagaaggccaagaagaagctggccgccacccccaagaaggccaagaagcccaagacagtgaaggccaagcctgtgaaggccagcaagcccaagaaggccaagcctgtgaagcccaaggccaagagcagcgccaagagagctgggaagaagaagtag

SEQ ID NO: 154826 - DNA, 411 bp, Artificial Sequence
  Description of Artificial Sequence: Synthetic coding sequence
atggcccggaccaagcagacagccaggaagagcactggaggcaaggcccccaggaagcagctggccaccaaggccgccaggaagagcgcccccagcactggaggagtgaagaagccccaccgctaccggcccggcaccgtggccctgcgggagatccgccgctaccagaagagcacagagctgctgatcaggaagctgcccttccagaggctggtgcgggagatcgcccaggacttcaagacagacctgcgcttccagagcgctgccatcggggccctgcaggaggccagcgaggcctacctggtgggcctgtttgaggacaccaacctgtgtgccatccacgccaagagggtgaccatcatgcccaaggacatccagctggcccggcgcatccggggggagcgggcctag

SEQ ID NO: 154827 - DNA, 372 bp, Artificial Sequence
  Description of Artificial Sequence: Synthetic coding sequence
atggcccggaccaagcagacagccaggaagagcactggaggcaaggcccccaggaagcagctggccaccaaggccgccaggaagagcgcccccagcactggaggagtgaagaagccccaccgctaccggcccggcaccgtggccctgcgggagatccgccgctaccagaagagcacagagctgctgatcaggaagctgcccttccagaggctggtgcgggagatcgcccaggacttcaagacagacctgcgcttccagagcgctgccatcggggccctgcaggtgaagtggtgggtgggccgcctgcgggtgtgcatccctgtggtgtaccaggagcagttccagatcgtggcctgtgcctacatcatctag

SEQ ID NO: 154828 - DNA, 411 bp, Artificial Sequence; identical to SEQ ID NO: 154826
  Description of Artificial Sequence: Synthetic coding sequence

SEQ ID NO: 154829 - DNA, 411 bp, Artificial Sequence; identical to SEQ ID NO: 154826
  Description of Artificial Sequence: Synthetic coding sequence

SEQ ID NO: 154830 - DNA, 411 bp, Artificial Sequence; identical to SEQ ID NO: 154826
  Description of Artificial Sequence: Synthetic coding sequence

SEQ ID NO: 154831 - DNA, 1047 bp, Artificial Sequence
  Description of Artificial Sequence: Synthetic coding sequence
atgccagatgagctgacagagcccggccgggccaccccagcccgggccagcagcttcctgattgagaacctgctggccgctgaggccaagggggccggccgggccacccagggagatggcagcagagaagatgaggaggaggatgatgatgatcctgaagatgaagatgctgagcaggccaggagaagaaggctgcagaggcggcggcagctgctggccggcactggacctggaggagaggcccgggcccgggccctgctgggccctggggccctgggcctgggcccccggcccccacctggccctggccccccatttgccctgggctgcggcggggccgcccgctggtacccccgggcccatggaggctacggcggcggcctgagcccagacaccagtgaccgggacagccctgagaccggggaggagatgggccgggcagagggcgcctggccccggggccctggccctggagctgtgcagcgggaggccgctgagctggccgcccggggccctgctgctggaacagaggaggccagcgagctggccgaggtgcctgctgctgctggggagacccggggcggcgtgggcgtgggcggcggcaggaagaagaagaccaggacagtgttcagccgcagccaggtgttccagctggagagcacctttgacctgaagcgctacctgagcagcgctgagcgggccggcctggccgccagcctgcagctgacagagacccaggtgaagatctggttccagaacagaagaaacaagtggaagaggcagctggccgctgagctggaggccgccagcctgagccccccaggggcccagaggctggtgcgggtgcctgtgctgtaccacgagagccccccagctgctgctgctgctggccccccagccaccctgcccttccccctggccccagctgccccagcccctcctccacccctgctgggcttcagcggggccctggcctaccccctggccgccttccctgctgctgcctctgtgcccttcctgcgggcccagatgcctggcctggtgtag

SEQ ID NO: 154832 - DNA, 822 bp, Artificial Sequence
  Description of Artificial Sequence: Synthetic coding sequence
atgggcagcaaagaagatgctgggaagggctgcccagctgctgggggcgtgtcctccttcaccatccagagcatcctgggcggcggccccagcgaggccccccgggagcctgtgggctggccagccaggaagaggagcctgtctgtgtcctctgaggaggaggagccagatgatggctggaaggccccagcctgcttctgcccagaccagcacggccccaaggagcagggccccaagcaccacccccccatccccttcccctgcctgggcacccccaagggcagcggcggcagcggccctgggggcctggagaggacccccttcctgagccccagccacagcgacttcaaggaggagaaggagcggctgctgcctgctggcagccccagccctggcagcgagcggcccagagatggcggcgctgagcggcaggccggggccgccaagaagaagaccaggacagtgttcagccgcagccaggtgtaccagctggagagcacctttgacatgaagcgctacctgagcagcagcgagcgggcctgcctggccagcagcctgcagctgacagagacccaggtgaagacctggttccagaacagaagaaacaagtggaagaggcagctgtctgctgagctggaggccgccaacatggcccacgccagcgcccagaccctggtgtccatgcccctggtgttccgggacagcagcctgctgcgggtgcctgtgcccaggagcctggccttccctgcccccctgtactacccaggcagcaacctgagcgccctgcccctgtacaacctgtacaacaagctggactactag

SEQ ID NO: 154833 - DNA, 1074 bp, Artificial Sequence
  Description of Artificial Sequence: Synthetic coding sequence
atgcctgagcccggcccagatgctgctggaacagccagcgcccagccccagcccccacctcctcctcctccagcccccaaggagagccccttcagcatcaagaacctgctgaatggagaccaccaccggcccccacccaagccccagcccccacccaggaccctgtttgccccagccagcgctgctgctgctgctgctgctgctgctgctgctgctgccaagggggccctggagggcgctgctggctttgccctgagccaggtgggggacctggccttccccaggtttgagatcccagcccagagatttgccctgcctgcccactacctggagaggagccctgcctggtggtacccctacaccctgaccccagctgggggccacctgcccaggcctgaggccagcgagaaggccctgctgcgggacagcagccctgccagcggcacagaccgggacagccctgagcccctgctgaaggctgaccctgaccacaaggagctggacagcaagagcccagatgagatcatcctggaggagagtgacagcgaggagagcaagaaggagggggaggccgcccctggagctgctggggcctctgtgggcgctgctgctgccaccccaggagctgaggactggaagaagggagctgagagccctgagaagaagccagcctgcaggaagaagaagaccaggacagtgttcagccgcagccaggtgttccagctggagagcacctttgacatgaagcgctacctgagcagcagcgagcgggccggcctggccgccagcctgcacctgacagagacccaggtgaagatctggttccagaacagaagaaacaagtggaagaggcagctggccgctgagctggaggccgccaacctgagccacgccgccgcccagagaattgtgcgggtgcccatcctgtaccacgagaacagcgctgctgagggcgctgctgctgctgctgctggggcccctgtgcctgtgtcccagcccctgctgaccttcccccaccctgtgtactacagccaccctgtggtgtcctctgtgcccctgctgcggcctgtgtag

SEQ ID NO: 154834 - DNA, 3405 bp, Artificial Sequence
  Description of Artificial Sequence: Synthetic coding sequence
atggagagcacccccagcttcctgaagggcacccccacctgggagaagacagccccagaaaatggaattgtgcggcaggagcccggcagccccccaagagatggcctgcaccacggccccctgtgcctgggggagcccgcccccttctggaggggcgtgctgagcaccccagacagctggctgcccccaggcttcccccagggccccaaggacatgctgcccctggtggagggggagggcccccagaatggagagaggaaggtgaactggctgggcagcaaggagggcctgcgctggaaggaggccatgctgacccaccccctggccttctgtggccctgcctgccccccaagatgtggccccctgatgcctgagcacagcggcggccacctgaagagtgaccctgtggccttccggccctggcactgccccttcctgctggagaccaagatcctggagcgggcccccttctgggtgcccacctgcctgcccccctacctggtgtctggcctgcccccagagcacccctgtgactggcccctgaccccccacccctgggtgtacagcggcggccagcccaaggtgcccagcgccttcagcctgggcagcaagggcttctactacaaggaccccagcatcccccggctggccaaggagcccctggccgctgctgagcccggcctgtttggcctgaacagcggcggccacctgcagagagctggggaggccgagcggcccagcctgcaccagagagatggagagatgggcgccggccggcagcagaacccctgccccctcttcctgggccagcctgacacagtgccctggacctcctggccagcctgccccccaggcctggtgcacaccctgggcaatgtgtgggccggccctggagatggcaacctgggctaccagctgggccccccagccaccccccgctgccccagccctgagccccctgtgacccagaggggctgctgcagcagctacccacccaccaagggcggcggcctgggcccctgtgggaagtgccaggagggcctggagggcggggccagcggggccagcgagcccagcgaggaggtgaacaaggccagcggcccccgggcctgcccccccagccaccacaccaagctgaagaagacctggctgaccaggcacagcgagcagtttgagtgcccccggggctgcccagaggtggaggagaggcctgtggcccggctgcgggccctgaagagagctggcagccctgaggtgcagggcgccatgggcagccctgcccccaagaggcccccagaccccttccctggaacagctgagcagggcgccggcggctggcaggaggtgcgggacaccagcatcggcaacaaggatgtggacagcggccagcatgatgagcagaagggcccccaggacggccaggccagcctgcaggaccccggcctgcaggacatcccctgcctggccctgcctgccaagctggcccagtgccagagctgtgcccaggccgccggggagggcggcggccacgcctgccacagccagcaggtgcggcgcagccccctgggcggggagctgcagcaggaggaggacacagccaccaacagcagcagcgaggagggccctggcagcggccctgacagccggctgagcacaggcctggccaagcacctgctgagcggcctgggggaccggctgtgccgcctgctgcggcgggagcgggaggccctggcctgggcccagcgggagggccagggccctgctgtgacagaggacagccctggcatcccccgctgctgcagccgctgccaccacggcctcttcaacacccactggcgctgcccccgctgcagccaccggctgtgtgtggcctgtggccgggtggccggcaccggccgggcccgggagaaggccggcttccaggagcagagcgcagaagaatgtacccaggaggccggccatgctgcctgcagcctgatgctgacccagtttgtgagcagccaggccctggccgagctgagcacagccatgcaccaggtgtgggtgaagtttgacatccggggccactgcccctgccaggctgatgcccgggtgtgggcccctggagatgctggccagcagaaggagagcacccagaagaccccacccaccccccagcccagctgcaatggagacacccacaggaccaagagcatcaaggaggagaccccagattctgctgagaccccagcagaagatcgggccggccggggccccctgccctgccccagcctgtgtgagctgctggccagcacagctgtgaagctgtgcctgggccacgagcgcatccacatggcctttgcccctgtgaccccagccctgcccagtgatgaccgcatcaccaacatcctggacagcatcatcgcccaggtggtggagaggaagatccaggagaaggccctgggccctggcctgcgggccggccctggcctgaggaagggcctgggcctgcccctgagccctgtgcggccccggctgcccccacctggggccctgctgtggctgcaggagccccagccctgcccccggcggggcttccacctgttccaggagcactggaggcagggccagcctgtgctggtgtctggcatccagaggaccctgcagggcaacctgtggggcacagaggccctgggcgccctgggcggccaggtgcaggccctgagccccctgggccccccccagcccagcagcctgggcagcaccaccttctgggagggcttctcctggccagagctgcggcccaagagtgatgagggctctgtgctgctgctgcaccgggccctgggagatgaggacaccagccgggtggagaacctggccgccagcctgcccctgcctgagtactgtgccctgcacggcaagctgaacctggccagctacctgcccccaggcctggccctgcggcccctggagccccagctgtgggccgcctacggcgtgagcccccaccggggccacctgggcaccaagaacctgtgtgtggaggtggccgacctggtgtccatcctggtgcacgccgacacccccctgcctgcctggcaccgggcccagaaggacttcctgagcggcctggatggagagggcctgtggagccctggcagccaggtgtccacagtgtggcacgtgttccgggcccaggatgcccagaggatccgccgcttcctgcagatggtgcagggcctggtgtccacagtgtctgtgacccagcacttcctgagccctgagaccagcgccctgagcgcccagctgtgccaccagggccccagcctgcccccagactgccacctgctgtatgcccagatggactgggccgtgttccaggccgtgaaggtggccgtgggcaccctgcaggaggccaagtag

SEQ ID NO: 154835 - DNA, 3570 bp, Artificial Sequence
  Description of Artificial Sequence: Synthetic coding sequence
atggagagcacccccagcttcctgaagggcacccccacctgggagaagacagccccagaaaatggaattgtgcggcaggagcccggcagccccccaagagatggcctgcaccacggccccctgtgcctgggggagcccgcccccttctggaggggcgtgctgagcaccccagacagctggctgcccccaggcttcccccagggccccaaggacatgctgcccctggtggagggggagggcccccagaatggagagaggaaggtgaactggctgggcagcaaggagggcctgcgctggaaggaggccatgctgacccaccccctggccttctgtggccctgcctgccccccaagatgtggccccctgatgcctgagcacagcggcggccacctgaagagtgaccctgtggccttccggccctggcactgccccttcctgctggagaccaagatcctggagcgggcccccttctgggtgcccacctgcctgcccccctacctggtgtctggcctgcccccagagcacccctgtgactggcccctgaccccccacccctgggtgtacagcggcggccagcccaaggtgcccagcgccttcagcctgggcagcaagggcttctactacaaggaccccagcatcccccggctggccaaggagcccctggccgctgctgagcccggcctgtttggcctgaacagcggcggccacctgcagagagctggggaggccgagcggcccagcctgcaccagagagatggagagatgggcgccggccggcagcagaacccctgccccctcttcctgggccagcctgacacagtgccctggacctcctggccagcctgccccccaggcctggtgcacaccctgggcaatgtgtgggccggccctggagatggcaacctgggctaccagctgggccccccagccaccccccgctgccccagccctgagccccctgtgacccagaggggctgctgcagcagctacccacccaccaagggcggcggcctgggcccctgtgggaagtgccaggagggcctggagggcggggccagcggggccagcgagcccagcgaggaggtgaacaaggccagcggcccccgggcctgcccccccagccaccacaccaagctgaagaagacctggctgaccaggcacagcgagcagtttgagtgcccccggggctgcccagaggtggaggagaggcctgtggcccggctgcgggccctgaagagagctggcagccctgaggtgcagggcgccatgggcagccctgcccccaagaggcccccagaccccttccctggaacagctgagcagggcgccggcggctggcaggaggtgcgggacaccagcatcggcaacaaggatgtggacagcggccagcatgatgagcagaagggcccccaggacggccaggccagcctgcaggaccccggcctgcaggacatcccctgcctggccctgcctgccaagctggcccagtgccagagctgtgcccaggccgccggggagggcggcggccacgcctgccacagccagcaggtgcggcgcagccccctgggcggggagctgcagcaggaggaggacacagccaccaacagcagcagcgaggagggccctggcagcggccctgacagccggctgagcacaggcctggccaagcacctgctgagcggcctgggggaccggctgtgccgcctgctgcggcgggagcgggaggccctggcctgggcccagcgggagggccagggccctgctgtgacagaggacagccctggcatcccccgctgctgcagccgctgccaccacggcctcttcaacacccactggcgctgcccccgctgcagccaccggctgtgtgtggcctgtggccgggtggccggcaccggccgggcccgggagaaggccggcttccaggagcagagcgcagaagaatgtacccaggaggccggccatgctgcctgcagcctgatgctgacccagtttgtgagcagccaggccctggccgagctgagcacagccatgcaccaggtgtgggtgaagtttgacatccggggccactgcccctgccaggctgatgcccgggtgtgggcccctggagatgctggccagcagaaggagagcacccagaagaccccacccaccccccagcccagctgcaatggagacacccacaggaccaagagcatcaaggaggagaccccagattctgctgagaccccagcagaagatcgggccggccggggccccctgccctgccccagcctgtgtgagctgctggccagcacagctgtgaagctgtgcctgggccacgagcgcatccacatggcctttgcccctgtgaccccagccctgcccagtgatgaccgcatcaccaacatcctggacagcatcatcgcccaggtggtggagaggaagatccaggagaaggccctgggccctggcctgcgggccggccctggcctgaggaagggcctgggcctgcccctgagccctgtgcggccccggctgcccccacctggggccctgctgtggctgcaggagccccagccctgcccccggcggggcttccacctgttccaggagcactggaggcagggccagcctgtgctggtgtctggcatccagaggaccctgcagggcaacctgtggggcacagaggccctgggcgccctgggcggccaggtgcaggccctgagccccctgggccccccccagcccagcagcctgggcagcaccaccttctgggagggcttctcctggccagagctgcggcccaagagtgatgagggctctgtgctgctgctgcaccgggccctgggagatgaggacaccagccgggtggagaacctggccgccagcctgcccctgcctgagtactgtgccctgcacggcaagctgaacctggccagctacctgcccccaggcctggccctgcggcccctggagccccagctgtgggccgcctacggcgtgagcccccaccggggccacctgggcaccaagaacctgtgtgtggaggtggccgacctggtgtccatcctggtgcacgccgacacccccctgcctgcctggcaccgggcccagaaggacttcctgagcggcctggatggagagggcctgtggagccctggcagccaggtgtccacagtgtggcacgtgttccgggcccaggatgcccagaggatccgccgcttcctgcagatggtgtgcccagctggagctggggccctggagcccggggcccctggcagctgctacctggatgctggcctgcggcggcggctgcgggaggagtggggcgtgtcctgctggaccctgctgcaggcccctggagaggccgtgctggtgcctgctggggccccccaccaggtgcagggcctggtgtccacagtgtctgtgacccagcacttcctgagccctgagaccagcgccctgagcgcccagctgtgccaccagggccccagcctgcccccagactgccacctgctgtatgcccagatggactgggccgtgttccaggccgtgaaggtggccgtgggcaccctgcaggaggccaagtag

SEQ ID NO: 154836 - DNA, 1410 bp, Artificial Sequence
  Description of Artificial Sequence: Synthetic coding sequence
atggccagcccccgggagctgacccagaaccccctgaagaagatctggatgccctacagcaatggccggcctgccctgcacgcctgccagaggggcgtgtgcatgaccaactgccccaccctcatcgtgatggtgggcctgcctgcccggggcaagacctacatcagcaagaagctgacccgctacctgaactggattggagtgcccacccgggagttcaacgtgggccagtacagaagagatgtggtgaagacctacaagagctttgagttcttcctgcctgacaatgaggagggcctgaagatcaggaagcagtgtgccctggccgccctgagagatgtgcggcgcttcctgtctgaggagggcggccacgtggccgtgtttgatgccaccaacaccacccgggagcggcgggccaccatcttcaactttggagagcagaatggctacaagaccttctttgtggagagcatctgtgtggaccctgaggtgattgctgccaacatcgtgcaggtgaagctgggcagcccagactatgtgaacagagacagtgatgaggccacagaggacttcatgagaagaattgagtgctatgaaaattcctatgagagcctggatgaggacctggaccgggacctgagctacatcaagatcatggatgtgggccagagctatgtggtgaacagagtggccgaccacatccagagccgcatcgtgtactacctgatgaacatccacgtgacccccaggagcatctacctgtgcagacatggagagagcgagctgaacctgaagggccgcatcggcggggaccccggcctgagcccccggggccgggagtttgccaagagcctggcccagttcatcagtgaccagaacatcaaggacctgaaggtgtggaccagccagatgaagaggaccatccagacagctgaggccctgggcgtgccctatgagcagtggaaggtgctgaatgaaattgatgctggggtgtgtgaggagatgacctatgaggagatccaggacaactaccccctggagtttgccctgcgggaccaggacaagtaccgctaccgctaccccaagggggagagctatgaggacctggtgcagaggctggagcctgtgatcatggagctggagcggcaggagaatgtgctggtgatctgccaccaggccgtgatgcgctgcctgctggcctacttcctggacaaggctgctgagcagctgccctacctgaagtgccccctgcacacagtgctgaagctgacccctgtggcctacggctgcaaggtggagagcatcttcctgaatgtggccgctgtgaacacccaccgggaccggccccagaatgtggacatcagcaggcctcctgaggaggccctggtgacagtgcctgcccaccagtag

SEQ ID NO: 154837 - DNA, 522 bp, Artificial Sequence
  Description of Artificial Sequence: Synthetic coding sequence
atgggcctgcccaggagagctggagatgctgctgagctgaggaagagcctgaagcccctgctggagaagagaagaagagcccgcatcaaccagagcctgagccagctgaagggcctcatcctgcccctgctgggccgggagaacagcaactgcagcaagctggagaaggcagatgtgctggagatgacagtgcgcttcctgcaggagctgcctgccagctcctggcccacagctgcccccctgccctgtgacagctaccgggagggctacagcgcctgtgtggcccggctggcccgggtgctgcctgcctgccgggtgctggagcctgctgtgtctgcccggctgctggagcacctgtggaggagagctgccagcgccaccctggatggcggccgggccggggacagcagcggccccagcgccccagccccagccccagccagcgcccctgagcccgccagcgcccctgtgcccagcccccccagccccccctgtggccctggcctgtggaggccctggtag

SEQ ID NO: 154838 - DNA, 231 bp, Artificial Sequence
  Description of Artificial Sequence: Synthetic coding sequence
atgggcctgcccaggagagctggagatgctgctgagctgaggaagagcctgaagcccctgctggagaagagaagaagagcccgcatcaaccagagcctgagccagctgaagggcctcatcctgcccctgctgggcagagaagatgccagcggctggcacacctggctgcccctgcacgcccagaactgcttcctgctgtacatccaggcccctgagcagcccccagcctag

SEQ ID NO: 154839 - DNA, 231 bp, Artificial Sequence; identical to SEQ ID NO: 154838
  Description of Artificial Sequence: Synthetic coding sequence

SEQ ID NO: 154840 - DNA, 561 bp, Artificial Sequence
  Description of Artificial Sequence: Synthetic coding sequence
atggagaagaagagaagagcccgcatcaacgtgtccctggagcagctgaagagcctgctggagaagcactacagccaccagatcaggaagaggaagctggagaaggctgacatcctggagctgtctgtgaagtacatgaggagcctgcagaacagcctgcagggcctgtggcctgtgcccagaggagctgagcagcccagcggcttccgcagctgcctgcccggggtgtcccagctgctgcggagaggagatgaggtgggcagcggcctgcgctgccccctggtgcctgagagcgctgctggcagcaccatggacagcgctggcctgggccaggaggccccagccctcttccggccctgcaccccagctgtgtgggccccagccccagctgctgggggccccaggagccccccacccctgctgctgctgcctgagagcctgcccggcagcagcgcctctgtgcccccaccccagcctgccagcagccgctgtgccgagagccctggcctgggcctgcgggtgtggaggccctggggcagccctggagatgacctgaactag

SEQ ID NO: 154841 - DNA, 666 bp, Artificial Sequence
  Description of Artificial Sequence: Synthetic coding sequence
atggctgctgacacccctgggaagcccagcgccagccccatggccggggccccagccagcgccagcaggaccccagacaagcccaggtctgctgctgagcacaggaagagcagcaagcctgtgatggagaagagaagaagagcccgcatcaatgaaagcctggcccagctgaagaccctcatcctggatgccctgaggaaggagagcagccgccacagcaagctggagaaggctgacatcctggagatgacagtgcgccacctgcggagcctgcggcgggtgcaggtgacagctgccctgtctgctgaccctgctgtgctgggcaagtaccgggccggcttccacgagtgcctggccgaggtgaaccgcttcctggccggctgtgagggcgtgcctgcagatgtgcgcagccggctgctgggccacctggccgcctgcctgcggcagctgggccccagccggcggcctgccagcctgagccctgctgccccagctgaggccccagcccctgaggtgtatgccggccggcccctgctgcccagcctgggcggccccttccccctgctggccccacccctgctgcccggcctgacccgggccctgcctgctgcccccagggctggcccccagggccctgggggcccctggaggccctggctgaggtag

SEQ ID NO: 154842 - DNA, 744 bp, Artificial Sequence
  Description of Artificial Sequence: Synthetic coding sequence
atggctgctgacacccctgggaagcccagcgccagccccatggccggggccccagccagcgccagcaggaccccagacaagcccaggtctgctgctgagcacaggaaggtgggcagcaggcctggggtgcggggggccactggaggccgggagggccggggcacccagcctgtgcctgacccccagagcagcaagcctgtgatggagaagagaagaagagcccgcatcaatgaaagcctggcccagctgaagaccctcatcctggatgccctgaggaaggagagcagccgccacagcaagctggagaaggctgacatcctggagatgacagtgcgccacctgcggagcctgcggcgggtgcaggtgacagctgccctgtctgctgaccctgctgtgctgggcaagtaccgggccggcttccacgagtgcctggccgaggtgaaccgcttcctggccggctgtgagggcgtgcctgcagatgtgcgcagccggctgctgggccacctggccgcctgcctgcggcagctgggccccagccggcggcctgccagcctgagccctgctgccccagctgaggccccagcccctgaggtgtatgccggccggcccctgctgcccagcctgggcggccccttccccctgctggccccacccctgctgcccggcctgacccgggccctgcctgctgcccccagggctggcccccagggccctgggggcccctggaggccctggctgaggtag

SEQ ID NO: 154843 - DNA, 501 bp, Artificial Sequence
  Description of Artificial Sequence: Synthetic coding sequence
atggcccccagcacagtggccgtggagctgctgagccccaaggagaagaaccggctgaggaagcctgtggtggagaagatgaggcgggaccgcatcaacagcagcattgagcagctgaagctgctgctggagcaggagtttgcccggcaccagcccaacagcaagctggagaaggctgacatcctggagatggctgtgtcctacctgaagcacagcaaggcctttgtggccgctgctggccccaagagcctgcaccaggactacagcgagggctacagctggtgcctgcaggaggccgtgcagttcctgaccctgcatgctgccagtgacacccagatgaagctgctgtaccacttccagaggcccccagctgccccagctgccccagccaaggagcccaaggcccctggggccgcccctcctccagccctgagcgccaaggccacagctgctgctgctgctgcccaccagcctgcctgtggcctgtggaggccctggtag

SEQ ID NO: 154844 - DNA, 675 bp, Artificial Sequence
  Description of Artificial Sequence: Synthetic coding sequence
atggcccctcctgctgcccctggccgggacagagtgggcagagaagatgaagatggctgggagaccaggggggacaggaaggccaggaagcccctggtggagaagaagagaagagcccgcatcaatgaaagcctgcaggagctgcggctgctgctggccggggctgaggtgcaggccaagctggagaatgctgaggtgctggagctgactgtgcggcgggtgcagggcgtgctgcggggccgggcccgggagcgggagcagctgcaggccgaggccagcgagagatttgctgctggctacatccagtgcatgcatgaggtgcacacctttgtgtccacctgccaggccattgatgccaccgtggccgctgagctgctgaaccacctgctggagagcatgcccctgcgggagggcagcagcttccaggacctgctgggagatgccctggccggccccccccgggcccctggccgcagcggctggccagctggaggagcccctggcagccccatccccagccccccaggccctggagatgacctgtgcagcgacctggaggaggcccctgaggccgagctgagccaggccccagctgagggccctgacctggtgcctgctgccctgggcagcctgaccacagcccagatcgcccggtctgtgtggaggccctggtag

SEQ ID NO: 154845 - DNA, 645 bp, Artificial Sequence
  Description of Artificial Sequence: Synthetic coding sequence
atggcccctcctgctgcccctggccgggacagagtgggcagagaagatgaagatggctgggagaccaggggggacaggaaggccaggaagcccctggtggagaagaagagaagagcccgcatcaatgaaagcctgcaggagctgcggctgctgctggccggggctgaggtgcaggccaagctggagaatgctgaggtgctggagctgactgtgcggcgggtgcagggcgtgctgcggggccgggcccggggggagtggaggagaggaggccggggcagaagaccccgggcccctgtgaccccagcccggcggaggaccagcctgcctgcccccctgagctgcagaagaagaggcctgcccccagagcagggcgccccaccccggctgctgggggagccccggccccggggccctgggggcctgggccatgctgtggccgcccaccgggccggccggggcagcctgccccccaccctgggcccccgggcccgggctgctgctgggggcagcgagcgggccctgcgctgccgcctgcaccctgtgcacgcccggggggcccacgtgcgggtgcacgtgcccggccaccggcgctaccgccgctgccgggcccctgagcccagcgcccgggtgcacgccgccgcctag

SEQ ID NO: 154846 - DNA, 669 bp, Artificial Sequence
  Description of Artificial Sequence: Synthetic coding sequence
atggcccctcctgctgcccctggccgggacagagtgggcagagaagatgaagatggctgggagaccaggggggacaggaaggccaggaagcccctggtggagaagaagagaagagcccgcatcaatgaaagcctgcaggagctgcggctgctgctggccggggctgaggccaagctggagaatgctgaggtgctggagctgactgtgcggcgggtgcagggcgtgctgcggggccgggcccgggagcgggagcagctgcaggccgaggccagcgagagatttgctgctggctacatccagtgcatgcatgaggtgcacacctttgtgtccacctgccaggccattgatgccaccgtggccgctgagctgctgaaccacctgctggagagcatgcccctgcgggagggcagcagcttccaggacctgctgggagatgccctggccggccccccccgggcccctggccgcagcggctggccagctggaggagcccctggcagccccatccccagccccccaggccctggagatgacctgtgcagcgacctggaggaggcccctgaggccgagctgagccaggccccagctgagggccctgacctggtgcctgctgccctgggcagcctgaccacagcccagatcgcccggtctgtgtggaggccctggtag

SEQ ID NO: 154847 - DNA, 678 bp, Artificial Sequence
  Description of Artificial Sequence: Synthetic coding sequence
atggtgacccgggacagagctgagaacagagatggccccaagatgctgaagcccctggtggagaagagaagaagagaccgcatcaacagaagcctggaggagctgcggctgctgctgctggagaggacccgggaccagaacctgaggaaccccaagctggagaaggccgagatcctggagtttgctgtgggctacctgcgggagaggagccgggtggagcccccaggagtgcccaggagccctgtgcaggatgctgaggccctggccagctgctacctgagcggcttccgggagtgcctgctgcggctggccgcctttgcccatgatgccagccctgctgcccgggcccagctgttcagcgccctgcacggctacctgcggcccaagccaccccggcccaagcctgtggacccccggcccccagccccccggcccagcctggaccctgctgccccagccctgggccctgccctgcaccagaggcctcctgtgcaccagggccaccccagcccccgctgtgcctggagccccagcctgtgcagcccccgggccggggacagcggggccccagcccccctgaccggcctgctgcccccacctcctccaccccaccggcaggatggagcccccaaggcccccctgcccccacctccagccttctggaggccctggccctag

SEQ ID NO: 154848 - DNA, 693 bp, Artificial Sequence
  Description of Artificial Sequence: Synthetic coding sequence
atggtgacccgggacagagctgagaacagagatggccccaagatgctgaagcccctggtggagaagagaagaagagaccgcatcaacagaagcctggaggagctgcggctgctgctgctggagaggacccgggaccagaacctgaggaaccccaagctggagaaggccgagatcctggagtttgctgtgggctacctgcgggagaggagccgggtggagcccccagctgctgctgcccctggggtgcccaggagccctgtgcaggatgctgaggccctggccagctgctacctgagcggcttcagagaatgtctgctgcggctggccgcctttgcccatgatgccagccctgctgcccgggcccagctgttcagcgccctgcacggctacctgcggcccaagccaccccggcccaagcctgtggacccccggcccccagccccccggcccagcctggaccctgctgccccagccctgggccctgccctgcaccagaggcctcctgtgcaccagggccaccccagcccccgctgtgcctggagccccagcctgtgcagccccagggctggggacagcggggccccagcccccctgaccggcctgctgcccccacctcctccaccccaccggcaggatggagcccccaaggcccccctgcccccacctccagccttctggaggccctggccctag

SEQ ID NO: 154849 - DNA, 1014 bp, Artificial Sequence
  Description of Artificial Sequence: Synthetic coding sequence
atgaagaggccctgtgaggagaccaccagcgagagtgacatggatgagaccattgatgtgggcagcgagaacaactacagcggccagagcaccagcagcgtcatccggctgaacagccccaccaccaccagccagatcatggccaggaagaagaggcggggcatcatcgagaagagaagaagagaccgcatcaacaacagcctgtctgagctgcggcggctggtgcccacagcctttgagaagcagggcagcgccaagctggagaaggccgagatcctgcagatgacagtggaccacctgaagatgctgcaggccaccggcggcaagggctactttgatgcccacgccctggccatggacttcatgagcatcggcttccgggagtgcctgacagaggtggcccgctacctgagctctgtggagggcctggacagcagtgaccccctgcgggtgcggctggtgagccacctgagcacctgtgccacccagcgggaggccgccgccatgaccagctccatggcccaccaccaccaccccctgcacccccaccactgggccgccgccttccaccacctgcctgctgccctgctgcagcccaacggcctgcacgccagcgagagcaccccctgccgcctgagcaccaccagcgaggtgcccccagcccacggcagcgccctgctgacagccacctttgcccacgccgacagcgccctgaggatgcccagcactggatctgtggccccctgtgtgccccccctgagcaccagcctgctgagcctgagcgccaccgtgcacgccgctgctgctgctgccacagctgctgcccacagcttccccctgagctttgctggggccttccccatgctgcccccaaatgctgctgctgctgtggccgccgccacagccatcagcccccccctgtctgtgtctgccaccagcagcccccagcagaccagcagcggcaccaacaacaagccctaccggccctggggcacagaggtgggcgccttctag

SEQ ID NO: 154850 - DNA, 876 bp, Artificial Sequence
  Description of Artificial Sequence: Synthetic coding sequence
atggccaggaagaagaggcggggcatcatcgagaagagaagaagagaccgcatcaacaacagcctgtctgagctgcggcggctggtgcccacagcctttgagaagcagggcagcgccaagctggagaaggccgagatcctgcagatgacagtggaccacctgaagatgctgcaggccaccggcggcaagggctactttgatgcccacgccctggccatggacttcatgagcatcggcttccgggagtgcctgacagaggtggcccgctacctgagctctgtggagggcctggacagcagtgaccccctgcgggtgcggctggtgagccacctgagcacctgtgccacccagcgggaggccgccgccatgaccagctccatggcccaccaccaccaccccctgcacccccaccactgggccgccgccttccaccacctgcctgctgccctgctgcagcccaacggcctgcacgccagcgagagcaccccctgccgcctgagcaccaccagcgaggtgcccccagcccacggcagcgccctgctgacagccacctttgcccacgccgacagcgccctgaggatgcccagcactggatctgtggccccctgtgtgccccccctgagcaccagcctgctgagcctgagcgccaccgtgcacgccgctgctgctgctgccacagctgctgcccacagcttccccctgagctttgctggggccttccccatgctgcccccaaatgctgctgctgctgtggccgccgccacagccatcagcccccccctgtctgtgtctgccaccagcagcccccagcagaccagcagcggcaccaacaacaagccctaccggccctggggcacagaggtgggcgccttctag

SEQ ID NO: 154851 - DNA, 1221 bp, Artificial Sequence
  Description of Artificial Sequence: Synthetic coding sequence
atgtctgccctgggcgccgtcatcgccctgctgctgtggggccagctgtttgctgtggacagcggaaatgatgtgacagacattgctgatgatggctgccccaagcccccagaaattgcccacggctacgtggagcacagcgtgcgctaccagtgcaagaactactacaagctgaggacagaaggagatggagtgtacaccctgaatgacaagaagcagtggatcaacaaggctgtgggggacaagctgcctgaatgtgaggctgatgatggctgccccaagcccccagagatcgcccacggctacgtggagcacagcgtgcgctaccagtgcaagaactactacaagctgaggacagaaggagatggagtgtacaccctgaacaatgagaagcagtggatcaacaaggctgtgggggacaagctgcctgaatgtgaggccgtgtgtgggaagcccaagaacccagccaaccctgtgcagaggatcctgggcggccacctggatgccaagggcagcttcccctggcaggccaagatggtgagccaccacaacctgaccactggagccaccctcatcaatgagcagtggctgctgaccacagccaagaacctcttcctgaaccacagtgaaaatgccacagccaaggacatcgcccccaccctgaccctgtatgtgggcaagaagcagctggtggagattgagaaggtggtgctgcaccccaactacagccaggtggacatcggcctcatcaagctgaagcagaaggtgtctgtgaatgaaagagtgatgcccatctgcctgcccagcaaggactatgcagaggtgggccgggtgggctacgtgtctggctggggcagaaatgccaacttcaagttcacagaccacctgaagtatgtgatgctgcctgtggccgaccaggaccagtgcatccgccactatgagggcagcacagtgcctgagaagaagacccccaagagccctgtgggcgtgcagcccatcctgaatgagcacaccttctgtgccggcatgagcaagtaccaggaggacacctgctatggagatgctggcagcgcctttgctgtgcatgacctggaggaggacacctggtacgccaccggcatcctgagctttgacaagagctgtgctgtggccgagtatggagtgtatgtgaaggtgaccagcatccaggactgggtgcagaagaccatcgcagaaaattag

SEQ ID NO: 154852 - DNA, 1149 bp, Artificial Sequence
  Description of Artificial Sequence: Synthetic coding sequence
gtgtatgcctgtgtgtgtgtgtgtgtgtacatgcacgtgtgtgtggatgcctgcatgtgctgtgaggccggccgcctggccttccacagcagcctgagcagcctgtgcagcgccctgggcgctgtgattgccctgctgctgtggggccagctgtttgctgtggacagcggaaatgatgtgacagacattgctgatgatggctgccccaagcccccagagatcgcccacggctacgtggagcacagcgtgcgctaccagtgcaagaactactacaagctgaggacagaaggagatggagtgtacaccctgaatgacaagaagcagtggatcaacaaggctgtgggggacaagctgcctgaatgtgaggccgtgtgtgggaagcccaagaacccagccaaccctgtgcagaggatcctgggcggccacctggatgccaagggcagcttcccctggcaggccaagatggtgagccaccacaacctgaccactggagccaccctcatcaatgagcagtggctgctgaccacagccaagaacctcttcctgaaccacagtgaaaatgccacagccaaggacatcgcccccaccctgaccctgtatgtgggcaagaagcagctggtggagattgagaaggtggtgctgcaccccaactacagccaggtggacatcggcctcatcaagctgaagcagaaggtgtctgtgaatgaaagagtgatgcccatctgcctgcccagcaaggactatgcagaggtgggccgggtgggctacgtgtctggctggggcagaaatgccaacttcaagttcacagaccacctgaagtatgtgatgctgcctgtggccgaccaggaccagtgcatccgccactatgagggcagcacagtgcctgagaagaagacccccaagagccctgtgggcgtgcagcccatcctgaatgagcacaccttctgtgccggcatgagcaagtaccaggaggacacctgctatggagatgctggcagcgcctttgctgtgcatgacctggaggaggacacctggtacgccaccggcatcctgagctttgacaagagctgtgctgtggccgagtatggagtgtatgtgaaggtgaccagcatccaggactgggtgcagaagaccatcgcagaaaattag

SEQ ID NO: 154853 - DNA, 1044 bp, Artificial Sequence
  Description of Artificial Sequence: Synthetic coding sequence
atgtctgccctgggcgccgtcatcgccctgctgctgtggggccagctgtttgctgtggacagcggaaatgatgtgacagacattgctgatgatggctgccccaagcccccagaaattgcccacggctacgtggagcacagcgtgcgctaccagtgcaagaactactacaagctgaggacagaaggagatggagtgtacaccctgaacaatgagaagcagtggatcaacaaggctgtgggggacaagctgcctgaatgtgaggccgtgtgtgggaagcccaagaacccagccaaccctgtgcagaggatcctgggcggccacctggatgccaagggcagcttcccctggcaggccaagatggtgagccaccacaacctgaccaccggggccaccctcatcaatgagcagtggctgctgaccacagccaagaacctcttcctgaaccacagtgaaaatgccacagccaaggacatcgcccccaccctgaccctgtatgtgggcaagaagcagctggtggagattgagaaggtggtgctgcaccccaactacagccaggtggacatcggcctcatcaagctgaagcagaaggtgtctgtgaatgaaagagtgatgcccatctgcctgcccagcaaggactatgcagaggtgggccgggtgggctacgtgtctggctggggcagaaatgccaacttcaagttcacagaccacctgaagtatgtgatgctgcctgtggccgaccaggaccagtgcatccgccactatgagggcagcacagtgcctgagaagaagacccccaagagccctgtgggcgtgcagcccatcctgaatgagcacaccttctgtgccggcatgagcaagtaccaggaggacacctgctatggagatgctggcagcgcctttgctgtgcatgacctggaggaggacacctggtacgccaccggcatcctgagctttgacaagagctgtgctgtggccgagtatggagtgtatgtgaaggtgaccagcatccaggactgggtgcagaagaccatcgccgagaactag

SEQ ID NO: 154854 - DNA, 846 bp, Artificial Sequence
  Description of Artificial Sequence: Synthetic coding sequence
atgagccgcatcagccagatgacagctgcccggagccccccccggctgcacatggccatgtggagcaccaggtttgccacctctgtgaggaccaaccctgtgcagaggatcctgggcggccacctggatgccaagggcagcttcccctggcaggccaagatggtgagccaccacaacctgaccaccggggccaccctcatcaatgagcagtggctgctgaccacagccaagaacctcttcctgaaccacagtgaaaatgccacagccaaggacatcgcccccaccctgaccctgtatgtgggcaagaagcagctggtggagattgagaaggtggtgctgcaccccaactacagccaggtggacatcggcctcatcaagctgaagcagaaggtgtctgtgaatgaaagagtgatgcccatctgcctgcccagcaaggactatgcagaggtgggccgggtgggctacgtgtctggctggggcagaaatgccaacttcaagttcacagaccacctgaagtatgtgatgctgcctgtggccgaccaggaccagtgcatccgccactatgagggcagcacagtgcctgagaagaagacccccaagagccctgtgggcgtgcagcccatcctgaatgagcacaccttctgtgccggcatgagcaagtaccaggaggacacctgctatggagatgctggcagcgcctttgctgtgcatgacctggaggaggacacctggtacgccaccggcatcctgagctttgacaagagctgtgctgtggccgagtatggagtgtatgtgaaggtgaccagcatccaggactgggtgcagaagaccatcgccgagaactag

SEQ ID NO: 154855 - DNA, 552 bp, Artificial Sequence
  Description of Artificial Sequence: Synthetic coding sequence
atgtctgctgcccgggagagccacccccacggcgtgaagaggtctgccagcccagatgatgacctgggcagcagcaactgggaggccgctgacctgggcaatgaggagaggaagcagaagttcctgcggctgatgggcgccggcaagaaggagcacacaggccgcctggtgattggagaccacaagagcaccagccacttcagaactggagaggaggacaagaagatcaatgaggagctggagagccagtaccagcagagcatggacagcaagctgagcggccgctacagaagacactgcggcctgggcttcagcgaggtggaggaccatgatggagaaggagatgtggccggagatgatgatgatgatgatgatgacagcccagaccctgagagcccagatgacagcgagagtgacagcgagagcgagaaggaggagagcgctgaggagctgcaggccgctgagcacccagatgaggtggaggaccccaagaacaagaaggatgccaagagcaactacaagatgatgtttgtgaagagcagcggcagctag

SEQ ID NO: 154856 - DNA, 1047 bp, Artificial Sequence
  Description of Artificial Sequence: Synthetic coding sequence
atgtctgacctgggcgccgtcatcagcctgctgctgtggggccggcagctgtttgccctgtacagcggaaatgatgtgacagacatcagtgatgaccgcttccccaagcccccagagatcgccaacggctacgtggagcacctgttccgctaccagtgcaagaactactaccgcctgaggacagaaggagatggagtgtacaccctgaatgacaagaagcagtggatcaacaaggctgtgggggacaagctgcctgaatgtgaggccgtgtgtgggaagcccaagaacccagccaaccctgtgcagaggatcctgggcggccacctggatgccaagggcagcttcccctggcaggccaagatggtgagccaccacaacctgaccactggagccaccctcatcaatgagcagtggctgctgaccacagccaagaacctcttcctgaaccacagtgaaaatgccacagccaaggacatcgcccccaccctgaccctgtatgtgggcaagaagcagctggtggagattgagaaggtggtgctgcaccccaactaccaccaggtggacatcggcctcatcaagctgaagcagaaggtgctggtgaatgaaagagtgatgcccatctgcctgcccagcaagaactatgcagaggtgggccgggtgggctacgtgtctggctggggccagagcgacaacttcaagctgacagaccacctgaagtatgtgatgctgcctgtggccgaccagtatgactgcatcacccactatgagggcagcacctgccccaagtggaaggcccccaagagccctgtgggcgtgcagcccatcctgaatgagcacaccttctgtgtgggcatgagcaagtaccaggaggacacctgctatggagatgctggcagcgcctttgctgtgcatgacctggaggaggacacctggtatgctgctggcatcctgagctttgacaagagctgtgctgtggccgagtatggagtgtatgtgaaggtgaccagcatccagcactgggtgcagaagaccatcgcagaaaattag

SEQ ID NO: 154857 - DNA, 1047 bp, Artificial Sequence; identical to SEQ ID NO: 154856
  Description of Artificial Sequence: Synthetic coding sequence

SEQ ID NO: 154858 - DNA, 615 bp, Artificial Sequence
  Description of Artificial Sequence: Synthetic coding sequence
atggctgctgccaacccctgggaccctgccagcgcccccaacggggccggcctggtgctgggccacttcatcgccagcggcatggtgaaccagaagaacctggagattgagctgctgaagctggagaaggacacagcagatgtggtgcaccccttcttcctggcccagaagtgccacaccctgcagagcatgaacaaccacctggaggccgtgctgaaggagaagaggagcctgcggcagaggctgctgaagcccatgtgccaggagaacctgcccattgaagctgtgtaccaccgctacatggtgcacctgctggagctggccgtgaccttcatcgagcggctggagacccacctggagaccatccggaacatcccccacctggccgccaacctgaagaagatgaaccaggccctggccaagatggacatcctggtgacagaaacagaggagctggccgagaacatcctgaagtggaggaagcagcagaatgaggtgagcagctgcatccccaagatcctggccgaggagagctacctgtacaagcatgacatcatcatgccacccctgcccttcaccagcaaggtgcacgtgcagaccatcaatgccaagtag

SEQ ID NO: 154859 - DNA, 837 bp, Artificial Sequence
  Description of Artificial Sequence: Synthetic coding sequence
atggagccccaggaggagcgggagacccaggtggccgcctggctgaagaagatctttggagaccaccccatcccccagtatgaggtgaaccccaggaccacagagatcctgcaccacctgtctgaaagaaacagagtgcgggacagagatgtgtacctggtgattgaggacctgaagcagaaggcctctgaatatgaaagtgaggccaagtacctgcaggacctgctgatggagagcgtgaacttcagccctgccaacctgagcagcacaggcagccgctacctgaatgccctggtggacagcgctgtggccctggagaccaaggacaccagcctggccagcttcatcccagctgtgaatgacctgaccagtgacctcttccgcaccaagagcaagtctgaggagatcaagattgagctggagaagctggagaagaacctgacagccaccctggtgctggagaagtgcctgcaggaggatgtgaagaaggccgagctgcacctgagcacagagcgggccaaggtggacaacagacggcagaacatggacttcctgaaggccaagtctgaggagttccgcttcggcatcaaggctgctgaggagcagctgagcgcccggggcatggatgccagcctgagccaccagagcctggtggccctgtctgagaagctggcccggctgaagcagcagaccatccccctgaagaagaagctggagagctacctggacctgatgcccaaccccagcctggcccaggtgaagattgaggaggccaagcgggagctggacagcattgaagctgagctgaccaggagagtggacatgatggagctgtag

SEQ ID NO: 154860 - DNA, 708 bp, Artificial Sequence
  Description of Artificial Sequence: Synthetic coding sequence
atggctgctgccaacccctgggaccctgccagcgcccccaacggggccggcctggtgctgggccacttcatcgccagcggcatggtgaaccaggagatgctgaacatgagcaagaagacagtgtcctgctttgtgaacttcacccggctgcagcagatcaccaacatccaggccgagatctaccagaagaacctggagattgagctgctgaagctggagaaggacacagcagatgtggtgcaccccttcttcctggcccagaagtgccacaccctgcagagcatgaacaaccacctggaggccgtgctgaaggagaagaggagcctgcggcagaggctgctgaagcccatgtgccaggagaacctgcccatcgaggccgtgtaccaccgctacatggtgcacctgctggagctggccgtgaccttcatcgagcggctggagacccacctggagaccatccggaacatcccccacctggccgccaacctgaagaagatgaaccaggccctggccaagatggacatcctggtgacagaaacagaggagctggccgagaacatcctgaagtggaggaagcagcagaatgaggtgagcagctgcatccccaagatcctggccgaggagagctacctgtacaagcatgacatcatcatgccacccctgcccttcaccagcaaggtgcacgtgcagaccatcaatgccaagtag

SEQ ID NO: 154861 - DNA, 615 bp, Artificial Sequence; identical to SEQ ID NO: 154858
  Description of Artificial Sequence: Synthetic coding sequence

SEQ ID NO: 154862 - DNA, 1812 bp, Artificial Sequence
  Description of Artificial Sequence: Synthetic coding sequence
atgagctgtggaaatgaatttgtggagaccctgaagaagattggctaccccaaggctgacaacctgaatggagaagattttgactggctgtttgaaggagtggaggatgagagcttcctgaagtggttctgtggaaatgtgaatgagcagaatgtgctgtctgagcgggagctggaggccttcagcatcctgcagaagagcggcaagcccatcctggagggcgccgccctggatgaggccctgaagacctgcaagaccagtgacctgaagaccccccggctggatgacaaggagctggagaagctggaggatgaggtgcagaccctgctgaagctgaagaacctgaagatccagaggaggaacaagtgccagctgatggcctctgtgaccagccacaagagcctgcggctgaatgccaaggaggaggaggccaccaagaagctgaagcagagccagggcatcctgaatgccatgatcaccaagatcagcaatgagctgcaggccctgacagatgaggtgacccagctgatgatgttcttccgccacagcaacctgggccagggcaccaaccccctggtgttcctgagccagttcagcctggagaagtacctgagccaggaggagcagagcacagctgccctgaccctgtacaccaagaagcagttcttccagggcatccacgaggtggtggagagcagcaatgaagacaacttccagctgctggacatccagacccccagcatctgtgacaaccaggagatcctggaggagcggcggctggagatggcccggctgcagctggcctacatctgtgcccagcaccagctgatccacctgaaggccagcaacagctccatgaagagcagcatcaagtgggccgaggagagcctgcacagcctgaccagcaaggctgtggacaaggagaacctggatgccaagatcagcagcctgaccagcgagatcatgaagctggagaaggaggtgacccagatcaaggacaggagcctgcctgctgtggtgcgggagaatgcccagctgctgaacatgcctgtggtgaagggggactttgacctgcagatcgccaagcaggactactacacagcccggcaggagctggtgctgaaccagctgatcaagcagaaggccagctttgagctgctgcagctgtcctatgaaattgagctgaggaagcaccgggacatctaccggcagctggagaacctggtgcaggagctgagccagagcaacatgatgctgtacaagcagctggagatgctgacagaccccagcgtgtcccagcagatcaaccccaggaacaccatcgacaccaaggactacagcacccaccggctgtaccaggtgctggagggggagaacaagaagaaggagctgttcctgacccacggcaacctggaggaggtggccgagaagctgaagcagaacatcagcctggtgcaggaccagctggccgtgtctgcccaggagcacagcttcttcctgagcaagaggaacaaggatgtggacatgctgtgtgacaccctgtaccagggcggcaaccagctgctgctgagtgaccaggagctgacagagcagttccacaaggtggagagccagctgaacaagctgaaccacctgctgacagacatcctggctgatgtgaagaccaagaggaagaccctggccaacaacaagctgcaccagatggagcgggagttctacgtgtacttcctgaaggatgaggactacctgaaggacatcgtggagaacctggagacccagagcaagatcaaggctgtgtccctggaggactag

SEQ ID NO: 154863 - DNA, 1812 bp, Artificial Sequence; identical to SEQ ID NO: 154862
  Description of Artificial Sequence: Synthetic coding sequence

SEQ ID NO: 154864 - DNA, 33 bp, Artificial Sequence
  Description of Artificial Sequence: Synthetic coding sequence
atgagctgtggaaatgaatttgtggagacctag

SEQ ID NO: 154865 - DNA, 102 bp, Artificial Sequence
  Description of Artificial Sequence: Synthetic coding sequence
atgagctgtggaaatgaatttgtggagaccctgaagaagattggctaccccaaggctgacaacctgaatggagaagattttgactggctgtttgagggctag

SEQ ID NO: 154866 - DNA, 456 bp, Artificial Sequence
  Description of Artificial Sequence: Synthetic coding sequence
atgggcaagaggcccaacctgctggccctgcagctgagtgacagcaccctggccgacatcatcgcccggctgcaggccggccagaagctgagcggcagcagccccttcagcagcgccttcaacagcctgagcctggacaaggagagcggcctgctgatgtttaaaggagacaagaagccccgggtgtgggtggtgcccacccagctgcggcgggacctgatcttctctgtgcatgacatccccctgggcgcccaccagaggcctgaggagacctacaagaagctgcggctgctgggctggtggccaggcatgcaggagcacgtgaaggactactgccgcagctgcctcttctgcatccccaggaacctgattggcagcgagctgaaggtgattgagagccccccagcctctgtgctgcggggccagggcgtgtgcaacagaagtggcaccaggtag

SEQ ID NO: 154867 - DNA, 957 bp, Artificial Sequence
  Description of Artificial Sequence: Synthetic coding sequence
atggccagcggggacttctgcagccctggagagggcatggagatcctgcagcaggtgtgcagcaagcagctgcccccctgcaacctgagcaaggaggacctgctgcagaacccctacttcagcaagctgctgctgaacctgagccagcacgtggatgagagcggcctgagcctgaccctggccaaggagcaggcccaggcctggaaggaggtgcggctgcacaagaccacctggctgcggtctgagatcctgcacagggtcatccaggagctgctggtggactactacgtgaagatccaggacaccaacgtgaccagcgaggacaagaaggactttgtgtggatgagggcccggctgcagcaggaggtggaggagcagctgaagaagaagtgcttcaccctgctgtgctactatgaccccaacagtgatgctgacagcgagaccgtgaaggccgccaaggtgtggaagctggccgaggtgctggtgggggagcagcagcagtgccaggatgccaagagccagcagaaggagcagatgctgctgctggagaagaagtctgctgcctacagccaggtgctgctgcgctgcctgaccctgctgcagaggctgctgcaggagcaccggctgaagacccagagcgagctggaccgcatcaatgcccagtacctggaggtgaagtgtggggccatgatcctgaagctgaggatggaggagctgaagatcctgagtgacacctacacagtggagaaggtggaggtgcacaggctcatccgggaccggctggagggcgccatccacctgcaggagcaggacatggagaacagccggcaggtgctgaacagctatgaggtgctgggggaggagtttgaccggctggtgaaggagtacacagtgctgaagcaggccacagagaacaagcgctgggccctgcaggagttcagcaaggtgtacagatag

SEQ ID NO: 154868 - DNA, 714 bp, Artificial Sequence
  Description of Artificial Sequence: Synthetic coding sequence
atggccagcggggacttctgcagccctggagagggcatggagatcctgcagcaggtgtgcagcaagcagctgcccccctgcaacctgagcaaggaggacctgctgcagaacccctacttcagcaagctgctgctgaacctgagccagcacgtggatgagagcggcctgagcctgaccctggccaaggagcaggcccaggcctggaaggaggtgcggctgcacaagaccacctggctgcggtctgagatcctgcacagggtcatccaggagctgctggtggactactacgtgaagatccaggacaccaacgtgaccagcgaggacaagaaggtgctgctgcgctgcctgaccctgctgcagaggctgctgcaggagcaccggctgaagacccagagcgagctggaccgcatcaatgcccagtacctggaggtgaagtgtggggccatgatcctgaagctgaggatggaggagctgaagatcctgagtgacacctacacagtggagaaggtggaggtgcacaggctcatccgggaccggctggagggcgccatccacctgcaggagcaggacatggagaacagccggcaggtgctgaacagctatgaggtgctgggggaggagtttgaccggctggtgaaggagtacacagtgctgaagcaggccacagagaacaagcgctgggccctgcaggagttcagcaaggtgtacagatag

SEQ ID NO: 154869 - DNA, 714 bp, Artificial Sequence; identical to SEQ ID NO: 154868
  Description of Artificial Sequence: Synthetic coding sequence

SEQ ID NO: 154870 - DNA, 720 bp, Artificial Sequence
  Description of Artificial Sequence: Synthetic coding sequence
atgaggctgctgggccccagccaggagcgggagatcccccccctgctgggcctggagaaggctgacctgctggagctgatgcccctgtctgaagattttgtgtggatgagggcccggctgcagcaggaggtggaggagcagctgaagaagaagtgcttcaccctgctgtgctactatgaccccaacagtgatgctgacagcgagaccgtgaaggccgccaaggtgtggaagctggccgaggtgctggtgggggagcagcagcagtgccaggatgccaagagccagcagaaggagcagatgctgctgctggagaagaagtctgctgcctacagccaggtgctgctgcgctgcctgaccctgctgcagaggctgctgcaggagcaccggctgaagacccagagcgagctggaccgcatcaatgcccagtacctggaggtgaagtgtggggccatgatcctgaagctgaggatggaggagctgaagatcctgagtgacacctacacagtggagaaggtggaggtgcacaggctcatccgggaccggctggagggcgccatccacctgcaggagcaggacatggagaacagccggcaggtgctgaacagctatgaggtgctgggggaggagtttgaccggctggtgaaggagtacacagtgctgaagcaggccacagagaacaagcgctgggccctgcaggagttcagcaaggtgtacagatag

SEQ ID NO: 154871 - DNA, 1092 bp, Artificial Sequence; identical to SEQ ID NO: 146563
  Description of Artificial Sequence: Synthetic coding sequence

SEQ ID NO: 154872 - DNA, 54 bp, Artificial Sequence
  Description of Artificial Sequence: Synthetic coding sequence
atgaggctgctgggccccagccaggagcgggagatcccccccctgctgggctag

SEQ ID NO: 154873 - DNA, 564 bp, Artificial Sequence
  Description of Artificial Sequence: Synthetic coding sequence
atggccagcggggacttctgcagccctggagagggcatggagatcctgcagcaggtgtgcagcaagcagctgcccccctgcaacctgagcaaggaggacctgctgcagaacccctacttcagcaagctgctgctgaacctgagccagcacgtggatgagagcggcctgagcctgaccctggccaaggagcaggcccaggcctggaaggaggtgcggctgcacaagaccacctggctgcggtctgagatcctgcacagggtcatccaggagctgctggtggactactacgtgaagatccaggacaccaacgtgaccagcgaggacaagaagttccacgagaccctggagcagaggctgctggtgacagagctgatgaggctgctgggccccagccaggagcgggagatcccccccctgctgggcctggagaaggctgacctgctggagctgatgcccctgtctgaagattttgtgtggatgagggcccggctgcagcaggaggtggaggagcagctgaagaagaagtgcttcaccctgctgtgctactatgaccccaacagctag

SEQ ID NO: 154874 - DNA, 840 bp, Artificial Sequence
  Description of Artificial Sequence: Synthetic coding sequence
atggccagcggggacttctgcagccctggagagggcatggagatcctgcagcaggtgtgcagcaagcagctgcccccctgcaacctgagcaaggaggacctgctgcagaacccctacttcagcaagctgctgctgaacctgagccagcacgtggatgagagcggcctgagcctgaccctggccaaggagcaggcccaggcctggaaggaggtgcggctgcacaagaccacctggctgcggtctgagatcctgcacagggtcatccaggagctgctggtggactactacgtgaagatccaggacaccaacgtgaccagcgaggacaagaagttccacgagaccctggagcagaggctgctggtgacagagctgatgaggctgctgggccccagccaggagcgggagatcccccccctgctgggcctggagaaggctgacctgctggagctgatgcccctgtctgaagattttgtgtggatgagggcccggctgcagcaggaggtggaggagcagctgaagaagaagtgcttcaccctgctgtgctactatgaccccaacagtgatgctgacagcgagaccgtgaaggccgccaaggtgtggaagctggccgaggtgctggtgggggagcagcagcagtgccaggatgccaagagccagcagaaggagcagatgctgctgctggagaagaagtctgctgcctacagccaggtgctgctgcgctgcctgaccctgctgcagaggctgctgcaggagcaccggctgaagacccagagcgagctggaccgcatcaatgcccagtacctggaggtgaagtgtggggccatgatcctgaagctgtag

SEQ ID NO: 154875 - DNA, 957 bp, Artificial Sequence; identical to SEQ ID NO: 154867
  Description of Artificial Sequence: Synthetic coding sequence

SEQ ID NO: 154876 - DNA, 957 bp, Artificial Sequence; identical to SEQ ID NO: 154867
  Description of Artificial Sequence: Synthetic coding sequence

SEQ ID NO: 154877 - DNA, 483 bp, Artificial Sequence
  Description of Artificial Sequence: Synthetic coding sequence
atggccagcggggacttctgcagccctggagagggcatggagatcctgcagcaggtgtgcagcaagcagctgcccccctgcaacctgagcaaggaggacctgctgcagaacccctacttcagcaagctgctgctgaacctgagccagcacgtggatgagagcggcctgagcctgaccctggccaaggagcaggcccaggcctggaaggaggtgcggctgcacaagaccacctggctgcggtctgagatcctgcacagggtcatccaggagctgctggtggactactacgtgaagatccaggacaccaacgtgaccagcgaggacaagaagttccacgagaccctggagcagaggctgctggtgacagagctgatgaggctgctgggccccagccaggagcgggagatcccccccctgctgggcctggagaaggctgacctgctggagctgatgcccctgtctgaagattttgtgtggatgtag

SEQ ID NO: 154878 - DNA, 1902 bp, Artificial Sequence
  Description of Artificial Sequence: Synthetic coding sequence
atggagctggcccaggaggcccgggagctgggctgctgggccgtggaggagatgggcgtgcctgtggccgcccgggcccctgagagcaccctgcggcggctgtgcctgggccagggcgctgacatctgggcctacatcctgcagcacgtgcacagccagaggacagtgaagaagatccggggcaacctgctgtggtacggccaccaggacagcccccaggtgcggaggaagctggagctggaggccgctgtgacccggctgcgggcagagatccaggagctggaccagagcctggagctgatggagcgggacacagaggcccaggacacagccatggagcaggcccggcagcacacccaggacacccagaggcgggccctgctgctgcgggcccaggccggggccatgaggcggcagcagcacaccctgcgggaccccatgcagaggctgcagaaccagctgcggcggctgcaggacatggagaggaaggccaaggtggatgtgaccttcggcagcctgaccagcgctgccctgggcctggagcctgtggtgctgagagatgtgaggacagcctgcaccctgcgggcccagttcctgcagaacctgctgctgccccaggccaagaggggcagcctgcccacccctcatgatgaccacttcggcaccagctaccagcagtggctgagctctgtggagaccctgctgaccaaccaccccccaggccacgtgctggccgccctggagcacctggccgctgagcgggaggccgagatccgcagcctgtgcagcggagatggcctgggggacacagagatcagccggccccaggccccagaccagagcgacagcagccagaccctgcccagcatggtgcacctgatccaggagggctggaggacagtgggcgtgctggtgtcccagaggagcaccctgctgaaggagcggcaggtgctgacccagaggctgcagggcctggtggaggaggtggagaggagagtgctgggcagcagcgagcggcaggtgctgatcctgggcctgcggcgctgctgcctgtggacagagctgaaggccctgcatgaccagagccaggagctgcaggatgctgctggccaccggcagctgctgctgcgggagctgcaggccaagcagcagaggatcctgcactggaggcagctggtggaggagacccaggagcaggtgcggctgctgatcaagggcaacagcgccagcaagacccggctgtgccgcagccctggagaggtgctggccctggtgcagaggaaggtggtgcccacctttgaagctgtggccccccagagccgggagctgctgcgctgcctggaggaggaggtgcgccacctgccccacatcctgctgggcaccctgctgcggcacaggcctggagagctgaagcccctgcccaccgtgctgcccagcatccaccagctgcacccagccagcccccggggcagcagcttcatcgccctgagccacaagctgggcctgcccccaggcaaggccagcgagctgctgctgcctgctgctgccagcctgcggcaggacctgctgctgctgcaggaccagaggagcctgtggtgctgggacctgctgcacatgaagaccagcctgcccccaggcctgcccacccaggagctgctgcagatccaggccagccaggagaagcagcagaaggagaacctgggccaggccctgaagaggctggagaagctgctgaagcaggccctggagcgcatccctgagctgcagggcatcgtgggggactggtgggagcagcccggccaggccgccctgtctgaggagctgtgccagggcctgagcctgccccagtggaggctgcgctgggtgcaggcccagggcgccctgcagaagctgtgcagctag

SEQ ID NO: 154879 - DNA, 873 bp, Artificial Sequence
  Description of Artificial Sequence: Synthetic coding sequence
atggagctggcccaggaggcccgggagctgggctgctgggccgtggaggagatgggcgtgcctgtggccgcccgggcccctgagagcaccctgcggcggctgtgcctgggccagggcgctgacatctgggcctacatcctgcagcacgtgcacagccagaggacagtgaagaagatccggggcaacctgctgtggtacggccaccaggacagcccccaggtgcggaggaagctggagctggaggccgctgtgacccggctgcgggcagagatccaggagctggaccagagcctggagctgatggagcgggacacagaggcccaggacacagccatggagcaggcccggcagcacacccaggacacccagaggcgggccctgctgctgcgggcccaggccggggccatgaggcggcagcagcacaccctgcgggaccccatgcagaggctgcagaaccagctgcggcggctgcaggacatggagaggaaggccaaggtggatgtgaccttcggcagcctgaccagcgctgccctgggcctggagcctgtggtgctgagagatgtgaggacagcctgcaccctgcgggcccagttcctgcagaacctgctgctgccccaggccaagaggggcagcctgcccacccctcatgatgaccacttcggcaccagctaccagcagtggctgagctctgtggagaccctgctgaccaaccaccccccaggccacgtgctggccgccctggagcacctggccgctgagcgggaggccgagatccgcagcctgtgcagcggagatggcctgggggacacagagatcagccggcgggccggcggcctgtgggtgtgctggagccccagcggggcccccagctag

SEQ ID NO: 154880 - DNA, 2409 bp, Artificial Sequence
  Description of Artificial Sequence: Synthetic coding sequence
atgaagtacatcaagagcaacagcaagaacagcagccaccactttgtggagaccttcaacatcaagccccaggacctgcacaagtgcatcgcccgctgccactttgcccggagccgcttcctgcagatcctgcagaggcaggactgtgtgacccagaagtaccaggagaatgcccagctgtctgtgaagcaggtgaggaacctgcggagtgaatgtattggcctggagaaccagatcaagaagatggagccctatgatgaccacagcaacatggaggagaagatccagaaggtgcgcagcctgtgggcctctgtgaatgagaccctgatgttcctggagaaggagcgggaggtggtgtcctctgtgctgagcctggtgaaccagtatgccctggatggcaccaacgtggccatcaacatcccccggctgctgctggacaagattgagaagcagatgttccagctgcacatcggaaatgtgtatgaagctgggaagctgaacctgctgaccgtcatccagctgctgaatgaggtgctgaaggtgatgaagtatgagcgctgccaggccgaccaggcccggctgactgtggacctgcactacctggagaaggagaccaagttccagaaggagcggctgagtgacctgaagcacatgagataccgcatcaaggatgacctgaccaccatccgccacagcgtggtggagaagcagggcgagtggcacaagaagtggaaggagttcctgggcctgagccccttcagcctcatcaagggctggacccccagcgtggacctgctgccccccatgagccccctgagctttgatcctgccagcgaggaggtgtatgccaagagcatcctgtgccagtacccagccagcctgcctgatgcccacaagcagcacaaccaggagaatggctgccgcggggacagcgacaccctgggcgccctgcatgacctggccaacagccctgccagcttcctgagccagagcgtgagcagcagtgacagaaattctgtgacagtgctggagaaggacaccaagatgggcacccccaaggagaagaatgaggccatcagcaagaagatccctgagtttgaggtggagaacagccccctgagtgatgtggccaagaacacagagagcagcgcctttggaggcagcctgcctgccaagaagagtgaccccttccagaaggagcaggaccacctggtggaggaggtggcccgggctgtgctgagtgacagcccccagctgtctgagggcaaggagatcaagctggaggagctgattgacagcctgggcagcaaccccttcctgaccaggaaccagatccccaggaccccagagaacctgatcacagagatccgcagctcctggaggaaggccatcgagatggaggagaacagaaccaaggagcccatccagatggatgctgagcaccgggaggtgctgcctgagagcctgcctgtgctgcacaaccagcgggagttctccatggctgacttcctgctggagaccaccgtgtctgactttggccagagccacctgacagaggagaaggtgatcagtgactgtgaatgtgtgccccagaagcacgtgctgaccagccacattgatgagccccccacccagaaccagagcgacctgctgaacaagaaggtgatctgcaagcaggacctggagtgcctggccttcaccaagctgtctgagaccagcaggatggagaccttcagccctgctgtgggcaacagaattgatgtgatgggcggcagcgaggaggagttcatgaagatcctggaccacctggaggtgtcctgcaacaagcccagcaccaacaagaccatgctgtggaacagcttccagatcagcagcggcatcagcagcaagagcttcaaggacaatgactttggcatcctgcacgagaccctgcctgaggaggtgggccacctgtccttcaacagcagcagcagcagcgaggccaacttcaagctggagcccaacagccccatgcacggcggcaccctgctggaggatgtggtgggcggccggcagaccaccccagagagtgacttcaacctgcaggccctgcggagccgctatgaggccctgaagaagagcctgagcaagaagcgggaggagagctacctgagcaacagccagaccccagagcggcacaagccagagctgagccccaccccccagaatgtgcagacagatgacaccctgaacttcctggacacctgtgacctgcacacagagcacatcaagcccagcctgcggaccagcatcggggagaggaagaggagcctgagccccctcatcaagttcagccctgtggagcagaggctgcggaccaccatcgcctgcagcctgggggagctgcccaacctgaagggcaaggtgtag

SEQ ID NO: 154881 - DNA, 2868 bp, Artificial Sequence
  Description of Artificial Sequence: Synthetic coding sequence
atgagcagcgcctctgtgacagcctttgagaaggagcacctgtggatgtacctgcaggccctgggctttgagcccggccctgccaccatcgcctgtgggaagatcgtgagccacacccacctgggcgtgaacatgtttgacaagctgaacagagatgccttccacatcatctcctacttcctgttccaggtgctggaccagagcctgaccaaggaggtgttcaagttctgctggcccccatttgaccagaagagtgacacagagttcaggaagcactgctgtgagtggatcaagaggatctctggagaatgtggcagcagcttcccccaggtggtgggcagcctcttcctgagccctgggggccccaagttcatccacctgatgtaccactttgccaggtttgtggccatgaagtacatcaagagcaacagcaagaacagcagccaccactttgtggagaccttcaacatcaagccccaggacctgcacaagtgcatcgcccgctgccactttgcccggagccgcttcctgcagatcctgcagaggcaggactgtgtgacccagaagtaccaggagaatgcccagctgtctgtgaagcaggtgaggaacctgcggagtgaatgtattggcctggagaaccagatcaagaagatggagccctatgatgaccacagcaacatggaggagaagatccagaaggtgcgcagcctgtgggcctctgtgaatgagaccctgatgttcctggagaaggagcgggaggtggtgtcctctgtgctgagcctggtgaaccagtatgccctggatggcaccaacgtggccatcaacatcccccggctgctgctggacaagattgagaagcagatgttccagctgcacatcggaaatgtgtatgaagctgggaagctgaacctgctgaccgtcatccagctgctgaatgaggtgctgaaggtgatgaagtatgagcgctgccaggccgaccaggcccggctgactgtggacctgcactacctggagaaggagaccaagttccagaaggagcggctgagtgacctgaagcacatgagataccgcatcaaggatgacctgaccaccatccgccacagcgtggtggagaagcagggcgagtggcacaagaagtggaaggagttcctgggcctgagccccttcagcctcatcaagggctggacccccagcgtggacctgctgccccccatgagccccctgagctttgatcctgccagcgaggaggtgtatgccaagagcatcctgtgccagtacccagccagcctgcctgatgcccacaagcagcacaaccaggagaatggctgccgcggggacagcgacaccctgggcgccctgcatgacctggccaacagccctgccagcttcctgagccagagcgtgagcagcagtgacagaaattctgtgacagtgctggagaaggacaccaagatgggcacccccaaggagaagaatgaggccatcagcaagaagatccctgagtttgaggtggagaacagccccctgagtgatgtggccaagaacacagagagcagcgcctttggaggcagcctgcctgccaagaagagtgaccccttccagaaggagcaggaccacctggtggaggaggtggcccgggctgtgctgagtgacagcccccagctgtctgagggcaaggagatcaagctggaggagctgattgacagcctgggcagcaaccccttcctgaccaggaaccagatccccaggaccccagagaacctgatcacagagatccgcagctcctggaggaaggccatcgagatggaggagaacagaaccaaggagcccatccagatggatgctgagcaccgggaggtgctgcctgagagcctgcctgtgctgcacaaccagcgggagttctccatggctgacttcctgctggagaccaccgtgtctgactttggccagagccacctgacagaggagaaggtgatcagtgactgtgaatgtgtgccccagaagcacgtgctgaccagccacattgatgagccccccacccagaaccagagcgacctgctgaacaagaaggtgatctgcaagcaggacctggagtgcctggccttcaccaagctgtctgagaccagcaggatggagaccttcagccctgctgtgggcaacagaattgatgtgatgggcggcagcgaggaggagttcatgaagatcctggaccacctggaggtgtcctgcaacaagcccagcaccaacaagaccatgctgtggaacagcttccagatcagcagcggcatcagcagcaagagcttcaaggacaatgactttggcatcctgcacgagaccctgcctgaggaggtgggccacctgtccttcaacagcagcagcagcagcgaggccaacttcaagctggagcccaacagccccatgcacggcggcaccctgctggaggatgtggtgggcggccggcagaccaccccagagagtgacttcaacctgcaggccctgcggagccgctatgaggccctgaagaagagcctgagcaagaagcgggaggagagctacctgagcaacagccagaccccagagcggcacaagccagagctgagccccaccccccagaatgtgcagacagatgacaccctgaacttcctggacacctgtgacctgcacacagagcacatcaagcccagcctgcggaccagcatcggggagaggaagaggagcctgagccccctcatcaagttcagccctgtggagcagaggctgcggaccaccatcgcctgcagcctgggggagctgcccaacctgaaggaggaggacatcctgaacaagagcctggatgccaaggagcccccaagtgacctgaccaggtag

SEQ ID NO: 154882 - DNA, 552 bp, Artificial Sequence
  Description of Artificial Sequence: Synthetic coding sequence
atgggcacccccaaggagaagaatgaggccatcagcaagaagatccctgagtttgaggtggagaacagccccctgagtgatgtggccaagaacacagagagcagcgcctttggaggcagcctgcctgccaagaagagtgaccccttccagaaggagcaggaccacctggtggaggaggtggcccgggctgtgctgagtgacagcccccagctgtctgagggcaaggagatcaagctggaggagctgattgacagcctgggcagcaaccccttcctgaccaggaaccagatccccaggaccccagagaacctgatcacagagatccgcagctcctggaggaaggccatcgagatggaggagaacagaaccaaggagcccatccagatggatgctgagcaccgggaggtgctgcctgagagcctgcctgtgctgcacaaccagcgggagttctccatggctgacttcctgctggagaccaccgtgtctgactttggccagagccacctgacagaggagaaggtgatcagtgactgtgaatgtgtgccccagtag

SEQ ID NO: 154883 - DNA, 1077 bp, Artificial Sequence
  Description of Artificial Sequence: Synthetic coding sequence
atggccggccaggatgctggctgcggcagaggaggagatgactacagtgaagatgaaggagacagctctgtgtccagagctgctgtggaggtgtttgggaagctgaaggacctgaactgccccttcctggagggcctgtacatcacagagcccaagaccatccaggagctgctgtgcagccccagcgagtaccgcctggagatcctggagtggatgtgcaccagggtgtggcccagcctgcaggaccgcttcagcagcctgaagggcgtgcccacagaggtgaagatccaggagatgaccaagctgggccacgagctgatgctgtgtgccccagatgaccaggagctgctgaagggctgtgcctgtgcccagaagcagctgcacttcatggaccagctgctggacaccatccgcagcctgaccatcggctgcagcagctgcagcagcctgatggagcactttgaggacacccgggagaagaatgaggccctgctgggggagctgttcagcagcccccacctgcagatgctgctgaacccagaatgtgacccctggcccctggacatgcagcccctgctgaacaagcagagtgatgactggcagtgggccagcgccagcgccaagtctgaggaggaggagaagctggccgagctggcccggcagctgcaggagagcgctgccaagctgcacgccctgaggacagagtactttgcccagcacgagcagggcgctgctgctggagctgctgacatcagcaccctggaccagaagctgcggctggtgaccagtgacttccaccagctgatcctggccttcctgcaggtgtatgatgatgagctgggggagtgctgccagaggcctggccctgacctgcacccctgtggccccatcatccaggccacccaccagaacctgaccagctacagccagctgctgcaggtggtgatggctgtggccgacaccagcgccaaggctgtggagaccgtgaagaagcagcagggcgagcagatctgctggggcggcagcagctctgtgatgagcctggccaccaagatgaatgagctgatggagaagtag

SEQ ID NO: 154884 - DNA, 1284 bp, Artificial Sequence
  Description of Artificial Sequence: Synthetic coding sequence
atgggcggggcccggctgggcgccaggaacatggccggccaggatgctggctgcggcagaggaggagatgactacagtgaagatgaaggagacagctctgtgtccagagctgctgtggaggtgtttgggaagctgaaggacctgaactgccccttcctggagggcctgtacatcacagagcccaagaccatccaggagctgctgtgcagccccagcgagtaccgcctggagatcctggagtggatgtgcaccagggtgtggcccagcctgcaggaccgcttcagcagcctgaagggcgtgcccacagaggtgaagatccaggagatgaccaagctgggccacgagctgatgctgtgtgccccagatgaccaggagctgctgaagggctgtgcctgtgcccagaagcagctgcacttcatggaccagctgctggacaccatccgcagcctgaccatcggctgcagcagctgcagcagcctgatggagcactttgaggacacccgggagaagaatgaggccctgctgggggagctgttcagcagcccccacctgcagatgctgctgaacccagaatgtgacccctggcccctggacatgcagcccctgctgaacaagcagagtgatgactggcagtgggccagcgccagcgccaagtctgaggaggaggagaagctggccgagctggcccggcagctgcaggagagcgctgccaagctgcacgccctgaggacagagtactttgcccagcacgagcagggcgctgctgctggagctgctgacatcagcaccctggaccagaagctgcggctggtgaccagtgacttccaccagctgatcctggccttcctgcaggtgtatgatgatgagctgggggagtgctgccagaggcctggccctgacctgcacccctgtggccccatcatccaggccacccaccagaacctgaccagctacagccagatcccccggggccagcccaagaagccagccctggtgaccatgaccaccgtgcccacctgtgccaccctgcccctggcccagggcttcagagatgtgcacttcggcttcctgtctgagcggctgcgggccttccagcccctgaccggctggagctgtgagacccccaggagcggcatgctgctgcaggtggtgatggctgtggccgacaccagcgccaaggctgtggagaccgtgaagaagcagcagggcgagcagatctgctggggcggcagcagctctgtgatgagcctggccaccaagatgaatgagctgatggagaagtag

SEQ ID NO: 154885 - DNA, 1107 bp, Artificial Sequence
  Description of Artificial Sequence: Synthetic coding sequence
atgggcggggcccggctgggcgccaggaacatggccggccaggatgctggctgcggcagaggaggagatgactacagtgaagatgaaggagacagctctgtgtccagagctgctgtggaggtgtttgggaagctgaaggacctgaactgccccttcctggagggcctgtacatcacagagcccaagaccatccaggagctgctgtgcagccccagcgagtaccgcctggagatcctggagtggatgtgcaccagggtgtggcccagcctgcaggaccgcttcagcagcctgaagggcgtgcccacagaggtgaagatccaggagatgaccaagctgggccacgagctgatgctgtgtgccccagatgaccaggagctgctgaagggctgtgcctgtgcccagaagcagctgcacttcatggaccagctgctggacaccatccgcagcctgaccatcggctgcagcagctgcagcagcctgatggagcactttgaggacacccgggagaagaatgaggccctgctgggggagctgttcagcagcccccacctgcagatgctgctgaacccagaatgtgacccctggcccctggacatgcagcccctgctgaacaagcagagtgatgactggcagtgggccagcgccagcgccaagtctgaggaggaggagaagctggccgagctggcccggcagctgcaggagagcgctgccaagctgcacgccctgaggacagagtactttgcccagcacgagcagggcgctgctgctggagctgctgacatcagcaccctggaccagaagctgcggctggtgaccagtgacttccaccagctgatcctggccttcctgcaggtgtatgatgatgagctgggggagtgctgccagaggcctggccctgacctgcacccctgtggccccatcatccaggccacccaccagaacctgaccagctacagccagctgctgcaggtggtgatggctgtggccgacaccagcgccaaggctgtggagaccgtgaagaagcagcagggcgagcagatctgctggggcggcagcagctctgtgatgagcctggccaccaagatgaatgagctgatggagaagtag

SEQ ID NO: 154886 - DNA, 411 bp, Artificial Sequence
  Description of Artificial Sequence: Synthetic coding sequence
atggaccagctgctggacaccatccgcagcctgaccatcggctgcagcagctgcagcagcctgatggagcactttgaggacacccgggagaagaatgaggccctgctgggggagctgttcagcagcccccacctgcagatgctgctgaacccagaatgtgacccctggcccctggacatgcagcccctgctgaacaagcagagtgatgactggcagtgggccagcgccagcgccaagtctgaggaggaggagaagctggccgagctggcccggcagctgcaggagagcgctgccaagctgcacgccctgaggacagagagcaccaccacctcctgggccagcgctgccagcgcccaggccctgaccagcacccgggccgcccccagcagccggcccaggacccgcatctag

SEQ ID NO: 154887 - DNA, 516 bp, Artificial Sequence
  Description of Artificial Sequence: Synthetic coding sequence
atggtgaagagaagaagaagccctgccctgggggaggagcgcttcagccccagcagcatcctgcacccccggctgcccctggtgctgctgggcaccagggtgcccctgagcggcggcggccctggagagccagaccagggccgcagcgcccccagctggaagagcctggccagcacccaccaccacagcaggcctgctgctggggccaccccagcccggcctgccacccagagccagctgggcccctttgccccacccctgcccggggtgcggcctgcccccttccctgctgtggaggtgtttgggaagctgaaggacctgaactgccccttcctggagggcctgtacatcacagagcccaagaccatccaggagctgctgtgcagccccagcgagtaccgcctggagatcctggagtggatgtgcaccagggtgtggcccagcctgcaggaccgcttcagcagcctgaagggcgtgcccacagaggtgaagatccagggcctgctggccggctag

SEQ ID NO: 154888 - DNA, 1233 bp, Artificial Sequence
  Description of Artificial Sequence: Synthetic coding sequence
atggctgacagcagcggcagaggagctgggaagccagccaccggccccaccaacagcagcagcgccaagaagaaggacaagagggtgcagggcggccgggtgattgagagccgctacctgcagtatgagaagaagaccacccagaaggccccagctggagatggcagccagacccggggcaagatgtctgagggcggcaggaagagcagcctgctgcagaagagcaaggctgacagcagcggcgtgggcaagggggacctgcagagcaccctgctggagggccatggaacagcccccccagacctggacctgagcgccatcaatgacaagagcatcgtgaagaagaccccccagctggccaagaccatcagcaagaagccagagagcaccagcttcagcgcccccaggaagaagagcccagacctgtctgaggccatggagatgatggagagccagaccctgctgctgaccctgctgtctgtgaagatggagaacaacctggccgagtttgagcggcgggcagagaagaacctgctgatcatgtgcaaggagaaggagaagctgcagaagaaggcccacgagctgaagaggcggctgctgctgagccagaggaagcgggagctggctgatgtgctggatgcccagatcgagatgctgagcccctttgaggccgtggccacccgcttcaaggagcagtaccgcacctttgccacagccctggacaccaccaggcatgagctgcctgtgcgcagcatccacctggagggagatggccagcagctgctggatgccctgcagcacgagctggtgaccacccagaggctgctgggggagctggatgtgggggacagcgaggagaatgtgcaggtgctggacctgctgtctgagctgaaggatgtgacagccaagaaggacctggagctgcggcgcagctttgcccaggtgctggagctgtctgctgaggccagcaaggaggccgccctggccaaccaggaggtgtgggaggagacccagggcatggccccacccagccgctggtacttcaaccaggacagcgcctgccgggagagcggcggggcccccaagaacacccccctgtctgaagatgacaaccctggggccagcagcgccccagcccaggccaccttcatcagccccagcgaggacttcagcagcagcagccaggccgaggtgccccccagcctgagccgcagcggccgggacctgtcctag

SEQ ID NO: 154889 - DNA, 1230 bp, Artificial Sequence
  Description of Artificial Sequence: Synthetic coding sequence
atggctgacagcagcggcagaggagctgggaagccagccaccggccccaccaacagcagcagcgccaagaagaaggacaagagggtgcagggcggccgggtgattgagagccgctacctgcagtatgagaagaagaccacccagaaggccccagctggagatggcagccagacccggggcaagatgtctgagggcggcaggaagagcagcctgctgcagaagagcaaggacagcagtggagtgggcaaaggagacctgcagagcaccctgctggagggccacggcacagcccccccagacctggacctgagcgccatcaatgacaagagcatcgtgaagaagaccccccagctggccaagaccatcagcaagaagccagagagcaccagcttcagcgcccccaggaagaagagcccagacctgtctgaggccatggagatgatggagagccagaccctgctgctgaccctgctgtctgtgaagatggagaacaacctggccgagtttgaaagaagagctgagaagaacctgctgatcatgtgcaaggagaaggagaagctgcagaagaaggcccacgagctgaagaggcggctgctgctgagccagaggaagcgggagctggctgatgtgctggatgcccagatcgagatgctgagcccctttgaagctgtggccacccgcttcaaggagcagtaccgcacctttgccacagccctggacaccaccaggcatgagctgcctgtgcgcagcatccacctggagggagatggccagcagctgctggatgccctgcagcacgagctggtgaccacccagaggctgctgggggagctggatgtgggggacagtgaagaaaatgtgcaggtgctggacctgctgtctgagctgaaggatgtgacagccaagaaggacctggagctgcggcgcagctttgcccaggtgctggagctgtctgctgaggccagcaaggaggccgccctggccaaccaggaggtgtgggaggagacccagggcatggccccacccagccgctggtacttcaaccaggacagcgcctgccgggagagcggcggggcccccaagaacacccccctgtctgaagatgacaaccctggggccagcagcgccccagcccaggccaccttcatcagccccagcgaggacttcagcagcagcagccaggccgaggtgccccccagcctgagccgcagcggccgggacctgtcctag

SEQ ID NO: 154890 - DNA, 1899 bp, Artificial Sequence
  Description of Artificial Sequence: Synthetic coding sequence
atggcccggcacagaaatgtgcggggctacaactatgatgaggactttgaagatgatgacctgtatggccagagcgtggaggatgactactgcatcagccccagcacagctgcccagttcatctacagccggcgggacaagcccagcgtggagcctgtggaggagtatgactatgaggacctgaaggagagcagcaacagcgtgagcaaccaccagctgagcggctttgaccaggcccggctgtacagctgcctggaccacatgagggaggtgctgggagatgctgtgcctgatgagatcctgattgaggccgtgctgaagaacaagtttgatgtgcagaaggccctgtctggagtgctggagcaggacagagtgcagagcctgaaggacaagaatgaggccaccgtgtccacaggcaagatcgccaagggcgtgctcttcagcagcagcgaggtgtctgctgacaacgtgcagagcagctacccccagagcgccaaccacctggactacagcagcaagccctttgattttgccagctctgtgggcaagtatggcctgagccacaacagctctgtgcccacccactgcctgctgcacaggaagaagaagctggacaccaggaagtctgagaagaagctggagagctgcaagctgaccaaggagctgagcctggccaacctgattcatgacatgagccgggacagctgtgagagccagcccagcgtgcggctgagcagcacagacagcctggagagcctgctgagcaagaacctggatgctgacctgctgcggccccacgccagcgagtgcatcagcaaggatgacagcgccttcaaggagatcccagacctgaagaccatcatcatcaagggcaccacccccaacaacagcctgtacatccagaacaacagcctgagtgacttccagaacatccctgtgcaggacagcctgggcagcagcaacaaccccctgtacctgaccagcagcctggagaacatgacagtggacaacctgaatgccagcaaggagacagaggtgggcaatgtgtccctggtggagcagagcgccaagaaccacaccttcaagaatgacaacctgcagttcagccagtgtgagagccccagcctgacagagctgttccaggagcacaaggagaacaacatcagccagtgcttcaccctgagtgacctgtgcaaccagagcagcgccagcttcacagacctgagcctgggcagcttccccctgagccagctggccaaccgctgccagagcagccctggcatcagcgagctgaccggcagcctgagcagcctggccttccacaaggccagccccacccgggacctggagaacctgagcctgtctgagctgattgctgagaccattgatgtggacaacagccagatcaagaaggagagctttgaggtgtccctgtctgaggtgcgcagccctggcatcgacagcaacatcgacctgtctgtgctgatcaagaacccagactttgtgcccaagcctgtggtggaccccagcatcgcccccagcagcaggaccaaggtgctgagcagcaagctgggcaagaacagcaactttgccaaggacaacaagaagaacaacaagggcagcctgaccaggaagccacccttcagcctgtcctggaccaaggccctggccgcccggcccagcgcctttgccagcaccctgtgcctgcgctaccccctgaagagctgcaagaggaggaccctggacctgtacaagaccttcctgtacagccggcaggtgcaggatgtgaaggacaaggagatcagccccctggtggccatcaccccatttgacttcaagagcgccagcccagatgacatcgtgaaggccaaccagaagaaggccttcacccgggagtag

SEQ ID NO: 154891 - DNA, 1563 bp, Artificial Sequence
  Description of Artificial Sequence: Synthetic coding sequence
atgacagtgtctgggaagaagcagaccatgggctttgaggtgcctggggtgtccagtgaagaaaatggccacagcttccacaccccccagaagggcccccccattgaagatgccatcgccagcagtgatgtgctggagacagccagcaagagcgccaaccccccccacaccatccaggccagcgaggagcagagcagcaccccagcccctgtgaagaagagcggcaagctgcggcagcagattgatgtgaaggccgagctggagaagaggcagggcggcaagcagctgctgaacctggtggtgattggccacgtggatgctgggaagagcaccctgatgggccacatgctgtacctgctgggcaacatcaacaagaggaccatgcacaagtatgagcaggagagcaagaaggccggcaaggccagctttgcctatgcctgggtgctggatgagaccggggaggagcgggagcggggcgtgaccatggatgtgggcatgaccaagtttgagaccaccaccaaggtgatcaccctgatggatgcccctggccacaaggacttcatccccaacatgatcactggagctgcccaggctgatgtggccgtgctggtggtggatgccagcagaggagaatttgaggccggctttgagaccggcggccagacccgggagcacggcctgctggtgcgcagcctgggcgtgacccagctggccgtggccgtgaacaagatggaccaggtgaactggcagcaggagcgcttccaggagatcaccgggaagctgggccacttcctgaagcaggccggcttcaaggagagtgatgtgggcttcatccccaccagcggcctgagcggggagaacctgatcaccaggagccagagcagcgagctgaccaagtggtacaagggcctgtgcctgctggagcagattgacagcttcaagccaccccagaggagcattgacaagcccttccggctgtgtgtgtctgatgtgttcaaggaccagggcagcggcttctgcatcaccgggaagattgaagctggctacatccagacaggagaccggctgctggccatgcccccaaatgagacctgcaccgtgaagggcatcaccctgcatgatgagcctgtggactgggccgccgccggggaccacgtgtccctgaccctggtgggcatggacatcatcaagatcaacgtgggctgcatcttctgtggccccaaggtgcccatcaaggcctgcacccgcttccgggcccgcatcctgatcttcaacatcgagatccccatcaccaagggcttccctgtgctgctgcactaccagacagtgtctgagcctgctgtgatcaagaggctcatctctgtgctgaacaagagcactggagaggtgaccaagaagaagcccaagttcctgaccaagggccagaatgccctggtggagctgcagacccagaggcccatcgccctggagctgtacaaggacttcaaggagctgggccgcttcatgctgcgctatggaggcagcaccatcgccgccggcgtggtgacagagatcaaggagtag

SEQ ID NO: 154892 - DNA, 1929 bp, Artificial Sequence
  Description of Artificial Sequence: Synthetic coding sequence
atggcccggcacagaaatgtgcggggctacaactatgatgaggactttgaagatgatgacctgtatggccagagcgtggaggatgactactgcatcagccccagcacagcccggctgtacagctgcctggaccacatgagggaggtgctgggagatgctgtgcctgatgagatcctgattgaggccgtgctgaagaacaagtttgatgtgcagaaggccctgtctggagtgctggagcaggacagagtgcagagcctgaaggacaagaatgaggccaccgtgtccacaggcaagatcgccaagggcaagcctgtggacagccagaccagccgctctgagagcgagatcgtgcccaaggtggccaagatgacagtgtctgggaagaagcagaccatgggctttgaggtgcctggggtgtccagtgaagaaaatggccacagcttccacaccccccagaagggcccccccattgaagatgccatcgccagcagtgatgtgctggagacagccagcaagagcgccaaccccccccacaccatccaggccagcgaggagcagagcagcaccccagcccctgtgaagaagagcggcaagctgcggcagcagattgatgtgaaggccgagctggagaagaggcagggcggcaagcagctgctgaacctggtggtgattggccacgtggatgctgggaagagcaccctgatgggccacatgctgtacctgctgggcaacatcaacaagaggaccatgcacaagtatgagcaggagagcaagaaggccggcaaggccagctttgcctatgcctgggtgctggatgagaccggggaggagcgggagcggggcgtgaccatggatgtgggcatgaccaagtttgagaccaccaccaaggtgatcaccctgatggatgcccctggccacaaggacttcatccccaacatgatcactggagctgcccaggctgatgtggccgtgctggtggtggatgccagcagaggagaatttgaggccggctttgagaccggcggccagacccgggagcacggcctgctggtgcgcagcctgggcgtgacccagctggccgtggccgtgaacaagatggaccaggtgaactggcagcaggagcgcttccaggagatcaccgggaagctgggccacttcctgaagcaggccggcttcaaggagagtgatgtgggcttcatccccaccagcggcctgagcggggagaacctgatcaccaggagccagagcagcgagctgaccaagtggtacaagggcctgtgcctgctggagcagattgacagcttcaagccaccccagaggagcattgacaagcccttccggctgtgtgtgtctgatgtgttcaaggaccagggcagcggcttctgcatcaccgggaagattgaagctggctacatccagacaggagaccggctgctggccatgcccccaaatgagacctgcaccgtgaagggcatcaccctgcatgatgagcctgtggactgggccgccgccggggaccacgtgtccctgaccctggtgggcatggacatcatcaagatcaacgtgggctgcatcttctgtggccccaaggtgcccatcaaggcctgcacccgcttccgggcccgcatcctgatcttcaacatcgagatccccatcaccaagggcttccctgtgctgctgcactaccagacagtgtctgagcctgctgtgatcaagaggctcatctctgtgctgaacaagagcactggagaggtgaccaagaagaagcccaagttcctgaccaagggccagaatgccctggtggagctgcagacccagaggcccatcgccctggagctgtacaaggacttcaaggagctgggccgcttcatgctgcgctatggaggcagcaccatcgccgccggcgtggtgacagagatcaaggagtag

SEQ ID NO: 154893 - DNA, 2055 bp, Artificial Sequence
  Description of Artificial Sequence: Synthetic coding sequence
atggcccggcacagaaatgtgcggggctacaactatgatgaggactttgaagatgatgacctgtatggccagagcgtggaggatgactactgcatcagccccagcacagctgcccagttcatctacagccggcgggacaagcccagcgtggagcctgtggaggagtatgactatgaggacctgaaggagagcagcaacagcgtgagcaaccaccagctgagcggctttgaccaggcccggctgtacagctgcctggaccacatgagggaggtgctgggagatgctgtgcctgatgagatcctgattgaggccgtgctgaagaacaagtttgatgtgcagaaggccctgtctggagtgctggagcaggacagagtgcagagcctgaaggacaagaatgaggccaccgtgtccacaggcaagatcgccaagggcaagcctgtggacagccagaccagccgctctgagagcgagatcgtgcccaaggtggccaagatgacagtgtctgggaagaagcagaccatgggctttgaggtgcctggggtgtccagtgaagaaaatggccacagcttccacaccccccagaagggcccccccattgaagatgccatcgccagcagtgatgtgctggagacagccagcaagagcgccaaccccccccacaccatccaggccagcgaggagcagagcagcaccccagcccctgtgaagaagagcggcaagctgcggcagcagattgatgtgaaggccgagctggagaagaggcagggcggcaagcagctgctgaacctggtggtgattggccacgtggatgctgggaagagcaccctgatgggccacatgctgtacctgctgggcaacatcaacaagaggaccatgcacaagtatgagcaggagagcaagaaggccggcaaggccagctttgcctatgcctgggtgctggatgagaccggggaggagcgggagcggggcgtgaccatggatgtgggcatgaccaagtttgagaccaccaccaaggtgatcaccctgatggatgcccctggccacaaggacttcatccccaacatgatcactggagctgcccaggctgatgtggccgtgctggtggtggatgccagcagaggagaatttgaggccggctttgagaccggcggccagacccgggagcacggcctgctggtgcgcagcctgggcgtgacccagctggccgtggccgtgaacaagatggaccaggtgaactggcagcaggagcgcttccaggagatcaccgggaagctgggccacttcctgaagcaggccggcttcaaggagagtgatgtgggcttcatccccaccagcggcctgagcggggagaacctgatcaccaggagccagagcagcgagctgaccaagtggtacaagggcctgtgcctgctggagcagattgacagcttcaagccaccccagaggagcattgacaagcccttccggctgtgtgtgtctgatgtgttcaaggaccagggcagcggcttctgcatcaccgggaagattgaagctggctacatccagacaggagaccggctgctggccatgcccccaaatgagacctgcaccgtgaagggcatcaccctgcatgatgagcctgtggactgggccgccgccggggaccacgtgtccctgaccctggtgggcatggacatcatcaagatcaacgtgggctgcatcttctgtggccccaaggtgcccatcaaggcctgcacccgcttccgggcccgcatcctgatcttcaacatcgagatccccatcaccaagggcttccctgtgctgctgcactaccagacagtgtctgagcctgctgtgatcaagaggctcatctctgtgctgaacaagagcactggagaggtgaccaagaagaagcccaagttcctgaccaagggccagaatgccctggtggagctgcagacccagaggcccatcgccctggagctgtacaaggacttcaaggagctgggccgcttcatgctgcgctatggaggcagcaccatcgccgccggcgtggtgacagagatcaaggagtag

SEQ ID NO: 154894 - DNA, 1227 bp, Artificial Sequence
  Description of Artificial Sequence: Synthetic coding sequence
atgggccacatgctgtacctgctgggcaacatcaacaagaggaccatgcacaagtatgagcaggagagcaagaaggccggcaaggccagctttgcctatgcctgggtgctggatgagaccggggaggagcgggagcggggcgtgaccatggatgtgggcatgaccaagtttgagaccaccaccaaggtgatcaccctgatggatgcccctggccacaaggacttcatccccaacatgatcactggagctgcccaggctgatgtggccgtgctggtggtggatgccagcagaggagaatttgaggccggctttgagaccggcggccagacccgggagcacggcctgctggtgcgcagcctgggcgtgacccagctggccgtggccgtgaacaagatggaccaggtgaactggcagcaggagcgcttccaggagatcaccgggaagctgggccacttcctgaagcaggccggcttcaaggagagtgatgtgggcttcatccccaccagcggcctgagcggggagaacctgatcaccaggagccagagcagcgagctgaccaagtggtacaagggcctgtgcctgctggagcagattgacagcttcaagccaccccagaggagcattgacaagcccttccggctgtgtgtgtctgatgtgttcaaggaccagggcagcggcttctgcatcaccgggaagattgaagctggctacatccagacaggagaccggctgctggccatgcccccaaatgagacctgcaccgtgaagggcatcaccctgcatgatgagcctgtggactgggccgccgccggggaccacgtgtccctgaccctggtgggcatggacatcatcaagatcaacgtgggctgcatcttctgtggccccaaggtgcccatcaaggcctgcacccgcttccgggcccgcatcctgatcttcaacatcgagatccccatcaccaagggcttccctgtgctgctgcactaccagacagtgtctgagcctgctgtgatcaagaggctcatctctgtgctgaacaagagcactggagaggtgaccaagaagaagcccaagttcctgaccaagggccagaatgccctggtggagctgcagacccagaggcccatcgccctggagctgtacaaggacttcaaggagctgggccgcttcatgctgcgctatggaggcagcaccatcgccgccggcgtggtgacagagatcaaggagtag

SEQ ID NO: 154895 - DNA, 840 bp, Artificial Sequence
  Description of Artificial Sequence: Synthetic coding sequence
atgagcctgtttgacctcttccggggcttcttcggcttccctggccccaggagccaccgggaccccttcttcggcggcatgaccagagatgaagatgatgatgaggaggaggaggaggagggcggctcctggggccggggcaacccccgcttccacagcccccagcaccccccagaggagtttggatttggcttctccttcagccctgggggcggcatccgcttccatgacaactttggatttgatgacctggtgcgggacttcaacagcatcttcagtgacatgggcgcctggaccctgcccagccaccccccagagctgcccggccctgagagcgagaccccaggagagcggctgcgggagggccagaccctgcgggacagcatgctgaagtacccagacagccaccagccccgcatctttggaggagtgctggagagtgatgcccggtctgagagcccccagcctgccccagactggggcagccagaggcccttccacagatttgatgatgtgtggcccatggacccccaccccaggaccagagaagataatgacctggacagccaggtgtcccaggagggcctgggccctgtgctgcagccccagcccaagagctacttcaagagcatctctgtgaccaagatcaccaagccagatggcatcgtggaggagaggagaacagtggtggacagcgagggccgcacagagaccaccgtgaccaggcatgaagctgacagcagccccaggggggaccctgagagcccccggcccccagccctggatgatgccttcagcatcctggacctcttcctgggccgctggttccgcagcaggtag

SEQ ID NO: 154896 - DNA, 696 bp, Artificial Sequence
  Description of Artificial Sequence: Synthetic coding sequence
atgagcctgtttgacctcttccggggcttcttcggcttccctggccccaggagcttcagccctgggggcggcatccgcttccatgacaactttggatttgatgacctggtgcgggacttcaacagcatcttcagtgacatgggcgcctggaccctgcccagccaccccccagagctgcccggccctgagagcgagaccccaggagagcggctgcgggagggccagaccctgcgggacagcatgctgaagtacccagacagccaccagccccgcatctttggaggagtgctggagagtgatgcccggtctgagagcccccagcctgccccagactggggcagccagaggcccttccacagatttgatgatgtgtggcccatggacccccaccccaggaccagagaagataatgacctggacagccaggtgtcccaggagggcctgggccctgtgctgcagccccagcccaagagctacttcaagagcatctctgtgaccaagatcaccaagccagatggcatcgtggaggagaggagaacagtggtggacagcgagggccgcacagagaccaccgtgaccaggcatgaagctgacagcagccccaggggggaccctgagagcccccggcccccagccctggatgatgccttcagcatcctggacctcttcctgggccgctggttccgcagcaggtag

SEQ ID NO: 154897 - DNA, 864 bp, Artificial Sequence
  Description of Artificial Sequence: Synthetic coding sequence
atgagcctgtttgacctcttccggggcttcttcggcttccctggccccaggagccaccgggaccccttcttcggcggcatgaccagagatgaagatgatgatgaggaggaggaggaggagggcggctcctggggccggggcaacccccgcttccacagcccccagcaccccccagaggagtttggatttggcttctccttcagccctgggggcggcatccgcttccatgacaactttggatttgatgacctggtgcgggacttcaacagcatcttcagtgacatgggcgcctggaccctgcccagccaccccccagccaacacctgccacctgtctgctgagctgcccggccctgagagcgagaccccaggagagcggctgcgggagggccagaccctgcgggacagcatgctgaagtacccagacagccaccagccccgcatctttggaggagtgctggagagtgatgcccggtctgagagcccccagcctgccccagactggggcagccagaggcccttccacagatttgatgatgtgtggcccatggacccccaccccaggaccagagaagataatgacctggacagccaggtgtcccaggagggcctgggccctgtgctgcagccccagcccaagagctacttcaagagcatctctgtgaccaagatcaccaagccagatggcatcgtggaggagaggagaacagtggtggacagcgagggccgcacagagaccaccgtgaccaggcatgaagctgacagcagccccaggggggaccctgagagcccccggcccccagccctggatgatgccttcagcatcctggacctcttcctgggccgctggttccgcagcaggtag

SEQ ID NO: 154898 - DNA, 1179 bp, Artificial Sequence
  Description of Artificial Sequence: Synthetic coding sequence
atgcagagccctgctgtgctggtgaccagccggcggctgcagaatgcccacacaggcctggacctgactgtgccccagcaccaggaggtgcggggcaagatgatgagcggccacgtggagtaccagatcctggtggtgacccggctggccgccttcaagagcgccaagcacaggccagaagatgtggtgcagttcctggtgtccaagaagtacagcgagattgaggagttctaccagaagctgagcagccgctatgctgctgccagcctgccccccctgcccaggaaggtgctgtttgtgggggagagtgacatccgggagcggcgggctgtgttcaatgagatcctgcgctgtgtgtccaaggatgctgagctggccggcagccctgagctgctggagttcctgggcaccaggagccctggagctgctggcctgaccagccgggacagctctgtgctggatggaacagacagccagacaggaaatgatgaggaggcctttgacttctttgaggagcaggaccaggtggccgaggagggcccccctgtgcagagcctgaagggagaagatgctgaggagagcctggaggaggaggaggccctggaccccctgggcatcatgaggagcaagaagcccaagaagcaccccaaggtggccgtgaaggccaagcccagcccccggctgaccatctttgatgaggaggtggaccctgatgagggcctgtttggacctggcaggaagctgagcccccaggaccccagtgaagatgtgtcctctgtggaccccctgaagctgtttgatgatcctgacctgggcggggccatccccctgggggacagcctgctgctgcctgctgcctgtgagagcggcggccccacccccagcctgagccacagagatgccagcaaggagctgttccgggtggaggaggacctggaccagatcctgaacctgggcgctgagcccaagcccaagccccagctgaagcccaagccccctgtggccgccaagcctgtgatccccaggaagccagctgtgccccccaaggccggccctgctgaggccgtggccggccagcagaagccccaggagcagatccaggccatggatgagatggacatcctgcagtacatccaggaccatgacaccccagcccaggccgcccccagcctcttctag

SEQ ID NO: 154899 - DNA, 654 bp, Artificial Sequence
  Description of Artificial Sequence: Synthetic coding sequence
atgagcctggtgggcggcttcccccaccaccctgtggtgcaccacgagggctacccctttgctgctgctgctgctgctgctgctgctgctgctgccagccgctgcagccatgaggagaacccctacttccacggctggctgattggccaccctgagatgagccccccagactacagcatggccctgagctacagcccagaatatgccagcggggctgctggcctggaccacagccactacggcggcgtgcccccaggagctggccccccaggcctgggcggccccaggcctgtgaagaggcggggcacagccaacaggaaggagaggaggaggacccagagcatcaacagcgcctttgctgagctgcgggagtgcatccccaacgtgcctgctgacaccaagctgagcaagatcaagaccctgcggctggccaccagctacatcgcctacctgatggacctgctggccaaggatgaccagaatggagaggccgaggccttcaaggccgagatcaagaagacagatgtgaaggaggagaagaggaagaaggagctgaatgagatcctgaagagcacagtgagcagcaatgacaagaagaccaagggccgcacaggctggccccagcacgtgtgggccctggagctgaagcagtag

SEQ ID NO: 154900 - DNA, 561 bp, Artificial Sequence
  Description of Artificial Sequence: Synthetic coding sequence
atgagcctggtgggcggcttcccccaccaccctgtggtgcaccacgagggctacccctttgctgctgctgctgctgctgctgctgctgctgctgccagccgctgcagccatgaggagaacccctacttccacggctggctgattggccaccctgagatgagccccccagactacagcatggccctgagctacagcccagaatatgccagcggcacagccaacaggaaggagaggaggaggacccagagcatcaacagcgcctttgctgagctgcgggagtgcatccccaacgtgcctgctgacaccaagctgagcaagatcaagaccctgcggctggccaccagctacatcgcctacctgatggacctgctggccaaggatgaccagaatggagaggccgaggccttcaaggccgagatcaagaagacagatgtgaaggaggagaagaggaagaaggagctgaatgagatcctgaagagcacagtgagcagcaatgacaagaagaccaagggccgcacaggctggccccagcacgtgtgggccctggagctgaagcagtag

SEQ ID NO: 154901 - DNA, 498 bp, Artificial Sequence
  Description of Artificial Sequence: Synthetic coding sequence
atgagccccccagactacagcatggccctgagctacagcccagaatatgccagcggggctgctggcctggaccacagccactacggcggcgtgcccccaggagctggccccccaggcctgggcggccccaggcctgtgaagaggcggggcacagccaacaggaaggagaggaggaggacccagagcatcaacagcgcctttgctgagctgcgggagtgcatccccaacgtgcctgctgacaccaagctgagcaagatcaagaccctgcggctggccaccagctacatcgcctacctgatggacctgctggccaaggatgaccagaatggagaggccgaggccttcaaggccgagatcaagaagacagatgtgaaggaggagaagaggaagaaggagctgaatgagatcctgaagagcacagtgagcagcaatgacaagaagaccaagggccgcacaggctggccccagcacgtgtgggccctggagctgaagcagtag

SEQ ID NO: 154902 - DNA, 2577 bp, Artificial Sequence
  Description of Artificial Sequence: Synthetic coding sequence
atgtctgtggtgggcctggatgtgggcagccagagctgctacatcgctgtggcccgggccggcggcatcgagaccatcgccaatgagttcagtgaccgctgcaccccatctgtcatcagctttggcagcaagaacagaaccatcggcgtggccgccaagaaccagcagatcacccacgccaacaacacagtgagcaacttcaagcgcttccacggccgggccttcaatgaccccttcatccagaaggagaaggagaacctgtcctatgacctggtgcccctgaagaatggaggagtgggcatcaaggtgatgtacatgggagaggagcacctgttctctgtggagcagatcacagccatgctgctgaccaagctgaaggagacagctgagaacagcctgaagaagcctgtgacagactgtgtgatctctgtgcccagcttcttcacagatgctgagaggagatctgtgctggatgctgcccagatcgtgggcctgaactgcctgcggctgatgaatgacatgacagctgtggccctgaactacggcatctacaagcaggacctgcccagcctggatgagaagcccagaattgtggtgtttgtggacatgggccacagcgccttccaggtgtctgcctgtgccttcaacaagggcaagctgaaggtgctgggcacagcctttgaccccttcctgggcggcaagaactttgatgagaagctggtggagcacttctgtgccgagttcaagaccaagtacaagctggatgccaagagcaagatccgggccctgctgcggctgtaccaggagtgtgagaagctgaagaagctgatgagcagcaacagcacagacctgcccctgaacatcgagtgcttcatgaatgacaaggatgtgtctgggaagatgaacagaagccagtttgaggagctgtgtgccgagctgctgcagaagattgaggtgcccctgtacagcctgctggagcagacccacctgaaggtggaggatgtgtctgctgtggagatcgtgggcggggccacccgcatcccagctgtgaaggagcgcatcgccaagttcttcggcaaggacatcagcaccaccctgaatgctgatgaagctgtggcccggggctgtgccctgcagtgtgccatcctgagccctgccttcaaggtgcgggagttctctgtgacagatgctgtgcccttccccatcagcctcatctggaaccacgacagcgaggacacagaaggagtgcatgaggtgttcagcaggaaccacgccgcccccttcagcaaggtgctgaccttcctgcggcggggcccctttgagctggaggccttctacagcgacccccagggcgtgccctacccagaggccaagattggccgctttgtggtgcagaatgtgtctgcccagaaggatggagagaagagccgggtgaaggtgaaggtgcgggtgaacacccacggcatcttcaccatcagcacagcctccatggtggagaaggtgcccacagaagaaaatgagatgagcagcgaggccgacatggagtgcctgaaccagaggcccccagaaaatccagacacagacaagaatgtgcagcaggacaacagcgaggccggcacccagccccaggtgcagacagatgcccagcagaccagccagagcccccccagccctgagctgaccagcgaggagaacaagatcccagatgctgacaaggccaatgagaagaaggtggaccagcccccagaggccaagaagcccaagatcaaggtggtgaatgtggagctgcccatcgaggccaacctggtgtggcagctgggcaaggacctgctgaacatgtacattgaaacagagggcaagatgatcatgcaggacaagctggagaaggagagaaatgatgccaagaatgctgtggaggagtatgtgtatgagttccgggacaagctgtgtggcccctatgagaagttcatctgtgagcaggaccaccagaacttcctgcggctgctgacagaaacagaggactggctgtatgaggagggggaggaccaggccaagcaggcctacgtggacaagctggaggagctgatgaagattggcacccctgtgaaggtgcgcttccaggaggccgaggagcggcccaagatgtttgaggagctgggccagaggctgcagcactacgccaagattgctgctgacttcaggaacaaggatgagaagtacaaccacattgatgagagcgagatgaagaaggtggagaagtctgtgaatgaggtgatggagtggatgaacaacgtgatgaatgcccaggccaagaagagcctggaccaggaccctgtggtgcgggcccaggagatcaagaccaagatcaaggagctgaacaacacctgtgagcctgtggtgacccagcccaagcccaagattgagagccccaagctggagaggaccccaaatggccccaacatcgacaagaaggaggaggacctggaggacaagaacaactttggagctgagcccccccaccagaatggagagtgctacccaaatgagaagaacagcgtgaacatggacctggactag

SEQ ID NO: 154903 - DNA, 414 bp, Artificial Sequence
  Description of Artificial Sequence: Synthetic coding sequence
atgtttgaggagctgggccagaggctgcagcactacgccaagattgctgctgacttcaggaacaaggatgagaagtacaaccacattgatgagagcgagatgaagaaggtggagaagtctgtgaatgaggtgatggagtggatgaacaacgtgatgaatgcccaggccaagaagagcctggaccaggaccctgtggtgcgggcccaggagatcaagaccaagatcaaggagctgaacaacacctgtgagcctgtggtgacccagcccaagcccaagattgagagccccaagctggagaggaccccaaatggccccaacatcgacaagaaggaggaggacctggaggacaagaacaactttggagctgagcccccccaccagaatgacagctgtggcatcgtgaacagctactag

SEQ ID NO: 154904 - DNA, 2034 bp, Artificial Sequence
  Description of Artificial Sequence: Synthetic coding sequence
atgtacatgggagaggagcacctgttctctgtggagcagatcacagccatgctgctgaccaagctgaaggagacagctgagaacagcctgaagaagcctgtgacagactgtgtgatctctgtgctgggcacagcctttgaccccttcctgggcggcaagaactttgatgagaagctggtggagcacttctgtgccgagttcaagaccaagtacaagctggatgccaagagcaagatccgggccctgctgcggctgtaccaggagtgtgagaagctgaagaagctgatgagcagcaacagcacagacctgcccctgaacatcgagtgcttcatgaatgacaaggatgtgtctgggaagatgaacagaagccagtttgaggagctgtgtgccgagctgctgcagaagattgaggtgcccctgtacagcctgctggagcagacccacctgaaggtggaggatgtgtctgctgtggagatcgtgggcggggccacccgcatcccagctgtgaaggagagaattgccaagttcttcggcaaggacatcagcaccaccctgaatgctgatgaggccgtggcccggggctgtgccctgcagtgtgccatcctgagccctgccttcaaggtgcgggagttctctgtgacagatgctgtgcccttccccatcagcctcatctggaaccatgattctgaggacacagagggcgtgcatgaggtgttcagcagaaatcatgctgcccccttcagcaaggtgctgaccttcctgcggcggggcccctttgagctggaggccttctacagcgacccccagggcgtgccctacccagaggccaagattggccgctttgtggtgcagaatgtgtctgcccagaaggatggagagaagagccgggtgaaggtgaaggtgcgggtgaacacccacggcatcttcaccatcagcacagcctccatggtggagaaggtgcccacagaggagaatgagatgagcagcgaggccgacatggagtgcctgaaccagaggcctcctgagaacccagacacagacaagaatgtgcagcaggacaacagcgaggccggcacccagccccaggtgcagacagatgcccagcagaccagccagagcccccccagccctgagctgaccagcgaggagaacaagatcccagatgctgacaaggccaatgagaagaaggtggaccagcccccagaggccaagaagcccaagatcaaggtggtgaatgtggagctgcccatcgaggccaacctggtgtggcagctgggcaaggacctgctgaacatgtacatcgagacagagggcaagatgatcatgcaggacaagctggagaaggagagaaatgatgccaagaatgctgtggaggagtatgtgtatgagttccgggacaagctgtgtggcccctatgagaagttcatctgtgagcaggaccaccagaacttcctgcggctgctgacagaaacagaggactggctgtatgaggagggggaggaccaggccaagcaggcctacgtggacaagctggaggagctgatgaagattggcacccctgtgaaggtgcgcttccaggaggccgaggagcggcccaagatgtttgaggagctgggccagaggctgcagcactacgccaagattgctgctgacttcaggaacaaggatgagaagtacaaccacattgatgaaagtgagatgaagaaggtggagaagtctgtgaatgaggtgatggagtggatgaacaacgtgatgaatgcccaggccaagaagagcctggaccaggaccctgtggtgcgggcccaggagatcaagaccaagatcaaggagctgaacaacacctgtgagcctgtggtgacccagcccaagcccaagattgagagccccaagctggagaggacccccaacggccccaacatcgacaagaaggaggaggacctggaggacaagaacaactttggagctgagcccccccaccagaatggagagtgctacccaaatgagaagaacagcgtgaacatggacctggactag

SEQ ID NO: 154905 - DNA, 1920 bp, Artificial Sequence
  Description of Artificial Sequence: Synthetic coding sequence
atggcccgggagcggccctgccgctgccacggcaatggaggccgcagccctggcaccggctgccccctgggccgcatcttccctgagggcagcagaagaaggaagaggaagtggcacgtggagggccctgtggaggcccccagaaatggccagacccccagggctggagctgagcggggccagggcaggaagaggcggcaggagaagcaggccggcggcatcgagaccatcgccaatgagttcagtgaccgctgcacccccagcgtcatcagctttggcagcaagaacagaaccatcggcgtggccgccaagaaccagcagatcacccacgccaacaacacagtgagcaacttcaagcgcttccacggccgggccttcaatgaccccttcatccagaaggagaaggagaacctgtcctatgacctggtgcccctgaagaatggaggagtgggcatcaaggtgatgtacatgggagaggagcacctgttctctgtggagcagatcacagccatgctgctgaccaagctgaaggagacagctgagaacagcctgaagaagcctgtgacagactgtgtgatctctgtgcccagcttcttcacagatgctgagcggcgctctgtgctggatgctgcccagatcgtgggcctgaactgcctgcggctgatgaatgacatgacagctgtggccctgaactacggcatctacaagcaggacctgcccagcctggatgagaagccccgcatcgtggtgtttgtggacatgggccacagcgccttccaggtgtctgcctgtgccttcaacaagggcaagctgaaggtgctgggcacagcctttgaccccttcctgggcggcaagaactttgatgagaagctggtggagcacttctgtgccgagttcaagaccaagtacaagctggatgccaagagcaagatccgggccctgctgcggctgtaccaggagtgtgagaagctgaagaagctgatgagcagcaacagcacagacctgcccctgaacatcgagtgcttcatgaatgacaaggatgtgtctgggaagatgaacagaagccagtttgaggagctgtgtgccgagctgctgcagaagattgaggtgcccctgtacagcctgctggagcagacccacctgaaggtggaggatgtgtctgctgtggagatcgtgggcggggccacccgcatcccagctgtgaaggagagaattgccaagttcttcggcaaggacatcagcaccaccctgaatgctgatgaggccgtggcccggggctgtgccctgcagtgtgccatcctgagccctgccttcaaggtgcgggagttctctgtgacagatgctgtgcccttccccatcagcctcatctggaaccatgattctgaggacacagagggcgtgcatgaggtgttcagcagaaatcatgctgcccccttcagcaaggtgctgaccttcctgcggcggggcccctttgagctggaggccttctacagcgacccccagggcgtgccctacccagaggccaagattggccgctttgtggtgcagaatgtgtctgcccagaaggatggagagaagagccgggtgaaggtgaaggtgcgggtgaacacccacggcatcttcaccatcagcacagcctccatggtggagaaggtgcccacagaggagaatgagatgagcagcgaggccgacatggagtgcctgaaccagaggcctcctgagaacccagacacagacaagaatgtgcagcaggacaacagcgaggccggcacccagccccaggtgcagacagatgcccagcagaccagccagagcccccccagccctgagctgaccagcgaggagaacaagatcccagatgctgacaagcagatgaagaagaagctgaccagcctgcagaagctgaagagccccaagtag

SEQ ID NO: 154906 - DNA, 2583 bp, Artificial Sequence
  Description of Artificial Sequence: Synthetic coding sequence
atggccacagctgctgtgctgcggggccctgctgcccactgggtggagagcttccagaaggcccgggaggagggcagcggcagcggcacctggaggggccgctggaggagaagaagtgtcatcagctttggcagcaagaacagaaccatcggcgtggccgccaagaaccagcagatcacccacgccaacaacacagtgagcaacttcaagcgcttccacggccgggccttcaatgaccccttcatccagaaggagaaggagaacctgtcctatgacctggtgcccctgaagaatggaggagtgggcatcaaggtgatgtacatgggagaggagcacctgttctctgtggagcagatcacagccatgctgctgaccaagctgaaggagacagctgagaacagcctgaagaagcctgtgacagactgtgtgatctctgtgcccagcttcttcacagatgctgagaggagatctgtgctggatgctgcccagatcgtgggcctgaactgcctgcggctgatgaatgacatgacagctgtggccctgaactacggcatctacaagcaggacctgcccagcctggatgagaagcccagaattgtggtgtttgtggacatgggccacagcgccttccaggtgtctgcctgtgccttcaacaagggcaagctgaaggtgctgggcacagcctttgaccccttcctgggcggcaagaactttgatgagaagctggtggagcacttctgtgccgagttcaagaccaagtacaagctggatgccaagagcaagatccgggccctgctgcggctgtaccaggagtgtgagaagctgaagaagctgatgagcagcaacagcacagacctgcccctgaacatcgagtgcttcatgaatgacaaggatgtgtctgggaagatgaacagaagccagtttgaggagctgtgtgccgagctgctgcagaagattgaggtgcccctgtacagcctgctggagcagacccacctgaaggtggaggatgtgtctgctgtggagatcgtgggcggggccacccgcatcccagctgtgaaggagcgcatcgccaagttcttcggcaaggacatcagcaccaccctgaatgctgatgaagctgtggcccggggctgtgccctgcagtgtgccatcctgagccctgccttcaaggtgcgggagttctctgtgacagatgctgtgcccttccccatcagcctcatctggaaccacgacagcgaggacacagaaggagtgcatgaggtgttcagcaggaaccacgccgcccccttcagcaaggtgctgaccttcctgcggcggggcccctttgagctggaggccttctacagcgacccccagggcgtgccctacccagaggccaagattggccgctttgtggtgcagaatgtgtctgcccagaaggatggagagaagagccgggtgaaggtgaaggtgcgggtgaacacccacggcatcttcaccatcagcacagcctccatggtggagaaggtgcccacagaagaaaatgagatgagcagcgaggccgacatggagtgcctgaaccagaggcccccagaaaatccagacacagacaagaatgtgcagcaggacaacagcgaggccggcacccagccccaggtgcagacagatgcccagcagaccagccagagcccccccagccctgagctgaccagcgaggagaacaagatcccagatgctgacaaggccaatgagaagaaggtggaccagcccccagaggccaagaagcccaagatcaaggtggtgaatgtggagctgcccatcgaggccaacctggtgtggcagctgggcaaggacctgctgaacatgtacattgaaacagagggcaagatgatcatgcaggacaagctggagaaggagagaaatgatgccaagaatgctgtggaggagtatgtgtatgagttccgggacaagctgtgtggcccctatgagaagttcatctgtgagcaggaccaccagaacttcctgcggctgctgacagaaacagaggactggctgtatgaggagggggaggaccaggccaagcaggcctacgtggacaagctggaggagctgatgaagattggcacccctgtgaaggtgcgcttccaggaggccgaggagcggcccaagatgtttgaggagctgggccagaggctgcagcactacgccaagattgctgctgacttcaggaacaaggatgagaagtacaaccacattgatgagagcgagatgaagaaggtggagaagtctgtgaatgaggtgatggagtggatgaacaacgtgatgaatgcccaggccaagaagagcctggaccaggaccctgtggtgcgggcccaggagatcaagaccaagatcaaggagctgaacaacacctgtgagcctgtggtgacccagcccaagcccaagattgagagccccaagctggagaggaccccaaatggccccaacatcgacaagaaggaggaggacctggaggacaagaacaactttggagctgagcccccccaccagaatggagagtgctacccaaatgagaagaacagcgtgaacatggacctggactag

SEQ ID NO: 154907 - DNA, 582 bp, Artificial Sequence
  Description of Artificial Sequence: Synthetic coding sequence
atggacagcaccctggccgtgcagcagtacatccagcagaacatccgggctgactgcagcaacatcgacaagatcctggagcccccagagggccaggatgaaggagtgtggaagtatgagcacctgcggcagttctgcctggagctgaatggcctggccgtgaagctgcagagcgagtgccacccagacacctgcacccagatgacagccacagagcagtggatcttcctgtgtgccgcccacaagacccccaaggagtgcccagccatcgactacaccaggcacaccctggatggagctgcctgcctgctgaacagcaacaagtacttccccagccgggtgtccatcaaggagagctctgtggccaagctgggctctgtgtgccgccgcatctaccgcatcttcagccacgcctacttccaccaccggcagatctttgatgaatatgaaaatgagaccttcctgtgccaccgcttcaccaagtttgtgatgaagtacaacctgatgagcaaggacaacctgattgtgcccatcctggaggaggaggtgcagaacagcgtgtctggagagagcgaggcctag

SEQ ID NO: 154908 - DNA, 306 bp, Artificial Sequence
  Description of Artificial Sequence: Synthetic coding sequence
atggccggccaggccttcaggaagttcctgcccctgtttgacagagtgctggtggagaggtctgctgctgagaccgtgaccaagggcggcatcatgctgcctgagaagagccagggcaaggtgctgcaggccaccgtggtggccgtgggcagcggcagcaagggcaagggcggggagatccagcctgtgtctgtgaaggtgggggacaaggtgctgctgcctgaatatggaggcaccaaggtggtgctggatgacaaggtgtgcaagctgaacaacagcaagaagaagagtgacatctgcaactag

SEQ ID NO: 154909 - DNA, 144 bp, Artificial Sequence
  Description of Artificial Sequence: Synthetic coding sequence
atgggcggggagatccagcctgtgtctgtgaaggtgggggacaaggtgctgctgcctgaatatggaggcaccaaggtggtgctggatgacaaggactacttcctgttcagagatggagacatcctgggcaagtatgtggactag

SEQ ID NO: 154910 - DNA, 591 bp, Artificial Sequence
  Description of Artificial Sequence: Synthetic coding sequence
atggctgatggccagatgcccttcagctgccactaccccagccggctgcggcgggaccccttccgggacagccccctgagcagccggctgctggatgatggcttcggcatggaccccttcccagatgacctgacagcctcctggccagactgggccctgccccggctgagcagcgcctggccaggcaccctgcggagcggcatggtgccccggggccccacagccacagccaggtttggagtgcctgctgagggccgcaccccaccacccttccctggagagccctggaaggtgtgtgtgaatgtgcacagcttcaagccagaggagctgatggtgaagaccaaggatggctacgtggaggtgtctgggaagcatgaggagaagcagcaggagggcggcatcgtgtccaagaacttcaccaagaagatccagctgcctgctgaggtggaccctgtgacagtgtttgccagcctgagccctgagggcctgctgatcatcgaggccccccaggtgcccccctacagcacctttggagagagcagcttcaacaatgagctgccccaggacagccaggaggtgacctgcacctag

SEQ ID NO: 154911 - DNA, 453 bp, Artificial Sequence
  Description of Artificial Sequence: Synthetic coding sequence
atggccaagatcatcctgcggcacctgattgagatccctgtgcgctaccaggaggagtttgaggcccggggcctggaggactgccgcctggaccacgccctgtatgccctgcccggccccaccatcgtggacctgaggaagacccgggccgcccagagcccccctgtggacagcgctgctgagaccccaccccgggagggcaagagccacttccagatcctgctggatgtggtgcagttcctgcctgaggacatcatcatccagacctttgagggctggctgctgatcaaggcccagcacggcaccaggatggatgaacatggcttcatcagccgctccttcacccggcagtacaagctgcctgatggagtggagatcaaggacctgtctgctgtgctgtgccatgatggcatcctggtggtggaggtgaaggaccctgtgggcaccaagtag

SEQ ID NO: 154912 - DNA, 513 bp, Artificial Sequence
  Description of Artificial Sequence: Synthetic coding sequence
atgagccacaggaccagcagcaccttccgggcagagaggagcttccacagcagcagcagcagcagcagcagcagcaccagcagcagcgccagccgggccctgcctgcccaggacccccccatggagaaggccctgtccatgttcagtgatgactttggcagcttcatgaggccccacagcgagcccctggccttccctgcccggcctggaggagctggcaacatcaagaccctgggagatgcctatgaatttgctgtggatgtgcgggacttcagccctgaggacatcatcgtgaccaccagcaacaaccacatcgaggtgcgggcagagaagctggccgcagatggcaccgtgatgaacacctttgcccacaagtgccagctgcctgaagatgtggaccccacctctgtgaccagcgccctgagagaagatggcagcctgaccatccgggcccggcggcacccccacacagaacatgtgcagcagaccttcagaacagagatcaagatctag

SEQ ID NO: 154913 - DNA, 792 bp, Artificial Sequence
  Description of Artificial Sequence: Synthetic coding sequence
atgagcggctgtgagctgagccccctgggcctgcgggtgggcctgtctgctggccctgcccatggaagacgcttccctgcccccagcggcccctggaggggcctgaacctggccagccggcagggcgccggccccaagccccgggacagccggccctacaaggctgctgctgtgggcgcctggcacgcccggcctgaggcctgtgcccacaccctgagctgcccagccctggcccggctgggccgggccaggagaagaccctggatgagccacaggaccagcagcaccttccgggcagagaggagcttccacagcagcagcagcagcagcagcagcagcaccagcagcagcgccagccgggccctgcctgcccaggacccccccatggagaaggccctgtccatgttcagtgatgactttggcagcttcatgaggccccacagcgagcccctggccttccctgctgcccaccccacagcccggcctgggggcgccggcaacatcaagaccctgggagatgcctatgaatttgctgtggatgtgcgggacttctccccagaggacatcatcgtgaccaccagcaacaaccacatcgaggtgcgggcagagaagctggccgcagatggcaccgtgatgaacacctttgcccacaagtgccagctgcctgaagatgtggaccccacctctgtgaccagcgccctgcgggaggatggcagcctgaccatccgggcccggcggcacccccacacagagcacgtgcagcagaccttcagaacagagatcaagatctag

SEQ ID NO: 154914 - DNA, 528 bp, Artificial Sequence
  Description of Artificial Sequence: Synthetic coding sequence
atgagccacaggaccagcagcaccttccgggcagagaggagcttccacagcagcagcagcagcagcagcagcagcaccagcagcagcgccagccgggccctgcctgcccaggacccccccatggagaaggccctgtccatgttcagtgatgactttggcagcttcatgaggccccacagcgagcccctggccttccctgctgcccaccccacagcccggcctgggggcgccggcaacatcaagaccctgggagatgcctatgaatttgctgtggatgtgcgggacttctccccagaggacatcatcgtgaccaccagcaacaaccacatcgaggtgcgggcagagaagctggccgcagatggcaccgtgatgaacacctttgcccacaagtgccagctgcctgaagatgtggaccccacctctgtgaccagcgccctgcgggaggatggcagcctgaccatccgggcccggcggcacccccacacagagcacgtgcagcagaccttcagaacagagatcaagatctag

SEQ ID NO: 154915 - DNA, 207 bp, Artificial Sequence
  Description of Artificial Sequence: Synthetic coding sequence
atgagccacaggaccagcagcaccttccgggcagagaggagcttccacagcagcagcagcagcagcagcagcagcaccagcagcagcgccagccgggccctgcctgcccaggacccccccatggagaaggccctgtccatgttcagtgatgactttggcagcttcatgaggccccacagcgagcccctggccttccctgggaagtag

SEQ ID NO: 154916 - DNA, 1722 bp, Artificial Sequence
  Description of Artificial Sequence: Synthetic coding sequence
atgctgcggctgcccaccgtcttccggcagatgaggcctgtgtcccgggtgctggccccccacctgacccgggcctatgccaaggatgtgaagtttggagcagatgcccgggccctgatgctgcagggcgtggacctgctggctgatgctgtggccgtgaccatgggccccaagggccgcaccgtcatcatcgagcagagctggggcagccccaaggtgaccaaggatggagtgacagtggccaagagcattgacctgaaggacaagtacaagaacattggagccaagctggtgcaggatgtggccaacaacaccaatgaggaggccggagatggcaccaccacagccaccgtgctggcccggagcatcgccaaggagggctttgagaagatcagcaaaggagccaaccctgtggagatcagaagaggagtgatgctggccgtggatgctgtgattgctgagctgaagaagcagagcaagcctgtgaccaccccagaggagatcgcccaggtggccaccatcagcgccaatggagacaaggagatcggcaacatcatcagtgatgccatgaagaaggtgggcaggaagggcgtcatcaccgtgaaggatggcaagaccctgaatgatgagctggagatcatcgagggcatgaagtttgaccggggctacatcagcccctacttcatcaacaccagcaagggccagaagtgtgagttccaggatgcctacgtgctgctgtctgagaagaagatcagcagcatccagagcatcgtgcctgccctggagatcgccaatgcccacaggaagcccctggtgatcatcgccgaggatgtggatggagaggccctgagcaccctggtgctgaaccggctgaaggtgggcctgcaggtggtggccgtgaaggcccctggctttggagacaacaggaagaaccagctgaaggacatggccatcgccaccggcggcgctgtgtttggagaggagggcctgaccctgaacctggaggatgtgcagccccatgacctgggcaaggtgggggaggtgattgtgaccaaggatgatgccatgctgctgaagggcaaaggagacaaggcccagatcgagaagaggatccaggagatcatcgagcagctggatgtgaccaccagtgaatatgagaaggagaagctgaatgaaaggctggccaagctgagtgatggagtggccgtgctgaaggtgggcggcaccagtgatgtggaggtgaatgagaagaaggacagagtgacagatgccctgaatgccaccagggctgctgtggaggagggcatcgtgctgggcggcggctgtgccctgctgcgctgcatcccagccctggacagcctgaccccagccaatgaagaccagaagattggaattgagatcatcaagaggaccctgaagatcccagccatgaccatcgccaagaatgccggcgtggagggcagcctcatcgtggagaagatcatgcagagcagcagcgaggtgggctatgatgccatggccggggactttgtgaacatggtggagaagggcatcatcgaccccaccaaggtggtgaggacagccctgctggatgctgctggggtggccagcctgctgaccacagctgaggtggtggtgacagagatccccaaggaggagaaggaccccggcatgggcgccatgggcggcatgggcggcggcatgggcggcggcatgttttag

SEQ ID NO: 154917 - DNA, 1722 bp, Artificial Sequence; identical to SEQ ID NO: 154916
  Description of Artificial Sequence: Synthetic coding sequence

SEQ ID NO: 154918 - DNA, 177 bp, Artificial Sequence
  Description of Artificial Sequence: Synthetic coding sequence
atgctgcggctgcccaccgtcttccggcagatgaggcctgtgtcccgggtgctggccccccacctgacccgggcctatgccaaggatgtgaagtttggagcagatgcccgggccctgatgctgcagggcgtggacctgctggctgatgctgtggccgtgaccatgggccccaagtag

SEQ ID NO: 154919 - DNA, 285 bp, Artificial Sequence
  Description of Artificial Sequence: Synthetic coding sequence
atgctgcggctgcccaccgtcttccggcagatgaggcctgtgtcccgggtgctggccccccacctgacccgggcctatgccaaggatgtgaagtttggagcagatgcccgggccctgatgctgcagggcgtggacctgctggctgatgctgtggccgtgaccatgggccccaagggccgcaccgtcatcatcgagcagagctggggcagccccaaggtgaccaaggatggagtgacagtggccaagagcattgacctgaaggacaagtacaagaacattggatag

SEQ ID NO: 154920 - DNA, 705 bp, Artificial Sequence
  Description of Artificial Sequence: Synthetic coding sequence
atgctgcggctgcccaccgtcttccggcagatgaggcctgtgtcccgggtgctggccccccacctgacccgggcctatgccaaggatgtgaagtttggagcagatgcccgggccctgatgctgcagggcgtggacctgctggctgatgctgtggccgtgaccatgggccccaagggccgcaccgtcatcatcgagcagagctggggcagccccaaggtgaccaaggatggagtgacagtggccaagagcattgacctgaaggacaagtacaagaacattggagccaagctggtgcaggatgtggccaacaacaccaatgaggaggccggagatggcaccaccacagccaccgtgctggcccggagcatcgccaaggagggctttgagaagatcagcaaaggagccaaccctgtggagatcagaagaggagtgatgctggccgtggatgctgtgattgctgagctgaagaagcagagcaagcctgtgaccaccccagaggagatcgcccaggtggccaccatcagcgccaatggagacaaggagatcggcaacatcatcagtgatgccatgaagaaggtgggcaggaagggcgtcatcacagatggcaagaccctgaatgatgagctggagatcatcgagggcatgaagtttgaccggggctacatcagcccctacttcatcaacaccagcaagggcaagaactag

SEQ ID NO: 154921 - DNA, 252 bp, Artificial Sequence
  Description of Artificial Sequence: Synthetic coding sequence
atgctgcggctgcccaccgtcttccggcagatgaggcctgtgtcccgggtgctggccccccacctgacccgggcctatgccaaggatgtgaagtttggagcagatgcccgggccctgatgctgcagggcgtggacctgctggctgatgctgtggccgtgaccatgggccccaagggccgcaccgtcatcatcgagcagagctggggcagccccaaggtgaccaaggatggagtgacagtggccaagagctag

SEQ ID NO: 154922 - DNA, 666 bp, Artificial Sequence
  Description of Artificial Sequence: Synthetic coding sequence
atgctgcggctgcccaccgtcttccggcagatgaggcctgtgtcccgggtgctggccccccacctgacccgggcctatgccaaggatgtgaagtttggagcagatgcccgggccctgatgctgcagggcgtggacctgctggctgatgctgtggccgtgaccatgggccccaagggccgcaccgtcatcatcgagcagagctggggcagccccaaggtgaccaaggatggagtgacagtggccaagagcattgacctgaaggacaagtacaagaacattggagccaagctggtgcaggatgtggccaacaacaccaatgaggaggccggagatggcaccaccacagccaccgtgctggcccggagcatcgccaaggagggctttgagaagatcagcaaaggagccaaccctgtggagatcagaagaggagtgatgctggccgtggatgctgtgattgctgagctgaagaagcagagcaagcctgtgaccaccccagaggagatcgcccaggtggccaccatcagcgccaatggagacaaggagatcggcaacatcatcagtgatgccatgaagaaggtgggcaggaagggcgtcatcaccgtgaaggatggcaagaccctgaatgatgagctggagatcatcgagggcatgaagtttgacagatag

SEQ ID NO: 154923 - DNA, 738 bp, Artificial Sequence
  Description of Artificial Sequence: Synthetic coding sequence
atgctggccgtggatgctgtgattgctgagctgaagaagcagagcaagcctgtgaccaccccagaggagatcgcccaggtggccaccatcagcgccaatggagacaaggagatcggcaacatcatcagtgatgccatgaagaaggtgggcaggaagggcgtcatcaccgtgaaggatggcaagaccctgaatgatgagctggagatcatcgagggcatgaagtttgaccggggctacatcagcccctacttcatcaacaccagcaagggccagaagtgtgagttccaggatgcctacgtgctgctgtctgagaagaagatcagcagcatccagagcatcgtgcctgccctggagatcgccaatgcccacaggaagcccctggtgatcatcgccgaggatgtggatggagaggccctgagcaccctggtgctgaaccggctgaaggtgggcctgcaggtggtggccgtgaaggcccctggctttggagacaacaggaagaaccagctgaaggacatggccatcgccaccggcggcgctgtgtttggagaggagggcctgaccctgaacctggaggatgtgcagccccatgacctgggcaaggtgggggaggtgattgtgaccaaggatgatgccatgctgctgaagggcaaaggagacaaggcccagatcgagaagaggatccaggagatcatcgagcagctggatgtgaccaccagtgaatatgagaaggagaactag

SEQ ID NO: 154924 - DNA, 477 bp, Artificial Sequence
  Description of Artificial Sequence: Synthetic coding sequence
atgctgcggctgcccaccgtcttccggcagatgaggcctgtgtcccgggtgctggccccccacctgacccgggcctatgccaaggatgtgaagtttggagcagatgcccgggccctgatgctgcagggcgtggacctgctggctgatgctgtggccgtgaccatgggccccaagggccgcaccgtcatcatcgagcagagctggggcagccccaaggtgaccaaggatggagtgacagtggccaagagcattgacctgaaggacaagtacaagaacattggagccaagctggtgcaggatgtggccaacaacaccaatgaggaggccggagatggcaccaccacagccaccgtgctggcccggagcatcgccaaggagggctttgagaagatcagcaaaggagccaaccctgtggagatcagaagaggaagaaatgtgtgctgccaccacagcgtgctgaacttctctgtgctgtag

SEQ ID NO: 154925 - DNA, 2061 bp, Artificial Sequence
  Description of Artificial Sequence: Synthetic coding sequence
atgctggccgtgcctgagatgggcctgcagggcctgtacatcggcagcagccctgagaggagccctgtgcccagccccccaggcagccccaggacccaggagagctgtggcatcgcccccctgacccccagccagagccccaagccagaggtgcgggccccccagcaggccagcttctctgtggtggtggccatcgactttggcaccaccagcagcggctacgccttctcctttgccagtgaccctgaggccatccacatgatgaggaagtgggagggcggggaccccggggtggcccaccagaagacccccacctgcctgctgctgaccccagagggcgccttccacagctttggctacacagcccgggactactaccatgacctggaccctgaggaggcccgggactggctgtactttgagaagttcaagatgaagatccacagcgccacagacctgaccctgaagacccagctggaggccgtgaatggcaagaccatgcctgccctggaggtgtttgcccacgccctgcgcttcttccgggagcacgccctgcaggagctgcgggagcagagccccagcctgcctgagaaggacacagtgcgctgggtgctgactgtgcctgccatctggaagcagcctgccaagcagttcatgagggaggccgcctacctggccggcctggtgtcccgggagaatgctgagcagctgctgattgccctggagcctgaggccgcctctgtgtactgcaggaagctgcggctgcaccagctgctggacctgagcggccgggcccctgggggcggccgcctgggggagcggcgcagcattgacagcagcttccggcaggcccgggagcagctgcggcgcagccgccacagcaggaccttcctggtggagagcggcgtgggggagctgtgggccgagatgcaggccggggaccgctacgtggtggccgactgtggcggcggcaccgtggacctgactgtgcaccagctggagcagccccacggcaccctgaaggagctgtacaaggccagcggcggcccctatggagctgtgggcgtggacctggcctttgagcagctgctgtgccgcatctttggagaggacttcatcgccaccttcaagaggcagaggcctgctgcctgggtggacctgaccatcgcctttgaggccaggaagaggacagctggcccccacagagctggggccctgaacatcagcctgcccttctccttcatcgacttctacaggaagcagaggggccacaacgtggagacagccctgcggcgcagctctgtgaactttgtgaagtggagcagccagggcatgctgaggatgagctgtgaggccatgaatgagctgttccagcccaccgtgtctggcatcatccagcacatcgaggccctgctggcccggcctgaggtgcagggcgtgaagctgctcttcctggtgggcggctttgctgagagcgctgtgctgcagcacgctgtgcaggccgccctgggcgcccggggcctgcgggtggtggtgccccatgatgtgggcctgaccatcctgaagggagctgtgctgtttggccaggcccctggggtggtgcgggtgagaagaagccccctgacctatggagtgggcgtgctgaacagatttgtgcccggccgccaccccccagagaagctgctggtgagagatggaagacgctggtgcacagatgtgtttgaaagatttgtggccgctgagcagagcgtggccctgggggaggaggtgagaagaagctactgcccagcccggcccggccagaggagagtgctgatcaacctgtactgctgtgccgcagaagatgcccgcttcatcacagaccccggggtgaggaaatgtggggccctgagcctggagctggagcctgctgactgtggccaggacacagctggggcccctcctggccggcgggagatccgggccgccatgcagtttggagacacagagatcaaggtgacagctgtggatgtgtccaccaacagatctgtgcgggccagcattgacttcctgagcaactag

SEQ ID NO: 154926 - DNA, 1803 bp, Artificial Sequence
  Description of Artificial Sequence: Synthetic coding sequence
atgatgaggaagtgggagggcggggaccccggggtggcccaccagaagacccccacctgcctgctgctgaccccagagggcgccttccacagctttggctacacagcccgggactactaccatgacctggaccctgaggaggcccgggactggctgtactttgagaagttcaagatgaagatccacagcgccacagacctgaccctgaagacccagctggaggccgtgaatggcaagaccatgcctgccctggaggtgtttgcccacgccctgcgcttcttccgggagcacgccctgcaggagctgcgggagcagagccccagcctgcctgagaaggacacagtgcgctgggtgctgactgtgcctgccatctggaagcagcctgccaagcagttcatgagggaggccgcctacctggccggcctggtgtcccgggagaatgctgagcagctgctgattgccctggagcctgaggccgcctctgtgtactgcaggaagctgcggctgcaccagctgctggacctgagcggccgggcccctgggggcggccgcctgggggagcggcgcagcattgacagcagcttccggcaggcccgggagcagctgcggcgcagccgccacagcaggaccttcctggtggagagcggcgtgggggagctgtgggccgagatgcaggccggggaccgctacgtggtggccgactgtggcggcggcaccgtggacctgactgtgcaccagctggagcagccccacggcaccctgaaggagctgtacaaggccagcggcggcccctatggagctgtgggcgtggacctggcctttgagcagctgctgtgccgcatctttggagaggacttcatcgccaccttcaagaggcagaggcctgctgcctgggtggacctgaccatcgcctttgaggccaggaagaggacagctggcccccacagagctggggccctgaacatcagcctgcccttctccttcatcgacttctacaggaagcagaggggccacaacgtggagacagccctgcggcgcagctctgtgaactttgtgaagtggagcagccagggcatgctgaggatgagctgtgaggccatgaatgagctgttccagcccaccgtgtctggcatcatccagcacatcgaggccctgctggcccggcctgaggtgcagggcgtgaagctgctcttcctggtgggcggctttgctgagagcgctgtgctgcagcacgctgtgcaggccgccctgggcgcccggggcctgcgggtggtggtgccccatgatgtgggcctgaccatcctgaagggagctgtgctgtttggccaggcccctggggtggtgcgggtgagaagaagccccctgacctatggagtgggcgtgctgaacagatttgtgcccggccgccaccccccagagaagctgctggtgagagatggaagacgctggtgcacagatgtgtttgaaagatttgtggccgctgagcagagcgtggccctgggggaggaggtgagaagaagctactgcccagcccggcccggccagaggagagtgctgatcaacctgtactgctgtgccgcagaagatgcccgcttcatcacagaccccggggtgaggaaatgtggggccctgagcctggagctggagcctgctgactgtggccaggacacagctggggcccctcctggccggcgggagatccgggccgccatgcagtttggagacacagagatcaaggtgacagctgtggatgtgtccaccaacagatctgtgcgggccagcattgacttcctgagcaactag

SEQ ID NO: 154927 - DNA, 1563 bp, Artificial Sequence
  Description of Artificial Sequence: Synthetic coding sequence
atgcctgccctggaggtgtttgcccacgccctgcgcttcttccgggagcacgccctgcaggagctgcgggagcagagccccagcctgcctgagaaggacacagtgcgctgggtgctgactgtgcctgccatctggaagcagcctgccaagcagttcatgagggaggccgcctacctggccggcctggtgtcccgggagaatgctgagcagctgctgattgccctggagcctgaggccgcctctgtgtactgcaggaagctgcggctgcaccagctgctggacctgagcggccgggcccctgggggcggccgcctgggggagcggcgcagcattgacagcagcttccggcaggcccgggagcagctgcggcgcagccgccacagcaggaccttcctggtggagagcggcgtgggggagctgtgggccgagatgcaggccggggaccgctacgtggtggccgactgtggcggcggcaccgtggacctgactgtgcaccagctggagcagccccacggcaccctgaaggagctgtacaaggccagcggcggcccctatggagctgtgggcgtggacctggcctttgagcagctgctgtgccgcatctttggagaggacttcatcgccaccttcaagaggcagaggcctgctgcctgggtggacctgaccatcgcctttgaggccaggaagaggacagctggcccccacagagctggggccctgaacatcagcctgcccttctccttcatcgacttctacaggaagcagaggggccacaacgtggagacagccctgcggcgcagctctgtgaactttgtgaagtggagcagccagggcatgctgaggatgagctgtgaggccatgaatgagctgttccagcccaccgtgtctggcatcatccagcacatcgaggccctgctggcccggcctgaggtgcagggcgtgaagctgctcttcctggtgggcggctttgctgagagcgctgtgctgcagcacgctgtgcaggccgccctgggcgcccggggcctgcgggtggtggtgccccatgatgtgggcctgaccatcctgaagggagctgtgctgtttggccaggcccctggggtggtgcgggtgagaagaagccccctgacctatggagtgggcgtgctgaacagatttgtgcccggccgccaccccccagagaagctgctggtgagagatggaagacgctggtgcacagatgtgtttgaaagatttgtggccgctgagcagagcgtggccctgggggaggaggtgagaagaagctactgcccagcccggcccggccagaggagagtgctgatcaacctgtactgctgtgccgcagaagatgcccgcttcatcacagaccccggggtgaggaaatgtggggccctgagcctggagctggagcctgctgactgtggccaggacacagctggggcccctcctggccggcgggagatccgggccgccatgcagtttggagacacagagatcaaggtgacagctgtggatgtgtccaccaacagatctgtgcgggccagcattgacttcctgagcaactag

SEQ ID NO: 154928 - DNA, 2028 bp, Artificial Sequence
  Description of Artificial Sequence: Synthetic coding sequence
atggctgacaaggaggccggcggcagtgatggcccccgggagacagcccccaccagcgcctacagcagccctgcccggagcctgggggacaccggcatcacccccctgagccccagccacatcgtgaatgacacagacagcaatgtgtctgagcagcagagcttcctggtggtggtggccgtggactttggcaccaccagcagcggctacgcctacagcttcaccaaggagcctgagtgcatccacgtgatgaggcgctgggagggcggggaccccggggtgagcaaccagaagacccccaccaccatcctgctgaccccagagaggaagttccacagctttggctatgctgcccgggacttctaccatgacctggaccccaatgaggccaagcagtggctgtacctggagaagttcaagatgaagctgcacaccaccggggacctgaccatggacacagacctgacagctgccaacgggaagaaggtgaaggccctggagatctttgcctatgccctgcagtacttcaaggagcaggccctgaaggagctgagtgaccaggccggcagcgagtttgaaaattctgatgtgcgctgggtgatcaccgtgcctgccatctggaagcagcctgccaagcagttcatgaggcaggccgcctaccaggccggcctggccagccctgagaacagcgagcagctgatcatcgccctggagcctgaggccgccagcatctactgcaggaagctgcggctgcaccagatgattgagctgagcagcaaggctgctgtgaatggctacagcggcagtgacacagtgggcgccggcttcacccaggccaaggagcacatcagaagaaaccggcagagcaggaccttcctggtggagaatgtcatcggggagatctggagcgagctggaggagggggacaagtatgtggtggtggacagcggcggcggcaccgtggacctgactgtgcaccagatccggctgcctgagggccacctgaaggagctgtacaaggccaccggcggcccctacggcagcctgggcgtggactatgaatttgagaagctgctgtacaagatctttggagaggacttcatcgagcagttcaagatcaagaggcctgctgcctgggtggacctgatgattgcctttgagagcaggaagagagctgctgccccagacaggaccaaccccctgaacatcaccctgcccttctccttcatcgactactacaagaagttccggggccacagcgtggagcacgccctgaggaagagcaatgtggactttgtgaagtggagcagccagggcatgctgaggatgagcccagatgccatgaatgccctcttcaagcccaccatcgacagcatcatcgagcacctgcgggacctcttccagaagccagaggtgtccacagtgaagttcctgttcctggtgggcggctttgctgaggcccccctgctgcagcaggccgtgcaggccgccttcggggaccagtgccgcatcatcatcccccaggatgtgggcctgaccatcctgaagggagctgtgctgtttggcctggaccctgctgtgatcaaggtgagaagaagccccctgacctatggagtgggcgtgctgaacagatatgtggagggcaagcaccccccagagaagctgctggtgaaggatggcacccgctggtgcacagatgtgtttgacaagttcatctctgctgaccagagcgtggccctgggggagctggtgaagaggagctacaccccagccaagcccagccagctggtgattgtcatcaacatctacagcagcgagcatgacaacgtgtccttcatcacagaccccggggtgaagaagtgtggcaccctgcggctggacctgaccggcaccagcggcacagctgtgcctgcccggcgggagatccagaccctgatgcagtttggagacacagagatcaaggccacagccatcgacatcgccaccagcaagtctgtgaaggtgggcatcgacttcctgaactactag

SEQ ID NO: 154929 - DNA, 819 bp, Artificial Sequence
  Description of Artificial Sequence: Synthetic coding sequence
atgaggagcctggacctggccagccagctgctgaggaaccagatcgtgacagatcctgacaacctgatggaggatgctgcctgggccaagcactgtgaccagaacctggtggccagtgatgcccctggagaggagggcaccggcatcctgaagagcaagaggacccaggccgctgaccaccagcccatcctgaagacagtgaaggccagtgatgaggactgccagctgcgcatcagtgaccgcatccgggagaccagtgacctggaggacagctgggatgagagcagcggggccggctgcagccagggcacccccagctacagcagcagccacagcctcttcagaggagctgtggccccctgccagagcagccccatggcccggctgggcgtgtctggagagcccagcccctgcaccagcaccaacagaagcaccccaggagtggccagcaccccccagacccctgtgagcagcagcagagctggctttgtgtctggaggagaccggcccctgaccagcgagcccccaccccgctgggccaggagaagaagaagatctgtggcccggaccatcgctgctgagctggctgaaaatagaaggctggcccgggagctgagcaagcgggaggaggagaagctggaccggctgattgccatcggggaggaggccagcgcccagcaggacacagccaatgagctgcggagagatgctgtgattgctgtgcggcggctggccacagctgtggaggaggccaccggggccttccagctgggcctggagaagctgctgcagaggctcatcagcaacaccaagagctag

SEQ ID NO: 154930 - DNA, 1530 bp, Artificial Sequence
  Description of Artificial Sequence: Synthetic coding sequence
atggccgccatcggcgtgcacctgggctgcaccagcgcctgtgtggccgtgtacaaggatggccgggccggcgtggtggccaatgatgctggggacagagtgaccccagctgtggtggcctacagtgaaaatgaggagatcgtgggcctggccgccaagcagagccgcatccggaacatcagcaacacagtgatgaaggtgaagcagatcctgggccgcagcagcagtgacccccaggcccagaagtacatcgccgagagcaagtgcctggtgattgagaagaatggcaagctgcgctatgaaattgacaccggggaggagaccaagtttgtgaacccagaagatgtggcccggctcatcttcagcaagatgaaggagacagcccacagcgtgctgggcagtgatgccaatgatgtggtgatcaccgtgccctttgattttggagagaagcagaagaatgccctgggggaggccgcccgggccgccggcttcaacgtgctgcggctcatccacgagcccagcgctgccctgctggcctacggcatcggccaggacagccccaccgggaagagcaacatcctggtgttcaagctgggcggcaccagcctgagcctgtctgtgatggaggtgaacagcggcatctacagagtgctgagcaccaacacagatgacaacatcggcggggcccacttcacagagaccctggcccagtacctggccagcgagttccagaggagcttcaagcatgatgtgagaggaaatgcccgggccatgatgaagctgaccaacagcgctgaggtggccaagcacagcctgagcaccctgggcagcgccaactgcttcctggacagcctgtatgagggccaggactttgactgcaatgtgtcccgggccaggtttgagctgctgtgcagccccctcttcaacaagtgcatcgaggccatccggggcctgctggaccagaatggcttcaccgcagatgacatcaacaaggtggtgctgtgtggcggcagcagccgcatccccaagctgcagcagctgatcaaggacctcttccctgctgtggagctgctgaacagcatccccccagatgaggtgatccccatcggggccgccattgaagctggcatcctgattggcaaggagaacctgctggtggaggacagcctgatgattgaatgttctgcccgggacatcctggtgaagggcgtggatgaaagtggggccagccgcttcaccgtgctcttccccagcggcacccccctgcctgcccggcggcagcacaccctgcaggcccctggcagcatcagctctgtgtgcctggagctgtatgaaagtgatggcaagaacagcgccaaggaggagaccaagtttgcccaggtggtgctgcaggacctggacaagaaggaaaatggcctgcgggacatcctggccgtgctgaccatgaagagagatggcagcctgcacgtgacctgcacagaccaggagactggaaaatgtgaggccatcagcattgaaattgccagctag

SEQ ID NO: 154931 - DNA, 432 bp, Artificial Sequence
  Description of Artificial Sequence: Synthetic coding sequence
atggccgccatcggcgtgcacctgggctgcaccagcgcctgtgtggccgtgtacaaggatggccgggccggcgtggtggccaatgatgctggggacagagtgaccccagctgtggtggcctacagtgaaaatgaggagatcgtgggcctggccgccaagcagagccgcatccggaacatcagcaacacagtgatgaaggtgaagcagatcctgggcagaagagtgctgagccgggacccccagctgcagcagctgccccagcccttccagcgctgcagctgcagcctgtctgagcagccccacggccagacaggctgtgtgcggggggcccagcccctgcaccagcaccagccccagcacagctggggcagcctgcacacagctgacagcagcctgctgtttgagagctggttctgcttctggtggggctag

SEQ ID NO: 154932 - DNA, 387 bp, Artificial Sequence
  Description of Artificial Sequence: Synthetic coding sequence
tgagcctgtgtggccgtgtacaaggatggccgggccggcgtggtggccaatgatgctggggacagagtgaccccagctgtggtggcctacagtgaaaatgaggagatcgtgggcctggccgccaagcagagccgcatccggaacatcagcaacacagtgatgaaggtgaagcagatcctgggccgcagcagcagtgacccccaggcccagaagtacatcgccgagagcaagtgcctggtgattgagaagaatggcaagctgcgctatgaaattgacacaggagaggagaccaagtttgtgaacccagaagatgtggcccggctcatcttcagcaagatgaagggggcctacagcccctggagccagagcaacagtgaagatggatag

SEQ ID NO: 154933 - DNA, 1926 bp, Artificial Sequence
  Description of Artificial Sequence: Synthetic coding sequence
atggccaaggctgctgccatcggcatcgacctgggcaccacctacagctgtgtgggcgtcttccagcacggcaaggtggagatcatcgccaatgaccagggcaacagaaccacccccagctatgtggccttcacagacacagagcggctgattggagatgctgccaagaaccaggtggccctgaacccccagaacacagtgtttgatgccaagaggctcatcggcaggaagtttggagaccctgtggtgcagagcgacatgaagcactggcccttccaggtgatcaatgatggagacaagcccaaggtgcaggtgtcctacaagggggagaccaaggccttctacccagaggagatcagctccatggtgctgaccaagatgaaggagattgctgaggcctacctgggctaccctgtgaccaatgctgtgatcaccgtgcctgcctacttcaatgacagccagaggcaggccaccaaggatgctggggtgattgctggcctgaatgtgctgcgcatcatcaatgagcccacagctgctgccatcgcctacggcctggacagaacaggcaagggggagagaaatgtgctgatctttgacctgggcggcggcacctttgatgtgtccatcctgaccattgatgatggcatctttgaggtgaaggccacagctggggacacccacctgggcggagaagattttgacaaccggctggtgaaccactttgtggaggagttcaagaggaagcacaagaaggacatcagccagaacaagagagctgtgcggcggctgaggacagcctgtgagcgggccaagaggaccctgagcagcagcacccaggccagcctggagattgacagcctgtttgagggcatcgacttctacaccagcatcacccgggccaggtttgaggagctgtgcagcgacctcttccgcagcaccctggagcctgtggagaaggccctgagagatgccaagctggacaaggcccagatccatgacctggtgctggtgggcggcagcacccgcatccccaaggtgcagaagctgctgcaggacttcttcaacggccgggacctgaacaagagcatcaacccagatgaggccgtggcctatggagctgctgtgcaggccgccatcctgatgggagacaagtcagaaaatgtgcaggacctgctgctgctggatgtggcccccctgagcctgggcctggagacagctgggggcgtgatgacagccctgatcaagaggaacagcaccatccccaccaagcagacccagatcttcaccacctacagcgacaaccagcccggggtgctgatccaggtgtatgaaggagagcgggccatgaccaaggacaacaacctgctgggccgctttgagctgagcggcatccccccagccccccggggcgtgccccagatcgaggtgacctttgatattgatgccaacggcatcctgaatgtgacagccacagacaagagcacaggcaaggccaacaagatcaccatcaccaatgacaagggccgcctgagcaaggaggagattgaaagaatggtgcaggaggccgagaagtacaaggccgaggatgaggtgcagcgggagcgggtgtctgccaagaatgccctggagagctatgccttcaacatgaagtctgctgtggaggatgagggcctgaagggcaagatcagcgaggccgacaagaagaaggtgctggacaagtgccaggaggtgatctcctggctggatgccaacaccctggccgagaaggatgaatttgagcacaagaggaaggagctggagcaggtgtgcaaccccatcatcagcggcctgtaccagggcgctgggggccctggccctgggggctttggagcccagggccccaagggcggcagcggcagcggccccaccatcgaggaggtggactag

SEQ ID NO: 154934 - DNA, 1431 bp, Artificial Sequence
  Description of Artificial Sequence: Synthetic coding sequence
atggccaaggctgctgccatcggcatcgacctgggcaccacctacagctgtgtgggcgtcttccagcacggcaaaggagagagaaatgtgctgatctttgacctgggcggcggcacctttgatgtgtccatcctgaccattgatgatggcatctttgaggtgaaggccacagctggggacacccacctgggcggggaggactttgacaaccggctggtgaaccactttgtggaggagttcaagaggaagcacaagaaggacatcagccagaacaagagagctgtgcggcggctgaggacagcctgtgagcgggccaagaggaccctgagcagcagcacccaggccagcctggagattgacagcctgtttgagggcatcgacttctacaccagcatcacccgggccaggtttgaggagctgtgcagcgacctcttccgcagcaccctggagcctgtggagaaggccctgagagatgccaagctggacaaggcccagatccatgacctggtgctggtgggcggcagcacccgcatccccaaggtgcagaagctgctgcaggacttcttcaacggccgggacctgaacaagagcatcaacccagatgaagctgtggcctacggggctgctgtgcaggccgccatcctgatgggagacaagtcagaaaatgtgcaggacctgctgctgctggatgtggcccccctgagcctgggcctggagacagctggaggagtgatgacagccctgatcaagaggaacagcaccatccccaccaagcagacccagatcttcaccacctacagcgacaaccagcccggggtgctgatccaggtgtatgaaggagagcgggccatgaccaaggacaacaacctgctgggccgctttgagctgagcggcatccccccagccccccggggcgtgccccagatcgaggtgacctttgatattgatgccaacggcatcctgaatgtgacagccacagacaagagcacaggcaaggccaacaagatcaccatcaccaatgacaagggccgcctgagcaaggaggagattgaaagaatggtgcaggaggccgagaagtacaaggcagaagatgaggtgcagcgggagcgggtgtctgccaagaatgccctggagagctatgccttcaacatgaagtctgctgtggaggatgagggcctgaagggcaagatcagcgaggccgacaagaagaaggtgctggacaagtgccaggaggtgatctcctggctggatgccaacaccctggccgagaaggatgaatttgagcacaagaggaaggagctggagcaggtgtgcaaccccatcatcagcggcctgtaccagggcgccggcggccctggccctgggggctttggagcccagggccccaagggcggcagcggcagcggccccaccatcgaggaggtggactag

SEQ ID NO: 154935 - DNA, 1431 bp, Artificial Sequence; identical to SEQ ID NO: 154934
  Description of Artificial Sequence: Synthetic coding sequence

SEQ ID NO: 154936 - DNA, 1926 bp, Artificial Sequence
  Description of Artificial Sequence: Synthetic coding sequence
atggccaaggctgctgccatcggcatcgacctgggcaccacctacagctgtgtgggcgtcttccagcacggcaaggtggagatcatcgccaatgaccagggcaacagaaccacccccagctatgtggccttcacagacacagagcggctgattggagatgctgccaagaaccaggtggccctgaacccccagaacacagtgtttgatgccaagaggctcatcggcaggaagtttggagaccctgtggtgcagagcgacatgaagcactggcccttccaggtgatcaatgatggagacaagcccaaggtgcaggtgtcctacaagggggacaccaaggccttctacccagaggagatcagctccatggtgctgaccaagatgaaggagattgctgaggcctacctgggctaccctgtgaccaatgctgtgatcaccgtgcctgcctacttcaatgacagccagaggcaggccaccaaggatgctggggtgattgctggcctgaatgtgctgcgcatcatcaatgagcccacagctgctgccatcgcctacggcctggacagaacaggcaagggggagagaaatgtgctgatctttgacctgggcggcggcacctttgatgtgtccatcctgaccattgatgatggcatctttgaggtgaaggccacagctggggacacccacctgggcggagaagattttgacaaccggctggtgaaccactttgtggaggagttcaagaggaagcacaagaaggacatcagccagaacaagagagctgtgcggcggctgaggacagcctgtgagcgggccaagaggaccctgagcagcagcacccaggccagcctggagattgacagcctgtttgagggcatcgacttctacaccagcatcacccgggccaggtttgaggagctgtgcagcgacctcttccgcagcaccctggagcctgtggagaaggccctgagagatgccaagctggacaaggcccagatccatgacctggtgctggtgggcggcagcacccgcatccccaaggtgcagaagctgctgcaggacttcttcaacggccgggacctgaacaagagcatcaacccagatgaggccgtggcctatggagctgctgtgcaggccgccatcctgatgggagacaagtcagaaaatgtgcaggacctgctgctgctggatgtggcccccctgagcctgggcctggagacagctgggggcgtgatgacagccctgatcaagaggaacagcaccatccccaccaagcagacccagatcttcaccacctacagcgacaaccagcccggggtgctgatccaggtgtatgaaggagagcgggccatgaccaaggacaacaacctgctgggccgctttgagctgagcggcatccccccagccccccggggcgtgccccagatcgaggtgacctttgatattgatgccaacggcatcctgaatgtgacagccacagacaagagcacaggcaaggccaacaagatcaccatcaccaatgacaagggccgcctgagcaaggaggagattgaaagaatggtgcaggaggccgagaagtacaaggccgaggatgaggtgcagcgggagcgggtgtctgccaagaatgccctggagagctatgccttcaacatgaagtctgctgtggaggatgagggcctgaagggcaagatcagcgaggccgacaagaagaaggtgctggacaagtgccaggaggtgatctcctggctggatgccaacaccctggccgagaaggatgaatttgagcacaagaggaaggagctggagcaggtgtgcaaccccatcatcagcggcctgtaccagggcgctgggggccctggccctgggggctttggagcccagggccccaagggcggcagcggcagcggccccaccatcgaggaggtggactag

SEQ ID NO: 154937 - DNA, 1431 bp, Artificial Sequence; identical to SEQ ID NO: 154934
  Description of Artificial Sequence: Synthetic coding sequence

SEQ ID NO: 154938 - DNA, 1926 bp, Artificial Sequence; identical to SEQ ID NO: 154933
  Description of Artificial Sequence: Synthetic coding sequence

SEQ ID NO: 154939 - DNA, 1926 bp, Artificial Sequence; identical to SEQ ID NO: 154933
  Description of Artificial Sequence: Synthetic coding sequence

SEQ ID NO: 154940 - DNA, 699 bp, Artificial Sequence
  Description of Artificial Sequence: Synthetic coding sequence
atggccaaggctgctgccatcggcatcgacctgggcaccacctacagctgtgtgggcgtcttccagcacggcaaggtggagatcatcgccaatgaccagggcaacagaaccacccccagctatgtggccttcacagacacagagcggctgattggagatgctggggtgattgctggcctgaatgtgctgcgcatcatcaatgagcccacagctgctgccatcgcctacggcctggacagaactggaaaaggagagagaaatgtgctgatctttgacctgggcggcggcacctttgatgtgtccatcctgaccattgatgatggcatctttgaggtgaaggccacagctggggacacccacctgggcggggaggactttgacaaccggctggtgaaccactttgtggaggagttcaagaggaagcacaagaaggacatcagccagaacaagagagctgtgcggcggctgaggacagcctgtgagcgggccaagaggaccctgagcagcagcacccaggccagcctggagattgacagcctgtttgagggcatcgacttctacaccagcatcacccgggccaggtttgaggagctgtgcagcgacctcttccgcagcaccctggagcctgtggagaaggcccccccagccagcccccgctgccgcagctgctgcaggaccagcagcactggagccacctag

SEQ ID NO: 154941 - DNA, 1926 bp, Artificial Sequence; identical to SEQ ID NO: 154933
  Description of Artificial Sequence: Synthetic coding sequence

SEQ ID NO: 154942 - DNA, 1431 bp, Artificial Sequence; identical to SEQ ID NO: 154934
  Description of Artificial Sequence: Synthetic coding sequence

SEQ ID NO: 154943 - DNA, 1431 bp, Artificial Sequence; identical to SEQ ID NO: 154934
  Description of Artificial Sequence: Synthetic coding sequence

SEQ ID NO: 154944 - DNA, 1653 bp, Artificial Sequence
  Description of Artificial Sequence: Synthetic coding sequence
atggccaaggctgctgccatcggcatcgacctgggcaccacctacagctgtgtgggcgtcttccagcacggcaaggtgcagatcagctccatggtgctgaccaagatgaaggagattgctgaggcctacctgggctaccctgtgaccaatgctgtgatcaccgtgcctgcctacttcaatgacagccagaggcaggccaccaaggatgctggggtgattgctggcctgaatgtgctgcgcatcatcaatgagcccacagctgctgccatcgcctacggcctggacagaactggaaaaggagagagaaatgtgctgatctttgacctgggcggcggcacctttgatgtgtccatcctgaccattgatgatggcatctttgaggtgaaggccacagctggggacacccacctgggcggggaggactttgacaaccggctggtgaaccactttgtggaggagttcaagaggaagcacaagaaggacatcagccagaacaagagagctgtgcggcggctgaggacagcctgtgagcgggccaagaggaccctgagcagcagcacccaggccagcctggagattgacagcctgtttgagggcatcgacttctacaccagcatcacccgggccaggtttgaggagctgtgcagcgacctcttccgcagcaccctggagcctgtggagaaggccctgagagatgccaagctggacaaggcccagatccatgacctggtgctggtgggcggcagcacccgcatccccaaggtgcagaagctgctgcaggacttcttcaacggccgggacctgaacaagagcatcaacccagatgaagctgtggcctacggggctgctgtgcaggccgccatcctgatgggagacaagtcagaaaatgtgcaggacctgctgctgctggatgtggcccccctgagcctgggcctggagacagctggaggagtgatgacagccctgatcaagaggaacagcaccatccccaccaagcagacccagatcttcaccacctacagcgacaaccagcccggggtgctgatccaggtgtatgaaggagagcgggccatgaccaaggacaacaacctgctgggccgctttgagctgagcggcatccccccagccccccggggcgtgccccagatcgaggtgacctttgatattgatgccaacggcatcctgaatgtgacagccacagacaagagcacaggcaaggccaacaagatcaccatcaccaatgacaagggccgcctgagcaaggaggagattgaaagaatggtgcaggaggccgagaagtacaaggcagaagatgaggtgcagcgggagcgggtgtctgccaagaatgccctggagagctatgccttcaacatgaagtctgctgtggaggatgagggcctgaagggcaagatcagcgaggccgacaagaagaaggtgctggacaagtgccaggaggtgatctcctggctggatgccaacaccctggccgagaaggatgaatttgagcacaagaggaaggagctggagcaggtgtgcaaccccatcatcagcggcctgtaccagggcgccggcggccctggccctgggggctttggagcccagggccccaagggcggcagcggcagcggccccaccatcgaggaggtggactag

SEQ ID NO: 154945 - DNA, 1872 bp, Artificial Sequence
  Description of Artificial Sequence: Synthetic coding sequence
atggccaaggctgctgccatcggcatcgacctgggcaccacctacagctgtgtgggcgtcttccagcacggcaaggtggagatcatcgccaatgaccagggcaacagaaccacccccagctatgtggccttcacagacacagagcggctgattggagatgctgccaagaaccaggtggccctgaaccctgtggtgcagagcgacatgaagcactggcccttccaggtgatcaatgatggagacaagcccaaggtgcaggtgtcctacaagggggagaccaaggccttctacccagaggagatcagctccatggtgctgaccaagatgaaggagattgctgaggcctacctgggctaccctgtgaccaatgctgtgatcaccgtgcctgcctacttcaatgacagccagaggcaggccaccaaggatgctggggtgattgctggcctgaatgtgctgcgcatcatcaatgagcccacagctgctgccatcgcctacggcctggacagaacaggcaagggggagagaaatgtgctgatctttgacctgggcggcggcacctttgatgtgtccatcctgaccattgatgatggcatctttgaggtgaaggccacagctggggacacccacctgggcggagaagattttgacaaccggctggtgaaccactttgtggaggagttcaagaggaagcacaagaaggacatcagccagaacaagagagctgtgcggcggctgaggacagcctgtgagcgggccaagaggaccctgagcagcagcacccaggccagcctggagattgacagcctgtttgagggcatcgacttctacaccagcatcacccgggccaggtttgaggagctgtgcagcgacctcttccgcagcaccctggagcctgtggagaaggccctgagagatgccaagctggacaaggcccagatccatgacctggtgctggtgggcggcagcacccgcatccccaaggtgcagaagctgctgcaggacttcttcaacggccgggacctgaacaagagcatcaacccagatgaggccgtggcctatggagctgctgtgcaggccgccatcctgatgggagacaagtcagaaaatgtgcaggacctgctgctgctggatgtggcccccctgagcctgggcctggagacagctgggggcgtgatgacagccctgatcaagaggaacagcaccatccccaccaagcagacccagatcttcaccacctacagcgacaaccagcccggggtgctgatccaggtgtatgaaggagagcgggccatgaccaaggacaacaacctgctgggccgctttgagctgagcggcatccccccagccccccggggcgtgccccagatcgaggtgacctttgatattgatgccaacggcatcctgaatgtgacagccacagacaagagcacaggcaaggccaacaagatcaccatcaccaatgacaagggccgcctgagcaaggaggagattgaaagaatggtgcaggaggccgagaagtacaaggccgaggatgaggtgcagcgggagcgggtgtctgccaagaatgccctggagagctatgccttcaacatgaagtctgctgtggaggatgagggcctgaagggcaagatcagcgaggccgacaagaagaaggtgctggacaagtgccaggaggtgatctcctggctggatgccaacaccctggccgagaaggatgaatttgagcacaagaggaaggagctggagcaggtgtgcaaccccatcatcagcggcctgtaccagggcgctgggggccctggccctgggggctttggagcccagggccccaagggcggcagcggcagcggccccaccatcgaggaggtggactag

SEQ ID NO: 154946 - DNA, 1653 bp, Artificial Sequence; identical to SEQ ID NO: 154944
  Description of Artificial Sequence: Synthetic coding sequence

SEQ ID NO: 154947 - DNA, 1653 bp, Artificial Sequence; identical to SEQ ID NO: 154944
  Description of Artificial Sequence: Synthetic coding sequence

SEQ ID NO: 154948 - DNA, 1653 bp, Artificial Sequence; identical to SEQ ID NO: 154944
  Description of Artificial Sequence: Synthetic coding sequence

SEQ ID NO: 154949 - DNA, 699 bp, Artificial Sequence; identical to SEQ ID NO: 154940
  Description of Artificial Sequence: Synthetic coding sequence

SEQ ID NO: 154950 - DNA, 1653 bp, Artificial Sequence; identical to SEQ ID NO: 154944
  Description of Artificial Sequence: Synthetic coding sequence

SEQ ID NO: 154951 - DNA, 699 bp, Artificial Sequence; identical to SEQ ID NO: 154940
  Description of Artificial Sequence: Synthetic coding sequence

SEQ ID NO: 154952 - DNA, 699 bp, Artificial Sequence; identical to SEQ ID NO: 154940
  Description of Artificial Sequence: Synthetic coding sequence

SEQ ID NO: 154953 - DNA, 699 bp, Artificial Sequence; identical to SEQ ID NO: 154940
  Description of Artificial Sequence: Synthetic coding sequence

SEQ ID NO: 154954 - DNA, 1926 bp, Artificial Sequence; identical to SEQ ID NO: 154933
  Description of Artificial Sequence: Synthetic coding sequence

SEQ ID NO: 154955 - DNA, 1926 bp, Artificial Sequence; identical to SEQ ID NO: 154933
  Description of Artificial Sequence: Synthetic coding sequence

SEQ ID NO: 154956 - DNA, 1926 bp, Artificial Sequence; identical to SEQ ID NO: 154933
  Description of Artificial Sequence: Synthetic coding sequence

SEQ ID NO: 154957 - DNA, 699 bp, Artificial Sequence; identical to SEQ ID NO: 154940
  Description of Artificial Sequence: Synthetic coding sequence

SEQ ID NO: 154958 - DNA, 1926 bp, Artificial Sequence; identical to SEQ ID NO: 154933
  Description of Artificial Sequence: Synthetic coding sequence

SEQ ID NO: 154959 - DNA, 1926 bp, Artificial Sequence; identical to SEQ ID NO: 154933
  Description of Artificial Sequence: Synthetic coding sequence

SEQ ID NO: 154960 - DNA, 2127 bp, Artificial Sequence
  Description of Artificial Sequence: Synthetic coding sequence
ctgcggagctgctgtgagggccccctgcggctgagccgggtgaccccagctgtgccccggctgagccgggccaacctgtgtggctgccgccaccggcgggtggagttccctgccttccggaggacagagctgctgagccgcatccccagcgctgtgagcagcccccagagccagagcggggcccaccggcagggcaccggcatggccaaggccgccgccatcggcatcgacctgggcaccacctacagctgtgtgggcgtcttccagcacggcaaggtggagatcatcgccaatgaccagggcaacagaaccacccccagctatgtggccttcacagacacagagcggctgattggagatgctgccaagaaccaggtggccctgaacccccagaacacagtgtttgatgccaagaggctgattggaaggaagtttggagaccctgtggtgcagagcgacatgaagcactggcccttccaggtgatcaatgatggagacaagcccaaggtgcaggtgtcctacaagggggagaccaaggccttctacccagaggagatcagctccatggtgctgaccaagatgaaggagattgctgaggcctacctgggctaccctgtgaccaatgctgtgatcaccgtgcctgcctacttcaatgacagccagaggcaggccaccaaggatgctggggtgattgctggcctgaatgtgctgcgcatcatcaatgagcccacagctgctgccatcgcctacggcctggacagaactggaaaaggagagagaaatgtgctgatctttgacctgggcggcggcacctttgatgtgtccatcctgaccattgatgatggcatctttgaggtgaaggccacagctggggacacccacctgggcggggaggactttgacaaccggctggtgaaccactttgtggaggagttcaagaggaagcacaagaaggacatcagccagaacaagagagctgtgcggcggctgaggacagcctgtgagcgggccaagaggaccctgagcagcagcacccaggccagcctggagattgacagcctgtttgagggcatcgacttctacaccagcatcacccgggccaggtttgaggagctgtgcagcgacctcttccgcagcaccctggagcctgtggagaaggccctgagagatgccaagctggacaaggcccagatccatgacctggtgctggtgggcggcagcacccgcatccccaaggtgcagaagctgctgcaggacttcttcaacggccgggacctgaacaagagcatcaacccagatgaagctgtggcctacggggctgctgtgcaggccgccatcctgatgggagacaagtcagaaaatgtgcaggacctgctgctgctggatgtggcccccctgagcctgggcctggagacagctggaggagtgatgacagccctgatcaagaggaacagcaccatccccaccaagcagacccagatcttcaccacctacagcgacaaccagcccggggtgctgatccaggtgtatgaaggagagcgggccatgaccaaggacaacaacctgctgggccgctttgagctgagcggcatccccccagccccccggggcgtgccccagatcgaggtgacctttgatattgatgccaacggcatcctgaatgtgacagccacagacaagagcacaggcaaggccaacaagatcaccatcaccaatgacaagggccgcctgagcaaggaggagattgaaagaatggtgcaggaggccgagaagtacaaggcagaagatgaggtgcagcgggagcgggtgtctgccaagaatgccctggagagctatgccttcaacatgaagtctgctgtggaggatgagggcctgaagggcaagatcagcgaggccgacaagaagaaggtgctggacaagtgccaggaggtgatctcctggctggatgccaacaccctggccgagaaggatgaatttgagcacaagaggaaggagctggagcaggtgtgcaaccccatcatcagcggcctgtaccagggcgccggcggccctggccctgggggctttggagcccagggccccaagggcggcagcggcagcggccccaccatcgaggaggtggactag

SEQ ID NO: 154961 - DNA, 1653 bp, Artificial Sequence; identical to SEQ ID NO: 154944
  Description of Artificial Sequence: Synthetic coding sequence

SEQ ID NO: 154962 - DNA, 1875 bp, Artificial Sequence
  Description of Artificial Sequence: Synthetic coding sequence
atggccaaggctgctgccatcggcatcgacctgggcaccacctacagctgtgtgggcgtcttccagcacggcaaggtggagatcatcgccaatgaccagggcaacagaaccacccccagctatgtggccttcacagacacagagcggctgattggagatgctgccaagaaccaggtggccctgaacccccctgtggtgcagagcgacatgaagcactggcccttccaggtgatcaatgatggagacaagcccaaggtgcaggtgtcctacaagggggagaccaaggccttctacccagaggagatcagctccatggtgctgaccaagatgaaggagattgctgaggcctacctgggctaccctgtgaccaatgctgtgatcaccgtgcctgcctacttcaatgacagccagaggcaggccaccaaggatgctggggtgattgctggcctgaatgtgctgcgcatcatcaatgagcccacagctgctgccatcgcctacggcctggacagaactggaaaaggagagagaaatgtgctgatctttgacctgggcggcggcacctttgatgtgtccatcctgaccattgatgatggcatctttgaggtgaaggccacagctggggacacccacctgggcggggaggactttgacaaccggctggtgaaccactttgtggaggagttcaagaggaagcacaagaaggacatcagccagaacaagagagctgtgcggcggctgaggacagcctgtgagcgggccaagaggaccctgagcagcagcacccaggccagcctggagattgacagcctgtttgagggcatcgacttctacaccagcatcacccgggccaggtttgaggagctgtgcagcgacctcttccgcagcaccctggagcctgtggagaaggccctgagagatgccaagctggacaaggcccagatccatgacctggtgctggtgggcggcagcacccgcatccccaaggtgcagaagctgctgcaggacttcttcaacggccgggacctgaacaagagcatcaacccagatgaagctgtggcctacggggctgctgtgcaggccgccatcctgatgggagacaagtcagaaaatgtgcaggacctgctgctgctggatgtggcccccctgagcctgggcctggagacagctggaggagtgatgacagccctgatcaagaggaacagcaccatccccaccaagcagacccagatcttcaccacctacagcgacaaccagcccggggtgctgatccaggtgtatgaaggagagcgggccatgaccaaggacaacaacctgctgggccgctttgagctgagcggcatccccccagccccccggggcgtgccccagatcgaggtgacctttgatattgatgccaacggcatcctgaatgtgacagccacagacaagagcacaggcaaggccaacaagatcaccatcaccaatgacaagggccgcctgagcaaggaggagattgaaagaatggtgcaggaggccgagaagtacaaggcagaagatgaggtgcagcgggagcgggtgtctgccaagaatgccctggagagctatgccttcaacatgaagtctgctgtggaggatgagggcctgaagggcaagatcagcgaggccgacaagaagaaggtgctggacaagtgccaggaggtgatctcctggctggatgccaacaccctggccgagaaggatgaatttgagcacaagaggaaggagctggagcaggtgtgcaaccccatcatcagcggcctgtaccagggcgccggcggccctggccctgggggctttggagcccagggccccaagggcggcagcggcagcggccccaccatcgaggaggtggactag

SEQ ID NO: 154963 - DNA, 1857 bp, Artificial Sequence
  Description of Artificial Sequence: Synthetic coding sequence
atggccaaggctgctgccatcggcatcgacctgggcaccacctacagctgtgtgggcgtcttccagcacggcaaggtggagatcatcgccaatgaccagggcaacagaaccacccccagctatgtggccttcacagacacagagcggctgattggagatgctgccaagaaccaggtggtgcagagcgacatgaagcactggcccttccaggtgatcaatgatggagacaagcccaaggtgcaggtgtcctacaagggggagaccaaggccttctacccagaggagatcagctccatggtgctgaccaagatgaaggagattgctgaggcctacctgggctaccctgtgaccaatgctgtgatcaccgtgcctgcctacttcaatgacagccagaggcaggccaccaaggatgctggggtgattgctggcctgaatgtgctgcgcatcatcaatgagcccacagctgctgccatcgcctacggcctggacagaactggaaaaggagagagaaatgtgctgatctttgacctgggcggcggcacctttgatgtgtccatcctgaccattgatgatggcatctttgaggtgaaggccacagctggggacacccacctgggcggggaggactttgacaaccggctggtgaaccactttgtggaggagttcaagaggaagcacaagaaggacatcagccagaacaagagagctgtgcggcggctgaggacagcctgtgagcgggccaagaggaccctgagcagcagcacccaggccagcctggagattgacagcctgtttgagggcatcgacttctacaccagcatcacccgggccaggtttgaggagctgtgcagcgacctcttccgcagcaccctggagcctgtggagaaggccctgagagatgccaagctggacaaggcccagatccatgacctggtgctggtgggcggcagcacccgcatccccaaggtgcagaagctgctgcaggacttcttcaacggccgggacctgaacaagagcatcaacccagatgaagctgtggcctacggggctgctgtgcaggccgccatcctgatgggagacaagtcagaaaatgtgcaggacctgctgctgctggatgtggcccccctgagcctgggcctggagacagctggaggagtgatgacagccctgatcaagaggaacagcaccatccccaccaagcagacccagatcttcaccacctacagcgacaaccagcccggggtgctgatccaggtgtatgaaggagagcgggccatgaccaaggacaacaacctgctgggccgctttgagctgagcggcatccccccagccccccggggcgtgccccagatcgaggtgacctttgatattgatgccaacggcatcctgaatgtgacagccacagacaagagcacaggcaaggccaacaagatcaccatcaccaatgacaagggccgcctgagcaaggaggagattgaaagaatggtgcaggaggccgagaagtacaaggcagaagatgaggtgcagcgggagcgggtgtctgccaagaatgccctggagagctatgccttcaacatgaagtctgctgtggaggatgagggcctgaagggcaagatcagcgaggccgacaagaagaaggtgctggacaagtgccaggaggtgatctcctggctggatgccaacaccctggccgagaaggatgaatttgagcacaagaggaaggagctggagcaggtgtgcaaccccatcatcagcggcctgtaccagggcgccggcggccctggccctgggggctttggagcccagggccccaagggcggcagcggcagcggccccaccatcgaggaggtggactag

SEQ ID NO: 154964 - DNA, 1857 bp, Artificial Sequence; identical to SEQ ID NO: 154963
  Description of Artificial Sequence: Synthetic coding sequence

SEQ ID NO: 154965 - DNA, 1653 bp, Artificial Sequence; identical to SEQ ID NO: 154944
  Description of Artificial Sequence: Synthetic coding sequence

SEQ ID NO: 154966 - DNA, 1857 bp, Artificial Sequence; identical to SEQ ID NO: 154963
  Description of Artificial Sequence: Synthetic coding sequence

SEQ ID NO: 154967 - DNA, 1653 bp, Artificial Sequence; identical to SEQ ID NO: 154944
  Description of Artificial Sequence: Synthetic coding sequence

SEQ ID NO: 154968 - DNA, 1761 bp, Artificial Sequence
  Description of Artificial Sequence: Synthetic coding sequence
atggccacagccaagggcatcgccatcggcatcgacctgggcaccacctacagctgtgtgggcgtcttccagcacggcaaggtggagatcatcgccaatgaccagggcaacagaaccacccccagctatgtggccttcacagacacagagcggctgattggagatgctgccaagaaccaggtggccatgaacccccagaacacagtgtttgatgccaagaggctcatcggcaggaagttcaatgaccctgtggtgcaggccgacatgaagctgtggcccttccaggtgatcaatgacagccagaggcaggccaccaaggatgctggggtgattgctggcctgaatgtgctgcgcatcatcaatgagcccacagctgctgccatcgcctacggcctggacaagggcggccagggcgagagacatgtgctgatctttgacctgggcggcggcacctttgatgtgtccatcctgaccattgatgatggcatctttgaggtgaaggccacagctggggacacccacctgggcggggaggactttgacaaccggctggtgagccactttgtggaggagttcaagaggaagcacaagaaggacatcagccagaacaagagagctgtgcggcggctgaggacagcctgtgagcgggccaagaggaccctgagcagcagcacccaggccaacctggagattgacagcctgtatgagggcatcgacttctacaccagcatcacccgggccaggtttgaggagctgtgtgccgacctcttccggggcaccctggagcctgtggagaaggccctgagagatgccaagatggacaaggccaagatccatgacatcgtgctggtgggcggcagcacccgcatccccaaggtgcagaggctgctgcaggactacttcaacggccgggacctgaacaagagcatcaacccagatgaagctgtggcctacggggctgctgtgcaggccgccatcctgatgggagacaagtctgagaaggtgcaggacctgctgctgctggatgtggcccccctgagcctgggcctggagacagctggaggagtgatgacagccctgatcaagaggaacagcaccatccccaccaagcagacccagatcttcaccacctacagcgacaaccagcccggggtgctgatccaggtgtatgaaggagagcgggccatgaccaaggacaacaacctgctgggccgctttgacctgaccggcatccccccagccccccggggcgtgccccagatcgaggtgacctttgatattgatgccaacggcatcctgaatgtgacagccacagacaagagcacaggcaaggtgaacaagatcaccatcaccaatgacaagggccgcctgagcaaggaggagattgaaagaatggtgctggatgctgagaagtacaaggcagaagatgaggtgcagcgggagaagattgctgccaagaatgccctggagagctatgccttcaacatgaagtctgtggtgtctgatgagggcctgaagggcaagatcagcgagagtgacaagaacaagatcctggacaagtgcaatgagctgctgtcctggctggaggtgaaccagctggccgagaaggatgaatttgaccacaagaggaaggagctggagcagatgtgcaaccccatcatcaccaagctgtaccagggcggctgcaccggccctgcctgtggcaccggctacgtgcccggccggcctgccaccggccccaccatcgaggaggtggactag

SEQ ID NO: 154969 - DNA, 1926 bp, Artificial Sequence
  Description of Artificial Sequence: Synthetic coding sequence
atggccacagccaagggcatcgccatcggcatcgacctgggcaccacctacagctgtgtgggcgtcttccagcacggcaaggtggagatcatcgccaatgaccagggcaacagaaccacccccagctatgtggccttcacagacacagagcggctgattggagatgctgccaagaaccaggtggccatgaacccccagaacacagtgtttgatgccaagaggctcatcggcaggaagttcaatgaccctgtggtgcaggccgacatgaagctgtggcccttccaggtgatcaatgaaggaggcaagcccaaggtgctggtgtcctacaagggggagaacaaggccttctacccagaggagatcagctccatggtgctgaccaagctgaaggagacagctgaggccttcctgggccaccctgtgaccaatgctgtgatcaccgtgcctgcctacttcaatgacagccagaggcaggccaccaaggatgctggggtgattgctggcctgaatgtgctgcgcatcatcaatgagcccacagctgctgccatcgcctacggcctggacaagggcggccagggcgagcggcacgtgctgatctttgacctgggcggcggcacctttgatgtgtccatcctgaccattgatgatggcatctttgaggtgaaggccacagctggggacacccacctgggcggagaagattttgacaaccggctggtgagccactttgtggaggagttcaagaggaagcacaagaaggacatcagccagaacaagagagctgtgcggcggctgaggacagcctgtgagcgggccaagaggaccctgagcagcagcacccaggccaacctggagattgacagcctgtatgagggcatcgacttctacaccagcatcacccgggccaggtttgaggagctgtgtgccgacctcttccggggcaccctggagcctgtggagaaggccctgagagatgccaagatggacaaggccaagatccatgacatcgtgctggtgggcggcagcacccgcatccccaaggtgcagaggctgctgcaggactacttcaacggccgggacctgaacaagagcatcaacccagatgaggccgtggcctatggagctgctgtgcaggccgccatcctgatgggagacaagtctgagaaggtgcaggacctgctgctgctggatgtggcccccctgagcctgggcctggagacagctgggggcgtgatgacagccctgatcaagaggaacagcaccatccccaccaagcagacccagatcttcaccacctacagcgacaaccagcccggggtgctgatccaggtgtatgaaggagagcgggccatgaccaaggacaacaacctgctgggccgctttgacctgaccggcatccccccagccccccggggcgtgccccagatcgaggtgacctttgatattgatgccaacggcatcctgaatgtgacagccacagacaagagcacaggcaaggtgaacaagatcaccatcaccaatgacaagggccgcctgagcaaggaggagattgaaagaatggtgctggatgctgagaagtacaaggccgaggatgaggtgcagcgggagaagattgctgccaagaatgccctggagagctatgccttcaacatgaagtctgtggtgtctgatgagggcctgaagggcaagatcagcgagagtgacaagaacaagatcctggacaagtgcaatgagctgctgtcctggctggaggtgaaccagctggccgagaaggatgaatttgaccacaagaggaaggagctggagcagatgtgcaaccccatcatcaccaagctgtaccagggcggctgcaccggccctgcctgtggcaccggctacgtgcccggccgcccagccaccggccccaccatcgaggaggtggactag

SEQ ID NO: 154970 - DNA, 1926 bp, Artificial Sequence
  Description of Artificial Sequence: Synthetic coding sequence
atggccacagccaagggcatcgccatcggcatcgacctgggcaccacctacagctgtgtgggcgtcttccagcacggcaaggtggagatcatcgccaatgaccagggcaacagaaccacccccagctatgtggccttcacagacacagagcggctgattggagatgctgccaagaaccaggtggccatgaacccccagaacacagtgtttgatgccaagaggctcatcggcaggaagttcaatgaccctgtggtgcaggccgacatgaagctgtggcccttccaggtgatcaatgaaggaggcaagcccaaggtgctggtgtcctacaagggggagaacaaggccttctacccagaggagatcagctccatggtgctgaccaagctgaaggagacagctgaggccttcctgggccaccctgtgaccaatgctgtgatcaccgtgcctgcctacttcaatgacagccagaggcaggccaccaaggatgctggggtgattgctggcctgaatgtgctgcgcatcatcaatgagcccacagctgctgccatcgcctacggcctggacaagggcggccagggcgagcggcacgtgctgatctttgacctgggcggcggcacctttgatgtgtccatcctgaccattgatgatggcatctttgaggtgaaggccacagctggggacacccacctgggcggagaagattttgacaaccggctggtgagccactttgtggaggagttcaagaggaagcacaagaaggacatcagccagaacaagagagctgtgcggcggctgaggacagcctgtgagcgggccaagaggaccctgagcagcagcacccaggccaacctggagattgacagcctgtatgagggcatcgacttctacaccagcatcacccgggccaggtttgaggagctgtgtgccgacctcttccggggcaccctggagcctgtggagaaggccctgagagatgccaagatggacaaggccaagatccatgacatcgtgctggtgggcggcagcacccgcatccccaaggtgcagaggctgctgcaggactacttcaacggccgggacctgaacaagagcatcaacccagatgaggccgtggcctatggagctgctgtgcaggccgccatcctgatgggagacaagtctgagaaggtgcaggacctgctgctgctggatgtggcccccctgagcctgggcctggagacagctgggggcgtgatgacagccctgatcaagaggaacagcaccatccccaccaagcagacccagatcttcaccacctacagcgacaaccagcccggggtgctgatccaggtgtatgaaggagagcgggccatgaccaaggacaacaacctgctgggccgctttgacctgaccggcatccccccagccccccggggcgtgccccagatcgaggtgacctttgatattgatgccaacggcatcctgaatgtgacagccatggacaagagcacaggcaaggtgaacaagatcaccatcaccaatgacaagggccgcctgagcaaggaggagattgaaagaatggtgctggatgctgagaagtacaaggccgaggatgaggtgcagcgggagaagattgctgccaagaatgccctggagagctatgccttcaacatgaagtctgtggtgtctgatgagggcctgaagggcaagatcagcgagagtgacaagaacaagatcctggacaagtgcaatgagctgctgtcctggctggaggtgaaccagctggccgagaaggatgaatttgaccacaagaggaaggagctggagcagatgtgcaaccccatcatcaccaagctgtaccagggcggctgcaccggccctgcctgtggcaccggctacgtgcccggccgcccagccaccggccccaccatcgaggaggtggactag

SEQ ID NO: 154971 - DNA, 1926 bp, Artificial Sequence; identical to SEQ ID NO: 154969
  Description of Artificial Sequence: Synthetic coding sequence

SEQ ID NO: 154972 - DNA, 1926 bp, Artificial Sequence; identical to SEQ ID NO: 154969
  Description of Artificial Sequence: Synthetic coding sequence

SEQ ID NO: 154973 - DNA, 699 bp, Artificial Sequence
  Description of Artificial Sequence: Synthetic coding sequence
gccaagggcatcgccatcggcatcgacctgggcaccacctacagctgtgtgggcgtcttccagcacggcaaggtggagatcatcgccaatgaccagggcaacagaaccacccccagctatgtggccttcacagacacagagcggctgattggagatgctggggtgattgctggcctgaatgtgctgcgcatcatcaatgagcccacagctgctgccatcgcctacggcctggacaagggcggccagggcgagcggcacgtgctgatctttgacctgggcggcggcacctttgatgtgtccatcctgaccattgatgatggcatctttgaggtgaaggccacagctggggacacccacctgggcggagaagattttgacaaccggctggtgagccactttgtggaggagttcaagaggaagcacaagaaggacatcagccagaacaagagagctgtgcggcggctgaggacagcctgtgagcgggccaagaggaccctgagcagcagcacccaggccaacctggagattgacagcctgtatgagggcatcgacttctacaccagcatcacccgggccaggtttgaggagctgtgtgccgacctcttccggggcaccctggagcctgtggagaagggggcccccccagccagcccccgctgcagcggctgcttccgcaccacctccatggatgtgatctag

SEQ ID NO: 154974 - DNA, 1926 bp, Artificial Sequence; identical to SEQ ID NO: 154970
  Description of Artificial Sequence: Synthetic coding sequence

SEQ ID NO: 154975 - DNA, 1599 bp, Artificial Sequence
  Description of Artificial Sequence: Synthetic coding sequence
atggccacagccaagggcatcgccatcggcatcgacctgggcaccacctacagctgtgtgggcgtcttccagcacggcaaggtggagatcatcgccaatgaccagggcaacagaaccacccccagctatgtggccttcacagacacagagcggctgattggagatgctgccaagaaccaggtggccatgaacccccagaacacagtgtttgatgccaagaggctcatcggcaggaagttcaatgaccctgtggtgcaggccgacatgaagctgtggcccttccaggtgatcaatgaaggaggcaagcccaaggtgctggtgtcctacaagggggagaacaaggccttctacccagaggagatcagctccatggtgctgaccaagctgaaggagacagctgaggccttcctgggccaccctgtgaccaatgctgtgatcaccgtgcctgcctacttcaatgacagccagaggcaggccaccaaggatgctggggtgattgctggcctgaatgtgctgcgcatcatcaatgagcccacagctgctgccatcgcctacggcctggacaagggcggccagggcgagcggcacgtgctgatctttgacctgggcggcggcacctttgatgtgtccatcctgaccattgatgatggcatctttgaggtgaaggccacagctggggacacccacctgggcggagaagattttgacaaccggctggtgagccactttgtggaggagttcaagaggaagcacaagaaggacatcagccagaacaagagagctgtgcggcggctgaggacagcctgtgagcgggccaagaggaccctgagcagcagcacccaggccaacctggagattgacagcctgtatgagggcatcgacttctacaccagcatcacccgggccaggtttgaggagctgtgtgccgacctcttccggggcaccctggagcctgtggagaaggccctgagagatgccaagatggacaaggccaagatccatgacatcgtgctggtgggcggcagcacccgcatccccaaggtgcagaggctgctgcaggactacttcaacggccgggacctgaacaagagcatcaacccagatgaggccgtggcctatggagctgctgtgcaggccgccatcctgatgggagacaagtctgagaaggtgcaggacctgctgctgctggatgtggcccccctgagcctgggcctggagacagctgggggcgtgatgacagccctgatcaagaggaacagcaccatccccaccaagcagacccagatcttcaccacctacagcgacaaccagcccggggtgctgatccaggtgtatgaaggagagcgggccatgaccaaggacaacaacctgctgggccgctttgacctgaccggcatccccccagccccccggggcgtgccccagatcgaggtgacctttgatattgatgccaacggcatcctgaatgtgacagccatggacaagagcacaggcaaggtgaacaagatcaccatcaccaatgacaagggccgcctgagcaaggaggagattgaaagaatggtgctggatgctgagaagtacaaggccgaggatgtgtag

SEQ ID NO: 154976 - DNA, 699 bp, Artificial Sequence; identical to SEQ ID NO: 154973
  Description of Artificial Sequence: Synthetic coding sequence

SEQ ID NO: 154977 - DNA, 1926 bp, Artificial Sequence; identical to SEQ ID NO: 154969
  Description of Artificial Sequence: Synthetic coding sequence

SEQ ID NO: 154978 - DNA, 1599 bp, Artificial Sequence; identical to SEQ ID NO: 154975
  Description of Artificial Sequence: Synthetic coding sequence

SEQ ID NO: 154979 - DNA, 1599 bp, Artificial Sequence
  Description of Artificial Sequence: Synthetic coding sequence
atggccacagccaagggcatcgccatcggcatcgacctgggcaccacctacagctgtgtgggcgtcttccagcacggcaaggtggagatcatcgccaatgaccagggcaacagaaccacccccagctatgtggccttcacagacacagagcggctgattggagatgctgccaagaaccaggtggccatgaacccccagaacacagtgtttgatgccaagaggctcatcggcaggaagttcaatgaccctgtggtgcaggccgacatgaagctgtggcccttccaggtgatcaatgaaggaggcaagcccaaggtgctggtgtcctacaagggggagaacaaggccttctacccagaggagatcagctccatggtgctgaccaagctgaaggagacagctgaggccttcctgggccaccctgtgaccaatgctgtgatcaccgtgcctgcctacttcaatgacagccagaggcaggccaccaaggatgctggggtgattgctggcctgaatgtgctgcgcatcatcaatgagcccacagctgctgccatcgcctacggcctggacaagggcggccagggcgagcggcacgtgctgatctttgacctgggcggcggcacctttgatgtgtccatcctgaccattgatgatggcatctttgaggtgaaggccacagctggggacacccacctgggcggagaagattttgacaaccggctggtgagccactttgtggaggagttcaagaggaagcacaagaaggacatcagccagaacaagagagctgtgcggcggctgaggacagcctgtgagcgggccaagaggaccctgagcagcagcacccaggccaacctggagattgacagcctgtatgagggcatcgacttctacaccagcatcacccgggccaggtttgaggagctgtgtgccgacctcttccggggcaccctggagcctgtggagaaggccctgagagatgccaagatggacaaggccaagatccatgacatcgtgctggtgggcggcagcacccgcatccccaaggtgcagaggctgctgcaggactacttcaacggccgggacctgaacaagagcatcaacccagatgaggccgtggcctatggagctgctgtgcaggccgccatcctgatgggagacaagtctgagaaggtgcaggacctgctgctgctggatgtggcccccctgagcctgggcctggagacagctgggggcgtgatgacagccctgatcaagaggaacagcaccatccccaccaagcagacccagatcttcaccacctacagcgacaaccagcccggggtgctgatccaggtgtatgaaggagagcgggccatgaccaaggacaacaacctgctgggccgctttgacctgaccggcatccccccagccccccggggcgtgccccagatcgaggtgacctttgatattgatgccaacggcatcctgaatgtgacagccacagacaagagcacaggcaaggtgaacaagatcaccatcaccaatgacaagggccgcctgagcaaggaggagattgaaagaatggtgctggatgctgagaagtacaaggccgaggatgtgtag

SEQ ID NO: 154980 - DNA, 1926 bp, Artificial Sequence; identical to SEQ ID NO: 154970
  Description of Artificial Sequence: Synthetic coding sequence

SEQ ID NO: 154981 - DNA, 699 bp, Artificial Sequence; identical to SEQ ID NO: 154973
  Description of Artificial Sequence: Synthetic coding sequence

SEQ ID NO: 154982 - DNA, 699 bp, Artificial Sequence; identical to SEQ ID NO: 154973
  Description of Artificial Sequence: Synthetic coding sequence

SEQ ID NO: 154983 - DNA, 1926 bp, Artificial Sequence; identical to SEQ ID NO: 154970
  Description of Artificial Sequence: Synthetic coding sequence

SEQ ID NO: 154984 - DNA, 1920 bp, Artificial Sequence
  Description of Artificial Sequence: Synthetic coding sequence
atgtctgcccggggccctgccatcggcatcgacctgggcaccacctacagctgtgtgggcgtcttccagcacggcaaggtggagatcatcgccaatgaccagggcaacagaaccacccccagctatgtggccttcacagacacagagcggctgattggagatgctgccaagaaccaggtggccatgaaccccaccaacaccatctttgatgccaagaggctgattggaaggaagtttgaagatgccaccgtgcagagcgacatgaagcactggcccttccgggtggtgtctgagggcggcaagcccaaggtgcaggtggagtacaagggggagaccaagaccttcttccctgaggagatcagctccatggtgctgaccaagatgaaggagattgctgaggcctacctgggcggcaaggtgcacagcgctgtgatcaccgtgcctgcctacttcaatgacagccagaggcaggccaccaaggatgctggcaccatcaccggcctgaatgtgctgcgcatcatcaatgagcccacagctgctgccatcgcctacggcctggacaagaagggctgtgccggcggggagaagaatgtgctgatctttgacctgggcggcggcacctttgatgtgtccatcctgaccattgaagatggcatctttgaggtgaagagcacagctggggacacccacctgggcggggaggactttgacaacaggatggtgagccacctggccgaggagttcaagaggaagcacaagaaggacatcggccccaacaagagagctgtgcggcggctgaggacagcctgtgagcgggccaagaggaccctgagcagcagcacccaggccagcattgaaattgacagcctgtatgaaggagtggacttctacaccagcatcacccgggccaggtttgaggagctgaatgctgacctcttccggggcaccctggagcctgtggagaaggccctgagagatgccaagctggacaagggccagatccaggagatcgtgctggtgggcggcagcacccgcatccccaagatccagaagctgctgcaggacttcttcaacgggaaggagctgaacaagagcatcaacccagatgaagctgtggcctacggggctgctgtgcaggccgccatcctgattggagacaagtcagaaaatgtgcaggacctgctgctgctggatgtgacccccctgagcctgggcatcgagacagctggaggagtgatgacccccctcatcaagaggaacaccaccatccccaccaagcagacccagaccttcaccacctacagcgacaaccagagctctgtgctggtgcaggtgtatgaaggagagcgggccatgaccaaggacaacaacctgctgggcaagtttgacctgaccggcatccccccagccccccggggcgtgccccagatcgaggtgacctttgatattgatgccaacggcatcctgaatgtgacagctgctgacaagagcacaggcaaggagaacaagatcaccatcaccaatgacaagggccgcctgagcaaggatgacatcgacaggatggtgcaggaggccgagcgctacaagtcagaagatgaggccaacagagacagagtggccgccaagaatgccctggagagctacacctacaacatcaagcagacagtggaggatgagaagctgcggggcaagatcagcgagcaggacaagaacaagatcctggacaagtgccaggaggtgatcaactggctggacaggaaccagatggccgagaaggatgaatatgagcacaagcagaaggagctggagcgggtgtgcaaccccatcatcagcaagctgtaccagggcggccctgggggcggcagcggcggcggcggcagcggggccagcggcggccccaccatcgaggaggtggactag

SEQ ID NO: 154985 - DNA, 1920 bp, Artificial Sequence; identical to SEQ ID NO: 154984
  Description of Artificial Sequence: Synthetic coding sequence

SEQ ID NO: 154986 - DNA, 1242 bp, Artificial Sequence
  Description of Artificial Sequence: Synthetic coding sequence
atgtctgcccggggccctgccatcggcatcgacctgggcaccacctacagctgtgtgggcgtcttccagcacggcaaggtggagatcatcgccaatgaccagggcaacagaaccacccccagctatgtggccttcacagacacagagcggctgattggagatgctgccaagaaccaggtggccatgaaccccaccaacaccatctttgatgccaagaggctgattggaaggaagtttgaggagctgaatgctgacctcttccggggcaccctggagcctgtggagaaggccctgagagatgccaagctggacaagggccagatccaggagatcgtgctggtgggcggcagcacccgcatccccaagatccagaagctgctgcaggacttcttcaacgggaaggagctgaacaagagcatcaacccagatgaagctgtggcctacggggctgctgtgcaggccgccatcctgattggagacaagtcagaaaatgtgcaggacctgctgctgctggatgtgacccccctgagcctgggcatcgagacagctggaggagtgatgacccccctcatcaagaggaacaccaccatccccaccaagcagacccagaccttcaccacctacagcgacaaccagagctctgtgctggtgcaggtgtatgaaggagagcgggccatgaccaaggacaacaacctgctgggcaagtttgacctgaccggcatccccccagccccccggggcgtgccccagatcgaggtgacctttgatattgatgccaacggcatcctgaatgtgacagctgctgacaagagcacaggcaaggagaacaagatcaccatcaccaatgacaagggccgcctgagcaaggatgacatcgacaggatggtgcaggaggccgagcgctacaagtcagaagatgaggccaacagagacagagtggccgccaagaatgccctggagagctacacctacaacatcaagcagacagtggaggatgagaagctgcggggcaagatcagcgagcaggacaagaacaagatcctggacaagtgccaggaggtgatcaactggctggacaggaaccagatggccgagaaggatgaatatgagcacaagcagaaggagctggagcgggtgtgcaaccccatcatcagcaagctgtaccagggcggccctgggggcggcagcggcggcggcggcagcggggccagcggcggccccaccatcgaggaggtggactag

SEQ ID NO: 154987 - DNA, 2523 bp, Artificial Sequence
  Description of Artificial Sequence: Synthetic coding sequence
atgtctgtggtgggcatcgacctgggcttccagagctgctacgtggccgtggcccgggccggcggcatcgagaccatcgccaatgagtacagcgaccgctgcaccccagcctgcatcagctttggccccaagaacagaagcatcggggctgctgccaagagccaggtgatcagcaatgccaagaacacagtgcagggcttcaagcgcttccacggccgggccttcagtgacccctttgtggaggccgagaagagcaacctggcctatgacatcgtgcagctgcccaccggcctgaccggcatcaaggtgacctacatggaggaggagaggaacttcaccacagagcaggtgacagccatgctgctgagcaagctgaaggagacagctgagagcgtgctgaagaagcctgtggtggactgtgtggtgtctgtgccctgcttctacacagatgctgagaggagatctgtgatggatgccacccagattgctggcctgaactgcctgcggctgatgaatgagaccacagctgtggccctggcctacggcatctacaagcaggacctgcctgccctggaggagaagcccagaaatgtggtgtttgtggacatgggccacagcgcctaccaggtgtctgtgtgtgccttcaacagaggcaagctgaaggtgctggccacagcctttgacaccaccctgggcggcaggaagtttgatgaggtgctggtgaaccacttctgtgaggagtttgggaagaagtacaagctggacatcaagagcaagatccgggccctgctgcggctgagccaggagtgtgagaagctgaagaagctgatgtctgccaatgccagtgacctgcccctgagcattgagtgcttcatgaatgatgtggatgtgtctggcaccatgaacagaggcaagttcctggagatgtgcaatgacctgctggcccgggtggagccccccctgcggtctgtgctggagcagaccaagctgaagaaggaggacatctatgctgtggagatcgtgggcggggccacccgcatcccagctgtgaaggagaagatcagcaagttcttcggcaaggagctgagcaccaccctgaatgctgatgaagctgtgacccggggctgtgccctgcagtgtgccatcctgagccctgccttcaaggtgcgggagttcagcatcacagatgtggtgccctaccccatcagcctgcgctggaacagccctgctgaggagggcagcagtgactgtgaggtgttcagcaagaaccacgccgcccccttcagcaaggtgctgaccttctacaggaaggagcccttcaccctggaggcctactacagcagcccccaggacctgccctacccagaccctgccatcgcccagttctctgtgcagaaggtgaccccccagagtgatggcagcagcagcaaggtgaaggtgaaggtgcgggtgaatgtgcacggcatcttctctgtgagcagcgccagcctggtggaggtgcacaagtcagaagaaaatgaggagcccatggagacagaccagaatgccaaggaggaggagaagatgcaggtggaccaggaggagccccacgtggaggagcagcagcagcagaccccagctgagaacaaggccgagagcgaggagatggagaccagccaggccggcagcaaggacaagaagatggaccagcccccccaggccaagaaggccaaggtgaagaccagcacagtggacctgcccatcgagaaccagctgctgtggcagattgaccgggagatgctgaacctgtacattgaaaatgaaggcaagatgatcatgcaggacaagctggagaaggagagaaatgatgccaagaatgctgtggaggagtatgtgtatgagatgagggacaagctgtctggagaatatgagaagtttgtgtctgaagatgacagaaattccttcaccctgaagctggaggacacagagaactggctgtatgaagatggagaggaccagcccaagcaggtgtatgtggacaagctggccgagctgaagaacctgggccagcccatcaagatccgcttccaggagagcgaggagcggcccaagctgtttgaggagctgggcaagcagatccagcagtacatgaagatcatcagcagcttcaagaacaaggaggaccagtatgaccacctggatgctgctgacatgaccaaggtggagaagagcaccaatgaggccatggagtggatgaacaacaagctgaacctgcagaacaagcagagcctgaccatggaccctgtggtgaagagcaaggagattgaggccaagatcaaggagctgaccagcacctgcagccccatcatcagcaagcccaagcccaaggtggagccccccaaggaggagcagaagaatgctgagcagaatggacctgtggatggccagggcgacaaccctggcccccaggccgctgagcagggcacagacacagctgtgcccagcgacagcgacaagaagctgcctgagatggacattgattag

SEQ ID NO: 154988 - DNA, 447 bp, Artificial Sequence
  Description of Artificial Sequence: Synthetic coding sequence
atgtctgtggtgggcatcgacctgggcttccagagctgctacgtggccgtggcccgggccggcggcatcgagaccatcgccaatgagtacagcgaccgctgcaccccagcctgcatcagctttggccccaagaacagaagcatcggggctgctgccaagagccaggtgatcagcaatgccaagaacacagtgcagggcttcaagcgcttccacggccgggccttcagtgacccctttgtggaggccgagaagagcaacctggcctatgacatcgtgcagctgcccaccggcctgaccggcatcaaggtgacctacatggaggaggagcagaatggacctgtggatggccagggcgacaaccctggcccccaggccgctgagcagggcacagacacagctgtgcccagcgacagcgacaagaagctgcctgagatggacattgattag

SEQ ID NO: 154989 - DNA, 1422 bp, Artificial Sequence
  Description of Artificial Sequence: Synthetic coding sequence
atgtctgtggtgggcatcgacctgggcttccagagctgctacgtggccgtggcccgggccggcggcatcgagaccatcgccaatgagtacagcgaccgctgcaccccagcctgcatcagctttggccccaagaacagaagcatcggggctgctgccaagagccaggtgatcagcaatgccaagaacacagtgcagggcttcaagcgcttccacggccgggccttcagtgacccctttgtggaggccgagaagagcaacctggcctatgacatcgtgcagctgcccaccggcctgaccggcatcaaggtgacctacatggaggaggagaggaacttcaccacagagcaggtgacagccatgctgctgagcaagctgaaggagacagctgagagcgtgctgaagaagcctgtggtggactgtgtggtgtctgtgccctgcttctacacagatgctgagaggagatctgtgatggatgccacccagattgctggcctgaactgcctgcggctgatgaatgagaccacagctgtggccctggcctacggcatctacaagcaggacctgcctgccctggaggagaagcccagaaatgtggtgtttgtggacatgggccacagcgcctaccaggtgtctgtgtgtgccttcaacagaggcaagctgaaggtgctggccacagcctttgacaccaccctgggcggcaggaagtttgatgaggtgctggtgaaccacttctgtgaggagtttgggaagaagtacaagctggacatcaagagcaagatccgggccctgctgcggctgagccaggagtgtgagaagctgaagaagctgatgtctgccaatgccagtgacctgcccctgagcattgagtgcttcatgaatgatgtggatgtgtctggcaccatgaacagaggcaagttcctggagatgtgcaatgacctgctggcccgggtggagccccccctgcggtctgtgctggagcagaccaagctgaagaaggaggacatctatgctgtggagatcgtgggcggggccacccgcatcccagctgtgaaggagaagatcagcaagttcttcggcaaggagctgagcaccaccctgaatgctgatgaagctgtgacccggggctgtgccctgcagtgtgccatcctgagccctgccttcaaggtgcgggagttcagcatcacagatgtggtgccctaccccatcagcctgcgctggaacagccctgctgaggagggcagcagtgactgtgaggtgttcagcaagaaccacgccgcccccttcagcaaggtgctgaccttctacaggaaggagcccttcaccctggaggcctactacagcagccctggctttgccctgagccgcagctgctacagcatcatcaagagcctgctgagcctgatggcccctgtgcagaagtag

SEQ ID NO: 154990 - DNA, 1965 bp, Artificial Sequence
  Description of Artificial Sequence: Synthetic coding sequence
atgaagctgagcctggtggccgccatgctgctgctgctgtctgctgcccgggcagaggaggaggacaagaaggaggatgtgggcaccgtggtgggcatcgacctgggcaccacctacagctgtgtgggcgtcttcaagaatggccgggtggagatcatcgccaatgaccagggcaaccgcatcacccccagctatgtggccttcaccccagagggggagcggctgattggagatgctgccaagaaccagctgaccagcaacccagaaaatacagtgtttgatgccaagaggctgattggaagaacctggaatgaccccagcgtgcagcaggacatcaagttcctgcccttcaaggtggtggagaagaagaccaagccctacatccaggtggacatcggcggcggccagaccaagacctttgcccctgaggagatcagcgccatggtgctgaccaagatgaaggagacagctgaggcctacctgggcaagaaggtgacccatgctgtggtgacagtgcctgcctacttcaatgatgcccagaggcaggccaccaaggatgctggcaccatcgccggcctgaatgtgatgaggatcatcaatgagcccacagctgctgccatcgcctacggcctggacaagcgggagggggagaagaacatcctggtgtttgacctgggcggcggcacctttgatgtgtccctgctgaccatcgacaatggagtgtttgaggtggtggccaccaacggggacacccacctgggcggggaggactttgaccagagggtgatggagcacttcatcaagctgtacaagaagaagacaggcaaggatgtgaggaaggacaacagagctgtgcagaagctgcggcgggaggtggagaaggccaagagggccctgagcagccagcaccaggccagaattgaaattgagagcttctatgaaggagaggacttcagcgagaccctgacccgggccaagtttgaggagctgaacatggacctcttccgcagcaccatgaagcctgtgcagaaggtgctggaggacagcgacctgaagaagagtgacattgatgaaattgtgctggtgggcggcagcacccgcatccccaagatccagcagctggtgaaggagttcttcaacgggaaggagcccagccggggcatcaacccagatgaagctgtggcctacggggctgctgtgcaggccggcgtgctgagcggggaccaggacacaggagacctggtgctgctggatgtgtgccccctgaccctgggcatcgagaccgtgggcggcgtgatgaccaagctgatccccaggaacacagtggtgcccaccaagaagagccagatcttcagcacagccagtgacaaccagcccaccgtgaccatcaaggtgtatgaaggagagcggcccctgaccaaggacaaccacctgctgggcacctttgacctgaccggcatccccccagccccccggggcgtgccccagatcgaggtgacctttgaaattgatgtgaatggcatcctgcgggtgacagctgaggacaagggcaccggcaacaagaacaagatcaccatcaccaatgaccagaaccggctgaccccagaggagattgaaagaatggtgaatgatgctgagaagtttgctgaggaggacaagaagctgaaggagagaattgacaccagaaatgagctggagagctatgcctacagcctgaagaaccagatcggggacaaggagaagctgggcggcaagctgagcagcgaggacaaggagaccatggagaaggctgtggaggagaagattgagtggctggagagccaccaggatgctgacatcgaggacttcaaggccaagaagaaggagctggaggagatcgtgcagcccatcatcagcaagctgtatggcagcgctggccccccacccactggagaggaggacacagctgagaaggatgagctgtag

SEQ ID NO: 154991 - DNA, 837 bp, Artificial Sequence
  Description of Artificial Sequence: Synthetic coding sequence
atgaagctgagcctggtggccgccatgctgctgctgctgtctgctgcccgggcagaggaggaggacaagaaggaggatgtgggcaccgtggtgggcatcgacctgggcaccacctacagctgtgtgggcgtcttcaagaatggccgggtggagatcatcgccaatgaccagggcaaccgcatcacccccagctatgtggccttcaccccagagggggagcggctgattggagatgctgccaagaaccagctgaccagcaacccagaaaatacagtgtttgatgccaagaggctgattggaagaacctggaatgaccccagcgtgcagcaggacatcaagttcctgcccttcaaggtggtggagaagaagaccaagccctacatccaggtggacatcggcggcggccagaccaagacctttgcccctgaggagatcagcgccatggtgctgaccaagatgaaggagacagctgaggcctacctgggcaagaaggtgacccatgctgtggtgacagtgcctgcctacttcaatgatgcccagaggcaggccaccaaggatgctggcaccatcgccggcctgaatgtgatgaggatcatcaatgagcccacagctgctgccatcgcctacggcctggacaagcgggagggggagaagaacatcctggtgtttgacctgggcggcggcacctttgatgtgtccctgctgaccatcgacaatggagtgtttgaggtggtggccaccaacggggacacccacctgggcggggaggactttgaccagagggtgatggagcacttcatcaagctgtacaagaagaagaccttcctgcggccctag

SEQ ID NO: 154992 - DNA, 1932 bp, Artificial Sequence
  Description of Artificial Sequence: Synthetic coding sequence
atgcaggccccccgggagctggccgtgggcatcgacctgggcaccacctacagctgtgtgggcgtcttccagcagggccgggtggagatcctggccaatgaccagggcaacagaaccacccccagctatgtggccttcacagacacagagcggctggtgggagatgctgccaagagccaggccgccctgaacccccacaacacagtgtttgatgccaagaggctcatcggcaggaagtttgctgacaccaccgtgcagagcgacatgaagcactggcccttccgggtggtgtctgagggcggcaagcccaaggtgcgggtgtgctacagaggagaggacaagaccttctacccagaggagatcagctccatggtgctgagcaagatgaaggagacagctgaggcctacctgggccagcctgtgaagcacgccgtcatcaccgtgcctgcctacttcaatgacagccagaggcaggccaccaaggatgctggggccatcgccggcctgaatgtgctgcgcatcatcaatgagcccacagctgctgccatcgcctacggcctggacagaagaggagctggggagagaaatgtgctgatctttgacctgggcggcggcacctttgatgtgtctgtgctgagcattgatgctggggtgtttgaggtgaaggccacagctggggacacccacctgggcggagaagattttgacaaccggctggtgaaccacttcatggaggagttccggaggaagcacggcaaggacctgagcggcaacaagagggccctgcggcggctgaggacagcctgtgagcgggccaagaggaccctgagcagcagcacccaggccaccctggagattgacagcctgtttgagggcgtggacttctacaccagcatcacccgggccaggtttgaggagctgtgcagcgacctcttccgcagcaccctggagcctgtggagaaggccctgagagatgccaagctggacaaggcccagatccatgatgtggtgctggtgggcggcagcacccgcatccccaaggtgcagaagctgctgcaggacttcttcaacgggaaggagctgaacaagagcatcaacccagatgaggccgtggcctatggagctgctgtgcaggccgctgtgctgatgggagacaagtgtgagaaggtgcaggacctgctgctgctggatgtggcccccctgagcctgggcctggagacagctgggggcgtgatgaccaccctcatccagagaaatgccaccatccccaccaagcagacccagaccttcaccacctacagcgacaaccagcccggggtcttcatccaggtgtatgaaggagagcgggccatgaccaaggacaacaacctgctgggccgctttgagctgagcggcatccccccagccccccggggcgtgccccagatcgaggtgacctttgatattgatgccaacggcatcctgtctgtgacagccacagacaggagcacaggcaaggccaacaagatcaccatcaccaatgacaagggccgcctgagcaaggaggaggtggagaggatggtgcatgaggccgagcagtacaaggccgaggatgaggcccagagggacagagtggccgccaagaacagcctggaggcccacgtgttccacgtgaagggcagcctgcaggaggagagcctgcgggacaagatcccagaagaagatagaaggaagatgcaggacaagtgccgggaggtgctggcctggctggagcacaaccagctggccgagaaggaggagtatgagcaccagaagcgggagctggagcagatctgccggcccatcttcagccggctgtatggaggccctggggtgcctgggggcagcagctgtggcacccaggcccggcagggcgaccccagcacaggccccatcatcgaggaggtggactag

SEQ ID NO: 154993 - DNA, 1860 bp, Artificial Sequence
  Description of Artificial Sequence: Synthetic coding sequence
atgcaggccccccgggagctggccgtgggcatcgacctgggcaccacctacagctgtgtggccttcacagacacagagcggctggtgggagatgctgccaagagccaggccgccctgaacccccacaacacagtgtttgatgccaagaggctcatcggcaggaagtttgctgacaccaccgtgcagagcgacatgaagcactggcccttccgggtggtgtctgagggcggcaagcccaaggtgcgggtgtgctacagaggagaggacaagaccttctacccagaggagatcagctccatggtgctgagcaagatgaaggagacagctgaggcctacctgggccagcctgtgaagcacgccgtcatcaccgtgcctgcctacttcaatgacagccagaggcaggccaccaaggatgctggggccatcgccggcctgaatgtgctgcgcatcatcaatgagcccacagctgctgccatcgcctacggcctggacagaagaggagctggggagagaaatgtgctgatctttgacctgggcggcggcacctttgatgtgtctgtgctgagcattgatgctggggtgtttgaggtgaaggccacagctggggacacccacctgggcggagaagattttgacaaccggctggtgaaccacttcatggaggagttccggaggaagcacggcaaggacctgagcggcaacaagagggccctgcggcggctgaggacagcctgtgagcgggccaagaggaccctgagcagcagcacccaggccaccctggagattgacagcctgtttgagggcgtggacttctacaccagcatcacccgggccaggtttgaggagctgtgcagcgacctcttccgcagcaccctggagcctgtggagaaggccctgagagatgccaagctggacaaggcccagatccatgatgtggtgctggtgggcggcagcacccgcatccccaaggtgcagaagctgctgcaggacttcttcaacgggaaggagctgaacaagagcatcaacccagatgaggccgtggcctatggagctgctgtgcaggccgctgtgctgatgggagacaagtgtgagaaggtgcaggacctgctgctgctggatgtggcccccctgagcctgggcctggagacagctgggggcgtgatgaccaccctcatccagagaaatgccaccatccccaccaagcagacccagaccttcaccacctacagcgacaaccagcccggggtcttcatccaggtgtatgaaggagagcgggccatgaccaaggacaacaacctgctgggccgctttgagctgagcggcatccccccagccccccggggcgtgccccagatcgaggtgacctttgatattgatgccaacggcatcctgtctgtgacagccacagacaggagcacaggcaaggccaacaagatcaccatcaccaatgacaagggccgcctgagcaaggaggaggtggagaggatggtgcatgaggccgagcagtacaaggccgaggatgaggcccagagggacagagtggccgccaagaacagcctggaggcccacgtgttccacgtgaagggcagcctgcaggaggagagcctgcgggacaagatcccagaagaagatagaaggaagatgcaggacaagtgccgggaggtgctggcctggctggagcacaaccagctggccgagaaggaggagtatgagcaccagaagcgggagctggagcagatctgccggcccatcttcagccggctgtatggaggccctggggtgcctgggggcagcagctgtggcacccaggcccggcagggcgaccccagcacaggccccatcatcgaggaggtggactag

SEQ ID NO: 154994 - DNA, 2337 bp, Artificial Sequence
  Description of Artificial Sequence: Synthetic coding sequence
atgagcaagaggaagctgatccccaagctgagcatccagagccctgtgctgcacaccaacctgaatgtgcagagcacccacccccccctgaagaaggaggacctgcaccgcatcagcaaggacagcctggagagtgacagcgagagcctgacccaggagatcatgtgccacagcgagtttgatgaccgcatcagaggaaatggcatggagccagacagcctggatgaggaggagagcccccgctggggcagcctgcacgagatggaggaggaggccagcggcaaggccgcccagatggcccgggagcagaaccaccacacctgggaccagggcgccaacaaccggcagcagcccatcgaggacaagtacagcgacctgcgctatgaccccaactggaagagcaagaaggaggagggccagctgctgtctgtggaggccctgcctgagagcacagacagcagcctggagaacctgcccctggcccccctgtaccccagccaggagacctccatggagctgagcggcggcaaaggagagcagaaggagagcccccagagcgctgccagcctgctgggcagcgagttcctgagccccaactatgagcacggggcccggcgcagcaagcccttcagcgagctgagtgacagcgacctggaggagaagagcagcagcctgagcccctacgtgaagagcagcagcagccacaatgaggtgttcctgcccggcagccggggccccaggaggaggaagagcaagcagcactttgtggagaagaacaagctgaccctgggcctgcccacccccaagacagacagctacctgcagctgcacaacaagaagagaggagagagccaccctgagcagatctcctaccctgtgcgggtgacagacaagaccagcatccagaatgccaaggagatggagaatgctgccatcgaccctgaggacaagtggcaccagagggcccagcagctgaagaactaccaggagcactggagccagtatgagagcaccaagagcagcaatgtgccccggggccagcccagcgacatggtgaatgaccaccagcccagcagaagacctgccaagctgaagatcaggaagcagtgcaagcaccagaatggcctgaagagcagcaccacagaggaggtgacagccagccagggcaaccagaacaaccccccccggcagcagcagaaccagaacaagcccctggacaccagcaccaagccagagagcatcgtcatcatgcacgccagcaacaatgatgtgcaggccagccgggccctgcggagccacaacctgaaggagaccagcaacacctttgccccacccaagcaggcctttgacaaggtgctgagcaagaacagcacaggctgtgacagcggcctgaatgtgaacaaggagcggggccacaaggaccaggaggagaagcgcttctcctaccagcagctgcacaccctgagtgacatggacctgaacaacctgaatgagctgagcaagagacatgtgctgctgagccagaagggcagccagtttgtgtaccacatcaacacccacggcagcaccaagaacaagaagcagctgaagcagccctacacagagaccaagtacagaaacctggagatgctgtggaagttccacagcagcagtgacagccagacagtgcgggccagcccagacagctggctgacccagatcatggagcagcaccagcaggccctggtgcagctgacagatgtgcagcccagcgagggcgccctgagctctgtgaccctgccccccatcctgagccgggtggagagcgagagccagctgagcagcgagaggagccagaggaaccaggtgaagatcagccgcagcaacagcgagggctacctgttccagctggagaagggcaagaagcacaagaagaggagcagcagcaagaacaccaagctgaagggctaccagaagagagatgtgaagctgggcggcctgggccctgactttgagagcatccgggacaagacccagaagctgatccagcagaaggagtatgccaagcaggtgaaggagtacaacatgaagaccctgagcatcctgagcaagccccagacagagaagacccagaagaagagcgccatcccccggcagaaggccctggagtatgccaagaccatccccaagcccaagcccagcaacctgacccaccaggccagcaaggagcagaagaaccccacctacgccggcaaggaggagagcctgcctgagatcagcctgctggagatcctgcagaacagacatgagcgggagaagcaggccgtggccgccttcaaggtgctgcacatcgtgtag

SEQ ID NO: 154995 - DNA, 1482 bp, Artificial Sequence
  Description of Artificial Sequence: Synthetic coding sequence
atgagcaaaggacctgctgtgggcatcgacctgggcaccacctacagctgtgtgggcgtcttccagcacggcaaggtggagatcatcgccaatgaccagggcaacagaaccacccccagctatgtggccttcacagacacagagcggctgattggagatgctgccaagaaccaggtggccatgaaccccaccaacacagtgtttgatgccaagaggctcatcggccgccgctttgatgatgctgtggtgcagagcgacatgaagcactggcccttcatggtggtgaatgatgctggccggcccaaggtgcaggtggagtacaagggggagaccaagagcttctacccagaggaggtgtcctccatggtgctgaccaagatgaaggagattgctgaggcctacctgggcaagacagtgaccaatgctgtggtgacagtgcctgcctacttcaatgacagccagaggcaggccaccaaggatgctggcaccatcgccggcctgaatgtgctgcgcatcatcaatgagcccacagctgctgccatcgcctacggcctggacaagaaggtgggcgctgagagaaatgtgctgatctttgacctgggcggcggcacctttgatgtgtccatcctgaccattgaagatggcatctttgaggtgaagagcacagctggggacacccacctgggcggagaagattttgacaacaggatggtgaaccacttcatcgccgagttcaagaggaagcacaagaaggacatcagcgagaacaagagagctgtgcggcggctgaggacagcctgtgagcgggccaagaggaccctgagcagcagcacccaggccagcattgaaattgacagcctgtatgagggcatcgacttctacaccagcatcacccgggccaggtttgaggagctgaatgctgacctcttccggggcaccctggaccctgtggagaaggccctgagagatgccaagctggacaagagccagatccatgacatcgtgctggtgggcggcagcacccgcatccccaagatccagaagctgctgcaggacttcttcaacgggaaggagctgaacaagagcatcaacccagatgaggccgtggcctatggagctgctgtgcaggccgccatcctgagcggggacaagtcagaaaatgtgcaggacctgctgctgctggatgtgacccccctgagcctgggcattgaaacagctgggggcgtgatgacagtgctgatcaagaggaacaccaccatccccaccaagcagacccagaccttcaccacctacagcgacaaccagcccggggtgctgatccaggtgtatgaaggagagcgggccatgaccaaggacaacaacctgctgggcaagtttgagctgaccggcatgcctgggggcatgcctgggggcttccctgggggcggggccccacccagcggcggggccagcagcggccccaccatcgaggaggtggactag

SEQ ID NO: 154996 - DNA, 1884 bp, Artificial Sequence
  Description of Artificial Sequence: Synthetic coding sequence
atgagcaaaggacctgctgtgggcatcgacctgggcaccacctacagctgtgtgggcgtcttccagcacggcaaggtggagatcatcgccaatgaccagggcaacagaaccacccccagctatgtggccttcacagacacagagcggctgattggagatgctgccaagaaccaggtggccatgaaccccaccaacacagtgtttgatgccaagaggctcatcggccgccgctttgatgatgctgtggtgcagagcgacatgaagcactggcccttcatggtggtgaatgatgctggccggcccaaggtgcaggtggagtacaagggggagaccaagagcttctacccagaggaggtgtcctccatggtgctgaccaagatgaaggagattgctgaggcctacctgggcaaggccaccaaggatgctggcaccatcgccggcctgaatgtgctgcgcatcatcaatgagcccacagctgctgccatcgcctacggcctggacaagaaggtgggcgctgagagaaatgtgctgatctttgacctgggcggcggcacctttgatgtgtccatcctgaccattgaagatggcatctttgaggtgaagagcacagctggggacacccacctgggcggggaggactttgacaacaggatggtgaaccacttcatcgccgagttcaagaggaagcacaagaaggacatcagcgagaacaagagagctgtgcggcggctgaggacagcctgtgagcgggccaagaggaccctgagcagcagcacccaggccagcattgaaattgacagcctgtatgagggcatcgacttctacaccagcatcacccgggccaggtttgaggagctgaatgctgacctcttccggggcaccctggaccctgtggagaaggccctgagagatgccaagctggacaagagccagatccatgacatcgtgctggtgggcggcagcacccgcatccccaagatccagaagctgctgcaggacttcttcaacgggaaggagctgaacaagagcatcaacccagatgaagctgtggcctacggggctgctgtgcaggccgccatcctgagcggggacaagtcagaaaatgtgcaggacctgctgctgctggatgtgacccccctgagcctgggcatcgagacagctggaggagtgatgacagtgctgatcaagaggaacaccaccatccccaccaagcagacccagaccttcaccacctacagcgacaaccagcccggggtgctgatccaggtgtatgaaggagagcgggccatgaccaaggacaacaacctgctgggcaagtttgagctgaccggcatccccccagccccccggggcgtgccccagatcgaggtgacctttgatattgatgccaacggcatcctgaatgtgtctgctgtggacaagagcacaggcaaggagaacaagatcaccatcaccaatgacaagggccgcctgagcaaggaggacatcgagaggatggtgcaggaggccgagaagtacaaggcagaagatgagaagcagagggacaaggtgagcagcaagaacagcctggagagctatgccttcaacatgaaggccaccgtggaggatgagaagctgcagggcaagatcaatgatgaggacaagcagaagatcctggacaagtgcaatgagatcatcaactggctggacaagaaccagacagctgagaaggaggagtttgagcaccagcagaaggagctggagaaggtgtgcaaccccatcatcaccaagctgtaccagagcgctgggggcatgcctgggggcatgcctgggggcttccctgggggcggggccccacccagcggcggggccagcagcggccccaccatcgaggaggtggactag

SEQ ID NO: 154997 - DNA, 1941 bp, Artificial Sequence
  Description of Artificial Sequence: Synthetic coding sequence
atgagcaaaggacctgctgtgggcatcgacctgggcaccacctacagctgtgtgggcgtcttccagcacggcaaggtggagatcatcgccaatgaccagggcaacagaaccacccccagctatgtggccttcacagacacagagcggctgattggagatgctgccaagaaccaggtggccatgaaccccaccaacacagtgtttgatgccaagaggctcatcggccgccgctttgatgatgctgtggtgcagagcgacatgaagcactggcccttcatggtggtgaatgatgctggccggcccaaggtgcaggtggagtacaagggggagaccaagagcttctacccagaggaggtgtcctccatggtgctgaccaagatgaaggagattgctgaggcctacctgggcaagacagtgaccaatgctgtggtgacagtgcctgcctacttcaatgacagccagaggcaggccaccaaggatgctggcaccatcgccggcctgaatgtgctgcgcatcatcaatgagcccacagctgctgccatcgcctacggcctggacaagaaggtgggcgctgagagaaatgtgctgatctttgacctgggcggcggcacctttgatgtgtccatcctgaccattgaagatggcatctttgaggtgaagagcacagctggggacacccacctgggcggagaagattttgacaacaggatggtgaaccacttcatcgccgagttcaagaggaagcacaagaaggacatcagcgagaacaagagagctgtgcggcggctgaggacagcctgtgagcgggccaagaggaccctgagcagcagcacccaggccagcattgaaattgacagcctgtatgagggcatcgacttctacaccagcatcacccgggccaggtttgaggagctgaatgctgacctcttccggggcaccctggaccctgtggagaaggccctgagagatgccaagctggacaagagccagatccatgacatcgtgctggtgggcggcagcacccgcatccccaagatccagaagctgctgcaggacttcttcaacgggaaggagctgaacaagagcatcaacccagatgaggccgtggcctatggagctgctgtgcaggccgccatcctgagcggggacaagtcagaaaatgtgcaggacctgctgctgctggatgtgacccccctgagcctgggcattgaaacagctgggggcgtgatgacagtgctgatcaagaggaacaccaccatccccaccaagcagacccagaccttcaccacctacagcgacaaccagcccggggtgctgatccaggtgtatgaaggagagcgggccatgaccaaggacaacaacctgctgggcaagtttgagctgaccggcatccccccagccccccggggcgtgccccagatcgaggtgacctttgatattgatgccaacggcatcctgaatgtgtctgctgtggacaagagcacaggcaaggagaacaagatcaccatcaccaatgacaagggccgcctgagcaaagaagatattgaaagaatggtgcaggaggccgagaagtacaaggccgaggatgagaagcagagggacaaggtgagcagcaagaacagcctggagagctatgccttcaacatgaaggccaccgtggaggatgagaagctgcagggcaagatcaatgatgaggacaagcagaagatcctggacaagtgcaatgagatcatcaactggctggacaagaaccagacagctgagaaggaggagtttgagcaccagcagaaggagctggagaaggtgtgcaaccccatcatcaccaagctgtaccagagcgctgggggcatgcctgggggcatgcctgggggcttccctgggggcggggcccctccttctggaggagccagcagcggccccaccatcgaggaggtggactag

SEQ ID NO: 154998 - DNA, 1503 bp, Artificial Sequence
  Description of Artificial Sequence: Synthetic coding sequence
atgagcaaaggacctgctgtgggcatcgacctgggcaccacctacagctgtgtgggcgtcttccagcacggcaaggtggagatcatcgccaatgaccagggcaacagaaccacccccagctatgtggccttcacagacacagagcggctgattggagatgctgccaagaaccaggtggccatgaaccccaccaacacagtgtttgatgccaagaggctcatcggccgccgctttgatgatgctgtggtgcagagcgacatgaagcactggcccttcatggtggtgaatgatgctggccggcccaagcacaagaaggacatcagcgagaacaagagagctgtgcggcggctgaggacagcctgtgagcgggccaagaggaccctgagcagcagcacccaggccagcattgaaattgacagcctgtatgagggcatcgacttctacaccagcatcacccgggccaggtttgaggagctgaatgctgacctcttccggggcaccctggaccctgtggagaaggccctgagagatgccaagctggacaagagccagatccatgacatcgtgctggtgggcggcagcacccgcatccccaagatccagaagctgctgcaggacttcttcaacgggaaggagctgaacaagagcatcaacccagatgaggccgtggcctatggagctgctgtgcaggccgccatcctgagcggggacaagtcagaaaatgtgcaggacctgctgctgctggatgtgacccccctgagcctgggcattgaaacagctgggggcgtgatgacagtgctgatcaagaggaacaccaccatccccaccaagcagacccagaccttcaccacctacagcgacaaccagcccggggtgctgatccaggtgtatgaaggagagcgggccatgaccaaggacaacaacctgctgggcaagtttgagctgaccggcatccccccagccccccggggcgtgccccagatcgaggtgacctttgatattgatgccaacggcatcctgaatgtgtctgctgtggacaagagcacaggcaaggagaacaagatcaccatcaccaatgacaagggccgcctgagcaaagaagatattgaaagaatggtgcaggaggccgagaagtacaaggccgaggatgagaagcagagggacaaggtgagcagcaagaacagcctggagagctatgccttcaacatgaaggccaccgtggaggatgagaagctgcagggcaagatcaatgatgaggacaagcagaagatcctggacaagtgcaatgagatcatcaactggctggacaagaaccagacagctgagaaggaggagtttgagcaccagcagaaggagctggagaaggtgtgcaaccccatcatcaccaagctgtaccagagcgctgggggcatgcctgggggcatgcctgggggcttccctgggggcggggcccctccttctggaggagccagcagcggccccaccatcgaggaggtggactag

SEQ ID NO: 154999 - DNA, 1233 bp, Artificial Sequence
  Description of Artificial Sequence: Synthetic coding sequence
atggtgaaccacttcatcgccgagttcaagaggaagcacaagaaggacatcagcgagaacaagagagctgtgcggcggctgaggacagcctgtgagcgggccaagaggaccctgagcagcagcacccaggccagcattgaaattgacagcctgtatgagggcatcgacttctacaccagcatcacccgggccaggtttgaggagctgaatgctgacctcttccggggcaccctggaccctgtggagaaggccctgagagatgccaagctggacaagagccagatccatgacatcgtgctggtgggcggcagcacccgcatccccaagatccagaagctgctgcaggacttcttcaacgggaaggagctgaacaagagcatcaacccagatgaggccgtggcctatggagctgctgtgcaggccgccatcctgagcggggacaagtcagaaaatgtgcaggacctgctgctgctggatgtgacccccctgagcctgggcattgaaacagctgggggcgtgatgacagtgctgatcaagaggaacaccaccatccccaccaagcagacccagaccttcaccacctacagcgacaaccagcccggggtgctgatccaggtgtatgaaggagagcgggccatgaccaaggacaacaacctgctgggcaagtttgagctgaccggcatccccccagccccccggggcgtgccccagatcgaggtgacctttgatattgatgccaacggcatcctgaatgtgtctgctgtggacaagagcacaggcaaggagaacaagatcaccatcaccaatgacaagggccgcctgagcaaagaagatattgaaagaatggtgcaggaggccgagaagtacaaggccgaggatgagaagcagagggacaaggtgagcagcaagaacagcctggagagctatgccttcaacatgaaggccaccgtggaggatgagaagctgcagggcaagatcaatgatgaggacaagcagaagatcctggacaagtgcaatgagatcatcaactggctggacaagaaccagacagctgagaaggaggagtttgagcaccagcagaaggagctggagaaggtgtgcaaccccatcatcaccaagctgtaccagagcgctgggggcatgcctgggggcatgcctgggggcttccctgggggcggggcccctccttctggaggagccagcagcggccccaccatcgaggaggtggactag

SEQ ID NO: 155000 - DNA, 1941 bp, Artificial Sequence; identical to SEQ ID NO: 154997
  Description of Artificial Sequence: Synthetic coding sequence

SEQ ID NO: 155001 - DNA, 2040 bp, Artificial Sequence
  Description of Artificial Sequence: Synthetic coding sequence
atgatcagcgccagcagagctgctgctgcccggctggtgggcgccgccgccagccggggccccacagctgcccggcaccaggacagctggaatggcctgagccatgaggccttccggctggtgtccagaagagattatgccagcgaggccatcaagggagctgtggtgggcatcgacctgggcaccaccaacagctgtgtggccgtgatggagggcaagcaggccaaggtgctggagaatgctgagggcgcccggaccaccccatctgtggtggccttcaccgcagatggagagcggctggtgggcatgcctgccaagaggcaggccgtgaccaaccccaacaacaccttctacgccaccaagaggctcatcggccgccgctatgatgatcctgaggtgcagaaggacatcaagaatgtgcccttcaagatcgtgcgggccagcaatggagatgcctgggtggaggcccacggcaagctgtacagccccagccagatcggggcctttgtgctgatgaagatgaaggagacagctgagaactacctgggccacacagccaagaatgctgtgatcaccgtgcctgcctacttcaatgacagccagaggcaggccaccaaggatgctggccagatcagcggcctgaatgtgctgcgggtcatcaatgagcccacagctgctgccctggcctacggcctggacaagtctgaggacaaggtgattgctgtgtatgacctgggcggcggcacctttgacatcagcatcctggagatccagaagggcgtgtttgaggtgaagagcaccaacggggacaccttcctgggcggggaggactttgaccaggccctgctgcggcacatcgtgaaggagttcaagcgggagaccggggtggacctgaccaaggacaacatggccctgcagagggtgcgggaggccgctgagaaggccaagtgtgagctgagcagctctgtgcagacagacatcaacctgccctacctgaccatggacagcagcggccccaagcacctgaacatgaagctgacccgggcccagtttgagggcatcgtgacagacctgatccggaggaccatcgccccctgccagaaggccatgcaggatgctgaggtgtccaagagtgacatcggggaggtgatcctggtgggcggcatgaccaggatgcccaaggtgcagcagacagtgcaggacctgtttggccgggcccccagcaaggctgtgaacccagatgaggccgtggccatcggggccgccatccagggcggcgtgctggccggagatgtgacagatgtgctgctgctggatgtgacccccctgagcctgggcatcgagaccctgggcggcgtcttcaccaagctgatcaacagaaacaccaccatccccaccaagaagagccaggtgttcagcacagctgctgatggccagacccaggtggagatcaaggtgtgccagggcgagcgggagatggccggggacaacaagctgctgggccagttcaccctcatcggcatccccccagccccccggggcgtgccccagatcgaggtgacctttgatattgatgccaatggaattgtgcacgtgtctgccaaggacaagggcaccggccgggagcagcagatcgtcatccagagcagcggcggcctgagcaaggatgacatcgagaacatggtgaagaatgctgagaagtatgcagaagaagatagaaggaagaaggagcgggtggaggccgtgaacatggccgagggcatcatccatgacacagagaccaagatggaggagttcaaggaccagctgcctgcagatgagtgcaacaagctgaaggaggagatcagcaagatgagggagctgctggccaggaaggacagcgagactggagagaacatccggcaggccgccagcagcctgcagcaggccagcctgaagctgtttgagatggcctacaagaagatggccagcgagcgggagggcagcggcagcagcggcactggagagcagaaggaggaccagaaggaggagaagcagtag

SEQ ID NO: 155002 - DNA, 1998 bp, Artificial Sequence
  Description of Artificial Sequence: Synthetic coding sequence
atgatcagcgccagcagagctgctgctgcccggcaccaggacagctggaatggcctgagccatgaggccttccggctggtgtccagaagagattatgccagcgaggccatcaagggagctgtggtgggcatcgacctgggcaccaccaacagctgtgtggccgtgatggagggcaagcaggccaaggtgctggagaatgctgagggcgcccggaccaccccatctgtggtggccttcaccgcagatggagagcggctggtgggcatgcctgccaagaggcaggccgtgaccaaccccaacaacaccttctacgccaccaagaggctcatcggccgccgctatgatgatcctgaggtgcagaaggacatcaagaatgtgcccttcaagatcgtgcgggccagcaatggagatgcctgggtggaggcccacggcaagctgtacagccccagccagatcggggcctttgtgctgatgaagatgaaggagacagctgagaactacctgggccacacagccaagaatgctgtgatcaccgtgcctgcctacttcaatgacagccagaggcaggccaccaaggatgctggccagatcagcggcctgaatgtgctgcgggtcatcaatgagcccacagctgctgccctggcctacggcctggacaagtctgaggacaaggtgattgctgtgtatgacctgggcggcggcacctttgacatcagcatcctggagatccagaagggcgtgtttgaggtgaagagcaccaacggggacaccttcctgggcggggaggactttgaccaggccctgctgcggcacatcgtgaaggagttcaagcgggagaccggggtggacctgaccaaggacaacatggccctgcagagggtgcgggaggccgctgagaaggccaagtgtgagctgagcagctctgtgcagacagacatcaacctgccctacctgaccatggacagcagcggccccaagcacctgaacatgaagctgacccgggcccagtttgagggcatcgtgacagacctgatccggaggaccatcgccccctgccagaaggccatgcaggatgctgaggtgtccaagagtgacatcggggaggtgatcctggtgggcggcatgaccaggatgcccaaggtgcagcagacagtgcaggacctgtttggccgggcccccagcaaggctgtgaacccagatgaggccgtggccatcggggccgccatccagggcggcgtgctggccggagatgtgacagatgtgctgctgctggatgtgacccccctgagcctgggcatcgagaccctgggcggcgtcttcaccaagctgatcaacagaaacaccaccatccccaccaagaagagccaggtgttcagcacagctgctgatggccagacccaggtggagatcaaggtgtgccagggcgagcgggagatggccggggacaacaagctgctgggccagttcaccctcatcggcatccccccagccccccggggcgtgccccagatcgaggtgacctttgatattgatgccaatggaattgtgcacgtgtctgccaaggacaagggcaccggccgggagcagcagatcgtcatccagagcagcggcggcctgagcaaggatgacatcgagaacatggtgaagaatgctgagaagtatgcagaagaagatagaaggaagaaggagcgggtggaggccgtgaacatggccgagggcatcatccatgacacagagaccaagatggaggagttcaaggaccagctgcctgcagatgagtgcaacaagctgaaggaggagatcagcaagatgagggagctgctggccaggaaggacagcgagactggagagaacatccggcaggccgccagcagcctgcagcaggccagcctgaagctgtttgagatggcctacaagaagatggccagcgagcgggagggcagcggcagcagcggcactggagagcagaaggaggaccagaaggaggagaagcagtag

SEQ ID NO: 155003 - DNA, 1899 bp, Artificial Sequence
  Description of Artificial Sequence: Synthetic coding sequence
atggccctggtgatgaggctgctggacctcttccagggcggcatcatgcaccagaagcagagccgggagcagctgctggtgctgatctgggtgctgcccaccccagcctggcagctgtggaaggtgaacaagcagcgctgctggaggatgcccaaggtgcctgagccccccctgcagctgtggcccctgcagcagatggtgtctgacctgctggagtgccggcccagcgaccggctgagccccacccagaccatccacttcatgctgcccagcgtgtccctggccggggacatgatgatcctgaagtacaggaagaccctgaagatgttccccctgaagctgtctgtgccccccatggtgatgcctgtgctgatgaagatgaaggagacagctgagaactacctgggccacacagccaagaatgctgtgatcaccgtgcctgcctacttcaatgacagccagaggcaggccaccaaggatgctggccagatcagcggcctgaatgtgctgcgggtcatcaatgagcccacagctgctgccctggcctacggcctggacaagtctgaggacaaggtgattgctgtgtatgacctgggcggcggcacctttgacatcagcatcctggagatccagaagggcgtgtttgaggtgaagagcaccaatggagacaccttcctgggcggagaagattttgaccaggccctgctgcggcacatcgtgaaggagttcaagcgggagactggagtggacctgaccaaggacaacatggccctgcagagggtgcgggaggccgctgagaaggccaagtgtgagctgagcagctctgtgcagacagacatcaacctgccctacctgaccatggacagcagcggccccaagcacctgaacatgaagctgacccgggcccagtttgagggcatcgtgacagacctgatccggaggaccatcgccccctgccagaaggccatgcaggatgctgaggtgtccaagagtgacattggagaggtgatcctggtgggcggcatgaccaggatgcccaaggtgcagcagacagtgcaggacctgtttggccgggcccccagcaaggctgtgaacccagatgaagctgtggccatcggggccgccatccagggcggcgtgctggccggagatgtgacagatgtgctgctgctggatgtgacccccctgagcctgggcatcgagaccctgggcggcgtcttcaccaagctgatcaacagaaacaccaccatccccaccaagaagagccaggtgttcagcacagctgctgatggccagacccaggtggagatcaaggtgtgccagggcgagcgggagatggccggggacaacaagctgctgggccagttcaccctgattggcatccccccagccccccggggcgtgccccagatcgaggtgacctttgatattgatgccaacggcatcgtgcacgtgtctgccaaggacaagggcaccggccgggagcagcagatcgtcatccagagcagcggcggcctgagcaaggatgacatcgagaacatggtgaagaatgctgagaagtatgcagaggaggacaggaggaagaaggagcgggtggaggccgtgaacatggccgagggcatcatccatgacacagagaccaagatggaggagttcaaggaccagctgcctgcagatgagtgcaacaagctgaaggaggagatcagcaagatgagggagctgctggccaggaaggacagcgagaccggggagaacatccggcaggccgccagcagcctgcagcaggccagcctgaagctgtttgagatggcctacaagaagatggccagcgagcgggagggcagcggcagcagcggcaccggggagcagaaggaggaccagaaggaggagaagcagtag

SEQ ID NO: 155004 - DNA, 2175 bp, Artificial Sequence
  Description of Artificial Sequence: Synthetic coding sequence
atgcctgaggaggtgcaccacggggaggaggaggtggagacctttgccttccaggccgagatcgcccagctgatgagcctcatcatcaacaccttctacagcaacaaggagatcttcctgcgggagctgatcagcaatgccagtgatgccctggacaagatccgctatgagagcctgacagaccccagcaagctggacagcggcaaggagctgaagattgacatcatccccaacccccaggagaggaccctgaccctggtggacacaggaattggcatgaccaaggctgacctgatcaacaacctgggcaccatcgccaagagcggcaccaaggccttcatggaggccctgcaggccggggctgacatctccatgattggccagtttggagtgggcttctacagcgcctacctggtggccgagaaggtggtggtgatcaccaagcacaatgatgatgagcagtatgcctgggagagcagcgctgggggcagcttcaccgtgcgggctgaccatggagagcccatcggccggggcaccaaggtgatcctgcacctgaaggaggaccagacagagtacctggaggagcggcgggtgaaggaggtggtgaagaagcacagccagttcatcggctaccccatcaccctgtacctggagaaggagcgggagaaggagatcagtgatgatgaggccgaggaggagaagggggagaaggaggaggaggacaaggatgatgaggagaagcccaagattgaagatgtgggcagtgatgaggaggatgattctgggaaggacaagaagaagaagaccaagaagatcaaggagaagtacatcgaccaggaggagctgaacaagaccaagcccatctggaccagaaatccagatgacatcacccaggaggagtatggagagttctacaagagcctgaccaatgactgggaggaccacctggccgtgaagcacttctctgtggagggccagctggagttccgggccctgctcttcatcccccggcgggccccctttgacctgtttgagaacaagaagaagaagaacaacatcaagctgtatgtgcggcgggtcttcatcatggacagctgtgatgagctgatccctgagtacctgaacttcatccggggcgtggtggacagcgaggacctgcccctgaacatcagccgggagatgctgcagcagagcaagatcctgaaggtgatcaggaagaacatcgtgaagaagtgcctggagctgttcagcgagctggccgaggacaaggagaactacaagaagttctatgaggccttcagcaagaacctgaagctgggcatccacgaggacagcaccaacagaagaaggctgtctgagctgctgcgctaccacaccagccagagcggagatgagatgaccagcctgtctgaatatgtgtccaggatgaaggagacccagaagagcatctactacatcactggagagagcaaggagcaggtggccaacagcgcctttgtggagcgggtgaggaagaggggctttgaggtggtgtacatgacagagcccattgatgagtactgtgtgcagcagctgaaggagtttgatggcaagagcctggtgtctgtgaccaaggagggcctggagctgcctgaagatgaggaggagaagaagaagatggaggagagcaaggccaagtttgagaacctgtgcaagctgatgaaggagatcctggacaagaaggtggagaaggtgaccatcagcaaccggctggtgagcagcccctgctgcatcgtgaccagcacctacggctggacagccaacatggagcgcatcatgaaggcccaggccctgcgggacaacagcaccatgggctacatgatggccaagaagcacctggagatcaacccagaccaccccatcgtggagaccctgcggcagaaggccgaggccgacaagaatgacaaggctgtgaaggacctggtggtgctgctgtttgaaacagccctgctgagcagcggcttcagcctggaggacccccagacccacagcaaccgcatctacaggatgatcaagctgggcctgggcattgatgaagatgaggtggccgctgaggagcccaatgctgctgtgcctgatgagatcccccccctggagggagatgaagatgccagcaggatggaggaggtggactag

SEQ ID NO: 155005 - DNA, 2175 bp, Artificial Sequence; identical to SEQ ID NO: 155004
  Description of Artificial Sequence: Synthetic coding sequence

SEQ ID NO: 155006 - DNA, 465 bp, Artificial Sequence
  Description of Artificial Sequence: Synthetic coding sequence
atggacagctgtgatgagctgatccctgagtacctgaacttcatccggggcgtggtggacagcgaggacctgcccctgaacatcagccgggagatgctgcagcagagcaagatcctgaaggtgatcaggaagaacatcgtgaagaagtgcctggagctgttcagcgagctggccgaggacaaggagaactacaagaagttctatgaggccttcagcaagaacctgaagctgggcatccacgaggacagcaccaacagaagaaggctgtctgagctgctgcgctaccacaccagccagagcggagatgagatgaccagcctgtctgaatatgtgtccaggatgaaggagacccagaagagcatctactacatcactggagagagcaaggagcaggtgtgcccctgccccacctggctgcccctgctggtgtcctctgtgttcttccccctgctgagcctgtgctag

SEQ ID NO: 155007 - DNA, 489 bp, Artificial Sequence
  Description of Artificial Sequence: Synthetic coding sequence
atggacagctgtgatgagctgatccctgagtacctgaacttcatccggggcgtggtggacagcgaggacctgcccctgaacatcagccgggagatgctgcagcagagcaagatcctgaaggtgatcaggaagaacatcgtgaagaagtgcctggagctgttcagcgagctggccgaggacaaggagaactacaagaagttctatgaggccttcagcaagaacctgaagctgggcatccacgaggacagcaccaacagaagaaggctgtctgagctgctgcgctaccacaccagccagagcggagatgagatgaccagcctgtctgaatatgtgtccaggatgaaggagacccagaagagcatctactacatcactggagagagcaaggagcaggtggccaacagcgcctttgtggagcgctgcccctgccccacctggctgcccctgctggtgtcctctgtgttcttccccctgctgagcctgtgctag

SEQ ID NO: 155008 - DNA, 552 bp, Artificial Sequence
  Description of Artificial Sequence: Synthetic coding sequence
atggacagctgtgatgagctgatccctgagtacctgaacttcatccggggcgtggtggacagcgaggacctgcccctgaacatcagccgggagatgctgcagcagagcaagatcctgaaggtgatcaggaagaacatcgtgaagaagtgcctggagctgttcagcgagctggccgaggacaaggagaactacaagaagttctatgaggccttcagcaagaacctgaagctgggcatccacgaggacagcaccaacagaagaaggctgtctgagctgctgcgctaccacaccagccagagcggagatgagatgaccagcctgtctgaatatgtgtccaggatgaaggagacccagaagagcatctactacatcaccggcagcccctgctggtgcctggtgttcttcagcctgagctgcccctgtgtggagggcagcaagctgcgggtgagcagccccatccccagcctgctgctgacagctggcctggatgtggtgtactgcggcctcttctacttcctgcactttgtgctgaagctgaagtatgccaagtag

SEQ ID NO: 155009 - DNA, 2175 bp, Artificial Sequence; identical to SEQ ID NO: 155004
  Description of Artificial Sequence: Synthetic coding sequence

SEQ ID NO: 155010 - DNA, 429 bp, Artificial Sequence
  Description of Artificial Sequence: Synthetic coding sequence
tgattcatccggggcgtggtggacagcgaggacctgcccctgaacatcagccgggagatgctgcagcagagcaagatcctgaaggtgatcaggaagaacatcgtgaagaagtgcctggagctgttcagcgagctggccgaggacaaggagaactacaagaagttctatgaggccttcagcaagaacctgaagctgggcatccacgaggacagcaccaacagaagaaggctgtctgagctgctgcgctaccacaccagccagagcggagatgagatgaccagcctgtctgaatatgtgtccaggatgaaggagacccagaagagcatctactacatcactggagagagcaaggagcaggtgtgcccctgccccacctggctgcccctgctggtgtcctctgtgttcttccccctgctgagcctgtgctag

SEQ ID NO: 155011 - DNA, 453 bp, Artificial Sequence
  Description of Artificial Sequence: Synthetic coding sequence
tgattcatccggggcgtggtggacagcgaggacctgcccctgaacatcagccgggagatgctgcagcagagcaagatcctgaaggtgatcaggaagaacatcgtgaagaagtgcctggagctgttcagcgagctggccgaggacaaggagaactacaagaagttctatgaggccttcagcaagaacctgaagctgggcatccacgaggacagcaccaacagaagaaggctgtctgagctgctgcgctaccacaccagccagagcggagatgagatgaccagcctgtctgaatatgtgtccaggatgaaggagacccagaagagcatctactacatcactggagagagcaaggagcaggtggccaacagcgcctttgtggagcgctgcccctgccccacctggctgcccctgctggtgtcctctgtgttcttccccctgctgagcctgtgctag

SEQ ID NO: 155012 - DNA, 516 bp, Artificial Sequence
  Description of Artificial Sequence: Synthetic coding sequence
tgattcatccggggcgtggtggacagcgaggacctgcccctgaacatcagccgggagatgctgcagcagagcaagatcctgaaggtgatcaggaagaacatcgtgaagaagtgcctggagctgttcagcgagctggccgaggacaaggagaactacaagaagttctatgaggccttcagcaagaacctgaagctgggcatccacgaggacagcaccaacagaagaaggctgtctgagctgctgcgctaccacaccagccagagcggagatgagatgaccagcctgtctgaatatgtgtccaggatgaaggagacccagaagagcatctactacatcaccggcagcccctgctggtgcctggtgttcttcagcctgagctgcccctgtgtggagggcagcaagctgcgggtgagcagccccatccccagcctgctgctgacagctggcctggatgtggtgtactgcggcctcttctacttcctgcactttgtgctgaagctgaagtatgccaagtag

SEQ ID NO: 155013 - DNA, 507 bp, Artificial Sequence
  Description of Artificial Sequence: Synthetic coding sequence
atgcctgaggaggtgcaccacggggaggaggaggtggagacctttgccttccaggccgagatcgcccagctgatgagcctcatcatcaacaccttctacagcaacaaggagatcttcctgcgggagctgatcagcaatgccagtgatgccctggacaagatccgctatgagagcctgacagaccccagcaagctggacagcggcaaggagctgaagattgacatctccatgattggccagtttggagtgggcttctacagcgcctacctggtggccgagaaggtggtggtgatcaccaagcacaatgatgatgagcagtatgcctgggagagcagcgctgggggcagcttcaccgtgcgggctgaccatggagagcccatcggccggggcaccaaggtgatcctgcacctgaaggaggaccagacagagtacctggaggagcggcgggtgaaggaggtggtgaagaagcacagccagttcatcggctaccccatcaccctgtactag

SEQ ID NO: 155014 - DNA, 483 bp, Artificial Sequence
  Description of Artificial Sequence: Synthetic coding sequence
atggagatccctgtgcctgtgcagcccagctggctgcggcgggccagcgcccccctgcccggcctgagcgcccctggccgcctgtttgaccagagatttggagagggcctgctggaggccgagctggccgccctgtgccccaccaccctggccccctactacctgcgggcccccagcgtggccctgcctgtggcccaggtgcccacagatcctggccacttctctgtgctgctggatgtgaagcacttcagccctgaggagattgctgtgaaggtggtgggggagcacgtggaggtgcacgcccggcatgaggagaggccagatgagcacggctttgtggcccgggagttccaccggcgctaccgcctgcccccaggagtggaccctgctgctgtgaccagcgccctgagccctgagggcgtgctgagcatccaggccgccccagccagcgcccaggcccctcctcctgctgctgccaagtag

SEQ ID NO: 155015 - DNA, 483 bp, Artificial Sequence; identical to SEQ ID NO: 155014
  Description of Artificial Sequence: Synthetic coding sequence

SEQ ID NO: 155016 - DNA, 591 bp, Artificial Sequence
  Description of Artificial Sequence: Synthetic coding sequence
atggagatccctgtgcctgtgcagcccagctggctgcggcgggccagcgcccccctgcccggcctgagcgcccctggccgcctgtttgaccagagatttggagagggcctgctggaggccgagctggccgccctgtgccccaccaccctggccccctactacctgcgggcccccagcgtggccctgcctgtggcccaggtgcccacagatcctggccacttctctgtgctgctggatgtgaagcacttcagccctgaggagattgctgtgaaggtggtgggggagcacgtggaggtgcacgcccggcatgaggagaggccagatgagcacggctttgtggcccgggagttccaccggcgctaccgcctgcccccaggagtggaccctgctgctgtgaccagcgccctgagccctgagggcgtgctgagcatccaggccgccccagccccccgggagcccccccaggcccccagcatcaaggctgacctgaccccacccagccagatgagccgggtgcggcagggcctgagcagccaccccctgctggacagcgccctgaccagcatcctggacacagccctgatcacctag

SEQ ID NO: 155017 - DNA, 1590 bp, Artificial Sequence
  Description of Artificial Sequence: Synthetic coding sequence
atggacctgcctgtgggccctggagctgctggccccagcaatgtgcctgccttcctgaccaagctgtggaccctggtgtctgaccctgacacagatgccctgatctgctggagccccagcggcaacagcttccacgtgtttgaccagggccagtttgccaaggaggtgctgcccaagtacttcaagcacaacaacatggccagctttgtgcggcagctgaacatgtatggcttcaggaaggtggtgcacatcgagcagggcggcctggtgaagccagagagagatgacacagagttccagcacccctgcttcctgcggggccaggagcagctgctggagaacatcaagaggaaggtgacctctgtgtccaccctgaagtctgaggacatcaagatccggcaggacagcgtgaccaagctgctgacagatgtgcagctgatgaagggcaagcaggagtgcatggacagcaagctgctggccatgaagcatgaaaatgaggccctgtggagggaggtggccagcctgcggcagaagcacgcccagcagcagaaggtggtgaacaagctgatccagttcctgatcagcctggtgcagagcaaccgcatcctgggcgtgaagaggaagatccccctgatgctgaatgacagcggcagcgcccacagcatgcccaagtacagccggcagttcagcctggagcacgtgcacggcagcggcccctacagcgcccccagccctgcctacagcagcagcagcctgtatgccccagatgctgtggccagcagcggccccatcatcagtgacatcacagagctggccccagccagccccatggccagccctgggggcagcattgatgagcggcccctgagcagcagccccctggtgcgggtgaaggaggagccccccagccccccccagagcccccgggtggaggaggccagccctggccggcccagctctgtggacaccctgctgagccccacagccctgattgacagcatcctgcgggagagcgagcccgccccagcctctgtgacagccctgacagatgcccggggccacacagacacagagggccggccccccagccccccacccaccagcaccccagagaagtgcctgtctgtggcctgcctggacaagaatgagctgagtgaccacctggatgccatggacagcaacctggacaacctgcagaccatgctgagcagccacggcttctctgtggacaccagcgccctgctggacctcttcagccccagcgtgacagtgcctgacatgagcctgcctgacctggacagcagcctggccagcatccaggagctgctgagcccccaggagccccccaggcctcctgaggccgagaacagcagcccagattctgggaagcagctggtgcactacacagcccagcccctcttcctgctggaccccggctctgtggacaccggcagcaatgacctgcctgtgctgtttgagctgggggagggcagctacttctctgaaggagatggctttgctgaggaccccaccatcagcctgctgaccggcagcgagccccccaaggccaaggaccccaccgtgtcctag

SEQ ID NO: 155018 - DNA, 1611 bp, Artificial Sequence
  Description of Artificial Sequence: Synthetic coding sequence
atgaagcagagcagcaatgtgcctgccttcctgagcaagctgtggaccctggtggaggagacccacaccaatgagttcatcacctggagccagaatggccagagcttcctggtgctggatgagcagagatttgccaaggagatcctgcccaagtacttcaagcacaacaacatggccagctttgtgcggcagctgaacatgtatggcttcaggaaggtggtgcacatcgacagcggcatcgtgaagcaggagagagatggccctgtggagttccagcacccctacttcaagcagggccaggatgacctgctggagaacatcaagaggaaggtgagcagcagcaagccagaggagaacaagatccggcaggaggacctgaccaagatcatcagcagcgcccagaaggtgcagatcaagcaggagaccatcgagagccggctgtctgagctgaagtcagaaaatgaaagcctgtggaaggaggtgtctgagctgcgggccaagcacgcccagcagcagcaggtgatcaggaagatcgtgcagttcatcgtgaccctggtgcagaacaaccagctggtgtccctgaagaggaagaggcccctgctgctgaacaccaatggagcccagaagaagaacctcttccagcacatcgtgaaggagcccacagacaaccaccaccacaaggtgccccacagcaggacagagggcctgaagccccgggagcgcatcagtgatgacatcatcatctatgatgtgacagatgacaatgctgatgaggagaacatccctgtgattcctgagaccaatgaagatgtgatcagtgaccccagcaactgcagccagtacccagacatcgtcatcgtggaggatgacaatgaagatgaatatgcccctgtgatccagagcggggagcagaatgaaccagcccgggagagcctgagcagcggcagtgatggcagcagccccctgatgagcagcgctgtgcagctgaatggcagcagcagcctgaccagcgaggaccctgtgaccatgatggacagcatcctgaatgacaacatcaacctgctgggcaaggtggagctgctggactacctggacagcattgactgcagcctggaggacttccaggccatgctgagcggccggcagttcagcattgatcctgacctgctggtggacctcttcaccagctctgtgcagatgaaccccacagactacatcaacaacaccaagtctgagaacaagggcctggagaccaccaagaacaacgtggtgcagcctgtgtctgaggagggcaggaagagcaagagcaagccagacaagcagctgatccagtacacagccttccccctgctggccttcctggatggcaacccagccagctctgtggagcaggccagcaccacagccagcagcgaggtgctgagctctgtggacaagcccatcgaggtggatgagctgctggacagcagcctggaccctgagcccacccagagcaagctggtgcggctggagcccctgacagaagctgaggccagcgaggccaccctcttctacctgtgtgagctggccccagcccccctggacagcgacatgcccctgctggacagctag

SEQ ID NO: 155019 - DNA, 1557 bp, Artificial Sequence
  Description of Artificial Sequence: Synthetic coding sequence
atgaagcagagcagcaatgtgcctgccttcctgagcaagctgtggaccctggtggaggagacccacaccaatgagttcatcacctggagccagaatggccagagcttcctggtgctggatgagcagagatttgccaaggagatcctgcccaagtacttcaagcacaacaacatggccagctttgtgcggcagctgaacatgtatggcttcaggaaggtggtgcacatcgacagcggcatcgtgaagcaggagagagatggccctgtggagttccagcacccctacttcaagcagggccaggatgacctgctggagaacatcaagaggaaggtgagcagcagcaagccagaggagaacaagatccggcaggaggacctgaccaagatcatcagcagcgcccagaaggtgcagatcaagcaggagaccatcgagagccggctgtctgagctgaagtcagaaaatgaaagcctgtggaaggaggtgtctgagctgcgggccaagcacgcccagcagcagcaggtgatcaggaagatcgtgcagttcatcgtgaccctggtgcagaacaaccagctggtgtccctgaagaggaagaggcccctgctgctgaacaccaatggagcccagaagaagaacctcttccagcacatcgtgaaggagcccacagacaaccaccaccacaaggtgccccacagcaggacagagggcctgaagccccgggagcgcatcagtgatgacatcatcatctatgatgtgacagatgacaatgctgatgaggagaacatccctgtgattcctgagaccaatgaagatgtgatcagtgaccccagcaactgcagccagtacccagacatcgtcatcgtggaggatgacaatgaagatgaatatgcccctgtgatccagagcggggagcagaatgaaccagcccgggagagcctgagcagcggcagtgatggcagcagccccctgatgagcagcgctgtgcagctgaatggcagcagcagcctgaccagcgaggaccctgtgaccatgatggacagcatcctgaatgacaacatcaacctgctgggcaaggtggagctgctggactacctggacagcattgactgcagcctggaggacttccaggccatgctgagcggccggcagttcagcattgatcctgacctgctggtggacagcgagaacaagggcctggagaccaccaagaacaacgtggtgcagcctgtgtctgaggagggcaggaagagcaagagcaagccagacaagcagctgatccagtacacagccttccccctgctggccttcctggatggcaacccagccagctctgtggagcaggccagcaccacagccagcagcgaggtgctgagctctgtggacaagcccatcgaggtggatgagctgctggacagcagcctggaccctgagcccacccagagcaagctggtgcggctggagcccctgacagaagctgaggccagcgaggccaccctcttctacctgtgtgagctggccccagcccccctggacagcgacatgcccctgctggacagctag

SEQ ID NO: 155020 - DNA, 1005 bp, Artificial Sequence
  Description of Artificial Sequence: Synthetic coding sequence
atgggagaggccggggctgctgaggaggcctgccgccacatgggcaccaaggaggagtttgtgaaggtgaggaagaaggacctggagcggctgaccacagaggtgatgcagatccgggacttcctgccccgcatcctgaatggagaggtgctggagagcttccagaagctgaagatcgtggagaagaacctggagaggaaggagcaggagctggagcagctgaagatggactgtgagcacttcaaggcccggctggagaccgtgcaggccgacaacatccgggagaagaaggagaagctggccctgcggcagcagctgaatgaggccaagcagcagctgctgcagcaggccgagtactgcacagagatgggcgccgccgcctgcaccctgctgtggggcgtgagcagcagcgaggaggtggtgaaggccatcctgggcggggacaaggccctgaagttcttcagcatcaccggccagaccatggagagctttgtgaagagcctggatggagatgtgcaggagctggacagtgatgagagccagtttgtgtttgccctggccggcatcgtgaccaacgtggccgccatcgcctgtggccgggagttcctggtgaacagcagccgggtgctgctggacaccatcctgcagctgctgggggacctgaagccaggccagtgcaccaagctgaaggtgctgatgctgatgagcctgtacaacgtgtccatcaacctgaagggcctgaagtacatcagcgagagccctggcttcatccccctgctgtggtggctgctgagtgaccctgatgctgaggtgtgcctgcacgtgctgcggctggtgcagagcgtggtgctggagcctgaggtgttcagcaagagcgccagcgagttccgcagcagcctgcccctgcagaggatcctggccatgagcaagagcaggaacccccggctgcagacagctgcccaggagctgctggaggacctgcggaccctggagcacaacgtgtag

SEQ ID NO: 155021 - DNA, 780 bp, Artificial Sequence
  Description of Artificial Sequence: Synthetic coding sequence
atggactgtgagcacttcaaggcccggctggagaccgtgcaggccgacaacatccgggagaagaaggagaagctggccctgcggcagcagctgaatgaggccaagcagcagctgctgcagcaggccgagtactgcacagagatgggcgctgctgcctgcaccctgctgtggggcgtgagcagcagcgaggaggtggtgaaggccatcctgggcggggacaaggccctgaagttcttcagcatcaccggccagaccatggagagctttgtgaagagcctggatggagatgtgcaggagctggacagtgatgagagccagtttgtgtttgccctggccggcatcgtgaccaacgtggccgccatcgcctgtggccgggagttcctggtgaacagcagccgggtgctgctggacaccatcctgcagctgctgggggacctgaagccaggccagtgcaccaagctgaaggtgctgatgctgatgagcctgtacaacgtgtccatcaacctgaagggcctgaagtacatcagcgagagccctggcttcatccccctgctgtggtggctgctgagtgaccctgatgctgaggtgtgcctgcacgtgctgcggctggtgcagagcgtggtgctggagcctgaggtgttcagcaagagcgccagcgagttccgcagcagcctgcccctgcagaggatcctggccatgagcaagagcaggaacccccggctgcagacagctgcccaggagctgctggaggacctgcggaccctggagcacaacgtgtag

SEQ ID NO: 155022 - DNA, 1479 bp, Artificial Sequence
  Description of Artificial Sequence: Synthetic coding sequence
atgcaggaggccccagctgccctgcccacagagcccggccccagccctgtgcctgccttcctgggcaagctgtgggccctggtgggggaccctggaacagaccacctgatccgctggagccccagcggcaccagcttcctggtgtctgaccagagcagatttgccaaggaggtgctgccccagtacttcaagcacagcaacatggccagctttgtgcggcagctgaacatgtatggcttcaggaaggtggtgtccattgagcagggcggcctgctgcggcctgagcgggaccacgtggagttccagcaccccagctttgtgcggggccgggagcagctgctggagcgggtgcggaggaaggtgcctgccctgcggggagatgatggccgctggaggcctgaggacctgggccgcctgctgggggaggtgcaggccctgcggggcgtgcaggagagcacagaggcccggctgcgggagctgcggcagcagaatgagatcctgtggagggaggtggtgaccctgcggcagagccacggccagcagcaccgggtgattggcaagctgatccagtgcctgtttggccccctgcaggccggccccagcaatgccggcggcaagaggaagctgagcctgatgctggatgagggcagcagctgccccaccccagccaagttcaacacctgccccctgcccggggccctgctgcaggacccctacttcatccagagccccctgcctgagaccaacctgggcctgagcccccaccgggcccggggccccatcatcagtgacatccctgaggacagccccagccctgagggcacccggctgagccccagcagtgatggccggcgggagaagggcctggccctgctgaaggaggagcccgccagccctggaggagatggagaggccggcctggccctggccccaaatgaatgtgacttctgtgtgacagcccccccacccctgcctgtggccgtggtgcaggccatcctggagggcaagggcagcttcagccctgagggccccagaaatgcccagcagcctgagcccggggacccccgggagatcccagaccggggccccctgggcctggagagcggggacaggagccctgagagcctgctgccccccatgctgctgcagcccccccaggagagcgtggagcccgccggccccctggatgtgctgggccccagcctgcagggccgggagtggaccctgatggacctggacatggagctgagcctgatgcagcccctggtgcctgagcggggggagcctgagctggccgtgaagggcctgaacagccccagccctgggaaggaccccaccctgggcgcccccctgctgctggatgtgcaggccgccctgggcggccctgccctgggcctgcccggggccctgaccatctacagcaccccagagagcaggacagccagctacctgggccctgaggccagccccagcccctag

SEQ ID NO: 155023 - DNA, 1389 bp, Artificial Sequence
  Description of Artificial Sequence: Synthetic coding sequence
atgcaggaggccccagctgccctgcccacagagcccggccccagccctgtgcctgccttcctgggcaagctgtgggccctggtgggggaccctggaacagaccacctgatccgctggagccccagcggcaccagcttcctggtgtctgaccagagcagatttgccaaggaggtgctgccccagtacttcaagcacagcaacatggccagctttgtgcggcagctgaacatgtatggcttcaggaaggtggtgtccattgagcagggcggcctgctgcggcctgagcgggaccacgtggagttccagcaccccagctttgtgcggggccgggagcagctgctggagcgggtgcggaggaaggtgcctgccctgcggggagatgatggccgctggaggcctgaggacctgggccgcctgctgggggaggtgcaggccctgcggggcgtgcaggagagcacagaggcccggctgcgggagctgcggcagcagaatgagatcctgtggagggaggtggtgaccctgcggcagagccacggccagcagcaccgggtgattggcaagctgatccagtgcctgtttggccccctgcaggccggccccagcaatgccggcggcaagaggaagctgagcctgatgctggatgagggcagcagctgccccaccccagccaagttcaacacctgccccctgcccggggccctgctgcaggacccctacttcatccagagccccagcacctacagcctgagccagaggcagatctgggccctggccctgaccggccctggggcccccagcagcctgaccagccagaagaccctgcaccccctgcggggccctggcttcctgccccctgtgatggccggggcccccccacccctgcctgtggccgtggtgcaggccatcctggagggcaagggcagcttcagccctgagggccccagaaatgcccagcagcctgagcccggggacccccgggagatcccagaccggggccccctgggcctggagagcggggacaggagccctgagagcctgctgccccccatgctgctgcagcccccccaggagagcgtggagcccgccggccccctggatgtgctgggccccagcctgcagggccgggagtggaccctgatggacctggacatggagctgagcctgatgcagcccctggtgcctgagcggggggagcctgagctggccgtgaagggcctgaacagccccagccctgggaaggaccccaccctgggcgcccccctgctgctggatgtgcaggccgccctgggcggccctgccctgggcctgcccggggccctgaccatctacagcaccccagagagcaggacagccagctacctgggccctgaggccagccccagcccctag

SEQ ID NO: 155024 - DNA, 1251 bp, Artificial Sequence
  Description of Artificial Sequence: Synthetic coding sequence
atgcaggaggccccagctgccctgcccacagagcccggccccagccctgtgcctgccttcctgggcaagctgtgggccctggtgggggaccctggaacagaccacctgatccgctggagccccagcggcaccagcttcctggtgtctgaccagagcagatttgccaaggaggtgctgccccagtacttcaagcacagcaacatggccagctttgtgcggcagctgaacatgtatggcttcaggaaggtggtgtccattgagcagggcggcctgctgcggcctgagcgggaccacgtggagttccagcaccccagctttgtgcggggccgggagcagctgctggagcgggtgcggaggaaggtgcctgccctgcggggagatgatggccgctggaggcctgaggacctgggccgcctgctgggggaggtgcaggccctgcggggcgtgcaggagagcacagaggcccggctgcgggagctgcggcagcagaatgagatcctgtggagggaggtggtgaccctgcggcagagccacggccagcagcaccgggtgattggcaagctgatccagtgcctgtttggccccctgcaggccggccccagcaatgccggcggcaagaggaagctgagcctgatgctggatgagggcagcagctgccccaccccagccaagttcaacacctgccccctgcccggggccctgctgcaggacccctacttcatccagagccccctgcctgagaccaacctgggcctgagcccccaccgggcccggggccccatcatcagtgacatccctgaggacagccccagccctgagggcacccggctgagccccagcagtgatggccggcggggccccctgggcctggagagcggggacaggagccctgagagcctgctgccccccatgctgctgcagcccccccaggagagcgtggagcccgccggccccctggatgtgctgggccccagcctgcagggccgggagtggaccctgatggacctggacatggagctgagcctgatgcagcccctggtgcctgagcggggggagcctgagctggccgtgaagggcctgaacagccccagccctgggaaggaccccaccctgggcgcccccctgctgctggatgtgcaggccgccctgggcggccctgccctgggcctgcccggggccctgaccatctacagcaccccagagagcaggacagccagctacctgggccctgaggccagccccagcccctag

SEQ ID NO: 155025 - DNA, 1479 bp, Artificial Sequence; identical to SEQ ID NO: 155022
  Description of Artificial Sequence: Synthetic coding sequence

SEQ ID NO: 155026 - DNA, 9 bp, Artificial Sequence
  Description of Artificial Sequence: Synthetic coding sequence
atgcagtag

SEQ ID NO: 155027 - DNA, 414 bp, Artificial Sequence
  Description of Artificial Sequence: Synthetic coding sequence
atgagcagcctcatccggcgggtcatcagcacagccaaggcccctggggccatcggcccctacagccaggccgtgctggtggacaggaccatctacatcagcggccagatcggcatggaccccagcagcggccagctggtgtctgggggcgtggccgaggaggccaagcaggccctgaagaacatgggagagatcctgaaggctgctggctgtgacttcaccaacgtggtgaagaccaccgtgctgctggccgacatcaatgacttcaacacagtgaatgagatctacaagcagtacttcaagagcaacttccctgcccgggccgcctaccaggtggccgccctgcccaagggcagcagaattgaaattgaagctgtggccatccagggccccctgaccacagccagcctgtag

SEQ ID NO: 155028 - DNA, 14505 bp, Artificial Sequence
  Description of Artificial Sequence: Synthetic coding sequence
atgcccagcgagagcttctgcctggccgcccaggcccggctggacagcaagtggctgaagacagacatccagctggccttcaccagagatggcctgtgtggcctgtggaatgagatggtgaaggatggagaaattgtgtacacaggaacagagagcacccagaatggagagctgccccccaggaaggatgattctgtggagcccagcggcaccaagaaggaggacctgaatgacaaggagaagaaggatgaggaggagaccccagcccccatctaccgggccaagagcatcctggacagctgggtgtggggcaagcagccagatgtgaatgagctgaaggagtgcctgtctgtgctggtgaaggagcagcaggccctggccgtgcagagcgccaccaccaccctgagcgccctgcggctgaagcagaggctggtgatcctggagcgctacttcatcgccctgaacagaacagtgttccaggagaatgtgaaggtgaagtggaagagcagcggcatcagcctgccccctgtggacaagaagagcagcaggcctgctggaaaaggagtggagggcctggcccgggtgggcagcagagctgccctgagctttgcctttgccttcctgcggcgggcctggaggtctggagaagatgctgacctgtgcagcgagctgctgcaggagagcctggatgccctgcgggccctgcctgaggccagcctgtttgatgagagcacagtgtcctctgtgtggctggaggtggtggagcgggccacccgcttcctgcggtctgtggtgactggagatgtgcacggcaccccagccaccaagggccctggcagcatccccctgcaggaccagcacctggccctggccatcctgctggagctggccgtgcagaggggcaccctgagccagatgctgagcgccatcctgctgctgctgcagctgtgggacagcggggcccaggagacagacaatgaaagaagtgcccagggcaccagcgcccccctgctgcccctgctgcagcgcttccagagcatcatctgcaggaaggatgccccccacagcgagggggacatgcacctgctgagcggccccctgagccccaatgaaagcttcctgcgctacctgaccctgccccaggacaatgagctggccatcgacctgcggcagacagctgtggtggtgatggcccacctggaccggctggccaccccctgcatgccacccctgtgcagcagccccaccagccacaagggcagcctgcaggaggtgattggctggggcctgattggctggaagtactatgccaacgtcatcggccccatccagtgtgagggcctggccaacctgggcgtgacccagatcgcctgtgccgagaagcgcttcctgatcctgagcagaaatggccgggtgtacacccaggcctacaacagcgacaccctggccccccagctggtgcagggcctggccagcagaaatattgtgaagattgctgcccacagtgatggccaccactacctggccctggccgccactggagaggtgtacagctggggctgtggagatggcggccgcctgggccatggagacacagtgcccctggaggagcccaaggtgatcagcgccttcagcggcaagcaggccggcaagcacgtggtgcacatcgcctgtggcagcacctacagcgctgccatcacagctgagggggagctgtacacctggggccggggcaactacggccgcctgggccacggcagcagtgaagatgaggccatccccatgctggtggccggcctgaagggcctgaaggtgattgatgtggcctgtggcagcggagatgcccagaccctggccgtgacagaaaatggccaggtgtggagctggggagatggagactatggcaagctgggccggggcggcagtgatggctgcaagacccccaagctgattgagaagctgcaggacctggatgtggtgaaggtgcgctgtggcagccagttcagcatcgccctgaccaaggatggccaggtgtacagctggggcaaaggagacaaccagaggctgggccatggaacagaggagcacgtgcgctaccccaagctgctggagggcctgcagggcaagaaggtgattgatgtggccgccggcagcacccactgcctggccctgacagaggacagcgaggtgcacagctggggcagcaatgaccagtgccagcactttgacaccctgcgggtgaccaagccagagcctgctgccctgcccggcctggacaccaagcacatcgtgggcatcgcctgtggccctgcccagagctttgcctggagcagctgcagcgagtggagcatcggcctgcgggtgccctttgtggtggacatctgcagcatgacctttgagcagctggacctgctgctgcggcaggtgtctgagggcatggatggcagcgctgactggcccccaccccaggagaaggaatgtgtggccgtggccaccctgaacctgctgcggctgcagctgcacgccgccatcagccaccaggtggaccctgagttcctgggcctgggcctgggcagcatcctgctgaacagcctgaagcagacagtggtgaccctggccagcagcgctggggtgctgagcacagtgcagagcgctgcccaggccgtgctgcagagcggctggagcgtgctgctgcccacagctgaggagcgggcccgggccctgagcgccctgctgccctgtgctgtgtctggaaatgaggtgaacatcagccctggaagacgcttcatgattgacctgctggtgggcagcctgatggctgatggcggcctggagagcgccctgcacgccgccatcacagctgagatccaggacatcgaggccaagaaggaggcccagaaggagaaggagattgatgagcaggaggccaatgccagcaccttccacaggagcaggacccccctggacaaggacctgatcaacacaggcatctgtgagagcagcggcaagcagtgcctgcccctggtgcagctgatccagcagctgctgagaaatattgccagccagacagtggcccggctgaaggatgtggcccggcgcatcagcagctgcctggactttgagcagcacagccgggagaggtctgccagcctggacctgctgctgcgcttccagaggctgctgatcagcaagctgtacccaggagagagcatcggccagaccagtgacatcagcagccctgagctgatgggcgtgggcagcctgctgaagaagtacacagccctgctgtgcacccacatcggggacatcctgcctgtggccgccagcatcgccagcacctcctggaggcactttgctgaggtggcctacatcgtggagggggacttcaccggggtgctgctgcctgagctggtggtgtccatcgtgctgctgctgagcaagaatgccggcctgatgcaggaggccggggctgtgcccctgctgggcggcctgctggagcacctggaccgcttcaaccacctggcccctgggaaggagagagatgaccacgaggagctggcctggccaggcatcatggagagcttcttcaccggccagaactgcaggaacaatgaggaggtgaccctcatcaggaaggctgacctggagaaccacaacaaggatggcggcttctggacagtgattgatggcaaggtgtatgacatcaaggacttccagacccagagcctgaccggcaacagcatcctggcccagtttgctggagaagatcctgtggtggccctggaggccgccctgcagtttgaggacacccgggagagcatgcacgccttctgtgtgggccagtacctggagccagaccaggagatcgtgaccatcccagacctgggcagcctgagcagccccctgattgacacagaaagaaacctgggcctgctgctgggcctgcacgccagctacctggccatgagcacccccctgagccctgtggagattgaatgtgccaagtggctgcagagcagcatcttcagcggcggcctgcagaccagccagatccactacagctacaatgaggagaaggatgaggaccactgcagcagccctgggggcaccccagccagcaagagccggctgtgcagccacagaagagccctgggggaccacagccaggccttcctgcaggccatcgctgacaacaacatccaggaccacaacgtgaaggacttcctgtgccagatcgagcgctactgccggcagtgccacctgaccacccccatcatgttccccccagagcaccctgtggaggaggtgggccgcctgctgctgtgctgcctgctgaagcatgaggacctgggccacgtggccctgagcctggtgcacgccggggccctgggcatcgagcaggtgaagcacaggaccctgcccaagtctgtggtggatgtgtgccgggtggtgtaccaggccaagtgcagcctcatcaagacccaccaggagcagggccgcagctacaaggaggtgtgtgcccctgtgattgaaaggctgcgcttcctgttcaatgagctgcggcctgctgtgtgcaatgacctgagcatcatgagcaagttcaagctgctgagcagcctgccccgctggaggcgcatcgcccagaagatcatccgggagaggaggaagaagagggtgcccaagaagccagagagcacagatgatgaggagaagattggaaatgaggagagtgacctggaggaggcctgcatcctgccccacagccccatcaacgtggacaagaggcccatcgccatcaagagccccaaggacaagtggcagcccctgctgagcacagtgactggagtgcacaagtacaagtggctgaagcagaatgtgcagggcctgtacccccagagccccctgctgagcaccatcgccgagtttgccctgaaggaggagcctgtggatgtggagaagatgaggaagtgcctgctgaagcagctggagagagctgaggtgcggctggagggcatcgacaccatcctgaagctggccagcaagaacttcctgctgcccagcgtgcagtatgccatgttctgtggctggcagaggctcatccctgagggcatcgacatcggggagcccctgacagactgcctgaaggatgtggacctgatcccccccttcaacaggatgctgctggaggtgaccttcggcaagctgtatgcctgggccgtgcagaacatcagaaatgtgctgatggatgccagcgccaagttcaaggagctgggcatccagcctgtgcccctgcagaccatcaccaatgaaaaccccagcggccccagcctgggcaccatcccccaggcccgcttcctgctggtgatgctgtccatgctgaccctgcagcacggggccaacaacctggacctgctgctgaacagcggcatgctggccctgacccagacagccctgcggctgattggccccagctgtgacaacgtggaggaggacatgaatgccagcgcccagggcgccagcgccaccgtgctggaggagaccaggaaggagacagcccctgtgcagctgcctgtgtctggccctgagctggccgccatgatgaagattggcaccagggtgatgaggggcgtggactggaagtggggagaccaggacggccccccacctggcctgggccgggtgattggagagctgggggaggatggctggatccgggtgcagtgggacaccggcagcaccaacagctacaggatgggcaaggagggcaagtatgacctgaagctggccgagctgcctgctgctgcccagcccagcgctgaggacagcgacacagaagatgacagcgaggccgagcagacagaaagaaacatccaccccacagccatgatgttcaccagcaccatcaacctgctgcagaccctgtgcctgtctgctggggtgcacgccgagatcatgcagagcgaggccaccaagaccctgtgtggcctgctgaggatgctggtggagagcggcaccacagacaagaccagcagccccaaccggctggtgtaccgggagcagcaccgctcctggtgcaccctgggctttgtgcgcagcatcgccctgaccccccaggtgtgtggggccctgagcagcccccagtggatcaccctgctgatgaaggtggtggagggccacgcccccttcaccgccaccagcctgcagaggcagatcctggccgtgcacctgctgcaggccgtgctgcccagctgggacaagacagagcgggcccgggacatgaagtgcctggtggagaagctgtttgacttcctgggcagcctgctgaccacctgcagcagtgatgtgcccctgctgcgggagagcaccctgcggcggcggcgggtgcggccccaggccagcctgacagccacccacagcagcaccctggccgaggaggtggtggccctgctgcggaccctgcacagcctgacccagtggaatggcctcatcaacaagtacatcaacagccagctgcggagcatcacccacagctttgtgggccggcccagcgagggcgcccagctggaggactacttcccagattctgagaaccctgaggtgggcggcctgatggctgtgctggccgtcatcggcggcattgatggccgcctgcggctgggcggccaggtgatgcatgatgaatttggagagggcaccgtgacccgcatcacccccaagggcaagatcaccgtgcagttcagtgacatgaggacctgccgggtgtgccccctgaaccagctgaagcccctgcctgctgtggccttcaacgtgaacaacctgcccttcacagagcccatgctgtctgtgtgggcccagctggtgaacctggccggcagcaagctggagaagcacaagatcaagaagagcaccaagcaggcctttgctggccaggtggacctggacctgctgcgctgccagcagctgaagctgtacatcctgaaggccggccgggccctgctgagccaccaggacaagctgcggcagatcctgagccagcctgctgtgcaggagactggaacagtgcacacagatgatggagctgtggtgtccccagacctgggggacatgagccctgagggcccccagccccccatgatcctgctgcagcagctgctggccagcgccacccagcccagccctgtgaaggccatctttgacaagcaggagctggaggccgccgccctggccgtgtgccagtgcctggccgtggagagcacccaccccagcagccctggctttgaggactgcagcagcagcgaggccaccacccctgtggccgtgcagcacatccggcctgcccgggtgaagaggaggaagcagagccctgtgcctgccctgcccatcgtggtgcagctgatggagatgggcttcagcagaagaaatattgaatttgccctgaagagcctgactggagccagcggaaatgccagcagcctgcccggggtggaggccctggtgggctggctgctggaccacagcgacatccaggtgacagagctgagtgatgctgacacagtgtctgatgagtacagtgatgaggaggtggtggaggatgtggatgatgctgcctacagcatgagcactggagctgtggtgacagagagccagacctacaagaagagagctgacttcctgagcaatgatgattatgctgtgtatgtgcgggagaacatccaggtgggcatgatggtgcgctgctgccgggcctatgaggaggtgtgtgaaggagatgtgggcaaggtgatcaagctggacagagatggcctgcatgacctgaatgtgcagtgtgactggcagcagaagggcggcacctactgggtgcgctacatccacgtggagctgattggctaccccccacccagcagcagcagccacatcaagattggagacaaggtgcgggtgaaggcctctgtgaccacccccaagtacaagtggggctctgtgacccaccagagcgtgggcgtggtgaaggccttcagcgccaacgggaaggacatcatcgtggacttcccccagcagagccactggacaggcctgctgtctgagatggagctggtgcccagcatccaccctggggtgacctgtgatggctgccagatgttccccatcaatggcagccgcttcaagtgcaggaactgtgatgactttgacttctgtgagacctgcttcaagaccaagaagcacaacaccaggcacaccttcggccgcatcaatgaacctggccagagcgctgtgttctgtggccgcagcggcaagcagctgaagcgctgccacagcagccagcccggcatgctgctggacagctggagcaggatggtgaagagcctgaatgtgagcagctctgtgaaccaggccagccggctgattgatggcagcgagccctgctggcagagcagcggcagccagggcaagcactggatccggctggagatcttcccagatgtgctggtgcaccggctgaagatgattgtggaccctgctgacagcagctacatgcccagcctggtggtggtgtctgggggcaacagcctgaacaacctgattgagctgaagaccatcaacatcaaccccagcgacaccaccgtgcccctgctgaatgactgcacagagtaccaccgctacatcgagatcgccatcaagcagtgccgcagcagcggcatcgactgcaagatccacggcctcatcctgctgggccgcatccgggcagaggaggaggacctggccgctgtgcccttcctggccagtgacaatgaggaggaggaggatgagaagggcaacagcggcagcctcatcaggaagaaggctgctggcctggagagcgctgccaccatccgcaccaaggtgtttgtgtggggcctgaatgacaaggaccagctgggcggcctgaagggcagcaagatcaaggtgcccagcttcagcgagaccctgagcgccctgaatgtggtgcaggtggccggcggcagcaagagcctgtttgctgtgacagtggagggcaaggtgtatgcctgtggggaggccaccaacggccgcctgggcctgggcatcagcagcggcaccgtgcccatcccccggcagatcacagccctgagcagctatgtggtgaagaaggtggccgtgcacagcggcggcagacatgccacagccctgactgtggatggcaaggtgttctcctggggcgagggagatgatggcaagctgggccacttcagcaggatgaactgtgacaagccccggctgattgaggccctgaagaccaagaggatccgggacatcgcctgtggcagcagccacagcgctgccctgaccagcagtggagagctgtacacctggggcctgggggagtatggccgcctgggccatggagacaacaccacccagctgaagcccaagatggtgaaggtgctgctgggccacagggtcatccaggtggcctgtggcagcagagatgcccagaccctggccctgacagatgagggcctggtgttctcctggggagatggagactttgggaagctgggccggggcggcagcgagggctgcaacatcccccagaacatcgagcggctgaatggccagggcgtgtgccagattgaatgtggggcccagttcagcctggccctgaccaagtctggagtggtgtggacctggggcaaaggagactacttccggctgggccacggcagtgatgtgcacgtgaggaagccccaggtggtggagggcctgcggggcaagaagatcgtgcacgtggccgtgggcgccctgcactgcctggccgtgacagattctggccaggtgtatgcctggggagacaatgaccacggccagcagggcaatggcaccaccaccgtgaacaggaagcccaccctggtgcagggcctggagggccagaagatcaccagggtggcctgtggcagcagccacagcgtggcctggaccaccgtggatgtggccaccccatctgtgcatgagcctgtgctcttccagacagcccgggaccccctgggcgccagctacctgggcgtgcccagtgatgctgacagcagcgctgccagcaacaagatcagcggggccagcaacagcaagcccaaccggcccagcctggccaagatcctgctgagcctggatggcaacctggccaagcagcaggccctgagccacatcctgacagccctgcagatcatgtatgccagagatgctgtggtgggcgccctgatgcctgctgccatgattgcccctgtggagtgccccagcttcagcagcgctgcccccagtgatgccagcgccatggccagccccatgaatggagaggagtgcatgctggccgtggacatcgaggaccggctgagccccaacccctggcaggagaagcgggagatcgtgtccagtgaagatgctgtgacccccagcgctgtgaccccatctgcccccagcgccagcgcccggcccttcatccctgtgacagatgacctgggcgccgccagcatcatcgccgagaccatgaccaagaccaaggaggatgtggagagccagaacaaggctgctggccctgagccccaggccctggatgagttcaccagcctgctgattgctgatgacaccagggtggtggtggacctgctgaagctgtctgtgtgcagcagagctggggaccggggcagagatgtgctgtctgctgtgctgagcggcatgggcacagcctacccccaggtggccgacatgctgctggagctgtgtgtgacagagctggaggatgtggccacagacagccagagcggccgcctgagcagccagcctgtggtggtggagagcagccacccctacacagatgacaccagcaccagcggcaccgtgaagatccctggagctgagggcctgcgggtggagtttgaccggcagtgcagcacagagaggagacatgaccccctgactgtgatggatggagtgaaccgcatcgtgtctgtgcgcagcggccgggagtggagcgactggagcagcgagctgcgcatccctggagatgagctgaagtggaagttcatcagtgatggctctgtgaatggctggggctggaggttcaccgtgtaccccatcatgcctgctgctggccccaaggagctgctgagtgacagatgtgtgctgagctgccccagcatggacctggtgacctgcctgctggacttccggctgaacctggccagcaacagaagcatcgtgccccggctggccgccagcctggccgcctgtgcccagctgagcgccctggccgccagccacaggatgtgggccctgcagaggctgaggaagctgctgaccacagaatttggccagagcatcaacatcaaccggctgctgggggagaatgatggagagacccgggccctgtccttcaccggcagcgccctggccgccctggtgaagggcctgcctgaggccctgcagaggcagtttgaatatgaggaccccatcgtgcggggcggcaagcagctgctgcacagccccttcttcaaggtgctggtggccctggcctgtgacctggagctggacaccctgccctgctgtgccgagacccacaagtgggcctggttccgccgctactgcatggccagccgggtggccgtggccctggacaagaggacccccctgcccaggctcttcctggatgaggtggccaagaagatccgggagctgatggctgacagcgagaacatggatgtgctgcacgagagccatgacatcttcaagcgggagcaggatgagcagctggtgcagtggatgaacagaagaccagatgactggaccctgtctgctgggggcagcggcaccatctacggctggggccacaaccaccggggccagctgggcggcatcgagggcgccaaggtgaaggtgcccaccccctgtgaggccctggccaccctgcggcctgtgcagctgattggaggagagcagaccctgtttgctgtgacagcagatggcaagctgtatgccaccggctatggagctgggggccgcctgggcattggaggaacagagagcgtgtccacccccaccctgctggagagcatccagcacgtgttcatcaagaaggtggccgtgaacagcggcggcaagcactgcctggccctgagcagcgagggggaggtgtacagctggggcgaggctgaagatggcaagctgggccacggcaacagaagcccctgtgaccggccccgggtgattgagagcctgcggggcatcgaggtggtggatgtggccgccggcggggcccacagcgcctgtgtgacagctgctggggacctgtacacctggggcaagggccgctatggccgcctgggccacagcgacagcgaggaccagctgaagcccaagctggtggaggccctgcagggccaccgggtggtggacatcgcctgtggcagcggagatgcccagaccctgtgcctgacagatgatgacacagtgtggagctggggagatggagactatggcaagctgggccggggcggcagtgatggctgcaaggtgcccatgaagattgacagcctgaccggcctgggcgtggtgaaggtggagtgtggcagccagttctctgtggccctgaccaagtctggagctgtgtacacctggggcaaaggagactaccaccggctgggccacggcagtgatgaccacgtgcggcggccccggcaggtgcagggcctgcagggcaagaaggtgattgccatcgccaccggcagcctgcactgtgtgtgctgcacagaagatggagaggtgtacacctggggagacaatgatgagggccagctgggagatggcaccaccaatgccatccagaggccccggctggtggccgccctgcagggcaagaaggtgaacagagtggcctgtggcagcgcccacaccctggcctggagcaccagcaagccagccagcgctgggaagctgcctgcccaggtgcccatggagtacaaccacctgcaggagatccccatcatcgccctgaggaaccggctgctgctgctgcaccacctgtctgagctgttctgcccctgcatccccatgtttgacctggagggcagcctggatgagaccggcctgggccccagcgtgggctttgacaccctgcggggcatcctgatcagccagggcaaggaggccgccttcaggaaggtggtgcaggccaccatggtgcgggaccggcagcacggccctgtggtggagctgaaccgcatccaggtgaagaggagccgcagcaaaggaggcctggccggcccagatggcaccaagtctgtgtttggccagatgtgtgccaagatgagcagctttggaccagacagcctgctgctgccccaccgggtgtggaaggtgaagtttgtgggggagagcgtggatgactgtggcggcggctacagcgagagcattgctgagatctgtgaggagctgcagaatggcctgacccccctgctgattgtgacccccaacggcagagatgaaagtggggccaacagagactgctacctgctgagccctgctgcccgggcccctgtgcacagctccatgttccgcttcctgggcgtgctgctgggcatcgccatcagaacaggcagccccctgagcctgaacctggccgagcctgtgtggaagcagctggccggcatgagcctgaccatcgctgacctgtctgaggtggacaaggacttcatccctggcctgatgtacatccgggacaatgaggccaccagcgaggagtttgaggccatgagcctgcccttcaccgtgcccagcgccagcggccaggacatccagctgagcagcaagcacacccacatcaccctggacaacagagcagaatatgtgcggctggccatcaactaccgcctgcacgagtttgatgagcaggtggccgctgtgcgggagggcatggcccgggtggtgcctgtgcccctgctgagcctcttcaccggctatgagctggagaccatggtgtgtggcagcccagacatccccctgcacctgctgaagtctgtggccacctacaagggcatcgagcccagcgccagcctcatccagtggttctgggaggtgatggagagcttcagcaacacagagaggagcctcttcctgcgctttgtgtggggccgcacccggctgcccaggaccatcgctgacttccggggccgggactttgtgatccaggtgctggacaagtacaaccccccagaccacttcctgcctgagagctacacctgcttcttcctgctgaagctgccccgctacagctgcaagcaggtgctggaggagaagctgaagtatgccatccacttctgcaagagcattgacacagatgattatgccagaattgccctgaccggggagcctgctgctgatgacagcagtgatgacagcgacaatgaagatgtggacagctttgccagtgacagcacccaggactacctgaccggccactag

SEQ ID NO: 155029 - DNA, 3075 bp, Artificial Sequence
  Description of Artificial Sequence: Synthetic coding sequence
atggagaggaggagcaggaggaagagcagaagaaatggccgcagcacagctgggaaggctgctgccacccagcctgccaagagccctggggcccagctgtggctgttccccagcgctgctggcctgcaccgggccctgctgcggcgggtggaggtgacccggcagctgtgctgcagccctggccgcctggccgtgctggagcggggcggggccggcgtgcaggtgcaccagctgctggccggcagcggcggggcccggacccccaagtgcatcaagctgggcaagaacatgaagatccacagcgtggaccagggcgctgagcacatgctgatcctgagcagtgatggcaagccctttgaatatgacaactacagcatgaagcacctgcgctttgagagcatcctgcaggagaagaagatcatccagatcacctgtggggactaccacagcctggccctgagcaaaggaggagagctgtttgcctggggccagaacctgcacggccagctgggcgtgggcaggaagttccccagcaccaccaccccccagatcgtggagcacctggccggcgtgcccctggcccagatctctgctggggaggcccacagcatggccctgtccatgagcggcaacatctacagctggggcaagaatgaatgtggccagctgggcctgggccacacagagagcaaggatgaccccagcctgattgagggcctggacaaccagaaggtggagtttgtggcctgtggcggcagccacagcgccctgctgacccaggacggcctgctcttcacctttggagctgggaagcacggccagctgggccacaacagcacccagaatgagctgcggccctgcctggtggccgagctggtgggctacagagtgacccagatcgcctgtggccgctggcacaccctggcctacgtgtctgacctgggcaaggtgttctcctttggcagcggcaaggatggccagctgggcaatggaggcacccgggaccagctgatgcccctgcctgtgaaggtgagcagcagcgaggagctgaagctggagagccacaccagcgagaaggagctgatcatgattgctgggggcaaccagagcatcctgctgtggatcaagaaggagaacagctatgtgaacctgaagaggaccatccccaccctgaatgaaggaacagtgaagcgctggattgctgatgtggagaccaagcgctggcagagcaccaagcgggagatccaggagatcttcagcagccctgcctgcctgaccggcagcttcctgaggaagaggaggaccacagagatgatgcctgtgtacctggacctgaacaaggccaggaacatcttcaaggagctgacccagaaggactggatcaccaacatgatcaccacctgcctgaaggacaacctgctgaagaggctgcccttccacagccccccccaggaggccctggagatcttcttcctgctgcctgaatgtcccatgatgcacatcagcaacaactgggagagcctggtggtgccctttgccaaggtggtgtgcaagatgtctgaccagagcagcctggtgctggaggagtactgggccaccctgcaggagagcaccttcagcaagctggtgcagatgttcaagacagctgtgatctgccagctggactactgggatgagagcgcagaagaaaatggaaatgtgcaggccctgctggagatgctgaagaagctgcaccgggtgaaccaggtgaagtgccagctgcctgagagcatcttccaggtggatgagctgctgcaccggctgaacttctttgtggaggtgtgccgccgctacctgtggaagatgacagtggatgcctctgaaaatgtgcagtgctgcgtcatcttcagccacttccccttcatcttcaacaacctgagcaagatcaagctgctgcacacagacaccctgctgaagattgagagcaagaagcacaaggcctacctgcggtctgctgccatcgaggaggagcgggagagcgagtttgccctgcggcccacctttgacctgactgtgagaagaaaccacctgattgaagatgtgctgaaccagctgagccagtttgaaaatgaagacctgaggaaggagctgtgggtgtccttctctggagagatcggctatgacctgggcggcgtgaagaaggagttcttctactgcctgtttgctgagatgatccagccagaatatggcatgttcatgtacccagagggcgccagctgcatgtggttccctgtgaagcccaagtttgagaagaagcgctacttcttcttcggcgtgctgtgtggcctgagcctcttcaactgcaatgtggccaacctgcccttccccctggccctcttcaagaagctgctggaccagatgcccagcctggaggacctgaaggagctgagcccagacctgggcaagaacctgcagaccctgctggatgatgaaggagacaactttgaggaggtgttctacatccacttcaacgtgcactgggacagaaatgacaccaacctgatccccaacggcagcagcatcaccgtgaaccagaccaacaagagggactatgtgtccaagtacatcaactacatcttcaatgacagcgtgaaggctgtgtatgaggagttcagaagaggcttctacaagatgtgtgatgaggacatcatcaagctgttccaccctgaggagctgaaggatgtgattgtgggcaacacagattatgactggaagacctttgagaagaatgcccgctatgagcccggctacaacagcagccaccccaccatcgtgatgttctggaaggccttccacaagctgaccctggaggagaagaagaagttcctggtgttcctgaccggcacagaccggctgcagatgaaggacctgaacaacatgaagatcaccttctgctgcccagagagctggaatgaaagagaccccatccgggccctgacctgcttctctgtgctcttcctgcccaagtacagcaccatggagaccgtggaggaggccctgcaggaggccatcaacaacaacagaggatttggatag

SEQ ID NO: 155030 - DNA, 1854 bp, Artificial Sequence
  Description of Artificial Sequence: Synthetic coding sequence
atgggccccaccctggccgtgcccaccccctacggctgcatcggctgcaagctgccccagcctgagtaccccccagccctgatcatcttcatgttctgtgccatggtgatcaccatcgtggtggacctgattggcaacagcatggtgatcctggccgtgaccaagaacaagaagctgaggaacagcggcaacatctttgtggtgtccctgtctgtggccgacatgctggtggccatctacccctaccccctgatgctgcacgccatgagcattggaggctgggacctgagccagctgcagtgccagatggtgggcttcatcaccggcctgtctgtggtgggcagcatcttcaacatcgtggccatcgccatcaaccgctactgctacatctgccacagcctgcagtatgaaagaatcttctctgtgaggaacacctgcatctacctggtgatcacctggatcatgacagtgctggccgtgctgcccaacatgtacatcggcaccattgaatatgaccccaggacctacacctgcatcttcaactacctgaacaaccctgtgttcaccgtgaccatcgtgtgcatccactttgtgctgcccctgctgattgtgggcttctgctacgtgcgcatctggaccaaggtgctggccgcccgggaccctgctggccagaacccagacaaccagctggccgaggtgaggaacttcctgaccatgtttgtgatcttcctgctgtttgctgtgtgctggtgccccatcaacgtgctgactgtgctggtggccgtgagccccaaggagatggccggcaagatccccaactggctgtacctggccgcctacttcatcgcctacttcaacagctgcctgaatgctgtgatctacggcctgctgaatgaaaacttccggcgggagtactggaccatcttccacgccatgaggcaccccatcatcttcttcagcggcctcatcagtgacatccgggagatgcaggaggcccggaccctggcccgggcccgggcccacgcccgggaccaggcccgggagcaggaccgggcccacgcctgcccagctgtggaggagacccccatgaatgtgagaaatgtgcccctgcctggagatgctgctgctggccacccagaccgggccagcggccaccccaagccccacagccgcagcagcagcgcctacaggaagagcgccagcacccaccacaagagcgtcttcagccacagcaaggccgccagcggccacctgaagcctgtgtctggccacagcaagccagccagcggccaccccaagagcgccaccgtgtaccccaagccagcctctgtgcacttcaaggctgacagcgtgcacttcaagggggacagcgtgcacttcaagccagacagcgtgcacttcaagccagccagcagcaaccccaagcccatcaccggccaccacgtgtctgctggcagccacagcaagagcgccttctctgctgccaccagccaccccaagcccaccaccggccacatcaagccagccaccagccatgctgagcccaccacagctgactaccccaagccagccaccaccagccaccccaagcccacagctgctgacaaccctgagctgagcgccagccactgcccagagatcccagccatcgcccaccctgtgtctgatgacagcgacctgcctgagagcgccagcagccctgctgctggccccaccaagccagctgccagccagctggagagtgacaccatcgctgacctgcctgaccccaccgtggtgaccaccagcaccaatgactaccatgatgtggtggtgattgatgtggaggatgatcctgatgagatggctgtgtag

SEQ ID NO: 155031 - DNA, 13125 bp, Artificial Sequence
  Description of Artificial Sequence: Synthetic coding sequence
atgaaggtggacaggaccaagctgaagaagacccccacagaggccccagctgactgccgggccctgattgacaagctgaaggtgtgcaatgatgagcagctgctgctggagctgcagcagatcaagacctggaacatcggcaaatgtgagctgtaccactgggtggacctgctggacagatttgatggcatcctggctgatgctggccagacagtggagaacatgtcctggatgctggtgtgtgacaggcctgagcgggagcagctgaagatgctgctgctggccgtgctgaacttcaccgccctgctgattgagtacagcttcagccgccacctgtacagcagcattgagcacctgaccaccctgctggccagcagtgacatgcaggtggtgctggccgtgctgaacctgctgtatgtgttcagcaagaggagcaactacatcacccggctgggcagtgacaagaggacccccctgctgacccggctgcagcacctggccgagagctggggcggcaaggaaaatggatttggcctggccgagtgctgccgggacctgcacatgatgaagtacccacccagcgccaccaccctgcactttgagttctacgccgaccccggggctgaggtgaagattgagaagaggaccaccagcaacaccctgcactacatccacatcgagcagctggacaagatcagcgagagccccagcgagatcatggagagcctgaccaagatgtacagcatccccaaggacaagcagatgctgctcttcacccacatccggctggcccacggcttcagcaaccacaggaagaggctgcaggccgtgcaggcccggctgcacgccatcagcatcctggtgtacagcaatgccctgcaggagagcgccaacagcatcctgtacaacggcctcatcgaggagctggtggatgtgctgcagatcacagacaagcagctgatggagatcaaggccgccagcctgcggaccctgaccagcatcgtgcacctggagaggacccccaagctgagcagcatcatcgactgcaccggcacagccagctaccacggcttcctgcctgtgctggtgaggaactgcatccaggccatgattgaccccagcatggacccctacccccaccagtttgccacagccctcttctccttcctgtaccacctggccagctatgatgctggaggagaggccctggtgtcctgtggcatgatggaggccctgctgaaggtgatcaagttcctgggagatgagcaggaccagatcacctttgtgaccagggctgtgcgggtggtggacctgatcaccaacctggacatggccgccttccagagccacagcggcctgagcatcttcatctaccgcctggagcacgaggtggacctgtgcaggaaggagtgcccctttgtgatcaagcccaagatccagaggcccaacaccacccaggagggggaggagatggagacagacatggatggagtgcagtgcatcccccagagagctgccctgctgaagtccatgctgaacttcctgaagaaggccatccaggaccctgccttcagtgatggcatccgccacgtgatggatggcagcctgcccaccagcctgaagcacatcatcagcaatgctgagtactacggccccagcctcttcctgctggccacagaggtggtgacagtgtttgtgttccaggagcccagcctgctgagcagcctgcaggacaatggcctgacagatgtgatgctgcacgccctgctgatcaaggatgtgcctgccacccgggaggtgctgggcagcctgcccaacgtgttttctgccctgtgcctgaatgcccggggcctgcagagctttgtgcagtgccagccctttgagcggctcttcaaggtgctgctgagcccagactacctgcctgccatgagaagaagaagaagcagtgaccccctgggggacacagccagcaacctgggcagcgctgtggatgagctgatgaggcaccagcccaccctgaagacagatgccaccacagccatcatcaagctgctggaggagatctgcaacctgggccgggaccccaagtacatctgccagaagcccagcatccagaaggcagatggaacagccacagcccccccacccaggagcaaccacgccgctgaggaggccagcagtgaagatgaggaggaggaggaggtgcaggccatgcagagcttcaacagcacccagcagaatgaaacagagcccaaccagcaggtggtgggcacagaggagcgcatccccatccccctgatggactacatcctgaatgtgatgaagtttgtggagagcatcctgagcaacaacaccacagatgaccactgccaggagtttgtgaaccagaagggcctgctgcccctggtgaccatcctgggcctgcccaacctgcccatcgacttccccaccagcgctgcctgccaggccgtggccggcgtgtgcaagagcatcctgaccctgagccatgagcccaaggtgctgcaggagggcctgctgcagctggacagcatcctgagcagcctggagcccctgcaccggcccatcgagagccctgggggctctgtgctgctgcgggagctggcctgtgctggaaatgtggctgatgccaccctgagcgcccaggccacccccctgctgcacgccctgacagctgcccacgcctacatcatgatgtttgtgcacacctgccgggtgggccagagcgagatccgcagcatctctgtgaaccagtggggcagccagctgggcctgtctgtgctgagcaagctgagccagctgtactgcagcctggtgtgggagagcacagtgctgctgagcctgtgcacccccaacagcctgcccagcggctgtgaatttggccaggccgacatgcagaagctggtgcccaaggatgagaaggccggcaccacccagggcggcaagagaagtgatggagagcaggatggagctgctggctccatggatgccagcacccagggcctgctggagggcatcggcctggatggagacaccctggcccccatggagacagatgagcccacagccagtgacagcaagggcaagagcaagatcaccccagccatggccgcccgcatcaagcagatcaagcccctgctgagcgccagcagccggctgggccgggccctggccgagctgtttggcctgctggtgaagctgtgtgtgggcagccctgtgcggcagaggaggagccaccacgccgccagcaccaccacagcccccaccccagctgcccggagcacagccagcgccctgaccaagctgctgaccaagggcctgtcctggcagcccccaccctacacccccaccccccgcttccggctgaccttcttcatctgcagcgtgggcttcaccagccccatgctgtttgatgagaggaagtacccctaccacctgatgctgcagaagttcctgtgcagcggcggccacaatgccctgtttgagaccttcaactgggccctgtccatgggcggcaaggtgcctgtgtctgagggcctggagcacagcgacctgcctgatggcactggagagttcctggatgcctggctgatgctggtggagaagatggtgaaccccaccaccgtgctggagagcccccacagcctgcctgccaagctgcctggaggagtgcagaacttcccccagttcagcgccctgcgcttcctggtggtgacccagaaggccgccttcacctgcatcaagaacctgtggaacaggaagcccctgaaggtgtatggaggccgcatggccgagagcatgctggccatcctgtgccacatcctgcggggggagcctgtgatccgggagcggctgagcaaggagaaggagggcagcagaggagaggaggacaccggccaggaggagggcggcagccggcgggagccccaggtgaaccagcagcagctgcagcagctgatggacatgggcttcacccgggagcacgccatggaggccctgctgaacaccagcaccatggagcaggccacagagtacctgctgacccaccccccacccatcatgggcggcgtggtgcgggacctgtccatgtctgaggaggaccagatgatgagggccatcgccatgagcctgggccaggacatccccatggaccagagagctgagagccctgaggaggtggcctgcaggaaggaggaggaggagaggaaggcccgggagaagcaggaggaggaggaggccaagtgcctggagaagttccaggatgctgaccccctggagcaggatgagctgcacaccttcacagacaccatgctgcccggctgcttccacctgctggatgagctgcctgacacagtgtacagagtgtgtgacctgatcatgacagccatcaagagaaatggagctgactacagagacatgatcctgaagcaggtggtgaaccaggtgtgggaggccgcagatgtgctgatcaaggccgccctgcccctgaccaccagtgacaccaagacagtgtctgagtggatcagccagatggccaccctgccccaggccagcaacctggccacccgcatcctgctgctgaccctgctgtttgaggagctgaagctgccctgtgcctgggtggtggagagcagcggcatcctgaatgtgctgatcaagctgctggaggtggtgcagccctgcctgcaggccgccaaggagcagaaggaggtgcagacccccaagtggatcacccctgtgctgctgctgattgacttctatgagaagacagccatcagcagcaagaggcgggcccagatgaccaagtacctgcagagcaacagcaacaactggcgctggtttgatgacaggagcggccgctggtgcagctacagcgccagcaacaacagcaccatcgacagcgcctggaagagcggggagacctctgtgcgcttcaccgctggaagaagacgctacacagtgcagttcaccaccatggtgcaggtgaatgaggagaccggcaacagaagacctgtgatgctgaccctgctgcgggtgccccggctgaacaagaacagcaagaacagcaatggccaggagctggagaagaccctggaggagagcaaggagatggacatcaagaggaaggagaacaagggaaatgacacccccctggccctggagagcaccaacacagagaaggagaccagcctggaggagaccaagatcggggagatcctgatccagggcctgacagaggacatggtgacagtgctgatccgggcctgtgtgtccatgctgggcgtgcctgtggaccctgacaccctgcacgccaccctgcggctgtgcctgcggctgacccgggaccacaagtatgccatgatgtttgctgagctgaagagcaccaggatgatcctgaacctgacccagagcagcggcttcaacggcttcacccccctggtgaccctgctgctgcggcacatcatcgaggacccctgcaccctgcggcacaccatggagaaggtggtgcgctctgctgccaccagcggggccggcagcaccaccagcggcgtggtgtctggcagcctgggcagccgggagatcaactacatcctgcgggtgctgggccctgctgcctgcaggaacccagacatcttcacagaggtggccaactgctgcatcagaattgccctgcctgccccccggggcagcggcacagccagtgatgatgaatttgagaacctgcgcatcaagggccccaatgctgtgcagctggtgaagaccacccccctgaagcccagccccctgcccgtcatcccagacaccatcaaggaggtgatctatgacatgctgaatgccctggccgcctaccacgcccctgaggaggccgacaagagtgaccccaagccaggagtgatgacccaggaggtgggccagctgctgcaggacatgggagatgatgtgtaccagcagtaccgcagcctgacccggcagagcagtgactttgacacccagagcggcttcagcatcaacagccaggtgtttgctgctgatggagccagcacagagaccagcgccagcggcaccagccagggcgaggccagcaccccagaggagagcagagatggcaagaaggacaaggagggggaccgggccagcgaggagggcaagcagaagggcaagggcagcaagcccctgatgcccaccagcaccatcctgcggctgctggccgagctggtgcgctcctatgtgggcatcgccaccctgattgccaactacagctacacagtgggccagagcgagctgatcaaggaggactgcagcgtgctggcctttgtgctggaccacctgctgccccacacccagaatgctgaggacaaggacaccccagccctggcccggctcttcctggccagcctggccgccgccggcagcggcacagatgcccaggtggccctggtgaatgaggtgaaggccgccctgggccgggccctggccatggccgagagcacagagaagcacgcccggctgcaggccgtgatgtgcatcatcagcaccatcatggagagctgccccagcaccagcagcttctacagcagcgccacagccaagacccagcacaacggcatgaacaacatcatccgcctcttcctgaagaagggcctggtgaatgacctggcccgggtgccccacagcctggacctgagcagccccaacatggccaacacagtgaatgctgccctgaagcccctggagaccctgagccgcatcgtgaaccagcccagcagcctgtttggcagcaagagcgccagcagcaagaacaagtctgagcaggatgcccagggcgccagccaggacagcagcagcaaccagcaggaccctggagagcccggggaggccgaggtgcaggaggaggaccatgatgtgacccagacagaggtggctgatggagacatcatggatggagaggccgagacagattctgtggtgattgctggccagcctgaggtgctgagcagccaggagatgcaggtggagaatgagctggaggacctgattgatgagctgctggagagagatggcggcagcggcaacagcaccatcatcgtgagccgcagcggggaggatgagagccaggaggatgtgctgatggatgaggcccccagcaacctgagccaggccagcaccctgcaggccaacagagaagattccatgaacatcctggaccctgaagatgaggaggagcacacccaggaggaggacagcagcggcagcaatgaagatgaagatgacagccaggatgaggaggaggaggaggaggaggatgaagaagatgaccaggaggatgatgaaggagaggagggagatgaagatgatgatgatgatggcagcgagatggagctggatgaggactacccagacatgaatgccagccccctggtgcgctttgaaagatttgaccgggaggatgacctgatcattgaatttgacaacatgttcagcagcgccacagacatcccccccagccctggcaacatccccaccacccaccccctgatggtgagacatgctgaccacagcagcctgaccctgggcagcggcagcagcaccacccggctgacccagggcatcggccgcagccagaggaccctgcggcagctgacagccaacacaggccacaccatccacgtgcactacccaggcaaccggcagcccaaccccccactcatcctgcagaggctgctgggccccagcgctgctgctgacatcctgcagctgagcagcagcctgcccctgcagagccggggccgggcccggctgctggtgggcaatgatgatgtgcacatcatcgcccggagtgatgatgagctgctggatgacttcttccatgaccagagcacagccaccagccaggccggcaccctgagcagcatccccacagccctgacccgctggacagaggagtgcaaggtgctggatgctgagagcatgcatgactgtgtgtctgtggtgaaggtgtccatcgtgaaccacctggagttcctgagagatgaggagctggaggagcggcgggagaagaggaggaagcagctggccgaggaggagaccaagatcacagacaagggcaaggaggacaaggaaaatagagaccagagcgcccagtgcacagccagcaagagcaatgacagcacagagcagaacctgagtgatggcacccccatgccagacagctaccccaccacccccagcagcacagatgctgccaccagcgagagcaaggagaccctgggcaccctgcagagcagccagcagcagcccaccctgcccaccccaccagccctgggggaggtgccccaggagctgcagagccctgctggggagggcggcagcagcacccagctgctgatgcctgtggagcctgaggagctgggccccacccggcccagcggggaggccgagaccacccagatggagctgagccctgcccccaccatcaccagcctgagccctgagagagctgaggacagtgatgccctgacagctgtgagcagccagctggagggcagccccatggacaccagcagcctggccagctgcaccctggaggaggccgtgggggacaccagcgctgctggcagcagcgagcagcccagggctggcagcagcaccccaggagatgcccccccagctgtggccgaggtgcagggccgcagtgatggcagcggggagagcgcccagcccccagaggacagcagccccccagccagcagcgagagcagcagcacccgggacagcgctgtggccatcagcggggctgacagccggggcatcctggaggagcccctgcccagcaccagcagcgaggaggaggaccccctggccggcatcagcctgcctgagggcgtggaccccagcttcctggccgccctgcctgatgacatcagaagagaggtgctgcagaaccagctgggcatccggccccccaccaggacagcccccagcaccaacagcagcgccccagctgtggtgggcaaccctggggtgacagaggtgtccccagagttcctggccgccctgcccccagccatccaggaggaggtgctggcccagcagagagctgagcagcagaggcgggagctggcccagaatgccagcagtgacacccccatggaccctgtgaccttcatccagaccctgcccagcgacctgcggcgctctgtgctggaggacatggaggacagcgtgctggccgtgatgcccccagacattgctgctgaggcccaggccctgcggcgggagcaggaggcccggcagaggcagctgatgcatgagcggctgtttggccacagcagcaccagcgccctgagcgccatcctgcggagccctgccttcaccagccggctgagcggcaacagaggagtgcagtacacccggctggccgtgcagaggggcggcaccttccagatgggcggcagcagcagccacaaccggcccagcggcagcaatgtggacaccctgctgcggctgcggggccgcctgctgctggaccacgaggccctgagctgcctgctggtgctgctgtttgtggatgagcccaagctgaacaccagccggctgcaccgggtgctgaggaacctgtgctaccacgcccagaccaggcactgggtgatccgcagcctgctgagcatcctgcagaggagcagcgagagcgagctgtgcatcgagacccccaagctgaccaccagcgaggagaagggcaagaagagcagcaagagctgtggcagcagcagccatgaaaatcggcccctggacctgctgcacaagatggagagcaagagcagcaaccagctgtcctggctgtctgtgtccatggatgctgccctgggctgcaggaccaacatcttccagatccagaggtctgggggcaggaagcacacagagaagcacgccagcggcggcagcacagtgcacatccacccccaggccgcccctgtggtgtgcagacatgtgctggacaccctcatccagctggccaaggtgttccccagccacttcacccagcagaggaccaaggagaccaactgtgagagtgaccgggagcggggcaacaaggcctgcagcccctgcagcagccagagcagcagcagcggcatctgcacagacttctgggacctgctggtgaagctggacaacatgaatgtgtccaggaagggcaagaacagcgtgaagtctgtgcctgtgtctgctggaggagagggggagaccagcccctacagcctggaggccagccccctgggccagctgatgaacatgctgagccaccctgtgatccgccgcagcagcctgctgacagagaagctgctgcggctgctgagcctcatcagcatcgccctgcctgagaacaaggtgtctgaggcccaggccaacagcggcagcggggccagcagcaccaccacagccaccagcaccaccagcaccaccaccaccacagctgccagcaccacccccaccccacccacagcccccacccctgtgaccagcgccccagccctggtggccgccacagccatcagcaccatcgtggtggccgccagcaccaccgtgaccacccccaccacagccaccaccaccgtgtccatcagccccaccaccaagggcagcaagagccctgccaaggtgtctgatggcggcagcagcagcacagacttcaagatggtgagcagcggcctgacagagaaccagctgcagctgtctgtggaggtgctgaccagccacagctgcagcgaggagggcctggaggatgctgccaacgtgctgctgcagctgagcagaggagacagcggcacccgggacacagtgctgaagctgctgctgaatggagcccggcacctgggctacaccctgtgcaagcagatcggcaccctgctggccgagctgcgggagtacaacctggagcagcagaggcgggcccagtgtgagaccctgagcccagatggcctgcctgaggagcagccccagaccaccaagctgaagggcaagatgcagagcagatttgacatggccgagaatgtggtgattgtggccagccagaagaggcccctgggcggccgggagctgcagctgcccagcatgtccatgctgaccagcaagaccagcacccagaagttcttcctgcgggtgctgcaggtgatcatccagctgagagatgacacccggcgggccaacaagaaggccaagcagacaggccgcctgggcagcagcggcctgggcagcgccagcagcatccaggccgctgtgcggcagctggaggccgaggctgatgccatcatccagatggtgcgggagggccagagggcccggcggcagcagcaggccgccaccagcgagagcagccagagcgaggcctctgtgcggcgggaggagagccccatggatgtggaccagcccagccccagcgcccaggacacccagagcatcgccagtgatggcaccccccagggcgagaaggagaaggaggagaggcctcctgagctgcccctgctgtctgagcagctgagcctggatgagctgtgggacatgctgggggagtgcctgaaggagctggaggagagccatgaccagcacgctgtgctggtgctgcagcctgctgtggaggccttcttcctggtgcacgccacagagcgggagagcaagccccctgtgcgggacacccgggagagccagctggcccacatcaaggatgagcccccacccctgagccctgcccccctgaccccagccacccccagcagcctggaccccttcttcagccgggagcccagctccatgcacatcagcagcagcctgcccccagacacccagaagttcctgcgctttgctgagacccacaggacagtgctgaaccagatcctgcggcagagcaccacccacctggctgatggcccctttgctgtgctggtggactacatccgggtgctggactttgatgtgaagaggaagtacttccggcaggagctggagcggctggatgagggcctgaggaaagaagacatggctgtgcacgtgcggcgggaccacgtgtttgaggacagctaccgggagctgcacaggaagagccctgaggagatgaagaaccggctgtacatcgtgtttgaaggagaggagggccaggatgctgggggcctgctgcgggagtggtacatgatcatcagccgggagatgttcaaccccatgtatgccctcttccgcaccagccctggggacagagtgacctacaccatcaaccccagcagccactgcaaccccaaccacctgagctacttcaagtttgtgggcagaattgtggccaaggctgtgtatgacaaccggctgctggagtgctacttcaccaggagcttctacaagcacatcctgggcaagtctgtgcgctacacagacatggagagcgaggactaccacttctaccagggcctggtgtacctgctggagaatgatgtgtccaccctgggctatgacctgaccttcagcacagaggtgcaggagtttggagtgtgtgaggtgcgggacctgaagcccaacggggccaacatcctggtgacagaggagaacaagaaggagtatgtgcacctggtgtgccagatgaggatgaccggggccatcaggaagcagctggccgccttcctggagggcttctatgagatcatccccaagaggctcatcagcatcttcacagagcaggagctggagctgctgatcagcggcctgcccaccattgatattgatgacctgaagagcaacacagagtaccacaagtaccagagcaacagcatccagatccagtggttctggagggccctgcggagctttgaccaggccgaccgggccaagttcctgcagtttgtgacaggcaccagcaaggtgcccctgcagggctttgctgccctggagggcatgaatggcatccagaagttccagatccacagagatgacaggagcacagaccggctgcccagcgcccacacctgcttcaaccagctggacctgcctgcctatgagagctttgagaagctgcggcacatgctgctgctggccatccaggagtgcagcgagggcttcggcctggcctag

SEQ ID NO: 155032 - DNA, 13125 bp, Artificial Sequence; identical to SEQ ID NO: 155031
  Description of Artificial Sequence: Synthetic coding sequence

SEQ ID NO: 155033 - DNA, 771 bp, Artificial Sequence
  Description of Artificial Sequence: Synthetic coding sequence
atggacccctacccccaccagtttgccacagccctcttctccttcctgtaccacctggccagctatgatgctggaggagaggccctggtgtcctgtggcatgatggaggccctgctgaaggtgatcaagttcctgggagatgagcaggaccagatcacctttgtgaccagggctgtgcgggtggtggacctgatcaccaacctggacatggccgccttccagagccacagcggcctgagcatcttcatctaccgcctggagcacgaggtggacctgtgcaggaaggagtgcccctttgtgatcaagcccaagatccagaggcccaacaccacccaggagggggaggagatggagacagacatggatgtggctgatgtggccatggagagcagccctggcagcagcatctccatggagcaccggctggatgtggagctgcgggccagcggcagcagcagcagcaccaacatcagcagcggccccagccctggccccagccctggcactggacctggccctggccctggccctggccctggccctggccctggccctggccctggccctggccctggccctggccctggccctggccctggccccaggcctggggtgcagtgcatcccccagagagctgccctgctgaagtccatgctgaacttcctgaagaaggccatccaggaccctgccttcagtgatggcatcagacatgtgatggatggcagcctgcccaccagcctgaagcacatcatcagcaatgctgagtactag

SEQ ID NO: 155034 - DNA, 687 bp, Artificial Sequence
  Description of Artificial Sequence: Synthetic coding sequence
tgagtgtcctgtggcatgatggaggccctgctgaaggtgatcaagttcctgggagatgagcaggaccagatcacctttgtgaccagggctgtgcgggtggtggacctgatcaccaacctggacatggccgccttccagagccacagcggcctgagcatcttcatctaccgcctggagcacgaggtggacctgtgcaggaaggagtgcccctttgtgatcaagcccaagatccagaggcccaacaccacccaggagggggaggagatggagacagacatggatgtggctgatgtggccatggagagcagccctggcagcagcatctccatggagcaccggctggatgtggagctgcgggccagcggcagcagcagcagcaccaacatcagcagcggccccagccctggccccagccctggcactggacctggccctggccctggccctggccctggccctggccctggccctggccctggccctggccctggccctggccctggccctggccctggccccaggcctggggtgcagtgcatcccccagagagctgccctgctgaagtccatgctgaacttcctgaagaaggccatccaggaccctgccttcagtgatggcatcagacatgtgatggatggcagcctgcccaccagcctgaagcacatcatcagcaatgctgagtactag

SEQ ID NO: 155035 - DNA, 3594 bp, Artificial Sequence
  Description of Artificial Sequence: Synthetic coding sequence
tgaccatctggcagcaatgtggacaccctgctgcggctgcggggccgcctgctgctggaccacgaggccctgagctgcctgctggtgctgctgtttgtggatgagcccaagctgaacaccagccggctgcaccgggtgctgaggaacctgtgctaccacgcccagaccaggcactgggtgatccgcagcctgctgagcatcctgcagaggagcagcgagagcgagctgtgcatcgagacccccaagctgaccaccagcgaggagaagggcaagaagagcagcaagagctgtggcagcagcagccatgaaaatcggcccctggacctgctgcacaagatggagagcaagagcagcaaccagctgtcctggctgtctgtgtccatggatgctgccctgggctgcaggaccaacatcttccagatccagaggtctgggggcaggaagcacacagagaagcacgccagcggcggcagcacagtgcacatccacccccaggccgcccctgtggtgtgcagacatgtgctggacaccctcatccagctggccaaggtgttccccagccacttcacccagcagaggaccaaggagaccaactgtgagagtgaccgggagcggggcaacaaggcctgcagcccctgcagcagccagagcagcagcagcggcatctgcacagacttctgggacctgctggtgaagctggacaacatgaatgtgtccaggaagggcaagaacagcgtgaagtctgtgcctgtgtctgctggaggagagggggagaccagcccctacagcctggaggccagccccctgggccagctgatgaacatgctgagccaccctgtgatccgccgcagcagcctgctgacagagaagctgctgcggctgctgagcctcatcagcatcgccctgcctgagaacaaggtgtctgaggcccaggccaacagcggcagcggggccagcagcaccaccacagccaccagcaccaccagcaccaccaccaccacagctgccagcaccacccccaccccacccacagcccccacccctgtgaccagcgccccagccctggtggccgccacagccatcagcaccatcgtggtggccgccagcaccaccgtgaccacccccaccacagccaccaccaccgtgtccatcagccccaccaccaagggcagcaagagccctgccaaggtgtctgatggcggcagcagcagcacagacttcaagatggtgagcagcggcctgacagagaaccagctgcagctgtctgtggaggtgctgaccagccacagctgcagcgaggagggcctggaggatgctgccaacgtgctgctgcagctgagcagaggagacagcggcacccgggacacagtgctgaagctgctgctgaatggagcccggcacctgggctacaccctgtgcaagcagatcggcaccctgctggccgagctgcgggagtacaacctggagcagcagaggcgggcccagtgtgagaccctgagcccagatggcctgcctgaggagcagccccagaccaccaagctgaagggcaagatgcagagcagatttgacatggccgagaatgtggtgattgtggccagccagaagaggcccctgggcggccgggagctgcagctgcccagcatgtccatgctgaccagcaagaccagcacccagaagttcttcctgcgggtgctgcaggtgatcatccagctgagagatgacacccggcgggccaacaagaaggccaagcagacaggccgcctgggcagcagcggcctgggcagcgccagcagcatccaggccgctgtgcggcagctggaggccgaggctgatgccatcatccagatgtctgagagcagccagagcgaggcctctgtgagaagagaggagagccccatggatgtggaccagcccagccccagcgcccaggacacccagagcatcgccagtgatggcaccccccagggcgagaaggagaaggaggagcggcccccagagctgcccctgctgtctgagcagctgagcctggatgagctgtgggacatgctgggagaatgtctgaaggagctggaggagagccatgaccagcacgctgtgctggtgctgcagcctgctgtggaggccttcttcctggtgcacgccacagagcgggagagcaagccccctgtgcgggacacccgggagagccagctggcccacatcaaggatgagcccccacccctgagccctgcccccctgaccccagccacccccagcagcctggaccccttcttcagccgggagcccagctccatgcacatcagcagcagcctgcccccagacacccagaagttcctgcgctttgctgagacccacaggacagtgctgaaccagatcctgcggcagagcaccacccacctggctgatggcccctttgctgtgctggtggactacatccgggtgctggactttgatgtgaagaggaagtacttccggcaggagctggagcggctggatgagggcctgaggaaggaggacatggctgtgcacgtgagaagagaccacgtgtttgaagattcctaccgggagctgcacaggaagagccctgaggagatgaagaacagactctacatcgtgtttgaaggagaggagggccaggatgctgggggcctgctgcgggagtggtacatgatcatcagccgggagatgttcaaccccatgtatgccctcttccgcaccagccctggggacagagtgacctacaccatcaaccccagcagccactgcaaccccaaccacctgagctacttcaagtttgtgggccgcatcgtggccaaggctgtgtatgacaaccggctgctggagtgctacttcaccaggagcttctacaagcacatcctgggcaagtctgtgcgctacacagacatggagagcgaggactaccacttctaccagggcctggtgtacctgctggagaatgatgtgtccaccctgggctatgacctgaccttcagcacagaggtgcaggagtttggagtgtgtgaggtgcgggacctgaagcccaatggagccaacatcctggtgacagaggagaacaagaaggagtatgtgcacctggtgtgccagatgaggatgactggagccatcaggaagcagctggccgccttcctggagggcttctatgagatcatccccaagaggctcatcagcatcttcacagagcaggagctggagctgctgatcagcggcctgcccaccatcgacattgatgacctgaagagcaacacagagtaccacaagtaccagagcaacagcatccagatccagtggttctggagggccctgcggagctttgaccaggccgaccgggccaagttcctgcagtttgtgacaggcaccagcaaggtgcccctgcagggctttgctgccctggagggcatgaatggcatccagaagttccagatccacagagatgacaggagcacagaccggctgcccagcgcccacacctgcttcaaccagctggacctgcctgcctatgagagctttgagaagctgcggcacatgctgctgctggccatccaggagtgcagcgagggcttcggcctggcctag

SEQ ID NO: 155036 - DNA, 10227 bp, Artificial Sequence
  Description of Artificial Sequence: Synthetic coding sequence
tgaagcctgcccagcggctgtgaatttggccaggccgacatgcagaagctggtgcccaaggatgagaaggcagatggagagcaggatggagctgctggctccatggatgccagcacccagggcctgctggagggcatcggcctggatggagacaccctggcccccatggagacagatgagcccacagccagtgacagcaagggcaagagcaagatcaccccagccatggccgcccgcatcaagcagatcaagcccctgctgagcgccagcagccggctgggccgggccctggccgagctgtttggcctgctggtgaagctgtgtgtgggcagccctgtgcggcagaggaggagccaccacgccgccagcaccaccacagcccccaccccagctgcccggagcacagccagcgccctgaccaagctgctgaccaagggcctgtcctggcagcccccaccctacacccccaccccccgcttccggctgaccttcttcatctgcagcgtgggcttcaccagccccatgctgtttgatgagaggaagtacccctaccacctgatgctgcagaagttcctgtgcagcggcggccacaatgccctgtttgagaccttcaactgggccctgtccatgggcggcaaggtgcctgtgtctgagggcctggagcacagcgacctgcctgatggcactggagagttcctggatgcctggctgatgctggtggagaagatggtgaaccccaccaccgtgctggagagcccccacagcctgcctgccaagctgcctggaggagtgcagaacttcccccagttcagcgccctgcgcttcctggtggtgacccagaaggccgccttcacctgcatcaagaacctgtggaacaggaagcccctgaaggtgtatggaggccgcatggccgagagcatgctggccatcctgtgccacatcctgcggggggagcctgtgatccgggagcggctgagcaaggagaaggagggcagcagaggagaggaggacaccggccaggaggagggcggcagccggcgggagccccaggtgaaccagcagcagctgcagcagctgatggacatgggcttcacccgggagcacgccatggaggccctgctgaacaccagcaccatggagcaggccacagagtacctgctgacccaccccccacccatcatgggcggcgtggtgcgggacctgtccatgtctgaggaggaccagatgatgagggccatcgccatgagcctgggccaggacatccccatggaccagagagctgagagccctgaggaggtggcctgcaggaaggaggaggaggagaggaaggcccgggagaagcaggaggaggaggaggccaagtgcctggagaagttccaggatgctgaccccctggagcaggatgagctgcacaccttcacagacaccatgctgcccggctgcttccacctgctggatgagctgcctgacacagtgtacagagtgtgtgacctgatcatgacagccatcaagagaaatggagctgactacagagacatgatcctgaagcaggtggtgaaccaggtgtgggaggccgcagatgtgctgatcaaggccgccctgcccctgaccaccagtgacaccaagacagtgtctgagtggatcagccagatggccaccctgccccaggccagcaacctggccacccgcatcctgctgctgaccctgctgtttgaggagctgaagctgccctgtgcctgggtggtggagagcagcggcatcctgaatgtgctgatcaagctgctggaggtggtgcagccctgcctgcaggccgccaaggagcagaaggaggtgcagacccccaagtggatcacccctgtgctgctgctgattgacttctatgagaagacagccatcagcagcaagaggcgggcccagatgaccaagtacctgcagagcaacagcaacaactggcgctggtttgatgacaggagcggccgctggtgcagctacagcgccagcaacaacagcaccatcgacagcgcctggaagagcggggagacctctgtgcgcttcaccgctggaagaagacgctacacagtgcagttcaccaccatggtgcaggtgaatgaggagaccggcaacagaagacctgtgatgctgaccctgctgcgggtgccccggctgaacaagaacagcaagaacagcaatggccaggagctggagaagaccctggaggagagcaaggagatggacatcaagaggaaggagaacaagggaaatgacacccccctggccctggagagcaccaacacagagaaggagaccagcctggaggagaccaagatcggggagatcctgatccagggcctgacagaggacatggtgacagtgctgatccgggcctgtgtgtccatgctgggcgtgcctgtggaccctgacaccctgcacgccaccctgcggctgtgcctgcggctgacccgggaccacaagtatgccatgatgtttgctgagctgaagagcaccaggatgatcctgaacctgacccagagcagcggcttcaacggcttcacccccctggtgaccctgctgctgcggcacatcatcgaggacccctgcaccctgcggcacaccatggagaaggtggtgcgctctgctgccaccagcggggccggcagcaccaccagcggcgtggtgtctggcagcctgggcagccgggagatcaactacatcctgcgggtgctgggccctgctgcctgcaggaacccagacatcttcacagaggtggccaactgctgcatcagaattgccctgcctgccccccggggcagcggcacagccagtgatgatgaatttgagaacctgcgcatcaagggccccaatgctgtgcagctggtgaagaccacccccctgaagcccagccccctgcccgtcatcccagacaccatcaaggaggtgatctatgacatgctgaatgccctggccgcctaccacgcccctgaggaggccgacaagagtgaccccaagccaggagtgatgacccaggaggtgggccagctgctgcaggacatgggagatgatgtgtaccagcagtaccgcagcctgacccggcagagcagtgactttgacacccagagcggcttcagcatcaacagccaggtgtttgctgctgatggagccagcacagagaccagcgccagcggcaccagccagggcgaggccagcaccccagaggagagcagagatggcaagaaggacaaggagggggaccgggccagcgaggagggcaagcagaagggcaagggcagcaagcccctgatgcccaccagcaccatcctgcggctgctggccgagctggtgcgctcctatgtgggcatcgccaccctgattgccaactacagctacacagtgggccagagcgagctgatcaaggaggactgcagcgtgctggcctttgtgctggaccacctgctgccccacacccagaatgctgaggacaaggacaccccagccctggcccggctcttcctggccagcctggccgccgccggcagcggcacagatgcccaggtggccctggtgaatgaggtgaaggccgccctgggccgggccctggccatggccgagagcacagagaagcacgcccggctgcaggccgtgatgtgcatcatcagcaccatcatggagagctgccccagcaccagcagcttctacagcagcgccacagccaagacccagcacaacggcatgaacaacatcatccgcctcttcctgaagaagggcctggtgaatgacctggcccgggtgccccacagcctggacctgagcagccccaacatggccaacacagtgaatgctgccctgaagcccctggagaccctgagccgcatcgtgaaccagcccagcagcctgtttggcagcaagagcgccagcagcaagaacaagtctgagcaggatgcccagggcgccagccaggacagcagcagcaaccagcaggaccctggagagcccggggaggccgaggtgcaggaggaggaccatgatgtgacccagacagaggtggctgatggagacatcatggatggagaggccgagacagattctgtggtgattgctggccagcctgaggtgctgagcagccaggagatgcaggtggagaatgagctggaggacctgattgatgagctgctggagagagatggcggcagcggcaacagcaccatcatcgtgagccgcagcggggaggatgagagccaggaggatgtgctgatggatgaggcccccagcaacctgagccaggccagcaccctgcaggccaacagagaagattccatgaacatcctggaccctgaagatgaggaggagcacacccaggaggaggacagcagcggcagcaatgaagatgaagatgacagccaggatgaggaggaggaggaggaggaggatgaagaagatgaccaggaggatgatgaaggagaggagggagatgaagatgatgatgatgatggcagcgagatggagctggatgaggactacccagacatgaatgccagccccctggtgcgctttgaaagatttgaccgggaggatgacctgatcattgaatttgacaacatgttcagcagcgccacagacatcccccccagccctggcaacatccccaccacccaccccctgatggtgagacatgctgaccacagcagcctgaccctgggcagcggcagcagcaccacccggctgacccagggcatcggccgcagccagaggaccctgcggcagctgacagccaacacaggccacaccatccacgtgcactacccaggcaaccggcagcccaaccccccactcatcctgcagaggctgctgggccccagcgctgctgctgacatcctgcagctgagcagcagcctgcccctgcagagccggggccgggcccggctgctggtgggcaatgatgatgtgcacatcatcgcccggagtgatgatgagctgctggatgacttcttccatgaccagagcacagccaccagccaggccggcaccctgagcagcatccccacagccctgacccgctggacagaggagtgcaaggtgctggatgctgagagcatgcatgactgtgtgtctgtggtgaaggtgtccatcgtgaaccacctggagttcctgagagatgaggagctggaggagcggcgggagaagaggaggaagcagctggccgaggaggagaccaagatcacagacaagggcaaggaggacaaggaaaatagagaccagagcgcccagtgcacagccagcaagagcaatgacagcacagagcagaacctgagtgatggcacccccatgccagacagctaccccaccacccccagcagcacagatgctgccaccagcgagagcaaggagaccctgggcaccctgcagagcagccagcagcagcccaccctgcccaccccaccagccctgggggaggtgccccaggagctgcagagccctgctggggagggcggcagcagcacccagctgctgatgcctgtggagcctgaggagctgggccccacccggcccagcggggaggccgagaccacccagatggagctgagccctgcccccaccatcaccagcctgagccctgagagagctgaggacagtgatgccctgacagctgtgagcagccagctggagggcagccccatggacaccagcagcctggccagctgcaccctggaggaggccgtgggggacaccagcgctgctggcagcagcgagcagcccagggctggcagcagcaccccaggagatgcccccccagctgtggccgaggtgcagggccgcagtgatggcagcggggagagcgcccagcccccagaggacagcagccccccagccagcagcgagagcagcagcacccgggacagcgctgtggccatcagcggggctgacagccggggcatcctggaggagcccctgcccagcaccagcagcgaggaggaggaccccctggccggcatcagcctgcctgagggcgtggaccccagcttcctggccgccctgcctgatgacatcagaagagaggtgctgcagaaccagctgggcatccggccccccaccaggacagcccccagcaccaacagcagcgccccagctgtggtgggcaaccctggggtgacagaggtgtccccagagttcctggccgccctgcccccagccatccaggaggaggtgctggcccagcagagagctgagcagcagaggcgggagctggcccagaatgccagcagtgacacccccatggaccctgtgaccttcatccagaccctgcccagcgacctgcggcgctctgtgctggaggacatggaggacagcgtgctggccgtgatgcccccagacattgctgctgaggcccaggccctgcggcgggagcaggaggcccggcagaggcagctgatgcatgagcggctgtttggccacagcagcaccagcgccctgagcgccatcctgcggagccctgccttcaccagccggctgagcggcaacagaggagtgcagtacacccggctggccgtgcagaggggcggcaccttccagatgggcggcagcagcagccacaaccggcccagcggcagcaatgtggacaccctgctgcggctgcggggccgcctgctgctggaccacgaggccctgagctgcctgctggtgctgctgtttgtggatgagcccaagctgaacaccagccggctgcaccgggtgctgaggaacctgtgctaccacgcccagaccaggcactgggtgatccgcagcctgctgagcatcctgcagaggagcagcgagagcgagctgtgcatcgagacccccaagctgaccaccagcgaggagaagggcaagaagagcagcaagagctgtggcagcagcagccatgaaaatcggcccctggacctgctgcacaagatggagagcaagagcagcaaccagctgtcctggctgtctgtgtccatggatgctgccctgggctgcaggaccaacatcttccagatccagaggtctgggggcaggaagcacacagagaagcacgccagcggcggcagcacagtgcacatccacccccaggccgcccctgtggtgtgcagacatgtgctggacaccctcatccagctggccaaggtgttccccagccacttcacccagcagaggaccaaggagaccaactgtgagagtgaccgggagcggggcaacaaggcctgcagcccctgcagcagccagagcagcagcagcggcatctgcacagacttctgggacctgctggtgaagctggacaacatgaatgtgtccaggaagggcaagaacagcgtgaagtctgtgcctgtgtctgctggaggagagggggagaccagcccctacagcctggaggccagccccctgggccagctgatgaacatgctgagccaccctgtgatccgccgcagcagcctgctgacagagaagctgctgcggctgctgagcctcatcagcatcgccctgcctgagaacaaggtgtctgaggcccaggccaacagcggcagcggggccagcagcaccaccacagccaccagcaccaccagcaccaccaccaccacagctgccagcaccacccccaccccacccacagcccccacccctgtgaccagcgccccagccctggtggccgccacagccatcagcaccatcgtggtggccgccagcaccaccgtgaccacccccaccacagccaccaccaccgtgtccatcagccccaccaccaagggcagcaagagccctgccaaggtgtctgatggcggcagcagcagcacagacttcaagatggtgagcagcggcctgacagagaaccagctgcagctgtctgtggaggtgctgaccagccacagctgcagcgaggagggcctggaggatgctgccaacgtgctgctgcagctgagcagaggagacagcggcacccgggacacagtgctgaagctgctgctgaatggagcccggcacctgggctacaccctgtgcaagcagatcggcaccctgctggccgagctgcgggagtacaacctggagcagcagaggcgggcccagtgtgagaccctgagcccagatggcctgcctgaggagcagccccagaccaccaagctgaagggcaagatgcagagcagatttgacatggccgagaatgtggtgattgtggccagccagaagaggcccctgggcggccgggagctgcagctgcccagcatgtccatgctgaccagcaagaccagcacccagaagttcttcctgcgggtgctgcaggtgatcatccagctgagagatgacacccggcgggccaacaagaaggccaagcagacaggccgcctgggcagcagcggcctgggcagcgccagcagcatccaggccgctgtgcggcagctggaggccgaggctgatgccatcatccagatggtgcgggagggccagagggcccggcggcagcagcaggccgccaccagcgagagcagccagagcgaggcctctgtgcggcgggaggagagccccatggatgtggaccagcccagccccagcgcccaggacacccagagcatcgccagtgatggcaccccccagggcgagaaggagaaggaggagaggcctcctgagctgcccctgctgtctgagcagctgagcctggatgagctgtgggacatgctgggggagtgcctgaaggagctggaggagagccatgaccagcacgctgtgctggtgctgcagcctgctgtggaggccttcttcctggtgcacgccacagagcgggagagcaagccccctgtgcgggacacccgggagagccagctggcccacatcaaggatgagcccccacccctgagccctgcccccctgaccccagccacccccagcagcctggaccccttcttcagccgggagcccagctccatgcacatcagcagcagcctgcccccagacacccagaagttcctgcgctttgctgagacccacaggacagtgctgaaccagatcctgcggcagagcaccacccacctggctgatggcccctttgctgtgctggtggactacatccgggtgctggactttgatgtgaagaggaagtacttccggcaggagctggagcggctggatgagggcctgaggaaagaagacatggctgtgcacgtgcggcgggaccacgtgtttgaggacagctaccgggagctgcacaggaagagccctgaggagatgaagaaccggctgtacatcgtgtttgaaggagaggagggccaggatgctgggggcctgctgcgggagtggtacatgatcatcagccgggagatgttcaaccccatgtatgccctcttccgcaccagccctggggacagagtgacctacaccatcaaccccagcagccactgcaaccccaaccacctgagctacttcaagtttgtgggcagaattgtggccaaggctgtgtatgacaaccggctgctggagtgctacttcaccaggagcttctacaagcacatcctgggcaagtctgtgcgctacacagacatggagagcgaggactaccacttctaccagggcctggtgtacctgctggagaatgatgtgtccaccctgggctatgacctgaccttcagcacagaggtgcaggagtttggagtgtgtgaggtgcgggacctgaagcccaacggggccaacatcctggtgacagaggagaacaagaaggagtatgtgcacctggtgtgccagatgaggatgaccggggccatcaggaagcagctggccgccttcctggagggcttctatgagatcatccccaagaggctcatcagcatcttcacagagcaggagctggagctgctgatcagcggcctgcccaccattgatattgatgacctgaagagcaacacagagtaccacaagtaccagagcaacagcatccagatccagtggttctggagggccctgcggagctttgaccaggccgaccgggccaagttcctgcagtttgtgacaggcaccagcaaggtgcccctgcagggctttgctgccctggagggcatgaatggcatccagaagttccagatccacagagatgacaggagcacagaccggctgcccagcgcccacacctgcttcaaccagctggacctgcctgcctatgagagctttgagaagctgcggcacatgctgctgctggccatccaggagtgcagcgagggcttcggcctggcctag

SEQ ID NO: 155037 - DNA, 651 bp, Artificial Sequence
  Description of Artificial Sequence: Synthetic coding sequence
atgaaggtggacaggaccaagctgaagaagacccccacagaggccccagctgactgccgggccctgattgacaagctgaaggtgtgcaatgatgagcagctgctgctggagctgcagcagatcaagacctggaacatcggcaaatgtgagctgtaccactgggtggacctgctggacagatttgatggcatcctggctgatgctggccagacagtggagaacatgtcctggatgctggtgtgtgacaggcctgagcgggagcagctgaagatgctgctgctggccgtgctgaacttcaccgccctgctgattgagtacagcttcagccgccacctgtacagcagcattgagcacctgaccaccctgctggccagcagtgacatgcaggtggtgctggccgtgctgaacctgctgtatgtgttcagcaagaggagcaactacatcacccggctgggcagtgacaagaggacccccctgctgacccggctgcagcacctggccgagagctggggcggcaaggaaaatggatttggcctggccgagtgctgccgggacctgcacatgatgaagtacccacccagcgccaccaccctgcactttgagttctacgccgaccccggggctgaggtgaagattgagaagaggaagtag

SEQ ID NO: 155038 - DNA, 282 bp, Artificial Sequence
  Description of Artificial Sequence: Synthetic coding sequence
atgaaggtggacaggaccaagctgaagaagacccccacagaggccccagctgactgccgggccctgattgacaagctgaaggtgtgcaatgatgagcagctgctgctggagctgcagcagatcaagacctggaacatcggcaaatgtgagctgtaccactgggtggacctgctggacagatttgatggcatcctggctgatgctggccagacagtggagaacatgtcctggatgctggtgtgtgacaggcctgagcgggagcagctgaagatgctgctgtag

SEQ ID NO: 155039 - DNA, 1482 bp, Artificial Sequence
  Description of Artificial Sequence: Synthetic coding sequence
atgctgccccgctgggagctggccctgtacctgctggccagcctgggcttccacttctacagcttctatgaggtgtacaaggtgtcccgggagcacgaggaggagctggaccaggagtttgagctggagacagacaccctgtttggaggcctgaagaaggatgccacagactttgagtggagcttctggatggagtggggcaagcagtggctggtgtggctgctgctgggccacatggtggtgtcccagatggccaccctgctggccaggaagcaccggccctggatcctgatgctgtatggcatgtgggcctgctggtgtgtgctgggcaccccaggagtggccatggtgctgctgcacaccaccatctccttctgtgtggcccagttccgcagccagctgctgacctggctgtgcagcctgctgctgctgagcaccctgcggctgcagggcgtggaggaggtgaagaggcgctggtacaagacagaaaatgagtactacctgctgcagttcaccctgactgtgcgctgcctgtactacaccagcttcagcctggagctgtgctggcagcagctgcctgctgccagcaccagctacagcttcccctggatgctggcctacgtgttctactaccctgtgctgcacaacggccccatcctgtccttcagcgagttcatcaagcagatgcagcagcaggagcatgacagcctgaaggccagcctgtgtgtgctggccctgggcctgggccgcctgctgtgctggtggtggctggccgagctgatggcccacctgatgtacatgcacgccatctacagcagcatccccctgctggagaccgtgtcctgctggaccctgggcggcctggccctggcccaggtgctcttcttctacgtgaagtacctggtgctgtttggagtgcctgccctgctgatgaggctggatggcctgaccccaccagccctgccccgctgtgtgtccaccatgttctccttcaccggcatgtggagatactttgatgtgggcctgcacaacttcctgatccgctacgtgtacatccctgtgggcggcagccagcacggcctgctgggcaccctcttcagcacagccatgacctttgcctttgtgtcctactggcatggaggctatgactacctgtggtgctgggccgccctgaactggctgggcgtgacagtggagaatggagtgcggcggctggtggagaccccctgcatccaggacagcctggcccgctacttcagcccccaggcccggcggcgcttccacgccgccctggccagctgcagcacctccatgctgatcctgagcaacctggtgttcctgggcggcaatgaggtgggcaagacctactggaaccgcatcttcatccagggctggccctgggtgaccctgtctgtgctgggcttcctgtactgctacagccacgtgggcatcgcctgggcccagacctacgccacagactag

SEQ ID NO: 155040 - DNA, 1347 bp, Artificial Sequence
  Description of Artificial Sequence: Synthetic coding sequence
atgaagttcaccaagagcccagaagatgccacagactttgagtggagcttctggatggagtggggcaagcagtggctggtgtggctgctgctgggccacatggtggtgtcccagatggccaccctgctggccaggaagcaccggccctggatcctgatgctgtatggcatgtgggcctgctggtgtgtgctgggcaccccaggagtggccatggtgctgctgcacaccaccatctccttctgtgtggcccagttccgcagccagctgctgacctggctgtgcagcctgctgctgctgagcaccctgcggctgcagggcgtggaggaggtgaagaggcgctggtacaagacagaaaatgagtactacctgctgcagttcaccctgactgtgcgctgcctgtactacaccagcttcagcctggagctgtgctggcagcagctgcctgctgccagcaccagctacagcttcccctggatgctggcctacgtgttctactaccctgtgctgcacaacggccccatcctgtccttcagcgagttcatcaagcagatgcagcagcaggagcatgacagcctgaaggccagcctgtgtgtgctggccctgggcctgggccgcctgctgtgctggtggtggctggccgagctgatggcccacctgatgtacatgcacgccatctacagcagcatccccctgctggagaccgtgtcctgctggaccctgggcggcctggccctggcccaggtgctcttcttctacgtgaagtacctggtgctgtttggagtgcctgccctgctgatgaggctggatggcctgaccccaccagccctgccccgctgtgtgtccaccatgttctccttcaccggcatgtggagatactttgatgtgggcctgcacaacttcctgatccgctacgtgtacatccctgtgggcggcagccagcacggcctgctgggcaccctcttcagcacagccatgacctttgcctttgtgtcctactggcacggcggctatgactacctgtggtgctgggccgccctgaactggctgggcgtgacagtggagaatggagtgcggcggctggtggagaccccctgcatccaggacagcctggcccgctacttcagcccccaggcccggcggcgcttccacgccgccctggccagctgcagcacctccatgctgatcctgagcaacctggtgttcctgggcggcaatgaggtgggcaagacctactggaaccgcatcttcatccagggctggccctgggtgaccctgtctgtgctgggcttcctgtactgctacagccacgtgggcatcgcctgggcccagacctacgccacagactag

SEQ ID NO: 155041 - DNA, 552 bp, Artificial Sequence
  Description of Artificial Sequence: Synthetic coding sequence
atgaggctggatggcctgaccccaccagccctgccccgctgtgtgtccaccatgttctccttcaccggcatgtggagatactttgatgtgggcctgcacaacttcctgatccgctacgtgtacatccctgtgggcggcagccagcacggcctgctgggcaccctcttcagcacagccatgacctttgcctttgtgtcctactggcatggaggctatgactacctgtggtgctgggccgccctgaactggctgggcgtgacagtggagaatggagtgcggcggctggtggagaccccctgcatccaggacagcctggcccgctacttcagcccccaggcccggcggcgcttccacgccgccctggccagctgcagcacctccatgctgatcctgagcaacctggtgttcctgggcggcaatgaggtgggcaagacctactggaaccgcatcttcatccagggctggccctgggtgaccctgtctgtgctgggcttcctgtactgctacagccacgtgggcatcgcctgggcccagacctacgccacagactag

SEQ ID NO: 155042 - DNA, 1482 bp, Artificial Sequence; identical to SEQ ID NO: 155039
  Description of Artificial Sequence: Synthetic coding sequence

SEQ ID NO: 155043 - DNA, 1557 bp, Artificial Sequence
  Description of Artificial Sequence: Synthetic coding sequence
atgctgccccgctgggagctggccctgtacctgctggccagcctgggcttccacttctacagcttctatgaggtgtacaaggtgtcccgggagcacgaggaggagctggaccaggagtttgagctggagacagacaccctgtttggaggcctgaagaaggatgccacagactttgagtggagcttctggatggagtggggcaagcagtggctggtgtggctgctgctgggccacatggtggtgtcccagatggccaccctgctggccaggaagcaccggccctggatcctgatgctgtatggcatgtgggcctgctggtgtgtgctgggcaccccaggagtggccatggtgctgctgcacaccaccatctccttctgtgtggcccagttccgcagccagctgctgacctggctgtgcagcctgctgctgctgagcaccctgcggctgcagggcgtggaggaggtgaagaggcgctggtacaagacagaaaatgagtactacctgctgcagttcaccctgactgtgcgctgcctgtactacaccagcttcagcctggagctgtgctggcagcagctgcctgctgccagcaccagctacagcttcccctggatgctggcctacgtgttctactaccctgtgctgcacaacggccccatcctgtccttcagcgagttcatcaagcagatgcagcagcaggagcatgacagcctgaaggccagcctgtgtgtgctggccctgggcctgggccgcctgctgtgctggtggtggctggccgagctgatggcccacctgatgtacatgcacgccatctacagcagcatccccctgctggagaccgtgtcctgctggaccctgggcggcctggccctggcccaggtgctcttcttctacgtgaagtacctggtgctgtttggagtgcctgccctgctgatgaggctggatggcctgaccccaccagccctgccccgctgtgtgtccaccatgttctccttcaccggcatgtggagatactttgatgtgggcctgcacaacttcctgatccgctacgtgtacatccctgtgggcggcagccagcacggcctgctgggcaccctcttcagcacagccatgacctttgcctttgtgtcctactggcatggaggctatgactacctgtggtgctgggccgccctgaactggctgggcgtgacagtggagaatggagtgcggcggctggtggagaccccctgcatccaggacagcctggcccgctacttcagcccccaggcccggcggcgcttccacgccgccctggccagctgcagcacctccatgctgatcctgagcaacctggtgttcctgggcggcaatgaggtgggcaagacctactggaaccgcatcttcatccagggcggcctcttcctgttcttcctgctgaacccctgctgggagacagccttccagggcttccctgtgttcctgcacttcctgcagacagaggtgctggccacctttgtgcccaactacttctcctggaacatctgcatcgagaacaccagcgagctgagcagctactag

SEQ ID NO: 155044 - DNA, 1482 bp, Artificial Sequence; identical to SEQ ID NO: 155039
  Description of Artificial Sequence: Synthetic coding sequence

SEQ ID NO: 155045 - DNA, 624 bp, Artificial Sequence
  Description of Artificial Sequence: Synthetic coding sequence
atggagtggggcaagcagtggctggtgtggctgctgctgggccacatggtggtgtcccagatggccaccctgctggccaggaagaggcgctggtacaagacagaaaatgagtactacctgctgcagttcaccctgactgtgcgctgcctgtactacaccagcttcagcctggagctgtgctggcagcagctgcctgctgccagcaccagctacagcttcccctggatgctggcctacgtgttctactaccctgtgctgcacaacggccccatcctgtccttcagcgagttcatcaagcagatgcagcagcaggagcatgacagcctgaaggccagcctgtgtgtgctggccctgggcctgggccgcctgctgtgctggtggtggctggccgagctgatggcccacctgatgtacatgcacgccatctacagcagcatccccctgctggagaccgtgtcctgctggaccctgggcggcctggccctggcccaggtgctcttcttctacgtgaagtacctggtgctgtttggagtgcctgccctgctgatgaggctggatggcctgaccccaccagccctgccccgctgtgtgtccaccatgttctccttcaccggcatgtggtag

SEQ ID NO: 155046 - DNA, 1287 bp, Artificial Sequence
  Description of Artificial Sequence: Synthetic coding sequence
atgctgccccgctgggagctggccctgtacctgctggccagcctgggcttccacttctacagcttctatgaggtgtacaaggtgtcccgggagcacgaggaggagctggaccaggagtttgagctggagacagacaccctgtttggaggcctgaagaaggatgccacagactttgagtggagcttctggatggagtggggcaagcagtggctggtgtggctgctgctgggccacatggtggtgtcccagatggccaccctgctggccaggaagaggcgctggtacaagacagaaaatgagtactacctgctgcagttcaccctgactgtgcgctgcctgtactacaccagcttcagcctggagctgtgctggcagcagctgcctgctgccagcaccagctacagcttcccctggatgctggcctacgtgttctactaccctgtgctgcacaacggccccatcctgtccttcagcgagttcatcaagcagatgcagcagcaggagcatgacagcctgaaggccagcctgtgtgtgctggccctgggcctgggccgcctgctgtgctggtggtggctggccgagctgatggcccacctgatgtacatgcacgccatctacagcagcatccccctgctggagaccgtgtcctgctggaccctgggcggcctggccctggcccaggtgctcttcttctacgtgaagtacctggtgctgtttggagtgcctgccctgctgatgaggctggatggcctgaccccaccagccctgccccgctgtgtgtccaccatgttctccttcaccggcatgtggagatactttgatgtgggcctgcacaacttcctgatccgctacgtgtacatccctgtgggcggcagccagcacggcctgctgggcaccctcttcagcacagccatgacctttgcctttgtgtcctactggcacggcggctatgactacctgtggtgctgggccgccctgaactggctgggcgtgacagtggagaatggagtgcggcggctggtggagaccccctgcatccaggacagcctggcccgctacttcagcccccaggcccggcggcgcttccacgccgccctggccagctgcagcacctccatgctgatcctgagcaacctggtgttcctgggcggcaatgaggtgggcaagacctactggaaccgcatcttcatccagggctggccctgggtgaccctgtctgtgctgggcttcctgtactgctacagccacgtgggcatcgcctgggcccagacctacgccacagactag

SEQ ID NO: 155047 - DNA, 1071 bp, Artificial Sequence
  Description of Artificial Sequence: Synthetic coding sequence
atgctgccccgctgggagctggccctgtacctgctggccagcctgggcttccacttctacagcttctatgaggtgtacaaggtgtcccgggagcacgaggaggagctggaccaggagtttgagctggagacagacaccctgtttggaggcctgaagaaggatgccacagactttgagtggagcttctggatggagtggggcaagcagtggctggtgtggctgctgctgggccacatggtggtgtcccagatggccaccctgctggccaggaagatgcagcagcaggagcatgacagcctgaaggccagcctgtgtgtgctggccctgggcctgggccgcctgctgtgctggtggtggctggccgagctgatggcccacctgatgtacatgcacgccatctacagcagcatccccctgctggagaccgtgtcctgctggaccctgggcggcctggccctggcccaggtgctcttcttctacgtgaagtacctggtgctgtttggagtgcctgccctgctgatgaggctggatggcctgaccccaccagccctgccccgctgtgtgtccaccatgttctccttcaccggcatgtggagatactttgatgtgggcctgcacaacttcctgatccgctacgtgtacatccctgtgggcggcagccagcacggcctgctgggcaccctcttcagcacagccatgacctttgcctttgtgtcctactggcacggcggctatgactacctgtggtgctgggccgccctgaactggctgggcgtgacagtggagaatggagtgcggcggctggtggagaccccctgcatccaggacagcctggcccgctacttcagcccccaggcccggcggcgcttccacgccgccctggccagctgcagcacctccatgctgatcctgagcaacctggtgttcctgggcggcaatgaggtgggcaagacctactggaaccgcatcttcatccagggctggccctgggtgaccctgtctgtgctgggcttcctgtactgctacagccacgtgggcatcgcctgggcccagacctacgccacagactag

SEQ ID NO: 155048 - DNA, 1485 bp, Artificial Sequence
  Description of Artificial Sequence: Synthetic coding sequence
atgagcctgggcctgggcagcgctgagcggggcgtgctgggcaccaggggggcccgggagcgctgcagaagaagaagacctggccagcccggggagcacgaggaggagctggaccaggagtttgagctggagacagacaccctgtttggaggcctgaagaaggatgccacagactttgagtggagcttctggatggagtggggcaagcagtggctggtgtggctgctgctgggccacatggtggtgtcccagatggccaccctgctggccaggaagcaccggccctggatcctgatgctgtatggcatgtgggcctgctggtgtgtgctgggcaccccaggagtggccatggtgctgctgcacaccaccatctccttctgtgtggcccagttccgcagccagctgctgacctggctgtgcagcctgctgctgctgagcaccctgcggctgcagggcgtggaggaggtgaagaggcgctggtacaagacagaaaatgagtactacctgctgcagttcaccctgactgtgcgctgcctgtactacaccagcttcagcctggagctgtgctggcagcagctgcctgctgccagcaccagctacagcttcccctggatgctggcctacgtgttctactaccctgtgctgcacaacggccccatcctgtccttcagcgagttcatcaagcagatgcagcagcaggagcatgacagcctgaaggccagcctgtgtgtgctggccctgggcctgggccgcctgctgtgctggtggtggctggccgagctgatggcccacctgatgtacatgcacgccatctacagcagcatccccctgctggagaccgtgtcctgctggaccctgggcggcctggccctggcccaggtgctcttcttctacgtgaagtacctggtgctgtttggagtgcctgccctgctgatgaggctggatggcctgaccccaccagccctgccccgctgtgtgtccaccatgttctccttcaccggcatgtggagatactttgatgtgggcctgcacaacttcctgatccgctacgtgtacatccctgtgggcggcagccagcacggcctgctgggcaccctcttcagcacagccatgacctttgcctttgtgtcctactggcacggcggctatgactacctgtggtgctgggccgccctgaactggctgggcgtgacagtggagaatggagtgcggcggctggtggagaccccctgcatccaggacagcctggcccgctacttcagcccccaggcccggcggcgcttccacgccgccctggccagctgcagcacctccatgctgatcctgagcaacctggtgttcctgggcggcaatgaggtgggcaagacctactggaaccgcatcttcatccagggctggccctgggtgaccctgtctgtgctgggcttcctgtactgctacagccacgtgggcatcgcctgggcccagacctacgccacagactag

SEQ ID NO: 155049 - DNA, 1293 bp, Artificial Sequence
  Description of Artificial Sequence: Synthetic coding sequence
atggagtggggcaagcagtggctggtgtggctgctgctgggccacatggtggtgtcccagatggccaccctgctggccaggaagcaccggccctggatcctgatgctgtatggcatgtgggcctgctggtgtgtgctgggcaccccaggagtggccatggtgctgctgcacaccaccatctccttctgtgtggcccagttccgcagccagctgctgacctggctgtgcagcctgctgctgctgagcaccctgcggctgcagggcgtggaggaggtgaagaggcgctggtacaagacagaaaatgagtactacctgctgcagttcaccctgactgtgcgctgcctgtactacaccagcttcagcctggagctgtgctggcagcagctgcctgctgccagcaccagctacagcttcccctggatgctggcctacgtgttctactaccctgtgctgcacaacggccccatcctgtccttcagcgagttcatcaagcagatgcagcagcaggagcatgacagcctgaaggccagcctgtgtgtgctggccctgggcctgggccgcctgctgtgctggtggtggctggccgagctgatggcccacctgatgtacatgcacgccatctacagcagcatccccctgctggagaccgtgtcctgctggaccctgggcggcctggccctggcccaggtgctcttcttctacgtgaagtacctggtgctgtttggagtgcctgccctgctgatgaggctggatggcctgaccccaccagccctgccccgctgtgtgtccaccatgttctccttcaccggcatgtggagatactttgatgtgggcctgcacaacttcctgatccgctacgtgtacatccctgtgggcggcagccagcacggcctgctgggcaccctcttcagcacagccatgacctttgcctttgtgtcctactggcacggcggctatgactacctgtggtgctgggccgccctgaactggctgggcgtgacagtggagaatggagtgcggcggctggtggagaccccctgcatccaggacagcctggcccgctacttcagcccccaggcccggcggcgcttccacgccgccctggccagctgcagcacctccatgctgatcctgagcaacctggtgttcctgggcggcaatgaggtgggcaagacctactggaaccgcatcttcatccagggctggccctgggtgaccctgtctgtgctgggcttcctgtactgctacagccacgtgggcatcgcctgggcccagacctacgccacagactag

SEQ ID NO: 155050 - DNA, 2103 bp, Artificial Sequence
  Description of Artificial Sequence: Synthetic coding sequence
atgctgaagatgctgtccttcaagctgctgctgctggccgtggccctgggcttctttgaaggagatgccaagtttggagagagaaatgaaggcagcggggccaggagaagacgctgcctgaatggaaacccccccaagaggctgaagaggcgggacaggaggatgatgagccagctggagctgctgtctggaggagagatgctgtgtggcggcttctacccccggctgagctgctgcctgcggagtgacagccctggcctgggccgcctggagaacaagatcttctctgtgaccaacaacacagaatgtgggaagctgctggaggagatcaagtgtgccctgtgcagcccccacagccagagcctcttccacagccctgagcgggaggtgctggagcgggacctggtgctgcccctgctgtgcaaggactactgcaaggagttcttctacacctgccggggccacatccctggcttcctgcagaccacagcagatgagttctgcttctactatgccaggaaggatggcggcctgtgcttcccagacttccccaggaagcaggtgcggggccctgccagcaactacctggaccagatggaggagtatgacaaggtggaggagatcagcaggaagcacaagcacaactgcttctgcatccaggaggtggtgtctggcctgcggcagcctgtgggcgccctgcacagcggagatggcagccagaggctcttcatcctggagaaggagggctacgtgaagatcctgaccccagagggggagatcttcaaggagccctacctggacatccacaagctggtgcagagcggcatcaagggaggagatgagcggggcctgctgagcctggccttccaccccaactacaagaagaatggcaagctgtatgtgtcctacaccaccaaccaggagcgctgggccatcggcccccatgaccacatcctgcgggtggtggagtacacagtgtccaggaagaacccccaccaggtggacctgaggacagcccgggtcttcctggaggtggccgagctgcacaggaagcacctgggcggccagctgctgtttggaccagatggcttcctgtacatcatcctgggagatggcatgatcaccctggatgacatggaggagatggatggcctgagtgacttcaccggctctgtgctgcggctggatgtggacacagacatgtgcaatgtgccctacagcatccccaggagcaacccccacttcaacagcaccaaccagcccccagaggtgtttgcccacggcctgcatgaccccggccgctgtgctgtggacagacaccccacagacatcaacatcaacctgaccatcctgtgcagcgacagcaatggcaagaacagaagcagcgcccgcatcctgcagatcatcaagggcaaggactatgagagcgagcccagcctgctggagttcaagcccttcagcaatggccccctggtgggcggctttgtgtaccggggctgccagagcgagcggctgtatggcagctatgtgtttggagacagaaatggaaacttcctgaccctgcagcagagccctgtgaccaagcagtggcaggagaagcccctgtgcctgggcaccagcggcagctgccggggctacttcagcggccacatcctgggctttggagaagatgagctgggggaggtgtacatcctgagcagcagcaagtccatgacccagacccacaacgggaagctgtacaagatcgtggaccccaagaggcccctgatgccagaagaatgtcgggccaccgtgcagcctgcccagaccctgaccagtgaatgttcccggctgtgcagaaatggctactgcacccccaccgggaagtgctgctgcagccctggctgggagggggacttctgcaggacagccaagtgtgagcccgcctgcagacatggaggagtgtgtgtgcggcccaacaagtgcctgtgcaagaagggctacctgggcccccagtgtgagcaggtggacaggaacatccggcgggtgaccagggctggcatcctggaccagatcatcgacatgaccagctacctgctggacctgaccagctacatcgtgtag

SEQ ID NO: 155051 - DNA, 963 bp, Artificial Sequence
  Description of Artificial Sequence: Synthetic coding sequence
atgctgaagatgctgtccttcaagctgctgctgctggccgtggccctgggcttctttgaaggagatgccaagtttggagagagaaatgaaggcagcggggccaggagaagacgctgcctgaatggaaacccccccaagaggctgaagaggcgggacaggaggatgatgagccagctggagctgctgtctggaggagagatgctgtgtggcggcttctacccccggctgagctgctgcctgcggagtgacagccctggcctgggccgcctggagaacaagatcttctctgtgaccaacaacacagaatgtgggaagctgctggaggagatcaagtgtgccctgtgcagcccccacagccagagcctcttccacagccctgagcgggaggtgctggagcgggacctggtgctgcccctgctgtgcaaggactactgcaaggagttcttctacacctgccggggccacatccctggcttcctgcagaccacagcagatgagttctgcttctactatgccaggaaggatggcggcctgtgcttcccagacttccccaggaagcaggtgcggggccctgccagcaactacctggaccagatggaggagtatgacaaggtggaggagatcagcaggaagcacaagcacaactgcttctgcatccaggaggtggtgtctggcctgcggcagcctgtgggcgccctgcacagcggagatggcagccagaggctcttcatcctggagaaggagggctacgtgaagatcctgaccccagagggggagatcttcaaggagccctacctggacatccacaagctggtgcagagcggcatcaaggtgggcttcctgaacttcatctacttctgtgccggctacgtgaacttcatcctggtgctgcccagcagcctgaaggtgttcctgtgcaacaagaggaagaacctggccggagaaaataaaggagccacctag

SEQ ID NO: 155052 - DNA, 4146 bp, Artificial Sequence
  Description of Artificial Sequence: Synthetic coding sequence
atggccagcccccgggccagccgctggcccccacccctgctgctgctgctgctgcccctgctgctgctgcccccagctgcccctggcacccgggaccccccacccagccctgcccggcgggccctgagcctggcccccctggccggggccggcctggagctgcagctggagcggcggcctgagcgggagcccccacccaccccaccccgggagcggcggggccctgccaccccaggccccagctaccgggcccctgagcctggagctgccacccagaggggccccagcggccgggccccccggggcggcagcgcagatgctgcctggaagcactggccagagagcaacacagaggcccacgtggagaacatcaccttctaccagaaccaggaggacttcagcacagtgagcagcaaggagggcgtgatggtgcagaccagcggcaagagccacgccgccagtgatgcccctgagaacctgaccctgctggccgagacagcagatgcccggggccgcagcggcagcagcagcaggaccaacttcaccatcctgcctgtgggctacagcctggagatcgccacagccctgaccagccagagcggcaacctggccagcgagagcctgcacctgcccagcagcagcagcgagtttgatgaaagaattgctgccttccagaccaagagcggcacagccagcgagatgggcacagagcgggccatgggcctgtctgaggagtggacagtgcacagccaggaggccaccaccagcgcctggagccccagcttcctgcctgccctggagatgggagagctgaccacccccagcaggaagaggaacagcagcggccctgacctgtcctggctgcacttctacagaacagctgccagcagccccctgctggacctgagcagcagcagcgagagcacagagaagctgaacaacagcacaggcctgcagagcagctctgtgtcccagaccaagaccatgcacgtggccaccgtcttcacagatggcggccccaggaccctgcggagcctgactgtgtccctgggccctgtgtccaagacagagggcttccccaaggacagcagaattgccaccaccagcagctctgtgctgctgagccccagcgctgtggagagcagaagaaacagccgggtgacaggcaaccctggagatgaggagttcatcgagcccagcacagaaaatgaatttggcctgaccagcctgcgctggcagaatgacagccccacctttggagagcaccagctggccagcagcagcgaggtgcagaatggcagccccatgagccagacagaaacagtgagccgctctgtggcccccatgagaggaggagagatcacagcccactggctgctgaccaacagcaccaccagcgcagatgtgacaggcagcagcgccagctacccagagggcgtgaatgcctctgtgctgacccagttcagtgacagcacagtgcagagcggcggcagccacacagccctgggggacaggagctacagcgagagcagcagcaccagcagcagcgagagcctgaacagcagcgcccccagaggagagaggagcattgctggcatctcctatggccaggtgcggggcacagccatcgagcagaggaccagcagtgaccacacagaccacacctacctgagcagcaccttcaccaagggggagcgggccctgctgagcatcacagacaacagcagcagcagtgacatcgtggagagcagcaccagctacatcaagatcagcaacagcagccacagcgagtacagcagcttcttccacgcccagacagagaggagcaacatcagcagctatgatggagaatatgcccagcccagcacagagagccctgtgctgcacaccagcaacctgcccagctacacccccaccatcaacatgcccaacacctctgtggtgctggacacagatgctgagtttgtgtctgacagcagcagcagcagcagcagcagcagcagcagcagcagcagcggcccccccctgcccctgcccagcgtgtcccagagccaccacctgttcagcagcatcctgcccagcacccgggcctctgtgcacctgctgaagagcaccagtgatgccagcaccccctggagcagcagccccagccccctgcctgtgtccctgaccaccagcaccagcgcccccctgtctgtgtcccagaccaccctgccccagagcagcagcacccctgtgctgccccgggcccgggagacccctgtgaccagcttccagaccagcaccatgaccagcttcatgaccatgctgcacagcagccagacagctgacctgaagagccagagcaccccccaccaggagaaggtgatcacagagagcaagagccccagcctggtgtccctgcccacagagagcaccaaggctgtgaccaccaacagccccctgccccccagcctgacagagagcagcacagagcagaccctgcctgccaccagcaccaacctggcccagatgagccccaccttcaccaccaccatcctgaagaccagccagcccctgatgaccaccccaggcaccctgagcagcacagccagcctggtgacaggccccatcgctgtgcagaccacagctgggaagcagctgagcctgacccaccctgagatcctggtgccccagatcagcacagaaggaggcatcagcacagaaagaaacagagtgattgtggatgccaccaccggcctcatccccctgacctctgtgcccaccagcgccaaggagatgaccaccaagctgggcgtgacagctgagtacagccctgccagccgcagcctgggcaccagccccagcccccagaccaccgtggtgtccacagctgaggacctggcccccaagagcgccacctttgctgtgcagagcagcacccagagccccaccaccgtgagcagcagcgcctctgtgaacagctgtgctgtgaacccctgcctgcacaatggagaatgtgtggccgacaacaccagccggggctaccactgccgctgcccccccagctggcagggagatgactgcagcgtggatgtgaatgaatgtctgagcaacccctgccccagcacagccatgtgcaacaacacccagggcagcttcatctgcaagtgccctgtgggctaccagctggagaagggcatctgcaacctggtgaggacctttgtgacagagttcaagctgaagaggaccttcctgaacaccaccgtggagaagcacagcgacctgcaggaggtggagaatgagatcaccaagaccctgaacatgtgcttcagcgccctgcccagctacatccgcagcacagtgcacgccagccgggagagcaatgctgtggtgatcagcctgcagaccaccttcagcctggccagcaatgtgaccctgtttgacctggccgacaggatgcagaagtgtgtgaacagctgcaagagcagcgctgaggtgtgccagctgctgggcagccagaggcgcatcttccgggccggcagcctgtgcaagaggaagagcccagaatgtgacaaggacaccagcatctgcacagacctggatggagtggccctgtgccagtgcaagagcggctacttccagttcaacaagatggaccacagctgccgggcctgtgaagatggctaccgcctggagaatgagacctgcatgagctgccccttcggcctgggcggcctgaactgtggcaacccctaccagctgatcaccgtggtgattgctgctgctgggggcggcctgctgctgatcctgggcatcgccctgattgtgacctgctgcaggaagaacaagaatgacatcagcaagctgatcttcaagagcggggacttccagatgagcccctatgcagagtaccccaagaaccccaggagccaggagtggggccgggaggccatcgagatgcatgaaaatggcagcaccaagaacctgctgcagatgacagatgtgtactacagccccacctctgtgagaaatcctgagctggagagaaatggcctgtacccagcctacacaggcctgcccggcagccgccacagctgcatcttccctggccagtacaaccccagcttcatcagtgatgagagcagaagaagagactacttctag

SEQ ID NO: 155053 - DNA, 5829 bp, Artificial Sequence
  Description of Artificial Sequence: Synthetic coding sequence
atggaggaccggcgggcagagaagagctgtgagcaggcctgtgagagcctgaagaggcaggactatgagatggccctgaagcactgcacagaggccctgctgagcctgggccagtacagcatggctgacttcaccggcccctgccccctggagattgaaagaatcaagattgagagcctgctgtaccgcatcgccagcttcctgcagctgaagaactacgtgcaggctgatgaggactgccgccacgtgctgggggagggcctggccaagggggaggatgccttccgggctgtgctgtgctgcatgcagctgaagggcaagctgcagcctgtgtccaccatcctggccaagagcctgaccggggagagcctgaatggcatggtgaccaaggacctgacccggctgaagaccctgctgtctgaaacagaaacagccaccagcaatgccctgagcggctaccacgtggaggacctggatgagggcagctgcaatggctggcacttccggcccccaccccggggcatcaccagcagcgaggagtacaccctgtgcaagcgcttcctggagcagggcatctgccgctatggagcccagtgcaccagcgcccacagccaggaggagctggccgagtggcagaagagatatgccagccgcctcatcaagctgaagcagcagaatgaaaacaagcagctgagcggcagctacatggagaccctcatcgagaagtggatgaacagcctgagccctgagaaggtgctgtctgaatgtattgaaggagtgaaggtggagcacaacccagacctgtctgtgacagtgtccaccaagaagagccaccagacctggacctttgccctgacctgcaagccagccaggatgctgtacagagtggccctgctgtatgatgcccaccggccccacttcagcatcatcgccatctctgctggggacagcaccacccaggtgtcccaggaggtgcctgagaactgccaggagtggattggaggcaagatggcccagaatggcctggaccactacgtgtacaaggtgggcatcgccttcaacacagagatcttcggcaccttccggcagaccatcgtgtttgattttggcctggagcctgtgctgatgcagagggtgatgattgatgctgccagcacagaggacctggagtacctgatgcacgccaagcagcagctggtgaccacagccaagcgctgggacagcagcagcaagaccatcatcgactttgagcccaatgagaccacagacctggagaagagcctgctgatccgctaccagatccccctgtctgctgaccagctgttcacccagagcgtgctggacaagagcctgaccaagagcaactaccagagccggctgcatgacctgctgtacatcgaggagatcgcccagtacaaggagatcagcaagttcaacctgaaggtgcagctgcagatcctggccagcttcatgctgactggagtgtctgggggcgccaagtatgcccagaatggccagctgtttggccgcttcaagctgacagagaccctgtctgaggacaccctggccggccgcctggtgatgaccaaggtgaatgctgtgtacctgctgcctgtgcccaagcagaagctggtgcagacccagggcaccaaggagaaggtgtatgaggccaccatcgaggagaagaccaaggagtacatcttcctgcggctgagccgggagtgctgtgaggagctgaacctgcggccagactgtgacacccaggtggagctgcagttccagctgaaccggctgcccctgtgtgagatgcactacgccctggaccgcatcaaggacaatggagtgctcttcccagacatctccatgacccccaccatcccctggagccccaaccggcagtgggatgagcagctggacccccggctgaatgccaagcagaaggaggccgtgctggccatcaccacccccctggccatccagctgccccctgtgctgatcatcggcccctacggcaccgggaagaccttcaccctggcccaggccgtgaagcacatcctgcagcagcaggagacccgcatcctgatctgcacccacagcaacagcgctgctgacctgtacatcaaggactacctgcacccctacgtggaggccggcaacccccaggcccggcccctgcgggtgtacttcaggaaccgctgggtgaagacagtgcaccctgtggtgcaccagtactgcctgatcagcagcgcccacagcaccttccagatgccccagaaggaggacatcctgaagcaccgggtggtggtggtgaccctgaacaccagccagtacctgtgccagctggacctggagcccggcttcttcacccacatcctgctggatgaggccgcccaggccatggagtgtgagaccatcatgcccctggccctggccacccagaacaccagaattgtgctggccggggaccacatgcagctgagcccctttgtgtacagcgagtttgcccgggagaggaacctgcacgtgtccctgctggaccggctgtatgagcactacccagctgagttcccctgccgcatcctgctgtgtgagaactaccgcagccatgaggccatcatcaactacaccagcgagctgttctatgagggcaagctgatggccagcggcaagcagcctgcccacaaggacttctaccccctgaccttcttcaccgcccggggggaggatgtgcaggagaagaacagcacagccttctacaacaatgctgaggtgtttgaggtggtggagcgggtggaggagctgcggaggaagtggcctgtggcctggggcaagctggatgatggcagcattggagtggtgaccccctatgctgaccaggtgttccgcatccgggcagagctgaggaagaagaggctgagtgatgtgaatgtggagcgggtgctgaatgtgcagggcaagcagttccgggtgctcttcctgagcacagtgaggaccaggcacacctgcaagcacaagcagacccccatcaagaagaaggagcagctgctggaggacagcacagaggacctggactatggcttcctgagcaactacaagctgctgaacacagccatcacccgggcccagagcctggtggccgtggtgggggaccccatcgccctgtgcagcatcggccgctgcaggaagttctgggagcgcttcatcgccctgtgccacgagaacagcagcctgcacggcatcacctttgagcagatcaaggcccagctggaggccctggagctgaagaagacctacgtgctgaaccccctggcccctgagttcatcccccgggccctgcggctgcagcacagcggcagcaccaacaagcagcagcagagcccccccaagggcaagagcctgcaccacacccagaatgaccacttccagaatgatggcatcgtgcagcccaaccccagcgtgctgattggcaaccccatccgggcctacaccccacctccacccctgggcccccaccccaacctgggcaagagccccagccctgtgcagagaattgacccccacacaggcaccagcatcctgtatgtgcctgctgtgtatggaggaaatgtggtgatgtctgtgcccctgcctgtgccctggacaggctaccagggccgctttgctgtggacccccgcatcatcacccaccaggccgccatggcctacaacatgaacctgctgcagacccacggccggggcagccccatcccctacggcctgggccaccacccccctgtgaccatcggccagccccagaaccagcaccaggagaaggaccagcacgagcagaacagaaatggcaagagtgacaccaacaacagcggccctgagatcaacaagatccgcaccccagagaagaagcccacagagcccaagcaggtggacctggagagcaacccccagaacagaagccctgagagccggcccagcgtggtgtaccccagcaccaagttccccaggaaggacaacctgaaccccaggcacatcaacctgcccctgcctgccccccacgcccagtatgccatccccaacagacacttccaccccctgccccagctgcccaggcctcccttccccatcccccagcagcacaccctgctgaaccagcagcagaacaacctgcctgagcagcccaaccagatccccccccagcccaaccaggtggtgcagcagcagagccagctgaaccagcagccccagcagcccccaccccagctgagccctgcctaccaggccggccccaacaatgccttcttcaacagcgctgtggcccaccggccccagagccccccagctgaggccgtcatccctgagcagcagcccccacccatgctgcaggagggccacagccccctgcgggccatcgcccagcccggccccatcctgcccagccacctgaacagcttcattgatgagaaccccagcggcctgcccatcggggaggccctggaccgcatccacggctctgtggccctggagaccctgcggcagcagcaggcccgcttccagcagtggagcgagcaccacgccttcctgagccagggcagcgccccctacccccaccaccaccacccccacctgcagcacctgccccagccccccctgggcctgcaccagccccctgtgcgggctgactggaagctgaccagcagcgcagaagatgaggtggagaccacctacagccgcttccaggacctgatccgggagctgagccaccgggaccagagcgagacccgggagctggccgagatgcccccaccccagagccggctgctgcagtaccggcaggtgcagagccgcagccccccagctgtgcccagcccccccagcagcacagaccacagcagccacttcagcaacttcaatgacaacagccgggacatcgaggtggccagcaacccagccttcccccagaggctgcccccccagatcttcaacagccccttcagcctgcccagcgagcacctggcccccccacccctgaagtacctggccccagatggagcctggacctttgccaacctgcagcagaaccacctgatgggccctggcttcccctacggcctgccccccctgccccacaggcctccccagaacccctttgtgcagatccagaaccaccagcacgccatcggccaggagcccttccaccccctgagcagcaggacagtgagcagcagcagcctgcccagcctggaggagtatgagccccggggccctggccggcccctgtaccagaggcgcatcagcagcagctctgtgcagccctgcagcgaggaggtgtccaccccccaggacagcctggcccagtgcaaggagctgcaggaccacagcaaccagagcagcttcaacttcagcagccctgagagctgggtgaacaccaccagcagcaccccctaccagaacatcccctgcaatggcagcagcaggacagcccagccccgggagctgattgccccacccaagacagtgaagcccccagaggaccagctgaagtctgagaacctggaggtgagcagcagcttcaactacagcgtgctgcagcacctgggccagtttcctcccctgatgcccaacaagcagattgctgagagcgccaacagcagcagcccccagagcagcgctgggggcaagccagccatgtcctatgccagcgccctgcgggccccacccaagccccggcccccacctgagcaggccaagaagagcagtgaccccctgagcctcttccaggagctgagcctgggcagcagcagcggcagcaatggcttctacagctacttcaagtag

SEQ ID NO: 155054 - DNA, 1365 bp, Artificial Sequence
  Description of Artificial Sequence: Synthetic coding sequence
atggaggaccggcgggcagagaagagctgtgagcaggcctgtgagagcctgaagaggcaggactatgagatggccctgaagcactgcacagaggccctgctgagcctgggccagtacagcatggctgacttcaccggcccctgccccctggagattgaaagaatcaagattgagagcctgctgtaccgcatcgccagcttcctgcagctgaagaactacgtgcaggctgatgaggactgccgccacgtgctgggggagggcctggccaagggggaggatgccttccgggctgtgctgtgctgcatgcagctgaagggcaagctgcagcctgtgtccaccatcctggccaagagcctgaccggggagagcctgaatggcatggtgaccaaggacctgacccggctgaagaccctgctgtctgaaacagaaacagccaccagcaatgccctgagcggctaccacgtggaggacctggatgagggcagctgcaatggctggcacttccggcccccaccccggggcatcaccagcagcgaggagtacaccctgtgcaagcgcttcctggagcagggcatctgccgctatggagcccagtgcaccagcgcccacagccaggaggagctggccgagtggcagaagagatatgccagccgcctcatcaagctgaagcagcagaatgaaaacaagcagctgagcggcagctacatggagaccctcatcgagaagtggatgaacagcctgagccctgagaaggtgctgtctgaatgtattgaaggagtgaaggtggagcacaacccagacctgtctgtgacagtgtccaccaagaagagccaccagacctggacctttgccctgacctgcaagccagccaggatgctgtacagagtggccctgctgtatgatgcccaccggccccacttcagcatcatcgccatctctgctggggacagcaccacccaggtgtcccaggaggtgcctgagaactgccaggagtggattggaggcaagatggcccagaatggcctggaccactacgtgtacaaggtgggcatcgccttcaacacagagatcttcggcaccttccggcagaccatcgtgtttgattttggcctggagcctgtgctgatgcagagggtgatgattgatgctgccagcacagaggacctggagtacctgatgcacgccaagcagcagctggtgaccacagccaagcgctgggacagcagcagcaagaccatcatcgactttgagcccaatgagaccacagacctggagaagagcctgctgatccgctaccagatccccctgtctgagaagaagaagaagaagaagaagaagaagaagaagaagaagaagaagaagtag

SEQ ID NO: 155055 - DNA, 294 bp, Artificial Sequence
  Description of Artificial Sequence: Synthetic coding sequence
atgcctgctgagaggcctgctggcagcggcggcagcgaggccccagccatggtggagcagctggacacagctgtgatcaccccagccatgctggaggaggaggagcagctggaggccgccggcctggagcgggagaggaagatgctggagaaggccaggatgtcctgggaccgggagagcacagagatccgctaccgccgcctgcagcacctgctggagaagagcaacatctacagcaagttcctgctgaccaagatggagcagcagcagctggagaccgtgatgaagatctag

SEQ ID NO: 155056 - DNA, 2517 bp, Artificial Sequence
  Description of Artificial Sequence: Synthetic coding sequence
atgcctgctgagaggcctgctggcagcggcggcagcgaggccccagccatggtggagcagctggacacagctgtgatcaccccagccatgctggaggaggaggagcagctggaggccgccggcctggagcgggagaggaagatgctggagaaggccaggatgtcctgggaccgggagagcacagagatccgctaccgccgcctgcagcacctgctggagaagagcaacatctacagcaagttcctgctgaccaagatggagcagcagcagctggaggagcagaagaagaaggagaagctggagaggaagaaggagagcctgaaggtgaagaagggcaagaacagcattgatgccagcgaggagaagcctgtgatgaggaagaagaggggccgggaggatgagagctacaacatcagcgaggtgatgagcaaggaggagatcctgtctgtggccaagaagaacaagaaggaaaatgaagatgagaacagcagcagcaccaacctgtgtgtggaggacctgcagaagaacaaggacagcaacagcatcatcaaggaccggctgtctgagaccgtgcggcagaacaccaagttcttctttgatcctgtgaggaagtgcaatggccagcctgtgcccttccagcagcccaagcacttcaccggaggagtgatgcgctggtaccaggtggagggcatggagtggctgaggatgctgtgggagaatggcatcaatggcatcctggctgatgagatgggcctgggcaagacagtgcagtgcatcgccaccatcgccctgatgatccagaggggcgtgcccggccccttcctggtgtgtggccccctgagcaccctgcccaactggatggccgagttcaagcgcttcaccccagacatccccaccatgctgtaccacggcacccaggaggagcggcagaagctggtgaggaacatctacaagaggaagggcaccctgcagatccaccctgtggtgatcaccagctttgaaattgccatgagggacagaaatgccctgcagcactgctactggaagtacctgattgtggatgagggccaccgcatcaagaacatgaagtgccgcctcatccgggagctgaagcgcttcaatgctgacaacaagctgctgctgaccggcacccccctgcagaacaacctgtctgagctgtggagcctgctgaacttcctgctgcctgatgtgtttgatgacctgaagagctttgagagctggtttgacatcaccagcctgtctgaaacagctgaggacatcatcgccaaggagcgggagcagaatgtgctgcacatgctgcaccagatcctgacccccttcctgctgcggcggctgaagagtgatgtggccctggaggtgccccccaagcgggaggtggtggtgtatgcccccctgagcaagaagcaggagatcttctacacagccatcgtgaacagaaccatcgccaacatgtttggcagcagcgagaaggagaccatcgagctgagccccaccggccggcccaagaggaggaccaggaagagcatcaactacagcaagattgatgacttccccaatgagctggagaagctgatcagccagatccagcctgaggtggaccgggagagagctgtggtggaggtgaacatccctgtggagagcgaggtgaacctgaagctgcagaacatcatgatgctgctgaggaagtgctgcaaccacccctacctgattgagtaccccattgatcctgtgacccaggagttcaagattgatgaggagctggtgaccaacagcggcaagttcctgatcctggacaggatgctgcctgagctgaagaagaggggccacaaggtgctgctcttcagccagatgacctccatgctggacatcctgatggactactgccacctgcgggacttcaacttcagccggctggatggctccatgagctacagcgagcgggagaagaacatgcacagcttcaacacagatcctgaggtgttcatcttcctggtgtccacccgggccggcggcctgggcatcaacctgacagctgctgacaccgtcatcatctatgacagcgactggaacccccagagcgacctgcaggcccaggaccgctgccacagaattggccagaccaagcctgtggtggtgtaccgcctggtgacagccaacaccatcgaccagaagatcgtggagagagctgctgccaagaggaagctggagaagctgatcatccacaagaaccacttcaagggcggccagagcggcctgaacctgagcaagaacttcctggaccccaaggagctgatggagctgctgaagagccgggactatgaaagagagatcaagggcagccgggagaaggtgatcagtgacaaggacctggagctgctgctggacagaagtgacctgattgaccagatgaatgccagcggccccatcaaggagaagatgggcatcttcaagatcctggagaacagcgaggacagcagcccagaatgtctcttctag

SEQ ID NO: 155057 - DNA, 2655 bp, Artificial Sequence
  Description of Artificial Sequence: Synthetic coding sequence
atgcctgctgagaggcctgctggcagcggcggcagcgaggccccagccatggtggagcagctggacacagctgtgatcaccccagccatgctggaggaggaggagcagctggaggccgccggcctggagcgggagaggaagatgctggagaaggccaggatgtcctgggaccgggagagcacagagatccgctaccgccgcctgcagcacctgctggagaagagcaacatctacagcaagttcctgctgaccaagatggagcagcagcagctggaggagcagaagaagaaggagaagctggagaggaagaaggagagcctgaaggtgaagaagggcaagaacagcattgatgccagcgaggagaagcctgtgatgaggaagaagaggggccgggaggatgagagctacaacatcagcgaggtgatgagcaaggaggagatcctgtctgtggccaagaagaacaagaaggaaaatgaagatgagaacagcagcagcaccaacctgtgtgtggaggacctgcagaagaacaaggacagcaacagcatcatcaaggaccggctgtctgagaccgtgcggcagaacaccaagttcttctttgatcctgtgaggaagtgcaatggccagcctgtgcccttccagcagcccaagcacttcaccggaggagtgatgcgctggtaccaggtggagggcatggagtggctgaggatgctgtgggagaatggcatcaatggcatcctggctgatgagatgggcctgggcaagacagtgcagtgcatcgccaccatcgccctgatgatccagaggggcgtgcccggccccttcctggtgtgtggccccctgagcaccctgcccaactggatggccgagttcaagcgcttcaccccagacatccccaccatgctgtaccacggcacccaggaggagcggcagaagctggtgaggaacatctacaagaggaagggcaccctgcagatccaccctgtggtgatcaccagctttgaaattgccatgagggacagaaatgccctgcagcactgctactggaagtacctgattgtggatgagggccaccgcatcaagaacatgaagtgccgcctcatccgggagctgaagcgcttcaatgctgacaacaagctgctgctgaccggcacccccctgcagaacaacctgtctgagctgtggagcctgctgaacttcctgctgcctgatgtgtttgatgacctgaagagctttgagagctggtttgacatcaccagcctgtctgaaacagctgaggacatcatcgccaaggagcgggagcagaatgtgctgcacatgctgcaccaggagcgcatccccaggatgtatgtgtctgagttcacagatgagggcttctttgagggcaagctgcccagcaggaaggacctgtatgacatccggccctatgagaacacctacctgctgaagctgcacaccaactttgagatcctgacccccttcctgctgcggcggctgaagagtgatgtggccctggaggtgccccccaagcgggaggtggtggtgtatgcccccctgagcaagaagcaggagatcttctacacagccatcgtgaacagaaccatcgccaacatgtttggcagcagcgagaaggagaccatcgagctgagccccaccggccggcccaagaggaggaccaggaagagcatcaactacagcaagattgatgacttccccaatgagctggagaagctgatcagccagatccagcctgaggtggaccgggagagagctgtggtggaggtgaacatccctgtggagagcgaggtgaacctgaagctgcagaacatcatgatgctgctgaggaagtgctgcaaccacccctacctgattgagtaccccattgatcctgtgacccaggagttcaagattgatgaggagctggtgaccaacagcggcaagttcctgatcctggacaggatgctgcctgagctgaagaagaggggccacaaggtgctgctcttcagccagatgacctccatgctggacatcctgatggactactgccacctgcgggacttcaacttcagccggctggatggctccatgagctacagcgagcgggagaagaacatgcacagcttcaacacagatcctgaggtgttcatcttcctggtgtccacccgggccggcggcctgggcatcaacctgacagctgctgacaccgtcatcatctatgacagcgactggaacccccagagcgacctgcaggcccaggaccgctgccacagaattggccagaccaagcctgtggtggtgtaccgcctggtgacagccaacaccatcgaccagaagatcgtggagagagctgctgccaagaggaagctggagaagctgatcatccacaagaaccacttcaagggcggccagagcggcctgaacctgagcaagaacttcctggaccccaaggagctgatggagctgctgaagagccgggactatgaaagagagatcaagggcagccgggagaaggtgatcagtgacaaggacctggagctgctgctggacagaagtgacctgattgaccagatgaatgccagcggccccatcaaggagaagatgggcatcttcaagatcctggagaacagcgaggacagcagcccagaatgtctcttctag

SEQ ID NO: 155058 - DNA, 390 bp, Artificial Sequence
  Description of Artificial Sequence: Synthetic coding sequence
atgcctgctgagaggcctgctggcagcggcggcagcgaggccccagccatggtggagcagctggacacagctgtgatcaccccagccatgctggaggaggaggagcagctggaggccgccggcctggagcgggagaggaagatgctggagaaggccaggatgtcctgggaccgggagagcacagagatccgctaccgccgcctgcagcacctgctggagaagagcaacatctacagcaagttcctgctgaccaagatggagcagcagcagctggaggagcagaagaagaaggagaagctggagaggaagaaggagagcctgaaggtgaagaagggcaagaacagcattgatgccagcgaggagaagccaggcaactttgtgtgtggctag

SEQ ID NO: 155059 - DNA, 948 bp, Artificial Sequence
  Description of Artificial Sequence: Synthetic coding sequence
atgcctgctgagaggcctgctggcagcggcggcagcgaggccccagccatggtggagcagctggacacagctgtgatcaccccagccatgctggaggaggaggagcagctggaggccgccggcctggagcgggagaggaagatgctggagaaggccaggatgtcctgggaccgggagagcacagagatccgctaccgccgcctgcagcacctgctggagaagagcaacatctacagcaagttcctgctgaccaagatggagcagcagcagctggaggagcagaagaagaaggagaagctggagaggaagaaggagagcctgaaggtgaagaagggcaagaacagcattgatgccagcgaggagaagcctgtgatgaggaagaagaggggccgggaggatgagagctacaacatcagcgaggtgatgagcaaggaggagatcctgtctgtggccaagaagaacaagaaggaaaatgaagatgagaacagcagcagcaccaacctgtgtgtggaggacctgcagaagaacaaggacagcaacagcatcatcaaggaccggctgtctgagaccgtgcggcagaacaccaagttcttctttgatcctgtgaggaagtgcaatggccagcctgtgcccttccagcagcccaagcacttcaccggaggagtgatgcgctggtaccaggtggagggcatggagtggctgaggatgctgtgggagaatggcatcaatggcatcctggctgatgagatgggcctgggcaagacagtgcagtgcatcgccaccatcgccctgatgatccagaggggcgtgcccggccccttcctggtgtgtggccccctgagcaccctgcccaactggatggccgagttcaagcgcttcaccccagacatccccaccatgctgtaccacggcacccaggaggagcggcagaagctgatctacctgtag

SEQ ID NO: 155060 - DNA, 2223 bp, Artificial Sequence
  Description of Artificial Sequence: Synthetic coding sequence
atgcctgctgagaggcctgctggcagcggcggcagcgaggccccagccatggtggagcagctggacacagctgtgatcaccccagccatgctggaggaggaggagcagctggaggccgccggcctggagcgggagaggaagatgctggagaaggccaggatgtcctgggaccgggagagcacagagatccgctaccgccgcctgcagcacctgctggagaagagcaacatctacagcaagttcctgctgaccaagatggagcagcagcagctggaggagcagaagaagaaggagaagctggagaggaagaaggagagcctgaaggtgaagaagggcaagaacagcattgatgccagcgaggagaagcctgtgatgaggaagaagaggggccgggaggatgagagctacaacatcagcgaggtgatgagcaaggaggagatcctgtctgtggccaagaagaacaagaaggaaaatgaagatgagaacagcagcagcaccaacctgtgtgtggaggacctgcagaagaacaaggacagcaacagcatcatcaaggaccggctgtctgagaccgtgcggcagaacaccaagttcttctttgatcctgtgaggaagtgcaatggccagcctgtgcccttccagcagcccaagcacttcaccggaggagtgatgcgctggtaccaggtggagggcatggagtggctgaggatgctgtgggagaatggcatcaatggcatcctggctgatgagatgggcctgggcaagacagtgcagtgcatcgccaccatcgccctgatgatccagaggggcgtgcccggccccttcctggtgtgtggccccctgagcaccctgcccaactggatggccgagttcaagcgcttcaccccagacatccccaccatgctgtaccacggcacccaggaggagcggcagaagctggtgaggaacatctacaagaggaagggcaccctgcagatccaccctgtggtgatcaccagctttgaaattgccatgagggacagaaatgccctgcagatcctgacccccttcctgctgcggcggctgaagagtgatgtggccctggaggtgccccccaagcgggaggtggtggtgtatgcccccctgagcaagaagcaggagatcttctacacagccatcgtgaacagaaccatcgccaacatgtttggcagcagcgagaaggagaccatcgagctgagccccaccggccggcccaagaggaggaccaggaagagcatcaactacagcaagattgatgacttccccaatgagctggagaagctgatcagccagatccagcctgaggtggaccgggagagagctgtggtggaggtgaacatccctgtggagagcgaggtgaacctgaagctgcagaacatcatgatgctgctgaggaagtgctgcaaccacccctacctgattgagtaccccattgatcctgtgacccaggagttcaagattgatgaggagctggtgaccaacagcggcaagttcctgatcctggacaggatgctgcctgagctgaagaagaggggccacaaggtgctgctcttcagccagatgacctccatgctggacatcctgatggactactgccacctgcgggacttcaacttcagccggctggatggctccatgagctacagcgagcgggagaagaacatgcacagcttcaacacagatcctgaggtgttcatcttcctggtgtccacccgggccggcggcctgggcatcaacctgacagctgctgacaccgtcatcatctatgacagcgactggaacccccagagcgacctgcaggcccaggaccgctgccacagaattggccagaccaagcctgtggtggtgtaccgcctggtgacagccaacaccatcgaccagaagatcgtggagagagctgctgccaagaggaagctggagaagctgatcatccacaagaaccacttcaagggcggccagagcggcctgaacctgagcaagaacttcctggaccccaaggagctgatggagctgctgaagagccgggactatgaaagagagatcaagggcagccgggagaaggtgatcagtgacaaggacctggagctgctgctggacagaagtgacctgattgaccagatgaatgccagcggccccatcaaggagaagatgggcatcttcaagatcctggagaacagcgaggacagcagcccagaatgtctcttctag

SEQ ID NO: 155061 - DNA, 579 bp, Artificial Sequence
  Description of Artificial Sequence: Synthetic coding sequence
atggtggagcagctggacacagctgtgatcaccccagccatgctggaggaggaggagcagctggaggccgccggcctggagcgggagaggaagatgctggagaaggccaggatgtcctgggaccgggagagcacagagatccgctaccgccgcctgcagcacctgctggagaagagcaacatctacagcaagttcctgctgaccaagatggagcagcagcagctggaggagcagaagaagaaggagaagctggagaggaagaaggagagcctgaaggtgaagaagggcaagaacagcattgatgccagcgaggagaagcctgtgatgaggaagaagaggggccgggaggatgagagctacaacatcagcgaggtgatgagcaaggaggagatcctgtctgtggccaagaagaacaagaaggaaaatgaagatgagaacagcagcagcaccaacctgtgtgtggaggacctgcagaagaacaaggacagcaacagcatcatcaaggaccggctgtctgagaccgtgcggcagaacaccaagttcttctttgatcctgtgaggaagtgcaatggccagtag

SEQ ID NO: 155062 - DNA, 1461 bp, Artificial Sequence
  Description of Artificial Sequence: Synthetic coding sequence
atgtggaagtctgtggtgggccatgatgtgtctgtgtctgtggagacccagggagatgactgggacacagatcctgactttgtgaatgacatcagcgagaaggagcagcgctggggcgccaagaccatcgagggcagcggccgcacagagcacatcaacatccaccagctgaggaacaaggtgtctgaggagcatgatgtgctgaggaagaaggagatggagagcggccccaaggccagccacggctatggaggccgctttggagtggagcgggacaggatggacaagtctgctgtgggccatgaatatgtggccgaggtggagaagcacagcagccagacagatgctgccaagggctttggaggcaagtatggagtggagcgggacagagctgacaagtctgctgtgggctttgactacaagggggaggtggagaagcacaccagccagaaggactacagccggggctttggaggccgctatggagtggagaaggacaagtgggacaaggccgccctgggctatgactacaagggggagacagagaagcatgagagccagagggactatgccaagggctttggaggccagtatggcatccagaaggacagagtggacaagtctgctgtgggcttcaatgagatggaggcccccaccacagcctacaagaagaccacccccatcgaggccgccagcagcggcacccggggcctgaaggccaagtttgagagcatggccgaggagaagaggaagcgggaggaggaggagaaggcccagcaggtggcccggcggcagcaggagaggaaggctgtgaccaagaggagccctgaggccccccagcctgtgattgccatggaggagcctgctgtgcctgcccccctgcccaagaagatcagcagcgaggcctggccccctgtgggcaccccacccagcagcgagagcgagcctgtgaggaccagccgggagcaccctgtgcccctgctgcccatccggcagaccctgcctgaggacaatgaggagcccccagccctgccccccaggaccctggagggcctgcaggtggaggaggagcctgtgtatgaggccgagcctgagcctgagcctgagcctgagcctgagccagaaaatgactatgaagatgtggaggagatggacagacatgagcaggaggatgagcctgagggggactatgaggaggtgctggagcctgaggacagcagcttcagcagcgccctggccggcagcagcggctgcccagctggggccggggccggggctgtggccctgggcatctctgctgtggccgtgtatgactaccagggcgagggcagtgatgagctgagctttgatcctgatgatgtgatcacagacatcgagatggtggatgagggctggtggaggggccgctgccacggccacttcggcctcttccctgccaactacgtgaagctgctggagtag

SEQ ID NO: 155063 - DNA, 600 bp, Artificial Sequence
  Description of Artificial Sequence: Synthetic coding sequence
atgcccaactacaagctgacctacttcaacatgaggggccgggcagagatcatccgctacatctttgcctacctggacatccagtatgaggaccaccgcatcgagcaggccgactggccagagatcaagagcaccctgccctttgggaagatccccatcctggaggtggatggcctgaccctgcaccagagcctggccatcgcccgctacctgaccaagaacacagacctggccggcaacacagagatggagcagtgccacgtggatgccatcgtggacaccctggatgacttcatgagctgcttcccctgggccgagaagaagcaggatgtgaaggagcagatgtttaatgagctgctgacctacaatgccccccacctgatgcaggacctggacacctacctgggcggccgggagtggctgattggcaacagcgtgacctgggccgacttctactgggagatctgcagcaccaccctgctggtgttcaagccagacctgctggacaaccacccccggctggtgaccctgaggaagaaggtgcaggccatcccagctgtggccaactggatcaagagaagaccccagaccaagctgtag

SEQ ID NO: 155064 - DNA, 813 bp, Artificial Sequence
  Description of Artificial Sequence: Synthetic coding sequence
atgcagtacccccaccctggccctgctgctggagctgtgggcgtgcccctgtatgcccccacccccctgctgcagcctgcccaccccacccccttctacatcgaggacatcctgggccggggccctgctgcccccaccccagcccccaccctgcccagccccaacagcagcttcaccagcctggtgagcccctaccgcacccctgtgtatgagcccacccccatccacccagccttcagccaccacagcgctgctgccctggccgccgcctacggccctgggggctttggaggccccctgtaccccttccccaggacagtgaatgactacacccacgccctgctgcggcatgaccccctgggcaagcccctgctgtggagccccttcctgcagaggcccctgcacaagaggaagggcggccaggtgcgcttcagcaatgaccagaccatcgagctggagaagaagtttgagacccagaagtacctgagccccccagagaggaagaggctggccaagatgctgcagctgtctgagcggcaggtgaagacctggttccagaacagaagagccaagtggaggcggctgaagcaggagaacccccagagcaacaagaaggaggagctggagagcctggacagcagctgtgaccagaggcaggacctgcccagcgagcagaacaagggggccagcctggacagcagccagtgcagccccagccctgccagccaggaggacctggagagcgagatcagcgaggacagcgaccaggaggtggacatcgagggggacaagagctacttcaatgccggctag

SEQ ID NO: 155065 - DNA, 570 bp, Artificial Sequence
  Description of Artificial Sequence: Synthetic coding sequence
atgctgggcatgatcaagaacagcctgtttggatctgtggagacctggccctggcaggtgctgagcaaaggagacaaggaggaggtggcctatgaggagcgggcctgtgagggcggcaagtttgccaccgtggaggtgacagacaagcctgtggatgaggccctgcgggaggccatgcccaaggtggccaagtatgctgggggcaccaatgacaagggcatcggcatgggcatgacagtgcccatcagctttgctgtgttccccaatgaagatggcagcctgcagaagaagctgaaggtgtggttccgcatccccaaccagttccagagcgaccccccagcccccagcgacaagtctgtgaagattgaggagcgggagggcatcaccgtgtacagcatgcagtttggaggctacgccaaggaggccgactatgtggcccaggccacccggctgcgggccgccctggagggcacagccacctacagaggagacatctacttctgcaccggctatgacccccccatgaagccctacggcagaagaaatgagatctggctgctgaagacctag

SEQ ID NO: 155066 - DNA, 4059 bp, Artificial Sequence
  Description of Artificial Sequence: Synthetic coding sequence
atgagcaaggtgacagcccctggcagcggccccccagctgctgccagcggcaaggagaagaggagcttcagcaagaggctcttccgcagcggccgggccggcggcggcggggccggcggccctggggccagcggccctgctgcccccagcagccccagcagccccagcagcgcccggtctgtgggcagcttcatgagccgggtgctgaagaccctgagcaccctgagccacctgagcagcgagggcgccgccccagaccggggcggcctgcggagctgcttccccccaggccctgctgctgcccccaccccaccaccctgccccccacctccagccagccctgcccccccagcctgtgccgctgagcctgtgcctggggtggccggcctgagaaatcatggcaacacctgcttcatgaatgccaccctgcagtgcctgagcaacacagagctgtttgctgagtacctggccctgggccagtacagagctggccggcctgagcccagcccagaccctgagcagcctgctggccgcggggcccagggccagggcgaggtgacagagcagctggcccacctggtgcgggccctgtggaccctggagtacaccccccagcacagccgggacttcaagaccatcgtgtccaagaatgccctgcagtaccggggcaacagccagcatgatgcccaggagttcctgctgtggctgctggacagagtgcatgaggacctgaaccacagcgtgaagcagagcggccagccccccctgaagccacccagcgagacagacatgatgcctgagggccccagcttccctgtgtgcagcacctttgtgcaggagctgttccaggcccagtaccgcagcagcctgacctgcccccactgccagaagcagagcaacacctttgaccccttcctgtgcatcagcctgcccatccccctgccccacacccggcccctgtatgtgacagtggtgtaccagggcaagtgcagccactgcatgagaattggagtggccgtgcccctgtctggaacagtggcccggctgcgggaggccgtgtccatggagaccaagatccccacagaccagatcgtgctgacagagatgtactatgatggcttccaccgctccttctgtgacacagatgacctggagaccgtgcatgaaagtgactgcatctttgcctttgagaccccagagatcttccggcctgagggcatcctgagccagaggggcatccacctgaacaacaacctgaaccacctgaagtttggcctggactaccaccggctgagcagccccacccagacagctgccaagcagggcaagatggacagccccaccagcagagctggcagtgacaagatcgtgctgctggtgtgcaacagagcctgcaccggccagcagggcaagagatttggcctgccctttgtgctgcacctggagaagaccatcgcctgggacctgctgcagaaggagatcctggagaagatgaagtacttcctgcggcccaccgtgtgcatccaggtgtgccccttcagcctgcgggtggtgtctgtggtgggcatcacctacctgctgccccaggaggagcagcccctgtgccaccccatcgtggagcgggccctgaagagctgtggccctgggggcacagcccacgtgaagctggtggtggagtgggacaaggagacccgggacttcctgtttgtgaacacagaagatgagtacatcccagatgctgagagcgtgcggctgcagcgggagcggcaccaccagccccagacctgcaccctgagccagtgcttccagctgtacaccaaggaggagcggctggccccagatgatgcctggcgctgcccccactgcaagcagctgcagcagggcagcatcaccctgagcctgtggaccctgcctgatgtgctgatcatccacctgaagcgcttccggcaggagggggacaggaggatgaagctgcagaacatggtgaagttccccctgaccggcctggacatgaccccccacgtggtgaagaggagccagagctcctggagcctgcccagccactggagcccctggaggcggccctacggcctgggccgggaccctgaggactacatctatgacctgtatgctgtgtgcaaccaccacggcaccatgcagggcggccactacacagcctactgcaagaacagcgtggatggcctgtggtactgctttgatgacagtgatgtgcagcagctgtctgaagatgaggtgtgcacccagacagcctacatcctcttctaccagaggagaacagccatccccagctggagcgccaacagctctgtggccggcagcaccagcagcagcctgtgtgagcactgggtgtcccggctgcccggcagcaagccagcctctgtgaccagcgctgccagcagcaggaggaccagcctggccagcctgtctgagagcgtggagatgaccggggagaggagtgaagatgatggcggcttcagcacccggccctttgtgcgctctgtgcagaggcagagcctgagcagccgcagctctgtgaccagccccctggccgtgaatgaaaactgcatgaggcccagctggagcctgagcgccaagctgcagatgaggagcaacagccccagccgcttcagcggggacagccccatccacagcagcgccagcaccctggagaagattggagaggccgcagatgacaaggtgtccatcagctgcttcggcagcctgaggaacctgagcagcagctaccaggagcccagcgacagccacagcagaagagagcacaaggctgtgggccgggcccccctggccgtgatggagggcgtcttcaaggatgaaagtgacacccggcggctgaacagctctgtggtggacacccagagcaagcacagcgcccagggcgaccggctgccccccctgagcggcccctttgacaacaacaaccagatcgcctacgtggaccagagcgacagcgtggacagcagccctgtgaaggaggtgaaggcccccagccaccctggcagcctggccaagaagccagagagcaccaccaagaggagccccagcagcaagggcaccagcgagcctgagaagagcctgaggaagggccggcctgccctggccagccaggagagcagcctgagcagcaccagccccagcagccccctgcctgtgaaggtgtccctgaagcccagccgcagccgcagcaaggctgacagcagcagccggggcagcggccgccacagcagccctgccccagcccagcccaagaaggagagcagccccaagagccaggacagcgtgagcagccccagcccccagaagcagaagagcgccagcgccctgacctacacagccagcagcaccagcgccaagaaggccagcggccctgccaccaggagccccttccccccaggcaagagcaggaccagtgaccacagcctgagccgggagggcagccggcagagcctgggcagtgaccgggccagcgccaccagcaccagcaagcccaacagcccccgggtgtcccaggcccgggccggggagggccgcggggccggcaagcacgtgcgcagcagctccatggccagcctgcggagccccagcaccagcatcaagagcggcctgaagagggacagcaagtctgaggacaagggcctgtccttcttcaagagcgccctgcggcagaaggagaccaggaggagcacagacctgggcaagacagccctgctgagcaagaaggccggcggcagctctgtgaagtctgtgtgcaagaacacaggagatgatgaagctgagcggggccaccagcccccagccagccagcagcccaatgccaacaccaccgggaaggagcagctggtgaccaaggaccctgccagcgccaagcacagcctgctgagcgccaggaagagcaagagcagccagctggacagcggcgtgcccagcagccctgggggccggcagagcgctgagaagagcagcaagaagctgagcagctccatgcagaccagcgcccggcccagccagaagccccagtag

SEQ ID NO: 155067 - DNA, 951 bp, Artificial Sequence
  Description of Artificial Sequence: Synthetic coding sequence
atgtctgctgaggtggagaccagcgagggcgtggatgagagcgagaagaagaacagcggggccctggagaaggagaaccagatgaggatggctgacctgtctgagctgctgaaggagggcaccaaggaggcccatgacagagctgagaacacccagtttgtgaaggacttcctgaagggcaacatcaagaaggagctgttcaagctggccaccacagccctgtacttcacctacagcgccctggaggaggagatggagaggaacaaggaccacccagcctttgcccccctgtacttccccatggagctgcacaggaaggaggccctgaccaaggacatggagtacttctttggagagaactgggaggagcaggtgcagtgccccaaggccgcccagaagtatgtggagcgcatccactacatcggccagaatgaacctgagctgctggtggcccacgcctacacccgctacatgggagacctgagcggcggccaggtgctgaagaaggtggcccagagggccctgaagctgcccagcactggagagggcacccagttctacctgtttgaaaatgtggacaatgcccagcagttcaagcagctgtaccgggccaggatgaatgccctggacctgaacatgaagaccaaggagagaattgtggaggaggccaacaaggcctttgagtacaacatgcagatcttcaatgagctggaccaggccggcagcaccctggcccgggagaccctggaggatggcttccctgtgcatgatggaaaaggagacatgaggaagtgccccttctatgctgctgagcaggacaagggggccctggagggcagcagctgccccttcagaacagccatggctgtgctgaggaagcccagcctgcagttcatcctggccgccggcgtggccctggccgccggcctgctggcctggtactacatgtag

SEQ ID NO: 155068 - DNA, 951 bp, Artificial Sequence; identical to SEQ ID NO: 155067
  Description of Artificial Sequence: Synthetic coding sequence

SEQ ID NO: 155069 - DNA, 951 bp, Artificial Sequence; identical to SEQ ID NO: 155067
  Description of Artificial Sequence: Synthetic coding sequence

SEQ ID NO: 155070 - DNA, 951 bp, Artificial Sequence; identical to SEQ ID NO: 155067
  Description of Artificial Sequence: Synthetic coding sequence

SEQ ID NO: 155071 - DNA, 951 bp, Artificial Sequence; identical to SEQ ID NO: 155067
  Description of Artificial Sequence: Synthetic coding sequence

SEQ ID NO: 155072 - DNA, 16908 bp, Artificial Sequence
  Description of Artificial Sequence: Synthetic coding sequence
atgatctcctgggaggtggtgcacacagtgttcctgtttgccctgctgtacagcagcctggcccaggatgccagcccccagagcgagatccgggcagaggagatccctgagggcgccagcaccctggcctttgtgtttgatgtgacaggctccatgtatgatgacctggtgcaggtgattgagggcgccagcaagatcctggagaccagcctgaagaggcccaagaggcccctcttcaactttgccctggtgcccttccatgaccctgagatcggccctgtgaccatcaccacagaccccaagaagttccagtatgagctgcgggagctgtatgtgcagggcggcggggactgcccagagatgagcattggagccatcaagatcgccctggagatcagcctgcccggcagcttcatctacgtgttcacagatgcccggagcaaggactaccgcctgacccatgaggtgctgcagctgatccagcagaagcagagccaggtggtgtttgtgctgaccggggactgtgatgacaggacccacatcggctacaaggtgtatgaggagatcgccagcaccagcagcggccaggtgttccacctggacaagaagcaggtgaatgaggtgctgaagtgggtggaggaggccgtgcaggccagcaaggtgcacctgctgagcacagaccacctggagcaggccgtgaacacctggaggatcccctttgaccccagcctgaaggaggtgacagtgtccctgagcggccccagccccatgattgagatccggaaccccctgggcaagctgatcaagaagggcttcggcctgcacgagctgctgaacatccacaacagcgccaaggtggtgaatgtgaaggagcctgaggccggcatgtggacagtgaagaccagcagcagcggccgccacagcgtgcgcatcaccggcctgagcaccatcgacttccgggccggcttcagcaggaagcccaccctggacttcaagaagacagtgtccaggcctgtgcagggcatccccacctacgtgctgctgaacaccagcggcatcagcaccccagccagaattgacctgctggagctgctgagcatcagcggcagcagcctgaagaccatccctgtgaagtactacccccacaggaagccctacggcatctggaacatcagtgactttgtgcccccaaatgaggccttcttcctgaaggtgacaggctatgacaaggatgactacctgttccagagggtgtcctctgtgtccttcagcagcatcgtgcctgatgcccccaaggtgaccatgcctgagaagaccccaggctactacctgcagcccggccagatcccctgcagcgtggacagcctgctgcccttcaccctgagctttgtgagaaatggagtgaccctgggcgtggaccagtacctgaaggagagcgcctctgtgaacctggacatcgccaaggtgaccctgagtgatgagggcttctatgagtgcatcgctgtgagcagcgctggcaccggccgggcccagaccttctttgatgtgtctgagcccccacctgtgatccaggtgcccaacaacgtgacagtgaccccaggagagagagctgtgctgacctgcctgatcatctctgctgtggactacaacctgacctggcagagaaatgacagagatgtgcggctggccgagcccgcccgcatccgcaccctggccaacctgagcctggagctgaagtctgtgaagttcaatgatgctggggagtaccactgcatggtgtcctctgagggcggcagcagcgctgcctctgtgttcctgactgtgcaggagccccccaaggtgacagtgatgcccaagaaccagagcttcaccggcggcagcgaggtgtccatcatgtgcagcgccaccggctaccccaagcccaagatcgcctggacagtgaatgacatgttcatcgtgggcagccaccgctacaggatgaccagtgatggcaccctcttcatcaagaatgctgcccccaaggatgctggcatctacggctgcctggccagcaacagcgctggaacagacaagcagaacagcaccctgcgctacatcgaggcccccaagctgatggtggtgcagagcgagctgctggtggccctgggggacatcaccgtgatggagtgcaagaccagcggcatccccccaccccaggtgaagtggttcaagggggacctggagctgcggcccagcaccttcctgatcatcgaccccctgctgggcctgctgaagatccaggagacccaggacctggatgctggggactacacctgtgtggccatcaatgaggccggccgggccaccgggaagatcaccctggatgtgggcagcccccctgtgttcatccaggagccagcagatgtgtccatggagatcggcagcaatgtgaccctgccctgctacgtgcagggctacccagagcccaccatcaagtggaggcggctggacaacatgcccatcttcagccggcccttctctgtgagcagcatcagccagctgaggactggagccctcttcatcctgaacctgtgggccagtgacaagggcacctacatctgtgaggccgagaaccagtttgggaagatccagagcgagaccaccgtgacagtgacaggcctggtggcccccctcatcggcatcagccccagcgtggccaacgtcatcgagggccagcagctgaccctgccctgcaccctgctggccggcaaccccatccctgagcggcgctggatcaagaacagcgccatgctgctgcagaacccctacatcaccgtgcggagtgatggcagcctgcacatcgagcgggtgcagctgcaggacggcggggagtacacctgtgtggccagcaatgtggccggcaccaacaacaagaccacctctgtggtggtgcacgtgctgcccaccatccagcacggccagcagatcctgagcaccatcgagggcatccctgtgaccctgccctgcaaggccagcggcaaccccaagcccagcgtcatctggagcaagaagggggagctgatcagcaccagcagcgccaagttctctgctggagcagatggcagcctgtatgtggtgtccccaggaggagaggagagcggggagtatgtgtgcacagccaccaacacagctggctacgccaagaggaaggtgcagctgactgtgtatgtgcggccccgggtgtttggagaccagaggggcctgagccaggacaagcctgtggagatctctgtgctggccggggaggaggtgaccctgccctgtgaggtgaagagcctgcccccacccatcatcacctgggccaaggagacccagctgatcagccccttcagccccaggcacaccttcctgcccagcggctccatgaagatcacagagaccaggaccagtgacagcggcatgtacctgtgtgtggccaccaacattgctggaaatgtgacccaggccgtgaagctgaatgtgcacgtgccccccaagatccagaggggccccaagcacctgaaggtgcaggtgggccagagggtggacatcccctgcaatgcccagggcacccccctgcccgtcatcacctggagcaagggcggcagcaccatgctggtggatggagagcaccacgtgagcaacccagatggcaccctgagcattgaccaggccacccccagtgatgctggcatctacacctgtgtggccaccaacattgctggaacagatgaaacagagatcaccctgcacgtgcaggagcccccaacagtggaggacctggagcccccctacaacaccaccttccaggagcgggtggccaaccagagaattgagttcccctgcccagccaagggcacccccaagcccaccatcaagtggctgcacaacggccgggagctgaccggccgggagcccggcatcagcatcctggaggatggcaccctgctggtgattgcctctgtgaccccctatgacaatggagagtacatctgtgtggccgtgaatgaggccggcaccacagagaggaagtacaacctgaaggtgcacgtgccccctgtgatcaaggacaaggagcaggtgaccaacgtgtctgtgctgctgaaccagctgaccaacctcttctgtgaggtggagggcacccccagccccatcatcatgtggtacaaggacaacgtgcaggtgacagagagcagcaccatccagacagtgaacaacgggaagatcctgaagctgttccgggccaccccagaagatgctggccgctacagctgcaaggccatcaacattgctggcaccagccagaagtacttcaacattgatgtgctggtgccccccaccatcatcggcaccaacttccccaatgaggtgtctgtggtgctgaacagagatgtggccctggagtgccaggtgaagggcacccccttcccagacatccactggttcaaggatggcaagcccctcttcctgggggaccccaacgtggagctgctggaccggggccaggtgctgcacctgaagaatgccaggagaaatgacaagggccgctaccagtgcaccgtgtccaatgctgctgggaagcaggccaaggacatcaagctgaccatctacatccccccatccatcaagggcggcaatgtgaccacagacatctctgtgctgatcaacagcctcatcaagctggagtgtgagacccggggcctgcccatgcctgccatcacctggtacaaggatggccagcccatcatgagcagcagccaggccctgtacatcgacaagggccagtacctgcacatcccccgggcccaggtgtctgattctgccacctacacctgccacgtggccaacgtggccggcacagctgagaagagcttccacgtggatgtgtatgtgccccccatgattgagggcaacctggccacccccctgaacaagcaggtggtgattgcccacagcctgaccctggagtgcaaggccgccggcaaccccagccccatcctgacctggctgaaggatggagtgcctgtgaaggccaatgacaacatccgcatcgaggccggcggcaagaagctggagatcatgtctgcccaggagattgaccggggccagtacatctgtgtggccacctctgtggccggggagaaggagatcaagtatgaggtggatgtgctggtgcccccagccattgaaggaggagatgagaccagctacttcatcgtgatggtgaacaacctgctggagctggactgccacgtgacaggcagccccccacccaccatcatgtggctgaaggatggccagctgattgatgaaagagatggcttcaagatcctgctgaatggaaggaagctggtgattgcccaggcccaggtgagcaacacaggcctgtaccgctgcatggccgccaacacagctggggaccacaagaaggagtttgaggtgacagtgcacgtgccccccaccatcaagagcagcggcctgtctgagcgggtggtggtgaagtacaagcctgtggccctgcagtgcatcgccaacggcatccccaaccccagcatcacctggctgaaggatgaccagcctgtgaacacagcccagggcaacctgaagatccagagcagcggccgggtgctgcagatcgccaagaccctgctggaggatgctggccgctacacctgtgtggccaccaatgctgctggggagacccagcagcacatccagctgcacgtgcatgagccccccagcctggaggatgctgggaagatgctgaatgaaacagtgctggtgagcaaccctgtgcagctggagtgcaaggctgctggcaaccctgtgcctgtgatcacctggtacaaggacaaccggctgctgagcggcagcacctccatgaccttcctgaacagaggccagatcatcgacatcgagagcgcccagatcagtgatgctggcatctacaagtgtgtggccatcaacagcgctggggccacagagctgttctacagcctgcaggtgcacgtggcccccagcatcagcggcagcaacaacatggtggccgtggtggtgaacaaccctgtgcggctggagtgtgaggcccggggcatcccagcccccagcctgacctggctgaaggatggcagccctgtgagcagcttcagcaatggcctgcaggtgctgagcggcggccgcatcctggccctgaccagcgcccagatcagtgacaccggccgctacacctgtgtggccgtgaatgctgctggggagaagcagagggacatcgacctgcgggtgtatgtgccccccaacatcatgggagaggagcagaatgtgtctgtgctgatcagccaggccgtggagctgctgtgccagagtgatgccatccccccacccaccctgacctggctgaaggatggccaccccctgctgaagaagccaggcctgagcatcagcgagaacagatctgtgctgaagattgaagatgcccaggtgcaggacaccggccgctacacctgtgaggccaccaacgtggccggcaagacagagaagaactacaacgtgaacatctgggtgccccccaacattggaggcagtgatgagctgacccagctgactgtgattgagggcaacctgatcagcctgctgtgtgagagcagcggcatccccccacccaacctgatctggaagaagaagggcagccctgtgctgacagacagcatgggccgggtgcgcatcctgagcggcggccggcagctgcagatcagcattgctgagaagagtgatgctgccctgtacagctgtgtggccagcaatgtggccggcacagccaagaaggagtacaacctgcaggtgtacatccggcccaccatcaccaacagcggcagccaccccacagagatcatcgtgacccggggcaagagcatcagcctggagtgtgaggtgcagggcatccccccacccaccgtgacctggatgaaggatggccaccccctcatcaaggccaagggcgtggagatcctggatgagggccacatcctgcagctgaagaacatccacgtgtctgacaccggccgctacgtgtgtgtggccgtgaatgtggccggcatgacagacaagaagtatgacctgtctgtgcacgcccctccttccatcatcggcaaccacaggagccctgagaacatctctgtggtggagaagaacagcgtgtccctgacctgtgaggccagcggcatccccctgcccagcatcacctggttcaaggatggctggcctgtgtccctgagcaacagcgtgcgcatcctgagcggcggccgcatgctgcggctgatgcagaccaccatggaggatgctggccagtacacctgtgtggtgagaaatgctgctggggaggagaggaagatcttcggcctgtctgtgctggtgcccccccacatcgtgggggagaacaccctggaggatgtgaaggtgaaggagaagcagagcgtgaccctgacctgtgaggtgacaggcaaccctgtgcctgagatcacctggcacaaggatggccagcccctgcaggaggatgaggcccaccacatcatcagcggcggccgcttcctgcagatcaccaacgtgcaggtgccccacacaggccgctacacctgcctggccagcagccctgctggccacaagagccgctccttcagcctgaatgtgtttgtgagccccaccatcgccggcgtgggcagtgatggcaacccagaagatgtgaccgtcatcctgaacagccccaccagcctggtgtgtgaggcctacagctaccccccagccaccatcacctggttcaaggatggcacccccctggagagcaacagaaacatccgcatcctgcccggcggccgcaccctgcagatcctgaatgcccaggaggacaatgccggccgctacagctgtgtggccaccaatgaggccggggagatgatcaagcactatgaggtgaaggtgtacatcccccccatcatcaacaagggggacctgtggggccctggcctgagccccaaggaggtgaagatcaaggtgaacaacaccctgaccctggagtgtgaggcctatgccatccccagcgccagcctgtcctggtacaaggatggccagcccctgaagagtgatgaccacgtgaacattgctgccaacggccacaccctgcagatcaaggaggcccagatcagtgacaccggccgctacacctgtgtggccagcaacattgctggagaagatgagctggactttgatgtgaacatccaggtgcccccatccttccagaagctgtgggagatcggcaacatgctggacaccggcagaaatggagaggccaaggatgtgatcatcaacaaccccatcagcctgtactgtgagaccaatgctgcccccccacccaccctgacctggtacaaggatggccaccccctgaccagcagtgacaaggtgctgatcctgcccggcggccgggtgctgcagatcccccgggccaaggtggaggatgctggccgctacacctgtgtggccgtgaatgaggccggggaggacagcctgcagtatgatgtgcgggtgctggtgccccccatcatcaagggggccaacagcgacctgcctgaggaggtgacagtgctggtgaacaagagcgccctgattgaatgtctgagcagcggcagccctgcccccagaaattcctggcagaaggatggccagcccctgctggaggatgaccaccacaagttcctgagcaatggccgcatcctgcagatcctgaacacccagatcacagacatcggccgctacgtgtgtgtggccgagaacacagctggcagcgccaagaagtacttcaacctgaatgtgcacgtgcccccatctgtgattggccccaagtctgagaacctgactgtggtggtgaacaacttcatcagcctgacctgtgaggtgtctggcttccccccaccagacctgtcctggctgaagaatgagcagcccatcaagctgaacaccaacaccctgattgtgcctgggggccgcaccctgcagatcatccgggccaaggtgtctgatggaggagagtacacctgcatcgccatcaaccaggccggggagagcaagaagaagttcagcctgactgtgtatgtgcccccatccatcaaggaccatgattctgagagcctgtctgtggtgaatgtgcgggagggcacctctgtgtccctggagtgtgagagcaatgctgtgcccccacctgtgatcacctggtacaagaatggccgcatgatcacagagagcacccacgtggagatcctggctgatggccagatgctgcacatcaagaaggccgaggtgtctgacaccggccagtatgtgtgccgggccatcaacgtggccggcagagatgacaagaacttccacctgaatgtgtatgtgccccccagcattgagggccctgagcgggaggtgattgtggagaccatcagcaaccctgtgaccctgacctgtgatgccaccggcatccccccacccaccatcgcctggctgaagaaccacaagagaattgaaaattctgacagcctggaggtgcgcatcctgagcggcggcagcaagctgcagatcgcccggagccagcacagcgacagcggcaactacacctgcatcgccagcaacatggagggcaaggcccagaagtactacttcctgagcatccaggtgccccccagcgtggccggggctgagatccccagtgatgtgtctgtgctgctgggggagaatgtggagctggtgtgcaatgccaacggcatccccacccccctcatccagtggctgaaggatggcaagcccatcgccagcggggagacagagcgcatccgggtgtctgccaacggcagcaccctgaacatctatggagccctgaccagtgacaccgggaagtacacctgtgtggccaccaacccagctggggaggaggaccgcatcttcaacctgaatgtgtatgtgacccccaccatccggggcaacaaggatgaagctgagaagctgatgaccctggtggacaccagcatcaacattgaatgtcgggccaccggcaccccaccaccccagatcaactggctgaagaatggcctgcccctgcccctgagcagccacatccggctgctggccgccggccaggtgatccgcatcgtgcgggcccaggtgtctgatgtggccgtgtacacctgtgtggccagcaacagagctggggtggacaacaagcactacaacctgcaggtgtttgccccacccaacatggacaacagcatgggcacagaggagatcaccgtgctgaagggcagcagcacctccatggcctgcatcacagatggcaccccagcccccagcatggcctggctgagagatggccagcccctgggcctggatgcccacctgactgtgtccacccacggcatggtgctgcagctgctgaaggccgagacagaagattctgggaagtacacctgcatcgccagcaatgaggccggggaggtgtccaagcacttcatcctgaaggtgctggagcccccccacatcaatggcagcgaggagcacgaggagatctctgtgattgtgaacaaccccctggagctgacctgcatcgccagcggcatcccagcccccaagatgacctggatgaaggatggccggcccctgccccagacagaccaggtgcagaccctgggcggcggggaggtgctgcgcatcagcacagcccaggtggaggacaccggccgctacacctgcctggccagcagccctgctggagatgatgacaaggagtacctggtgcgggtgcacgtgccccccaacattgctggaacagatgagccccgggacatcaccgtgctgaggaaccggcaggtgaccctggagtgcaagagtgatgctgtgcccccacctgtgatcacctggctgagaaatggagagcggctgcaggccaccccccgggtgcgcatcctgagcggcggccgctacctgcagatcaacaatgctgacctgggggacacagccaactacacctgtgtggccagcaacattgctgggaagaccacccgggagttcatcctgactgtgaatgtgccccccaacatcaagggcggcccccagagcctggtgatcctgctgaacaagagcacagtgctggagtgcatcgccgagggcgtgcccaccccccgcatcacctggaggaaggatggagctgtgctggccggcaaccacgcccgctacagcatcctggagaatggcttcctgcacatccagagcgcccacgtgacagacaccggccgctacctgtgcatggccaccaatgctgctggaacagacagaagaagaattgacctgcaggtgcacgtgcccccatccatcgcccctggccccaccaacatgaccgtcatcgtgaatgtgcagaccaccctggcctgtgaggccaccggcatccccaagcccagcatcaactggaggaagaatggccacctgctgaatgtggaccagaaccagaacagctaccgcctgctgagcagcggcagcctggtgatcatcagccccagcgtggatgacacagccacctatgaatgtactgtgaccaacggggctggagatgacaagaggacagtggacctgactgtgcaggtgccccccagcattgctgatgagcccacagacttcctggtgaccaagcacgccccagctgtgatcacctgcacagccagcggcgtgcccttccccagcatccactggaccaagaatggcatccggctgctgcccagaggagatggctaccgcatcctgagcagcggggccatcgagatcctggccacccagctgaaccacgccggccgctacacctgtgtggccagaaatgctgctggcagcgcccacagacatgtgaccctgcacgtgcatgagccccctgtgatccagccccagcccagcgagctgcacgtgatcctgaacaaccccatcctgctgccctgtgaggccaccggcacccccagccccttcatcacctggcagaaggagggcatcaacgtgaacaccagcggcagaaatcatgctgtgctgcccagcggcggcctgcagatcagcagagctgtgagagaagatgctggcacctacatgtgtgtggcccagaacccagctggaacagccctgggcaagatcaagctgaatgtgcaggtgccccctgtgatcagcccccacctgaaggagtatgtgattgctgtggacaagcccatcaccctgagctgtgaggctgatggcctgcccccaccagacatcacctggcacaaggatggccgggccatcgtggagagcatccggcagagggtgctgagcagcggcagcctgcagatcgcctttgtgcagcctggagatgctggccactacacctgcatggccgccaacgtggccggcagcagcagcaccagcaccaagctgactgtgcacgtgcccccacgcatccgcagcacagagggccactacacagtgaatgaaaacagccaggccatcctgccctgtgtggctgatggcatccccaccccagccatcaactggaagaaggacaacgtgctgctggccaacctgctgggcaagtacacagctgagccctatggagagctgatcctggagaatgtggtgctggaggacagcggcttctacacctgtgtggccaacaatgctgctggggaggacacccacacagtgtccctgactgtgcacgtgctgcccaccttcacagagctgcctggagatgtgtccctgaacaagggggagcagctgcggctgagctgcaaggccaccggcatccccctgcccaagctgacctggaccttcaacaacaacatcatcccagcccactttgacagcgtgaatggccacagcgagctggtgattgagcgggtgtccaaagaagattctggcacctacgtgtgcacagcagaaaattctgtgggctttgtgaaggccatcggctttgtgtatgtgaaggagccccctgtgttcaagggggactaccccagcaactggattgagcccctgggcggcaatgccatcctgaactgtgaggtgaagggggaccccacccccaccatccagtggaacaggaagggcgtggacatcgagatcagccaccgcatccggcagctgggcaatggcagcctggccatctatggaacagtgaatgaagatgctggggactacacctgtgtggccaccaatgaagctggggtggtggagaggtccatgagcctgaccctgcagagcccccccatcatcaccctggagcctgtggagaccgtcatcaatgccggcggcaagatcatcctgaactgccaggccaccggggagccccagcccaccatcacctggagccggcagggccacagcatctcctgggatgacagagtgaatgtgctgagcaacaacagcctgtacatcgcagatgcccagaaggaggacaccagcgagtttgaatgtgtggccaggaacctgatgggctctgtgctggtgcgggtgcctgtgattgtgcaggtgcatggaggcttcagccagtggagcgcctggagggcctgcagcgtgacctgtgggaagggcatccagaagaggagccggctgtgcaaccagcccctgcctgccaatggaggcaagccctgccagggcagtgacctggagatgaggaactgccagaacaagccctgccctgtggatggctcctggagcgagtggagcctgtgggaggagtgcaccaggagctgtggccggggcaaccagaccaggaccaggacctgcaacaaccccagcgtgcagcacggcggccggccctgtgagggcaatgctgtggagatcatcatgtgcaacatccggccctgccctgtgcatggagcctggagcgcctggcagccctggggcacctgcagcgagagctgtgggaagggcacccagacccgggcccggctgtgcaacaaccccccaccagcctttggaggcagctactgtgatggagctgagacccagatgcaggtgtgcaatgaaagaaactgccccatccacggcaagtgggccacctgggcctcctggagcgcctgcagcgtgtcctgtggcggcggggcccggcagaggacccggggctgcagcgaccctgtgccccagtatggaggcaggaaatgtgagggcagtgatgtgcagagcgacttctgcaacagcgacccctgccccacccacggcaactggagcccctggagcggctggggcacctgcagcaggacctgcaatggaggccagatgaggcgctaccgcacctgtgacaaccccccacccagcaatggaggccgggcctgtggcggccctgacagccagatccagcgctgcaacacagacatgtgccctgtggatggctcctggggctcctggcacagctggagccagtgcagcgccagctgtggcggcggggagaagaccaggaagaggctgtgtgaccaccctgtgcctgtgaagggcggccggccctgccctggggacaccacccaggtgacccgctgcaatgtgcaggcctgccctgggggcccccagagggcccggggcagcgtcatcggcaacatcaatgatgtggagtttggcatcgccttcctgaatgccaccatcacagacagccccaacagcgacacccgcatcatccgggccaagatcaccaacgtgcccaggagcctgggcagcgccatgaggaagatcgtgtccatcctgaaccccatctactggaccacagccaaggagattggagaggccgtgaatggcttcaccctgaccaatgctgtgttcaagcgggagacccaggtggagtttgccactggagagatcctgcagatgagccacatcgcccggggcctggacagtgatggcagcctgctgctggacatcgtggtgtctggctacgtgctgcagctgcagagccctgctgaggtgacagtgaaggactacacagaggactacatccagacaggccctggccagctgtatgcctacagcaccaggctcttcaccattgatggcatcagcatcccctacacctggaaccacacagtgttctatgaccaggcccagggccgcatgcccttcctggtggagaccctgcacgccagctctgtggagagtgactacaaccagatcgaggagaccctgggcttcaagatccacgccagcatcagcaaaggagacaggagcaaccagtgccccagcggcttcaccctggacagcgtgggccccttctgtgctgatgaagatgaatgtgccgccggcaacccctgcagccacagctgccacaatgccatgggcacctactactgcagctgccccaagggcctgaccatcgccgcagatggccgcacctgccaggacattgatgaatgtgccctgggccgccacacctgccacgccggccaggactgtgacaacaccatcggcagctaccgctgtgtggtgcgctgtggcagcggcttccggaggaccagtgatggcctgagctgccaggacatcaatgaatgccaggagagcagcccctgccaccagcgctgcttcaatgccatcggcagcttccactgcggctgtgagcccggctaccagctgaagggcaggaagtgcatggatgtgaatgaatgtcggcagaatgtgtgcaggccagaccagcactgcaagaacacccggggcggctacaagtgcatcgacctgtgccccaacggcatgaccaaggccgagaatggcacctgcattgatattgatgagtgcaaggatggcacccaccagtgccgctacaaccagatctgtgagaacacccggggcagctaccgctgtgtgtgcccccggggctaccgcagccagggcgtgggccggccctgcatggacatcaatgaatgtgagcaggtgcccaagccctgtgcccaccagtgcagcaacaccccaggcagcttcaagtgcatctgccccccaggccagcacctgctgggagatggcaagagctgtgccggcctggagcggctgcccaactacggcacccagtacagcagctacaacctggcccgcttcagccctgtgaggaacaactaccagccccagcagcactaccggcagtacagccacctgtacagcagctacagcgagtacagaaacagcaggaccagcctgagcaggaccaggaggaccatcaggaagacctgcccagagggcagcgaggccagccatgacacctgtgtggacattgatgaatgtgaaaatacagatgcctgccagcacgagtgcaagaacaccttcggcagctaccagtgcatctgccccccaggctaccagctgacccacaacgggaagacctgccaggacattgatgaatgtctggagcagaatgtgcactgcggccccaacaggatgtgcttcaacatgaggggcagctaccagtgcatcgacaccccctgcccccccaactaccagagggaccctgtgtctggcttctgcctgaagaactgccccccaaatgacctggagtgtgccctgagcccctatgccctggagtacaagctggtgtccctgccctttggaattgccaccaaccaggacctgatccggctggtggcctacacccaggatggagtgatgcaccccaggaccaccttcctgatggtggatgaggagcagacagtgccctttgccctgagagatgagaacctgaagggcgtggtgtacaccacccggcccctgcgggaggccgagacctacaggatgagggtgcgggccagcagctacagcgccaacggcaccatcgagtaccagaccaccttcatcgtgtacatcgctgtgtctgcctacccctactag

SEQ ID NO: 155073 - DNA, 16557 bp, Artificial Sequence
  Description of Artificial Sequence: Synthetic coding sequence
atgatctcctgggaggtggtgcacacagtgttcctgtttgccctgctgtacagcagcctggcccaggatgccagcccccagagcgagatccgggcagaggagatccctgagggcgccagcaccctggcctttgtgtttgatgtgacaggctccatgtatgatgacctggtgcaggtgattgagggcgccagcaagatcctggagaccagcctgaagaggcccaagaggcccctcttcaactttgccctggtgcccttccatgaccctgagatcggccctgtgaccatcaccacagaccccaagaagttccagtatgagctgcgggagctgtatgtgcagggcggcggggactgcccagagatgagcattggagccatcaagatcgccctggagatcagcctgcccggcagcttcatctacgtgttcacagatgcccggagcaaggactaccgcctgacccatgaggtgctgcagctgatccagcagaagcagagccaggtggtgtttgtgctgaccggggactgtgatgacaggacccacatcggctacaaggtgtatgaggagatcgccagcaccagcagcggccaggtgttccacctggacaagaagcaggtgaatgaggtgctgaagtgggtggaggaggccgtgcaggccagcaaggtgcacctgctgagcacagaccacctggagcaggccgtgaacacctggaggatcccctttgaccccagcctgaaggaggtgacagtgtccctgagcggccccagccccatgattgagatccggaaccccctgggcaagctgatcaagaagggcttcggcctgcacgagctgctgaacatccacaacagcgccaaggtggtgaatgtgaaggagcctgaggccggcatgtggacagtgaagaccagcagcagcggccgccacagcgtgcgcatcaccggcctgagcaccatcgacttccgggccggcttcagcaggaagcccaccctggacttcaagaagacagtgtccaggcctgtgcagggcatccccacctacgtgctgctgaacaccagcggcatcagcaccccagccagaattgacctgctggagctgctgagcatcagcggcagcagcctgaagaccatccctgtgaagtactacccccacaggaagccctacggcatctggaacatcagtgactttgtgcccccaaatgaggccttcttcctgaaggtgacaggctatgacaaggatgactacctgttccagagggtgtcctctgtgtccttcagcagcatcgtgcctgatgcccccaaggtgaccatgcctgagaagaccccaggctactacctgcagcccggccagatcccctgcagcgtggacagcctgctgcccttcaccctgagctttgtgagaaatggagtgaccctgggcgtggaccagtacctgaaggagagcgcctctgtgaacctggacatcgccaaggtgaccctgagtgatgagggcttctatgagtgcatcgctgtgagcagcgctggcaccggccgggcccagaccttctttgatgtgtctgagcccccacctgtgatccaggtgcccaacaacgtgacagtgaccccaggagagagagctgtgctgacctgcctgatcatctctgctgtggactacaacctgacctggcagagaaatgacagagatgtgcggctggccgagcccgcccgcatccgcaccctggccaacctgagcctggagctgaagtctgtgaagttcaatgatgctggggagtaccactgcatggtgtcctctgagggcggcagcagcgctgcctctgtgttcctgactgtgcaggagccccccaaggtgacagtgatgcccaagaaccagagcttcaccggcggcagcgaggtgtccatcatgtgcagcgccaccggctaccccaagcccaagatcgcctggacagtgaatgacatgttcatcgtgggcagccaccgctacaggatgaccagtgatggcaccctcttcatcaagaatgctgcccccaaggatgctggcatctacggctgcctggccagcaacagcgctggaacagacaagcagaacagcaccctgcgctacatcgaggcccccaagctgatggtggtgcagagcgagctgctggtggccctgggggacatcaccgtgatggagtgcaagaccagcggcatccccccaccccaggtgaagtggttcaagggggacctggagctgcggcccagcaccttcctgatcatcgaccccctgctgggcctgctgaagatccaggagacccaggacctggatgctggggactacacctgtgtggccatcaatgaggccggccgggccaccgggaagatcaccctggatgtgggcagcccccctgtgttcatccaggagccagcagatgtgtccatggagatcggcagcaatgtgaccctgccctgctacgtgcagggctacccagagcccaccatcaagtggaggcggctggacaacatgcccatcttcagccggcccttctctgtgagcagcatcagccagctgaggactggagccctcttcatcctgaacctgtgggccagtgacaagggcacctacatctgtgaggccgagaaccagtttgggaagatccagagcgagaccaccgtgacagtgacaggcctggtggcccccctcatcggcatcagccccagcgtggccaacgtcatcgagggccagcagctgaccctgccctgcaccctgctggccggcaaccccatccctgagcggcgctggatcaagaacagcgccatgctgctgcagaacccctacatcaccgtgcggagtgatggcagcctgcacatcgagcgggtgcagctgcaggacggcggggagtacacctgtgtggccagcaatgtggccggcaccaacaacaagaccacctctgtggtggtgcacgtgctgcccaccatccagcacggccagcagatcctgagcaccatcgagggcatccctgtgaccctgccctgcaaggccagcggcaaccccaagcccagcgtcatctggagcaagaagggggagctgatcagcaccagcagcgccaagttctctgctggagcagatggcagcctgtatgtggtgtccccaggaggagaggagagcggggagtatgtgtgcacagccaccaacacagctggctacgccaagaggaaggtgcagctgactgtgtatgtgcggccccgggtgtttggagaccagaggggcctgagccaggacaagcctgtggagatctctgtgctggccggggaggaggtgaccctgccctgtgaggtgaagagcctgcccccacccatcatcacctgggccaaggagacccagctgatcagccccttcagccccaggcacaccttcctgcccagcggctccatgaagatcacagagaccaggaccagtgacagcggcatgtacctgtgtgtggccaccaacattgctggaaatgtgacccaggccgtgaagctgaatgtgcacgtgccccccaagatccagaggggccccaagcacctgaaggtgcaggtgggccagagggtggacatcccctgcaatgcccagggcacccccctgcccgtcatcacctggagcaagggcggcagcaccatgctggtggatggagagcaccacgtgagcaacccagatggcaccctgagcattgaccaggccacccccagtgatgctggcatctacacctgtgtggccaccaacattgctggaacagatgaaacagagatcaccctgcacgtgcaggagcccccaacagtggaggacctggagcccccctacaacaccaccttccaggagcgggtggccaaccagagaattgagttcccctgcccagccaagggcacccccaagcccaccatcaagtggctgcacaacggccgggagctgaccggccgggagcccggcatcagcatcctggaggatggcaccctgctggtgattgcctctgtgaccccctatgacaatggagagtacatctgtgtggccgtgaatgaggccggcaccacagagaggaagtacaacctgaaggtgcacgtgccccctgtgatcaaggacaaggagcaggtgaccaacgtgtctgtgctgctgaaccagctgaccaacctcttctgtgaggtggagggcacccccagccccatcatcatgtggtacaaggacaacgtgcaggtgacagagagcagcaccatccagacagtgaacaacgggaagatcctgaagctgttccgggccaccccagaagatgctggccgctacagctgcaaggccatcaacattgctggcaccagccagaagtacttcaacattgatgtgctggtgccccccaccatcatcggcaccaacttccccaatgaggtgtctgtggtgctgaacagagatgtggccctggagtgccaggtgaagggcacccccttcccagacatccactggttcaaggatggcaagcccctcttcctgggggaccccaacgtggagctgctggaccggggccaggtgctgcacctgaagaatgccaggagaaatgacaagggccgctaccagtgcaccgtgtccaatgctgctgggaagcaggccaaggacatcaagctgaccatctacatccccccatccatcaagggcggcaatgtgaccacagacatctctgtgctgatcaacagcctcatcaagctggagtgtgagacccggggcctgcccatgcctgccatcacctggtacaaggatggccagcccatcatgagcagcagccaggccctgtacatcgacaagggccagtacctgcacatcccccgggcccaggtgtctgattctgccacctacacctgccacgtggccaacgtggccggcacagctgagaagagcttccacgtggatgtgtatgtgccccccatgattgagggcaacctggccacccccctgaacaagcaggtggtgattgcccacagcctgaccctggagtgcaaggccgccggcaaccccagccccatcctgacctggctgaaggatggagtgcctgtgaaggccaatgacaacatccgcatcgaggccggcggcaagaagctggagatcatgtctgcccaggagattgaccggggccagtacatctgtgtggccacctctgtggccggggagaaggagatcaagtatgaggtggatgtgctggtgcccccagccattgaaggaggagatgagaccagctacttcatcgtgatggtgaacaacctgctggagctggactgccacgtgacaggcagccccccacccaccatcatgtggctgaaggatggccagctgattgatgaaagagatggcttcaagatcctgctgaatggaaggaagctggtgattgcccaggcccaggtgagcaacacaggcctgtaccgctgcatggccgccaacacagctggggaccacaagaaggagtttgaggtgacagtgcacgtgccccccaccatcaagagcagcggcctgtctgagcgggtggtggtgaagtacaagcctgtggccctgcagtgcatcgccaacggcatccccaaccccagcatcacctggctgaaggatgaccagcctgtgaacacagcccagggcaacctgaagatccagagcagcggccgggtgctgcagatcgccaagaccctgctggaggatgctggccgctacacctgtgtggccaccaatgctgctggggagacccagcagcacatccagctgcacgtgcatgagccccccagcctggaggatgctgggaagatgctgaatgaaacagtgctggtgagcaaccctgtgcagctggagtgcaaggctgctggcaaccctgtgcctgtgatcacctggtacaaggacaaccggctgctgagcggcagcacctccatgaccttcctgaacagaggccagatcatcgacatcgagagcgcccagatcagtgatgctggcatctacaagtgtgtggccatcaacagcgctggggccacagagctgttctacagcctgcaggtgcacgtggcccccagcatcagcggcagcaacaacatggtggccgtggtggtgaacaaccctgtgcggctggagtgtgaggcccggggcatcccagcccccagcctgacctggctgaaggatggcagccctgtgagcagcttcagcaatggcctgcaggtgctgagcggcggccgcatcctggccctgaccagcgcccagatcagtgacaccggccgctacacctgtgtggccgtgaatgctgctggggagaagcagagggacatcgacctgcgggtgtatgtgccccccaacatcatgggagaggagcagaatgtgtctgtgctgatcagccaggccgtggagctgctgtgccagagtgatgccatccccccacccaccctgacctggctgaaggatggccaccccctgctgaagaagccaggcctgagcatcagcgagaacagatctgtgctgaagattgaagatgcccaggtgcaggacaccggccgctacacctgtgaggccaccaacgtggccggcaagacagagaagaactacaacgtgaacatctgggtgccccccaacattggaggcagtgatgagctgacccagctgactgtgattgagggcaacctgatcagcctgctgtgtgagagcagcggcatccccccacccaacctgatctggaagaagaagggcagccctgtgctgacagacagcatgggccgggtgcgcatcctgagcggcggccggcagctgcagatcagcattgctgagaagagtgatgctgccctgtacagctgtgtggccagcaatgtggccggcacagccaagaaggagtacaacctgcaggtgtacatccggcccaccatcaccaacagcggcagccaccccacagagatcatcgtgacccggggcaagagcatcagcctggagtgtgaggtgcagggcatccccccacccaccgtgacctggatgaaggatggccaccccctcatcaaggccaagggcgtggagatcctggatgagggccacatcctgcagctgaagaacatccacgtgtctgacaccggccgctacgtgtgtgtggccgtgaatgtggccggcatgacagacaagaagtatgacctgtctgtgcacgcccctccttccatcatcggcaaccacaggagccctgagaacatctctgtggtggagaagaacagcgtgtccctgacctgtgaggccagcggcatccccctgcccagcatcacctggttcaaggatggctggcctgtgtccctgagcaacagcgtgcgcatcctgagcggcggccgcatgctgcggctgatgcagaccaccatggaggatgctggccagtacacctgtgtggtgagaaatgctgctggggaggagaggaagatcttcggcctgtctgtgctggtgcccccccacatcgtgggggagaacaccctggaggatgtgaaggtgaaggagaagcagagcgtgaccctgacctgtgaggtgacaggcaaccctgtgcctgagatcacctggcacaaggatggccagcccctgcaggaggatgaggcccaccacatcatcagcggcggccgcttcctgcagatcaccaacgtgcaggtgccccacacaggccgctacacctgcctggccagcagccctgctggccacaagagccgctccttcagcctgaatgtgtttgtgagccccaccatcgccggcgtgggcagtgatggcaacccagaagatgtgaccgtcatcctgaacagccccaccagcctggtgtgtgaggcctacagctaccccccagccaccatcacctggttcaaggatggcacccccctggagagcaacagaaacatccgcatcctgcccggcggccgcaccctgcagatcctgaatgcccaggaggacaatgccggccgctacagctgtgtggccaccaatgaggccggggagatgatcaagcactatgaggtgaaggtgtacatcccccccatcatcaacaagggggacctgtggggccctggcctgagccccaaggaggtgaagatcaaggtgaacaacaccctgaccctggagtgtgaggcctatgccatccccagcgccagcctgtcctggtacaaggatggccagcccctgaagagtgatgaccacgtgaacattgctgccaacggccacaccctgcagatcaaggaggcccagatcagtgacaccggccgctacacctgtgtggccagcaacattgctggagaagatgagctggactttgatgtgaacatccaggtgcccccatccttccagaagctgtgggagatcggcaacatgctggacaccggcagaaatggagaggccaaggatgtgatcatcaacaaccccatcagcctgtactgtgagaccaatgctgcccccccacccaccctgacctggtacaaggatggccaccccctgaccagcagtgacaaggtgctgatcctgcccggcggccgggtgctgcagatcccccgggccaaggtggaggatgctggccgctacacctgtgtggccgtgaatgaggccggggaggacagcctgcagtatgatgtgcgggtgctggtgccccccatcatcaagggggccaacagcgacctgcctgaggaggtgacagtgctggtgaacaagagcgccctgattgaatgtctgagcagcggcagccctgcccccagaaattcctggcagaaggatggccagcccctgctggaggatgaccaccacaagttcctgagcaatggccgcatcctgcagatcctgaacacccagatcacagacatcggccgctacgtgtgtgtggccgagaacacagctggcagcgccaagaagtacttcaacctgaatgtgcacgtgcccccatctgtgattggccccaagtctgagaacctgactgtggtggtgaacaacttcatcagcctgacctgtgaggtgtctggcttccccccaccagacctgtcctggctgaagaatgagcagcccatcaagctgaacaccaacaccctgattgtgcctgggggccgcaccctgcagatcatccgggccaaggtgtctgatggaggagagtacacctgcatcgccatcaaccaggccggggagagcaagaagaagttcagcctgactgtgtatgtgcccccatccatcaaggaccatgattctgagagcctgtctgtggtgaatgtgcgggagggcacctctgtgtccctggagtgtgagagcaatgctgtgcccccacctgtgatcacctggtacaagaatggccgcatgatcacagagagcacccacgtggagatcctggctgatggccagatgctgcacatcaagaaggccgaggtgtctgacaccggccagtatgtgtgccgggccatcaacgtggccggcagagatgacaagaacttccacctgaatgtgtatgtgccccccagcattgagggccctgagcgggaggtgattgtggagaccatcagcaaccctgtgaccctgacctgtgatgccaccggcatccccccacccaccatcgcctggctgaagaaccacaagagaattgaaaattctgacagcctggaggtgcgcatcctgagcggcggcagcaagctgcagatcgcccggagccagcacagcgacagcggcaactacacctgcatcgccagcaacatggagggcaaggcccagaagtactacttcctgagcatccaggtgccccccagcgtggccggggctgagatccccagtgatgtgtctgtgctgctgggggagaatgtggagctggtgtgcaatgccaacggcatccccacccccctcatccagtggctgaaggatggcaagcccatcgccagcggggagacagagcgcatccgggtgtctgccaacggcagcaccctgaacatctatggagccctgaccagtgacaccgggaagtacacctgtgtggccaccaacccagctggggaggaggaccgcatcttcaacctgaatgtgtatgtgacccccaccatccggggcaacaaggatgaagctgagaagctgatgaccctggtggacaccagcatcaacattgaatgtcgggccaccggcaccccaccaccccagatcaactggctgaagaatggcctgcccctgcccctgagcagccacatccggctgctggccgccggccaggtgatccgcatcgtgcgggcccaggtgtctgatgtggccgtgtacacctgtgtggccagcaacagagctggggtggacaacaagcactacaacctgcaggtgtttgccccacccaacatggacaacagcatgggcacagaggagatcaccgtgctgaagggcagcagcacctccatggcctgcatcacagatggcaccccagcccccagcatggcctggctgagagatggccagcccctgggcctggatgcccacctgactgtgtccacccacggcatggtgctgcagctgctgaaggccgagacagaagattctgggaagtacacctgcatcgccagcaatgaggccggggaggtgtccaagcacttcatcctgaaggtgctggagcccccccacatcaatggcagcgaggagcacgaggagatctctgtgattgtgaacaaccccctggagctgacctgcatcgccagcggcatcccagcccccaagatgacctggatgaaggatggccggcccctgccccagacagaccaggtgcagaccctgggcggcggggaggtgctgcgcatcagcacagcccaggtggaggacaccggccgctacacctgcctggccagcagccctgctggagatgatgacaaggagtacctggtgcgggtgcacgtgccccccaacattgctggaacagatgagccccgggacatcaccgtgctgaggaaccggcaggtgaccctggagtgcaagagtgatgctgtgcccccacctgtgatcacctggctgagaaatggagagcggctgcaggccaccccccgggtgcgcatcctgagcggcggccgctacctgcagatcaacaatgctgacctgggggacacagccaactacacctgtgtggccagcaacattgctgggaagaccacccgggagttcatcctgactgtgaatgtgccccccaacatcaagggcggcccccagagcctggtgatcctgctgaacaagagcacagtgctggagtgcatcgccgagggcgtgcccaccccccgcatcacctggaggaaggatggagctgtgctggccggcaaccacgcccgctacagcatcctggagaatggcttcctgcacatccagagcgcccacgtgacagacaccggccgctacctgtgcatggccaccaatgctgctggaacagacagaagaagaattgacctgcaggtgcacgtgcccccatccatcgcccctggccccaccaacatgaccgtcatcgtgaatgtgcagaccaccctggcctgtgaggccaccggcatccccaagcccagcatcaactggaggaagaatggccacctgctgaatgtggaccagaaccagaacagctaccgcctgctgagcagcggcagcctggtgatcatcagccccagcgtggatgacacagccacctatgaatgtactgtgaccaacggggctggagatgacaagaggacagtggacctgactgtgcaggtgccccccagcattgctgatgagcccacagacttcctggtgaccaagcacgccccagctgtgatcacctgcacagccagcggcgtgcccttccccagcatccactggaccaagaatggcatccggctgctgcccagaggagatggctaccgcatcctgagcagcggggccatcgagatcctggccacccagctgaaccacgccggccgctacacctgtgtggccagaaatgctgctggcagcgcccacagacatgtgaccctgcacgtgcatgagccccctgtgatccagccccagcccagcgagctgcacgtgatcctgaacaaccccatcctgctgccctgtgaggccaccggcacccccagccccttcatcacctggcagaaggagggcatcaacgtgaacaccagcggcagaaatcatgctgtgctgcccagcggcggcctgcagatcagcagagctgtgagagaagatgctggcacctacatgtgtgtggcccagaacccagctggaacagccctgggcaagatcaagctgaatgtgcaggtgccccctgtgatcagcccccacctgaaggagtatgtgattgctgtggacaagcccatcaccctgagctgtgaggctgatggcctgcccccaccagacatcacctggcacaaggatggccgggccatcgtggagagcatccggcagagggtgctgagcagcggcagcctgcagatcgcctttgtgcagcctggagatgctggccactacacctgcatggccgccaacgtggccggcagcagcagcaccagcaccaagctgactgtgcacgtgcccccacgcatccgcagcacagagggccactacacagtgaatgaaaacagccaggccatcctgccctgtgtggctgatggcatccccaccccagccatcaactggaagaaggacaacgtgctgctggccaacctgctgggcaagtacacagctgagccctatggagagctgatcctggagaatgtggtgctggaggacagcggcttctacacctgtgtggccaacaatgctgctggggaggacacccacacagtgtccctgactgtgcacgtgctgcccaccttcacagagctgcctggagatgtgtccctgaacaagggggagcagctgcggctgagctgcaaggccaccggcatccccctgcccaagctgacctggaccttcaacaacaacatcatcccagcccactttgacagcgtgaatggccacagcgagctggtgattgagcgggtgtccaaagaagattctggcacctacgtgtgcacagcagaaaattctgtgggctttgtgaaggccatcggctttgtgtatgtgaaggagccccctgtgttcaagggggactaccccagcaactggattgagcccctgggcggcaatgccatcctgaactgtgaggtgaagggggaccccacccccaccatccagtggaacaggaagggcgtggacatcgagatcagccaccgcatccggcagctgggcaatggcagcctggccatctatggaacagtgaatgaagatgctggggactacacctgtgtggccaccaatgaagctggggtggtggagaggtccatgagcctgaccctgcagagcccccccatcatcaccctggagcctgtggagaccgtcatcaatgccggcggcaagatcatcctgaactgccaggccaccggggagccccagcccaccatcacctggagccggcagggccacagcatctcctgggatgacagagtgaatgtgctgagcaacaacagcctgtacatcgcagatgcccagaaggaggacaccagcgagtttgaatgtgtggccaggaacctgatgggctctgtgctggtgcgggtgcctgtgattgtgcaggtgcatggaggcttcagccagtggagcgcctggagggcctgcagcgtgacctgtgggaagggcatccagaagaggagccggctgtgcaaccagcccctgcctgccaatggaggcaagccctgccagggcagtgacctggagatgaggaactgccagaacaagccctgccctgtggatggctcctggagcgagtggagcctgtgggaggagtgcaccaggagctgtggccggggcaaccagaccaggaccaggacctgcaacaaccccagcgtgcagcacggcggccggccctgtgagggcaatgctgtggagatcatcatgtgcaacatccggccctgccctgtgcatggagcctggagcgcctggcagccctggggcacctgcagcgagagctgtgggaagggcacccagacccgggcccggctgtgcaacaaccccccaccagcctttggaggcagctactgtgatggagctgagacccagatgcaggtgtgcaatgaaagaaactgccccatccacggcaagtgggccacctgggcctcctggagcgcctgcagcgtgtcctgtggcggcggggcccggcagaggacccggggctgcagcgaccctgtgccccagtatggaggcaggaaatgtgagggcagtgatgtgcagagcgacttctgcaacagcgacccctgccccacccacggcaactggagcccctggagcggctggggcacctgcagcaggacctgcaatggaggccagatgaggcgctaccgcacctgtgacaaccccccacccagcaatggaggccgggcctgtggcggccctgacagccagatccagcgctgcaacacagacatgtgccctgtggatggctcctggggctcctggcacagctggagccagtgcagcgccagctgtggcggcggggagaagaccaggaagaggctgtgtgaccaccctgtgcctgtgaagggcggccggccctgccctggggacaccacccaggtgacccgctgcaatgtgcaggcctgccctgggggcccccagagggcccggggcagcgtcatcggcaacatcaatgatgtggagtttggcatcgccttcctgaatgccaccatcacagacagccccaacagcgacacccgcatcatccgggccaagatcaccaacgtgcccaggagcctgggcagcgccatgaggaagatcgtgtccatcctgaaccccatctactggaccacagccaaggagattggagaggccgtgaatggcttcaccctgaccaatgctgtgttcaagcgggagacccaggtggagtttgccactggagagatcctgcagatgagccacatcgcccggggcctggacagtgatggcagcctgctgctggacatcgtggtgtctggctacgtgctgcagctgcagagccctgctgaggtgacagtgaaggactacacagaggactacatccagacaggccctggccagctgtatgcctacagcaccaggctcttcaccattgatggcatcagcatcccctacacctggaaccacacagtgttctatgaccaggcccagggccgcatgcccttcctggtggagaccctgcacgccagctctgtggagagtgactacaaccagatcgaggagaccctgggcttcaagatccacgccagcatcagcaaaggagacaggagcaaccagtgccccagcggcttcaccctggacagcgtgggccccttctgtgctgatgaagatgaatgtgccgccggcaacccctgcagccacagctgccacaatgccatgggcacctactactgcagctgccccaagggcctgaccatcgccgcagatggccgcacctgccaggacattgatgaatgtgccctgggccgccacacctgccacgccggccaggactgtgacaacaccatcggcagctaccgctgtgtggtgcgctgtggcagcggcttccggaggaccagtgatggcctgagctgccaggacatcaatgaatgccaggagagcagcccctgccaccagcgctgcttcaatgccatcggcagcttccactgcggctgtgagcccggctaccagctgaagggcaggaagtgcatggatgtgaatgaatgtcggcagaatgtgtgcaggccagaccagcactgcaagaacacccggggcggctacaagtgcatcgacctgtgccccaacggcatgaccaaggccgagaatggcacctgcattgatattgatgagtgcaaggatggcacccaccagtgccgctacaaccagatctgtgagaacacccggggcagctaccgctgtgtgtgcccccggggctaccgcagccagggcgtgggccggccctgcatggacattgatgaatgtgagaacacagatgcctgccagcacgagtgcaagaacaccttcggcagctaccagtgcatctgccccccaggctaccagctgacccacaacgggaagacctgccaggacattgatgagtgcctggagcagaatgtgcactgcggccccaacaggatgtgcttcaacatgaggggcagctaccagtgcatcgacaccccctgcccccccaactaccagagggaccctgtgtctggcttctgcctgaagaactgccccccaaatgacctggagtgtgccctgagcccctatgccctggagtacaagctggtgtccctgcccttcggcatcgccaccaaccaggacctgatccggctggtggcctacacccaggatggagtgatgcaccccaggaccaccttcctgatggtggatgaggagcagacagtgccctttgccctgagagatgagaacctgaagggcgtggtgtacaccacccggcccctgcgggaggccgagacctacaggatgagggtgcgggccagcagctacagcgccaacggcaccatcgagtaccagaccaccttcatcgtgtacatcgctgtgtctgcctacccctactag

SEQ ID NO: 155074 - DNA, 723 bp, Artificial Sequence
  Description of Artificial Sequence: Synthetic coding sequence
gccatcggcagcttccactgcggctgtgagcccggctaccagctgaagggcaggaagtgcatggatgtgaatgaatgtcggcagaatgtgtgcaggccagaccagcactgcaagaacacccggggcggctacaagtgcatcgacctgtgccccaacggcatgaccaaggccgagaatggcacctgcattgatattgatgagtgcaaggatggcacccaccagtgccgctacaaccagatctgtgagaacacccggggcagctaccgctgtgtgtgcccccggggctaccgcagccagggcgtgggccggccctgcatggacattgatgaatgtgagaacacagatgcctgccagcacgagtgcaagaacaccttcggcagctaccagtgcatctgccccccaggctaccagctgacccacaacgggaagacctgccaggacattgatgagtgcctggagcagaatgtgcactgcggccccaacaggatgtgcttcaacatgaggggcagctaccagtgcatcgacaccccctgcccccccaactaccagagggaccctgtgtctggcttctgcctgaagaactgccccccaaatgacctggagtgtgccctgagcccctatgccctggagtacaagctggtgtccctgcccttcggcatcgccaccaaccaggacctgatccggctggtggcctacacccaggatggagtgatgcacccctag

SEQ ID NO: 155075 - DNA, 1455 bp, Artificial Sequence
  Description of Artificial Sequence: Synthetic coding sequence
atggacctgggcaaggaccagagccacctgaagcaccaccagaccccagacccccaccaggaggagaaccacagccctgaggtgattggcacctggagcctgaggaaccgggagctgctgaggaagaggaaggccgaggtgcatgagaaggagaccagccagtggctgtttggagagcagaagaagaggaagcagcagaggacaggcaagggcaacagaagaggaaggaagaggcagcagaacacagagctgaaggtggagccccagccccagatcgagaaggagatcgtggagaaggccctggcccccatcgagaagaagacagagcccccaggcagcatcaccaaggtgttccccagcgtggccagcccccagaaggtggtgcctgaggagcacttcagcgagatctgccaggagagcaacatctaccaggagaacttcagcgagtaccaggagattgctgtgcagaaccacagcagcgagacctgccagcacgtgtctgagcctgaggacctgagccccaagatgtaccaggagatctctgtgctgcaggacaacagcagcaagatctgccaggacatgaaggagcctgaggacaacagccccaacacctgccaggtgatcagcgtcatccaggaccaccccttcaagatgtaccaggacatggccaagcgggaggacctggcccccaagatgtgccaggaggccgctgtgcccaagatcctgccctgccccaccagcgaggacacagctgacctggccggctgcagcctgcaggcctaccccaagccagatgtgcccaagggctacatcctggacacagaccagaacccagctgagcctgaggagtacaatgaaacagaccagggcattgctgagacagagggcctcttccccaagatccaggagattgctgagcccaaggacctgagcaccaagacccaccaggagagcgctgagcccaagtacctgccccacaagacctgcaatgagatcatcgtgcccaaggcccccagccacaagaccatccaggagaccccccacagcgaggactacagcattgagatcaaccaggagaccccaggcagcgagaagtacagccctgagacctaccaggagatccctggcctggaggagtacagccctgagatctaccaggagaccagccagctggaggagtacagccctgagatctaccaggagaccccaggccctgaggacctgagcacagagacctacaagaacaaggatgtgcccaaggagtgcttccctgagccccaccaggagaccggcggcccccagggccaggaccccaaggcccaccaggaggatgccaaggatgcctacaccttcccccaggagatgaaggagaagcccaaggaggagcccggcatcccagccatcctgaatgaaagccacccagaaaatgatgtgtacagctatgtgctcttctag

SEQ ID NO: 155076 - DNA, 1455 bp, Artificial Sequence; identical to SEQ ID NO: 155075
  Description of Artificial Sequence: Synthetic coding sequence

SEQ ID NO: 155077 - DNA, 429 bp, Artificial Sequence
  Description of Artificial Sequence: Synthetic coding sequence
atggtgctgagccctgctgacaagaccaacgtgaaggccgcctggggcaaggtgggcgcccacgccggggagtatggagctgaggccctggagaggatgttcctgtccttccccaccaccaagacctacttcccccactttgacctgagccacggcagcgcccaggtgaagggccacggcaagaaggtggctgatgccctgaccaatgctgtggcccacgtggatgacatgcccaatgccctgagcgccctgagtgacctgcacgcccacaagctgcgggtggaccctgtgaacttcaagctgctgagccactgcctgctggtgaccctggccgcccacctgcctgctgagttcaccccagctgtgcacgccagcctggacaagttcctggcctctgtgtccacagtgctgaccagcaagtacagatag

SEQ ID NO: 155078 - DNA, 429 bp, Artificial Sequence; identical to SEQ ID NO: 155077
  Description of Artificial Sequence: Synthetic coding sequence

SEQ ID NO: 155079 - DNA, 333 bp, Artificial Sequence
  Description of Artificial Sequence: Synthetic coding sequence
atgttcctgtccttccccaccaccaagacctacttcccccactttgacctgagccacggcagcgcccaggtgaagggccacggcaagaaggtggctgatgccctgaccaatgctgtggcccacgtggatgacatgcccaatgccctgagcgccctgagtgacctgcacgcccacaagctgcgggtggaccctgtgaacttcaagctgctgagccactgcctgctggtgaccctggccgcccacctgcctgctgagttcaccccagctgtgcacgccagcctggacaagttcctggcctctgtgtccacagtgctgaccagcaagtacagatag

SEQ ID NO: 155080 - DNA, 444 bp, Artificial Sequence
  Description of Artificial Sequence: Synthetic coding sequence
atggtgcacctgaccccagaggagaagtctgctgtgacagccctgtggggcaaggtgaatgtggatgaggtgggcggggaggccctgggccgcctgctggtggtgtacccctggacccagcgcttctttgagagctttggagacctgagcaccccagatgctgtgatgggcaaccccaaggtgaaggcccacggcaagaaggtgctgggcgccttcagtgatggcctggcccacctggacaacctgaagggcacctttgccaccctgtctgagctgcactgtgacaagctgcacgtggaccctgagaacttccggctgctgggcaatgtgctggtgtgtgtgctggcccaccactttgggaaggagttcaccccacctgtgcaggccgcctaccagaaggtggtggccggcgtggccaatgccctggcccacaagtaccactag

SEQ ID NO: 155081 - DNA, 273 bp, Artificial Sequence
  Description of Artificial Sequence: Synthetic coding sequence
atggtgcacctgaccccagaggagaagtctgctgtgacagccctgtggggcaaggtgaatgtggatgaggtgggcggggaggccctgggccgcctgctggtggtgtacccctggacccagcgcttctttgagagctttggagacctgagcaccccagatgctgtgatgggcaaccccaaggtgaaggcccacggcaagaaggtgctgggcgccttcagtgatggcctggcccacctggacaacctgaagggcacctttgccaccctgtcctag

SEQ ID NO: 155082 - DNA, 426 bp, Artificial Sequence
  Description of Artificial Sequence: Synthetic coding sequence
atggtgcacctgaccccagaggagaagacagctgtgaatgccctgtggggcaaggtgaatgtggatgctgtgggcggggaggccctgggccgcctgctggtggtgtacccctggacccagcgcttctttgagagctttggagacctgagcagcccagatgctgtgatgggcaaccccaaggtgaaggcccacggcaagaaggtgctgggcgccttcagtgatggcctggcccacctggacaacctgaagggcaccttcagccagctgtctgagctgcactgtgacaagctgcacgtggaccctgagaacttccgggtgtgcaagaaggtgcctgaggccctgcagatcggcagcacctgcctcttctacaaggagtacatgggcaaggagaagagcaaaggaacagtgcagggcatcaatggatag

SEQ ID NO: 155083 - DNA, 444 bp, Artificial Sequence
  Description of Artificial Sequence: Synthetic coding sequence
atggtgcacctgaccccagaggagaagacagctgtgaatgccctgtggggcaaggtgaatgtggatgctgtgggcggggaggccctgggccgcctgctggtggtgtacccctggacccagcgcttctttgagagctttggagacctgagcagcccagatgctgtgatgggcaaccccaaggtgaaggcccacggcaagaaggtgctgggcgccttcagtgatggcctggcccacctggacaacctgaagggcaccttcagccagctgtctgagctgcactgtgacaagctgcacgtggaccctgagaacttccggctgctgggcaatgtgctggtgtgtgtgctggccaggaactttgggaaggagttcaccccccagatgcaggccgcctaccagaaggtggtggccggcgtggccaatgccctggcccacaagtaccactag

SEQ ID NO: 155084 - DNA, 315 bp, Artificial Sequence
  Description of Artificial Sequence: Synthetic coding sequence
atggtgcacctgaccccagaggagaagacagctgtgaatgccctgtggggcaaggtgaatgtggatgctgtgggcggggaggccctgggccgcctgctggtggtgtacccctggacccagcgcttctttgagagctttggagacctgagcagcccagatgctgtgatgggcaaccccaaggtgaaggcccacggcaagaaggtgctgggcgccttcagtgatggcctggcccacctggacaacctgaagggcaccttcagccagctgtctgagctgcactgtgacaagctgcacgtggaccctgagaacttctag

SEQ ID NO: 155085 - DNA, 444 bp, Artificial Sequence
  Description of Artificial Sequence: Synthetic coding sequence
atggtgcacttcaccgctgaggagaaggctgctgtgaccagcctgtggagcaagatgaatgtggaggaggccggcggggaggccctgggccgcctgctggtggtgtacccctggacccagcgcttctttgacagctttggaaacctgagcagccccagcgccatcctgggcaaccccaaggtgaaggcccacggcaagaaggtgctgaccagctttggagatgccatcaagaacatggacaacctgaagccagcctttgccaagctgtctgagctgcactgtgacaagctgcacgtggaccctgagaacttcaagctgctgggcaatgtgatggtgatcatcctggccacccactttgggaaggagttcaccccagaggtgcaggccgcctggcagaagctggtgtctgctgtggccatcgccctggcccacaagtaccactag

SEQ ID NO: 155086 - DNA, 444 bp, Artificial Sequence; identical to SEQ ID NO: 155085
  Description of Artificial Sequence: Synthetic coding sequence

SEQ ID NO: 155087 - DNA, 264 bp, Artificial Sequence
  Description of Artificial Sequence: Synthetic coding sequence
atggtgcacttcaccgctgaggagaaggctgctgtgaccagcctgtggagcaagatgaatgtggaggaggccggcggggaggccctgggccgcctgctggtggtgtacccctggacccagcgcttctttgacagctttggaaacctgagcagccccagcgccatcctgggcaaccccaaggtgaaggcccacggcaagaaggtgctgaccagctttggagatgccatcaagaacatggacaacctgaagccagcctttgcctag

SEQ ID NO: 155088 - DNA, 444 bp, Artificial Sequence
  Description of Artificial Sequence: Synthetic coding sequence
atgggccacttcacagaggaggacaaggccaccatcaccagcctgtggggcaaggtgaatgtggaggatgctggaggagagaccctgggccgcctgctggtggtgtacccctggacccagcgcttctttgacagctttggaaacctgagcagcgccagcgccatcatgggcaaccccaaggtgaaggcccacggcaagaaggtgctgaccagcctgggagatgccaccaagcacctggatgacctgaagggcacctttgcccagctgtctgagctgcactgtgacaagctgcacgtggaccctgagaacttcaagctgctgggcaatgtgctggtgacagtgctggccatccactttgggaaggagttcaccccagaggtgcaggcctcctggcagaagatggtgacagctgtggccagcgccctgagcagccgctaccactag

SEQ ID NO: 155089 - DNA, 444 bp, Artificial Sequence
  Description of Artificial Sequence: Synthetic coding sequence
atgggccacttcacagaggaggacaaggccaccatcaccagcctgtggggcaaggtgaatgtggaggatgctggaggagagaccctgggccgcctgctggtggtgtacccctggacccagcgcttctttgacagctttggaaacctgagcagcgccagcgccatcatgggcaaccccaaggtgaaggcccacggcaagaaggtgctgaccagcctgggagatgccatcaagcacctggatgacctgaagggcacctttgcccagctgtctgagctgcactgtgacaagctgcacgtggaccctgagaacttcaagctgctgggcaatgtgctggtgacagtgctggccatccactttgggaaggagttcaccccagaggtgcaggcctcctggcagaagatggtgactggagtggccagcgccctgagcagccgctaccactag

SEQ ID NO: 155090 - DNA, 477 bp, Artificial Sequence
  Description of Artificial Sequence: Synthetic coding sequence
atgggccacttcacagaggaggacaaggccaccatcaccagcctgtggggcaaggtgaatgtggaggatgctggaggagagaccctgggccgcctgctggtggtgtacccctggacccagcgcttctttgacagctttggaaacctgagcagcgccagcgccatcatgggcaaccccaaggtgaaggcccacggcaagaaggtgctgaccagcctgggagatgccatcaagcacctggatgacctgaagggcacctttgcccagctgtctgagctgcactgtgacaagctgcacgtggaccctgagaacttcaagctgctgggcaatgtgctggtgacagtgctggccatccactttgggaaggagttcaccccagaggtgcaggcctcctggcagaagatggactggagcggccagtgccctgtgctgcagatccccctgagcagcctgcccatgatgcagagcttccagggctag

SEQ ID NO: 155091 - DNA, 414 bp, Artificial Sequence
  Description of Artificial Sequence: Synthetic coding sequence
atggtggtgctgggggagatgaagaggaaggtgctgcccctgcacttcctgcccttcatgaggctgctggtggtgtacccctggacccagcgcttctttgacagctttggaaacctgagcagcgccagcgccatcatgggcaaccccaaggtgaaggcccacggcaagaaggtgctgaccagcctgggagatgccatcaagcacctggatgacctgaagggcacctttgcccagctgtctgagctgcactgtgacaagctgcacgtggaccctgagaacttcaagctgctgggcaatgtgctggtgacagtgctggccatccactttgggaaggagttcaccccagaggtgcaggcctcctggcagaagatggtgactggagtggccagcgccctgagcagccgctaccactag

SEQ ID NO: 155092 - DNA, 444 bp, Artificial Sequence; identical to SEQ ID NO: 155089
  Description of Artificial Sequence: Synthetic coding sequence

SEQ ID NO: 155093 - DNA, 426 bp, Artificial Sequence
  Description of Artificial Sequence: Synthetic coding sequence
atgctgagcgcccaggagcgggcccagatcgcccaggtgtgggacctgattgctggccacgaggcccagtttggagctgagctgctgctgcggctcttcaccgtgtaccccagcaccaaggtgtacttcccccacctgagcgcctgccaggatgccacccagctgctgagccacggccagaggatgctggccgctgtgggcgctgctgtgcagcacgtggacaacctgcgggccgccctgagccccctggccgacctgcacgccctggtgctgcgggtggaccctgccaacttccccctgctgatccagtgcttccacgtggtgctggccagccacctgcaggatgagttcaccgtgcagatgcaggccgcctgggacaagttcctgactggagtggccgtggtgctgacagagaagtacagatag

SEQ ID NO: 155094 - DNA, 429 bp, Artificial Sequence
  Description of Artificial Sequence: Synthetic coding sequence
atggccctgtctgctgaggaccgggccctggtgcgggccctgtggaagaagctgggcagcaatgtgggcgtgtacaccacagaggccctggagaggaccttcctggccttccctgccaccaagacctacttcagccacctggacctgagccctggcagcagccaggtgcgggcccacggccagaaggtggctgatgccctgagcctggccgtggagcggctggatgacctgccccacgccctgagcgccctgagccacctgcacgcctgccagctgcgggtggaccctgccagcttccagctgctgggccactgcctgctggtgaccctggcccggcactacccaggggacttcagccctgccctgcaggccagcctggacaagttcctgagccacgtgatcagcgccctggtgtctgagtacagatag

SEQ ID NO: 155095 - DNA, 429 bp, Artificial Sequence
  Description of Artificial Sequence: Synthetic coding sequence
atgagcctgaccaagacagagaggaccatcatcgtgtccatgtgggccaagatcagcacccaggccgacaccatcggcacagagaccctggagcggctcttcctgagccacccccagaccaagacctacttcccccactttgacctgcaccctggcagcgcccagctgcgggcccacggcagcaaggtggtggccgctgtgggagatgctgtgaagagcattgatgacattggaggagccctgagcaagctgtctgagctgcacgcctacatcctgcgggtggaccctgtgaacttcaagctgctgagccactgcctgctggtgaccctggccgcccgcttccctgctgacttcaccgctgaggcccacgccgcctgggacaagttcctgtctgtggtgtcctctgtgctgacagagaagtacagatag

SEQ ID NO: 155096 - DNA, 1389 bp, Artificial Sequence
  Description of Artificial Sequence: Synthetic coding sequence
atggcccgggtgctgggcgcccctgtggccctgggcctgtggagcctgtgctggagcctggccatcgccacccccctgccccccaccagcgcccacggcaatgtggccgagggggagaccaagccagaccctgatgtgacagagcgctgcagtgatggctggagctttgatgccaccaccctggatgacaatggcaccatgctgttcttcaagggggagtttgtgtggaagagccacaagtgggaccgggagctgatcagcgagcgctggaagaacttccccagccctgtggatgctgccttccggcagggccacaacagcgtcttcctgatcaagggggacaaggtgtgggtgtacccacctgagaagaaggagaagggctaccccaagctgctgcaggatgagttccctggcatccccagccccctggatgctgctgtggagtgccacagaggagagtgccaggccgagggcgtgctcttcttccagggcgaccgggagtggttctgggacctggccaccggcaccatgaaggagaggtcctggccagctgtgggcaactgcagcagcgccctgcgctggctgggccgctactactgcttccagggcaaccagttcctgcgctttgatcctgtgcggggggaggtgcccccacgctaccccagagatgtgcgggactacttcatgccctgccccggccggggccacggccacagaaatggcaccggccacggcaacagcacccaccacggccctgagtacatgcgctgcagcccccacctggtgctgagcgccctgaccagtgacaaccacggggccacctacgccttcagcggcacccactactggaggctggacaccagcagagatggctggcacagctggcccatcgcccaccagtggccccagggccccagcgctgtggatgctgccttctcctgggaggagaagctgtacctggtgcagggcacccaggtgtatgtgttcctgaccaagggcggctacaccctggtgtctggctaccccaagaggctggagaaggaggtgggcacccctcatggcatcatcctggacagcgtggatgctgccttcatctgccccggcagcagccggctgcacatcatggccggccggcggctgtggtggctggacctgaagagcggggcccaggccacctggacagagctgccctggccccatgagaaggtggatggagccctgtgcatggagaagagcctgggccccaacagctgcagcgccaatggacctggcctgtacctgattcatggccccaacctgtactgctacagtgatgtggagaagctgaatgctgccaaggccctgccccagccccagaatgtgaccagcctgctgggctgcacccactag

SEQ ID NO: 155097 - DNA, 765 bp, Artificial Sequence
  Description of Artificial Sequence: Synthetic coding sequence
atggcccgggtgctgggcgcccctgtggccctgggcctgtggagcctgtgctggagcctggccatcgccacccccctgccccccaccagcgcccacggcaatgtggccgagggggagaccaagccagaccctgatgtgacagagcgctgcagtgatggctggagctttgatgccaccaccctggatgacaatggcaccatgctgttcttcaagggggagtttgtgtggaagagccacaagtgggaccgggagctgatcagcgagcgctggaagaacttccccagccctgtggatgctgccttccggcagggccacaacagcgtcttcctgatcaagggggacaaggtgtgggtgtacccacctgagaagaaggagaagggctaccccaagctgctgcaggatgagttccctggcatccccagccccctggatgctgctgtggagtgccacagaggagagtgccaggccgagggcgtgctcttcttccagggcgaccgggagtggttctgggacctggccaccggcaccatgaaggagaggtcctggccagctgtgggcaactgcagcagcgccctgcgctggctgggccgctactactgcttccagggcaaccagttcctgcgctttgatcctgtgcggggggaggtgcccccacgctaccccagagatgtgcgggactacttcatgccctgccccggccggggccacggccacagaaatggcaccggccacggcaacagcatctgtgctgtggcccacatctag

SEQ ID NO: 155098 - DNA, 1353 bp, Artificial Sequence
  Description of Artificial Sequence: Synthetic coding sequence
atgtggctgaaggtgttcaccaccttcctgagctttgccaccggggcctgcagcggcctgaaggtgacagtgcccagccacacagtgcacggcgtgcggggccaggccctgtacctgcctgtgcactacggcttccacaccccagccagtgacatccagatcatctggctgtttgagcggccccacaccatgcccaagtacctgctgggctctgtgaacaagtctgtggtgcctgacctggagtaccagcacaagttcaccatgatgcccccaaatgccagcctgctgatcaaccccctgcagttcccagatgagggcaactacatcgtgaaggtgaacatccagggcaatggcaccctgagcgccagccagaagatccaggtgacagtggatgatcctgtgaccaagcctgtggtgcagatccaccccccatctggagctgtggagtatgtgggcaacatgaccctgacctgccacgtggagggcggcacccggctggcctaccagtggctgaagaatggccggcctgtgcacaccagcagcacctacagcttcagcccccagaacaacaccctgcacatcgcccctgtgaccaaggaggacatcggcaactacagctgcctggtgaggaaccctgtgtctgagatggagagtgacatcatcatgcccatcatctactacggcccctacggcctgcaggtgaacagcgacaagggcctgaaggtgggggaggtgttcaccgtggacctgggggaggccatcctgtttgactgcagcgctgacagccacccccccaacacctacagctggatccggaggacagacaacaccacctacatcatcaagcacggcccccggctggaggtggccagcgagaaggtggcccagaagaccatggactatgtgtgctgtgcctacaacaacatcaccggccggcaggatgagacccacttcaccgtcatcatcacctctgtgggcctggagaagctggcccagaagggcaagagcctgagccccctggccagcatcaccggcatcagcctcttcctgatcatctccatgtgcctgctcttcctgtggaagaagtaccagccctacaaggtgatcaagcagaagctggagggccggcctgagacagagtacaggaaggcccagaccttcagcggccatgaagatgccctggatgactttggcatctatgaatttgtggccttcccagatgtgtctggagtgagccgcatccccagccgctctgtgcctgccagtgactgtgtgtctggccaggacctgcacagcacagtgtatgaagtcatccagcacatcccagcccagcagcaggaccaccctgagtag

SEQ ID NO: 155099 - DNA, 1389 bp, Artificial Sequence
  Description of Artificial Sequence: Synthetic coding sequence
atgggccaggatgccttcatggagccctttggagacaccctgggcgtcttccagtgcaagatctacctgctgctgtttggagcctgcagcggcctgaaggtgacagtgcccagccacacagtgcacggcgtgcggggccaggccctgtacctgcctgtgcactacggcttccacaccccagccagtgacatccagatcatctggctgtttgagcggccccacaccatgcccaagtacctgctgggctctgtgaacaagtctgtggtgcctgacctggagtaccagcacaagttcaccatgatgcccccaaatgccagcctgctgatcaaccccctgcagttcccagatgagggcaactacatcgtgaaggtgaacatccagggcaatggcaccctgagcgccagccagaagatccaggtgacagtggatgatcctgtgaccaagcctgtggtgcagatccaccccccatctggagctgtggagtatgtgggcaacatgaccctgacctgccacgtggagggcggcacccggctggcctaccagtggctgaagaatggccggcctgtgcacaccagcagcacctacagcttcagcccccagaacaacaccctgcacatcgcccctgtgaccaaggaggacatcggcaactacagctgcctggtgaggaaccctgtgtctgagatggagagtgacatcatcatgcccatcatctactacggcccctacggcctgcaggtgaacagcgacaagggcctgaaggtgggggaggtgttcaccgtggacctgggggaggccatcctgtttgactgcagcgctgacagccacccccccaacacctacagctggatccggaggacagacaacaccacctacatcatcaagcacggcccccggctggaggtggccagcgagaaggtggcccagaagaccatggactatgtgtgctgtgcctacaacaacatcaccggccggcaggatgagacccacttcaccgtcatcatcacctctgtgggcctggagaagctggcccagaagggcaagagcctgagccccctggccagcatcaccggcatcagcctcttcctgatcatctccatgtgcctgctcttcctgtggaagaagtaccagccctacaaggtgatcaagcagaagctggagggccggcctgagacagagtacaggaaggcccagaccttcagcggccatgaagatgccctggatgactttggcatctatgaatttgtggccttcccagatgtgtctggagtgagccgcatccccagccgctctgtgcctgccagtgactgtgtgtctggccaggacctgcacagcacagtgtatgaagtcatccagcacatcccagcccagcagcaggaccaccctgagtag

SEQ ID NO: 155100 - DNA, 1104 bp, Artificial Sequence
  Description of Artificial Sequence: Synthetic coding sequence
atggcctacagagtgctgggccgggccggccccccccagccccggcgggcccggcggctgctgtttgccttcaccctgagcctgagctgcacctacctgtgctacagcttcctgtgctgctgtgatgacctgggccgcagccggctgctgggcgccccccgctgcctgcggggccccagcgctgggggccagaagctgctgcagaagagccggccctgtgaccccagcggccccaccccatctgagcccagcgcccccagcgccccagctgctgctgtgcctgccccccggctgagcggcagcaaccacagcggcagccccaagctgggcaccaagaggctgccccaggccctgattgtgggcgtgaagaagggcggcaccagggctgtgctggagttcatccgggtgcacccagatgtgcgggccctgggcacagagccccacttctttgacaggaactacggccggggcctggactggtaccgcagcctgatgcccaggaccctggagagccagatcaccctggagaagacccccagctactttgtgacccaggaggccccccggcgcatcttcaacatgagccgggacaccaagctgattgtggtggtgagaaatcctgtgacccgggccatcagtgactacacccagaccctgagcaagaagccagacatccccacctttgagggcctgtccttcaggaacagaaccctgggcctggtggatgtgtcctggaatgccatccgcatcggcatgtatgtgctgcacctggagagctggctgcagtacttccccctggcccagatccactttgtgtctggagagcggctcatcacagatcctgctggggagatgggccgggtgcaggacttcctgggcatcaagcgcttcatcacagacaagcacttctacttcaacaagaccaagggcttcccctgcctgaagaagacagagagcagcctgctgccccgctgcctgggcaagagcaagggccgcacccacgtgcagattgatcctgaggtgattgaccagctgcgggagttctaccggccctacaacatcaagttctatgaaacagtgggccaggacttccgctgggagtag

SEQ ID NO: 155101 - DNA, 1035 bp, Artificial Sequence
  Description of Artificial Sequence: Synthetic coding sequence
cctccagcccgggcccacggggccatggcctacagagtgctgggccgggccggccccccccagccccggcgggcccggcggctgctgtttgccttcaccctgagcctgagctgcacctacctgtgctacagcttcctgtgctgctgtgatgacctgggccgcagccggctgctgggcgccccccgctgcctgcggggccccagcgctgggggccagaagctgctgcagaagagccggccctgtgaccccagcggccccaccccatctgagcccagcgcccccagcgccccagctgctgctgtgcctgccccccggctgagcggcagcaaccacagcggcagccccaagctgggcaccaagaggctgccccaggccctgattgtgggcgtgaagaagggcggcaccagggctgtgctggagttcatccgggtgcacccagatgtgcgggccctgggcacagagccccacttctttgacaggaactacggccggggcctggactggtaccgcagcctgatgcccaggaccctggagagccagatcaccctggagaagacccccagctactttgtgacccaggaggccccccggcgcatcttcaacatgagccgggacaccaagctgattgtggtggtgagaaatcctgtgacccgggccatcagtgactacacccagaccctgagcaagaagccagacatccccacctttgagggcctgtccttcaggaacagaaccctgggcctggtggatgtgtcctggaatgccatccgcatcggcatgtatgtgctgcacctggagagctggctgcagtacttccccctggcccagatccactttgtgtctggagagcggctcatcacagatcctgctggggagatgggccgggtgcaggacttcctgggcatcaagcgcttcatcacagacaagcacttctacttcaacaagaccaagggcttcccctgcctgaagaaccgcatcgagcccccagcctccatgctgggccagatcaagcgggagaacagctgcacagactag

SEQ ID NO: 155102 - DNA, 1221 bp, Artificial Sequence
  Description of Artificial Sequence: Synthetic coding sequence
atggcccctcctggccctgccagcgccctgagcaccagcgctgagcccctgagccgcagcatcttcaggaagttcctgctgatgctgtgcagcctgctgaccagcctgtatgtgttctactgcctggccgagcgctgccagaccctgagcggccctgtggtgggcctgagcggcggcggggaggaggccggggcccctgggggcggcgtgctggccggcggcccccgggagctggccgtgtggccagctgctgcccagaggaagaggctgctgcagctgccccagtggaggagaagaagacctccagcccccagagatgatggagaggaggccgcctgggaggaggagagccctggcctgagcggcggccctgggggcagcggggccggcagcacagtggccgaggcccctcctggcaccctggccctgctgctggatgagggcagcaagcagctgccccaggccatcatcatcggcgtgaagaagggcggcacccgggccctgctggagttcctgcgggtgcacccagatgtgcgggctgtgggcgctgagccccacttctttgacaggagctatgacaagggcctggcctggtacagagacctgatgcccaggaccctggatggccagatcaccatggagaagacccccagctactttgtgacccgggaggccccagcccgcatcagcgccatgagcaaggacaccaagctgattgtggtggtgcgggaccctgtgacccgggccatcagtgactacacccagaccctgagcaagaggccagacatccccacctttgagagcctgaccttcaagaacagaacagctggcctgattgacacctcctggagcgccatccagatcggcatctatgccaagcacctggagcactggctgcggcacttccccatccggcagatgctgtttgtgtctggagagcggctcatcagtgaccctgctggggagctgggccgggtgcaggacttcctgggcctgaagaggatcatcacagacaagcacttctacttcaacaagaccaagggcttcccctgcctgaagaaggccgagggcagcagccggccccactgcctgggcaagaccaagggccgcacccaccctgagattgaccgggaggtggtgcggcggctgcgggagttctaccggcccttcaacctgaagttctaccagatgacaggccatgactttggctgggatggatag

SEQ ID NO: 155103 - DNA, 1173 bp, Artificial Sequence
  Description of Artificial Sequence: Synthetic coding sequence
atgggccagaggctgagcggcggccgcagctgcctggatgtgcccggccgcctgctgccccagcccccacctcctcctcctcctgtgcggaggaagctggccctgctgtttgccatgctgtgtgtgtggctgtacatgttcctgtacagctgtgccggcagctgtgccgccgcccctggcctgctgctgctgggcagcggcagccgggccgcccatgaccccccagccctggccacagccccagatggcaccccaccccggctgcccttccgggcccccccagccacccccctggccagcggcaaggagatggccgagggcgccgccagccctgaggagcagagccctgaggtgcctgacagccccagccccatcagcagcttcttcagcggcagcggcagcaagcagctgccccaggccatcatcattggagtgaagaagggcggcacccgggccctgctggagttcctgcgggtgcacccagatgtgcgggctgtgggcgctgagccccacttctttgacaggagctatgacaagggcctggcctggtacagagacctgatgcccaggaccctggatggccagatcaccatggagaagacccccagctactttgtgacccgggaggccccagcccgcatcagcgccatgagcaaggacaccaagctgattgtggtggtgcgggaccctgtgacccgggccatcagtgactacacccagaccctgagcaagaggccagacatccccacctttgagagcctgaccttcaagaacagaacagctggcctgattgacacctcctggagcgccatccagatcggcatctatgccaagcacctggagcactggctgcggcacttccccatccggcagatgctgtttgtgtctggagagcggctcatcagtgaccctgctggggagctgggccgggtgcaggacttcctgggcctgaagaggatcatcacagacaagcacttctacttcaacaagaccaagggcttcccctgcctgaagaaggccgagggcagcagccggccccactgcctgggcaagaccaagggccgcacccaccctgagattgaccgggaggtggtgcggcggctgcgggagttctaccggcccttcaacctgaagttctaccagatgactggacatgactttggctgggactag

SEQ ID NO: 155104 - DNA, 1173 bp, Artificial Sequence; identical to SEQ ID NO: 155103
  Description of Artificial Sequence: Synthetic coding sequence

SEQ ID NO: 155105 - DNA, 1371 bp, Artificial Sequence
  Description of Artificial Sequence: Synthetic coding sequence
atggcccgctggccagcccctcctcctcctcctcctcctcctccacccctggccgcccctcctcctcctggggccagcgccaagggccccccagccaggaagctgctcttcatgtgcaccctgagcctgtctgtgacctacctgtgctacagcctgctgggcggcagcggcagcctgcagttccccctggccctgcaggagagccctggagctgctgctgagcccccacccagccccccaccacccagcctgctgcccacccctgtgcggctgggcgcccccagccagcccccagcccccccacccctggacaatgccagccacggggagcccccagagcccccagagcagcctgctgcccctggaacagatggctggggcctgcccagcggcggcggcggggcccaggatgcctggctgcggacccccctggcccccagcgagatgatcacagcccagagcgccctgcctgagcgggaggcccaggagagcagcaccacagatgaggacctggccggccggcgggccgccaacggcagcagcgagcggggcggcgctgtgtccaccccagactatggagagaagaagctgccccaggccctgatcattggagtgaagaagggcggcacccgggccctgctggaggccatccgggtgcacccagatgtgcgggctgtgggcgtggagccccacttctttgacagaaattatgagaagggcctggagtggtacagaaatgtgatgcccaagaccctggatggccagatcaccatggagaagacccccagctactttgtgaccaatgaggcccccaagaggatccacagcatggccaaggacatcaagctgattgtggtggtgaggaaccctgtgacccgggccatcagtgactacacccagaccctgagcaagaagccagagatccccacctttgaggtgctggccttcaagaacagaaccctgggcctgattgatgcctcctggagcgccatcagaattggcatctatgccctgcacctggagaactggctgcagtacttccccctgagccagatcctgtttgtgtctggagagcggctgattgtggaccctgctggggagatggccaaggtgcaggacttcctgggcctgaagagggtggtgacagagaagcacttctacttcaacaagaccaagggcttcccctgcctgaagaagccagaggacagcagcgccccccgctgcctgggcaagagcaaaggaagaacccaccccagaattgatcctgatgtgatccaccggctgaggaagttctacaagcccttcaacctgatgttctaccagatgacaggccaggacttccagtgggagcaggaggagggggacaagtag

SEQ ID NO: 155106 - DNA, 1041 bp, Artificial Sequence
  Description of Artificial Sequence: Synthetic coding sequence
atgctgttcaagcagcaggcctggctgcggcagaagctgctggtgctgggcagcctggccgtgggcagcctgctgtacctggtggcccgggtgggcagcctggaccggctgcagcccatctgccccatcgagggccgcctgggcggggcccggacccaggccgagttccccctgcgggccctgcagttcaagaggggcctgctgcacgagttcagaaaaggaaatgccagcaaggagcaggtgcggctgcatgacctggtgcagcagctgcccaaggccatcatcatcggcgtgaggaagggcggcacccgggccctgctggagatgctgaacctgcaccctgctgtggtgaaggccagccaggagatccacttctttgacaatgatgagaactacggcaagggcatcgagtggtacaggaagaagatgcccttctcctacccccagcagatcaccatcgagaagagccctgcctacttcatcacagaggaggtgcctgagcgcatctacaagatgaacagcagcatcaagctgctgatcatcgtgcgggagcccaccacccgggccatcagtgactacacccaggtgctggagggcaaggagaggaagaacaagacctactacaagtttgagaagctggccatcgaccccaacacctgtgaggtgaacaccaagtacaaggctgtgaggaccagcatctacaccaagcacctggagcgctggctgaagtacttccccatcgagcagttccacgtggtggatggagacaggctcatcacagagcccctgcctgagctgcagctggtggagaagttcctgaacctgcccccacgcatcagccagtacaacctgtacttcaatgccacccggggcttctactgcctgcgcttcaacatcatcttcaacaagtgcctggccggcagcaagggccgcatccaccctgaggtggaccccagcgtcatcaccaagctgaggaagttcttccaccccttcaaccagaagttctaccagatcactggaagaaccctgaactggccctag

SEQ ID NO: 155107 - DNA, 1041 bp, Artificial Sequence; identical to SEQ ID NO: 155106
  Description of Artificial Sequence: Synthetic coding sequence

SEQ ID NO: 155108 - DNA, 969 bp, Artificial Sequence
  Description of Artificial Sequence: Synthetic coding sequence
atgctgttcatcaagttcatccacctggaggtgttctccatgcctgagcgggccatcgcccggcatgaggtgcgggagattgagcagaggcacaccatggatggcccccggcaggatgccaccctggatgaggaggaggacatggtgatcatctacaacagagtgcccaagacagccagcaccagcttcaccaacatcgcctatgacctgtgtgccaagaacaagtaccacgtgctgcacatcaacaccaccaagaacaaccctgtgatgagcctgcaggaccaggtgcgctttgtgaagaacatcacctcctggaaggagatgaagccaggcttctaccacggccacgtgtcctacctggactttgccaagtttggagtgaagaagaagcccatctacatcaacgtcatccgggaccccatcgagcggctggtgtcctactactacttcctgcgctttggagatgactacagacctggcctgcggcggaggaagcagggcgacaagaagacctttgatgaatgtgtggccgagggcggcagtgactgtgcccctgagaagctgtggctgcagatccccttcttctgtggccacagcagcgagtgctggaatgtgggcagccgctgggccatggaccaggccaagtacaacctgatcaatgagtacttcctggtgggcgtgacagaggagctggaggacttcatcatgctgctggaggccgccctgccccgcttcttccggggggccacagagctgtacagaacagccccagacacagccacccccagccaccgccacggccccatctgtggcagcaagagcatcagcagcctgctggtgaaggtgtcccctgtgtgcaaggacagccactgccactgccggcggggcaccggcacccccaagggggagaccctggccaccctggccccctgcagccagagctggagctctgtgacccaccgctggtag

SEQ ID NO: 155109 - DNA, 912 bp, Artificial Sequence
  Description of Artificial Sequence: Synthetic coding sequence
atgctgttcatcaagttcatccacctggaggtgttctccatgcctgagcgggccatcgcccggcatgaggtgcgggagattgagcagaggcacaccatggatggcccccggcaggatgccaccctggatgaggaggaggacatggtgatcatctacaacagagtgcccaagacagccagcaccagcttcaccaacatcgcctatgacctgtgtgccaagaacaagtaccacgtgctgcacatcaacaccaccaagaacaaccctgtgatgagcctgcaggaccaggtgcgctttgtgaagaacatcacctcctggaaggagatgaagccaggcttctaccacggccacgtgtcctacctggactttgccaagtttggagtgaagaagaagcccatctacatcaacgtcatccgggaccccatcgagcggctggtgtcctactactacttcctgcgctttggagatgactacagacctggcctgcggcggaggaagcagggcgacaagaagacctttgatgaatgtgtggccgagggcggcagtgactgtgcccctgagaagctgtggctgcagatccccttcttctgtggccacagcagcgagtgctggaatgtgggcagccgctgggccatggaccaggccaagtacaacctgatcaatgagtacttcctggtgggcgtgacagaggagctggaggacttcatcatgctgctggaggccgccctgccccgcttcttccggggggccacagagctgtacagaacagccccagacacagccacccccagccaccgccacggccccatctgtggcagcaagagcatcagcagcctgctggtgaaggtgtcccctgtgtgcaaggacagccactgcctgggcaagtgcagcagaaatggcctgtctgctgtgtag

SEQ ID NO: 155110 - DNA, 1071 bp, Artificial Sequence
  Description of Artificial Sequence: Synthetic coding sequence
atgggcctgctgcgcatcatgatgccacccaagctgcagctgctggccgtggtggcctttgctgtggccatgctgttcctggagaaccagatccagaagctggaggagagccgcagcaagctggagcgggccatcgcccggcatgaggtgcgggagattgagcagaggcacaccatggatggcccccggcaggatgccaccctggatgaggaggaggacatggtgatcatctacaacagagtgcccaagacagccagcaccagcttcaccaacatcgcctatgacctgtgtgccaagaacaagtaccacgtgctgcacatcaacaccaccaagaacaaccctgtgatgagcctgcaggaccaggtgcgctttgtgaagaacatcacctcctggaaggagatgaagccaggcttctaccacggccacgtgtcctacctggactttgccaagtttggagtgaagaagaagcccatctacatcaacgtcatccgggaccccatcgagcggctggtgtcctactactacttcctgcgctttggagatgactacagacctggcctgcggcggaggaagcagggcgacaagaagacctttgatgaatgtgtggccgagggcggcagtgactgtgcccctgagaagctgtggctgcagatccccttcttctgtggccacagcagcgagtgctggaatgtgggcagccgctgggccatggaccaggccaagtacaacctgatcaatgagtacttcctggtgggcgtgacagaggagctggaggacttcatcatgctgctggaggccgccctgccccgcttcttccggggggccacagagctgtacagaacaggcaagaagagccacctgaggaagaccacagagaagaagctgcccaccaagcagaccatcgccaagctgcagcagagcgacatctggaagatggagaatgagttctatgaatttgccctggagcagttccagttcatccgggcccatgctgtgcgggagaaggatggagacctgtacatcctggcccagaacttcttctatgagaagatctaccccaagagcaactag

SEQ ID NO: 155111 - DNA, 690 bp, Artificial Sequence
  Description of Artificial Sequence: Synthetic coding sequence
atgggcctgctgcgcatcatgatgccacccaagctgcagctgctggccgtggtggcctttgctgtggccatgctgttcctggagaaccagatccagaagctggaggagagccgcagcaagctggagcgggccatcgcccggcatgaggtgcgggagattgagcagaggcacaccatggatggcccccggcaggatgccaccctggatgaggaggaggacatggtgatcatctacaacagagtgcccaagacagccagcaccagcttcaccaacatcgcctatgacctgtgtgccaagaacaagtaccacgtgctgcacatcaacaccaccaagaacaaccctgtgatgagcctgcaggaccaggtgcgctttgtgaagaacatcacctcctggaaggagatgaagccaggcttctaccacggccacgtgtcctacctggactttgccaagtttggagtgaagaagaagcccatctacatcaacgtcatccgggaccccatcgagcggctggtgtcctactactacttcctgcgctttggagatgactacagacctggcctgcggcggaggaagcagggcgacaagaagacctttgatgaatgtgtggccgagggcggcagtgactgtgcccctgagaagctgtggctgcagatccccttcttctgtggccacagcagcgagtgctggtag

SEQ ID NO: 155112 - DNA, 1236 bp, Artificial Sequence
  Description of Artificial Sequence: Synthetic coding sequence
atgagaagaagaagagctgggggccgcaccatggtggagcgggccagcaagtttgtgctggtggtggccggctctgtgtgcttcatgctgatcctgtaccagtatgccggccctggcctgagcctgggcgcccctgggggccgggcccccccagatgacctggacctcttccccaccccagacccccactatgagaagaagtactacttccctgtgcgggagctggagaggagcctgcgctttgacatgaagggagatgatgtgattgtgttcctgcacatccagaagacaggaggcaccaccttcggccgccacctggtgcagaatgtgcggctggaggtgccctgtgactgccggcccggccagaagaagtgcacctgctaccggcccaacagaagagagacctggctgttcagccgcttcagcacaggctggagctgtggcctgcatgctgactggacagagctgaccaactgtgtgcctggggtgctggaccggcgggacagcgctgccctgcggacccccaggaagttctactacatcaccctgctgcgggaccctgtgagccgctacctgtctgagtggaggcatgtgcagagaggagccacctggaagaccagcctgcacatgtgtgatggccgcacccccaccccagaggagctgcccccctgctatgagggcacagactggagcggctgcaccctgcaggagttcatggactgcccctacaacctggccaacaaccggcaggtgaggatgctggccgacctgagcctggtgggctgctacaacctgtccttcatccctgagggcaagagggcccagctgctgctggagagcgccaagaagaacctgcggggcatggccttcttcggcctgacagagttccagaggaagacccagtacctgtttgagaggaccttcaacctgaagttcatccggcccttcatgcagtacaacagcacccgggccggcggcgtggaggtggatgaggacaccatcagaagaattgaggagctgaatgacctggacatgcagctgtatgactatgccaaggacctcttccagcagcgctaccagtacaagaggcagctggagcggcgggagcagaggctgcggagccgggaggagcggctgctgcaccgggccaaggaggccctgccccgggaggatgctgatgagcccggccgggtgcccacagaggactacatgagccacatcatcgagaagtggtag

SEQ ID NO: 155113 - DNA, 831 bp, Artificial Sequence
  Description of Artificial Sequence: Synthetic coding sequence
atgctgttcctgtttgctgtgattgtgctgcagtatgtgtgccctggaacagagtgccagctgctgcggctgcaggccttcagcagccctgtgcctgacccctacagaagtgaagatgagagcagcgccaggtttgtgccccgctacaacttcaccaggggggacctgctgaggaaggtggactttgacatcaagggagatgacctgattgtgttcctgcacatccagaagacaggaggcaccaccttcggccgccacctggtgaggaacatccagctggagcagccctgtgagtgccgggtgggccagaagaagtgcacctgccacaggcctgggaagcgggagacctggctgttcagccgcttcagcacaggctggagctgtggcctgcacgccgactggacagagctgaccagctgtgtgcccagcgtggtggatggcaagagagatgcccggctgcggcccagccgctggaggatcttccagatcctggatgctgccagcaaggacaagaggggcagccccaacaccaatgctggggccaacagccccagcagcaccaagaccaggaacaccagcaagagcggcaagaacttccactacatcaccatcctgcgggaccctgtgagccgctacctgtctgagtggaggcatgtgcagagaggagccacctggaaggccagcctgcacgtgtgtgatggccggccccccaccagcgaggagctgcccagctgctacacaggagatgactggagcggctgccccctgaaggagttcatggactgcccctacaacctggccaacaacagatgtgcctgcagccccacctag

SEQ ID NO: 155114 - DNA, 1389 bp, Artificial Sequence
  Description of Artificial Sequence: Synthetic coding sequence
atggatgagaagagcaacaagctgctgctggccctggtgatgctgttcctgtttgctgtgattgtgctgcagtatgtgtgccccggcacagagtgccagctgctgcggctgcaggccttcagcagccctgtgcctgacccctacagaagtgaagatgagagcagcgccaggtttgtgccccgctacaacttcaccaggggggacctgctgaggaaggtggactttgacatcaagggagatgacctgattgtgttcctgcacatccagaagacaggaggcaccaccttcggccgccacctggtgaggaacatccagctggagcagccctgtgaatgtcgggtgggccagaagaagtgcacctgccacaggcctgggaagcgggagacctggctgttcagccgcttcagcacaggctggagctgtggcctgcatgctgactggacagagctgaccagctgtgtgcccagcgtggtggatggcaagagagatgcccggctgcggcccagccgctggaggatcttccagatcctggatgctgccagcaaggacaagaggggcagccccaacaccaatgctggggccaacagccccagcagcaccaagaccaggaacaccagcaagagcggcaagaacttccactacatcaccatcctgcgggaccctgtgagccgctacctgtctgagtggaggcatgtgcagagaggagccacctggaaggccagcctgcacgtgtgtgatggccggccccccaccagcgaggagctgcccagctgctacacaggagatgactggagcggctgccccctgaaggagttcatggactgcccctacaacctggccaacaaccggcaggtgaggatgctgagtgacctgaccctggtgggctgctacaacctgtctgtgatgcctgagaagcagaggaacaaggtgctgctggagagcgccaagagcaacctgaagcacatggccttcttcggcctgacagagttccagaggaagacccagtacctgtttgagaagaccttcaacatgaacttcatcagccccttcacccagtacaacaccacccgggccagctctgtggagatcaatgaggagatccagaagagaattgagggcctgaacttcctggacatggagctgtacagctatgccaaggacctcttcctgcagcgctaccagttcatgaggcagaaggagcaccaggaggcccggaggaagaggcaggagcagaggaagttcctgaagggccgcctgctgcagacccacttccagagccagggccagggccagagccagaaccccaaccagaaccagagcaaggagcagaatgacaacaccagcaatggcaccaatgactacatcggctctgtggagaagtggaggtag

SEQ ID NO: 155115 - DNA, 1818 bp, Artificial Sequence
  Description of Artificial Sequence: Synthetic coding sequence
atggccctgcctgcctgtgctgtgcgggagtttgagcccccccggcagcctgagcggggggcccctgtgaggaccacctgccccaggaggcacagccgggtggaggccgagctggccgccagcaggcctggctctgtggccgcctctgtgcgggccggccccccccggggcgtgagccacggcttccacacccggcccctgctggacaagcccaggaaggccagcagcagcctggccggggccgcctgtgcccccctgtttgccctgctgagccggggcagaagaagaaggatgcacgtgctgcggcggcgctgggacctgggcagcctgtgccgggccctgctgacccggggcctggccgccctgggccacagcctgaagcacgtgctgggcgccatcttcagcaagatcttcggccccatggcctctgtgggcaacatggatgagaagagcaacaagctgctgctggccctggtgatgctgttcctgtttgctgtgattgtgctgcagtatgtgtgccccggcacagagtgccagctgctgcggctgcaggccttcagcagccctgtgcctgacccctacagaagtgaagatgagagcagcgccaggtttgtgccccgctacaacttcaccaggggggacctgctgaggaaggtggactttgacatcaagggagatgacctgattgtgttcctgcacatccagaagacaggaggcaccaccttcggccgccacctggtgaggaacatccagctggagcagccctgtgaatgtcgggtgggccagaagaagtgcacctgccacaggcctgggaagcgggagacctggctgttcagccgcttcagcacaggctggagctgtggcctgcatgctgactggacagagctgaccagctgtgtgcccagcgtggtggatggcaagagagatgcccggctgcggcccagcaggaacttccactacatcaccatcctgcgggaccctgtgagccgctacctgtctgagtggaggcatgtgcagagaggagccacctggaaggccagcctgcacgtgtgtgatggccggccccccaccagcgaggagctgcccagctgctacacaggagatgactggagcggctgccccctgaaggagttcatggactgcccctacaacctggccaacaaccggcaggtgaggatgctgagtgacctgaccctggtgggctgctacaacctgtctgtgatgcctgagaagcagaggaacaaggtgctgctggagagcgccaagagcaacctgaagcacatggccttcttcggcctgacagagttccagaggaagacccagtacctgtttgagaagaccttcaacatgaacttcatcagccccttcacccagtacaacaccacccgggccagctctgtggagatcaatgaggagatccagaagagaattgagggcctgaacttcctggacatggagctgtacagctatgccaaggacctcttcctgcagcgctaccagttcatgaggcagaaggagcaccaggaggcccggaggaagaggcaggagcagaggaagttcctgaagggccgcctgctgcagacccacttccagagccagggccagggccagagccagaaccccaaccagaaccagagccagaaccccaaccccaatgccaaccagaacctgacccagaacctgatgcagaacctgacccagagcctgagccagaaggaaaatcgggagagccccaagcagaacagcggcaaggagcagaatgacaacaccagcaatggcaccaatgactacatcggctctgtggagaagtggaggtag

SEQ ID NO: 155116 - DNA, 1380 bp, Artificial Sequence
  Description of Artificial Sequence: Synthetic coding sequence
atggatgagaagagcaacaagctgctgctggccctggtgatgctgttcctgtttgctgtgattgtgctgcagtatgtgtgccccggcacagagtgccagctgctgcggctgcaggccttcagcagccctgtgcctgacccctacagaagtgaagatgagagcagcgccaggtttgtgccccgctacaacttcaccaggggggacctgctgaggaaggtggactttgacatcaagggagatgacctgattgtgttcctgcacatccagaagacaggaggcaccaccttcggccgccacctggtgaggaacatccagctggagcagccctgtgaatgtcgggtgggccagaagaagtgcacctgccacaggcctgggaagcgggagacctggctgttcagccgcttcagcacaggctggagctgtggcctgcatgctgactggacagagctgaccagctgtgtgcccagcgtggtggatggcaagagagatgcccggctgcggcccagcaggaacttccactacatcaccatcctgcgggaccctgtgagccgctacctgtctgagtggaggcatgtgcagagaggagccacctggaaggccagcctgcacgtgtgtgatggccggccccccaccagcgaggagctgcccagctgctacacaggagatgactggagcggctgccccctgaaggagttcatggactgcccctacaacctggccaacaaccggcaggtgaggatgctgagtgacctgaccctggtgggctgctacaacctgtctgtgatgcctgagaagcagaggaacaaggtgctgctggagagcgccaagagcaacctgaagcacatggccttcttcggcctgacagagttccagaggaagacccagtacctgtttgagaagaccttcaacatgaacttcatcagccccttcacccagtacaacaccacccgggccagctctgtggagatcaatgaggagatccagaagagaattgagggcctgaacttcctggacatggagctgtacagctatgccaaggacctcttcctgcagcgctaccagttcatgaggcagaaggagcaccaggaggcccggaggaagaggcaggagcagaggaagttcctgaagggccgcctgctgcagacccacttccagagccagggccagggccagagccagaaccccaaccagaaccagagccagaaccccaaccccaatgccaaccagaacctgacccagaacctgatgcagaacctgacccagagcctgagccagaaggaaaatcgggagagccccaagcagaacagcggcaaggagcagaatgacaacaccagcaatggcaccaatgactacatcggctctgtggagaagtggaggtag

SEQ ID NO: 155117 - DNA, 996 bp, Artificial Sequence
  Description of Artificial Sequence: Synthetic coding sequence
atgctgctgaagcacaacgggaagctgctgctcttctacctgctgagctaccaggccctggccagtgactggttctactgcagcttcaaccgctggaggatcttccagatcctggatgctgccaggaacttccactacatcaccatcctgcgggaccctgtgagccgctacctgtctgagtggaggcatgtgcagagaggagccacctggaaggccagcctgcacgtgtgtgatggccggccccccaccagcgaggagctgcccagctgctacacaggagatgactggagcggctgccccctgaaggagttcatggactgcccctacaacctggccaacaaccggcaggtgaggatgctgagtgacctgaccctggtgggctgctacaacctgtctgtgatgcctgagaagcagaggaacaaggtgctgctggagagcgccaagagcaacctgaagcacatggccttcttcggcctgacagagttccagaggaagacccagtacctgtttgagaagaccttcaacatgaacttcatcagccccttcacccagtacaacaccacccgggccagctctgtggagatcaatgaggagatccagaagagaattgagggcctgaacttcctggacatggagctgtacagctatgccaaggacctcttcctgcagcgctaccagttcatgaggcagaaggagcaccaggaggcccggaggaagaggcaggagcagaggaagttcctgaagggccgcctgctgcagacccacttccagagccagggccagggccagagccagaaccccaaccagaaccagagccagaaccccaaccccaatgccaaccagaacctgacccagaacctgatgcagaacctgacccagagcctgagccagaaggaaaatcgggagagccccaagcagaacagcggcaaggagcagaatgacaacaccagcaatggcaccaatgactacatcggctctgtggagaagtggaggtag

SEQ ID NO: 155118 - DNA, 1938 bp, Artificial Sequence
  Description of Artificial Sequence: Synthetic coding sequence
atggccctgcctgcctgtgctgtgcgggagtttgagcccccccggcagcctgagcggggggcccctgtgaggaccacctgccccaggaggcacagccgggtggaggccgagctggccgccagcaggcctggctctgtggccgcctctgtgcgggccggccccccccggggcgtgagccacggcttccacacccggcccctgctggacaagcccaggaaggccagcagcagcctggccggggccgcctgtgcccccctgtttgccctgctgagccggggcagaagaagaaggatgcacgtgctgcggcggcgctgggacctgggcagcctgtgccgggccctgctgacccggggcctggccgccctgggccacagcctgaagcacgtgctgggcgccatcttcagcaagatcttcggccccatggcctctgtgggcaacatggatgagaagagcaacaagctgctgctggccctggtgatgctgttcctgtttgctgtgattgtgctgcagtatgtgtgccccggcacagagtgccagctgctgcggctgcaggccttcagcagccctgtgcctgacccctacagaagtgaagatgagagcagcgccaggtttgtgccccgctacaacttcaccaggggggacctgctgaggaaggtggactttgacatcaagggagatgacctgattgtgttcctgcacatccagaagacaggaggcaccaccttcggccgccacctggtgaggaacatccagctggagcagccctgtgaatgtcgggtgggccagaagaagtgcacctgccacaggcctgggaagcgggagacctggctgttcagccgcttcagcacaggctggagctgtggcctgcatgctgactggacagagctgaccagctgtgtgcccagcgtggtggatggcaagagagatgcccggctgcggcccagccgctggaggatcttccagatcctggatgctgccagcaaggacaagaggggcagccccaacaccaatgctggggccaacagccccagcagcaccaagaccaggaacaccagcaagagcggcaagaacttccactacatcaccatcctgcgggaccctgtgagccgctacctgtctgagtggaggcatgtgcagagaggagccacctggaaggccagcctgcacgtgtgtgatggccggccccccaccagcgaggagctgcccagctgctacacaggagatgactggagcggctgccccctgaaggagttcatggactgcccctacaacctggccaacaaccggcaggtgaggatgctgagtgacctgaccctggtgggctgctacaacctgtctgtgatgcctgagaagcagaggaacaaggtgctgctggagagcgccaagagcaacctgaagcacatggccttcttcggcctgacagagttccagaggaagacccagtacctgtttgagaagaccttcaacatgaacttcatcagccccttcacccagtacaacaccacccgggccagctctgtggagatcaatgaggagatccagaagagaattgagggcctgaacttcctggacatggagctgtacagctatgccaaggacctcttcctgcagcgctaccagttcatgaggcagaaggagcaccaggaggcccggaggaagaggcaggagcagaggaagttcctgaagggccgcctgctgcagacccacttccagagccagggccagggccagagccagaaccccaaccagaaccagagccagaaccccaaccccaatgccaaccagaacctgacccagaacctgatgcagaacctgacccagagcctgagccagaaggaaaatcgggagagccccaagcagaacagcggcaaggagcagaatgacaacaccagcaatggcaccaatgactacatcggctctgtggagaagtggaggtag

SEQ ID NO: 155119 - DNA, 1416 bp, Artificial Sequence
  Description of Artificial Sequence: Synthetic coding sequence
atggatgagcgcttcaacaagtggctgctgacccctgtgctgaccctgctgtttgtggtgatcatgtaccagtatgtgagccccagctgcaccagcagctgcaccaactttggagagcagcccagggctggggaggccggccccccagctgtgcccggccctgcccggcgggcccaggcccctcctgaggagtgggagcggcggccccagctgcccccaccaccccggggccccccagagggccccagaggagctgctgcccctgaggaggaggatgaggagcccggggacccccgggagggggaggaggaggaggaggaggatgagccagaccctgaggccccagaaaatggcagcctgcccaggtttgtgccccgcttcaacttcagcctgaaggacctgaccaggtttgtggacttcaacatcaagggcagagatgtgattgtgttcctgcacatccagaagacaggaggcaccaccttcggccgccacctggtgaagaacatccggctggagcagccctgcagctgcaaggccggccagaagaagtgcacctgccacaggcctgggaagaaggagacctggctgttcagccgcttcagcacaggctggagctgtggcctgcacgccgactggacagagctgaccaactgtgtgcctgccatcatggagaagaaggactgccccaggaaccacagccacaccaggaacttctactacatcaccatgctgcgggaccctgtgagccgctacctgtctgagtggaagcacgtgcagagaggagccacctggaagaccagcctgcacatgtgtgatggccgcagccccaccccagatgagctgcccacctgctacccaggagatgactggagcggcgtgtccctgcgggagttcatggactgcacctacaacctggccaacaaccggcaggtgaggatgctggccgacctgagcctggtgggctgctacaacctgaccttcatgaatgaaagtgaaagaaacaccatcctgctgcagagcgccaagaacaacctgaagaacatggccttcttcggcctgacagagttccagaggaagacccagttcctgtttgagaggaccttcaacctgaagttcatcagccccttcacccagttcaacatcacccgggccagcaatgtggagatcaatgaaggagcccggcagagaattgaggacctgaacttcctggacatgcagctgtatgaatatgccaaggacctcttccagcagcgctaccaccacaccaagcagctggagcaccagagggaccggcagaagaggcgggaggagcggcggctgcagcgggagcaccgggaccaccagtggcccaaggaggatggagctgctgagggcaccgtgacagaggactacaacagccaggtggtgcgctggtag

SEQ ID NO: 155120 - DNA, 543 bp, Artificial Sequence
  Description of Artificial Sequence: Synthetic coding sequence
tgagcccagaccccacctcctcctcctgctgctgtggccgtggccgtgacccctgtgccccagttcccccgggcctgcacagaagctgagtttgcctgccacagctacaatgaatgtgtggccctggagtaccgctgtgaccggcggccagactgccgggacatgtctgatgagctgaactgtgaggagcctgtgctgggcatcagccccaccttcagcctgctggtggagaccaccagcctgccccccaggcctgagaccaccatcatgaggcagccccctgtgacccacgccccccagcccctgctgcccggctctgtgcggcccctgccctgtggcccccaggaggccgcctgcagaaatggccactgcatcccccgggactacctgtgtgatggccaggaggactgtgaagatggcagtgatgagctggactgtggccccccaccaccctgtgagcccaatgagttcccctgtggaaatggccactgtgccctgaagctgtggaggtgtgatggagactttgactgtgaggacagatag

SEQ ID NO: 155121 - DNA, 285 bp, Artificial Sequence
  Description of Artificial Sequence: Synthetic coding sequence
tgaggccacccccacagccccagcagtggagctgcctgggccgccgccttcctgggcggccggcccccaggcaccagctgctgcaccctgtctgtgcagcccctgcggacccaggccgccacagctgctggcagccccacccgctgggcccagccccggcccctgcccagctgcagcagcaagaaccctgagctgggccctgagctgcccagagatgtgtacatgcctggcccctggaccctgggggagggccctggccagtgcccagctggctaccccaggtag

SEQ ID NO: 155122 - DNA, 13176 bp, Artificial Sequence
  Description of Artificial Sequence: Synthetic coding sequence
atgggctggagggctgctggggccctgctgctggccctgctgctgcacggccgcctgctggccgtgacccacggcctgcgggcctatgatggcctgagcctgcctgaggacatcgagaccgtgacagccagccagatgcgctggacccacagctacctgagtgatgatgaggacatgctggccgacagcatctctggagatgacctgggcagcggggacctgggcagcggggacttccagatggtgtacttccgggccctggtgaacttcaccaggagcattgagtacagcccccagctggaggatgctggcagccgggagttccgggaggtgtctgaggccgtggtggacaccctggagagcgagtacctgaagatccctggggaccaggtggtgtctgtggtgttcatcaaggagctggatggctgggtgtttgtggagctggatgtgggcagcgagggcaatgctgatggagcccagatccaggagatgctgctgcgggtcatcagcagcggctctgtggccagctatgtgaccagcccccagggcttccagttccggcggctgggcaccgtgccccagttcccccgggcctgcacagaggccgagtttgcctgccacagctacaatgaatgtgtggccctggagtaccgctgtgacagaagaccagactgccgggacatgtctgatgagctgaactgtgaggagcctgtgctgggcatcagccccaccttcagcctgctggtggagaccaccagcctgccccccaggcctgagaccaccatcatgaggcagccccctgtgacccacgccccccagcccctgctgcccggctctgtgcggcccctgccctgtggcccccaggaggccgcctgcagaaatggccactgcatcccccgggactacctgtgtgatggccaggaggactgtgaagatggcagtgatgagctggactgtggccccccaccaccctgtgagcccaatgagttcccctgtggaaatggccactgtgccctgaagctgtggaggtgtgatggagactttgactgtgaggacagaacagatgaggccaactgccccaccaagaggcctgaggaggtgtgtggccccacccagttccgctgtgtgtccaccaacatgtgcatcccagccagcttccactgtgatgaggagagtgactgcccagacagaagtgatgaatttggctgcatgccaccccaggtggtgaccccaccccgggagagcatccaggccagccggggccagacagtgaccttcacctgtgtggccatcggcgtgcccacccccatcatcaactggaggctgaactggggccacatccccagccacccccgggtgacagtgaccagcgagggcggccggggcaccctcatcatcagagatgtgaaggagagtgaccagggcgcctacacctgtgaggccatgaatgcccggggcatggtgtttggcatcccagatggagtgctggagctggtgccccagaggggcccctgcccagatggccacttctacctggagcacagcgctgcctgcctgccctgcttctgcttcggcatcacctctgtgtgccagagcacccggcgcttccgggaccagatccggctgcgctttgaccagccagatgacttcaagggcgtgaatgtgaccatgcctgcccagcccggcaccccacccctgagcagcacccagctgcagattgaccccagcctgcacgagttccagctggtggacctgagccgccgcttcctggtgcatgacagcttctgggccctgcctgagcagttcctgggcaacaaggtggacagctatggaggcagcctgcgctacaacgtgcgctatgagctggcccggggcatgctggagcctgtgcagaggccagatgtggtgctgatgggcgccggctaccgcctgctgagccggggccacacccccacccagcccggggccctgaaccagaggcaggtgcagttcagcgaggagcactgggtgcatgaaagtggccggcctgtgcagagagctgagctgctgcaggtgctgcagagcctggaggccgtgctgatccagacagtgtacaacaccaagatggcctctgtgggcctgagtgacatcgccatggacaccaccgtgacccacgccaccagccacggccgggcccacagcgtggaggagtgccgctgccccatcggctacagcggcctgagctgtgagagctgtgatgcccacttcaccagggtgcctgggggcccctacctgggcacctgcagcggctgcaactgcaatggacatgccagcagctgtgaccctgtgtatggccactgcctgaactgccagcacaacacagagggcccccagtgcaacaagtgcaaggccggcttctttggagatgccatgaaggccacagccaccagctgccggccctgcccctgcccctacattgatgccagccgccgcttcagtgacacctgcttcctggacacagatggccaggccacctgtgatgcctgtgcccctggctacacaggaagaagatgtgagagctgtgcccctggctatgagggcaaccccatccagcccggcggcaagtgcaggcctgtgaaccaggagatcgtgcgctgtgatgagcggggctccatgggcaccagcggggaggcctgccgctgcaagaacaacgtggtgggccgcctgtgcaatgaatgtgctgatggcagcttccacctgagcaccaggaacccagatggctgcctgaagtgcttctgcatgggcgtgagccgccactgcaccagcagctcctggagccgggcccagctgcacggggccagcgaggagcccggccacttcagcctgaccaatgctgccagcacccacaccaccaatgaaggcatcttcagccccaccccaggagagctgggcttcagcagcttccaccggctgctgagcggcccctacttctggagcctgcccagccgcttcctgggggacaaggtgaccagctatggaggagagctgcgcttcaccgtgacccagaggagccagcccggcagcacccccctgcacggccagcccctggtggtgctgcagggcaacaacatcatcctggagcaccacgtggcccaggagcccagccctggccagcccagcaccttcatcgtgcccttccgggagcaggcctggcagaggccagatggccagcctgccacccgggagcacctgctgatggccctggccggcatcgacaccctgctgatccgggccagctatgcccagcagcctgctgagagccgggtgtctggcatctccatggatgtggccgtgcctgaggagaccggccaggaccctgccctggaggtggagcagtgcagctgccccccaggctaccggggccccagctgccaggactgtgacaccggctacaccaggaccccatctggcctgtacctgggcacctgtgagcgctgcagctgccacggccacagcgaggcctgtgagcctgagaccggggcctgccagggctgccagcaccacacagagggcccccgctgtgagcagtgccagcccggctactatggagatgcccagaggggcaccccccaggactgccagctgtgcccctgctacggggaccctgctgctggccaggccgcccacacctgcttcctggacacagatggccaccccacctgtgatgcctgcagccctggccacagcggccgccactgtgagcgctgtgcccctggctactacggcaaccccagccagggccagccctgccagagggacagccaggtgcccggccccatcggctgcaactgtgacccccagggctctgtgagcagccagtgtgatgctgctggccagtgccagtgcaaggcccaggtggagggcctgacctgcagccactgccggccccaccacttccacctgagcgccagcaacccagatggctgcctgccctgcttctgcatgggcatcacccagcagtgtgccagcagcgcctacaccaggcacctgatcagcacccactttgcccctggggacttccagggctttgccctggtgaacccccagaggaacagccggctgaccggggagttcaccgtggagcctgtgcctgagggcgcccagctgagctttggaaactttgcccagctgggccacgagagcttctactggcagctgcctgagacctaccagggcgacaaggtggccgcctatggaggcaagctgcgctacaccctgagctacacagctggcccccagggcagccccctgagtgaccctgatgtgcagatcaccggcaacaacatcatgctggtggccagccagcctgccctgcagggccctgagcggcgctcctatgagatcatgttccgggaggagttctggaggaggccagatggccagcctgccacccgggagcacctgctgatggccctggccgacctggatgagctgctgatccgggccaccttcagctctgtgcccctggccgccagcatctctgctgtgtccctggaggtggcccagcccggccccagcaaccggccccgggccctggaggtggaggagtgccgctgccccccaggctacatcggcctgagctgccaggactgtgcccctggctacaccaggactggaagtggcctgtacctgggccactgtgagctgtgtgagtgcaatggccacagcgacctgtgccaccctgagaccggggcctgcagccagtgccagcacaatgctgctggggagttctgtgagctgtgtgcccctggctactatggagatgccacagctggcaccccagaggactgccagccctgtgcctgccccctgaccaaccctgagaacatgttcagcaggacctgtgagagcctgggcgccggcggctaccgctgcacagcctgtgagcccggctacacaggccagtactgtgagcagtgtggccctggctacgtgggcaaccccagcgtgcagggcggccagtgcctgcctgagaccaaccaggcccccctggtggtggaggtgcacccagcccggagcatcgtgccccagggcggcagccacagcctgcgctgccaggtgtctggcagccccccccactacttctactggagcagagaagatggccggcctgtgcccagcggcacccagcagaggcaccagggcagcgagctgcacttccccagcgtgcagcccagtgatgctggggtgtacatctgcacctgcaggaacctgcaccagagcaacaccagcagagctgagctgctggtgacagaggcccccagcaagcccatcaccgtgacagtggaggagcagaggagccagagcgtgcggcctggagcagatgtgaccttcatctgcacagccaagagcaagagccctgcctacaccctggtgtggacccggctgcacaacgggaagctgcccacccgggccatggacttcaacggcatcctgaccatcagaaatgtgcagctgagtgatgctggcacctacgtgtgcaccggcagcaacatgtttgccatggaccagggcacagccaccctgcacgtgcaggccagcggcaccctgagcgcccctgtggtgtccatccaccccccccagctgactgtgcagcccggccagctggccgagttccgctgcagcgccaccggcagccccacccccaccctggagtggacaggaggccctgggggccagctgcctgccaaggcccagatccacggcggcatcctgcggctgcctgctgtggagcccacagaccaggcccagtacctgtgccgggcccacagcagcgctggccagcaggtggcccgggctgtgctgcacgtgcatggaggcggcggcccccgggtgcaggtgtccccagagaggacccaggtgcatgctggccgcacagtgcggctgtactgcagagctgctggggtgcccagcgccaccatcacctggaggaaggagggcggcagcctgcccccccaggcccggtctgagaggacagacatcgccaccctgctgatcccagccatcaccacagcagatgctggcttctacctgtgtgtggccaccagccctgctggaacagcccaggcccgcatccaggtggtggtgctgagcgccagtgatgccagccccccacctgtgaagattgagagcagcagccccagcgtgacagagggccagaccctggacctgaactgtgtggtggccggcagcgcccacgcccaggtgacctggtaccgccggggcggcagcctgcccccccacacccaggtgcacggcagccggctgcggctgccccaggtgtccccagctgacagcggggagtatgtgtgccgggtggagaatggaagtggccccaaggaggccagcatcaccgtgtctgtgctgcacggcacccacagcggccccagctacacccctgtgcccggcagcacccggcccatccgcatcgagcccagcagcagccacgtggccgagggccagaccctggacctgaactgtgtggtgcccggccaggcccacgcccaggtgacctggcacaagagaggaggcagcctgcctgcccggcaccagacccacggcagcctgctgcggctgcaccaggtgaccccagctgacagcggggagtatgtgtgccacgtggtgggcaccagcggccccctggaggcctctgtgctggtgaccatcgaggccagcgtcatccctggccccatcccccctgtgagaattgagagcagcagcagcacagtggccgagggccagaccctggacctgagctgtgtggtggccggccaggcccacgcccaggtgacctggtacaagaggggcggcagcctgcctgcccggcaccaggtgcggggcagccggctgtacatcttccaggccagccctgcagatgctggccagtatgtgtgccgggccagcaatggcatggaggccagcatcaccgtgacagtgacaggcacccagggcgccaacctggcctacccagctggcagcacccagcccatcagaattgagcccagcagcagccaggtggccgagggccagaccctggacctgaactgtgtggtgcccggccagagccacgcccaggtgacctggcacaagaggggcggcagcctgcctgtgcgccaccagacccacggcagcctgctgcggctgtaccaggccagccctgctgacagcggggagtatgtgtgccgggtgctgggcagctctgtgcccctggaggcctctgtgctggtgaccatcgagcctgctggctctgtgcctgccctgggcgtgacccccaccgtgagaattgagagcagcagcagccaggtggccgagggccagaccctggacctgaactgcctggtggccggccaggcccacgcccaggtgacctggcacaagaggggcggcagcctgcctgcccggcaccaggtgcacggcagccggctgcggctgctgcaggtgaccccagctgacagcggggagtatgtgtgccgggtggtgggcagcagcggcacccaggaggcctctgtgctggtgaccatccagcagaggctgagcggcagccacagccagggcgtggcctaccctgtgcgcatcgagagcagcagcgccagcctggccaacggccacaccctggacctgaactgcctggtggccagccaggccccccacaccatcacctggtacaagagaggaggcagcctgcccagccgccaccagatcgtgggcagccggctgcgcatcccccaggtgaccccagctgacagcggggagtatgtgtgccacgtgtccaatggagctggcagccgggagaccagcctcatcgtgaccatccagggcagcggcagcagccacgtgcccagcgtgagcccccccatccgcatcgagagcagcagccccaccgtggtggagggccagaccctggacctgaactgtgtggtggcccggcagccccaggccatcatcacctggtacaagagaggaggcagcctgcccagccgccaccagacccacggcagccacctgcggctgcaccagatgtctgtggccgacagcggggagtatgtgtgccgggccaacaacaacattgatgccctggaggccagcatcgtcatctctgtgagccccagcgctggcagccccagcgcccctggcagctccatgcccatcagaattgagagcagcagcagccacgtggccgagggggagaccctggacctgaactgtgtggtgcccggccaggcccacgcccaggtgacctggcacaagaggggcggcagcctgcccagccaccaccagacccggggcagccggctgcggctgcaccacgtgtccccagctgacagcggggagtatgtgtgccgggtgatgggcagcagcggccccctggaggcctctgtgctggtgaccatcgaggccagcggcagcagcgctgtgcacgtgcctgcccctggaggagccccacccatcagaattgagcccagcagcagccgggtggccgagggccagaccctggacctgaagtgtgtggtgcccggccaggcccacgcccaggtgacctggcacaagaggggcggcaacctgcctgcccggcaccaggtgcacggccccctgctgcggctgaaccaggtgtccccagctgacagcggggagtacagctgccaggtgacaggcagcagcggcaccctggaggcctctgtgctggtgaccatcgagcccagcagccctggccccatcccagcccctggcctggcccagcccatctacatcgaggccagcagcagccacgtgacagagggccagaccctggacctgaactgtgtggtgcccggccaggcccacgcccaggtgacctggtacaagaggggcggcagcctgcctgcccggcaccagacccacggcagccagctgcggctgcacctggtgtccccagctgacagcggggagtatgtgtgcagagctgccagcggccctggccctgagcaggaggccagcttcaccgtgacagtgccccccagcgagggcagcagctaccgcctgcggagccctgtgatcagcattgacccccccagcagcacagtgcagcagggccaggatgccagcttcaagtgcctgattcatgatggagctgcccccatcagcctggagtggaagaccaggaaccaggagctggaggacaacgtgcacatcagccccaacggcagcatcatcaccatcgtgggcacccggcccagcaaccacggcacctaccgctgtgtggccagcaatgcctatggagtggcccagagcgtggtgaacctgtctgtgcacggccccccaacagtgtctgtgctgcctgagggccctgtgtgggtgaaggtgggcaaggctgtgaccctggagtgtgtgtctgctggggagcccaggagcagcgcccgctggacccgcatcagcagcaccccagccaagctggagcagaggacctacggcctgatggacagccatgctgtgctgcagatcagcagcgccaagcccagtgatgctggcacctacgtgtgcctggcccagaatgccctgggcacagcccagaagcaggtggaggtgattgtggacaccggggccatggcccctggggccccccaggtgcaggccgaggaggccgagctgactgtggaggccggccacacagccaccctgcgctgcagcgccaccggcagccctgcccccaccatccactggagcaagctgcggagccccctgccctggcagcaccggctggagggggacaccctcatcatcccccgggtggcccagcaggacagcggccagtacatctgcaatgccaccagccctgctggccatgctgaggccaccatcatcctgcacgtggagagccccccctatgccaccaccgtgcctgagcacgcctctgtgcaggccggggagaccgtgcagctgcagtgcctggcccacggcaccccacccctgaccttccagtggagccgggtgggcagcagcctgcccggccgggccacagccagaaatgagctgctgcactttgaaagagctgcccctgaggacagcggccgctaccgctgccgggtgaccaacaaggtgggcagcgctgaggcctttgcccagctgctggtgcagggccccccaggcagcctgcctgccaccagcatcccagctggcagcacccccaccgtgcaggtgaccccccagctggagaccaagagcattggagcctctgtggagttccactgtgctgtgcccagcgaccggggcacccagctgcgctggttcaaggagggcggccagctgcccccaggccacagcgtgcaggatggagtgctgcgcatccagaacctggaccagagctgccagggcacctacatctgccaggcccacggcccctggggcaaggcccaggccagcgcccagctggtgatccaggccctgcccagcgtgctgatcaacatccgcacctctgtgcagacagtggtggtgggccatgctgtggagtttgaatgtctggccctgggggaccccaagccccaggtgacctggagcaaggtgggcggccacctgcggcccggcatcgtgcagagcggcggcgtggtgcgcatcgcccacgtggagctggctgatgctggccagtaccgctgcacagccaccaatgctgctggcaccacccagagccacgtgctgctgctggtgcaggccctgccccagatctccatgccccaggaggtgcgggtgcctgctggcagcgctgctgtgttcccctgcatcgccagcggctaccccaccccagacatctcctggagcaagctggatggcagcctgcccccagacagccggctggagaacaacatgctgatgctgcccagcgtgcggccccaggatgctggcacctacgtgtgcacagccaccaaccggcagggcaaggtgaaggcctttgcccacctgcaggtgcctgagcgggtggtgccctacttcacccagaccccctacagcttcctgcccctgcccaccatcaaggatgcctacaggaagtttgagatcaagatcaccttccggccagacagcgcagatggcatgctgctgtacaacggccagaagagggtgcccggcagccccaccaacctggccaaccggcagcctgacttcatcagctttggcctggtgggcggccggcctgagttccgctttgatgctggcagcggcatggccaccatccgccaccccacccccctggccctgggccacttccacacagtgaccctgctgcggagcctgacccagggcagcctcatcgtgggggacctggcccctgtgaatggcaccagccagggcaagttccagggcctggacctgaatgaggagctgtacctgggcggctacccagactatggagccatccccaaggccggcctgagcagcggcttcatcggctgtgtgcgggagctgcgcatccagggcgaggagatcgtgttccatgacctgaacctgacagcccacggcatcagccactgccccacctgccgggaccggccctgccagaatggaggccagtgccacgacagcgagagcagcagctatgtgtgtgtgtgcccagctggcttcaccggcagccgctgtgagcacagccaggccctgcactgccaccctgaggcctgtggcccagatgccacctgtgtgaacagaccagatggccggggctacacctgccgctgccacctgggccgcagcggcctgcgctgtgaggagggcgtgacagtgaccacccccagcctgtctggagctggcagctacctggccctgcctgccctgaccaacacccaccacgagctgcggctggatgtggagttcaagcccctggccccagatggagtgctgctcttcagcggcggcaagagcggccctgtggaggactttgtgtccctggccatggtgggcggccacctggagttccgctatgagctgggcagcggcctggccgtgctgcggtctgctgagcccctggccctgggccgctggcaccgggtgtctgctgagcggctgaacaaggatggcagcctgcgggtgaatggaggccggcctgtgctgcggagcagccctgggaagagccagggcctgaacctgcacaccctgctgtacctgggcggcgtggagcccagcgtgcccctgagccctgccaccaacatgtctgcccacttccggggctgtgtgggggaggtgtctgtgaatggcaagaggctggacctgacctacagcttcctgggcagccagggcatcggccagtgctatgacagcagcccctgtgagcggcagccctgccagcacggggccacctgcatgcctgctggggagtatgagttccagtgcctgtgcagagatggcttcaagggggacctgtgtgagcacgaggagaacccctgccagctgcgggagccctgcctgcatggaggcacctgccagggcacccgctgcctgtgcctgcccggcttcagcggcccccgctgccagcagggcagcggccatggaattgctgagagtgactggcacctggagggcagcggcggcaatgatgcccctggccagtacggggcctacttccatgatgatggcttcctggccttccctggccacgtgttcagccgcagcctgcctgaggtgcctgagaccatcgagctggaggtgaggaccagcacagccagcggcctgctgctgtggcagggcgtggaggtgggggaggccggccagggcaaggacttcatcagcctgggcctgcaggacggccacctggtgttccgctaccagctgggcagcggggaggcccggctggtgtctgaggaccccatcaatgatggagagtggcaccgggtgacagccctgcgggagggcagaagaggcagcatccaggtggatggagaggagctggtgtctggccgcagccctggccccaacgtggccgtgaatgccaagggctctgtgtacatcggcggggccccagatgtggccaccctgaccggcggccgcttcagcagcggcatcaccggctgtgtgaagaacctggtgctgcacagcgcccggcctggggcccccccaccccagcccctggacctgcagcaccgggcccaggccggggccaacacccggccctgccccagctag

SEQ ID NO: 155123 - DNA, 720 bp, Artificial Sequence
  Description of Artificial Sequence: Synthetic coding sequence
gtcacccacggcctgcgggcctatgatggcctgagcctgcctgaagatattgaaacagtgacagccagccagatgcgctggacccacagctacctgagtgatgatgaggacatgctggccgacagcatctctggagatgacctgggcagcggggacctgggcagcggggacttccagatgggctcctggatggccggcttcctgtggagctggatgtgggccaggaagggcatgaggatgggcctgcgcttccgccgctgctgcagcggcagcagccctgctgccctgtggccacccaccagccccctgccccgggacagcagcagtgatgcctgggcccagtgccccagcagccaggagcccgcccggcggcccagcctgcctgccacagccaccatgtctgtgtggccctggagcattgctgtgactggaggccccacagctggcacctgcctgatgagcagcatcgtgcgcagccagagctgggtgtctgccccccacagcctgagcctgtggaggaggcacctgtacagacctggccagaggcagcccagctgtgacagccaccagagccccaccctgctgagcccctgcttccctgtgcccagcggcccctgccctgtgggcccccggcggccccatgctgccatgggcacagccagccctgagaccaccagcgccacagacagaagaacagccaggacagctgccatgtcctag

SEQ ID NO: 155124 - DNA, 567 bp, Artificial Sequence
  Description of Artificial Sequence: Synthetic coding sequence
atgaatgctggggcctctgtgctgaccttcccctgggccgtgtatggcctgccccgggcccggcctgctgtgacagacctgaccggccccctgccccccagcagccctgccctgcccagcgtgctgatcaacatccgcacctctgtgcagacagtggtggtgggccatgctgtggagtttgaatgtctggccctgggggaccccaagccccaggtgacctggagcaaggtgggcggccacctgcggcccggcatcgtgcagagcggcggcgtggtgcgcatcgcccacgtggagctggctgatgctggccagtaccgctgcacagccaccaatgctgctggcaccacccagagccacgtgctgctgctggtgcaggccctgccccagatctccatgccccaggaggtgcgggtgcctgctggcagcgctgctgtgttcccctgcatcgccagcggctaccccaccccagacatctcctggagcaagctggatggcagcctgcccccagacagccggctggagaacaacatgctgatgctgcccagcgtgcggccccaggatgcctag

SEQ ID NO: 155125 - DNA, 594 bp, Artificial Sequence
  Description of Artificial Sequence: Synthetic coding sequence
tgaacacccagcggcctgtacctgggcacctgtgagcgctgcagctgccacggccacagcgaggcctgtgagcctgagactggagcctgccagggctgccagcaccacacagagggcccccgctgtgagcagtgccagcccggctactatggagatgcccagaggggcaccccccaggactgccagctgtgcccctgctatggagaccctgctgctggccaggccgcccacacctgcttcctggacacagatggccaccccacctgtgatgcctgcagccctggccacagcggccgccactgtgagcgctgtgcccctggctactacggcaaccccagccagggccagccctgccagagggacagccaggtgcccggccccatcggctgcaactgtgacccccagggctctgtgagcagccagtgtgatgctgctggccagtgccagtgcaaggtgagccccaacccctgcccctgtggggcctgcagcgcccccctgccccggccctgtggggagatccggcagcacctggtggaggccgagacctgggcctggggcgccggccatggaggccagggccggggctgcccctag

SEQ ID NO: 155126 - DNA, 492 bp, Artificial Sequence
  Description of Artificial Sequence: Synthetic coding sequence
cctcctgtgaagattgagagcagcagccccagcgtgacagagggccagaccctggacctgaactgtgtggtggccggcagcgcccacgcccaggtgacctggtaccgccggggcggcagcctgcccccccacacccaggtgcacggcagccggctgcggctgccccaggtgtccccagctgacagcggggagtatgtgtgccgggtggagaatggaagtggccccaaggaggccagcatcaccgtgtcctactgccccccagcctggagctggtgtgtgcccggcagcacccggcccatccgcatcgagcccagcagcagccacgtggccgagggccagaccctggacctgaactgtgtggtgcccggccaggcccacgcccaggtgacctggcacaagagaggaggcagcctgcctgcccggcaccagacccacggcagcctgctgcggctgcaccaggtgaccccagctgacagcggggagtatgtgtag

SEQ ID NO: 155127 - DNA, 573 bp, Artificial Sequence
  Description of Artificial Sequence: Synthetic coding sequence
cctgaggacatcgagaccgtgacagccagccagatgcgctggacccacagctacctgagtgatgatgaggacatgctggccgacagcatctctggagatgacctgggcagcggggacctgggcagcggggacttccagatggtgtacttccgggccctggtgaacttcaccaggagcattgagtacagcccccagctggaggatgctggcagccgggagttccgggaggtgtctgaggccgtggtggacaccctggagagcgagtacctgaagatccctggggaccaggtggtgtctgtggtgttcatcaaggagctggatggctgggtgtttgtggagctggatgtgggcagcgagggcaatgctgatggagcccagatccaggagatgctgctgcgggtcatcagcagcggctctgtggccagctatgtgaccagcccccagggcttccagttccggcggctgggcactggagagcccatcctggtgtctggcatcgccagcagccggctggtgggcagccccttctctgtgtctgccatcggcagccagctgggcctggcccaccactag

SEQ ID NO: 155128 - DNA, 624 bp, Artificial Sequence
  Description of Artificial Sequence: Synthetic coding sequence
ggggagagccgggagggccggggctaccggcaggtggcccagagggtggccgagaggagccctgtgcccagcctgctgagccacagcggctgtgtggtgcacacccggctgagccctgtgcccagcgtgtccccacccatcagaattgagagcagcagccccaccgtggtggagggccagaccctggacctgaactgtgtggtggcccggcagccccaggccatcatcacctggtacaagaggggcggcagcctgcccagccgccaccagacccacggcagccacctgcggctgcaccagatgtctgtggccgacagcggggagtatgtgtgccgggccaacaacaacattgatgccctggaggccagcatcgtcatctctgtgagccccagcgctggcagccccagcgcccctggcagctccatgcccatccgcatcgagagcagcagcagccacgtggccgagggggagaccctggacctgaactgtgtggtgcccggccaggcccacgcccaggtgacctggcacaagagaggaggcagcctgcccagccaccaccagacccggggcagccggctgcggctgcaccacgtgtccccagctgacagcggggagtatgtgtag

SEQ ID NO: 155129 - DNA, 1104 bp, Artificial Sequence
  Description of Artificial Sequence: Synthetic coding sequence
atgggctggaggcggggccgcggggccccccgcttcccagatggcatggccgccggccagaggaggagcagcctgagccggctgggcagccaggccgagggcctgctgaccagccagaccatgggcggccaggccgagaccctgctgaccagccagacaggctggctgctgggccggggctgcaacctgggcagccctgggggccaggtgtcctgggacaaggtgcgcatccctggggtgctgcagaggctgggcgtgacctactttgtggtggccgtgctggagctgctgtttgccaagcctgtgcctgagcactgtgccagcgagaggagctgcctgagcctgcgggacatcaccagctcctggccccagtggctgctgatcctggtgctggagggcctgtggctgggcctgaccttcctgctgcctgtgcccggctgccccaccggctacctgggccctgggggcattggagactttgggaagtaccccaactgcacaggaggagctgctggctacatcgaccggctgctgctgggagatgaccacctgtaccagcaccccagcagcgctgtgctgtaccacacagaggtggcctatgaccctgagggcatcctgggcaccatcaacagcatcgtgatggccttcctgggcgtgcaggccggcaagatcctgctgtactacaaggcccggaccaaggacatcctgatccgcttcaccgcctggtgctgcatcctgggcctcatctctgtggccctgaccaaggtgtctgaaaatgaaggcttcatccctgtgaacaagaacctgtggagcctgtcctatgtgaccaccctgagcagctttgccttcttcatcctgctggtgctgtaccctgtggtggatgtgaagggcctgtggacaggcacccccttcttctacccaggcatgaacagcatcctggtgtatgtgggccacgaggtgtttgagaactacttccccttccagtggaagctgaaggacaaccagagccacaaggagcacctgacccagaacatcgtggccacagccctgtgggtgctgattgcctacatcctgtacaggaagaagatcttctggaagatctag

SEQ ID NO: 155130 - DNA, 669 bp, Artificial Sequence
  Description of Artificial Sequence: Synthetic coding sequence
atgtctggggccggccgggccctggccgccctgctgctggccgcctctgtgctgtctgctgccctgctggcccctgggggcagcagcggcagagatgcccaggccgccccaccccgggacctggacaagaagagacatgctgagctgaagatggaccaggccctgctgctgatccacaatgagctgctgtggaccaacctgactgtgtactggaagtctgagtgctgctaccactgcctcttccaggtgctggtgaatgtgccccagagccccaaggccggcaagcccagcgctgctgctgcctctgtgtccacccagcacggcagcatcctgcagctgaatgacaccctggaggagaaggaggtgtgccgcctggagtacagatttggagaatttggaaactacagcctgctggtgaagaacatccacaacggggtgtctgaaattgcctgtgacctggccgtgaatgaagatcctgtggacagcaacctgcctgtgtccatcgccttcctgattggcctggccgtcatcatcgtcatctccttcctgcggctgctgctgcgggtgctgctgtgccaccctggctggagcgctgtggcccccagccggctgacccccagcagcgccagccgggtgcacaccatcctgctgccccagcccccagagtag

SEQ ID NO: 155131 - DNA, 1908 bp, Artificial Sequence
  Description of Artificial Sequence: Synthetic coding sequence
atgtctggggccggccgggccctggccgccctgctgctggccgcctctgtgctgtctgctgccctgctggcccctgggggcagcagcggcagagatgcccaggccgccccaccccgggacctggacaagaagagacatgctgagctgaagatggaccaggccctgctgctgatccacaatgagctgctgtggaccaacctgactgtgtactggaagtctgagtgctgctaccactgcctcttccaggtgctggtgaatgtgccccagagccccaaggccggcaagcccagcgctgctgctgcctctgtgtccacccagcacggcagcatcctgcagctgaatgacaccctggaggagaaggaggtgtgccgcctggagtacagatttggagaatttggaaactacagcctgctggtgaagaacatccacaacggggtgtctgaaattgcctgtgacctggccgtgaatgaagatcctgtggacagcaacctgcctgtgtccatcgccttcctgattggcctggccgtcatcatcgtcatctccttcctgcggctgctgctgagcctggatgacttcaacaactggatcagcaaggccatcagcagccgggagacagacaggctcatcaacagcgagctgggcagccccagcaggacagaccccctggatggagatgtgcagcctgccacctggaggctgagcgccctgcccccccggctgcggtctgtggacaccttccggggcatcgccctgatcctgatggtgtttgtgaactatggaggcggcaagtactggtacttcaagcacgcctcctggaatggcctgactgtggccgacctggtgttcccctggtttgtgttcatcatgggcagcagcatcttcctgtccatgaccagcatcctgcagaggggctgcagcaagttccggctgctgggcaagatcgcctggaggagcttcctgctgatctgcatcggcatcatcatcgtgaaccccaactactgcctgggccccctgtcctgggacaaggtgcgcatccctggggtgctgcagaggctgggcgtgacctactttgtggtggccgtgctggagctgctgtttgccaagcctgtgcctgagcactgtgccagcgagaggagctgcctgagcctgcgggacatcaccagctcctggccccagtggctgctgatcctggtgctggagggcctgtggctgggcctgaccttcctgctgcctgtgcccggctgccccaccggctacctgggccctgggggcattggagactttgggaagtaccccaactgcacaggaggagctgctggctacatcgaccggctgctgctgggagatgaccacctgtaccagcaccccagcagcgctgtgctgtaccacacagaggtggcctatgaccctgagggcatcctgggcaccatcaacagcatcgtgatggccttcctgggcgtgcaggccggcaagatcctgctgtactacaaggcccggaccaaggacatcctgatccgcttcaccgcctggtgctgcatcctgggcctcatctctgtggccctgaccaaggtgtctgaaaatgaaggcttcatccctgtgaacaagaacctgtggagcctgtcctatgtgaccaccctgagcagctttgccttcttcatcctgctggtgctgtaccctgtggtggatgtgaagggcctgtggacaggcacccccttcttctacccaggcatgaacagcatcctggtgtatgtgggccacgaggtgtttgagaactacttccccttccagtggaagctgaaggacaaccagagccacaaggagcacctgacccagaacatcgtggccacagccctgtgggtgctgattgcctacatcctgtacaggaagaagatcttctggaagatctag

SEQ ID NO: 155132 - DNA, 1992 bp, Artificial Sequence
  Description of Artificial Sequence: Synthetic coding sequence
atgaccggggcccgggccagcgctgctgagcagaggcgggccggccgcagcggccaggcccgggctgctgagagagctgctggcatgtctggggccggccgggccctggccgccctgctgctggccgcctctgtgctgtctgctgccctgctggcccctgggggcagcagcggcagagatgcccaggccgccccaccccgggacctggacaagaagagacatgctgagctgaagatggaccaggccctgctgctgatccacaatgagctgctgtggaccaacctgactgtgtactggaagtctgagtgctgctaccactgcctcttccaggtgctggtgaatgtgccccagagccccaaggccggcaagcccagcgctgctgctgcctctgtgtccacccagcacggcagcatcctgcagctgaatgacaccctggaggagaaggaggtgtgccgcctggagtacagatttggagaatttggaaactacagcctgctggtgaagaacatccacaacggggtgtctgaaattgcctgtgacctggccgtgaatgaagatcctgtggacagcaacctgcctgtgtccatcgccttcctgattggcctggccgtcatcatcgtcatctccttcctgcggctgctgctgagcctggatgacttcaacaactggatcagcaaggccatcagcagccgggagacagacaggctcatcaacagcgagctgggcagccccagcaggacagaccccctggatggagatgtgcagcctgccacctggaggctgagcgccctgcccccccggctgcggtctgtggacaccttccggggcatcgccctgatcctgatggtgtttgtgaactatggaggcggcaagtactggtacttcaagcacgcctcctggaatggcctgactgtggccgacctggtgttcccctggtttgtgttcatcatgggcagcagcatcttcctgtccatgaccagcatcctgcagaggggctgcagcaagttccggctgctgggcaagatcgcctggaggagcttcctgctgatctgcatcggcatcatcatcgtgaaccccaactactgcctgggccccctgtcctgggacaaggtgcgcatccctggggtgctgcagaggctgggcgtgacctactttgtggtggccgtgctggagctgctgtttgccaagcctgtgcctgagcactgtgccagcgagaggagctgcctgagcctgcgggacatcaccagctcctggccccagtggctgctgatcctggtgctggagggcctgtggctgggcctgaccttcctgctgcctgtgcccggctgccccaccggctacctgggccctgggggcattggagactttgggaagtaccccaactgcacaggaggagctgctggctacatcgaccggctgctgctgggagatgaccacctgtaccagcaccccagcagcgctgtgctgtaccacacagaggtggcctatgaccctgagggcatcctgggcaccatcaacagcatcgtgatggccttcctgggcgtgcaggccggcaagatcctgctgtactacaaggcccggaccaaggacatcctgatccgcttcaccgcctggtgctgcatcctgggcctcatctctgtggccctgaccaaggtgtctgaaaatgaaggcttcatccctgtgaacaagaacctgtggagcctgtcctatgtgaccaccctgagcagctttgccttcttcatcctgctggtgctgtaccctgtggtggatgtgaagggcctgtggacaggcacccccttcttctacccaggcatgaacagcatcctggtgtatgtgggccacgaggtgtttgagaactacttccccttccagtggaagctgaaggacaaccagagccacaaggagcacctgacccagaacatcgtggccacagccctgtgggtgctgattgcctacatcctgtacaggaagaagatcttctggaagatctag

SEQ ID NO: 155133 - DNA, 1647 bp, Artificial Sequence
  Description of Artificial Sequence: Synthetic coding sequence
atgagggtgctgtgtgccttccctgaggccatgcccagcagcaacagccggcccccagcctgcctggcccctggggccctgtacctggccctgctgctgcacctgagcctgagcagccaggccggggaccggcggcccctgcctgtggacagagctgctggcctgaaggagaagaccctcatcctgctggatgtgtccaccaagaaccctgtgaggacagtgaatgaaaacttcctgagcctgcagctggaccccagcatcatccatgatggctggctggacttcctgagcagcaagaggctggtgaccctggcccggggcctgagccctgccttcctgcgctttggaggcaagaggacagacttcctgcagttccagaacctgagaaatcctgccaagagccggggcggccctggccctgactactacctgaagaactatgaagatgacatcgtgcggagtgatgtggccctggacaagcagaagggctgcaagatcgcccagcacccagatgtgatgctggagctgcagcgggagaaggccgcccagatgcacctggtgctgctgaaggagcagttcagcaacacctacagcaacctgatcctgacagcccggagcctggacaagctgtacaactttgctgactgcagcggcctgcacctgatctttgccctgaatgccctgcggaggaaccccaacaacagctggaacagcagcagcgccctgagcctgctgaagtacagcgccagcaagaagtacaacatctcctgggagctgggcaatgagcccaacaactaccgcaccatgcacggccgggctgtgaatggcagccagctgggcaaggactacatccagctgaagagcctgctgcagcccatccgcatctacagccgggccagcctgtatggccccaacatcggccggcccaggaagaatgtcatcgccctgctggatggcttcatgaaggtggccggcagcacagtggatgctgtgacctggcagcactgctacattgatggccgggtggtgaaggtgatggacttcctgaagacccggctgctggacaccctgagtgaccagatcaggaagatccagaaggtggtgaacacctacaccccaggcaagaagatctggctggagggcgtggtgaccaccagcgctgggggcaccaacaacctgagtgacagctatgctgctggcttcctgtggctgaacaccctgggcatgctggccaaccagggcattgatgtggtgatccgccacagcttctttgaccacggctacaaccacctggtggaccagaacttcaaccccctgcctgactactggctgagcctgctgtacaagaggctcatcggccccaaggtgctggccgtgcacgtggccggcctgcagaggaagccccggcccggccgggtcatccgggacaagctgcgcatctatgcccactgcaccaaccaccacaaccacaactacgtgcggggcagcatcaccctcttcatcatcaacctgcacaggagcaggaagaagatcaagctggccggcaccctgcgggacaagctggtgcaccagtacctgctgcagccctacggccaggagggcctgaagagcaagacccagcgctgccagtactgcggcatcatctag

SEQ ID NO: 155134 - DNA, 1605 bp, Artificial Sequence
  Description of Artificial Sequence: Synthetic coding sequence
atgagggtgctgtgtgccttccctgaggccatgcccagcagcaacagccggcccccagcctgcctggcccctggggccctgtacctggccctgctgctgcacctgagcctgagcagccaggccggggaccggcggcccctgcctgtggacagagctgctggcctgaaggagaagaccctcatcctgctggatgtgtccaccaagaaccctgtgaggacagtgaatgaaaacttcctgagcctgcagctggaccccagcatcatccatgatggctggctggacttcctgagcagcaagaggctggtgaccctggcccggggcctgagccctgccttcctgcgctttggaggcaagaggacagacttcctgcagttccagaacctgagaaatcctgccaagagccggggcggccctggccctgactactacctgaagaactatgaagatgacatcgtgcggagtgatgtggccctggacaagcagaagggctgcaagatcgcccagcacccagatgtgatgctggagctgcagcgggagaaggccgcccagatgcacctggtgctgctgaaggagcagttcagcaacacctacagcaacctgatcctgacagagcccaacaactaccgcaccatgcacggccgggctgtgaatggcagccagctgggcaaggactacatccagctgaagagcctgctgcagcccatccgcatctacagccgggccagcctgtatggccccaacatcggccggcccaggaagaatgtcatcgccctgctggatggcttcatgaaggtggccggcagcacagtggatgctgtgacctggcagcactgctacattgatggccgggtggtgaaggtgatggacttcctgaagacccggctgctggacaccctgagtgaccagatcaggaagatccagaaggtggtgaacacctacaccccaggcaagaagatctggctggagggcgtggtgaccaccagcgctgggggcaccaacaacctgagtgacagctatgctgctggcttcctgtggctgaacaccctgggcatgctggccaaccagggcattgatgtggtgatccgccacagcttctttgaccacggctacaaccacctggtggaccagaacttcaaccccctgcctgactactggctgagcctgctgtacaagaggctcatcggccccaaggtgctggccgtgcacgtggccggcctgcagaggaagccccggcccggccgggtcatccgggacaagctgcgcatctatgcccactgcaccaaccaccacaaccacaactacgtgcggggcagcatcaccctcttcatcatcaacctgcacaggagcaggaagaagatcaagctggccggcaccctgcgggacaagctggtgcaccagtacctgctgcagccctacggccaggagggcctgaagagcaagtctgtgcagctgaatggccagcccctggtgatggtggatgatggcaccctgcctgagctgaagccccggcccctgcgggccggccgcaccctggtgatcccccctgtgaccatgggcttctacgtggtgaagaatgtgaatgccctggcctgccgctacagatag

SEQ ID NO: 155135 - DNA, 1779 bp, Artificial Sequence
  Description of Artificial Sequence: Synthetic coding sequence
atgagggtgctgtgtgccttccctgaggccatgcccagcagcaacagccggcccccagcctgcctggcccctggggccctgtacctggccctgctgctgcacctgagcctgagcagccaggccggggaccggcggcccctgcctgtggacagagctgctggcctgaaggagaagaccctcatcctgctggatgtgtccaccaagaaccctgtgaggacagtgaatgaaaacttcctgagcctgcagctggaccccagcatcatccatgatggctggctggacttcctgagcagcaagaggctggtgaccctggcccggggcctgagccctgccttcctgcgctttggaggcaagaggacagacttcctgcagttccagaacctgagaaatcctgccaagagccggggcggccctggccctgactactacctgaagaactatgaagatgacatcgtgcggagtgatgtggccctggacaagcagaagggctgcaagatcgcccagcacccagatgtgatgctggagctgcagcgggagaaggccgcccagatgcacctggtgctgctgaaggagcagttcagcaacacctacagcaacctgatcctgacagcccggagcctggacaagctgtacaactttgctgactgcagcggcctgcacctgatctttgccctgaatgccctgcggaggaaccccaacaacagctggaacagcagcagcgccctgagcctgctgaagtacagcgccagcaagaagtacaacatctcctgggagctgggcaatgagcccaacaactaccgcaccatgcacggccgggctgtgaatggcagccagctgggcaaggactacatccagctgaagagcctgctgcagcccatccgcatctacagccgggccagcctgtatggccccaacatcggccggcccaggaagaatgtcatcgccctgctggatggcttcatgaaggtggccggcagcacagtggatgctgtgacctggcagcactgctacattgatggccgggtggtgaaggtgatggacttcctgaagacccggctgctggacaccctgagtgaccagatcaggaagatccagaaggtggtgaacacctacaccccaggcaagaagatctggctggagggcgtggtgaccaccagcgctgggggcaccaacaacctgagtgacagctatgctgctggcttcctgtggctgaacaccctgggcatgctggccaaccagggcattgatgtggtgatccgccacagcttctttgaccacggctacaaccacctggtggaccagaacttcaaccccctgcctgactactggctgagcctgctgtacaagaggctcatcggccccaaggtgctggccgtgcacgtggccggcctgcagaggaagccccggcccggccgggtcatccgggacaagctgcgcatctatgcccactgcaccaaccaccacaaccacaactacgtgcggggcagcatcaccctcttcatcatcaacctgcacaggagcaggaagaagatcaagctggccggcaccctgcgggacaagctggtgcaccagtacctgctgcagccctacggccaggagggcctgaagagcaagtctgtgcagctgaatggccagcccctggtgatggtggatgatggcaccctgcctgagctgaagccccggcccctgcgggccggccgcaccctggtgatcccccctgtgaccatgggcttctacgtggtgaagaatgtgaatgccctggcctgccgctacagatag

SEQ ID NO: 155136 - DNA, 1443 bp, Artificial Sequence
  Description of Artificial Sequence: Synthetic coding sequence
atgagggtgctgtgtgccttccctgaggccatgcccagcagcaacagccggcccccagcctgcctggcccctggggccctgtacctggccctgctgctgcacctgagcctgagcagccaggccggggaccggcggcccctgcctgtggacagagctgctggcctgaaggagaagaccctcatcctgctggatgtgtccaccaagaaccctgtgaggacagtgaatgaaaacttcctgagcctgcagctggaccccagcatcatccatgatggctggctggacttcctgagcagcaagaggctggtgaccctggcccggggcctgagccctgccttcctgcgctttggaggcaagaggacagacttcctgcagttccagaacctgagaaatcctgccaagagccggggcggccctggccctgactactacctgaagaactatgaagatgagcccaacaactaccgcaccatgcacggccgggctgtgaatggcagccagctgggcaaggactacatccagctgaagagcctgctgcagcccatccgcatctacagccgggccagcctgtatggccccaacatcggccggcccaggaagaatgtcatcgccctgctggatggcttcatgaaggtggccggcagcacagtggatgctgtgacctggcagcactgctacattgatggccgggtggtgaaggtgatggacttcctgaagacccggctgctggacaccctgagtgaccagatcaggaagatccagaaggtggtgaacacctacaccccaggcaagaagatctggctggagggcgtggtgaccaccagcgctgggggcaccaacaacctgagtgacagctatgctgctggcttcctgtggctgaacaccctgggcatgctggccaaccagggcattgatgtggtgatccgccacagcttctttgaccacggctacaaccacctggtggaccagaacttcaaccccctgcctgactactggctgagcctgctgtacaagaggctcatcggccccaaggtgctggccgtgcacgtggccggcctgcagaggaagccccggcccggccgggtcatccgggacaagctgcgcatctatgcccactgcaccaaccaccacaaccacaactacgtgcggggcagcatcaccctcttcatcatcaacctgcacaggagcaggaagaagatcaagctggccggcaccctgcgggacaagctggtgcaccagtacctgctgcagccctacggccaggagggcctgaagagcaagtctgtgcagctgaatggccagcccctggtgatggtggatgatggcaccctgcctgagctgaagccccggcccctgcgggccggccgcaccctggtgatcccccctgtgaccatgggcttctacgtggtgaagaatgtgaatgccctggcctgccgctacagatag

SEQ ID NO: 155137 - DNA, 1251 bp, Artificial Sequence
  Description of Artificial Sequence: Synthetic coding sequence
atgaagcgggagcggggggccctgagccgggccagccgggccctgcggctggccccctttgtgtacctgctgctgatccagacagaccccctggagggcgtgaacatcaccagccctgtgcggctcatccacggcaccgtgggcaagagcgccctgctgtctgtgcagtacagcagcaccagcagtgacaggcctgtggtgaagtggcagctgaagagggacaagcctgtgacagtggtgcagagcattggaacagaggtgattggcaccctgcggccagactacagagaccgcatccggctgtttgaaaatggcagcctgctgctgagtgacctgcagctggctgatgagggcacctatgaggtggagatcagcatcacagatgacaccttcaccggggagaagaccatcaacctgactgtggatgtgcccatcagccggccccaggtgctggtggccagcaccaccgtgctggagctgtctgaggccttcaccctgaactgcagccatgaaaatggcaccaagcccagctacacctggctgaaggatggcaagcccctgctgaatgacagcaggatgctgctgagcccagaccagaaggtgctgaccatcaccagggtgctgatggaggatgatgacctgtacagctgcatggtggagaaccccatcagccagggccgcagcctgcctgtgaagatcaccgtgtacagaagaagcagcctgtacatcatcctgagcactggaggcatcttcctgctggtgaccctggtgacagtgtgtgcctgctggaagcccagcaagaggaagcagaagaagctggagaagcagaacagcctggagtacatggaccagaatgatgaccggctgaagccagaggccgacaccctgcccaggtctggagagcaggagaggaagaaccccatggccctgtacatcctgaaggacaaggacagccctgagacagaagaaaatcctgcccctgagcccaggtctgccacagagcccggccccccaggctacagcgtgtccccagctgtgcccggccgcagccctggcctgcccatccgcagcgcccggcgctaccccaggagccctgcccggagccctgccactggaagaacccacagcagccccccccgggcccccagcagccctggccgcagccgcagcgccagcaggaccctgaggacagctggggtgcacatcatccgggagcaggatgaagctggccctgtggagatcagcgcctag

SEQ ID NO: 155138 - DNA, 1104 bp, Artificial Sequence
  Description of Artificial Sequence: Synthetic coding sequence
atgaagcgggagcggggggccctgagccgggccagccgggccctgcggctggccccctttgtgtacctgctgctgatccagacagaccccctggagggcgtgaacatcaccagccctgtgcggctcatccacggcaccgtgggcaagagcgccctgctgtctgtgcagtacagcagcaccagcagtgacaggcctgtggtgaagtggcagctgaagagggacaagcctgtgacagtggtgcagagcattggaacagaggtgattggcaccctgcggccagactacagagaccgcatccggctgtttgaaaatggcagcctgctgctgagtgacctgcagctggctgatgagggcacctatgaggtggagatcagcatcacagatgacaccttcaccggggagaagaccatcaacctgactgtggatgtgcccatcagccggccccaggtgctggtggccagcaccaccgtgctggagctgtctgaggccttcaccctgaactgcagccatgaaaatggcaccaagcccagctacacctggctgaaggatggcaagcccctgctgaatgacagcaggatgctgctgagcccagaccagaaggtgctgaccatcaccagggtgctgatggaggatgatgacctgtacagctgcatggtggagaaccccatcagccagggccgcagcctgcctgtgaagatcaccgtgtacagaagaagcagcctgtacatcatcctgagcactggaggcatcttcctgctggtgaccctggtgacagtgtgtgcctgctggaagcccagcaagaggaagcagaagaagctggagaagcagaacagcctggagtacatggaccagaatgatgaccggctgaagccagagggggagctgcctgccacccagagccccatccccagcaccatccgctctgtgggctgctgggagaaggccgagctgggggacaaggagaacagcagcgctggcaccctgcccagcgacctgggcgccagcaagggcaaggagcctgagcccgccagcctggccagcagccacagcctgcccaggagacatgccatgcccagcaccctgtctgtgtctgtgcatgaatag

SEQ ID NO: 155139 - DNA, 669 bp, Artificial Sequence
  Description of Artificial Sequence: Synthetic coding sequence
atgagccagaccaagatgctgaaggtgcgggtgaccctcttctgcatcctggccggcatcgtgctggccatgacagctgtggtgacagaccactgggccgtgctgagcccccacatggagcaccacaacaccacctgtgaggccgcccacttcggcctgtggaggatctgcaccaagaggatccccatggatgacagcaagacctgtggccccatcaccctgcctggagagaagaactgcagctacttccgccacttcaaccctggagagagcagcgagatctttgagttcaccacccagaaggagtacagcatctctgctgctgccatcgccatcttcagcctgggcttcatcatcctgggcagcctgtgtgtgctgctgagcctgggcaagaagagggactacctgctgcggcctgcctccatgttctacgcctttgctggcctgtgcatcctggtgtctgtggaggtgatgaggcagagcgtgaagaggatgattgacagtgaagatactgtgtggattgagtactactacagctggagctttgcctgtgcctgtgccgccttcatcctgctcttcctgggcggcctggccctgctgctcttcagcctgcccaggatgcccaggaacccctgggagagctgcatggatgctgagcctgagcactag

SEQ ID NO: 155140 - DNA, 633 bp, Artificial Sequence
  Description of Artificial Sequence: Synthetic coding sequence
atggacctggaggagttcctgtctgaaaatggcatcccccccagccccagccagcacgaccacagcccccaccccccaggcctgcagcctgccagcagcgctgcccccagcgtgatggacctgagcagccgggccagcgcccccctgcaccctggcatccccagccccaactgcatgcagagccccatccggcccggccagctgctgcctgccaacagaaacacccccagccccattgatcctgacaccatccaggtgcctgtgggctatgagccagaccctgctgacctggccctgagcagcatccctggccaggagatgtttgaccccaggaagaggaagttcagcgaggaggagctgaagccccagcccatgatcaagaaggccaggaaggtgttcatcccagatgacctgaaggatgacaagtactgggcccggcggaggaagaacaacatggccgccaagaggagcagagatgcccggcggctgaaggagaaccagatcgccatccgggccagcttcctggagaaggagaacagcgccctgcggcaggaggtggccgacctgaggaaggagctgggcaagtgcaagaacatcctggccaagtatgaggcccggcacggccccctgtag

SEQ ID NO: 155141 - DNA, 1095 bp, Artificial Sequence
  Description of Artificial Sequence: Synthetic coding sequence
atgcacccccaggtggtgatcctgagcctcatcctgcacctggccgacagcgtggccggctctgtgaaggtgggcggggaggccggccccagcgtgaccctgccctgccactacagcggggctgtgacctccatgtgctggaacagaggcagctgcagcctcttcacctgccagaatggaattgtgtggaccaacggcacccacgtgacctacaggaaggacacccgctacaagctgctgggggacctgagcagaagagatgtgtccctgaccattgaaaatacagctgtgtctgacagcggcgtgtactgctgccgggtggagcaccggggctggttcaatgacatgaagatcaccgtgtccctggagatcgtgccccccaaggtgaccaccacccccatcgtgaccaccgtgcccaccgtgaccaccgtgaggaccagcaccaccgtgcccaccaccaccaccgtgcccatgaccaccgtgcccaccaccaccgtgcccaccaccatgagcatccccaccaccaccaccgtgctgaccaccatgacagtgtccaccaccacctctgtgcccaccaccaccagcatccccaccaccacctctgtgcctgtgaccaccaccgtgtccacctttgtgccccccatgcccctgccccggcagaaccacgagcctgtggccaccagccccagcagcccccagcctgctgagacccaccccaccaccctgcagggcgccatcagaagagagcccaccagcagccccctgtacagctacaccacagatggaaatgacacagtgacagagagcagtgatggcctgtggaacaacaaccagacccagctgttcctggagcacagcctgctgacagccaacaccaccaagggcatctatgctggggtgtgcatctctgtgctggtgctgctggccctgctgggcgtcatcatcgccaagaagtacttcttcaagaaggaggtgcagcagctgtctgtgtccttcagcagcctgcagatcaaggccctgcagaatgctgtggagaaggaggtgcaggccgaggacaacatctacatcgagaacagcctgtatgccacagactag

SEQ ID NO: 155142 - DNA, 1206 bp, Artificial Sequence
  Description of Artificial Sequence: Synthetic coding sequence
atgcacccccaggtggtgatcctgagcctcatcctgcacctggccgacagcgtggccggctctgtgaaggtgggcggggaggccggccccagcgtgaccctgccctgccactacagcggggctgtgacctccatgtgctggaacagaggcagctgcagcctcttcacctgccagaatggaattgtgtggaccaacggcacccacgtgacctacaggaaggacacccgctacaagctgctgggggacctgagcagaagagatgtgtccctgaccattgaaaatacagctgtgtctgacagcggcgtgtactgctgccgggtggagcaccggggctggttcaatgacatgaagatcaccgtgtccctggagatcgtgccccccaaggtgaccaccacccccatcgtgaccaccgtgcccaccgtgaccaccgtgaggaccagcaccaccgtgcccaccaccaccaccgtgcccatgaccaccgtgcccaccaccaccgtgcccaccaccatgagcatccccaccaccaccaccgtgctgaccaccatgacagtgtccaccaccacctctgtgcccaccaccaccagcatccccaccaccacctctgtgcctgtgaccaccaccgtgtccacctttgtgccccccatgcccctgccccggcagaaccacgagcctgtggccaccagccccagcagcccccagcctgctgagacccaccccaccaccctgcagggcgccatcagaagagagcccaccagcagccccctgtacagctacaccacagatggaaatgacacagtgacagagagcagtgatggcctgtggaacaacaaccagacccagctgttcctggagcacagcctgctgacagccaacaccaccaagggcatctatgctggggtgtgcatctctgtgctggtgctgctggccctgctgggcgtcatcatcgccaagatgttccacctggccgccttcaagctgaagctgtgcaagatgcagctgaagaggaagagcaagcagaagaccatcagcaccctgagaattgtgttcatgcccaggaccaagacccagtggtgcagcctgcgggtgtatgcccacgagtgccggcggctgaacagacaccagcacatccggcggctgctggaccccaagaccatcttcctgttccagttccacctggccttccagcacgtgtctgacaccggctag

SEQ ID NO: 155143 - DNA, 672 bp, Artificial Sequence
  Description of Artificial Sequence: Synthetic coding sequence
atgcacccccaggtggtgatcctgagcctcatcctgcacctggccgacagcgtggccggctctgtgaaggtgggcggggaggccggccccagcgtgaccctgccctgccactacagcggggctgtgacctccatgtgctggaacagaggcagctgcagcctcttcacctgccagaatggaattgtgtggaccaacggcacccacgtgacctacaggaaggacacccgctacaagctgctgggggacctgagcagaagagatgtgtccctgaccattgaaaatacagctgtgtctgacagcggcgtgtactgctgccgggtggagcaccggggctggttcaatgacatgaagatcaccgtgtccctggagatcgtgccccccaaggtgaccaccacccccatcgtgaccaccgtgcccaccgtgaccaccgtgaggaccagcaccaccgtgcccaccaccaccaccgtgcccatgaccaccgtgcccaccaccaccgtgcccaccaccatgagcatccccaccaccaccaccgtgctgaccaccatgacagtgtccaccaccacctctgtgcccaccaccaccagcatccccaccaccacctctgtgcctgtgaccaccaccgtgtccacctttgtgccccccatgcccctgccccggcagaaccacgagtag

SEQ ID NO: 155144 - DNA, 1095 bp, Artificial Sequence; identical to SEQ ID NO: 155141
  Description of Artificial Sequence: Synthetic coding sequence

SEQ ID NO: 155145 - DNA, 1095 bp, Artificial Sequence; identical to SEQ ID NO: 155141
  Description of Artificial Sequence: Synthetic coding sequence

SEQ ID NO: 155146 - DNA, 522 bp, Artificial Sequence
  Description of Artificial Sequence: Synthetic coding sequence
atggagcctggagctggccacctggatggccacagagctggcagccccagcctgcggcaggccctgtgtgatggcagcgctgtgatgttcagcagcaaggagcggggccgctgcaccgtcatcaactttgtgcccctggaggcccccctgcggagcacccccaggagccggcaggtgacagaggcctgtggcggggagggccgggctgtgcccctgggcagcgagcctgagtggagcgtgggcggcatggaggccaccctggagcagcacctggaggacaccatgaagaaccccagcatcgtgggcgtgctgtgcacagacagccagggcctgaacctgggctgccggggcaccctgagtgatgaacatgctggggtcatctctgtgctggcccagcaggccgccaagctgaccagtgaccccacagacatccctgtggtgtgcctggagagtgacaatggaaacatcatgatccagaagcatgatggcatcaccgtggccgtgcacaagatggccagctag

SEQ ID NO: 155147 - DNA, 267 bp, Artificial Sequence
  Description of Artificial Sequence: Synthetic coding sequence
atgggcaactggggcctgggcatcgccccctgggtggatggagagagcgagctggagttccggcggctgggcatgcagggccccctggaggccctgcggcggcgggagtggaacacccagagggccagcttctccttctccttcctgattgccctgagcccccacacagtggactactgccacagctatgagctgttcaacagacgctggcacggccacgtgctggccacccagaggcccagcctcttcatcctgatgctggtgtag

SEQ ID NO: 155148 - DNA, 2334 bp, Artificial Sequence
  Description of Artificial Sequence: Synthetic coding sequence
atgggccggggcagcggcacctttgagcggctgctggacaaggccaccagccagctgctgctggagacagactgggagagcatcctgcagatctgtgacctgatccggcagggcgacacccaggccaagtatgctgtgaacagcatcaagaagaaggtgaatgacaagaacccccacgtggccctgtatgccctggaggtgatggagagcgtggtgaagaactgtggccagacagtgcatgatgaggtggccaacaagcagaccatggaggagctgaaggacctgctgaagaggcaggtggaggtgaatgtgaggaacaagatcctgtacctgatccaggcctgggcccacgccttcagaaatgagcccaagtacaaggtggtgcaggacacctaccagatcatgaaggtggagggccacgtgtttcctgagttcaaggagagtgatgccatgtttgctgctgagcgggccccagactgggtggatgctgaggagtgccaccgctgccgggtgcagtttggagtgatgaccaggaagcaccactgccgggcctgtggccagatcttctgtgggaagtgcagcagcaagtacagcaccatccccaagtttggaattgagaaggaggtgcgggtgtgtgagccctgctatgagcagctgaacaggaaggccgagggcaaggccaccagcaccacagagctgcccccagagtacctgaccagccccctgagccagcagagccagctgccccccaagagagatgaaacagccctgcaggaggaggaggagctgcagctggccctggccctgagccagagcgaggccgaggagaaggagcggctgcggcagaagagcacctacaccagctaccccaaggccgagcccatgcccagcgccagcagcgcccccccagccagcagcctgtacagcagccctgtgaacagcagcgcccccctggccgaggacatcgaccctgagctggcccgctacctgaacagaaactactgggagaagaagcaggaggaggccaggaagagccccaccccatctgcccctgtgcccctgacagagcctgctgcccagcctggagagggccacgccgcccccaccaacgtggtggagaaccccctgcctgagacagacagccagcccatccccccatctgggggccccttcagcgagccccagttccacaacggggagagcgaggagagccatgagcagttcctgaaggccctgcagaatgctgtgaccacctttgtgaacaggatgaagagcaaccacatgaggggccgcagcatcaccaatgattctgctgtgctgagcctcttccagagcatcaatggcatgcacccccagctgctggagctgctgaaccagctggatgaaagaagactctactatgagggcctgcaggacaagctggcccagatcagagatgcccggggggccctgagcgccctgcgggaggagcaccgggagaagctgcggcgggctgctgaggaggccgagcggcagaggcagatccagctggcccagaagctggagatcatgaggcagaagaagcaggagtacctggaggtgcagaggcagctggccatccagaggctgcaggagcaggagaaggagcggcagatgaggctggagcagcagaagcagacagtgcagatgagggcccagatgcctgccttccccctgccctatgcccagctgcaggccatgcctgctgctgggggcgtgctgtaccagcccagcggccctgccagcttccccagcaccttctccccagctggctctgtggagggcagccccatgcatggagtgtacatgagccagcctgccccagctgctggcccctaccccagcatgcccagcacagctgctgaccccagcatggtgtctgcctacatgtacccagctggggccaccggggcccaggccgccccccaggcccaggccggccccacagccagccctgcctacagcagctaccagcccacccccacagctggctaccagaatgtggccagccaggccccccagagcctgcctgccatcagccagcccccccagagcagcaccatgggctacatgggcagccagagcgtgtccatgggctaccagccctacaacatgcagaacctgatgaccaccctgcccagccaggatgccagcctgcccccccagcagccctacatcgccggccagcagcccatgtaccagcagatggcccccagcggcggccccccccagcagcagccccctgtggcccagcagccccaggcccagggccccccagcccagggcagcgaggcccagctgatcagctttgattag

SEQ ID NO: 155149 - DNA, 2076 bp, Artificial Sequence
  Description of Artificial Sequence: Synthetic coding sequence
atgggccggggcagcggcacctttgagcggctgctggacaaggccaccagccagctgctgctggagacagactgggagagcatcctgcagatctgtgacctgatccggcagggcgacacccaggccaagtatgctgtgaacagcatcaagaagaaggtgaatgacaagaacccccacgtggccctgtatgccctggaggtgatggagagcgtggtgaagaactgtggccagacagtgcatgatgaggtggccaacaagcagaccatggaggagctgaaggacctgctgaagaggcaggtggaggtgaatgtgaggaacaagatcctgtacctgatccaggcctgggcccacgccttcagaaatgagcccaagtacaaggtggtgcaggacacctaccagatcatgaaggtggagggccacgtgtttcctgagttcaaggagagtgatgccatgtttgctgctgagcgggccccagactgggtggatgctgaggagtgccaccgctgccgggtgcagtttggagtgatgaccaggaagcaccactgccgggcctgtggccagatcttctgtgggaagtgcagcagcaagtacagcaccatccccaagtttggaattgagaaggaggtgcgggtgtgtgagccctgctatgagcagctgaacaggaaggccgagggcaaggccaccagcaccacagagctgcccccagagtacctgaccagccccctgagccagcagagccagctgccccccaagagagatgaaacagccctgcaggaggaggaggagctgcagctggccctggccctgagccagagcgaggccgaggagaaggagcggctgcggcagaagagcacctacaccagctaccccaaggccgagcccatgcccagcgccagcagcgcccccccagccagcagcctgtacagcagccctgtgaacagcagcgcccccctggccgaggacatcgaccctgagctggcccgctacctgaacagaaactactgggagaagaagcaggaggaggccaggaagagccccaccccatctgcccctgtgcccctgacagagcctgctgcccagcctggagagggccacgccgcccccaccaacgtggtggagaaccccctgcctgagacagacagccagcccatccccccatctgggggccccttcagcgagccccagttccacaacggggagagcgaggagagccatgagcagttcctgaaggccctgcagaatgctgtgaccacctttgtgaacaggatgaagagcaaccacatgaggggccgcagcatcaccaatgattctgctgtgctgagcctcttccagagcatcaatggcatgcacccccagctgctggagctgctgaaccagctggatgaaagaagactctactatgagggcctgcaggacaagctggcccagatcagagatgcccggggggccctgagcgccctgcgggaggagcaccgggagaagctgcggcgggctgctgaggaggccgagcggcagaggcagatccagctggcccagaagctggagatcatgatgcatggagtgtacatgagccagcctgccccagctgctggcccctaccccagcatgcccagcacagctgctgaccccagcatggtgtctgcctacatgtacccagctggggccaccggggcccaggccgccccccaggcccaggccggccccacagccagccctgcctacagcagctaccagcccacccccacagctggctaccagaatgtggccagccaggccccccagagcctgcctgccatcagccagcccccccagagcagcaccatgggctacatgggcagccagagcgtgtccatgggctaccagccctacaacatgcagaacctgatgaccaccctgcccagccaggatgccagcctgcccccccagcagccctacatcgccggccagcagcccatgtaccagcagatggcccccagcggcggccccccccagcagcagccccctgtggcccagcagccccaggcccagggccccccagcccagggcagcgaggcccagctgatcagctttgattag

SEQ ID NO: 155150 - DNA, 324 bp, Artificial Sequence
  Description of Artificial Sequence: Synthetic coding sequence
atgaggctgagcaagaccctggtggacatggacatggctgactacagcgctgccctggaccctgcctacaccaccctggagtttgaaaatgtgcaggtgctgaccatgggaaatgactttgtggccgccgccagccggcagatcgaggccagcccccccaccagcctggagcacatctggaggggcggccagttcagcacaggccgccacgtgcccatccgccgccaccagccccagagggcccagcagcccggctgccagaggcctgtgtgccacctgcggggccctggccacggccagaccctgcgctgcctggagctgtag

SEQ ID NO: 155151 - DNA, 1425 bp, Artificial Sequence
  Description of Artificial Sequence: Synthetic coding sequence
atgaggctgagcaagaccctggtggacatggacatggctgactacagcgctgccctggaccctgcctacaccaccctggagtttgaaaatgtgcaggtgctgaccatgggaaatgacaccagccccagcgagggcaccaacctgaatgcccccaacagcctgggcgtgtctgccctgtgtgccatctgtggggaccgggccaccgggaagcactacggggccagcagctgtgatggctgcaagggcttcttcagaagatctgtgaggaagaaccacatgtacagctgccgcttcagccggcagtgtgtggtggacaaggacaagaggaaccagtgccgctactgccgcctgaagaagtgcttccgggccggcatgaagaaggaggccgtgcagaatgaaagagaccgcatcagcacccggcgcagcagctatgaggacagcagcctgcccagcatcaatgccctgctgcaggccgaggtgctgagccggcagatcaccagccctgtgtctggcatcaatggagacatccgggccaagaagatcgccagcattgctgatgtgtgtgagagcatgaaggagcagctgctggtgctggtggagtgggccaagtacatcccagccttctgtgagctgcccctggatgaccaggtggccctgctgcgggcccacgccggggagcacctgctgctgggcgccaccaagaggtccatggtgttcaaggatgtgctgctgctgggcaatgactacatcgtgcccaggcactgcccagagctggccgagatgagccgggtgtccatccgcatcctggatgagctggtgctgcccttccaggagctgcagattgatgacaatgaatatgcctacctgaaggccatcatcttctttgatcctgatgccaagggcctgagtgaccccgggaagatcaagaggctgcggagccaggtgcaggtgtccctggaggactacatcaatgaccggcagtatgacagccggggccgctttggagagctgctgctgctgctgcccaccctgcagagcatcacctggcagatgattgagcagatccagttcatcaagctgtttggcatggccaagattgacaacctgctgcaggagatgctgctgggcggcagccccagtgatgccccccacgcccaccaccccctgcacccccacctgatgcaggagcacatgggcaccaacgtgattgtggccaacaccatgcccacccacctgagcaatggccagatgtgtgagtggccccggccccggggccaggccgccaccccagagaccccccagcccagccccccaggcggcagcggcagcgagccctacaagctgctgcccggggctgtggccaccatcgtgaagcccctgagcgccatcccccagcccaccatcaccaagcaggaggtgatctag

SEQ ID NO: 155152 - DNA, 1359 bp, Artificial Sequence
  Description of Artificial Sequence: Synthetic coding sequence
atggtgtctgtgaatgcccccctgggcgcccctgtggagagcagctatgacaccagccccagcgagggcaccaacctgaatgcccccaacagcctgggcgtgtctgccctgtgtgccatctgtggggaccgggccaccgggaagcactacggggccagcagctgtgatggctgcaagggcttcttcagaagatctgtgaggaagaaccacatgtacagctgccgcttcagccggcagtgtgtggtggacaaggacaagaggaaccagtgccgctactgccgcctgaagaagtgcttccgggccggcatgaagaaggaggccgtgcagaatgaaagagaccgcatcagcacccggcgcagcagctatgaggacagcagcctgcccagcatcaatgccctgctgcaggccgaggtgctgagccggcagatcaccagccctgtgtctggcatcaatggagacatccgggccaagaagatcgccagcattgctgatgtgtgtgagagcatgaaggagcagctgctggtgctggtggagtgggccaagtacatcccagccttctgtgagctgcccctggatgaccaggtggccctgctgcgggcccacgccggggagcacctgctgctgggcgccaccaagaggtccatggtgttcaaggatgtgctgctgctgggcaatgactacatcgtgcccaggcactgcccagagctggccgagatgagccgggtgtccatccgcatcctggatgagctggtgctgcccttccaggagctgcagattgatgacaatgaatatgcctacctgaaggccatcatcttctttgatcctgatgccaagggcctgagtgaccccgggaagatcaagaggctgcggagccaggtgcaggtgtccctggaggactacatcaatgaccggcagtatgacagccggggccgctttggagagctgctgctgctgctgcccaccctgcagagcatcacctggcagatgattgagcagatccagttcatcaagctgtttggcatggccaagattgacaacctgctgcaggagatgctgctgggcggcagccccagtgatgccccccacgcccaccaccccctgcacccccacctgatgcaggagcacatgggcaccaacgtgattgtggccaacaccatgcccacccacctgagcaatggccagatgtgtgagtggccccggccccggggccaggccgccaccccagagaccccccagcccagccccccaggcggcagcggcagcgagccctacaagctgctgcccggggctgtggccaccatcgtgaagcccctgagcgccatcccccagcccaccatcaccaagcaggaggtgatctag

SEQ ID NO: 155153 - DNA, 1515 bp, Artificial Sequence
  Description of Artificial Sequence: Synthetic coding sequence
atgaggctgagcaagaccctggtggacatggacatggctgactacagcgctgccctggaccctgcctacaccaccctggagtttgaaaatgtgcaggtgctgaccatgggaaatgtgctgctgcccctgcggctggcccggctgcggcaccccctgcggcaccactggagcatctctggaggagtggacagcagcccccagggcgacaccagccccagcgagggcaccaacctgaatgcccccaacagcctgggcgtgtctgccctgtgtgccatctgtggggaccgggccaccgggaagcactacggggccagcagctgtgatggctgcaagggcttcttcagaagatctgtgaggaagaaccacatgtacagctgccgcttcagccggcagtgtgtggtggacaaggacaagaggaaccagtgccgctactgccgcctgaagaagtgcttccgggccggcatgaagaaggaggccgtgcagaatgaaagagaccgcatcagcacccggcgcagcagctatgaggacagcagcctgcccagcatcaatgccctgctgcaggccgaggtgctgagccggcagatcaccagccctgtgtctggcatcaatggagacatccgggccaagaagatcgccagcattgctgatgtgtgtgagagcatgaaggagcagctgctggtgctggtggagtgggccaagtacatcccagccttctgtgagctgcccctggatgaccaggtggccctgctgcgggcccacgccggggagcacctgctgctgggcgccaccaagaggtccatggtgttcaaggatgtgctgctgctgggcaatgactacatcgtgcccaggcactgcccagagctggccgagatgagccgggtgtccatccgcatcctggatgagctggtgctgcccttccaggagctgcagattgatgacaatgaatatgcctacctgaaggccatcatcttctttgatcctgatgccaagggcctgagtgaccccgggaagatcaagaggctgcggagccaggtgcaggtgtccctggaggactacatcaatgaccggcagtatgacagccggggccgctttggagagctgctgctgctgctgcccaccctgcagagcatcacctggcagatgattgagcagatccagttcatcaagctgtttggcatggccaagattgacaacctgctgcaggagatgctgctgggcggcagccccagtgatgccccccacgcccaccaccccctgcacccccacctgatgcaggagcacatgggcaccaacgtgattgtggccaacaccatgcccacccacctgagcaatggccagatgtgtgagtggccccggccccggggccaggccgccaccccagagaccccccagcccagccccccaggcggcagcggcagcgagccctacaagctgctgcccggggctgtggccaccatcgtgaagcccctgagcgccatcccccagcccaccatcaccaagcaggaggtgatctag

SEQ ID NO: 155154 - DNA, 1395 bp, Artificial Sequence
  Description of Artificial Sequence: Synthetic coding sequence
atgaggctgagcaagaccctggtggacatggacatggctgactacagcgctgccctggaccctgcctacaccaccctggagtttgaaaatgtgcaggtgctgaccatgggaaatgacaccagccccagcgagggcaccaacctgaatgcccccaacagcctgggcgtgtctgccctgtgtgccatctgtggggaccgggccaccgggaagcactacggggccagcagctgtgatggctgcaagggcttcttcagaagatctgtgaggaagaaccacatgtacagctgccgcttcagccggcagtgtgtggtggacaaggacaagaggaaccagtgccgctactgccgcctgaagaagtgcttccgggccggcatgaagaaggaggccgtgcagaatgaaagagaccgcatcagcacccggcgcagcagctatgaggacagcagcctgcccagcatcaatgccctgctgcaggccgaggtgctgagccggcagatcaccagccctgtgtctggcatcaatggagacatccgggccaagaagatcgccagcattgctgatgtgtgtgagagcatgaaggagcagctgctggtgctggtggagtgggccaagtacatcccagccttctgtgagctgcccctggatgaccaggtggccctgctgcgggcccacgccggggagcacctgctgctgggcgccaccaagaggtccatggtgttcaaggatgtgctgctgctgggcaatgactacatcgtgcccaggcactgcccagagctggccgagatgagccgggtgtccatccgcatcctggatgagctggtgctgcccttccaggagctgcagattgatgacaatgaatatgcctacctgaaggccatcatcttctttgatcctgatgccaagggcctgagtgaccccgggaagatcaagaggctgcggagccaggtgcaggtgtccctggaggactacatcaatgaccggcagtatgacagccggggccgctttggagagctgctgctgctgctgcccaccctgcagagcatcacctggcagatgattgagcagatccagttcatcaagctgtttggcatggccaagattgacaacctgctgcaggagatgctgctgggcggcagccccagtgatgccccccacgcccaccaccccctgcacccccacctgatgcaggagcacatgggcaccaacgtgattgtggccaacaccatgcccacccacctgagcaatggccagatgagcaccccagagaccccccagcccagccccccaggcggcagcggcagcgagccctacaagctgctgcccggggctgtggccaccatcgtgaagcccctgagcgccatcccccagcccaccatcaccaagcaggaggtgatctag

SEQ ID NO: 155155 - DNA, 1254 bp, Artificial Sequence
  Description of Artificial Sequence: Synthetic coding sequence
atgaggctgagcaagaccctggtggacatggacatggctgactacagcgctgccctggaccctgcctacaccaccctggagtttgaaaatgtgcaggtgctgaccatgggaaatgacaccagccccagcgagggcaccaacctgaatgcccccaacagcctgggcgtgtctgccctgtgtgccatctgtggggaccgggccaccgggaagcactacggggccagcagctgtgatggctgcaagggcttcttcagaagatctgtgaggaagaaccacatgtacagctgccgcttcagccggcagtgtgtggtggacaaggacaagaggaaccagtgccgctactgccgcctgaagaagtgcttccgggccggcatgaagaaggaggccgtgcagaatgaaagagaccgcatcagcacccggcgcagcagctatgaggacagcagcctgcccagcatcaatgccctgctgcaggccgaggtgctgagccggcagatcaccagccctgtgtctggcatcaatggagacatccgggccaagaagatcgccagcattgctgatgtgtgtgagagcatgaaggagcagctgctggtgctggtggagtgggccaagtacatcccagccttctgtgagctgcccctggatgaccaggtggccctgctgcgggcccacgccggggagcacctgctgctgggcgccaccaagaggtccatggtgttcaaggatgtgctgctgctgggcaatgactacatcgtgcccaggcactgcccagagctggccgagatgagccgggtgtccatccgcatcctggatgagctggtgctgcccttccaggagctgcagattgatgacaatgaatatgcctacctgaaggccatcatcttctttgatcctgatgccaagggcctgagtgaccccgggaagatcaagaggctgcggagccaggtgcaggtgtccctggaggactacatcaatgaccggcagtatgacagccggggccgctttggagagctgctgctgctgctgcccaccctgcagagcatcacctggcagatgattgagcagatccagttcatcaagctgtttggcatggccaagattgacaacctgctgcaggagatgctgctgggcggcccctgccaggcccaggagggccggggctggagcggggacagccctggggaccggccccacacagtgagcagccccctgagcagcctggccagccccctgtgccgcttcggccaggtggcctag

SEQ ID NO: 155156 - DNA, 1329 bp, Artificial Sequence
  Description of Artificial Sequence: Synthetic coding sequence
atggtgtctgtgaatgcccccctgggcgcccctgtggagagcagctatgacaccagccccagcgagggcaccaacctgaatgcccccaacagcctgggcgtgtctgccctgtgtgccatctgtggggaccgggccaccgggaagcactacggggccagcagctgtgatggctgcaagggcttcttcagaagatctgtgaggaagaaccacatgtacagctgccgcttcagccggcagtgtgtggtggacaaggacaagaggaaccagtgccgctactgccgcctgaagaagtgcttccgggccggcatgaagaaggaggccgtgcagaatgaaagagaccgcatcagcacccggcgcagcagctatgaggacagcagcctgcccagcatcaatgccctgctgcaggccgaggtgctgagccggcagatcaccagccctgtgtctggcatcaatggagacatccgggccaagaagatcgccagcattgctgatgtgtgtgagagcatgaaggagcagctgctggtgctggtggagtgggccaagtacatcccagccttctgtgagctgcccctggatgaccaggtggccctgctgcgggcccacgccggggagcacctgctgctgggcgccaccaagaggtccatggtgttcaaggatgtgctgctgctgggcaatgactacatcgtgcccaggcactgcccagagctggccgagatgagccgggtgtccatccgcatcctggatgagctggtgctgcccttccaggagctgcagattgatgacaatgaatatgcctacctgaaggccatcatcttctttgatcctgatgccaagggcctgagtgaccccgggaagatcaagaggctgcggagccaggtgcaggtgtccctggaggactacatcaatgaccggcagtatgacagccggggccgctttggagagctgctgctgctgctgcccaccctgcagagcatcacctggcagatgattgagcagatccagttcatcaagctgtttggcatggccaagattgacaacctgctgcaggagatgctgctgggcggcagccccagtgatgccccccacgcccaccaccccctgcacccccacctgatgcaggagcacatgggcaccaacgtgattgtggccaacaccatgcccacccacctgagcaatggccagatgagcaccccagagaccccccagcccagccccccaggcggcagcggcagcgagccctacaagctgctgcccggggctgtggccaccatcgtgaagcccctgagcgccatcccccagcccaccatcaccaagcaggaggtgatctag

SEQ ID NO: 155157 - DNA, 1227 bp, Artificial Sequence
  Description of Artificial Sequence: Synthetic coding sequence
atgaacaccacagacaacggggtgaactgcctgtgtgccatctgtggggaccgggccaccgggaagcactacggggccagcagctgtgatggctgcaagggcttcttcagaagaagcatcaggaagagccacgtgtacagctgccgcttcagccggcagtgtgtggtggacaaggacaagaggaaccagtgccgctactgccgcctgaggaagtgcttccgggccggcatgaagaaggaggccgtgcagaatgaaagagaccgcatcagcacccggcgcagcacctttgatggcagcaacatccccagcatcaacaccctggcccaggccgaggtgcgcagccggcagatctctgtgagcagccctggcagcagcacagacatcaacgtgaagaagatcgccagcattggagatgtgtgtgagagcatgaagcagcagctgctggtgctggtggagtgggccaagtacatcccagccttctgtgagctgcccctggatgaccaggtggccctgctgcgggcccacgccggggagcacctgctgctgggcgccaccaagaggtccatgatgtacaaggacatcctgctgctgggcaacaactacgtgatccacaggaacagctgtgaggtggagatcagccgggtggccaacagagtgctggatgagctggtgcggcccttccaggagatccagattgatgacaatgaatatgcctgcctgaaggccatcgtgttctttgatcctgatgccaagggcctgagtgaccctgtgaagatcaagaacatgaggttccaggtgcagatcggcctggaggactacatcaatgaccggcagtatgacagccggggccgctttggagagctgctgctgctgctgcccaccctgcagagcatcacctggcagatgattgagcagatccagtttgtgaagctgtttggcatggtgaagattgacaacctgctgcaggagatgctgctgggcggggccagcaatgatggcagccacctgcaccaccccatgcacccccacctgagccaggaccccctgaccggccagaccatcctgctgggccccatgagcaccctggtgcatgctgaccagatcagcaccccagagacccccctgcccagccccccccagggcagcggccaggagcagtacaagattgctgccaaccaggccagcgtcatcagccaccagcacctgagcaagcagaagcagctgtag

SEQ ID NO: 155158 - DNA, 1338 bp, Artificial Sequence
  Description of Artificial Sequence: Synthetic coding sequence
atggacatggccaactacagcgaggtgctggaccccacctacaccaccctggagtttgagaccatgcagatcctgtacaacagcagtgacagcagcgcccctgagacctccatgaacaccacagacaatggagtgaactgcctgtgtgccatctgtggggaccgggccaccgggaagcactatggagccagcagctgtgatggctgcaagggcttcttccgccgcagcatcaggaagagccacgtgtacagctgccgcttcagccggcagtgtgtggtggacaaggacaagaggaaccagtgccgctactgccgcctgaggaagtgcttccgggccggcatgaagaaggaggccgtgcagaatgaaagagaccgcatcagcaccaggaggagcacctttgatggcagcaacatccccagcatcaacaccctggcccaggccgaggtgcgcagccggcagatctctgtgagcagccctggcagcagcacagacatcaacgtgaagaagatcgccagcattggagatgtgtgtgagagcatgaagcagcagctgctggtgctggtggagtgggccaagtacatcccagccttctgtgagctgcccctggatgaccaggtggccctgctgcgggcccatgctggggagcacctgctgctgggcgccaccaagaggtccatgatgtacaaggacatcctgctgctgggcaacaactacgtgatccacaggaacagctgtgaggtggagatcagccgggtggccaacagagtgctggatgagctggtgcggcccttccaggagatccagattgatgacaatgaatatgcctgcctgaaggccatcgtgttctttgatcctgatgccaagggcctgagtgaccctgtgaagatcaagaacatgaggttccaggtgcagatcggcctggaggactacatcaatgaccggcagtatgacagccggggccgctttggagagctgctgctgctgctgcccaccctgcagagcatcacctggcagatgattgagcagatccagtttgtgaagctgtttggcatggtgaagattgacaacctgctgcaggagatgctgctgggcggggccagcaatgatggcagccacctgcaccaccccatgcacccccacctgagccaggaccccctgaccggccagaccatcctgctgggccccatgagcaccctggtgcacgccgaccagatcagcaccccagagacccccctgcccagccccccccagggcagcggccaggagcagtacaagattgctgccaaccaggccagcgtcatcagccaccagcacctgagcaagcagaagcagctgtag

SEQ ID NO: 155159 - DNA, 723 bp, Artificial Sequence
  Description of Artificial Sequence: Synthetic coding sequence
atgagccgcagcaaccggcagaaggagtacaagtgtggggacctggtgtttgccaagatgaagggctacccccactggccagccagaattgatgagatgcctgaggccgctgtgaagagcacagccaacaagtaccaggtgttcttcttcggcacccatgaaacagccttcctgggccccaaggacctcttcccctatgaggagagcaaggagaagtttgggaagcccaacaagaggaagggcttcagcgagggcctgtgggagattgagaacaaccccaccgtgaaggccagcggctaccagagcagccagaagaagagctgtgtggaggagcctgagcctgagcctgaggccgcagaaggagatggagacaagaagggaaatgctgagggcagcagtgatgaggagggcaagctggtgattgatgagcccgccaaggagaagaatgaaaaaggagccctgaagaggcgggccggggacctgctggaggacagccccaagaggcccaaggaggctgaaaatcctgagggggaggagaaggaggccgccaccctggaggtggagcggcccctgcccatggaggtggagaagaacagcacccccagcgagcccggcagcggccggggccccccccaggaggaggaggaggaggaggatgaggaggaggaggccaccaaggaggatgctgaggcccctggcatccgggaccacgagagcctgtag

SEQ ID NO: 155160 - DNA, 771 bp, Artificial Sequence
  Description of Artificial Sequence: Synthetic coding sequence
atgcaccctgagggcggccagtttgtgccccagctgctgggccacctgctggccaccaagctgaagcgcttcctgctgagcaagggcggcagaagagcccagatcccagatgtgtcccgggccaccccccacaccattgatgagatgcctgaggccgctgtgaagagcacagccaacaagtaccaggtgttcttcttcggcacccatgaaacagccttcctgggccccaaggacctcttcccctatgaggagagcaaggagaagtttgggaagcccaacaagaggaagggcttcagcgagggcctgtgggagattgagaacaaccccaccgtgaaggccagcggctaccagagcagccagaagaagagctgtgtggaggagcctgagcctgagcctgaggccgcagaaggagatggagacaagaagggaaatgctgagggcagcagtgatgaggagggcaagctggtgattgatgagcccgccaaggagaagaatgaaaaaggagccctgaagaggcgggccggggacctgctggaggacagccccaagaggcccaaggaggctgaaaatcctgagggggaggagaaggaggccgccaccctggaggtggagcggcccctgcccatggaggtggagaagaacagcacccccagcgagcccggcagcggccggggccccccccaggaggaggaggaggaggaggatgaggaggaggaggccaccaaggaggatgctgaggcccctggcatccgggaccacgagagcctgtag

SEQ ID NO: 155161 - DNA, 702 bp, Artificial Sequence
  Description of Artificial Sequence: Synthetic coding sequence
atggagcagagagctgggggcaacagagtgcagaccagcaccctgaactgtgccggggctgctgtgattgatgagatgcctgaggccgctgtgaagagcacagccaacaagtaccaggtgttcttcttcggcacccatgaaacagccttcctgggccccaaggacctcttcccctatgaggagagcaaggagaagtttgggaagcccaacaagaggaagggcttcagcgagggcctgtgggagattgagaacaaccccaccgtgaaggccagcggctaccagagcagccagaagaagagctgtgtggaggagcctgagcctgagcctgaggccgcagaaggagatggagacaagaagggaaatgctgagggcagcagtgatgaggagggcaagctggtgattgatgagcccgccaaggagaagaatgagaagggggccctgaagagaagagctggggacctgctggaggacagccccaagaggcccaaggaggccgagaaccctgagggggaggagaaggaggccgccaccctggaggtggagcggcccctgcccatggaggtggagaagaacagcaccccatctgagcccggcagcggccggggccccccccaggaggaggaggaggaggaggatgaggaggaggaggccaccaaggaggatgctgaggcccctggcatccgggaccacgagagcctgtag

SEQ ID NO: 155162 - DNA, 789 bp, Artificial Sequence
  Description of Artificial Sequence: Synthetic coding sequence
atgagccgcagcaaccggcagaaggagtacaagtgtggggacctggtgtttgccaagatgaagggctacccccactggccagccagaattgatgagatgcctgaggccgctgtgaagagcacagccaacaagtaccaggtgttcttcagcggccccacccggcggcacagctgggcccccaagaccagcagcctgaccaggaacccccggcgcagcctggccagccccacccggggcaagggcagcgcccggggctgcggccgcagcaggaccaccctgctgagccggctgcctgccatcagccccccacccagctgcacagagccctgcctgcccggccagtgggtgtacccaggggccaaccccacagagagcagccagaagaagagctgtgtggaggagcctgagcctgagcctgaggccgcagaaggagatggagacaagaagggaaatgctgagggcagcagtgatgaggagggcaagctggtgattgatgagcccgccaaggagaagaatgagaagggggccctgaagagaagagctggggacctgctggaggacagccccaagaggcccaaggaggccgagaaccctgagggggaggagaaggaggccgccaccctggaggtggagcggcccctgcccatggaggtggagaagaacagcaccccatctgagcccggcagcggccggggccccccccaggaggaggaggaggaggaggatgaggaggaggaggccaccaaggaggatgctgaggcccctggcatccgggaccacgagaggtag

SEQ ID NO: 155163 - DNA, 627 bp, Artificial Sequence
  Description of Artificial Sequence: Synthetic coding sequence
atgcctgaggccgctgtgaagagcacagccaacaagtaccaggtgttcttcttcggcacccatgaaacagccttcctgggccccaaggacctcttcccctatgaggagagcaaggagaagtttgggaagcccaacaagaggaagggcttcagcgagggcctgtgggagattgagaacaaccccaccgtgaaggccagcggctaccagagcagccagaagaagagctgtgtggaggagcctgagcctgagcctgaggccgcagaaggagatggagacaagaagggaaatgctgagggcagcagtgatgaggagggcaagctggtgattgatgagcccgccaaggagaagaatgaaaaaggagccctgaagaggcgggccggggacctgctggaggacagccccaagaggcccaaggaggctgaaaatcctgagggggaggagaaggaggccgccaccctggaggtggagcggcccctgcccatggaggtggagaagaacagcacccccagcgagcccggcagcggccggggccccccccaggaggaggaggaggaggaggatgaggaggaggaggccaccaaggaggatgctgaggcccctggcatccgggaccacgagagcctgtag

SEQ ID NO: 155164 - DNA, 723 bp, Artificial Sequence; identical to SEQ ID NO: 155159
  Description of Artificial Sequence: Synthetic coding sequence

SEQ ID NO: 155165 - DNA, 2676 bp, Artificial Sequence
  Description of Artificial Sequence: Synthetic coding sequence
atgcacgccatcaatggatttgtgtttggaaacctgcctgagctgaacatgtgtgcccagaagagggtggcctggcacctgtttggcatgggaaatgaaattgatgtgcacacagccttcttccacggccagatgctgaccacccggggccaccacacagatgtggccaacatcttccctgccacctttgtgacagctgagatggtgccctgggagcccggcacctggctgatcagctgccaggtgaacagccacttcagagatggcatgcaggccctgtacaaggtgaagagctgcagcatggcccctcctgtggacctgctgaccgggaaggtgcggcagtacttcatcgaggcccacgagatccagtgggactatggccccatgggccatgatggcagcacaggcaagaacctgcgggagcccggcagcatcagtgacaagttcttccagaagagcagcagcagaattggaggcacctactggaaggtgcgctatgaggccttccaggatgagaccttccaggagaagatgcacctggaggaggacagacacctgggcatcctgggccctgtgatccgggcagaggtgggggacaccatccaggtggtgttctacaacagagccagccagcccttctccatgcagccccacggcgtcttctatgagaaggactatgagggcaccgtgtacaatgatggcagcagctacccaggcctggtggccaagccctttgagaaggtgacctaccgctggacagtgccccctcatgctggccccacagcccaggaccctgcctgcctgacctggatgtacttctctgctgctgaccccatccgggacaccaacagcggcctggtgggccccctgctggtgtgcagagctggggccctgggcgcagatggcaagcagaagggcgtggacaaggagttcttcctgctcttcaccgtgctggatgagaacaagtcctggtacagcaatgccaaccaggccgccgccatgctggacttccggctgctgtctgaggacatcgagggcttccaggacagcaacaggatgcacgccatcaatggcttcctgttcagcaacctgccccggctggacatgtgcaagggggacacagtggcctggcacctgctgggcctgggcacagaaacagatgtgcatggagtgatgttccagggcaacacagtgcagctgcagggcatgaggaaaggagctgccatgctgttcccccacacctttgtgatggccatcatgcagcctgacaacctgggcacctttgagatctactgccaggccggcagccaccgggaggccggcatgagggccatctacaacgtgtcccagtgccccggccaccaggccaccccccggcagcgctaccaggccgcccgcatctactacatcatggccgaggaggtggagtgggactactgcccagaccgctcctgggagcgggagtggcacaaccagagcgagaaggacagctatggctacatcttcctgagcaacaaggatggcctgctgggcagccgctacaagaaggctgtgttccgggagtacacagatggcaccttccgcatcccccggcccaggacaggccctgaggagcacctgggcatcctgggccccctcatcaagggggaggtgggggacatcctgactgtggtgttcaagaacaatgccagccggccctacagcgtgcacgcccacggcgtgctggagagcaccaccgtgtggcccctggccgctgagcctggagaggtggtgacctaccagtggaacatccctgagaggagcggccctggccccaatgacagcgcctgtgtgtcctggatctactacagcgctgtggaccccatcaaggacatgtacagcggcctggtgggccccctggccatctgccagaagggcatcctggagccccacggcggccgcagtgacatggaccgggagtttgccctgctcttcctgatctttgatgagaacaagtcctggtacctggaggagaatgtggccacccacggcagccaggaccccggcagcatcaacctgcaggatgagaccttcctggagagcaacaagatgcacgccatcaatggcaagctgtatgccaacctgcggggcctgaccatgtaccagggcgagcgggtggcctggtacatgctggccatgggccaggatgtggacctgcacaccatccacttccacgccgagagcttcctgtacagaaatggagagaactacagagcagatgtggtggacctcttccctggcacctttgaggtggtggagatggtggccagcaaccctggcacctggctgatgcactgccacgtgacagaccacgtgcatgctggcatggagaccctcttcaccgtcttcagcaggacagagcacctgagccccctgaccgtcatcaccaaggagacagagaaggctgtgcccccccgggacatcgaggagggcaatgtgaagatgctgggcatgcagatccccatcaagaatgtggagatgctggcctctgtgctggtggccatctctgtgaccctgctgctggtggtgctggccctgggcggcgtggtgtggtaccagcaccggcagaggaagctgcggaggaacagaagaagcatcctggatgacagcttcaagctgctgtccttcaagcagtag

SEQ ID NO: 155166 - DNA, 3477 bp, Artificial Sequence
  Description of Artificial Sequence: Synthetic coding sequence
atggagagcggccacctgctgtgggccctgctcttcatgcagagcctgtggccccagctgacagatggagccaccagggtgtactacctgggcatcagagatgtgcagtggaactatgcccccaagggcagaaatgtcatcaccaaccagcccctggacagcgacatcgtggccagcagcttcctgaagagtgacaagaacagaattggaggcacctacaagaagaccatctacaaggagtacaaggatgacagctacacagatgaggtggcccagcctgcctggctgggcttcctgggccctgtgctgcaggccgaggtgggagatgtgatcctgatccacctgaagaactttgccacccggccctacaccatccacccccacggcgtcttctatgagaaggacagcgagggcagcctgtacccagatggcagcagcggccccctgaaggcagatgacagcgtgcccccaggcggcagccacatctacaactggaccatccctgagggccacgcccccacagatgctgaccctgcctgcctgacctggatctaccacagccacgtggatgccccccgggacatcgccaccggcctcatcggccccctcatcacctgcaagagaggagccctggatggcaacagccccccccagaggcaggatgtggaccatgacttcttcctgctcttctctgtggtggatgagaacctgtcctggcacctgaatgaaaatattgccacctactgcagcgaccctgcctctgtggacaaggaggatgagaccttccaggagagcaacaggatgcacgccatcaatggatttgtgtttggaaacctgcctgagctgaacatgtgtgcccagaagagggtggcctggcacctgtttggcatgggaaatgaaattgatgtgcacacagccttcttccacggccagatgctgaccacccggggccaccacacagatgtggccaacatcttccctgccacctttgtgacagctgagatggtgccctgggagcccggcacctggctgatcagctgccaggtgaacagccacttcagagatggcatgcaggccctgtacaaggtgaagagctgcagcatggcccctcctgtggacctgctgaccgggaaggtgcggcagtacttcatcgaggcccacgagatccagtgggactatggccccatgggccatgatggcagcacaggcaagaacctgcgggagcccggcagcatcagtgacaagttcttccagaagagcagcagccgcatcggcggcacctactggaaggtgcgctatgaggccttccaggatgagaccttccaggagaagatgcacctggaggaggacagacacctgggcatcctgggccctgtgatccgggcagaggtgggggacaccatccaggtggtgttctacaacagagccagccagcccttctccatgcagccccatggagtcttctatgagaaggactatgagggcaccgtgtacaatgatggcagcagctacccaggcctggtggccaagccctttgagaaggtgacctaccgctggacagtgccccctcatgctggccccacagcccaggaccctgcctgcctgacctggatgtacttctctgctgctgaccccatccgggacaccaacagcggcctggtgggccccctgctggtgtgccgggccggggccctgggcgcagatggcaagcagaagggcgtggacaaggagttcttcctgctcttcaccgtgctggatgagaacaagtcctggtacagcaatgccaaccaggccgccgccatgctggacttccggctgctgtctgaagatattgagggcttccaggacagcaacaggatgcacgccatcaatggcttcctgttcagcaacctgccccggctggacatgtgcaagggggacacagtggcctggcacctgctgggcctgggcacagaaacagatgtgcacggcgtgatgttccagggcaacacagtgcagctgcagggcatgaggaagggggccgccatgctgttcccccacacctttgtgatggccatcatgcagcctgacaacctgggcacctttgagatctactgccaggccggcagccaccgggaggccggcatgagggccatctacaacgtgtcccagtgccccggccaccaggccaccccccggcagcgctaccaggccgcccgcatctactacatcatggccgaggaggtggagtgggactactgcccagaccgctcctgggagcgggagtggcacaaccagagcgagaaggacagctatggctacatcttcctgagcaacaaggatggcctgctgggcagccgctacaagaaggctgtgttccgggagtacacagatggcaccttccgcatcccccggcccaggactggacctgaggagcacctgggcatcctgggccccctcatcaagggggaggtgggggacatcctgactgtggtgttcaagaacaatgccagccggccctacagcgtgcacgcccatggagtgctggagagcaccaccgtgtggcccctggccgctgagcccggggaggtggtgacctaccagtggaacatccctgagaggagcggccctggccccaatgattctgcctgtgtgtcctggatctactacagcgctgtggaccccatcaaggacatgtacagcggcctggtgggccccctggccatctgccagaagggcatcctggagccccatggaggccgcagtgacatggaccgggagtttgccctgctcttcctgatctttgatgagaacaagtcctggtacctggaggagaatgtggccacccacggcagccaggaccccggcagcatcaacctgcaggatgagaccttcctggagagcaacaagatgcacgccatcaacgggaagctgtatgccaacctgcggggcctgaccatgtaccagggcgagcgggtggcctggtacatgctggccatgggccaggatgtggacctgcacaccatccacttccacgccgagagcttcctgtacagaaatggagagaactacagagcagatgtggtggacctcttccctggcacctttgaggtggtggagatggtggccagcaaccctggcacctggctgatgcactgccacgtgacagaccacgtgcacgccggcatggagaccctcttcaccgtcttcagcaggacagagcacctgagccccctgaccgtcatcaccaaggagacagagaaggctgtgcccccccgggacatcgaggagggcaatgtgaagatgctgggcatgcagatccccatcaagaatgtggagatgctggcctctgtgctggtggccatctctgtgaccctgctgctggtggtgctggccctgggcggcgtggtgtggtaccagcaccggcagaggaagctgcggaggaacagaagaagcatcctggatgacagcttcaagctgctgtccttcaagcagtag

SEQ ID NO: 155167 - DNA, 3486 bp, Artificial Sequence
  Description of Artificial Sequence: Synthetic coding sequence
atgtgggccatggagagcggccacctgctgtgggccctgctcttcatgcagagcctgtggccccagctgacagatggagccaccagggtgtactacctgggcatcagagatgtgcagtggaactatgcccccaagggcagaaatgtcatcaccaaccagcccctggacagcgacatcgtggccagcagcttcctgaagagtgacaagaaccgcatcggcggcacctacaagaagaccatctacaaggagtacaaggatgacagctacacagatgaggtggcccagcctgcctggctgggcttcctgggccctgtgctgcaggccgaggtgggagatgtgatcctgatccacctgaagaactttgccacccggccctacaccatccacccccatggagtcttctatgagaaggacagcgagggcagcctgtacccagatggcagcagcggccccctgaaggcagatgattctgtgcccccaggcggcagccacatctacaactggaccatccctgagggccacgcccccacagatgctgaccctgcctgcctgacctggatctaccacagccacgtggatgccccccgggacatcgccaccggcctgattggccccctcatcacctgcaagagaggagccctggatggcaacagccccccccagaggcaggatgtggaccatgacttcttcctgctcttctctgtggtggatgagaacctgtcctggcacctgaatgaaaacatcgccacctactgcagcgaccctgcctctgtggacaaggaggatgagaccttccaggagagcaacaggatgcacgccatcaatggatttgtgtttggaaacctgcctgagctgaacatgtgtgcccagaagagggtggcctggcacctgtttggcatgggaaatgaaattgatgtgcacacagccttcttccacggccagatgctgaccacccggggccaccacacagatgtggccaacatcttccctgccacctttgtgacagctgagatggtgccctgggagcccggcacctggctgatcagctgccaggtgaacagccacttcagagatggcatgcaggccctgtacaaggtgaagagctgcagcatggcccctcctgtggacctgctgaccgggaaggtgcggcagtacttcatcgaggcccacgagatccagtgggactatggccccatgggccatgatggcagcacaggcaagaacctgcgggagcccggcagcatcagtgacaagttcttccagaagagcagcagcagaattggaggcacctactggaaggtgcgctatgaggccttccaggatgagaccttccaggagaagatgcacctggaggaggacagacacctgggcatcctgggccctgtgatccgggcagaggtgggggacaccatccaggtggtgttctacaacagagccagccagcccttctccatgcagccccacggcgtcttctatgagaaggactatgagggcaccgtgtacaatgatggcagcagctacccaggcctggtggccaagccctttgagaaggtgacctaccgctggacagtgccccctcatgctggccccacagcccaggaccctgcctgcctgacctggatgtacttctctgctgctgaccccatccgggacaccaacagcggcctggtgggccccctgctggtgtgcagagctggggccctgggcgcagatggcaagcagaagggcgtggacaaggagttcttcctgctcttcaccgtgctggatgagaacaagtcctggtacagcaatgccaaccaggccgccgccatgctggacttccggctgctgtctgaggacatcgagggcttccaggacagcaacaggatgcacgccatcaatggcttcctgttcagcaacctgccccggctggacatgtgcaagggggacacagtggcctggcacctgctgggcctgggcacagaaacagatgtgcatggagtgatgttccagggcaacacagtgcagctgcagggcatgaggaaaggagctgccatgctgttcccccacacctttgtgatggccatcatgcagcctgacaacctgggcacctttgagatctactgccaggccggcagccaccgggaggccggcatgagggccatctacaacgtgtcccagtgccccggccaccaggccaccccccggcagcgctaccaggccgcccgcatctactacatcatggccgaggaggtggagtgggactactgcccagaccgctcctgggagcgggagtggcacaaccagagcgagaaggacagctatggctacatcttcctgagcaacaaggatggcctgctgggcagccgctacaagaaggctgtgttccgggagtacacagatggcaccttccgcatcccccggcccaggacaggccctgaggagcacctgggcatcctgggccccctcatcaagggggaggtgggggacatcctgactgtggtgttcaagaacaatgccagccggccctacagcgtgcacgcccacggcgtgctggagagcaccaccgtgtggcccctggccgctgagcctggagaggtggtgacctaccagtggaacatccctgagaggagcggccctggccccaatgacagcgcctgtgtgtcctggatctactacagcgctgtggaccccatcaaggacatgtacagcggcctggtgggccccctggccatctgccagaagggcatcctggagccccacggcggccgcagtgacatggaccgggagtttgccctgctcttcctgatctttgatgagaacaagtcctggtacctggaggagaatgtggccacccacggcagccaggaccccggcagcatcaacctgcaggatgagaccttcctggagagcaacaagatgcacgccatcaatggcaagctgtatgccaacctgcggggcctgaccatgtaccagggcgagcgggtggcctggtacatgctggccatgggccaggatgtggacctgcacaccatccacttccacgccgagagcttcctgtacagaaatggagagaactacagagcagatgtggtggacctcttccctggcacctttgaggtggtggagatggtggccagcaaccctggcacctggctgatgcactgccacgtgacagaccacgtgcatgctggcatggagaccctcttcaccgtcttcagcaggacagagcacctgagccccctgaccgtcatcaccaaggagacagagaaggctgtgcccccccgggacatcgaggagggcaatgtgaagatgctgggcatgcagatccccatcaagaatgtggagatgctggcctctgtgctggtggccatctctgtgaccctgctgctggtggtgctggccctgggcggcgtggtgtggtaccagcaccggcagaggaagctgcggaggaacagaagaagcatcctggatgacagcttcaagctgctgtccttcaagcagtag

SEQ ID NO: 155168 - DNA, 2910 bp, Artificial Sequence
  Description of Artificial Sequence: Synthetic coding sequence
atgtgggccatggagagcggccacctgctgtgggccctgctcttcatgcagagcctgtggccccagctgacagatggagccaccagggtgtactacctgggcatcagagatgtgcagtggaactatgcccccaagggcagaaatgtcatcaccaaccagcccctggacagcgacatcgtggccagcagcttcctgaagagtgacaagaaccgcatcggcggcacctacaagaagaccatctacaaggagtacaaggatgacagctacacagatgaggtggcccagcctgcctggctgggcttcctgggccctgtgctgcaggccgaggtgggagatgtgatcctgatccacctgaagaactttgccacccggccctacaccatccacccccatggagtcttctatgagaaggacagcgagggcagcctgtacccagatggcagcagcggccccctgaaggcagatgattctgtgcccccaggcggcagccacatctacaactggaccatccctgagggccacgcccccacagatgctgaccctgcctgcctgacctggatctaccacagccacgtggatgccccccgggacatcgccaccggcctgattggccccctcatcacctgcaagagaggagccctggatggcaacagccccccccagaggcaggatgtggaccatgacttcttcctgctcttctctgtggtggatgagaacctgtcctggcacctgaatgaaaacatcgccacctactgcagcgaccctgcctctgtggacaaggaggatgagaccttccaggagagcaacaggatgcacgccatcaatggatttgtgtttggaaacctgcctgagctgaacatgtgtgcccagaagagggtggcctggcacctgtttggcatgggaaatgaaattgatgtgcacacagccttcttccacggccagatgctgaccacccggggccaccacacagatgtggccaacatcttccctgccacctttgtgacagctgagatggtgccctgggagcccggcacctggctgatcagctgccaggtgaacagccacttcagagatggcatgcaggccctgtacaaggtgaagagctgcagcatggcccctcctgtggacctgctgaccgggaaggtgcggcagtacttcatcgaggcccacgagatccagtgggactatggccccatgggccatgatggcagcacaggcaagaacctgcgggagcccggcagcatcagtgacaagttcttccagaagagcagcagcagaattggaggcacctactggaaggtgcgctatgaggccttccaggatgagaccttccaggagaagatgcacctggaggaggacagacacctgggcatcctgggccctgtgatccgggcagaggtgggggacaccatccaggtggtgttctacaacagagccagccagcccttctccatgcagccccacggcgtcttctatgagaaggactatgagggcaccgtgtacaatgatggcacctttgagatctactgccaggccggcagccaccgggaggccggcatgagggccatctacaacgtgtcccagtgccccggccaccaggccaccccccggcagcgctaccaggccgcccgcatctactacatcatggccgaggaggtggagtgggactactgcccagaccgctcctgggagcgggagtggcacaaccagagcgagaaggacagctatggctacatcttcctgagcaacaaggatggcctgctgggcagccgctacaagaaggctgtgttccgggagtacacagatggcaccttccgcatcccccggcccaggacaggccctgaggagcacctgggcatcctgggccccctcatcaagggggaggtgggggacatcctgactgtggtgttcaagaacaatgccagccggccctacagcgtgcacgcccacggcgtgctggagagcaccaccgtgtggcccctggccgctgagcctggagaggtggtgacctaccagtggaacatccctgagaggagcggccctggccccaatgacagcgcctgtgtgtcctggatctactacagcgctgtggaccccatcaaggacatgtacagcggcctggtgggccccctggccatctgccagaagggcatcctggagccccacggcggccgcagtgacatggaccgggagtttgccctgctcttcctgatctttgatgagaacaagtcctggtacctggaggagaatgtggccacccacggcagccaggaccccggcagcatcaacctgcaggatgagaccttcctggagagcaacaagatgcacgccatcaatggcaagctgtatgccaacctgcggggcctgaccatgtaccagggcgagcgggtggcctggtacatgctggccatgggccaggatgtggacctgcacaccatccacttccacgccgagagcttcctgtacagaaatggagagaactacagagcagatgtggtggacctcttccctggcacctttgaggtggtggagatggtggccagcaaccctggcacctggctgatgcactgccacgtgacagaccacgtgcatgctggcatggagaccctcttcaccgtcttcagcaggacagagcacctgagccccctgaccgtcatcaccaaggagacagagaaggctgtgcccccccgggacatcgaggagggcaatgtgaagatgctgggcatgcagatccccatcaagaatgtggagatgctggcctctgtgctggtggccatctctgtgaccctgctgctggtggtgctggccctgggcggcgtggtgtggtaccagcaccggcagaggaagctgcggaggaacagaagaagcatcctggatgacagcttcaagctgctgtccttcaagcagtag

SEQ ID NO: 155169 - DNA, 2436 bp, Artificial Sequence
  Description of Artificial Sequence: Synthetic coding sequence
atggagagcggccacctgctgtgggccctgctcttcatgcagagcctgtggccccagctgacagatggagccaccagggtgtactacctgggcatcagagatgtgcagtggaactatgcccccaagggcagaaatgtcatcaccaaccagcccctggacagcgacatcgtggccagcagcttcctgaagagtgacaagaacagaattggaggcacctacaagaagaccatctacaaggagtacaaggatgacagctacacagatgaggtggcccagcctgcctggctgggcttcctgggccctgtgctgcaggccgaggtgggagatgtgatcctgatccacctgaagaactttgccacccggccctacaccatccacccccacggcgtcttctatgagaaggacagcgagggcagcctgtacccagatggcagcagcggccccctgaaggcagatgacagcgtgcccccaggcggcagccacatctacaactggaccatccctgagggccacgcccccacagatgctgaccctgcctgcctgacctggatctaccacagccacgtggatgccccccgggacatcgccaccggcctcatcggccccctcatcacctgcaagagaggagccctggatggcaacagccccccccagaggcaggatgtggaccatgacttcttcctgctcttctctgtggtggatgagaacctgtcctggcacctgaatgaaaatattgccacctactgcagcgaccctgcctctgtggacaaggaggatgagaccttccaggagagcaacaggatgcacgccatcaatggatttgtgtttggaaacctgcctgagctgaacatgtgtgcccagaagagggtggcctggcacctgtttggcatgggaaatgaaattgatgtgcacacagccttcttccacggccagatgctgaccacccggggccaccacacagatgtggccaacatcttccctgccacctttgtgacagctgagatggtgccctgggagcccggcacctggctgatcagctgccaggtgaacagccacttcagagatggcatgcaggccctgtacaaggtgaagagctgcagcatggcccctcctgtggacctgctgaccgggaaggtgcggcagtacttcatcgaggcccacgagatccagtgggactatggccccatgggccatgatggcagcacaggcaagaacctgcgggagcccggcagcatcagtgacaagttcttccagaagagcagcagccgcatcggcggcacctactggaaggtgcgctatgaggccttccaggatgagaccttccaggagaagatgcacctggaggaggacagacacctgggcatcctgggccctgtgatccgggcagaggtgggggacaccatccaggtggtgttctacaacagagccagccagcccttctccatgcagccccatggagtcttctatgagaaggactatgagggcaccgtgtacaatgatgaccccatccgggacaccaacagcggcctggtgggccccctgctggtgtgcagagctggggccctgggcgcagatggcaagcagaagggcgtggacaaggagttcttcctgctcttcaccgtgctggatgagaacaagtcctggtacagcaatgccaaccaggccgccgccatgctggacttccggctgctgtctgaggacatcgagggcttccaggacagcaacaggatgcacgccatcaatggcttcctgttcagcaacctgccccggctggacatgtgcaagggggacacagtggcctggcacctgctgggcctgggcacagaaacagatgtgcatggagtgatgttccagggcaacacagtgcagctgcagggcatgaggaaaggagctgccatgctgttcccccacacctttgtgatggccatcatgcagcctgacaacctgggcacctttgagatctactgccaggccggcagccaccgggaggccggcatgagggccatctacaacgtgtcccagtgccccggccaccaggccaccccccggcagcgctaccaggccgcccgcatctactacatcatggccgaggaggtggagtgggactactgcccagaccgctcctgggagcgggagtggcacaaccagagcgagaaggacagctatggctacatcttcctgagcaacaaggatggcctgctgggcagccgctacaagaaggctgtgttccgggagtacacagatggcaccttccgcatcccccggcccaggacaggccctgaggagcacctgggcatcctgggccccctcatcaagggggaggtgggggacatcctgactgtggtgttcaagaacaatgccagccggccctacagcgtgcacgcccacggcgtgctggagagcaccaccgtgtggcccctggccgctgagccctag

SEQ ID NO: 155170 - DNA, 3483 bp, Artificial Sequence
  Description of Artificial Sequence: Synthetic coding sequence
atgtgggccatggagagcggccacctgctgtgggccctgctcttcatgcagagcctgtggccccagctgacagatggagccaccagggtgtactacctgggcatcagagatgtgcagtggaactatgcccccaagggcagaaatgtcatcaccaaccagcccctggacagcgacatcgtggccagcagcttcctgaagagtgacaagaaccgcatcggcggcacctacaagaagaccatctacaaggagtacaaggatgacagctacacagatgaggtggcccagcctgcctggctgggcttcctgggccctgtgctgcaggccgaggtgggagatgtgatcctgatccacctgaagaactttgccacccggccctacaccatccacccccatggagtcttctatgagaaggacagcgagggcagcctgtacccagatggcagcagcggccccctgaaggcagatgattctgtgcccccaggcggcagccacatctacaactggaccatccctgagggccacgcccccacagatgctgaccctgcctgcctgacctggatctaccacagccacgtggatgccccccgggacatcgccaccggcctgattggccccctcatcacctgcaagagaggagccctggatggcaacagccccccccagaggcaggatgtggaccatgacttcttcctgctcttctctgtggtggatgagaacctgtcctggcacctgaatgaaaacatcgccacctactgcagcgaccctgcctctgtggacaaggaggatgagaccttccaggagagcaacaggatgcacgccatcaatggatttgtgtttggaaacctgcctgagctgaacatgtgtgcccagaagagggtggcctggcacctgtttggcatgggaaatgaaattgatgtgcacacagccttcttccacggccagatgctgaccacccggggccaccacacagatgtggccaacatcttccctgccacctttgtgacagctgagatggtgccctgggagcccggcacctggctgatcagctgccaggtgaacagccacttcagagatggcatgcaggccctgtacaaggtgaagagctgcagcatggcccctcctgtggacctgctgaccgggaaggtgcggcagtacttcatcgaggcccacgagatccagtgggactatggccccatgggccatgatggcagcacaggcaagaacctgcgggagcccggcagcatcagtgacaagttcttccagaagagcagcagcagaattggaggcacctactggaaggtgcgctatgaggccttccaggatgagaccttccaggagaagatgcacctggaggaggacagacacctgggcatcctgggccctgtgatccgggcagaggtgggggacaccatccaggtggtgttctacaacagagccagccagcccttctccatgcagccccacggcgtcttctatgagaaggactatgagggcaccgtgtacaatgatggcagcagctacccaggcctggtggccaagccctttgagaaggtgacctaccgctggacagtgccccctcatgctggccccacagcccaggaccctgcctgcctgacctggatgtacttctctgctgctgaccccatccgggacaccaacagcggcctggtgggccccctgctggtgtgcagagctggggccctgggcgcagatggcaagcagaagggcgtggacaaggagttcttcctgctcttcaccgtgctggatgagaacaagtcctggtacagcaatgccaaccaggccgccgccatgctggacttccggctgctgtctgaggacatcgagggcttccaggacagcaacaggatgcacgccatcaatggcttcctgttcagcaacctgccccggctggacatgtgcaagggggacacagtggcctggcacctgctgggcctgggcacagaaacagatgtgcatggagtgatgttccagggcaacacagtgcagctgcagggcatgaggaaaggagctgccatgctgttcccccacacctttgtgatggccatcatgcagcctgacaacctgggcacctttgagatctactgccaggccggcagccaccgggaggccggcatgagggccatctacaacgtgtcccagtgccccggccaccaggccaccccccggcagcgctaccaggccgcccgcatctactacatcatggccgaggaggtggagtgggactactgcccagaccgctcctgggagcgggagtggcacaaccagagcgagaaggacagctatggctacatcttcctgagcaacaaggatggcctgctgggcagccgctacaagaaggctgtgttccgggagtacacagatggcaccttccgcatcccccggcccaggacaggccctgaggagcacctgggcatcctgggccccctcatcaagggggaggtgggggacatcctgactgtggtgttcaagaacaatgccagccggccctacagcgtgcacgcccacggcgtgctggagagcaccaccgtgtggcccctggccgctgagcctggagaggtggtgacctaccagtggaacatccctgagaggagcggccctggccccaatgacagcgcctgtgtgtcctggatctactacagcgctgtggaccccatcaaggacatgtacagcggcctggtgggccccctggccatctgccagaagggcatcctggagccccacggcggccgcagtgacatggaccgggagtttgccctgctcttcctgatctttgatgagaacaagtcctggtacctggaggagaatgtggccacccacggcagccaggaccccggcagcatcaacctgcaggatgagaccttcctggagagcaacaagatgcacgccatcaatggcaagctgtatgccaacctgcggggcctgaccatgtaccagggcgagcgggtggcctggtacatgctggccatgggccaggatgtggacctgcacaccatccacttccacgccgagagcttcctgtacagaaatggagagaactacagagcagatgtggtggacctcttccctggcacctttgaggtggtggagatggtggccagcaaccctggcacctggctgatgcactgccacgtgacagaccacgtgcatgctggcatggagaccctcttcaccgtcttcagcaggacagagcacctgagccccctgaccgtcatcaccaaggagacagagaaggtgcccccccgggacatcgaggagggcaatgtgaagatgctgggcatgcagatccccatcaagaatgtggagatgctggcctctgtgctggtggccatctctgtgaccctgctgctggtggtgctggccctgggcggcgtggtgtggtaccagcaccggcagaggaagctgcggaggaacagaagaagcatcctggatgacagcttcaagctgctgtccttcaagcagtag

SEQ ID NO: 155171 - DNA, 627 bp, Artificial Sequence
  Description of Artificial Sequence: Synthetic coding sequence
atggagagcggccacctgctgtgggccctgctcttcatgcagagcctgtggccccagctgacagatggagccaccagggtgtactacctgggcatcagagatgtgcagtggaactatgcccccaagggcagaaatgtcatcaccaaccagcccctggacagcgacatcgtggccagcagcttcctgaagagtgacaagaacagaattggaggcacctacaagaagaccatctacaaggagtacaaggatgacagctacacagatgaggtggcccagcctgcctggctgggcttcctgggccctgtgctgcaggccgaggtgggagatgtgatcctgatccacctgaagaactttgccacccggccctacaccatccacccccacggcgtcttctatgagaaggacagcgagggcagcctgtacccagatggcagcagcggccccctgaaggcagatgacagcgtgcccccaggcggcagccacatctacaactggaccatccctgagggccacgcccccacagatgctgaccctgcctgcctgacctggatctaccacagccacgtggatgccccccgggacatcgccaccggcctcatcggccccctcatcacctgcaagaggtag

SEQ ID NO: 155172 - DNA, 3639 bp, Artificial Sequence
  Description of Artificial Sequence: Synthetic coding sequence
atgacccagaccctgccctaccacctgagcctgctgaatgtgctcttccctggcccctgcagccgccacttcaagttcagaagaggaaaatgtgcccagcctgcctggaggaaggtgtctgcccccagccaggacctgctgatcaccaaggtgatgtgggccatggagagcggccacctgctgtgggccctgctcttcatgcagagcctgtggccccagctgacagatggagccaccagggtgtactacctgggcatcagagatgtgcagtggaactatgcccccaagggcagaaatgtcatcaccaaccagcccctggacagcgacatcgtggccagcagcttcctgaagagtgacaagaacagaattggaggcacctacaagaagaccatctacaaggagtacaaggatgacagctacacagatgaggtggcccagcctgcctggctgggcttcctgggccctgtgctgcaggccgaggtgggagatgtgatcctgatccacctgaagaactttgccacccggccctacaccatccacccccacggcgtcttctatgagaaggacagcgagggcagcctgtacccagatggcagcagcggccccctgaaggcagatgacagcgtgcccccaggcggcagccacatctacaactggaccatccctgagggccacgcccccacagatgctgaccctgcctgcctgacctggatctaccacagccacgtggatgccccccgggacatcgccaccggcctcatcggccccctcatcacctgcaagagaggagccctggatggcaacagccccccccagaggcaggatgtggaccatgacttcttcctgctcttctctgtggtggatgagaacctgtcctggcacctgaatgaaaatattgccacctactgcagcgaccctgcctctgtggacaaggaggatgagaccttccaggagagcaacaggatgcacgccatcaatggatttgtgtttggaaacctgcctgagctgaacatgtgtgcccagaagagggtggcctggcacctgtttggcatgggaaatgaaattgatgtgcacacagccttcttccacggccagatgctgaccacccggggccaccacacagatgtggccaacatcttccctgccacctttgtgacagctgagatggtgccctgggagcccggcacctggctgatcagctgccaggtgaacagccacttcagagatggcatgcaggccctgtacaaggtgaagagctgcagcatggcccctcctgtggacctgctgaccgggaaggtgcggcagtacttcatcgaggcccacgagatccagtgggactatggccccatgggccatgatggcagcacaggcaagaacctgcgggagcccggcagcatcagtgacaagttcttccagaagagcagcagccgcatcggcggcacctactggaaggtgcgctatgaggccttccaggatgagaccttccaggagaagatgcacctggaggaggacagacacctgggcatcctgggccctgtgatccgggcagaggtgggggacaccatccaggtggtgttctacaacagagccagccagcccttctccatgcagccccatggagtcttctatgagaaggactatgagggcaccgtgtacaatgatggcagcagctacccaggcctggtggccaagccctttgagaaggtgacctaccgctggacagtgccccctcatgctggccccacagcccaggaccctgcctgcctgacctggatgtacttctctgctgctgaccccatccgggacaccaacagcggcctggtgggccccctgctggtgtgccgggccggggccctgggcgcagatggcaagcagaagggcgtggacaaggagttcttcctgctcttcaccgtgctggatgagaacaagtcctggtacagcaatgccaaccaggccgccgccatgctggacttccggctgctgtctgaagatattgagggcttccaggacagcaacaggatgcacgccatcaatggcttcctgttcagcaacctgccccggctggacatgtgcaagggggacacagtggcctggcacctgctgggcctgggcacagaaacagatgtgcacggcgtgatgttccagggcaacacagtgcagctgcagggcatgaggaagggggccgccatgctgttcccccacacctttgtgatggccatcatgcagcctgacaacctgggcacctttgagatctactgccaggccggcagccaccgggaggccggcatgagggccatctacaacgtgtcccagtgccccggccaccaggccaccccccggcagcgctaccaggccgcccgcatctactacatcatggccgaggaggtggagtgggactactgcccagaccgctcctgggagcgggagtggcacaaccagagcgagaaggacagctatggctacatcttcctgagcaacaaggatggcctgctgggcagccgctacaagaaggctgtgttccgggagtacacagatggcaccttccgcatcccccggcccaggactggacctgaggagcacctgggcatcctgggccccctcatcaagggggaggtgggggacatcctgactgtggtgttcaagaacaatgccagccggccctacagcgtgcacgcccatggagtgctggagagcaccaccgtgtggcccctggccgctgagcccggggaggtggtgacctaccagtggaacatccctgagaggagcggccctggccccaatgattctgcctgtgtgtcctggatctactacagcgctgtggaccccatcaaggacatgtacagcggcctggtgggccccctggccatctgccagaagggcatcctggagccccatggaggccgcagtgacatggaccgggagtttgccctgctcttcctgatctttgatgagaacaagtcctggtacctggaggagaatgtggccacccacggcagccaggaccccggcagcatcaacctgcaggatgagaccttcctggagagcaacaagatgcacgccatcaacgggaagctgtatgccaacctgcggggcctgaccatgtaccagggcgagcgggtggcctggtacatgctggccatgggccaggatgtggacctgcacaccatccacttccacgccgagagcttcctgtacagaaatggagagaactacagagcagatgtggtggacctcttccctggcacctttgaggtggtggagatggtggccagcaaccctggcacctggctgatgcactgccacgtgacagaccacgtgcacgccggcatggagaccctcttcaccgtcttcagcaggacagagcacctgagccccctgaccgtcatcaccaaggagacagagaaggctgtgcccccccgggacatcgaggagggcaatgtgaagatgctgggcatgcagatccccatcaagaatgtggagatgctggcctctgtgctggtggccatctctgtgaccctgctgctggtggtgctggccctgggcggcgtggtgtggtaccagcaccggcagaggaagctgcggaggaacagaagaagcatcctggatgacagcttcaagctgctgtccttcaagcagtag

SEQ ID NO: 155173 - DNA, 1254 bp, Artificial Sequence
  Description of Artificial Sequence: Synthetic coding sequence
atggcccagaaggagggcggccgcacagtgccctgctgcagccggcccaaggtggccgccctgacagctggcaccctgctgctgctgacagccatcggggccgcctcctgggccatcgtggccgtgctgctgcggagtgaccaggagcccctgtaccctgtgcaggtgagcagcgcagatgcccggctgatggtgtttgacaagacagagggcacctggaggctgctgtgcagcagccgcagcaatgcccgggtggccggcctgagctgtgaggagatgggcttcctgcgggccctgacccacagcgagctggatgtgaggacagctggggccaacggcaccagcggcttcttctgtgtggatgagggccgcctgccccacacccagaggctgctggaggtgatctctgtgtgtgactgcccccggggccgcttcctggccgccatctgccaggactgtggccgcaggaagctgcctgtggacagaattgtgggcggccgggacaccagcctgggccgctggccctggcaggtgtccctgcgctatgatggagcccacctgtgtggcggcagcctgctgagcggggactgggtgctgacagctgcccactgcttccctgagaggaacagagtgctgagccgctggagggtgtttgctggagctgtggcccaggccagcccccacggcctgcagctgggcgtgcaggccgtggtgtaccacggcggctacctgcccttccgggaccccaacagcgaggagaacagcaatgacatcgccctggtgcacctgagcagccccctgcccctgacagagtacatccagcctgtgtgcctgcctgctgctggccaggccctggtggatggcaagatctgcaccgtgacaggctggggcaacacccagtactacggccagcaggccggcgtgctgcaggaggcccgggtgcccatcatcagcaatgatgtgtgcaatggagctgacttctacggcaaccagatcaagcccaagatgttctgtgccggctacccagagggcggcattgatgcctgccagggcgacagcggcggcccctttgtgtgtgaggacagcatcagcaggaccccccgctggaggctgtgtggcatcgtgtcctggggcaccggctgtgccctggcccagaagccaggagtgtacaccaaggtgtctgacttccgggagtggatcttccaggccatcaagacccacagcgaggccagcggcatggtgacccagctgtag

SEQ ID NO: 155174 - DNA, 1254 bp, Artificial Sequence; identical to SEQ ID NO: 155173
  Description of Artificial Sequence: Synthetic coding sequence

SEQ ID NO: 155175 - DNA, 1182 bp, Artificial Sequence
  Description of Artificial Sequence: Synthetic coding sequence
atgtgcaagatgaggacccgggaggacatgcagctgggcaatgaaggacctggaacagccctgcggctcatccacctgcaggtgagcagcgcagatgcccggctgatggtgtttgacaagacagagggcacctggaggctgctgtgcagcagccgcagcaatgcccgggtggccggcctgagctgtgaggagatgggcttcctgcgggccctgacccacagcgagctggatgtgaggacagctggggccaacggcaccagcggcttcttctgtgtggatgagggccgcctgccccacacccagaggctgctggaggtgatctctgtgtgtgactgcccccggggccgcttcctggccgccatctgccaggactgtggccgcaggaagctgcctgtggacagaattgtgggcggccgggacaccagcctgggccgctggccctggcaggtgtccctgcgctatgatggagcccacctgtgtggcggcagcctgctgagcggggactgggtgctgacagctgcccactgcttccctgagaggaacagagtgctgagccgctggagggtgtttgctggagctgtggcccaggccagcccccacggcctgcagctgggcgtgcaggccgtggtgtaccacggcggctacctgcccttccgggaccccaacagcgaggagaacagcaatgacatcgccctggtgcacctgagcagccccctgcccctgacagagtacatccagcctgtgtgcctgcctgctgctggccaggccctggtggatggcaagatctgcaccgtgacaggctggggcaacacccagtactacggccagcaggccggcgtgctgcaggaggcccgggtgcccatcatcagcaatgatgtgtgcaatggagctgacttctacggcaaccagatcaagcccaagatgttctgtgccggctacccagagggcggcattgatgcctgccagggcgacagcggcggcccctttgtgtgtgaggacagcatcagcaggaccccccgctggaggctgtgtggcatcgtgtcctggggcaccggctgtgccctggcccagaagccaggagtgtacaccaaggtgtctgacttccgggagtggatcttccaggccatcaaggtgaaggtgggcagccgctgggagcccggctggggccgcctgggcgtgtag

SEQ ID NO: 155176 - DNA, 2103 bp, Artificial Sequence
  Description of Artificial Sequence: Synthetic coding sequence
atgaagtgtgtgctggtggccacagagggcgctgaggtgctcttctactggacagaccaggagtttgaggagagcctgcggctgaagtttggccagagtgaaaatgaggaggaggagctgcctgccctggaggaccagctgagcaccctgctggcccctgtgatcatcagctccatgaccatgctggagaagctgagtgacacctacacctgcttcagcacagaaaatggaaacttcctgtatgtgctgcacctgtttggagagtgcctcttcatcgccatcaatggagaccacacagaaagtgaaggagacctgcggaggaagctgtatgtgctgaagtacctgtttgaggtgcacttcggcctggtgacagtggatggccacctgatcaggaaggagctgcggcccccagacctggcccagagggtgcagctgtgggagcacttccagagcctgctgtggacctacagccggctgcgggagcaggagcagtgctttgctgtggaggccctggagcggctcatccacccccagctgtgtgagctgtgcatcgaggccctggagcggcacgtgatccaggccgtgaacaccagccctgagcggggcggggaggaggccctgcacgccttcctgctggtgcacagcaagctgctggccttctacagcagccacagcgccagcagcctgcggcctgctgacctgctggccctgatcctgctggtgcaggacctgtaccccagcgagagcacagcagaagatgacatccagcccagcccccggcgggcccggagcagccagaacatccctgtgcagcaggcctggagcccccacagcacaggccccaccggcggcagcagcgctgagacagaaacagacagcttcagcctgcctgaggagtacttcaccccagcccccagccctggggaccagagcagcggcagcaccatctggctggagggcggcaccccacccatggatgccctgcagattgctgaggacaccctgcagaccctggtgccccactgccctgtgcccagcggcccccggcgcatcttcctggatgccaacgtgaaggagagctactgccccctggtgccccacaccatgtactgcctgcccctgtggcagggcatcaacctggtgctgctgaccaggagccccagcgcccccctggccctggtgctgagccagctgatggatggcttctccatgctggagaagaagctgaaggagggccctgagcccggggccagcctgcggagccagcccctggtgggggacctgcggcagaggatggacaagtttgtgaagaacagaggagcccaggagatccagagcacctggctggagttcaaggccaaggccttcagcaagtctgagcccggcagctcctgggagctgctgcaggcctgtgggaagctgaagaggcagctgtgtgccatctaccgcctgaacttcctgaccacagcccccagccggggcggcccccacctgccccagcacctgcaggaccaggtgcagaggctgatgagggagaagctgacagactggaaggacttcctgctggtgaagagcagaagaaacatcaccatggtgtcctacctggaggacttccctggcctggtgcacttcatctacgtggacaggaccaccggccagatggtggcccccagcctgaactgcagccagaagaccagcagcgagctgggcaagggccccctggccgcctttgtgaagaccaaggtgtggagcctcatccagctggcccggcgctacctgcagaagggctacaccaccctgctcttccaggagggggacttctactgcagctacttcctgtggtttgaaaatgacatgggctacaagctgcagatgattgaggtgcctgtgctgagtgatgattctgtgcccatcggcatgctgggcggggactactacaggaagctgctgcgctactacagcaagaaccggcccacagaagctgtgcgctgctatgagctgctggccctgcacctgagcgtcatccccacagacctgctggtgcagcaggccggccagctggcccggcggctgtgggaggccagccgcatccccctgctgtag

SEQ ID NO: 155177 - DNA, 975 bp, Artificial Sequence
  Description of Artificial Sequence: Synthetic coding sequence
atgaagtgtgtgctggtggccacagagggcgctgaggtgctcttctactggacagaccaggagtttgaggagagcctgcggctgaagtttggccagagtgaaaatgaggaggaggagctgcctgccctggaggaccagctgagcaccctgctggcccctgtgatcatcagctccatgaccatgctggagaagctgagtgacacctacacctgcttcagcacagaaaatggaaacttcctgtatgtgctgcacctgtttggagagtgcctcttcatcgccatcaatggagaccacacagaaagtgaaggagacctgcggaggaagctgtatgtgctgaagtacctgtttgaggtgcacttcggcctggtgacagtggatggccacctgatcaggaaggagctgcggcccccagacctggcccagagggtgcagctgtgggagcacttccagagcctgctgtggacctacagccggctgcgggagcaggagcagtgctttgctgtggaggccctggagcggctcatccacccccagctgtgtgagctgtgcatcgaggccctggagcggcacgtgatccaggccgtgaacaccagccctgagcggggcggggaggaggccctgcacgccttcctgctggtgcacagcaagctgctggccttctacagcagccacagcgccagcagcctgcggcctgctgacctgctggccctgatcctgctggtgcaggacctgtaccccagcgagagcacagcagaagatgacatccagcccagcccccggcgggcccggagcagccagaacatccctgtgcagcaggcctggagcccccacagcacaggccccaccggcggcagcagcgctgagacagaaacagacagcttcagcctgcctgaggagtacttcaccccagcccccagccctggggaccagagcagcggggaggacaggaggaaggccggcggcaacaacagctag

SEQ ID NO: 155178 - DNA, 981 bp, Artificial Sequence
  Description of Artificial Sequence: Synthetic coding sequence
cggctcatccacccccagctgtgtgagctgtgcatcgaggccctggagcggcacgtgatccaggccgtgaacaccagccctgagcggggcggggaggaggccctgcacgccttcctgctggtgcacagcaagctgctggccttctacagcagccacagcgccagcagcctgcggcctgctgacctgctggccctgatcctgctggtgcaggacctgtaccccagcgagagcacagcagaagatgacatccaggagacagacagcttcagcctgcctgaggagtacttcaccccagcccccagccctggggaccagagcagcggcagcaccatctggctggagggcggcaccccacccatggatgccctgcagattgctgaggacaccctgcagaccctggtgccccactgccctgtgcccagcggcccccggcgcatcttcctggatgccaacgtgaaggagagctactgccccctggtgccccacaccatgtactgcctgcccctgtggcagggcatcaacctggtgctgctgaccaggagccccagcgcccccctggccctggtgctgagccagctgatggatggcttctccatgctggagaagaagctgaaggagggccctgagcccggggccagcctgcggagccagcccctggtgggggacctgcggcagaggatggacaagtttgtgaagaacagaggagcccaggagatccagagcacctggctggagttcaaggccaaggccttcagcaagtctgagcccggcagctcctgggagctgctgcaggcctgtgggaagctgaagaggcagctgtgtgccatctaccgcctgaacttcctgaccacagcccccagcagaggaggcccccacctgccccagcacctgcaggaccaggtgcagaggctgatgagggagaagctgacagactggaaggacttcctgctggtgaagagcagaagaaacatcaccatgtag

SEQ ID NO: 155179 - DNA, 2103 bp, Artificial Sequence; identical to SEQ ID NO: 155176
  Description of Artificial Sequence: Synthetic coding sequence

SEQ ID NO: 155180 - DNA, 2004 bp, Artificial Sequence
  Description of Artificial Sequence: Synthetic coding sequence
atgaagtgtgtgctggtggccacagagggcgctgaggtgctcttctactggacagaccaggagtttgaggagagcctgcggctgaagtttggccagagtgaaaatgaggaggaggagctgcctgccctggaggaccagctgagcaccctgctggcccctgtgatcatcagctccatgaccatgctggagaagctgagtgacacctacacctgcttcagcacagaaaatggaaacttcctgtatgtgctgcacctgtttggagagtgcctcttcatcgccatcaatggagaccacacagaaagtgaaggagacctgcggaggaagctgtatgtgctgaagtacctgtttgaggtgcacttcggcctggtgacagtggatggccacctgatcaggaaggagctgcggcccccagacctggcccagagggtgcagctgtgggagcacttccagagcctgctgtggacctacagccggctgcgggagcaggagcagtgctttgctgtggaggccctggagcggctcatccacccccagctgtgtgagctgtgcatcgaggccctggagcggcacgtgatccaggccgtgaacaccagccctgagcggggcggggaggaggccctgcacgccttcctgctggtgcacagcaagctgctggccttctacagcagccacagcgccagcagcctgcggcctgctgacctgctggccctgatcctgctggtgcaggacctgtaccccagcgagagcacagcagaagatgacatccaggagacagacagcttcagcctgcctgaggagtacttcaccccagcccccagccctggggaccagagcagcggcagcaccatctggctggagggcggcaccccacccatggatgccctgcagattgctgaggacaccctgcagaccctggtgccccactgccctgtgcccagcggcccccggcgcatcttcctggatgccaacgtgaaggagagctactgccccctggtgccccacaccatgtactgcctgcccctgtggcagggcatcaacctggtgctgctgaccaggagccccagcgcccccctggccctggtgctgagccagctgatggatggcttctccatgctggagaagaagctgaaggagggccctgagcccggggccagcctgcggagccagcccctggtgggggacctgcggcagaggatggacaagtttgtgaagaacagaggagcccaggagatccagagcacctggctggagttcaaggccaaggccttcagcaagtctgagcccggcagctcctgggagctgctgcaggcctgtgggaagctgaagaggcagctgtgtgccatctaccgcctgaacttcctgaccacagcccccagcagaggaggcccccacctgccccagcacctgcaggaccaggtgcagaggctgatgagggagaagctgacagactggaaggacttcctgctggtgaagagcagaagaaacatcaccatggtgtcctacctggaggacttccctggcctggtgcacttcatctacgtggacaggaccaccggccagatggtggcccccagcctgaactgcagccagaagaccagcagcgagctgggcaagggccccctggccgcctttgtgaagaccaaggtgtggagcctcatccagctggcccggcgctacctgcagaagggctacaccaccctgctcttccaggagggggacttctactgcagctacttcctgtggtttgaaaatgacatgggctacaagctgcagatgattgaggtgcctgtgctgagtgatgacagcgtgcccatcggcatgctgggcggggactactacaggaagctgctgcgctactacagcaagaaccggcccacagaggccgtgcgctgctatgagctgctggccctgcacctgagcgtcatccccacagacctgctggtgcagcaggccggccagctggcccggcggctgtgggaggccagccgcatccccctgctgtag

SEQ ID NO: 155181 - DNA, 480 bp, Artificial Sequence
  Description of Artificial Sequence: Synthetic coding sequence
tgactgcggcccccagacctggcccagagggtgcagctgtgggagcacttccagagcctgctgtggacctacagccggctgcgggagcaggagcagtgctttgctgtggaggccctggagcggctcatccacccccagctgtgtgagctgtgcatcgaggccctggagcggcacgtgatccaggccgtgaacaccagccctgagcggggcggggaggaggccctgcacgccttcctgctggtgcacagcaagctgctggccttctacagcagccacagcgccagcagcctgcggcctgctgacctgctggccctgatcctgctggtgcaggacctgtaccccagcgagagcacagcagaagatgacatccaggagacagacagcttcagcctgcctgaggagtacttcaccccagcccccagccctggggaccagagcagtggagaagatagaaggaaggccggcggcaacaacagctag

SEQ ID NO: 155182 - DNA, 3015 bp, Artificial Sequence
  Description of Artificial Sequence: Synthetic coding sequence
atggtgcagctgtacaacctgcaccccttcggcagccagcaggtggtgccctgcaagctggagccagaccgcttctgtggcggcggcagagatgccctgtttgtggccgccggctgcaaggtggaggcctttgctgtggccggccaggagctgtgccagccccgctgtgccttcagcaccctgggccgggtgctgcggctggcctacagcgaggccggggactacctggtggccatcgaggagaagaacaaggccaccttcctgcgggcctacgtgaactggaggaacaagaggacagagaacagccgggtgtgcatccgcatgattggccacaacgtggagggccccttcagcaaggccttccgggaccagatgtacatcatcgagatgcccctgtctgaggcccccctgtgcatcagctgctgccctgtgaagggggacctgctggtgggctgcaccaacaagctggtgctcttcagcctgaagtaccagatcatcaatgaggagttcagcctgctggactttgagaggagcctcatcatccacatcgacaacatcacccctgtggaggtgtccttctgtgtgggctacgtggccgtgatgtctgacctggaggtgctgattgtgaagctggagagcggccccaagaatggagagcgggtgcaccaccacccccacaagaccaacaaccgcatcagaagaacagaggagggcatcagcaatgagatcagccagctggagagtgatgactttgtgatctgccagaagcccctggagctgctgggggagaagtctgagcagagcggcctgtctgtgaccctggagagcacaggcctggctgatgagaagaggaagtacagccacttccagcacctgctgtacagaagatttgccccagacatcagcagctatgtgctgagtgatgacatcaagctgcacagcctgcagctgctgcccatctaccagacaggcagcctgaccagtgatggcaagaacctgagccaggagaaggagctgctgagcctcttctgcttcttcagcctgccccacgtgggctacctgtacatggtggtgaagtctgtggagctgatgtctgtgtaccagtacccagagaagagccagcaggccgtgctgaccccccagttcctgcacgtgatcaccagcaacaacctgcagtgcttcaccgtgcgctgcagcgctgctgctgcccgggaggaggacccctacatggacaccaccctgaaggcctgcccccctgtgtccatggatgtgtgtgccctgcgcatccagctgttcatcggcctgaaggccatctgccacttcaagaaccacatcatcctgctgaccaaggccgagcctgaggccatccctgagcggcggcagagccccaagaggctgctgagcaggaaggacacctctgtgaagatcaagatcccccctgtggccgaggccggctggaacctgtacatcgtgaacaccatcagccctgtgcagctgtacaaggagatggtggactacagcaacacctacaagacagtgaagacccagagctgcatccacctgctgtctgaggcccacctgctggtgcgggccgccctgatggatgccagccagctggagcctggagagaaggccgagctgctggaggccttcaaggagagctgtggccacctgggggactgctacagccggctggacagccagcacagccacctgaccctgccctactacaagatgagcggcctgtccatggccgaggtgctggccaggacagactggacagtggaggatggcctgcagaagtatgaaagaggcctcatcttctacatcaaccacagcctgtatgagaacctggatgaggagctgaatgaggagctggccgccaaggtggtgcagatgttttatgtggccgagcccaagcaggtgccccacatcctgtgcagccccagcatgaagaacatcaaccccctgacagccatgagctacctgaggaagctggacaccagcggcttcagcagcatcctggtgaccctgaccaaggctgctgtggccctgaagatgggagacctggacatgcacagaaatgagatgaagagccacagcgagatgaagctggtgtgtggcttcatcctggagccccggctgctgatccagcagaggaagggccagatcgtgcccacagagctggccctgcacctgaaggagacccagcccggcctgctggtggcctctgtgctgggcctgcagaagaacaacaagattggcatcgaggaggccgacagcttcttcaaggtgctgtgtgccaaggatgaggacaccatcccccagctgctggtggacttctgggaggcccagctggtggcctgcctgcctgatgtggtgctgcaggagctgttcttcaagctgaccagccagtacatctggaggctgagcaagaggcagcccccagacaccacccccctgcggaccagtgaagatctcatcaatgcctgcagccactacggcctcatctacccctgggtgcacgtggtgatcagcagtgacagcctggccgacaagaactacacagaggacctgagcaagctgcagagcctcatctgtggccccagctttgatattgccagcatcatccccttcctggagcccctgtctgaggacaccatcgccggcctgtctgtgcacgtgctgtgcaggacccggctgaaggagtatgagcagtgcatcgacatcctgctggagcgctgcccagaggccgtcatcccctatgccaaccacgagctgaaggaggagaacagaaccctgtggtggaagaagctgctgcctgagctgtgccagaggatcaagtgtggcggggagaagtaccagctgtacctgagcagcctgaaggagaccctgagcatcgtggccgtggagctggagctgaaggacttcatgaatgtgctgcctgaagatggaacagccaccttcttcctgccctacctgctgtactgcagcaggaagaagcccctgacctag

SEQ ID NO: 155183 - DNA, 1587 bp, Artificial Sequence
  Description of Artificial Sequence: Synthetic coding sequence
atggccaccagcaccagcacagaggccaagagcgcctcctggtggaactacttcttcctgtatgatggcagcaaggtgaaggaggagggggaccccaccagggctggcatctgctacttctaccccagccagaccctgctggaccagcaggagctgctgtgtggccagattgctggggtggtgcgctgtgtgtctgacatcagtgacagcccccccaccctggtgcggctgaggaagctgaagtttgccatcaaggtggatggagactacctgtgggtgctgggctgtgctgtggagctgcctgatgtgtcctgcaagcgcttcctggaccagctggtgggcttcttcaacttctacaacggccctgtgtccctggcctatgagaactgcagccaggaggagctgagcacagagtgggacaccttcatcgagcagatcctgaagaacaccagtgacctgcacaagatcttcaacagcctgtggaacctggaccagaccaaggtggagcccctgctgctgctgaaggccgcccgcatcctgcagacctgccagaggagcccccacatcctggccggctgcatcctgtacaagggcctcatcgtgtccacccagctgccccccagcctgacagccaaggtgctgctgcacaggacagccccccaggagcagaggctgcccactggagaagatgccccccaggagcacggcaagtggatgctgtggagcttcaagaacagagtgacccaccagaaccccaatggagctgccctgccccccaacgtgcagatcatccctgtgtttgtgaccaaggaggaggccatcagcctgcacgagttccctgtggagcagatgaccaggagcctggccagccctgctggcctgcaggacggcagcgcccagcaccaccccaagggcggcagcaccagcgccctgaaggaaaatgccaccggccacgtggagagcatggcctggaccaccccagaccccaccagcccagatgaggcctgcccagatggcaggaaagaaaatggctgcctgagcggccatgacctggagagcatccggcctgctggcctgcacaacagcgcccggggggaggtgctgggcctgagcagcagcctgggcaaggagctggtgttcctgcaggaggagctggacctgtctgagatccacatccctgaggcccaggaggtggagatggccagcggccactttgccttcctgcacgtgcctgtgcctgatggccgggccccctactgcaaggccagcctgagcgccagcagcagcctggagcccaccccacctgaggacacagccatcagcagcctgcggcccccatctgcccctgagatgctgacccagcacggggcccaggagcagctggaggaccaccctggccacagcagccaggcccccatccccagggctgaccccctgcccaagagcacagtgctcttcagcggcggctgtgtgaagggcagtgacacccagctgtgtgtgcccggcctggtgtggtacctggagccccagttctactacgtgattgtgcgccacttctttgacagcatgaggcagacagctggatag

SEQ ID NO: 155184 - DNA, 2127 bp, Artificial Sequence
  Description of Artificial Sequence: Synthetic coding sequence
atggccaccagcaccagcacagaggccaagagcgcctcctggtggaactacttcttcctgtatgatggcagcaaggtgaaggaggagggggaccccaccagggctggcatctgctacttctaccccagccagaccctgctggaccagcaggagctgctgtgtggccagattgctggggtggtgcgctgtgtgtctgacatcagtgacagcccccccaccctggtgcggctgaggaagctgaagtttgccatcaaggtggatggagactacctgtgggtgctgggctgtgctgtggagctgcctgatgtgtcctgcaagcgcttcctggaccagctggtgggcttcttcaacttctacaacggccctgtgtccctggcctatgagaactgcagccaggaggagctgagcacagagtgggacaccttcatcgagcagatcctgaagaacaccagtgacctgcacaagatcttcaacagcctgtggaacctggaccagaccaaggtggagcccctgctgctgctgaaggccgcccgcatcctgcagacctgccagaggagcccccacatcctggccggctgcatcctgtacaagggcctcatcgtgtccacccagctgccccccagcctgacagccaaggtgctgctgcacaggacagccccccaggagcagaggctgcccactggagaagatgccccccaggagcacggggccgccctgccccccaacgtgcagatcatccctgtgtttgtgaccaaggaggaggccatcagcctgcacgagttccctgtggagcagatgaccaggagcctggccagccctgctggcctgcaggacggcagcgcccagcaccaccccaagggcggcagcaccagcgccctgaaggaaaatgccaccggccacgtggagagcatggcctggaccaccccagaccccaccagcccagatgaggcctgcccagatggcaggaaagaaaatggctgcctgagcggccatgacctggagagcatccggcctgctggcctgcacaacagcgcccggggggaggtgctgggcctgagcagcagcctgggcaaggagctggtgttcctgcaggaggagctggacctgtctgagatccacatccctgaggcccaggaggtggagatggccagcggccactttgccttcctgcacgtgcctgtgcctgatggccgggccccctactgcaaggccagcctgagcgccagcagcagcctggagcccaccccacctgaggacacagccatcagcagcctgcggcccccatctgcccctgagatgctgacccagcacggggcccaggagcagctggaggaccaccctggccacagcagccaggcccccatccccagggctgaccccctgcccaggaggacccggcggcccctgctgctgccccggctggaccccggccagaggggcaacaagctgcccactggagagcagggcctggatgaagatgtggatggagtgtgtgagagccacgccgcccctggcctggagtgcagcagcggcagcgccaactgccagggcgccggccccagcgcagatggcatcagcagccggctgaccccagctgagagctgcatgggcctggtgaggatgaacctgtacacccactgtgtgaagggcctggtgctgagcctgctggccgaggagcccctgctgggggacagcgctgccatcgaggaggtgtaccacagcagcctggccagcctgaatggcctggaggtgcacctgaaggagaccctgcccagagatgaagctgccagcaccagcagcacctacaacttcacccactatgaccgcatccagagcctgctgatggccaacctgccccaggtggccaccccccaggaccggcgcttcctgcaggccgtgtccctgatgcacagcgagtttgcccagctgcctgccctgtatgagatgacagtgagaaatgccagcacagctgtgtatgcctgctgcaaccccatccaggagacctacttccagcagctggccccagctgcccggagcagcggcttccccaacccccaggatggagccttcagcctgagcggcaaggccaagcagaagctgctgaagcatggagtgaacctgctgtag

SEQ ID NO: 155185 - DNA, 2166 bp, Artificial Sequence
  Description of Artificial Sequence: Synthetic coding sequence
atggcccccctgtgcagcctggcccgctggaactacttcttcctgtatgatggcagcaaggtgaaggaggagggggaccccacccgggccggcatctgctacttctaccccagccagaccctgctggaccagcaggagctgctgtgtggccagattgctggggtggtgcgctgtgtgtctgacatcagtgacagcccccccaccctggtgcggctgaggaagctgaagtttgccatcaaggtggatggagactacctgtgggtgctgggctgtgctgtggagctgcctgatgtgtcctgcaagcgcttcctggaccagctggtgggcttcttcaacttctacaatggacctgtgtccctggcctatgagaactgcagccaggaggagctgagcacagagtgggacaccttcatcgagcagatcctgaagaacaccagtgacctgcacaagatcttcaacagcctgtggaacctggaccagaccaaggtggagcccctgctgctgctgaaggccgcccgcatcctgcagacctgccagaggagcccccacatcctggccggctgcatcctgtacaagggcctgattgtgtccacccagctgccccccagcctgacagccaaggtgctgctgcacaggacagccccccaggagcagaggctgcccaccggggaggatgccccccaggagcacggcaagtggatgctgtggagcttcaagaacagagtgacccaccagaaccccaacggggccgccctgcccccaaatgtgcagatcatccctgtgtttgtgaccaaggaggaggccatcagcctgcacgagttccctgtggagcagatgaccaggagcctggccagccctgctggcctgcaggacggcagcgcccagcaccaccccaagggcggcagcaccagcgccctgaaggaaaatgccactggacatgtggagagcatggcctggaccaccccagaccccaccagcccagatgaggcctgcccagatggcaggaaagaaaatggctgcctgagcggccatgacctggagagcatccggcctgctggcctgcacaacagcgcccggggggaggtgctgggcctgagcagcagcctgggcaaggagctggtgttcctgcaggaggagctggacctgtctgagatccacatccctgaggcccaggaggtggagatggccagcggccactttgccttcctgcacgtgcctgtgcctgatggccgggccccctactgcaaggccagcctgagcgccagcagcagcctggagcccaccccacctgaggacacagccatcagcagcctgcggccccccagcgcccctgagatgctgacccagcacggggcccaggagcagctggaggaccaccctggccacagcagccaggcccccatccccagggctgaccccctgcccaggaggacccggcggcccctgctgctgccccggctggaccccggccagaggggcaacaagctgcccaccggggagcagggcctggatgaagatgtggatggagtgtgtgagagccatgctgcccctggcctggagtgcagcagcggcagcgccaactgccagggcgccggccccagcgcagatggcatcagcagccggctgaccccagctgagagctgcatgggcctggtgaggatgaacctgtacacccactgtgtgaagggcctggtgctgagcctgctggccgaggagcccctgctgggggacagcgctgccatcgaggaggtgtaccacagcagcctggccagcctgaatggcctggaggtgcacctgaaggagaccctgcccagagatgaggccgccagcaccagcagcacctacaacttcacccactatgaccgcatccagagcctgctgatggccaacctgccccaggtggccaccccccaggaccggcgcttcctgcaggccgtgtccctgatgcacagcgagtttgcccagctgcctgccctgtatgagatgacagtgagaaatgccagcacagctgtgtatgcctgctgcaaccccatccaggagacctacttccagcagctggccccagctgcccggagcagcggcttccccaacccccaggatggagccttcagcctgagcggcaaggccaagcagaagctgctgaagcacggcgtgaacctgctgtag

SEQ ID NO: 155186 - DNA, 2127 bp, Artificial Sequence; identical to SEQ ID NO: 155184
  Description of Artificial Sequence: Synthetic coding sequence

SEQ ID NO: 155187 - DNA, 2112 bp, Artificial Sequence
  Description of Artificial Sequence: Synthetic coding sequence
atggcccccctgtgcagcctggcccgctggaactacttcttcctgtatgatggcagcaaggtgaaggaggagggggaccccacccgggccggcatctgctacttctaccccagccagaccctgctggaccagcaggagctgctgtgtggccagattgctggggtggtgcgctgtgtgtctgacatcagtgacagcccccccaccctggtgcggctgaggaagctgaagtttgccatcaaggtggatggagactacctgtgggtgctgggctgtgctgtggagctgcctgatgtgtcctgcaagcgcttcctggaccagctggtgggcttcttcaacttctacaatggacctgtgtccctggcctatgagaactgcagccaggaggagctgagcacagagtgggacaccttcatcgagcagatcctgaagaacaccagtgacctgcacaagatcttcaacagcctgtggaacctggaccagaccaaggtggagcccctgctgctgctgaaggccgcccgcatcctgcagacctgccagaggagcccccacatcctggccggctgcatcctgtacaagggcctgattgtgtccacccagctgccccccagcctgacagccaaggtgctgctgcacaggacagccccccaggagcagaggctgcccaccggggaggatgccccccaggagcacggggccgccctgcccccaaatgtgcagatcatccctgtgtttgtgaccaaggaggaggccatcagcctgcacgagttccctgtggagcagatgaccaggagcctggccagccctgctggcctgcaggacggcagcgcccagcaccaccccaagggcggcagcaccagcgccctgaaggaaaatgccactggacatgtggagagcatggcctggaccaccccagaccccaccagcccagatgaggcctgcccagatggcaggaaagaaaatggctgcctgagcggccatgacctggagagcatccggcctgctggcctgcacaacagcgcccggggggaggtgctgggcctgagcagcagcctgggcaaggagctggtgttcctgcaggaggagctggacctgtctgagatccacatccctgaggcccaggaggtggagatggccagcggccactttgccttcctgcacgtgcctgtgcctgatggccgggccccctactgcaaggccagcctgagcgccagcagcagcctggagcccaccccacctgaggacacagccatcagcagcctgcggccccccagcgcccctgagatgctgacccagcacggggcccaggagcagctggaggaccaccctggccacagcagccaggcccccatccccagggctgaccccctgcccaggaggacccggcggcccctgctgctgccccggctggaccccggccagaggggcaacaagctgcccaccggggagcagggcctggatgaagatgtggatggagtgtgtgagagccatgctgcccctggcctggagtgcagcagcggcagcgccaactgccagggcgccggccccagcgcagatggcatcagcagccggctgaccccagctgagagctgcatgggcctggtgaggatgaacctgtacacccactgtgtgaagggcctggtgctgagcctgctggccgaggagcccctgctgggggacagcgctgccatcgaggaggtgtaccacagcagcctggccagcctgaatggcctggaggtgcacctgaaggagaccctgcccagagatgaggccgccagcaccagcagcacctacaacttcacccactatgaccgcatccagagcctgctgatggccaacctgccccaggtggccaccccccaggaccggcgcttcctgcaggccgtgtccctgatgcacagcgagtttgcccagctgcctgccctgtatgagatgacagtgagaaatgccagcacagctgtgtatgcctgctgcaaccccatccaggagacctacttccagcagctggccccagctgcccggagcagcggcttccccaacccccaggatggagccttcagcctgagcggcaaggccaagcagaagctgctgaagcacggcgtgaacctgctgtag

SEQ ID NO: 155188 - DNA, 3390 bp, Artificial Sequence
  Description of Artificial Sequence: Synthetic coding sequence
atggcctttgtgcctgtgattcctgagagctacagccacgtgctggccgagtttgagagcctggaccccctgctgagcgccctgcggctggacagcagccggctgaagtgcaccagcattgctgtgtccaggaagtggctggccctgggcagcagcggcggcggcctgcacctgatccagaaggagggctggaagcacaggctcttcctgagccaccgggagggcgccatcagccaggtggcctgctgcctgcatgatgatgattatgtggccgtggccaccagccagggcctggtggtggtgtgggagctgaaccaggagcggcggggcaagccagagcagatgtatgtgtcctctgagcacaagggccggcgggtgacagccctgtgctgggacacagccatcctgcgggtgtttgtgggggaccacgccggcaaggtgtctgccatcaagctgaacaccagcaagcaggccaaggctgctgctgcctttgtgatgtttcctgtgcagaccatcaccaccgtggacagctgtgtggtgcagctggactacctggatggccgcctgctgatcagcagcctgaccaggagcttcctgtgtgacacagagcgggagaagttctggaagattggcaacaaggagagagatggagaatatggagcctgcttcttccctggccgctgcagcggcggccagcagcccctcatctactgtgcccggcccggcagcaggatgtgggaggtgaactttgatggagaggtgatcagcacccaccagttcaagaagctgctgagcctgccccccctgcccgtcatcaccctgcggtctgagccccagtatgaccacacagctggcagcagccagagcctgtccttccccaagctgctgcacctgtctgagcactgtgtgctgacctggacagagcggggcatctacatcttcatcccccagaatgtgcaggtgctgctgtggagcgaggtgaaggacatccaggatgtggccgtgtgcagaaatgagctgttctgcctgcacctgaatggcaaggtgagccacctgagcctcatctctgtggagcgctgtgtggagcggctgctgcggcggggcctgtggaacctggccgcccggacctgctgcctcttccagaacagcgtgattgccagccgggccaggaagaccctgacagctgacaagctggagcacctgaagagccagctggaccacggcacctacaatgacctgatcagccagctggaggagctgatcctgaagtttgagcccctggacagcgcctgcagcagccgccgcagcagcatcagcagccatgagagcttcagcatcctggacagcggcatctaccgcatcatcagcagccggcggggcagccagagtgatgaggacagctgcagcctgcacagccagaccctgtctgaagatgagcgcttcaaggagttcaccagccagcaggaggaggacctgcctgaccagtgctgcggcagccacggcaatgaagataatgtgagccacgcccctgtgatgtttgaaacagacaagaatgagaccttcctgcccttcggcatccccctgcccttccgcagccccagccccctggtgtccctgcaggccgtgaaggagagcgtgagcagctttgtgaggaagaccacagagaagattggcaccctgcacaccagcccagacctgaaggtgcggcctgagctgcggggagatgagcagagctgtgaagaagatgtgtccagtgacacctgccccaaggaggaggacacagaggaggagaaggaggtgaccagccccccaccagaagaagatcgcttccaggagctgaaggtggccacagctgaggccatgaccaagctgcaggaccccctggtgctgtttgaaagtgagagcctgaggatggtgctgcaggagtggctgagccacctggagaagacctttgccatgaaggacttctctggagtgtctgacacagacaacagctccatgaagctgaaccaggatgtgctgctggtgaatgaaagcaagaagggcatcctggatgaggacaatgagaaggagaagagggacagcctgggcaatgaggagagcgtggacaagacagcctgtgaatgtgtgcgcagcccccgggagagcctggatgacctcttccagatctgcagcccctgtgccatcgccagcggcctgagaaatgacctggccgagctgaccaccctgtgcctggagctgaatgtgctgaacagcaagatcaagagcaccagcggccacgtggaccacaccctgcagcagtacagccctgagatcctggcctgccagttcctgaagaagtacttcttcctgctgaacctgaagagggccaaggagagcatcaagctgagctacagcaacagccccagcgtgtgggacaccttcatcgagggcctgaaggagatggccagcagcaaccctgtgtacatggagatggagaagggggacctgcccacccggctgaagctgctggatgatgaggtgccctttgacagccccctgctggtggtgtatgccacccggctgtatgagaagtttggagagagcgccctgcggagcctcatcaagttcttccccagcatcctgcccagcgacatcatccagctgtgccaccaccaccctgctgagttcctggcctacctggacagcctggtgaagagcaggcctgaggaccagaggagcagcttcctggagagcctgctgcagcctgagagcctgcggctggactggctgctgctggccgtgtccctggatgccccacccagcaccagcaccatggatgatgagggctacccccggccccacagccacctgctgtcctggggctacagccagctgatcctgcacctgatcaagctgcctgctgacttcatcaccaaggagaagatgacagacatctgccgcagctgtggcttctggccaggctacctgatcctgtgcctggagctggagaggagaagagaggccttcaccaacatcgtgtacctgaatgacatgagcctgatggagggggacaatggctggatccctgagaccgtggaggagtggaagctgctgctgcacctgatccagagcaagagcaccaggcctgccccccaggagagcctgaatggcagcctgagtgatggccccagccccatcaacgtggagaatgtggccctgctgctggccaaggccatgggccctgaccgggcctggagcctgctgcaggagtgtggcctggccctggagctgtctgagaagttcaccaggacctgtgacatcctgagaattgctgagaagaggcagagggccctgatccagagcatgctggagaagtgtgaccgcttcctgtggagccagcaggcctag

SEQ ID NO: 155189 - DNA, 3048 bp, Artificial Sequence
  Description of Artificial Sequence: Synthetic coding sequence
atgtatgtgtcctctgagcacaagggccggcgggtgacagccctgtgctgggacacagccatcctgcgggtgtttgtgggggaccacgccggcaaggtgtctgccatcaagctgaacaccagcaagcaggccaaggctgctgctgcctttgtgatgtttcctgtgcagaccatcaccaccgtggacagctgtgtggtgcagctggactacctggatggccgcctgctgatcagcagcctgaccaggagcttcctgtgtgacacagagcgggagaagttctggaagattggcaacaaggagagagatggagaatatggagcctgcttcttccctggccgctgcagcggcggccagcagcccctcatctactgtgcccggcccggcagcaggatgtgggaggtgaactttgatggagaggtgatcagcacccaccagttcaagaagctgctgagcctgccccccctgcccgtcatcaccctgcggtctgagccccagtatgaccacacagctggcagcagccagagcctgtccttccccaagctgctgcacctgtctgagcactgtgtgctgacctggacagagcggggcatctacatcttcatcccccagaatgtgcaggtgctgctgtggagcgaggtgaaggacatccaggatgtggccgtgtgcagaaatgagctgttctgcctgcacctgaatggcaaggtgagccacctgagcctcatctctgtggagcgctgtgtggagcggctgctgcggcggggcctgtggaacctggccgcccggacctgctgcctcttccagaacagcgtgattgccagccgggccaggaagaccctgacagctgacaagctggagcacctgaagagccagctggaccacggcacctacaatgacctgatcagccagctggaggagctgatcctgaagtttgagcccctggacagcgcctgcagcagccgccgcagcagcatcagcagccatgagagcttcagcatcctggacagcggcatctaccgcatcatcagcagccggcggggcagccagagtgatgaggacagctgcagcctgcacagccagaccctgtctgaagatgagcgcttcaaggagttcaccagccagcaggaggaggacctgcctgaccagtgctgcggcagccacggcaatgaagataatgtgagccacgcccctgtgatgtttgaaacagacaagaatgagaccttcctgcccttcggcatccccctgcccttccgcagccccagccccctggtgtccctgcaggccgtgaaggagagcgtgagcagctttgtgaggaagaccacagagaagattggcaccctgcacaccagcccagacctgaaggtgcggcctgagctgcggggagatgagcagagctgtgaagaagatgtgtccagtgacacctgccccaaggaggaggacacagaggaggagaaggaggtgaccagccccccaccagaagaagatcgcttccaggagctgaaggtggccacagctgaggccatgaccaagctgcaggaccccctggtgctgtttgaaagtgagagcctgaggatggtgctgcaggagtggctgagccacctggagaagacctttgccatgaaggacttctctggagtgtctgacacagacaacagctccatgaagctgaaccaggatgtgctgctggtgaatgaaagcaagaagggcatcctggatgaggacaatgagaaggagaagagggacagcctgggcaatgaggagagcgtggacaagacagcctgtgaatgtgtgcgcagcccccgggagagcctggatgacctcttccagatctgcagcccctgtgccatcgccagcggcctgagaaatgacctggccgagctgaccaccctgtgcctggagctgaatgtgctgaacagcaagatcaagagcaccagcggccacgtggaccacaccctgcagcagtacagccctgagatcctggcctgccagttcctgaagaagtacttcttcctgctgaacctgaagagggccaaggagagcatcaagctgagctacagcaacagccccagcgtgtgggacaccttcatcgagggcctgaaggagatggccagcagcaaccctgtgtacatggagatggagaagggggacctgcccacccggctgaagctgctggatgatgaggtgccctttgacagccccctgctggtggtgtatgccacccggctgtatgagaagtttggagagagcgccctgcggagcctcatcaagttcttccccagcatcctgcccagcgacatcatccagctgtgccaccaccaccctgctgagttcctggcctacctggacagcctggtgaagagcaggcctgaggaccagaggagcagcttcctggagagcctgctgcagcctgagagcctgcggctggactggctgctgctggccgtgtccctggatgccccacccagcaccagcaccatggatgatgagggctacccccggccccacagccacctgctgtcctggggctacagccagctgatcctgcacctgatcaagctgcctgctgacttcatcaccaaggagaagatgacagacatctgccgcagctgtggcttctggccaggctacctgatcctgtgcctggagctggagaggagaagagaggccttcaccaacatcgtgtacctgaatgacatgagcctgatggagggggacaatggctggatccctgagaccgtggaggagtggaagctgctgctgcacctgatccagagcaagagcaccaggcctgccccccaggagagcctgaatggcagcctgagtgatggccccagccccatcaacgtggagaatgtggccctgctgctggccaaggccatgggccctgaccgggcctggagcctgctgcaggagtgtggcctggccctggagctgtctgagaagttcaccaggacctgtgacatcctgagaattgctgagaagaggcagagggccctgatccagagcatgctggagaagtgtgaccgcttcctgtggagccagcaggcctag

SEQ ID NO: 155190 - DNA, 3048 bp, Artificial Sequence; identical to SEQ ID NO: 155189
  Description of Artificial Sequence: Synthetic coding sequence

SEQ ID NO: 155191 - DNA, 2328 bp, Artificial Sequence
  Description of Artificial Sequence: Synthetic coding sequence
atgaagaggagcggcaccctgcggctgctgagtgacctgagcgccttcggcggggccgcccggctgcgggagctggtggccggggacagcgctgtgcgggtgcggggcagcccagatggccgccacctgctgctgctgcggcccccaggagctgtggccccccagctgctggtggccagccggggccctggagctgagctggagcgggcctggccagctggccagcccagccccctggatgccttcttcctgccctggccagcccggcctgccctggtgctggtgtgggagagcggcctggccgaggtgtggggcgctggggtgggccctggctggaggcccctgcagagcacagagctgtgccctgggggcggggcccgggtggtggccgtggccgccctgcggggccgcctggtgtggtgtgaggagcggcaggcccgggcagagggccccagcggcagccctgctgctgccttcagccactgtgtgtgtgtgaggaccctggagcccagcggggaggccagcaccagcctgggccgcacccacgtgctgctgcaccactgcccagccttcggcctgctggccagctgccggcagctgttcctggtgcccacagccaccacctggccaggagtggcccacgtgctgctgatctggagccctgggaagggcaaggtgatggtggccgccccccggctgggcctgagctacagcaagagcctgaaccctggccgcggggacacctgggacttccgcaccctgctgcggggcctgcccggcctgctgagcccccgggagcccctggccgtgcacacctgggcccccaccccccagggcctgctgctgctggactttggaggcaccgtgtccctgctgcagagccatggaggcaccagggctgtgggcaccctgcaggaggcccctgtgggcccctggggcagcgctgccctgggcaccttccagggcaccctggcctgtgtgctgggcagcaccctggagctgctggacatgggcagcggccagctgctggagaggaaggtgctgagcacagacagagtgcacctgctggagcccccagcccctggcatggaggatgaggaggagctggagacccggggcaacctgcggctgctgagcgccctgggcctcttctgtgtgggctgggaggccccccagggcgtggagctgcccagcgccaaggacctggtgtttgaggaggcctgtggctactaccagaggaggagcctgcggggggcccagctgaccccagaggagctgcggcacagcagcaccttccgggccccccaggccctggccagcatcctgcagggccacctgcccccatctgccctgctgaccatgctgaggacagagctgcgggactaccggggcctggagcagctgaaggcccagctggtggccggagatgatgaggaggccggctggacagagctggccgagcaggaggtggcccggctgctgaggacagagctgattggagaccagctggcccagctgaacacagtgttccaggccctgcccacagctgcctggggcgccaccctgcgggccctgcagctgcagctggatggaaatggcaagctgcggagccaggcccccccagatgtgtggaagaaggtgctgggcggcatcacagctgggaaggagcccccaaatggcatcctgcccccatttgagctgctgtgccagtgcctgtgccagctggagccccgctggctgcccccatttgtggagctggcccagcagcagggcggccctggctggggcgccggcggccctggcctgcccctgtaccgccgggccctggccgtgctgggggaggagggcaccaggcctgaggccctggagctggagctgctgctgagcagcggccggcccaaggctgtgctgcaggccgtgggccagctggtgcagaaggagcagtgggaccgggccctggatgctggcctggccctgggccccagcagccccctgctgcggtctgagatcttcaagctgctgctggccgagtttgcccagcaccggcggctggatgcccacctgcccctgctgtgccgcctgtgccccccagagctggccccagctgagctgctgctgctgctgcggacctacctgcctgatgaggtgggcccccccacccccttccctgagcctggagctgagccccccctgactgtgggcctgctgaaggccctgctggagcagacaggagcccagggctggctgagcggccctgtgctgagcccctatgaggacatcctgtgggaccccagcaccccaccacccaccccaccccgggacctgtag

SEQ ID NO: 155192 - DNA, 1596 bp, Artificial Sequence
  Description of Artificial Sequence: Synthetic coding sequence
atgctgggcttcctgagccggggccccagcatgaagctgtgcatgggcctggcctgtgtgctgagcctgtggaacacagtgtctggcatcaagggggaggccaagaaggagaagggcatgaccttcctgcccaccaccgtgtctggcctgcgggaggaggagaggaaggagaagggcgtggccttcctggccaccacagagctgcctgcccggagcattgacctgagcgccctgaacctgacagagctggtgaatggcatgctgagccgggccctgaaggacagcaagaagttcttcagcctgctgtctgtgaccagctacagcagctttgccttccacaagttctctgtggccgtgtacaacatcagcaacctgaagacagtggaccctgccaagttccccacccgctactgctactgcctgaacaacagaacaaatgacctgagtgacttcaccgccctgctggtggacatcatcggcaacagcaccagctacctgacagagatcttcaagagcaccagcatcctgtctgtgaaccagagcaatgaaagtgactgcatcttcatctgtgtgatgaccgggaagagcggcaggaacctgagtgacttctgggagattgaggagaagtaccccatcatcaactacaccttcaccagcggcctgagcggcgtgctgggcgccgccacccggggcacagcccggaccagcaagcccaccaccaagagccagaagaccctgcccagcaccagccctggccactggacccagagcaccccctgggccagcgccctgcggagcagcccctggacagaaacagctgcccccagcgagacagaggagaccctgaacacaggccggcccccagagctgcctgcccgggccacagccacctggttcagcgccagccacaccctgcctgccctggccaccaggagagtggcccggacccagtggctgacagctgaccggcagacctgggccagcatcagctctgtgccctgggcccagaccatcagcgagaagaagccaggcggcagcctgtgggagaccaggagcagcccccccaccacagctggaacagaggaggccatgaacaccaccagcctgctggccccagctgctgagatcatggccaccccaggcagccccagccaggccagccccaccctgggcgccttcacccacggcacccagacccccagccccaccaaggccacagccccccgctacccccagacaggagacctgtctgctgagtggcccttcaccgctggggaggagcctgtgctggtgccccggccccaccaggtgagccgctgcccccagcccctcttcaaggtgggcgccatggccgccgcccccctgaccctggccatccagaggctgaacccctgcctgatggagctgtgccagttcttccagcagtgcctgtgcatgagccagaggagccccaggacagaggacatgagatactgcctggagtactacagctggttcctgaagaatgccacctacatctgccagagggtgaagagggtgagccacagccacaccctgaagcagaagtgcctggagaacatctgcaagtctgtgtag

SEQ ID NO: 155193 - DNA, 558 bp, Artificial Sequence
  Description of Artificial Sequence: Synthetic coding sequence
atgagccccagcctgcaggagggcgcccagctgggggagaacaagcccagcacctgcagcttcagcattgagcgcatcctgggcctggaccagaagaaggactgtgtgcccctgatgaagccccaccggccctgggccgacacctgcagcagcagcggcaaggatggcaacctgtgcctgcacgtgcccaaccccccatctggcatctccttccccagcgtggtggaccaccccatgcctgaggagcgggccagcaaatatgagaactacttcagcgccagcgagcggctgagcctgaagcgggagctgtcctggtaccggggcagaagacccaggacagccttcacccagaaccagatcgaggtgctggagaatgtgttccgggtgaactgctacccaggcatcgacatccgggaggacctggcccagaagctgaacctggaggaggaccgcatccagatctggttccagaacagaagagccaagctgaagaggagccaccgggagagccagttcctgatggccaagaagaacttcaacaccaacctgctggagtag

SEQ ID NO: 155194 - DNA, 324 bp, Artificial Sequence
  Description of Artificial Sequence: Synthetic coding sequence
atgagccccagcctgcaggagggcgcccagctgggggagaacaagcccagcacctgcagcttcagcattgagcgcatcctgggcctggaccagaagaaggactgtgtgcccctgatgaagccccaccggccctgggccgacacctgcagcagcagcggcaaggatggcaacctgtgcctgcacgtgcccaaccccccatctggcatctccttccccagcgtggtggaccaccccatgcctgaggagcgggccagcaaatatgagaactacttcagcgccagcgagcggctgagcctgaagcgggagctgtcctggtacagatag

SEQ ID NO: 155195 - DNA, 1263 bp, Artificial Sequence
  Description of Artificial Sequence: Synthetic coding sequence
atggaggtgcccccccggctgagccacgtgcccccacccctcttccccagcgccccagccaccctggccagccgcagcctgagccactggaggccccggcccccccggcagctggcccccctgctgcccagcctggcccccagcagcgcccggcagggcgcccggcgggcccagagacatgtgacagcccagcagcccagccggctggccggcggggccgccatcaagggcggcagaagaagaagaccagacctcttcagaagacacttcaagagcagcagcatccagaggtctgctgctgctgctgctgccaccaggacagcccggcagcaccccccagctgacagctctgtgaccatggaggacatgaatgagtacagcaacatcgaggagtttgctgagggcagcaagatcaatgccagcaagaaccagcaggatgatggcaagatgttcatcggcggcctgtcctgggacaccagcaagaaggacctgacagagtacctgagcagatttggagaggtggtggactgcaccatcaagacagatcctgtgacaggccgcagccggggctttggatttgtgctcttcaaggatgctgcctctgtggacaaggtgctggagctgaaggagcacaagctggatggcaagctgattgaccccaagagggccaaggccctgaagggcaaggagccccccaagaaggtgtttgtgggcggcctgagcccagacaccagcgaggagcagatcaaggagtactttggagccttcggggagattgagaacatcgagctgcccatggacaccaagaccaatgaaagaagaggcttctgcttcatcacctacacagatgaggagcctgtgaagaagctgctggagagccgctaccaccagatcggcagcgggaaatgtgagatcaaggtggcccagcccaaggaggtgtaccggcagcagcagcagcagcagaagggcggcagaggagctgctgctgggggccggggcggcacccggggccggggccggggccagggccagaactggaaccagggcttcaacaactactatgaccagggctacggcaactacaacagcgcctatggaggagaccagaactacagcggctacggcggctatgactacacaggctacaactacggcaactacggctacggccagggctacgccgactacagcggccagcagagcacctacggcaaggccagcagaggaggcggcaaccaccagaacaactaccagccctactag

SEQ ID NO: 155196 - DNA, 735 bp, Artificial Sequence
  Description of Artificial Sequence: Synthetic coding sequence
atggaggacatgaatgagtacagcaacatcgaggagtttgctgagggcagcaagatcaatgccagcaagaaccagcaggatgatggcaagatgtttattggaggcctgtcctgggacaccagcaagaaggacctgacagagtacctgagcagatttggagaggtggtggactgcaccatcaagacagatcctgtgacaggccgcagccggggcttcggctttgtgctcttcaaggatgctgcctctgtggacaaggtgctggagctgaaggagcacaagctggatggcaagctgattgaccccaagagggccaaggccctgaagggcaaggagccccccaagaaggtgtttgtgggcggcctgagcccagacaccagcgaggagcagatcaaggagtactttggagcctttggagaaattgaaaatattgagctgcccatggacaccaagaccaatgaaagaagaggcttctgcttcatcacctacacagatgaggagcctgtgaagaagctgctggagagccgctaccaccagatcggcagcgggaaatgtgagatcaaggtggcccagcccaaggaggtgtaccggcagcagcagcagcagcagaagggcggccgcggggctgctgctgggggccggggcggcacccggggccggggccggggccagcagagcacctacggcaaggccagcagaggaggcggcaaccaccagaacaactaccagccctactag

SEQ ID NO: 155197 - DNA, 1263 bp, Artificial Sequence; identical to SEQ ID NO: 155195
  Description of Artificial Sequence: Synthetic coding sequence

SEQ ID NO: 155198 - DNA, 1902 bp, Artificial Sequence
  Description of Artificial Sequence: Synthetic coding sequence
atggccaaccaggtgaatggaaatgctgtgcagctgaaggaggaggaggagcccatggacaccagctctgtgacccacacagagcactacaagaccctcatcgaggccggcctgccccagaaggtggccgagcggctggatgagatcttccagacaggcctggtggcctacgtggacctggatgagcgggccattgatgccctgcgggagttcaatgaggagggcgccctgtctgtgctgcagcagttcaaggagagtgacctgagccacgtgcagaacaagagcgccttcctgtgtggggtgatgaagacctaccggcagcgggagaagcagggcagcaaggtgcaggagagcaccaagggcccagatgaggccaagatcaaggccctgctggagaggacaggctacaccctggatgtgaccaccggccagaggaaatatggaggccccccaccagacagcgtgtacagcggcgtgcagcccggcattggaacagaggtgtttgtgggcaagatcccccgggacctgtatgaagatgagctggtgcccctgtttgagaaggccggccccatctgggacctgcggctgatgatggaccccctgagcggccagaacagaggctacgccttcatcaccttctgtgggaaggaggccgcccaggaggccgtgaagctgtgtgacagctatgagatccggcctgggaagcacctgggcgtgtgcatctctgtggccaacaaccggctgtttgtgggcagcatccccaagaacaagaccaaggagaacatcctggaggagttcagcaaggtgacagagggcctggtggatgtgatcctgtaccaccagccagatgacaagaagaagaacagaggcttctgcttcctggagtatgaggaccacaagtctgctgcccaggcccggcggcggctgatgtctgggaaggtgaaggtgtggggcaatgtggtgacagtggagtgggccgaccctgtggaggagccagaccctgaggtgatggccaaggtgaaggtgctgtttgtgaggaacctggccaccaccgtgacagaggagatcctggagaagagcttcagcgagtttgggaagctggagcgggtgaagaagctgaaggactatgcctttgtgcactttgaggacagaggagctgctgtgaaggccatggatgagatgaatggcaaggagattgaaggagaggagattgagatcgtgctggccaagcccccagacaagaagaggaaggagcggcaggccgcccggcaggccagccgcagcacagcctatgaggactactactaccaccccccacccaggatgcccccacccatccggggccggggccggggcggcggccggggcggctacggctaccccccagactactacggctatgaggactactatgatgactactacggctatgactaccatgactaccggggcggctatgaggacccctactacggctatgatgatggctatgctgtgcggggccggggcggcggccggggcggccgcggggcccctcctccaccccggggccgcggggcccccccaccccggggccgggccggctacagccagagaggagcccccctgggccccccccggggcagccggggcggccggggcggccctgcccagcagcagaggggccggggcagccggggcagccggggcaacagaggaggaaatgtgggcggcaagaggaaggcagatggctacaaccagcctgacagcaagaggcggcagaccaacaaccagcagaactggggcagccagcccatcgcccagcagcccctgcagcagggcggggactacagcggcaactacggctacaacaatgacaaccaggagttctaccaggacacctacggccagcagtggaagtag

SEQ ID NO: 155199 - DNA, 1902 bp, Artificial Sequence; identical to SEQ ID NO: 155198
  Description of Artificial Sequence: Synthetic coding sequence

SEQ ID NO: 155200 - DNA, 1911 bp, Artificial Sequence
  Description of Artificial Sequence: Synthetic coding sequence
atggccaaccaggtgaatggaaatgctgtgcagctgaaggaggaggaggagcccatggacaccagctctgtgacccacacagagcactacaagaccctcatcgaggccggcctgccccagaaggtggccgagcggctggatgagatcttccagacaggcctggtggcctacgtggacctggatgagcgggccattgatgccctgcgggagttcaatgaggagggcgccctgtctgtgctgcagcagttcaaggagagtgacctgagccacgtgcagaacaagagcgccttcctgtgtggggtgatgaagacctaccggcagcgggagaagcagggcagcaaggtgcaggagagcaccaagggcccagatgaggccaagatcaaggccctgctggagaggacaggctacaccctggatgtgaccaccggccagaggaaatatggaggccccccaccagacagcgtgtacagcggcgtgcagcccggcattggaacagaggtgtttgtgggcaagatcccccgggacctgtatgaagatgagctggtgcccctgtttgagaaggccggccccatctgggacctgcggctgatgatggaccccctgagcggccagaacagaggctacgccttcatcaccttctgtgggaaggaggccgcccaggaggccgtgaagctgtgtgacagctatgagatccggcctgggaagcacctgggcgtgtgcatctctgtggccaacaaccggctgtttgtgggcagcatccccaagaacaagaccaaggagaacatcctggaggagttcagcaaggtgacaggcctgacagagggcctggtggatgtgatcctgtaccaccagccagatgacaagaagaagaacagaggcttctgcttcctggagtatgaggaccacaagtctgctgcccaggcccggcggcggctgatgtctgggaaggtgaaggtgtggggcaatgtggtgacagtggagtgggccgaccctgtggaggagccagaccctgaggtgatggccaaggtgaaggtgctgtttgtgaggaacctggccaccaccgtgacagaggagatcctggagaagagcttcagcgagtttgggaagctggagcgggtgaagaagctgaaggactatgcctttgtgcactttgaagatagaggagctgctgtgaaggccatggatgagatgaatggcaaggagattgaaggagaggagattgaaattgtgctggccaagcccccagacaagaagaggaaggagcggcaggccgcccggcaggccagccgcagcacagcctatgaggactactactaccaccccccacccaggatgcccccacccatccggggccggggccggggcggcggccggggcggctacggctaccccccagactactacggctatgaggactactatgatgactactacggctatgactaccatgactacagaggaggctatgaggacccctactacggctatgatgatggctatgctgtgcggggccggggcggcggccggggcggccgcggggcccctcctccaccccggggccgcggggcccccccaccccggggccgggccggctacagccagagaggagcccccctgggccccccccggggcagcagaggaggccggggcggccctgcccagcagcagaggggccggggcagccggggcagccggggcaacagaggaggaaatgtgggcggcaagaggaaggcagatggctacaaccagcctgacagcaagaggcggcagaccaacaaccagcagaactggggcagccagcccatcgcccagcagcccctgcagcagggcggggactacagcggcaactacggctacaacaatgacaaccaggagttctaccaggacacctacggccagcagtggaagtag

SEQ ID NO: 155201 - DNA, 1422 bp, Artificial Sequence
  Description of Artificial Sequence: Synthetic coding sequence
atgaagacctaccggcagcgggagaagcagggcagcaaggtgcaggagagcaccaagggcccagatgaggccaagatcaaggccctgctggagaggacaggctacaccctggatgtgaccaccggccagaggaaatatggaggccccccaccagattctgtgtacagcggcgtgcagcccggcatcggcacagaatgtgacagctatgagatccggcctgggaagcacctgggcgtgtgcatctctgtggccaacaaccggctgtttgtgggcagcatccccaagaacaagaccaaggagaacatcctggaggagttcagcaaggtgacagagggcctggtggatgtgatcctgtaccaccagccagatgacaagaagaagaacagaggcttctgcttcctggagtatgaggaccacaagtctgctgcccaggcccggcggcggctgatgtctgggaaggtgaaggtgtggggcaatgtggtgacagtggagtgggccgaccctgtggaggagccagaccctgaggtgatggccaaggtgaaggtgctgtttgtgaggaacctggccaccaccgtgacagaggagatcctggagaagagcttcagcgagtttgggaagctggagcgggtgaagaagctgaaggactatgcctttgtgcactttgaggacagaggagctgctgtgaaggccatggatgagatgaatggcaaggagattgaaggagaggagattgagatcgtgctggccaagcccccagacaagaagaggaaggagcggcaggccgcccggcaggccagccgcagcacagcctatgaggactactactaccaccccccacccaggatgcccccacccatccggggccggggccggggcggcggccggggcggctacggctaccccccagactactacggctatgaggactactatgatgactactacggctatgactaccatgactaccggggcggctatgaggacccctactacggctatgatgatggctatgctgtgcggggccggggcggcggccggggcggccgcggggcccctcctccaccccggggccgcggggcccccccaccccggggccgggccggctacagccagagaggagcccccctgggccccccccggggcagccggggcggccggggcggccctgcccagcagcagaggggccggggcagccggggcagccggggcaacagaggaggaaatgtgggcggcaagaggaaggcagatggctacaaccagcctgacagcaagaggcggcagaccaacaaccagcagaactggggcagccagcccatcgcccagcagcccctgcagcagggcggggactacagcggcaactacggctacaacaatgacaaccaggagttctaccaggacacctacggccagcagtggaagtag

SEQ ID NO: 155202 - DNA, 1788 bp, Artificial Sequence
  Description of Artificial Sequence: Synthetic coding sequence
atggccaaccaggtgaatggaaatgctgtgcagctgaaggaggaggaggagcccatggacaccagctctgtgacccacacagagcactacaagaccctcatcgaggccggcctgccccagaaggtggccgagcggctggatgagatcttccagacaggcctggtggcctacgtggacctggatgagcgggccattgatgccctgcgggagttcaatgaggagggcgccctgtctgtgctgcagcagttcaaggagagtgacctgagccacgtgcagaacaagagcgccttcctgtgtggggtgatgaagacctaccggcagcgggagaagcagggcagcaaggtgcaggagagcaccaagggcccagatgaggccaagatcaaggtgtttgtgggcaagatcccccgggacctgtatgaagatgagctggtgcccctgtttgagaaggccggccccatctgggacctgcggctgatgatggaccccctgagcggccagaacagaggctacgccttcatcaccttctgtgggaaggaggccgcccaggaggccgtgaagctgtgtgacagctatgagatccggcctgggaagcacctgggcgtgtgcatctctgtggccaacaaccggctgtttgtgggcagcatccccaagaacaagaccaaggagaacatcctggaggagttcagcaaggtgacagagggcctggtggatgtgatcctgtaccaccagccagatgacaagaagaagaacagaggcttctgcttcctggagtatgaggaccacaagtctgctgcccaggcccggcggcggctgatgtctgggaaggtgaaggtgtggggcaatgtggtgacagtggagtgggccgaccctgtggaggagccagaccctgaggtgatggccaaggtgaaggtgctgtttgtgaggaacctggccaccaccgtgacagaggagatcctggagaagagcttcagcgagtttgggaagctggagcgggtgaagaagctgaaggactatgcctttgtgcactttgaggacagaggagctgctgtgaaggccatggatgagatgaatggcaaggagattgaaggagaggagattgagatcgtgctggccaagcccccagacaagaagaggaaggagcggcaggccgcccggcaggccagccgcagcacagcctatgaggactactactaccaccccccacccaggatgcccccacccatccggggccggggccggggcggcggccggggcggctacggctaccccccagactactacggctatgaggactactatgatgactactacggctatgactaccatgactaccggggcggctatgaggacccctactacggctatgatgatggctatgctgtgcggggccggggcggcggccggggcggccgcggggcccctcctccaccccggggccgcggggcccccccaccccggggccgggccggctacagccagagaggagcccccctgggccccccccggggcagccggggcggccggggcggccctgcccagcagcagaggggccggggcagccggggcagccggggcaacagaggaggaaatgtgggcggcaagaggaaggcagatggctacaaccagcctgacagcaagaggcggcagaccaacaaccagcagaactggggcagccagcccatcgcccagcagcccctgcagcagggcggggactacagcggcaactacggctacaacaatgacaaccaggagttctaccaggacacctacggccagcagtggaagtag

SEQ ID NO: 155203 - DNA, 2304 bp, Artificial Sequence
  Description of Artificial Sequence: Synthetic coding sequence
atgaggtcctgggccttctcctacctggatgccatggacaacatcacccggcagaaccagttctatgacacccaggtgatcaagcaggagaatgaaagtggctatgaaagaagacccctggagatggagcagcagcaggcctacagacctgagatgaagacagagatgaagcagggcgcccccaccagcttcctgcccccagaggccagccagctgaagccagaccggcagcagttccagagcaggaagaggccctatgaggagaacagaggccggggctactttgagcacagagaagatagaagaggccgcagcccccagcccccagctgaggaggatgaagatgactttgatgacaccctggtggccatcgacacctacaactgtgacctgcacttcaaggtggcccgggacaggagcagcggctaccccctgaccatcgagggctttgcctacctgtggagcggggcccgggccagctatggagtgcggcggggccgggtgtgctttgagatgaagatcaatgaggagatctctgtgaagcacctgcccagcacagagccagacccccacgtggtgagaattggctggagcctggacagctgcagcacccagctgggggaggagcccttctcctatggctatggaggcaccgggaagaagagcaccaacagcagatttgagaactacggggacaagtttgctgaaaatgatgtgattggctgctttgctgactttgaatgtggaaatgatgtggagctgtccttcaccaagaatggcaagtggatgggcatcgccttccgcatccagaaggaggccctgggcggccaggccctgtacccccacgtgctggtgaagaactgtgctgtggagttcaactttggccagagagctgagccctactgcagcgtgctgcccggcttcaccttcatccagcacctgcccctgtctgagcgcatccggggcaccgtgggccccaagagcaaggcagaatgtgagatcctgatgatggtgggcctgcctgctgctgggaagaccacctgggccatcaagcatgctgccagcaaccccagcaagaagtacaacatcctgggcaccaatgccatcatggacaagatgagggtgatgggcctgcggcggcagaggaactatgccggccgctgggatgtgctgatccagcaggccacccagtgcctgaacagactcatccagattgctgccaggaagaagaggaactacatcctggaccagaccaacgtgtatggcagcgcccagaggaggaagatgaggccctttgagggcttccagaggaaggccatcgtcatctgccccacagatgaggacctgaaggacaggaccatcaagaggacagatgaggagggcaaggatgtgcctgaccatgctgtgctggagatgaaggccaacttcaccctgcctgatgtgggggacttcctggatgaggtgctcttcatcgagctgcagcgggaggaggccgacaagctggtgcggcagtacaatgaggagggcaggaaggccggccccccacctgagaagagatttgacaacagaggaggcggcggcttccggggccggggcggcggcggcggcttccagagatatgaaaatagaggccccccaggcggcaacagaggaggcttccagaacagaggaggcggcagcggcggcggcggcaactaccggggcggcttcaacagaagtggcggcggcggctacagccagaaccgctggggcaacaacaacagagacaacaacaacagcaacaacagaggcagctacaacagagccccccagcagcagcccccaccccagcagcccccaccaccccagcccccaccccagcagcccccacctcctccttcctacagccctgccaggaaccccccaggggccagcacctacaacaagaacagcaacatccctggcagcagcgccaacaccagcacccccaccgtgagcagctacagccccccccagcccagctacagccagcccccctacaaccagggcggctacagccagggctacacagcccctcctcctcctcctcctcctcctccagcctacaactacggcagctatggaggctacaacccagccccctacaccccacctcctccacccacagcccagacctacccccagcccagctacaaccagtaccagcagtatgcccagcagtggaaccagtactaccagaaccagggccagtggccaccctactacggcaactatgactatggcagctacagcggcaacacccagggcggcaccagcacccagtag

SEQ ID NO: 155204 - DNA, 369 bp, Artificial Sequence
  Description of Artificial Sequence: Synthetic coding sequence
atggatgtgcggcggctgaaggtgaatgagctgcgggaggagctgcagaggcggggcctggacacccggggcctgaaggccgagctggccgagcggctgcaggccgccctggaggccgaggagccagatgatgagcgggagctggatgctgatgatgagcccggccggcccggccacatcaatgaggaggccgagctgcagcctgccaccctgcagcccggccgcctgcagcccggcctgcacagccccacagccagcaccagcaccaccacctgcctgcagctgtgggagctgcggcggctgcagcccggccccctgtaccccacagccaccccccactgcacagacctgcccagcgcccagctgtag

SEQ ID NO: 155205 - DNA, 2271 bp, Artificial Sequence
  Description of Artificial Sequence: Synthetic coding sequence
atggacaacatcacccggcagaaccagttctatgacacccaggtgatcaagcaggagaatgaaagtggctatgaaagaagacccctggagatggagcagcagcaggcctacagacctgagatgaagacagagatgaagcagggcgcccccaccagcttcctgcccccagaggccagccagctgaagccagaccggcagcagttccagagcaggaagaggccctatgaagaaaatagaggccggggctactttgagcaccgggaggaccggcggggccgcagcccccagcccccagcagaagaagatgaagatgactttgatgacaccctggtggccatcgacacctacaactgtgacctgcacttcaaggtggcccgggacaggagcagcggctaccccctgaccatcgagggctttgcctacctgtggagcggggcccgggccagctatggagtgagaagaggccgggtgtgctttgagatgaagatcaatgaggagatctctgtgaagcacctgcccagcacagagccagacccccacgtggtgcgcatcggctggagcctggacagctgcagcacccagctgggggaggagcccttctcctatggctacggcggcaccgggaagaagagcaccaacagcagatttgaaaattatggagacaagtttgctgaaaatgatgtgattggctgctttgctgactttgaatgtggaaatgatgtggagctgtccttcaccaagaatggcaagtggatgggcatcgccttccgcatccagaaggaggccctgggcggccaggccctgtacccccacgtgctggtgaagaactgtgctgtggagttcaactttggccagagagctgagccctactgcagcgtgctgcccggcttcaccttcatccagcacctgcccctgtctgagcgcatccggggcaccgtgggccccaagagcaaggccgagtgtgagatcctgatgatggtgggcctgcctgctgctgggaagaccacctgggccatcaagcacgccgccagcaaccccagcaagaagtacaacatcctgggcaccaatgccatcatggacaagatgagggtgatgggcctgcggcggcagagaaattatgccggccgctgggatgtgctgatccagcaggccacccagtgcctgaacagactcatccagattgctgccaggaagaagaggaactacatcctggaccagaccaacgtgtatggcagcgcccagaggaggaagatgaggccctttgagggcttccagaggaaggccatcgtcatctgccccacagatgaggacctgaaggacaggaccatcaagaggacagatgaggagggcaaggatgtgcctgaccatgctgtgctggagatgaaggccaacttcaccctgcctgatgtgggggacttcctggatgaggtgctcttcatcgagctgcagcgggaggaggccgacaagctggtgcggcagtacaatgaggagggcaggaaggccggccccccacctgagaagagatttgacaacagaggaggcggcggcttccggggccggggcggcggcggcggcttccagagatatgagaacagaggccccccaggcggcaacagaggaggcttccagaacagaggaggcggcagcggcggcggcggcaactacagaggaggcttcaacagaagtggcggcggcggctacagccagaaccgctggggcaacaacaacagagacaacaacaacagcaacaacagaggcagctacaacagagccccccagcagcagcccccaccccagcagcccccaccaccccagcccccaccccagcagcccccacctccacccagctacagccctgccagaaatcctcctggggccagcacctacaacaagaacagcaacatccctggcagcagcgccaacaccagcacccccaccgtgtcctcctacagccccccccagcccagctacagccagcccccctacaaccagggcggctacagccagggctacacagcccctcctcctcctcctcctcctcctccagcctacaactacggcagctatggaggctacaacccagccccctacaccccacctcctccacccacagcccagacctacccccagcccagctacaaccagtaccagcagtatgcccagcagtggaaccagtactaccagaaccagggccagtggccaccctactacggcaactatgactatggcagctacagcggcaacacccagggcggcaccagcacccagtag

SEQ ID NO: 155206 - DNA, 2259 bp, Artificial Sequence
  Description of Artificial Sequence: Synthetic coding sequence
atggatgtgcggcggctgaaggtgaatgagctgcgggaggagctgcagaggcggggcctggacacccggggcctgaaggccgagctggccgagcggctgcagcccccacctcctggcctgcagccccacgccgagcccggcggctacagcggcccagatggccactacgccatggacaacatcacccggcagaaccagttctatgacacccaggtgatcaagcaggagaatgaaagtggctatgaaagaagacccctggagatggagcagcagcaggcctacagacctgagatgaagacagagatgaagcagggcgcccccaccagcttcctgcccccagaggccagccagctgaagccagaccggcagcagttccagagcaggaagaggccctatgaggagaacagaggccggggctactttgagcacagagaagatagaagaggccgcagcccccagcccccagctgaggaggatgaagatgactttgatgacaccctggtggccatcgacacctacaactgtgacctgcacttcaaggtggcccgggacaggagcagcggctaccccctgaccatcgagggctttgcctacctgtggagcggggcccgggccagctatggagtgcggcggggccgggtgtgctttgagatgaaggactttgaatgtggaaatgatgtggagctgtccttcaccaagaatggcaagtggatgggcatcgccttccgcatccagaaggaggccctgggcggccaggccctgtacccccacgtgctggtgaagaactgtgctgtggagttcaactttggccagagagctgagccctactgcagcgtgctgcccggcttcaccttcatccagcacctgcccctgtctgagcgcatccggggcaccgtgggccccaagagcaaggccgagtgtgagatcctgatgatggtgggcctgcctgctgctgggaagaccacctgggccatcaagcacgccgccagcaaccccagcaagaagtacaacatcctgggcaccaatgccatcatggacaagatgagggtgatgggcctgcggcggcagagaaattatgccggccgctgggatgtgctgatccagcaggccacccagtgcctgaacagactcatccagattgctgccaggaagaagaggaactacatcctggaccagaccaacgtgtatggcagcgcccagaggaggaagatgaggccctttgagggcttccagaggaaggccatcgtcatctgccccacagatgaggacctgaaggacaggaccatcaagaggacagatgaggagggcaaggatgtgcctgaccatgctgtgctggagatgaaggccaacttcaccctgcctgatgtgggggacttcctggatgaggtgctcttcatcgagctgcagcgggaggaggccgacaagctggtgcggcagtacaatgaggagggcaggaaggccggccccccacctgagaagagatttgacaacagaggaggcggcggcttccggggccggggcggcggcggcggcttccagagatatgagaacagaggccccccaggcggcaacagaggaggcttccagaacagaggaggcggcagcggcggcggcggcaactacagaggaggcttcaacagaagtggcggcggcggctacagccagaaccgctggggcaacaacaacagagacaacaacaacagcaacaacagaggcagctacaacagagccccccagcagcagcccccaccccagcagcccccaccaccccagcccccaccccagcagcccccacctccacccagctacagccctgccagaaatcctcctggggccagcacctacaacaagaacagcaacatccctggcagcagcgccaacaccagcacccccaccgtgtcctcctacagccccccccagagctttggcttcttccccagcaccttccagcccagctacagccagcccccctacaaccagggcggctacagccagggctacacagcccctcctcctcctcctcctcctcctccagcctacaactacggcagctatggaggctacaacccagccccctacaccccacctcctccacccacagcccagacctacccccagcccagctacaaccagtaccagcagtatgcccagcagtggaaccagtactaccagaaccagggccagtggccaccctactacggcaactatgactatggcagctacagcggcaacacccagggcggcaccagcacccagtag

SEQ ID NO: 155207 - DNA, 2571 bp, Artificial Sequence
  Description of Artificial Sequence: Synthetic coding sequence
atggatgtgcggcggctgaaggtgaatgagctgcgggaggagctgcagaggcggggcctggacacccggggcctgaaggccgagctggccgagcggctgcaggccgccctggaggccgaggagccagatgatgagcgggagctggatgctgatgatgagcccggccggcccggccacatcaatgaggaggtggagacagagggcggcagcgagctggagggcacagcccagcccccacctcctggcctgcagccccatgctgagcccggcggctacagcggcccagatggccactacgccatggacaacatcacccggcagaaccagttctatgacacccaggtgatcaagcaggagaatgaaagtggctatgaaagaagacccctggagatggagcagcagcaggcctacagacctgagatgaagacagagatgaagcagggcgcccccaccagcttcctgcccccagaggccagccagctgaagccagaccggcagcagttccagagcaggaagaggccctatgaagaaaatagaggccggggctactttgagcaccgggaggaccggcggggccgcagcccccagcccccagcagaagaagatgaagatgactttgatgacaccctggtggccatcgacacctacaactgtgacctgcacttcaaggtggcccgggacaggagcagcggctaccccctgaccatcgagggctttgcctacctgtggagcggggcccgggccagctatggagtgagaagaggccgggtgtgctttgagatgaagatcaatgaggagatctctgtgaagcacctgcccagcacagagccagacccccacgtggtgcgcatcggctggagcctggacagctgcagcacccagctgggggaggagcccttctcctatggctacggcggcaccgggaagaagagcaccaacagcagatttgaaaattatggagacaagtttgctgaaaatgatgtgattggctgctttgctgactttgaatgtggaaatgatgtggagctgtccttcaccaagaatggcaagtggatgggcatcgccttccgcatccagaaggaggccctgggcggccaggccctgtacccccacgtgctggtgaagaactgtgctgtggagttcaactttggccagagagctgagccctactgcagcgtgctgcccggcttcaccttcatccagcacctgcccctgtctgagcgcatccggggcaccgtgggccccaagagcaaggccgagtgtgagatcctgatgatggtgggcctgcctgctgctgggaagaccacctgggccatcaagcacgccgccagcaaccccagcaagaagtacaacatcctgggcaccaatgccatcatggacaagatgagggtgatgggcctgcggcggcagagaaattatgccggccgctgggatgtgctgatccagcaggccacccagtgcctgaacagactcatccagattgctgccaggaagaagaggaactacatcctggaccagaccaacgtgtatggcagcgcccagaggaggaagatgaggccctttgagggcttccagaggaaggccatcgtcatctgccccacagatgaggacctgaaggacaggaccatcaagaggacagatgaggagggcaaggatgtgcctgaccatgctgtgctggagatgaaggccaacttcaccctgcctgatgtgggggacttcctggatgaggtgctcttcatcgagctgcagcgggaggaggccgacaagctggtgcggcagtacaatgaggagggcaggaaggccggccccccacctgagaagagatttgacaacagaggaggcggcggcttccggggccggggcggcggcggcggcttccagagatatgagaacagaggccccccaggcggcaacagaggaggcttccagaacagaggaggcggcagcggcggcggcggcaactacagaggaggcttcaacagaagtggcggcggcggctacagccagaaccgctggggcaacaacaacagagacaacaacaacagcaacaacagaggcagctacaacagagccccccagcagcagcccccaccccagcagcccccaccaccccagcccccaccccagcagcccccacctccacccagctacagccctgccagaaatcctcctggggccagcacctacaacaagaacagcaacatccctggcagcagcgccaacaccagcacccccaccgtgtcctcctacagccccccccagcccagctacagccagcccccctacaaccagggcggctacagccagggctacacagcccctcctcctcctcctcctcctcctccagcctacaactacggcagctatggaggctacaacccagccccctacaccccacctcctccacccacagcccagacctacccccagcccagctacaaccagtaccagcagtatgcccagcagtggaaccagtactaccagaaccagggccagtggccaccctactacggcaactatgactatggcagctacagcggcaacacccagggcggcaccagcacccagtag

SEQ ID NO: 155208 - DNA, 2751 bp, Artificial Sequence
  Description of Artificial Sequence: Synthetic coding sequence
atggactgtgagcacagcctgagcctgccctgccgcggggctgaggcctgggagattggaattgacaagtacctgtatgccatgaggctgagtgatgagaccctgattgacatcatgacccgcttcaggaaggagatgaagaatggcctgagccgggacttcaaccccacagccaccgtgaagatgctgcccacctttgtgcgcagcatcccagatggcagcgagaagggggacttcatcgccctggacctgggcggcagcagcttccgcatcctgcgggtgcaggtgaaccacgagaagaaccagaatgtgcacatggagagcgaggtgtatgacaccccagaaaatattgtgcacggcagcggcagccagctgtttgaccacgtggctgaatgtctgggggacttcatggagaagaggaagatcaaggacaagaagctgcctgtgggcttcaccttctccttcccctgccagcagagcaagattgatgaggccatcctgatcacctggaccaagcgcttcaaggccagcggcgtggagggcgcagatgtggtgaagctgctgaacaaggccatcaagaagagaggagactatgatgccaacatcgtggccgtggtgaatgacacagtgggcaccatgatgacctgtggctatgatgaccagcactgtgaggtgggcctcatcattggaacaggcaccaatgcctgctacatggaggagctgcggcacatcgacctggtggagggagatgagggccgcatgtgcatcaacacagagtggggcgcctttggagatgatggcagcctggaggacatcagaacagaatttgaccgggagattgaccggggcagcctgaaccctgggaagcagctgtttgagaagatggtgtctggcatgtacctgggggagctggtgcggctcatcctggtgaagatggccaaggagggcctgctgtttgagggccgcatcaccccagagctgctgacccggggcaagttcaacaccagtgatgtgtctgccatcgagaagaacaaggagggcctgcacaatgccaaggagatcctgacccggctgggcgtggagcccagtgatgatgactgtgtgtctgtgcagcacgtgtgcaccatcgtgtccttccgcagcgccaacctggtggccgccaccctgggcgccatcctgaaccggctgcgggacaacaagggcaccccccggctgcggaccaccgtgggcgtggatggcagcctgtacaagacccacccccagtacagccgccgcttccacaagaccctgcggcggctggtgcctgacagtgatgtgcgcttcctgctgtctgagagcggcagcggcaagggggccgccatggtgacagctgtggcctaccgcctggccgagcagcaccggcagatcgaggagaccctggcccacttccacctgaccaaggacatgctgctggaggtgaagaagaggatgagagctgagatggagctgggcctgaggaagcagacccacaacaatgctgtggtgaagatgctgcccagctttgtgcggaggaccccagatggaacagaaaatggagacttcctggccctggacctgggcggcaccaacttccgggtgctgctggtgaagatccgcagcggcaagaagaggacagtggagatgcacaacaagatctatgccatccccatcgagatcatgcagggcactggagaggagctgtttgaccacatcgtgtcctgcatcagtgacttcctggactacatgggcatcaagggccccaggatgcccctgggcttcaccttctccttcccctgccagcagaccagcctggatgctggcatcctgatcacctggaccaagggcttcaaggccacagactgtgtgggccatgatgtggtgaccctgctgagagatgccatcaagaggcgggaggagtttgacctggatgtggtggccgtggtgaatgacacagtgggcaccatgatgacctgtgcctatgaggagcccacctgtgaggtgggcctcatcgtgggcaccggcagcaatgcctgctacatggaggagatgaagaatgtggagatggtggagggggaccagggccagatgtgcatcaacatggagtggggcgcctttggagacaatggctgcctggatgacatccgcacccactatgaccggctggtggatgagtacagcctgaatgccggcaagcagagatatgagaagatgatcagcggcatgtacctgggggagatcgtgaggaacatcctgattgacttcaccaagaagggcttcctgttccggggccagatcagcgagaccctgaagacccggggcatctttgagaccaagttcctgagccagattgaaagtgaccggctggccctgctgcaggtgcgggccatcctgcagcagctgggcctgaacagcacctgtgatgacagcatcctggtgaagacagtgtgtggggtggtgtccagaagagctgcccagctgtgtggggccggcatggctgctgtggtggacaagatccgggagaacagaggcctggaccggctgaatgtgacagtgggcgtggatggcaccctgtacaagctgcacccccacttcagccgcatcatgcaccagacagtgaaggagctgagccccaagtgcaatgtgtccttcctgctgtctgaagatggcagcggcaagggggccgccctgatcacagctgtgggcgtgcggctgaggacagaggccagcagctag

SEQ ID NO: 155209 - DNA, 2754 bp, Artificial Sequence
  Description of Artificial Sequence: Synthetic coding sequence
atgattgctgcccagctgctggcctactacttcacagagctgaaggatgaccaggtgaagaagattgacaagtacctgtatgccatgaggctgagtgatgagaccctgattgacatcatgacccgcttcaggaaggagatgaagaatggcctgagccgggacttcaaccccacagccaccgtgaagatgctgcccacctttgtgcgcagcatcccagatggcagcgagaagggggacttcatcgccctggacctgggcggcagcagcttccgcatcctgcgggtgcaggtgaaccacgagaagaaccagaatgtgcacatggagagcgaggtgtatgacaccccagagaacatcgtgcacggcagcggcagccagctgtttgaccacgtggccgagtgcctgggggacttcatggagaagaggaagatcaaggacaagaagctgcctgtgggcttcaccttctccttcccctgccagcagagcaagattgatgaggccatcctgatcacctggaccaagcgcttcaaggccagcggcgtggagggcgcagatgtggtgaagctgctgaacaaggccatcaagaagagaggagactatgatgccaacatcgtggccgtggtgaatgacacagtgggcaccatgatgacctgtggctatgatgaccagcactgtgaggtgggcctcatcatcggcaccggcaccaatgcctgctacatggaggagctgcggcacatcgacctggtggagggagatgagggccgcatgtgcatcaacacagagtggggcgcctttggagatgatggcagcctggaggacatcagaacagaatttgaccgggagattgaccggggcagcctgaaccctgggaagcagctgtttgagaagatggtgtctggcatgtacctgggggagctggtgcggctcatcctggtgaagatggccaaggagggcctgctgtttgagggccgcatcaccccagagctgctgacccggggcaagttcaacaccagtgatgtgtctgccatcgagaagaacaaggagggcctgcacaatgccaaggagatcctgacccggctgggcgtggagcccagtgatgatgactgtgtgtctgtgcagcacgtgtgcaccatcgtgtccttccgcagcgccaacctggtggccgccaccctgggcgccatcctgaaccggctgcgggacaacaagggcaccccccggctgcggaccaccgtgggcgtggatggcagcctgtacaagacccacccccagtacagccgccgcttccacaagaccctgcggcggctggtgcctgacagtgatgtgcgcttcctgctgtctgagagcggcagcgggaaaggagctgccatggtgacagctgtggcctaccgcctggccgagcagcaccggcagatcgaggagaccctggcccacttccacctgaccaaggacatgctgctggaggtgaagaagaggatgagagctgagatggagctgggcctgaggaagcagacccacaacaatgctgtggtgaagatgctgcccagctttgtgcggaggaccccagatggaacagaaaatggagacttcctggccctggacctgggcggcaccaacttccgggtgctgctggtgaagatccgcagcggcaagaagaggacagtggagatgcacaacaagatctatgccatccccatcgagatcatgcagggcaccggggaggagctgtttgaccacatcgtgtcctgcatcagtgacttcctggactacatgggcatcaagggccccaggatgcccctgggcttcaccttctccttcccctgccagcagaccagcctggatgctggcatcctgatcacctggaccaagggcttcaaggccacagactgtgtgggccatgatgtggtgaccctgctgagagatgccatcaagagaagagaggagtttgacctggatgtggtggccgtggtgaatgacacagtgggcaccatgatgacctgtgcctatgaggagcccacctgtgaggtgggcctgattgtgggcaccggcagcaatgcctgctacatggaggagatgaagaatgtggagatggtggagggggaccagggccagatgtgcatcaacatggagtggggcgccttcggggacaatggctgcctggatgacatccgcacccactatgaccggctggtggatgagtacagcctgaatgctgggaagcagagatatgagaagatgatcagcggcatgtacctgggggagatcgtgaggaacatcctgattgacttcaccaagaagggcttcctgttccggggccagatcagcgagaccctgaagacccggggcatctttgagaccaagttcctgagccagatcgagagtgaccggctggccctgctgcaggtgcgggccatcctgcagcagctgggcctgaacagcacctgtgatgacagcatcctggtgaagacagtgtgtggggtggtgtcccggcgggccgcccagctgtgtggggccggcatggctgctgtggtggacaagatcagagaaaatagaggcctggaccggctgaatgtgacagtgggcgtggatggcaccctgtacaagctgcacccccacttcagccgcatcatgcaccagacagtgaaggagctgagccccaagtgcaatgtgtccttcctgctgtctgaagatggcagcgggaaaggagctgccctgatcacagctgtgggcgtgcggctgaggacagaggccagcagctag

SEQ ID NO: 155210 - DNA, 2718 bp, Artificial Sequence
  Description of Artificial Sequence: Synthetic coding sequence
atggccaagagggccctgcatgacttcatcgacaagtacctgtatgccatgaggctgagtgatgagaccctgattgacatcatgacccgcttcaggaaggagatgaagaatggcctgagccgggacttcaaccccacagccaccgtgaagatgctgcccacctttgtgcgcagcatcccagatggcagcgagaagggggacttcatcgccctggacctgggcggcagcagcttccgcatcctgcgggtgcaggtgaaccacgagaagaaccagaatgtgcacatggagagcgaggtgtatgacaccccagagaacatcgtgcacggcagcggcagccagctgtttgaccacgtggccgagtgcctgggggacttcatggagaagaggaagatcaaggacaagaagctgcctgtgggcttcaccttctccttcccctgccagcagagcaagattgatgaggccatcctgatcacctggaccaagcgcttcaaggccagcggcgtggagggcgcagatgtggtgaagctgctgaacaaggccatcaagaagagaggagactatgatgccaacatcgtggccgtggtgaatgacacagtgggcaccatgatgacctgtggctatgatgaccagcactgtgaggtgggcctcatcatcggcaccggcaccaatgcctgctacatggaggagctgcggcacatcgacctggtggagggagatgagggccgcatgtgcatcaacacagagtggggcgcctttggagatgatggcagcctggaggacatcagaacagaatttgaccgggagattgaccggggcagcctgaaccctgggaagcagctgtttgagaagatggtgtctggcatgtacctgggggagctggtgcggctcatcctggtgaagatggccaaggagggcctgctgtttgagggccgcatcaccccagagctgctgacccggggcaagttcaacaccagtgatgtgtctgccatcgagaagaacaaggagggcctgcacaatgccaaggagatcctgacccggctgggcgtggagcccagtgatgatgactgtgtgtctgtgcagcacgtgtgcaccatcgtgtccttccgcagcgccaacctggtggccgccaccctgggcgccatcctgaaccggctgcgggacaacaagggcaccccccggctgcggaccaccgtgggcgtggatggcagcctgtacaagacccacccccagtacagccgccgcttccacaagaccctgcggcggctggtgcctgacagtgatgtgcgcttcctgctgtctgagagcggcagcgggaaaggagctgccatggtgacagctgtggcctaccgcctggccgagcagcaccggcagatcgaggagaccctggcccacttccacctgaccaaggacatgctgctggaggtgaagaagaggatgagagctgagatggagctgggcctgaggaagcagacccacaacaatgctgtggtgaagatgctgcccagctttgtgcggaggaccccagatggaacagaaaatggagacttcctggccctggacctgggcggcaccaacttccgggtgctgctggtgaagatccgcagcggcaagaagaggacagtggagatgcacaacaagatctatgccatccccatcgagatcatgcagggcaccggggaggagctgtttgaccacatcgtgtcctgcatcagtgacttcctggactacatgggcatcaagggccccaggatgcccctgggcttcaccttctccttcccctgccagcagaccagcctggatgctggcatcctgatcacctggaccaagggcttcaaggccacagactgtgtgggccatgatgtggtgaccctgctgagagatgccatcaagagaagagaggagtttgacctggatgtggtggccgtggtgaatgacacagtgggcaccatgatgacctgtgcctatgaggagcccacctgtgaggtgggcctgattgtgggcaccggcagcaatgcctgctacatggaggagatgaagaatgtggagatggtggagggggaccagggccagatgtgcatcaacatggagtggggcgccttcggggacaatggctgcctggatgacatccgcacccactatgaccggctggtggatgagtacagcctgaatgctgggaagcagagatatgagaagatgatcagcggcatgtacctgggggagatcgtgaggaacatcctgattgacttcaccaagaagggcttcctgttccggggccagatcagcgagaccctgaagacccggggcatctttgagaccaagttcctgagccagatcgagagtgaccggctggccctgctgcaggtgcgggccatcctgcagcagctgggcctgaacagcacctgtgatgacagcatcctggtgaagacagtgtgtggggtggtgtcccggcgggccgcccagctgtgtggggccggcatggctgctgtggtggacaagatcagagaaaatagaggcctggaccggctgaatgtgacagtgggcgtggatggcaccctgtacaagctgcacccccacttcagccgcatcatgcaccagacagtgaaggagctgagccccaagtgcaatgtgtccttcctgctgtctgaagatggcagcgggaaaggagctgccctgatcacagctgtgggcgtgcggctgaggacagaggccagcagctag

SEQ ID NO: 155211 - DNA, 2766 bp, Artificial Sequence
  Description of Artificial Sequence: Synthetic coding sequence
atgggccagatctgccagcgggagagcgccacagctgctgagaagcccaagctgcacctgctggccgagagcgagattgacaagtacctgtatgccatgaggctgagtgatgagaccctgattgacatcatgacccgcttcaggaaggagatgaagaatggcctgagccgggacttcaaccccacagccaccgtgaagatgctgcccacctttgtgcgcagcatcccagatggcagcgagaagggggacttcatcgccctggacctgggcggcagcagcttccgcatcctgcgggtgcaggtgaaccacgagaagaaccagaatgtgcacatggagagcgaggtgtatgacaccccagagaacatcgtgcacggcagcggcagccagctgtttgaccacgtggccgagtgcctgggggacttcatggagaagaggaagatcaaggacaagaagctgcctgtgggcttcaccttctccttcccctgccagcagagcaagattgatgaggccatcctgatcacctggaccaagcgcttcaaggccagcggcgtggagggcgcagatgtggtgaagctgctgaacaaggccatcaagaagagaggagactatgatgccaacatcgtggccgtggtgaatgacacagtgggcaccatgatgacctgtggctatgatgaccagcactgtgaggtgggcctcatcatcggcaccggcaccaatgcctgctacatggaggagctgcggcacatcgacctggtggagggagatgagggccgcatgtgcatcaacacagagtggggcgcctttggagatgatggcagcctggaggacatcagaacagaatttgaccgggagattgaccggggcagcctgaaccctgggaagcagctgtttgagaagatggtgtctggcatgtacctgggggagctggtgcggctcatcctggtgaagatggccaaggagggcctgctgtttgagggccgcatcaccccagagctgctgacccggggcaagttcaacaccagtgatgtgtctgccatcgagaagaacaaggagggcctgcacaatgccaaggagatcctgacccggctgggcgtggagcccagtgatgatgactgtgtgtctgtgcagcacgtgtgcaccatcgtgtccttccgcagcgccaacctggtggccgccaccctgggcgccatcctgaaccggctgcgggacaacaagggcaccccccggctgcggaccaccgtgggcgtggatggcagcctgtacaagacccacccccagtacagccgccgcttccacaagaccctgcggcggctggtgcctgacagtgatgtgcgcttcctgctgtctgagagcggcagcgggaaaggagctgccatggtgacagctgtggcctaccgcctggccgagcagcaccggcagatcgaggagaccctggcccacttccacctgaccaaggacatgctgctggaggtgaagaagaggatgagagctgagatggagctgggcctgaggaagcagacccacaacaatgctgtggtgaagatgctgcccagctttgtgcggaggaccccagatggaacagaaaatggagacttcctggccctggacctgggcggcaccaacttccgggtgctgctggtgaagatccgcagcggcaagaagaggacagtggagatgcacaacaagatctatgccatccccatcgagatcatgcagggcaccggggaggagctgtttgaccacatcgtgtcctgcatcagtgacttcctggactacatgggcatcaagggccccaggatgcccctgggcttcaccttctccttcccctgccagcagaccagcctggatgctggcatcctgatcacctggaccaagggcttcaaggccacagactgtgtgggccatgatgtggtgaccctgctgagagatgccatcaagagaagagaggagtttgacctggatgtggtggccgtggtgaatgacacagtgggcaccatgatgacctgtgcctatgaggagcccacctgtgaggtgggcctgattgtgggcaccggcagcaatgcctgctacatggaggagatgaagaatgtggagatggtggagggggaccagggccagatgtgcatcaacatggagtggggcgccttcggggacaatggctgcctggatgacatccgcacccactatgaccggctggtggatgagtacagcctgaatgctgggaagcagagatatgagaagatgatcagcggcatgtacctgggggagatcgtgaggaacatcctgattgacttcaccaagaagggcttcctgttccggggccagatcagcgagaccctgaagacccggggcatctttgagaccaagttcctgagccagatcgagagtgaccggctggccctgctgcaggtgcgggccatcctgcagcagctgggcctgaacagcacctgtgatgacagcatcctggtgaagacagtgtgtggggtggtgtcccggcgggccgcccagctgtgtggggccggcatggctgctgtggtggacaagatcagagaaaatagaggcctggaccggctgaatgtgacagtgggcgtggatggcaccctgtacaagctgcacccccacttcagccgcatcatgcaccagacagtgaaggagctgagccccaagtgcaatgtgtccttcctgctgtctgaagatggcagcgggaaaggagctgccctgatcacagctgtgggcgtgcggctgaggacagaggccagcagctag

SEQ ID NO: 155212 - DNA, 2748 bp, Artificial Sequence
  Description of Artificial Sequence: Synthetic coding sequence
atgattgctgcccagctgctggcctactacttcacagagctgaaggatgaccaggtgaagaagattgacaagtacctgtatgccatgaggctgagtgatgagaccctgattgacatcatgacccgcttcaggaaggagatgaagaatggcctgagccgggacttcaaccccacagccaccgtgaagatgctgcccacctttgtgcgcagcatcccagatggcagcgagaagggggacttcatcgccctggacctgggcggcagcagcttccgcatcctgcgggtgcaggtgaaccacgagaagaaccagaatgtgcacatggagagcgaggtgtatgacaccccagagaacatcgtgcacggcagcggcagccagctgtttgaccacgtggccgagtgcctgggggacttcatggagaagaggaagatcaaggacaagaagctgcctgtgggcttcaccttctccttcccctgccagcagagcaagattgatgaggccatcctgatcacctggaccaagcgcttcaaggccagcggcgtggagggcgcagatgtggtgaagctgctgaacaaggccatcaagaagagaggagactatgatgccaacatcgtggccgtggtgaatgacacagtgggcaccatgatgacctgtggctatgatgaccagcactgtgaggtgggcctcatcatcggcaccggcaccaatgcctgctacatggaggagctgcggcacatcgacctggtggagggagatgagggccgcatgtgcatcaacacagagtggggcgcctttggagatgatggcagcctggaggacatcagaacagaatttgaccgggagattgaccggggcagcctgaaccctgggaagcagctgtttgagaagatggtgtctggcatgtacctgggggagctggtgcggctcatcctggtgaagatggccaaggagggcctgctgtttgagggccgcatcaccccagagctgctgacccggggcaagttcaacaccagtgatgtgtctgccatcgagaagaacaaggagggcctgcacaatgccaaggagatcctgacccggctgggcgtggagcccagtgatgatgactgtgtgtctgtgcagcacgtgtgcaccatcgtgtccttccgcagcgccaacctggtggccgccaccctgggcgccatcctgaaccggctgcgggacaacaagggcaccccccggctgcggaccaccgtgggcgtggatggcagcctgtacaagacccacccccagtacagccgccgcttccacaagaccctgcggcggctggtgcctgacagtgatgtgcgcttcctgctgtctgagagcggcagcgggaaaggagctgccatggtgacagctgtggcctaccgcctggccgagcagcaccggcagatcgaggagaccctggcccacttccacctgaccaaggacatgctgctggaggtgaagaagaggatgagagctgagatggagctgggcctgaggaagcagacccacaacaatgctgtggtgaagatgctgcccagctttgtgcggaggaccccagatggaacagaaaatggagacttcctggccctggacctgggcggcaccaacttccgggtgctgctggtgaagatccgcagcggcaagaagaggacagtggagatgcacaacaagatctatgccatccccatcgagatcatgcagggcaccggggaggagctgtttgaccacatcgtgtcctgcatcagtgacttcctggactacatgggcatcaagggccccaggatgcccctgggcttcaccttctccttcccctgccagcagaccagcctggatgctggcatcctgatcacctggaccaagggcttcaaggccacagactgtgtgggccatgatgtggtgaccctgctgagagatgccatcaagagaagagaggagtttgacctggatgtggtggccgtggtgaatgacacagtgggcaccatgatgacctgtgcctatgaggagcccacctgtgaggtgggcctgattgtgggcaccggcagcaatgcctgctacatggaggagatgaagaatgtggagatggtggagggggaccagggccagatgtgcatcaacatggagtggggcgccttcggggacaatggctgcctggatgacatccgcacccactatgaccggctggtggatgagtacagcctgaatgctgggaagcagagatatgagaagatgatcagcggcatgtacctgggggagatcgtgaggaacatcctgattgacttcaccaagaagggcttcctgttccggggccagatcagcgagaccctgaagacccggggcatctttgagaccaagttcctgagccagatcgagagtgaccggctggccctgctgcaggtgcgggccatcctgcagcagctgggcctgaacagcacctgtgatgacagcatcctggtgaagacagtgtgtggggtggtgtcccggcgggccgcccagctgtgtggggccggcatggctgctgtggtggacaagatcagagaaaatagaggcctggaccggctgaatgtgacagtgggcgtggatggcaccctgtacaagctgcacccccacttcagccgcatcatgcaccagacagtgaaggagctgagccccaagtgcaatgtgtccttcctgctgtctgaagatggcagcgggaaaggagctgccctgatcacagctgtgggcgtgcggctgaggacagaggcctag

SEQ ID NO: 155213 - DNA, 345 bp, Artificial Sequence
  Description of Artificial Sequence: Synthetic coding sequence
atggccaagagggccctgcatgacttcatcgacaagtacctgtatgccatgaggctgagtgatgagaccctgattgacatcatgacccgcttcaggaaggagatgaagaatggcctgagccgggacttcaaccccacagccaccgtgaagatgctgcccacctttgtgcgcagcatcccagatggcagcgagaagggggacttcatcgccctggacctgggcggcagcagcttccgcatcctgcgggtgcaggtgaaccacgagaagaaccagaatgtgcacatggagagcgaggtgtatgacaccccagagaacatcgtgcacggcagcggcagccagctgtag

SEQ ID NO: 155214 - DNA, 876 bp, Artificial Sequence
  Description of Artificial Sequence: Synthetic coding sequence
atggactgtgagcacagcctgagcctgccctgccgcggggctgaggcctgggagattggaattgacaagtacctgtatgccatgaggctgagtgatgagaccctgattgacatcatgacccgcttcaggaaggagatgaagaatggcctgagccgggacttcaaccccacagccaccgtgaagatgctgcccacctttgtgcgcagcatcccagatggcagcgagaagggggacttcatcgccctggacctgggcggcagcagcttccgcatcctgcgggtgcaggtgaaccacgagaagaaccagaatgtgcacatggagagcgaggtgtatgacaccccagaaaatattgtgcacggcagcggcagccagctgtttgaccacgtggctgaatgtctgggggacttcatggagaagaggaagatcaaggacaagaagctgcctgtgggcttcaccttctccttcccctgccagcagagcaagattgatgaggccatcctgatcacctggaccaagcgcttcaaggccagcggcgtggagggcgcagatgtggtgaagctgctgaacaaggccatcaagaagagaggagactatgatgccaacatcgtggccgtggtgaatgacacagtgggcaccatgatgacctgtggctatgatgaccagcactgtgaggtgggcctcatcattggaacaggcaccaatgcctgctacatggaggagctgcggcacatcgacctggtggagggagatgagggccgcatgtgcatcaacacagagtggggcgcctttggagatgatggcagcctggaggacatcagaacagaatttgaccgggagattgaccggggcagcctgaaccctgggaagcagctgtag

SEQ ID NO: 155215 - DNA, 2859 bp, Artificial Sequence
  Description of Artificial Sequence: Synthetic coding sequence
atgggccagatctgccagcgggagagccggcagggcctggccatgctgcccaggctcttcctgaacccctggaggcaggtgatcctgctgccccagccccccaaggtgctgggcctgcaggccacagctgctgagaagcccaagctgcacctgctggccgagagcgagattgacaagtacctgtatgccatgaggctgagtgatgagaccctgattgacatcatgacccgcttcaggaaggagatgaagaatggcctgagccgggacttcaaccccacagccaccgtgaagatgctgcccacctttgtgcgcagcatcccagatggcagcgagaagggggacttcatcgccctggacctgggcggcagcagcttccgcatcctgcgggtgcaggtgaaccacgagaagaaccagaatgtgcacatggagagcgaggtgtatgacaccccagaaaatattgtgcacggcagcggcagccagctgtttgaccacgtggctgaatgtctgggggacttcatggagaagaggaagatcaaggacaagaagctgcctgtgggcttcaccttctccttcccctgccagcagagcaagattgatgaggccatcctgatcacctggaccaagcgcttcaaggccagcggcgtggagggcgcagatgtggtgaagctgctgaacaaggccatcaagaagagaggagactatgatgccaacatcgtggccgtggtgaatgacacagtgggcaccatgatgacctgtggctatgatgaccagcactgtgaggtgggcctcatcattggaacaggcaccaatgcctgctacatggaggagctgcggcacatcgacctggtggagggagatgagggccgcatgtgcatcaacacagagtggggcgcctttggagatgatggcagcctggaggacatcagaacagaatttgaccgggagattgaccggggcagcctgaaccctgggaagcagctgtttgagaagatggtgtctggcatgtacctgggggagctggtgcggctcatcctggtgaagatggccaaggagggcctgctgtttgagggccgcatcaccccagagctgctgacccggggcaagttcaacaccagtgatgtgtctgccatcgagaagaacaaggagggcctgcacaatgccaaggagatcctgacccggctgggcgtggagcccagtgatgatgactgtgtgtctgtgcagcacgtgtgcaccatcgtgtccttccgcagcgccaacctggtggccgccaccctgggcgccatcctgaaccggctgcgggacaacaagggcaccccccggctgcggaccaccgtgggcgtggatggcagcctgtacaagacccacccccagtacagccgccgcttccacaagaccctgcggcggctggtgcctgacagtgatgtgcgcttcctgctgtctgagagcggcagcggcaagggggccgccatggtgacagctgtggcctaccgcctggccgagcagcaccggcagatcgaggagaccctggcccacttccacctgaccaaggacatgctgctggaggtgaagaagaggatgagagctgagatggagctgggcctgaggaagcagacccacaacaatgctgtggtgaagatgctgcccagctttgtgcggaggaccccagatggaacagaaaatggagacttcctggccctggacctgggcggcaccaacttccgggtgctgctggtgaagatccgcagcggcaagaagaggacagtggagatgcacaacaagatctatgccatccccatcgagatcatgcagggcactggagaggagctgtttgaccacatcgtgtcctgcatcagtgacttcctggactacatgggcatcaagggccccaggatgcccctgggcttcaccttctccttcccctgccagcagaccagcctggatgctggcatcctgatcacctggaccaagggcttcaaggccacagactgtgtgggccatgatgtggtgaccctgctgagagatgccatcaagaggcgggaggagtttgacctggatgtggtggccgtggtgaatgacacagtgggcaccatgatgacctgtgcctatgaggagcccacctgtgaggtgggcctcatcgtgggcaccggcagcaatgcctgctacatggaggagatgaagaatgtggagatggtggagggggaccagggccagatgtgcatcaacatggagtggggcgcctttggagacaatggctgcctggatgacatccgcacccactatgaccggctggtggatgagtacagcctgaatgccggcaagcagagatatgagaagatgatcagcggcatgtacctgggggagatcgtgaggaacatcctgattgacttcaccaagaagggcttcctgttccggggccagatcagcgagaccctgaagacccggggcatctttgagaccaagttcctgagccagattgaaagtgaccggctggccctgctgcaggtgcgggccatcctgcagcagctgggcctgaacagcacctgtgatgacagcatcctggtgaagacagtgtgtggggtggtgtccagaagagctgcccagctgtgtggggccggcatggctgctgtggtggacaagatccgggagaacagaggcctggaccggctgaatgtgacagtgggcgtggatggcaccctgtacaagctgcacccccacttcagccgcatcatgcaccagacagtgaaggagctgagccccaagtgcaatgtgtccttcctgctgtctgaagatggcagcggcaagggggccgccctgatcacagctgtgggcgtgcggctgaggacagaggccagcagctag

SEQ ID NO: 155216 - DNA, 420 bp, Artificial Sequence
  Description of Artificial Sequence: Synthetic coding sequence
atgggccagatctgccagcgggagagcgccacagctgctgagaagcccaagctgcacctgctggccgagagcgagattgacaagtacctgtatgccatgaggctgagtgatgagaccctgattgacatcatgacccgcttcaggaaggagatgaagaatggcctgagccgggacttcaaccccacagccaccgtgaagatgctgcccacctttgtgcgcagcatcccagatggcagcgagaagggggacttcatcgccctggacctgggcggcagcagcttccgcatcctgcgggtgcaggtgaaccacgagaagaaccagaatgtgcacatggagagcgaggtgtatgacaccccagagaacatcgtgcacggcagcggcagccagctgtttgaccacgtggccgagtgcctgggctag

SEQ ID NO: 155217 - DNA, 2754 bp, Artificial Sequence
  Description of Artificial Sequence: Synthetic coding sequence
atgattgccagccacctgctggcctacttcttcacagagctgaaccacgaccaggtgcagaaggtggaccagtacctgtaccacatgaggctgagtgatgagaccctgctggagatcagcaagcgcttcaggaaggagatggagaagggcctgggcgccaccacccaccccacagctgctgtgaagatgctgcccacctttgtgcgcagcaccccagatggaacagaacatggagagttcctggccctggacctgggcggcaccaacttccgggtgctgtgggtgaaggtgacagacaatggcctgcagaaggtggagatggagaaccagatctatgccatccctgaggacatcatgaggggcagcggcacccagctgtttgaccacatcgccgagtgcctggccaacttcatggacaagctgcagatcaaggacaagaagctgcccctgggcttcaccttctccttcccctgccaccagaccaagctggatgagagcttcctggtgtcctggaccaagggcttcaagagcagcggcgtggagggcagagatgtggtggccctgatcaggaaggccatccagaggagaggagactttgatattgatattgtggccgtggtgaatgacacagtgggcaccatgatgacctgtggctatgatgaccacaactgtgagatcggcctgattgtgggcaccggcagcaatgcctgctacatggaggagatgaggcacatcgacatggtggagggagatgagggccgcatgtgcatcaacatggagtggggcgcctttggagatgatggcagcctgaatgacatcagaacagaatttgaccaggagattgacatgggcagcctgaaccctgggaagcagctgtttgagaagatgatcagcggcatgtacatgggagagctggtgcggctcatcctggtgaagatggccaaggaggagctgctgtttggaggcaagctgagccctgagctgctgaacacaggccgctttgagaccaaggacatcagtgacatcgagggggagaaggatggcatcaggaaggcccgggaggtgctgatgaggctgggcctggaccccacccaggaggactgtgtggccacccaccgcatctgccagatcgtgtccaccaggtctgccagcctgtgtgccgccaccctggccgctgtgctgcagaggatcaaggaaaataaaggagaggagcggctgcggagcaccatcggcgtggatggctctgtgtacaagaagcacccccactttgccaagaggctgcacaagacagtgcggcggctggtgcccggctgtgatgtgcgcttcctgcggagtgaagatggcagcgggaaaggagctgccatggtgacagctgtggcctaccgcctggccgaccagcaccgggcccggcagaagaccctggagcacctgcagctgagccatgaccagctgctggaggtgaagaggaggatgaaggtggagatggagcggggcctgagcaaggagacccacgccagcgcccctgtgaagatgctgcccacctacgtgtgtgccaccccagatggaacagagaagggggacttcctggccctggacctgggcggcaccaacttccgggtgctgctggtgcgggtgagaaatggcaagtggggcggcgtggagatgcacaacaagatctatgccatcccccaggaggtgatgcacggcactggagatgagctgtttgaccacatcgtgcagtgcatcgctgacttcctggagtacatgggcatgaagggcgtgtccctgcccctgggcttcaccttctccttcccctgccagcagaacagcctggatgagagcatcctgctgaagtggaccaagggcttcaaggccagcggctgtgaaggagaagatgtggtgaccctgctgaaggaggccatccacagaagagaggagtttgacctggatgtggtggccgtggtgaatgacacagtgggcaccatgatgacctgtggctttgaggacccccactgtgaggtgggcctgattgtgggcaccggcagcaatgcctgctacatggaggagatgagaaatgtggagctggtggagggggaggagggccgcatgtgtgtgaacatggagtggggcgccttcggggacaatggctgcctggatgacttcagaacagaatttgatgtggccgtggatgagctgagcctgaaccctgggaagcagagatttgagaagatgatcagcggcatgtacctgggggagatcgtgaggaacatcctgattgacttcaccaagaggggcctgctcttccggggccgcatcagcgagcggctgaagacccggggcatctttgagaccaagttcctgagccagatcgagagtgactgcctggccctgctgcaggtgcgggccatcctgcagcacctgggcctggagagcacctgtgatgacagcatcatcgtgaaggaggtgtgcaccgtggtggcccggcgggccgcccagctgtgtggggccggcatggctgctgtggtggaccgcatcagagaaaatagaggcctggatgccctgaaggtgacagtgggcgtggatggcaccctgtacaagctgcacccccactttgccaaggtgatgcatgagaccgtgaaggacctggcccccaagtgtgatgtgtccttcctgcagagtgaagatggcagcgggaaaggagctgccctgatcacagctgtggcctgccgcatccgggaggccggccagaggtag

SEQ ID NO: 155218 - DNA, 2670 bp, Artificial Sequence
  Description of Artificial Sequence: Synthetic coding sequence
atgaggctgagtgatgagaccctgctggagatcagcaagcgcttcaggaaggagatggagaagggcctgggcgccaccacccaccccacagctgctgtgaagatgctgcccacctttgtgcgcagcaccccagatggaacagaacatggagagttcctggccctggacctgggcggcaccaacttccgggtgctgtgggtgaaggtgacagacaatggcctgcagaaggtggagatggagaaccagatctatgccatccctgaggacatcatgaggggcagcggcacccagctgtttgaccacatcgccgagtgcctggccaacttcatggacaagctgcagatcaaggacaagaagctgcccctgggcttcaccttctccttcccctgccaccagaccaagctggatgagagcttcctggtgtcctggaccaagggcttcaagagcagcggcgtggagggcagagatgtggtggccctgatcaggaaggccatccagaggagaggagactttgatattgatattgtggccgtggtgaatgacacagtgggcaccatgatgacctgtggctatgatgaccacaactgtgagatcggcctgattgtgggcaccggcagcaatgcctgctacatggaggagatgaggcacatcgacatggtggagggagatgagggccgcatgtgcatcaacatggagtggggcgcctttggagatgatggcagcctgaatgacatcagaacagaatttgaccaggagattgacatgggcagcctgaaccctgggaagcagctgtttgagaagatgatcagcggcatgtacatgggagagctggtgcggctcatcctggtgaagatggccaaggaggagctgctgtttggaggcaagctgagccctgagctgctgaacacaggccgctttgagaccaaggacatcagtgacatcgagggggagaaggatggcatcaggaaggcccgggaggtgctgatgaggctgggcctggaccccacccaggaggactgtgtggccacccaccgcatctgccagatcgtgtccaccaggtctgccagcctgtgtgccgccaccctggccgctgtgctgcagaggatcaaggaaaataaaggagaggagcggctgcggagcaccatcggcgtggatggctctgtgtacaagaagcacccccactttgccaagaggctgcacaagacagtgcggcggctggtgcccggctgtgatgtgcgcttcctgcggagtgaagatggcagcgggaaaggagctgccatggtgacagctgtggcctaccgcctggccgaccagcaccgggcccggcagaagaccctggagcacctgcagctgagccatgaccagctgctggaggtgaagaggaggatgaaggtggagatggagcggggcctgagcaaggagacccacgccagcgcccctgtgaagatgctgcccacctacgtgtgtgccaccccagatggaacagagaagggggacttcctggccctggacctgggcggcaccaacttccgggtgctgctggtgcgggtgagaaatggcaagtggggcggcgtggagatgcacaacaagatctatgccatcccccaggaggtgatgcacggcactggagatgagctgtttgaccacatcgtgcagtgcatcgctgacttcctggagtacatgggcatgaagggcgtgtccctgcccctgggcttcaccttctccttcccctgccagcagaacagcctggatgagagcatcctgctgaagtggaccaagggcttcaaggccagcggctgtgaaggagaagatgtggtgaccctgctgaaggaggccatccacagaagagaggagtttgacctggatgtggtggccgtggtgaatgacacagtgggcaccatgatgacctgtggctttgaggacccccactgtgaggtgggcctgattgtgggcaccggcagcaatgcctgctacatggaggagatgagaaatgtggagctggtggagggggaggagggccgcatgtgtgtgaacatggagtggggcgccttcggggacaatggctgcctggatgacttcagaacagaatttgatgtggccgtggatgagctgagcctgaaccctgggaagcagagatttgagaagatgatcagcggcatgtacctgggggagatcgtgaggaacatcctgattgacttcaccaagaggggcctgctcttccggggccgcatcagcgagcggctgaagacccggggcatctttgagaccaagttcctgagccagatcgagagtgactgcctggccctgctgcaggtgcgggccatcctgcagcacctgggcctggagagcacctgtgatgacagcatcatcgtgaaggaggtgtgcaccgtggtggcccggcgggccgcccagctgtgtggggccggcatggctgctgtggtggaccgcatcagagaaaatagaggcctggatgccctgaaggtgacagtgggcgtggatggcaccctgtacaagctgcacccccactttgccaaggtgatgcatgagaccgtgaaggacctggcccccaagtgtgatgtgtccttcctgcagagtgaagatggcagcgggaaaggagctgccctgatcacagctgtggcctgccgcatccgggaggccggccagaggtag

SEQ ID NO: 155219 - DNA, 2754 bp, Artificial Sequence; identical to SEQ ID NO: 155217
  Description of Artificial Sequence: Synthetic coding sequence

SEQ ID NO: 155220 - DNA, 2772 bp, Artificial Sequence
  Description of Artificial Sequence: Synthetic coding sequence
atggacagcatcggcagcagcggcctgcggcagggcgaggagaccctgagctgcagcgaggagggcctgcccggccccagcgacagcagcgagctggtgcaggagtgcctgcagcagttcaaggtgacccgggcccagctgcagcagatccaggccagcctgctgggctccatggagcaggccctgcggggccaggccagccctgccccagctgtgaggatgctgcccacctacgtgggcagcaccccccacggcacagagcagggcgactttgtggtgctggagctgggcgccactggagccagcctgcgggtgctgtgggtgaccctgactggaattgagggccaccgggtggagcccaggagccaggagtttgtgatcccccaggaggtgatgctgggcgccggccagcagctgtttgattttgctgcccactgcctgtctgagttcctggatgcccagcctgtgaacaagcagggcctgcagctgggcttctccttctccttcccctgccaccagacaggcctggacaggagcaccctcatctcctggaccaagggcttccgctgcagcggcgtggagggccaggatgtggtgcagctgctgagagatgccatccggcggcagggcgcctacaacattgatgtggtggccgtggtgaatgacacagtgggcaccatgatgggctgtgagcccggggtgcggccctgtgaggtgggcctggtggtggacaccggcaccaatgcctgctacatggaggaggcccggcacgtggccgtgctggatgaagatcggggccgggtgtgtgtgtctgtggagtggggcagcttcagtgatgatggagccctgggccctgtgctgaccacctttgaccacaccctggaccacgagagcctgaaccctggggcccagagatttgagaagatgattggaggcctgtacctgggggagctggtgcggctggtgctggcccacctggcccgctgtggggtgctgtttggaggctgcaccagccctgccctgctgagccagggcagcatcctgctggagcacgtggccgagatggaggaccccagcactggagctgcccgggtgcacgccatcctgcaggacctgggcctgagccctggggccagtgatgtggagctggtgcagcacgtgtgtgccgctgtgtgcaccagggctgcccagctgtgtgccgccgccctggccgctgtgctgagctgcctgcagcacagccgggagcagcagaccctgcaggtggccgtggccactggaggccgggtgtgtgagcggcacccccgcttctgcagcgtgctgcagggcaccgtgatgctgctggccccagaatgtgatgtgtccctcatccccagcgtggatggcggcggccggggcgtggccatggtgacagctgtggccgcccggctggccgcccaccggcggctgctggaggagaccctggcccccttccggctgaaccacgaccagctggccgctgtgcaggcccagatgaggaaggccatggccaagggcctgcggggggaggccagcagcctgaggatgctgcccacctttgtgcgggccaccccagatggcagcgagcggggggacttcctggccctggacctgggcggcaccaacttccgggtgctgctggtgcgggtgaccactggagtgcagatcaccagcgagatctacagcatccctgagaccgtggcccagggcagcggccagcagctgtttgaccacatcgtggactgcatcgtggacttccagcagaagcagggcctgagcggccagagcctgcccctgggcttcaccttctccttcccctgccggcagctgggcctggaccagggcatcctgctgaactggaccaagggcttcaaggccagtgactgtgagggccaggatgtggtgtccctgctgcgggaggccatcacccggcggcaggccgtggagctgaatgtggtggccatcgtgaatgacacagtgggcaccatgatgagctgtggctatgaggacccccgctgtgagatcggcctgattgtgggcaccggcaccaatgcctgctacatggaggagctgagaaatgtggccggcgtgcctggggacagcggccgcatgtgcatcaacatggagtggggcgcctttggagatgatggcagcctggccatgctgagcaccaggtttgatgcctctgtggaccaggccagcatcaaccctgggaagcagagatttgagaagatgatcagcggcatgtacctgggggagatcgtgcgccacatcctgctgcacctgaccagcctgggcgtgctcttccggggccagcagatccagaggctgcagacccgggacatcttcaagaccaagttcctgtctgaaattgaaagtgacagcctggccctgcggcaggtgcgggccatcctggaggacctgggcctgcccctgaccagtgatgatgccctgatggtgctggaggtgtgccaggccgtgtcccagagagctgcccagctgtgtggggccggcgtggccgctgtggtggagaagatcagagaaaatagaggcctggaggagctggccgtgtctgtgggcgtggatggcaccctgtacaagctgcacccccgcttcagcagcctggtggccgccaccgtgcgggagctggccccccgctgtgtggtgaccttcctgcagagtgaagatggcagcgggaaaggagctgccctggtgacagctgtggcctgccgcctggcccagctgaccagggtgtag

SEQ ID NO: 155221 - DNA, 1590 bp, Artificial Sequence
  Description of Artificial Sequence: Synthetic coding sequence
atgaccagcagccggctgtggttcagcctgctgctggccgccgcctttgctggccgggccacagccctgtggccctggccccagaacttccagaccagtgaccagagatatgtgctgtaccccaacaacttccagttccagtatgatgtgagcagcgctgcccagcccggctgcagcgtgctggatgaggccttccagcgctacagagacctgctgtttggaagtggctcctggccccggccctacctgaccgggaagaggcacaccctggagaagaatgtgctggtggtgtctgtggtgaccccaggctgcaaccagctgcccaccctggagagcgtggagaactacaccctgaccatcaatgatgaccagtgcctgctgctgtctgaaacagtgtggggcgccctgcggggcctggagaccttcagccagctggtgtggaagtctgctgagggcaccttcttcatcaacaagacagaaattgaggacttcccccgcttcccccaccggggcctgctgctggacaccagccgccactacctgcccctgagcagcatcctggacaccctggatgtgatggcctacaacaagctgaatgtgttccactggcacctggtggatgaccccagcttcccctatgagagcttcaccttccctgagctgatgaggaagggcagctacaaccctgtgacccacatctacacagcccaggatgtgaaggaggtgattgaatatgcccggctgcggggcatccgggtgctggccgagtttgacaccccaggccacaccctgtcctggggccctggcatccctggcctgctgaccccctgctacagcggcagcgagcccagcggcacctttggacctgtgaaccccagcctgaacaacacctatgagttcatgagcaccttcttcctggaggtgagcagcgtcttcccagacttctacctgcacctgggcggagatgaggtggacttcacctgctggaagagcaaccctgagatccaggacttcatgaggaagaagggctttggagaggacttcaagcagctggagagcttctacatccagaccctgctggacatcgtgtcctcctatggcaagggctacgtggtgtggcaggaggtgtttgacaacaaggtgaagatccagcctgacaccatcatccaggtgtggagggaggacatccctgtgaactacatgaaggagctggagctggtgaccaaggccggcttccgggccctgctgagcgccccctggtacctgaaccgcatctcctatggccctgactggaaggacttctacatcgtggagcccctggcctttgagggcaccccagagcagaaggccctggtgattggaggagaggcctgcatgtggggcgagtatgtggacaacaccaacctggtgccccggctgtggcccagggctggagctgtggccgagcggctgtggagcaacaagctgaccagtgacctgacctttgcctatgagcggctgagccacttccgctgtgagctgctgcggcggggcgtgcaggcccagcccctgaatgtgggcttctgtgagcaggagtttgagcagacctag

SEQ ID NO: 155222 - DNA, 906 bp, Artificial Sequence
  Description of Artificial Sequence: Synthetic coding sequence
atgatgacctctgtgtacagcagcctgcggctgagcggggagctgtctgaagatgtgatggcctacaacaagctgaatgtgttccactggcacctggtggatgaccccagcttcccctatgagagcttcaccttccctgagctgatgaggaagggcagctacaaccctgtgacccacatctacacagcccaggatgtgaaggaggtgattgaatatgcccggctgcggggcatccgggtgctggccgagtttgacaccccaggccacaccctgtcctggggccctggcatccctggcctgctgaccccctgctacagcggcagcgagcccagcggcaccttcggccctgtgaaccccagcctgaacaacacctatgagttcatgagcaccttcttcctggaggtgtcctctgtgtttcctgacttctacctgcacctgggcggagatgaggtggacttcacctgctggaagagcaaccctgagatccaggacttcatgaggaagaagggctttggagaggacttcaagcagctggagagcttctacatccagaccctgctggacatcgtgagcagctatggcaagggctacgtggtgtggcaggaggtgtttgacaacaaggtgaagatccagcctgacaccatcatccaggtgtggagggaggacatccctgtgaactacatgaaggagctggagctggtgaccaaggccggcttccgggccctgctgagcgccccctggtacctgaaccgcatctcctatggccctgactggaaggacttctacatcgtggagcccctggcctttgagggcaccccagagcagaaggccctggtgattggaggagaggcctgcatgtggggcgagtatgtggacaacaccaacctggtgccccggctgtggtag

SEQ ID NO: 155223 - DNA, 507 bp, Artificial Sequence
  Description of Artificial Sequence: Synthetic coding sequence
atggcctacaacaagctgaatgtgttccactggcacctggtggatgaccccagcttcccctatgagagcttcaccttccctgagctgatgaggaagggcagctacaaccctgtgacccacatctacacagcccaggatgtgaaggaggtgattgaatatgcccggctgcggggcatccgggtgctggccgagtttgacaccccaggccacaccctgtcctggggccctggcatccctggcctgctgaccccctgctacagcggcagcgagcccagcggcacctttggacctgtgaaccccagcctgaacaacacctatgagttcatgagcaccttcttcctggaggtgagcagcgtcttcccagacttctacctgcacctgggcggagatgaggtggacttcacctgctggaagagcaaccctgagatccaggacttcatgaggaagaagggctttggagaggacttcaagcagctggagagcttctacatccagacctacccctag

SEQ ID NO: 155224 - DNA, 1671 bp, Artificial Sequence
  Description of Artificial Sequence: Synthetic coding sequence
atggagctgtgtggcctgggcctgcccaggcctcccatgctgctggccctgctgctggccaccctgctggccgccatgctggccctgctgacccaggtggccctggtggtgcaggtggccgaggccgcccgggcccccagcgtgtctgccaagccaggccctgccctgtggcccctgcccctgctggtgaagatgacccccaacctgctgcacctggcccctgagaacttctacatcagccacagccccaacagcacagctggccccagctgcaccctgctggaggaggccttccgccgctaccacggctacatcttcggcttctacaagtggcaccacgagcctgctgagttccaggccaagacccaggtgcagcagctgctggtgtccatcaccctgcagagtgaatgtgatgccttccccaacatcagcagtgatgagagctacaccctgctggtgaaggagcctgtggccgtgctgaaggccaacagagtgtggggcgccctgcggggcctggagaccttcagccagctggtgtaccaggacagctatggcaccttcaccatcaatgaaagcaccatcatcgacagcccccgcttcagccaccggggcatcctgattgacaccagccgccactacctgcctgtgaagatcatcctgaagaccctggatgccatggccttcaacaagttcaacgtgctgcactggcacatcgtggatgaccagagcttcccctaccagagcatcaccttccctgagctgagcaacaagggcagctacagcctgagccacgtgtacaccccaaatgatgtgaggatggtgattgaatatgcccggctgcggggcatccgggtgctgcctgagtttgacaccccaggccacaccctgtcctggggcaagggccagaaggacctgctgaccccctgctacagccggcagaacaagctggacagctttggccccatcaaccccaccctgaacaccacctacagcttcctgaccaccttcttcaaggagatcagcgaggtgtttcctgaccagttcatccacctgggcggagatgaggtggagttcaagtgctgggagagcaaccccaagatccaggacttcatgaggcagaagggcttcggcacagacttcaagaagctggagagcttctacatccagaaggtgctggacatcatcgccaccatcaacaagggcagcatcgtgtggcaggaggtgtttgatgacaaggccaagctggcccctggcaccatcgtggaggtgtggaaggacagcgcctacccagaggagctgagccgggtgacagccagcggcttccctgtgatcctgagcgccccctggtacctggacctgatctcctatggccaggactggaggaagtactacaaggtggagcccctggactttggaggcacccagaagcagaagcagctgttcatcggcggggaggcctgcctgtggggcgagtatgtggatgccaccaacctgaccccccggctgtggccccgggccagcgctgtgggggagcggctgtggagcagcaaggatgtgcgggacatggatgatgcctatgaccggctgaccaggcaccgctgcaggatggtggagcggggcattgctgcccagcccctgtatgccggctactgcaaccacgagaacatgtag

SEQ ID NO: 155225 - DNA, 996 bp, Artificial Sequence
  Description of Artificial Sequence: Synthetic coding sequence
atggccttcaacaagttcaacgtgctgcactggcacatcgtggatgaccagagcttcccctaccagagcatcaccttccctgagctgagcaacaagggcagctacagcctgagccacgtgtacaccccaaatgatgtgaggatggtgattgaatatgcccggctgcggggcatccgggtgctgcctgagtttgacaccccaggccacaccctgtcctggggcaagggccagaaggacctgctgaccccctgctacagccggcagaacaagctggacagctttggccccatcaaccccaccctgaacaccacctacagcttcctgaccaccttcttcaaggagatcagcgaggtgtttcctgaccagttcatccacctgggcggagatgaggtggagttcaagtgctgggagagcaaccccaagatccaggacttcatgaggcagaagggctttggaacagacttcaagaagctggagagcttctacatccagaaggtgctggacatcatcgccaccatcaacaagggcagcatcgtgtggcaggaggtgtttgatgacaaggccaagctggcccctggcaccatcgtggaggtgtggaaggacagcgcctacccagaggagctgagccgggtgacagccagcggcttccctgtgatcctgagcgccccctggtacctggacctgatctcctatggccaggactggaggaagtactacaaggtggagcccctggactttggaggcacccagaagcagaagcagctgttcatcggcggggaggcctgcctgtggggcgagtatgtggatgccaccaacctgaccccccggctgtggccccgggccagcgctgtgggggagcggctgtggagcagcaaggatgtgcgggacatggatgatgcctatgaccggctgaccaggcaccgctgcaggatggtggagcggggcattgctgcccagcccctgtatgccggctactgcaaccacgagaacatgtag

SEQ ID NO: 155226 - DNA, 2376 bp, Artificial Sequence
  Description of Artificial Sequence: Synthetic coding sequence
atgtggaacatgctgattgtggccatgtgcctggccctgctgggctgcctgcaggcccaggagctgcagggccacgtgtccatcatcctgctgggcgccaccggggacctggccaagaagtacctgtggcagggcctcttccagctgtacctggatgaggccggccggggccacagcttctccttccatggagctgccctgacagcccccaagcagggccaggagctgatggccaaggccctggagagcctgagctgccccaaggacatggcccccagccactgtgccgagcacaaggaccagttcctgcagctgagccagtaccggcagctgaagacagctgaggactaccaggccctgaacaaggacatcgaggcccagctgcagcacgccggcctgcgggaggccggccgcatcttctacttctctgtgcccccatttgcctatgaggacatcgccaggaacatcaacagcagctgccggcccggccctggggcctggctgcgggtggtgctggagaagcccttcggccatgaccacttcagcgcccagcagctggccacagagctgggcaccttcttccaggaggaggagatgtacagagtggaccactacctgggcaagcaggccgtggcccagatcctgcccttccgggaccagaacaggaaggccctggatggcctgtggaacagacaccacgtggagcgggtggagatcatcatgaaggagaccgtggatgctgagggccgcaccagcttctatgaggagtatggagtcatcagagatgtgctgcagaaccacctgacagaggtgctgaccctggtggccatggagctgccccacaacgtgtcctctgctgaggccgtgctgcggcacaagctgcaggtgttccaggccctgcggggcctgcagaggggcagcgctgtggtgggccagtaccagagctacagcgagcaggtgagaagagagctgcagaagccagacagcttccacagcctgacccccacctttgctgctgtgctggtgcacatcgacaacctgcgctgggagggcgtgcccttcatcctgatgtctgggaaggccctggatgagcgggtgggctacgcccgcatcctcttcaagaaccaggcctgctgcgtgcagagcgagaagcactgggccgccgcccagagccagtgcctgccccggcagctggtgttccacatcggccacggggacctgggcagccctgctgtgctggtgtccaggaacctcttccggcccagcctgcccagctcctggaaggagatggagggccccccaggcctgcggctgtttggcagccccctgagtgactactatgcctacagccctgtgcgggagagagatgcccacagcgtgctgctgagccacatcttccacggcaggaagaacttcttcatcaccacagagaacctgctggcctcctggaacttctggacccccctgctggagagcctggcccacaaggccccccggctgtacccaggcggcgcagaaaatggccgcctgctggactttgagttcagcagcggccgcctcttcttcagccagcagcagcctgagcagctggtgcccggccctggccctgcccccatgcccagcgacttccaggtgctgcgggccaagtaccgggagagccccctggtgtctgcctggagcgaggagctgatcagcaagctggccaatgacatcgaggccacagctgtgcgggctgtgcggcgcttcggccagttccacctggccctgagcggcggcagcagccctgtggccctcttccagcagctggccacagcccactacggcttcccctgggcccacacccacctgtggctggtggatgagcgctgtgtgcccctgagtgaccctgagagcaacttccagggcctgcaggcccacctgctgcagcacgtgcgcatcccctactacaacatccaccccatgcctgtgcacctgcagcagaggctgtgtgccgaggaggaccagggcgcccagatctatgcccgggagatcagcgccctggtggccaacagcagctttgacctggtgctgctgggcatgggcgcagatggccacacagccagcctcttcccccagagccccaccggcctggatggagagcagctggtggtgctgaccaccagccccagccagccccacaggaggatgagcctgagcctgcccctcatcaacagagccaagaaggtggccgtgctggtgatgggccgcatgaagcgggagatcaccaccctggtgtcccgggtgggccacgagcccaagaagtggcccatctctggagtgctgccccacagcggccagctggtgtggtacatggactatgatgccttcctgggctag

SEQ ID NO: 155227 - DNA, 1968 bp, Artificial Sequence
  Description of Artificial Sequence: Synthetic coding sequence
atgggccgctgggcctgggtgcccagcccctggcccccacctggcctgggccccttcctgctgctgctgctgctgctgctgctgctgccccggggcttccagccccagcccggcggcaacagaacagagagccctgagcccaatgccacagccaccccagccatccccaccatcctggtgacctctgtgaccagcgagaccccagccaccagcgcccctgaggccgagggcccccagagcggcggcctgcccccaccacccagggctgtgcccagcagcagcagcccccaggcccaggccctgacagaagatggccggccctgccgcttccccttccgctatggaggccgcatgctgcacgcctgcaccagcgagggcagcgcccacaggaagtggtgtgccaccacccacaactatgaccgggaccgggcctggggctactgtgtggaggccaccccacctcctgggggccctgctgccctggacccctgtgccagcggcccctgcctgaatggaggcagctgcagcaacacccaggacccccagagctaccactgcagctgcccccgggccttcaccgggaaggactgtggcacagagaagtgctttgatgagaccaggtatgagtacctggagggcggggaccgctgggcccgggtgcggcagggccacgtggagcagtgtgaatgttttggaggccgcacctggtgtgagggcaccaggcacacagcctgcctgagcagcccctgcctgaatggaggcacctgccacctgattgtggccaccggcaccaccgtgtgtgcctgccccccaggctttgctggccgcctgtgcaacatcgagccagatgagcgctgcttcctgggcaatggcaccggctaccggggcgtggccagcaccagcgccagcggcctgagctgcctggcctggaacagcgacctgctgtaccaggagctgcacgtggacagcgtgggcgctgctgccctgctgggcctgggcccccacgcctactgcagaaatccagacaatgatgagcggccctggtgctacgtggtgaaggacagcgccctgtcctgggagtactgccgcctggaggcctgtgagagcctgaccagggtgcagctgagcccagacctgctggccaccctgcctgagcccgccagccctggccggcaggcctgtggccgccgccacaagaagaggaccttcctgcggccccgcatcattggaggcagcagcagcctgcccggcagccacccctggctggccgccatctacatcggggacagcttctgtgccggcagcctggtgcacacctgctgggtggtgtctgctgcccactgcttcagccacagccccccccgggacagcgtgtctgtggtgctgggccagcacttcttcaacagaaccacagatgtgacccagacctttggaattgagaagtacatcccctacaccctgtacagcgtcttcaaccccagcgaccatgacctggtgctgatccggctgaagaagaagggggacagatgtgccaccaggagccagtttgtgcagcccatctgcctgcctgagcccggcagcaccttccctgctggccacaagtgccagattgctggctggggccacctggatgaaaatgtgtctggctacagcagcagcctgcgggaggccctggtgcccctggtggccgaccacaagtgcagcagccctgaggtgtatggagctgacatcagccccaacatgctgtgtgccggctactttgactgcaagagtgatgcctgccagggcgacagcggcggccccctggcctgtgagaagaatggagtggcctacctgtatggcatcatctcctggggagatggctgcggccgcctgcacaagccaggagtgtacaccagggtggccaactacgtggactggatcaatgaccgcatccggcccccccggcggctggtggcccccagctag

SEQ ID NO: 155228 - DNA, 3807 bp, Artificial Sequence
  Description of Artificial Sequence: Synthetic coding sequence
atgagctctgtggccgtgctgacccaggagagctttgctgagcacaggagcggcctggtgccccagcagatcaaggtggccaccctgaacagcgaggaggagagtgacccccccacctacaaggatgccttcccccccctgcctgagaaggccgcctgcctggagagcgcccaggagcccagcggggcctggggcaacaagatccggcccatcaaggccagcgtcatcacccaggtgttccacgtgcccctggaggagaggaagtacaaggacatgaaccagtttggagagggggagcaggccaagatctgcctggagatcatgcagaggactggagcccacctggagctgagcctggccaaggaccagggcctgagcatcatggtgtctgggaagctggatgctgtgatgaaggccaggaaggacatcgtggcccggctgcagacccaggccagcgccaccgtggccatccccaaggagcaccaccgcttcgtcatcggcaagaatggagagaagctgcaggacctggagctgaagacagccaccaagatccagatccccaggccagatgaccccagcaaccagatcaagatcaccggcaccaaggagggcatcgagaaggcccggcatgaggtgctgctgatctctgctgagcaggacaagagagctgtggagcggctggaggtggagaaggccttccaccccttcatcgccggcccctacaaccggctggtgggggagatcatgcaggagaccggcacccgcatcaacatccccccacccagcgtgaacagaacagagatcgtgttcaccggggagaaggagcagctggcccaggccgtggcccgcatcaagaagatctatgaggagaagaagaagaagaccaccaccatcgctgtggaggtgaagaagagccagcacaagtatgtgattggccccaagggcaacagcctgcaggagatcctggagaggactggagtgtctgtggagatcccccccagcgacagcatcagcgagaccgtcatcctgcggggggagcctgagaagctgggccaggccctgacagaggtgtatgccaaggccaacagcttcaccgtgtcctctgtggccgcccccagctggctgcaccgcttcatcatcggcaagaagggccagaacctggccaagatcacccagcagatgcccaaggtgcacatcgagttcacagaaggagaggacaagatcaccctggagggccccacagaagatgtgaatgtggcccaggagcagatcgagggcatggtgaaggacctgatcaacaggatggactatgtggagatcaacatcgaccacaagttccaccgccacctgattggcaagagcggggccaacatcaaccgcatcaaggaccagtacaaggtgtctgtgcgcatccccccagattctgagaagagcaacctgatcagaattgaaggagacccccagggcgtgcagcaggccaagcgggagctgctggagctggccagcaggatggagaatgaaagaaccaaggacctgatcatcgagcagcgcttccacaggaccatcatcggccagaagggggagcgcatccgggagatccgggacaagtttcctgaggtgatcatcaacttcccagaccctgcccagaagagtgacatcgtgcagctgcggggccccaagaatgaggtggagaagtgcaccaagtacatgcagaagatggtggccgacctggtggagaacagctacagcatctctgtgcccatcttcaagcagttccacaagaacatcattggaaaaggaggagccaacatcaagaagatccgggaggagagcaacaccaagattgacctgcctgctgagaacagcaacagcgagaccatcatcatcaccgggaagagggccaactgtgaggccgcccggagccgcatcctgagcatccagaaggacctggccaacattgctgaggtggaggtgtccatcccagccaagctgcacaacagcctgattggcaccaagggccgcctcatccgcagcatcatggaggagtgtggcggcgtgcacatccacttccctgtggagggcagcggcagtgacacagtggtgatccggggccccagcagtgatgtggagaaggccaagaagcagctgctgcacctggccgaggagaagcagaccaagagcttcaccgtggacatccgggccaagccagagtaccacaagttcctgattggaaaaggaggcggcaagatcaggaaggtgcgggacagcactggagcccgggtcatcttccctgctgctgaggacaaggaccaggacctgatcaccatcatcggcaaggaggatgctgtgcgggaggcccagaaggagctggaggccctgatccagaacctggacaacgtggtggaggacagcatgctggtggaccccaagcaccaccgccactttgtgatccggcggggccaggtgctgcgggagattgctgaggagtatggaggagtgatggtgtccttccccaggagcggcacccagagcgacaaggtgaccctgaagggggccaaggactgtgtggaggccgccaagaagaggatccaggagatcatcgaggacctggaggcccaggtgaccctggagtgtgccatcccccagaagttccacaggtctgtgatgggccccaagggcagccgcatccagcagatcacccgggacttctctgtgcagatcaagttcccagaccgggaggagaatgctgtgcacagcacagagcctgtggtgcaggagaatggagatgaagctggggagggccgggaggccaaggactgtgaccccggcagcccccggcgctgtgacatcatcatcatcagcggcaggaaggagaagtgtgaggccgccaaggaggccctggaggccctggtgcctgtgaccatcgaggtggaggtgccctttgacctgcaccgctacgtgattggccagaagggcagcggcatcaggaagatgatggatgaatttgaggtgaacatccacgtgcctgcccctgagctgcagagcgacatcatcgccatcaccggcctggccgccaacctggaccgggccaaggccggcctgctggagcgggtgaaggagctgcaggccgagcaggaggaccgggccctgcggagcttcaagctgtctgtgacagtggaccccaagtaccaccccaagatcatcggcaggaaaggagctgtgatcacccagatccggctggagcatgatgtgaacatccagttcccagacaaggatgatggcaaccagccccaggaccagatcaccatcaccggctatgagaagaacacagaggccgccagagatgccatcctgcgcatcgtgggggagctggagcagatggtgtctgaagatgtgcccctggaccaccgggtgcacgcccgcatcattggagcccggggcaaggccatcaggaagatcatggatgagttcaaggtggacatccgcttcccccagagcggggccccagaccccaactgtgtgacagtgacaggcctgcctgaaaatgtggaggaggccatcgaccacatcctgaacctggaggaggagtacctggctgatgtggtggacagcgaggccctgcaggtgtacatgaagcccccagcccacgaggaggccaaggcccccagccggggctttgtggtgagagatgccccctggacagccagcagcagcgagaaggccccagacatgagcagcagcgaggagttccccagctttggagcccaggtggcccccaagaccctgccctggggccccaagaggtag

SEQ ID NO: 155229 - DNA, 3807 bp, Artificial Sequence; identical to SEQ ID NO: 155228
  Description of Artificial Sequence: Synthetic coding sequence

SEQ ID NO: 155230 - DNA, 3807 bp, Artificial Sequence; identical to SEQ ID NO: 155228
  Description of Artificial Sequence: Synthetic coding sequence

SEQ ID NO: 155231 - DNA, 249 bp, Artificial Sequence
  Description of Artificial Sequence: Synthetic coding sequence
atgagctctgtggccgtgctgacccaggagagctttgctgagcacaggagcggcctggtgccccagcagatcaaggtggccaccctgaacagcgaggaggagagtgacccccccacctacaaggatgccttcccccccctgcctgagaaggccgcctgcctggagagcgcccaggagcccagcggggcctggggcaacaagatccggcccatcaaggccagcgtcatcacccaggtgttccacgtgtag

SEQ ID NO: 155232 - DNA, 45 bp, Artificial Sequence
  Description of Artificial Sequence: Synthetic coding sequence
atgagctctgtggccgtgctgacccaggagagctttgctgagtag

SEQ ID NO: 155233 - DNA, 210 bp, Artificial Sequence
  Description of Artificial Sequence: Synthetic coding sequence
atgagctctgtggccgtgctgacccaggagagctttgctgagcacaggagcggcctggtgccccagcagatcaaggtggccaccctgaacagcgaggaggagagtgacccccccacctacaaggatgccttcccccccctgcctgagaaggccgcctgcctggagagcgcccaggagcccagcggggcctggggcaacaagatcagatag

SEQ ID NO: 155234 - DNA, 165 bp, Artificial Sequence
  Description of Artificial Sequence: Synthetic coding sequence
atgagctctgtggccgtgctgacccaggagagctttgctgagcacaggagcggcctggtgccccagcagatcaaggtggccaccctgaacagcgaggaggagagtgacccccccacctacaaggatgccttcccccccctgcctgagaaggccgcctgcctgtag

SEQ ID NO: 155235 - DNA, 675 bp, Artificial Sequence
  Description of Artificial Sequence: Synthetic coding sequence
atgagctctgtggccgtgctgacccaggagagctttgctgagcacaggagcggcctggtgccccagcagatcaaggtggccaccctgaacagcgaggaggagagtgacccccccacctacaaggatgccttcccccccctgcctgagaaggccgcctgcctggagagcgcccaggagcccagcggggcctggggcaacaagatccggcccatcaaggccagcgtcatcacccaggtgttccacgtgcccctggaggagaggaagtacaaggacatgaaccagtttggagagggggagcaggccaagatctgcctggagatcatgcagaggactggagcccacctggagctgagcctggccaaggaccagggcctgagcatcatggtgtctgggaagctggatgctgtgatgaaggccaggaaggacatcgtggcccggctgcagacccaggccagcgccaccgtggccatccccaaggagcaccaccgcttcgtcatcggcaagaatggagagaagctgcaggacctggagctgaagacagccaccaagatccagatccccaggccagatgaccccagcaaccagatcaagatcaccggcaccaaggagggcatcgagaaggcccggcatgaggtgctgctgatctctgctgagcaggacaagagagctgtgtag

SEQ ID NO: 155236 - DNA, 246 bp, Artificial Sequence
  Description of Artificial Sequence: Synthetic coding sequence
atgagctctgtggccgtgctgacccaggagagctttgctgagcacaggagcggcctggtgccccagcagatcaaggtggccaccctgaacagcgaggaggagagtgacccccccacctacaaggatgccttcccccccctgcctgagaaggccgcctgcctggagagcgcccaggagcccagcggggcctggggcaacaagatccggcccatcaaggccagcgtcatcacccaggtgttccactag

SEQ ID NO: 155237 - DNA, 240 bp, Artificial Sequence
  Description of Artificial Sequence: Synthetic coding sequence
atgagctctgtggccgtgctgacccaggagagctttgctgagcacaggagcggcctggtgccccagcagatcaaggtggccaccctgaacagcgaggaggagagtgacccccccacctacaaggatgccttcccccccctgcctgagaaggccgcctgcctggagagcgcccaggagcccagcggggcctggggcaacaagatccggcccatcaaggccagcgtcatcacccaggtgtag

SEQ ID NO: 155238 - DNA, 291 bp, Artificial Sequence
  Description of Artificial Sequence: Synthetic coding sequence
atgagctctgtggccgtgctgacccaggagagctttgctgagcacaggagcggcctggtgccccagcagatcaaggtggccaccctgaacagcgaggaggagagtgacccccccacctacaaggatgccttcccccccctgcctgagaaggccgcctgcctggagagcgcccaggagcccagcggggcctggggcaacaagatccggcccatcaaggccagcgtcatcacccaggtgttccacgtgcccctggaggagaggaagtacaaggacatgaaccagtttggatag

SEQ ID NO: 155239 - DNA, 60 bp, Artificial Sequence
  Description of Artificial Sequence: Synthetic coding sequence
atgagctctgtggccgtgctgacccaggagagctttgctgagcacaggagcggcctgtag

SEQ ID NO: 155240 - DNA, 3708 bp, Artificial Sequence
  Description of Artificial Sequence: Synthetic coding sequence
atgcacctggccgagcgggaccgctggctgtttgtggccaccgtgatgatgcactttgtgtccatcaagagcggcttccctggcctgtgtgtgggcgtgcgcagcaccatgagctctgtggccgtgctgacccaggagagctttgctgagcacaggagcggcctggtgccccagcagatcaaggtggccaccctgaacagcgaggaggagagtgacccccccacctacaaggatgccttcccccccctgcctgagaaggccgcctgcctggagagcgcccaggagcccagcggggcctggggcaacaagatccggcccatcaaggccagcgtcatcacccaggtgttccacgtgcccctggaggagaggaagtacaaggacatgaaccagtttggagagggggagcaggccaagatctgcctggagatcatgcagaggactggagcccacctggagctgagcctggccaaggaccagggcctgagcatcatggtgtctgggaagctggatgctgtgatgaaggccaggaaggacatcgtggcccggctgcagacccaggccagcgccaccgtggccatccccaaggagcaccaccgcttcgtcatcggcaagaatggagagaagctgcaggacctggagctgaagacagccaccaagatccagatccccaggccagatgaccccagcaaccagatcaagatcaccggcaccaaggagggcatcgagaaggcccggcatgaggtgctgctgatctctgctgagcaggacaagagagctgtggagcggctggaggtggagaaggccttccaccccttcatcgccggcccctacaaccggctggtgggggagatcatgcaggagaccggcacccgcatcaacatccccccacccagcgtgaacagaacagagatcgtgttcaccggggagaaggagcagctggcccaggccgtggcccgcatcaagaagatctatgaggagaaggccaacagcttcaccgtgtcctctgtggccgcccccagctggctgcaccgcttcatcatcggcaagaagggccagaacctggccaagatcacccagcagatgcccaaggtgcacatcgagttcacagaaggagaggacaagatcaccctggagggccccacagaagatgtgaatgtggcccaggagcagatcgagggcatggtgaaggacctgatcaacaggatggactatgtggagatcaacatcgaccacaagttccaccgccacctgattggcaagagcggggccaacatcaaccgcatcaaggaccagtacaaggtgtctgtgcgcatccccccagacagcgagaagagcaacctgatccgcatcgagggggacccccagggcgtgcagcaggccaagcgggagctgctggagctggccagcaggatggagaatgaaagaaccaaggacctgatcatcgagcagcgcttccacaggaccatcatcggccagaagggggagcgcatccgggagatccgggacaagtttcctgaggtgatcatcaacttcccagaccctgcccagaagagtgacatcgtgcagctgcggggccccaagaatgaggtggagaagtgcaccaagtacatgcagaagatggtggccgacctggtggagaacagctacagcatctctgtgcccatcttcaagcagttccacaagaacatcatcggcaagggcggggccaacatcaagaagatccgggaggagagcaacaccaagattgacctgcctgctgagaacagcaacagcgagaccatcatcatcaccgggaagagggccaactgtgaggccgcccggagccgcatcctgagcatccagaaggacctggccaacattgctgaggtggaggtgtccatcccagccaagctgcacaacagcctcatcggcaccaagggccgcctcatccgcagcatcatggaggagtgtggcggcgtgcacatccacttccctgtggagggcagcggcagtgacacagtggtgatccggggccccagcagtgatgtggagaaggccaagaagcagctgctgcacctggccgaggagaagcagaccaagagcttcaccgtggacatccgggccaagccagagtaccacaagttcctgattggcaagggcggcggcaagatcaggaaggtgcgggacagcactggagcccgggtcatcttccctgctgctgaggacaaggaccaggacctgatcaccatcatcggcaaggaggatgctgtgcgggaggcccagaaggagctggaggccctgatccagaacctggacaacgtggtggaggacagcatgctggtggaccccaagcaccaccgccacttcgtcatcagaagaggccaggtgctgcgggagattgctgaggagtatggaggagtgatggtgtccttccccaggagcggcacccagagcgacaaggtgaccctgaagggggccaaggactgtgtggaggccgccaagaagaggatccaggagatcatcgaggacctggaggcccaggtgaccctggagtgtgccatcccccagaagttccacaggtctgtgatgggccccaagggcagccgcatccagcagatcacccgggacttctctgtgcagatcaagttcccagaccgggaggagaatgctgtgcacagcacagagcctgtggtgcaggagaatggagatgaggccggggagggccgggaggccaaggactgtgaccccggcagcccccggcgctgtgacatcatcatcatcagcggcaggaaggagaagtgtgaggccgccaaggaggccctggaggccctggtgcctgtgaccatcgaggtggaggtgccctttgacctgcacagatatgtgattggccagaagggcagcggcatcaggaagatgatggatgaatttgaggtgaacatccacgtgcctgcccctgagctgcagagcgacatcatcgccatcaccggcctggccgccaacctggaccgggccaaggccggcctgctggagcgggtgaaggagctgcaggccgagcaggaggaccgggccctgcgctccttcaagctgtctgtgacagtggaccccaagtaccaccccaagatcattggaaggaagggggccgtcatcacccagatccggctggagcatgatgtgaacatccagttcccagacaaggatgatggcaaccagccccaggaccagatcaccatcaccggctatgagaagaacacagaagctgccagagatgccatcctgagaattgtgggggagctggagcagatggtgtctgaagatgtgcccctggaccaccgggtgcacgcccgcatcatcggggcccggggcaaggccatcaggaagatcatggatgagttcaaggtggacatccgcttcccccagagcggggccccagaccccaactgtgtgacagtgacaggcctgcctgaaaatgtggaggaggccatcgaccacatcctgaacctggaggaggagtacctggctgatgtggtggacagcgaggccctgcaggtgtacatgaagcccccagcccacgaggaggccaaggcccccagccggggctttgtggtgagagatgccccctggacagccagcagcagcgagaaggccccagacatgagcagcagcgaggagttccccagctttggagcccaggtggcccccaagaccctgccctggggccccaagaggtag

SEQ ID NO: 155241 - DNA, 666 bp, Artificial Sequence
  Description of Artificial Sequence: Synthetic coding sequence
atgagctctgtggccgtgctgacccaggagagctttgctgagcacaggagcggcctggtgccccagcagatcaaggtggccaccctgaacagcgaggaggagagtgacccccccacctacaaggatgccttcccccccctgcctgagaaggccgcctgcctggagagcgcccaggagcccagcggggcctggggcaacaagatccggcccatcaaggccagcgtcatcacccaggtgttccacgtgcccctggaggagaggaagtacaaggacatgaaccagtttggagagggggagcaggccaagatctgcctggagatcatgcagaggactggagcccacctggagctgagcctggccaaggaccagggcctgagcatcatggtgtctgggaagctggatgctgtgatgaaggccaggaaggacatcgtggcccggctgcagacccaggccagcgccaccgtggccatccccaaggagcaccaccgcttcgtcatcggcaagaatggagagaagctgcaggacctggagctgaagacagccaccaagatccagatccccaggccagatgaccccagcaaccagatcaagatcaccggcaccaaggagggcatcgagaaggcccggcatgaggtgctgctgatctctgctgagcaggacaagtag

SEQ ID NO: 155242 - DNA, 426 bp, Artificial Sequence
  Description of Artificial Sequence: Synthetic coding sequence
atgagctctgtggccgtgctgacccaggagagctttgctgagcacaggagcggcctggtgccccagcagatcaaggtggccaccctgaacagcgaggaggagagtgacccccccacctacaaggatgccttcccccccctgcctgagaaggccgcctgcctggagagcgcccaggagcccagcggggcctggggcaacaagatccggcccatcaaggccagcgtcatcacccaggtgttccacgtgcccctggaggagaggaagtacaaggacatgaaccagtttggagagggggagcaggccaagatctgcctggagatcatgcagaggactggagcccacctggagctgagcctggccaaggaccagggcctgagcatcatggtgtctgggaagctggatgctgtgatgaaggccaggaagtag

SEQ ID NO: 155243 - DNA, 381 bp, Artificial Sequence
  Description of Artificial Sequence: Synthetic coding sequence
atgagctctgtggccgtgctgacccaggagagctttgctgagcacaggagcggcctggtgccccagcagatcaaggtggccaccctgaacagcgaggaggagagtgacccccccacctacaaggatgccttcccccccctgcctgagaaggccgcctgcctggagagcgcccaggagcccagcggggcctggggcaacaagatccggcccatcaaggccagcgtcatcacccaggtgttccacgtgcccctggaggagaggaagtacaaggacatgaaccagtttggagagggggagcaggccaagatctgcctggagatcatgcagaggactggagcccacctggagctgagcctggccaaggaccagggcctgtcctag

SEQ ID NO: 155244 - DNA, 444 bp, Artificial Sequence
  Description of Artificial Sequence: Synthetic coding sequence
atgagctctgtggccgtgctgacccaggagagctttgctgagcacaggagcggcctggtgccccagcagatcaaggtggccaccctgaacagcgaggaggagagtgacccccccacctacaaggatgccttcccccccctgcctgagaaggccgcctgcctggagagcgcccaggagcccagcggggcctggggcaacaagatccggcccatcaaggccagcgtcatcacccaggtgttccacgtgcccctggaggagaggaagtacaaggacatgaaccagtttggagagggggagcaggccaagatctgcctggagatcatgcagaggactggagcccacctggagctgagcctggccaaggaccagggcctgagcatcatggtgtctgggaagctggatgctgtgatgaaggccaggaaggacatcgtggcccggctgtag

SEQ ID NO: 155245 - DNA, 54 bp, Artificial Sequence
  Description of Artificial Sequence: Synthetic coding sequence
atgagctctgtggccgtgctgacccaggagagctttgctgagcacaggagctag

SEQ ID NO: 155246 - DNA, 495 bp, Artificial Sequence
  Description of Artificial Sequence: Synthetic coding sequence
atgagctctgtggccgtgctgacccaggagagctttgctgagcacaggagcggcctggtgccccagcagatcaaggtggccaccctgaacagcgaggaggagagtgacccccccacctacaaggatgccttcccccccctgcctgagaaggccgcctgcctggagagcgcccaggagcccagcggggcctggggcaacaagatccggcccatcaaggccagcgtcatcacccaggtgttccacgtgcccctggaggagaggaagtacaaggacatgaaccagtttggagagggggagcaggccaagatctgcctggagatcatgcagaggactggagcccacctggagctgagcctggccaaggaccagggcctgagcatcatggtgtctgggaagctggatgctgtgatgaaggccaggaaggacatcgtggcccggctgcagacccaggccagcgccaccgtggccatccccaaggagcaccaccgcttctag

SEQ ID NO: 155247 - DNA, 144 bp, Artificial Sequence
  Description of Artificial Sequence: Synthetic coding sequence
atgagctctgtggccgtgctgacccaggagagctttgctgagcacaggagcggcctggtgccccagcagatcaaggtggccaccctgaacagcgaggaggagagtgacccccccacctacaaggatgccttcccccccctgtag

SEQ ID NO: 155248 - DNA, 1044 bp, Artificial Sequence
  Description of Artificial Sequence: Synthetic coding sequence
atggagaacctgatgaccagcagcaccctgccccccctgtttgctgatgaagatggcagcaaggagagcaatgacctggccaccaccggcctgaaccaccctgaggtgccctacagcagcggggccaccagcagcaccaacaaccctgagtttgtggaggacctgagccagggccagctgctgcagagcgagagcagcaatgctgctgagggcaatgagcagagacatgaagatgagcagaggagcaagagaggaggctggagcaaaggaaggaagaggaagaagcccctgcgggacagcaatgcccccaagagccccctgaccggctacgtgcgcttcatgaatgaaagaagagagcagctgcgggccaagaggcctgaggtgcccttccctgagatcaccaggatgctgggcaatgagtggagcaagctgcccccagaggagaagcagcgctacctggatgaggccgaccgggacaaggagcgctacatgaaggagctggagcagtaccagaagacagaggcctacaaggtgttcagcaggaagacccaggaccggcagaagggcaagagccaccggcaggatgctgcccggcaggccacccatgaccacgagaaggagacagaggtgaaggagaggtctgtgtttgacatccccatcttcacagaggagttcctgaaccacagcaaggcccgggaggccgagctgcggcagctgaggaagagcaacatggagtttgaggagagaaatgctgccctgcagaagcacgtggagagcatgaggacagctgtggagaagctggaggtggatgtgatccaggagaggagcaggaacacagtgctgcagcagcacctggagaccctgcggcaggtgctgaccagcagctttgcctccatgcccctgcccggcagcggggagacccccaccgtggacaccatcgacagctacatgaaccggctgcacagcatcatcctggccaacccccaggacaatgaaaacttcatcgccaccgtgcgggaggtggtgaaccggctggacagatag

SEQ ID NO: 155249 - DNA, 1044 bp, Artificial Sequence; identical to SEQ ID NO: 155248
  Description of Artificial Sequence: Synthetic coding sequence

SEQ ID NO: 155250 - DNA, 471 bp, Artificial Sequence
  Description of Artificial Sequence: Synthetic coding sequence
atggagaacctgatgaccagcagcaccctgccccccctgtttgctgatgaagatggcagcaaggagagcaatgacctggccaccaccggcctgaaccaccctgaggtgccctacagcagcggggccaccagcagcaccaacaaccctgagtttgtggaggacctgagccagggccagctgctgcagagcgagagcagcaatgctgctgagggcaatgagcagagacatgaagatgagcagaggagcaagagaggaggctggagcaaaggaaggaagaggaagaagcccctgcgggacagcaatgcccccaagagccccctgaccggctacgtgcgcttcatgaatgaaagaagagagcagctgcgggccaagaggcctgaggtgcccttccctgagatcaccaggatgctgggcaatgagtggagcaagctgcccccagaggagaagcagcgctacctggatgaggcctag

SEQ ID NO: 155251 - DNA, 303 bp, Artificial Sequence
  Description of Artificial Sequence: Synthetic coding sequence
atggagaacctgatgaccagcagcaccctgccccccctgtttgctgatgaagatggcagcaaggagagcaatgacctggccaccaccggcctgaaccaccctgaggtgccctacagcagcggggccaccagcagcaccaacaaccctgagtttgtggaggacctgagccagggccagctgctgcagagcgagagcagcaatgctgctgagggcaatgagcagagacatgaagatgagcagaggagcaagagaggaggctggagcaaaggaaggaagaggaagaagcccctgcgggacagctag

SEQ ID NO: 155252 - DNA, 489 bp, Artificial Sequence
  Description of Artificial Sequence: Synthetic coding sequence
atggagaacctgatgaccagcagcaccctgccccccctgtttgctgatgaagatggcagcaaggagagcaatgacctggccaccaccggcctgaaccaccctgaggtgccctacagcagcggggccaccagcagcaccaacaaccctgagtttgtggaggacctgagccagggccagctgctgcagagcgagagcagcaatgctgctgagggcaatgagcagagacatgaagatgagcagaggagcaagagaggaggctggagcaaaggaaggaagaggaagaagcccctgcgggacagcaatgcccccaagagccccctgaccggctacgtgcgcttcatgaatgaaagaagagagcagctgcgggccaagaggcctgaggtgcccttccctgagatcaccaggatgctgggcaatgagtggagcaagctgcccccagaggagaagcagcgctacctggatgaggccgaccgggacaaggagaggtag

SEQ ID NO: 155253 - DNA, 954 bp, Artificial Sequence
  Description of Artificial Sequence: Synthetic coding sequence
atgagccacggccccaagcagcccggggctgctgctgccccagctgggggcaaggcccctggccagcacggcggctttgtggtgacagtgaagcaggagcggggggagggcccccgggccggggagaagggcagccatgaggaggagcctgtgaagaagaggggctggcccaagggcaagaagaggaagaagatcctgcccaacggccccaaggcccctgtgacaggctacgtgcgcttcctgaatgaaagaagagagcagatccgcaccaggcacccagacctgcccttccctgagatcaccaagatgctgggcgctgagtggagcaagctgcagcccacagagaagcagcgctacctggatgaagctgagcgggagaagcagcagtacatgaaggagctgcgggcctaccagcagagcgaggcctacaagatgtgcacagagaagatccaggagaagaagatcaagaaggaggacagcagcagcggcctgatgaacaccctgctgaatggccacaagggcggggactgtgatggcttcagcacctttgatgtgcccatcttcacagaggagttcctggaccagaacaaggcccgggaggccgagctgcggcggctgaggaagatgaatgtggcctttgaggagcagaatgctgtgctgcagaggcacacccagagcatgagcagcgcccgggagcggctggagcaggagctggccctggaggagaggaggaccctggccctgcagcagcagctgcaggccgtgcggcaggccctgacagccagctttgccagcctgcctgtgcccggcactggagagacccccaccctgggcaccctggacttctacatggcccggctgcacggggccatcgagcgggaccctgcccagcacgagaagctgattgtgcgcatcaaggagatcctggcccaggtggccagcgagcacctgtag

SEQ ID NO: 155254 - DNA, 807 bp, Artificial Sequence
  Description of Artificial Sequence: Synthetic coding sequence
atggacaccagggtgggcacagccatggccagcccccccagcatgttccccagcagcctgaagagctcctggaccaagaccaagagggtgagaagaagctttggagcagaagatgaatgtggcctgcggggagctgagcggggcacagctgaggcccacgccgagcacgagcagagggcccgggccagcggggccggggccggggccggcggcgcagaagatgctggagctgctgctgctgcccctggccgggcccctggggcccaccggcagctgcggctgacagctggggccggccacggcagaaatgcccacgccggccacagcggcctgctgcacggccctgccagccgcagccaccgggcccggcccaggcctgcccgggaggcccaccggccccaccagggcaaccctggccctggccggcagagggcccctgtgcgcagcggccgggcccatgatgctgaggagaagctgtgggcccggccctgccacaccccaccccggggccgggaggccggcggccccccaggccctggccccatcctgcacctgggcggcagcagcccccccaagatcaagttcctgcagcaccccttctccttccagagcccccagcccccagagcccgggaagagcacccgggacacccccaggaggaccagccagccccgggtgcccctgctgggcggccagacccgctacacaggcagccctggccacccccaggacaccggccagaccaagcccacccccagcacccggcaggacccccccaactacagcctgcggggagctgtgccctag

SEQ ID NO: 155255 - DNA, 648 bp, Artificial Sequence
  Description of Artificial Sequence: Synthetic coding sequence
atgagccacggccccaagcagcccggggctgctgctgccccagctgggggcaaggcccctggccagcacggcggctttgtggtgacagtgaagcaggagcggggggagggcccccgggccggggagaagggcagccatgaggaggagcctgtgaagaagaggggctggcccaagggcaagaagaggaagaagatcctgcccaacggccccaaggcccctgtgacaggctacgtgcgcttcctgaatgaaagaagagagcagatccgcaccaggcacccagacctgcccttccctgagatcaccaagatgctgggcgctgagtggagcaagctgcagcccacagagaagcagcgctacctggatgaagctgagcgggagaagcagcagtacatgaaggagctgcgggcctaccagcagagcgaggcctacaagatgtgcacagagaagatccaggagaagaagatcaagaaggaggacagcagcagcggcctgatgaacaccctgctgaatggccacaagggcggggactgtgatggcttcagcacctttgatgtgcccatcttcacagaggagttcctggaccagaacaaggcccgggaggccgagctgcggcggctgaggaagatgaatgtggcctttgaggagtag

SEQ ID NO: 155256 - DNA, 429 bp, Artificial Sequence
  Description of Artificial Sequence: Synthetic coding sequence
atgagccacggccccaagcagcccggggctgctgctgccccagctgggggcaaggcccctggccagcacggcggctttgtggtgacagtgaagcaggagcggggggagggcccccgggccggggagaagggcagccatgaggaggagcctgtgaagaagaggggctggcccaagggcaagaagaggaagaagatcctgcccaacggccccaaggcccctgtgacaggctacgtgcgcttcctgaatgaaagaagagagcagatccgcaccaggcacccagacctgcccttccctgagatcaccaagatgctgggcgctgagtggagcaagctgcagcccacagagaagcagcgctacctggatgaagctgagcgggagaagcagcagtacatgaaggagctgcgggcctaccagcagagcgaggcctag

SEQ ID NO: 155257 - DNA, 324 bp, Artificial Sequence
  Description of Artificial Sequence: Synthetic coding sequence
atgtctgagagcagcagcaagagcagccagcccctggccagcaagcaggagaaggatggaacagagaagaggggccggggccggcccaggaagcagccccctgtgtccccaggcacagccctggtgggcagccagaaggagcccagcgaggtgcccacccccaagaggccccggggccggcccaagggcagcaagaacaagggagctgccaagaccaggaagaccaccaccaccccaggcaggaagccccggggccggcccaagaagctggagaaggaggaggaggagggcatcagccaggagagcagcgaggaggagcagtag

SEQ ID NO: 155258 - DNA, 291 bp, Artificial Sequence
  Description of Artificial Sequence: Synthetic coding sequence
atgtctgagagcagcagcaagagcagccagcccctggccagcaagcaggagaaggatggaacagagaagaggggccggggccggcccaggaagcagccccccaaggagcccagcgaggtgcccacccccaagaggccccggggccggcccaagggcagcaagaacaagggggccgccaagaccaggaagaccaccaccaccccaggcaggaagccccggggccggcccaagaagctggagaaggaggaggaggagggcatcagccaggagagcagcgaggaggagcagtag

SEQ ID NO: 155259 - DNA, 291 bp, Artificial Sequence; identical to SEQ ID NO: 155258
  Description of Artificial Sequence: Synthetic coding sequence

SEQ ID NO: 155260 - DNA, 324 bp, Artificial Sequence; identical to SEQ ID NO: 155257
  Description of Artificial Sequence: Synthetic coding sequence

SEQ ID NO: 155261 - DNA, 291 bp, Artificial Sequence; identical to SEQ ID NO: 155258
  Description of Artificial Sequence: Synthetic coding sequence

SEQ ID NO: 155262 - DNA, 987 bp, Artificial Sequence
  Description of Artificial Sequence: Synthetic coding sequence
atgtctgagagcagcagcaagagcagccagcccctggccagcaagcaggagaaggatggaacagagaagaggggccggggccggcccaggaagcagccccctgtgtccccaggcacagccctggtgggcagccagaaggagcccagcgaggtgcccacccccaagaggccccggggccggcccaagggcagcaagaacaagggggagggcggccggggcggccacctggccggcgtgctgggcggcggcgctgtgacccacgcctgccgcctgctgctgaccggcggggccgccagcttctgggactggacagccctgctgcggagccaccggccccaccccttcccccggcccaccatcaccacagccagcggccgccacccccacctgccccctgtgcccagccccccccactacacagcccaccagcccctgcagggcagccacggcctgagcggggagcagttcagccctggcctgagcagccagctgcccccacccacccacgcctacacccacgccctgctggacaaggccaacatccccctgagcaggaccctgcacctgctgcggccccacagcctgggcggcggggacatcgccctgtgggccttcggcctgggcgcccccagcctgctgctgcactgcagcctgtggctgcccatcgtgggccctggccgggtgcccctggccctgaagggggcccaggcccccagccaccctggcaccccctacagcacagccctggccgccgccggcgtggccaacggcggcggctgctggcccccaggcttcccccagcccaactgcctgtgccaccacgtgggcctgaccttccaccccagccccaccagcctggtgcctgtgctgggctggacagcccccttcggctacaggaaggccggcggcgtgagccccctgctgcccctgcactgcggccacagccccctggccctgcggctgggcagcgagtacatcctgtggtag

SEQ ID NO: 155263 - DNA, 291 bp, Artificial Sequence; identical to SEQ ID NO: 155258
  Description of Artificial Sequence: Synthetic coding sequence

SEQ ID NO: 155264 - DNA, 324 bp, Artificial Sequence; identical to SEQ ID NO: 155257
  Description of Artificial Sequence: Synthetic coding sequence

SEQ ID NO: 155265 - DNA, 321 bp, Artificial Sequence
  Description of Artificial Sequence: Synthetic coding sequence
atgtctgcccggggggagggcgccggccagcccagcaccagcgcccagggccagcctgctgccccagccccccagaagaggggccggggccggcccaggaagcagcagcaggagcccaccggggagcccagccccaagaggccccggggccggcccaagggcagcaagaacaagagccccagcaaggccgcccagaagaaggccgaggccactggagagaagaggccccggggccggcccaggaagtgggacaacctgctgcccaggaccagcagcaagaagaagaccagcctgggcaacagcaccaagaggagccactag

SEQ ID NO: 155266 - DNA, 357 bp, Artificial Sequence
  Description of Artificial Sequence: Synthetic coding sequence
atgtctgcccggggggagggcgccggccagcccagcaccagcgcccagggccagcctgctgccccagccccccagaagaggggccggggccggcccaggaagcagcagcaggagcccaccggggagcccagccccaagaggccccggggccggcccaagggcagcaagaacaagagccccagcaaggccgcccagaagaaggccgaggccactggagagaagaggccccggggccggcccaggaagtggccccagcaggtggtgcagaagaagccagcccaggtgaatgtggccctgcccgggaaggaccaccctggcaacctgatctacctgctcttcagcaagaatgccacctag

SEQ ID NO: 155267 - DNA, 273 bp, Artificial Sequence
  Description of Artificial Sequence: Synthetic coding sequence
atgtctgcccggggggagggcgccggccagcccagcaccagcgcccagggccagcctgctgccccagccccccagaagaggggccggggccggcccaggaagcagcagcaggagcccaccggggagcccagccccaagaggccccggggccggcccaagggcagcaagaacaagagccccagcaaggccgcccagaagaaggccgaggccactggagagaagaggccccggggccggcccaggaagtgggaggagttctacatcgccgcctag

SEQ ID NO: 155268 - DNA, 330 bp, Artificial Sequence
  Description of Artificial Sequence: Synthetic coding sequence
atgtctgcccggggggagggcgccggccagcccagcaccagcgcccagggccagcctgctgccccagccccccagaagaggggccggggccggcccaggaagcagcagcaggagcccaccggggagcccagccccaagaggccccggggccggcccaagggcagcaagaacaagagccccagcaaggccgcccagaagaaggccgaggccactggagagaagaggccccggggccggcccaggaagtggccccagcaggtggtgcagaagaagccagcccaggaggagacagaggagaccagcagccaggagagcgctgaggaggactag

SEQ ID NO: 155269 - DNA, 279 bp, Artificial Sequence
  Description of Artificial Sequence: Synthetic coding sequence
atgtctgcccggggggagggcgccggccagcccagcaccagcgcccagggccagcctgctgccccagccccccagaagaggggccggggccggcccaggaagcagcagcaggagcccaccggggagcccagccccaagaggccccggggccggcccaagggcagcaagaacaagagccccagcaaggccgcccagaagaaggccgaggccactggagagaagaggccccggggccggcccaggaagtggtggctgctgatgaagagcccctgctggtag

SEQ ID NO: 155270 - DNA, 312 bp, Artificial Sequence
  Description of Artificial Sequence: Synthetic coding sequence
atgtctgcccggggggagggcgccggccagcccagcaccagcgcccagggccagcctgctgccccagccccccagaagaggggccggggccggcccaggaagcagcagcaggagcccaccggggagcccagccccaagaggccccggggccggcccaagggcagcaagaacaagagccccagcaaggccgcccagaagaaggccgaggccactggagagaagaggccccggggccggcccaggaagtggctgcgggcccaggccctggacagtgatggcctgggcagcaacagcggccccagcctgtcctag

SEQ ID NO: 155271 - DNA, 261 bp, Artificial Sequence
  Description of Artificial Sequence: Synthetic coding sequence
atgtctgcccggggggagggcgccggccagcccagcaccagcgcccagggccagcctgctgccccagccccccagaagaggggccggggccggcccaggaagcagcagcaggagcccaccggggagcccagccccaagaggccccggggccggcccaagggcagcaagaacaagagccccagcaaggccgcccagaagaaggccgaggccactggagagaagaggccccggggccggcccaggaagtggctgcagaactag

SEQ ID NO: 155272 - DNA, 300 bp, Artificial Sequence
  Description of Artificial Sequence: Synthetic coding sequence
atgtctgcccggggggagggcgccggccagcccagcaccagcgcccagggccagcctgctgccccagccccccagaagaggggccggggccggcccaggaagcagcagcaggagcccaccggggagcccagccccaagaggccccggggccggcccaagggcagcaagaacaagagccccagcaaggccgcccagaagaaggccgaggccactggagagaagaggccccggggccggcccaggaagtggccccagcaggtggtgcagaagaagccagcccaggtgcgccacagccactag

SEQ ID NO: 155273 - DNA, 477 bp, Artificial Sequence
  Description of Artificial Sequence: Synthetic coding sequence
atgggcaaaggagaccccaagaagccccggggcaagatgagcagctatgccttctttgtgcagacctgccgggaggagcacaagaagaagcacccagatgcctctgtgaacttcagcgagttcagcaagaagtgcagcgagcgctggaagaccatgtctgccaaggagaagggcaagtttgaggacatggccaaggctgacaaggcccgctatgagcgggagatgaagacctacatcccccccaagggggagaccaagaagaagttcaaggaccccaatgcccccaagaggcctcccagcgccttcttcctgttctgcagcgagtaccggcccaagatcaagggggagcaccctggcctgagcattggagatgtggccaagaagctgggggagatgtggaacaacacagctgctgatgacaagcagccctatgagaagaaggccgccaagctgaaggagaagtatgagaagttctag

SEQ ID NO: 155274 - DNA, 648 bp, Artificial Sequence
  Description of Artificial Sequence: Synthetic coding sequence
atgggcaaaggagaccccaagaagccccggggcaagatgagcagctatgccttctttgtgcagacctgccgggaggagcacaagaagaagcacccagatgcctctgtgaacttcagcgagttcagcaagaagtgcagcgagcgctggaagaccatgtctgccaaggagaagggcaagtttgaggacatggccaaggctgacaaggcccgctatgagcgggagatgaagacctacatcccccccaagggggagaccaagaagaagttcaaggaccccaatgcccccaagaggcctcccagcgccttcttcctgttctgcagcgagtaccggcccaagatcaagggggagcaccctggcctgagcattggagatgtggccaagaagctgggggagatgtggaacaacacagctgctgatgacaagcagccctatgagaagaaggccgccaagctgaaggagaagtatgagaaggacattgctgcctaccgggccaagggcaagccagatgctgccaagaagggcgtggtgaaggccgagaagagcaagaagaagaaggaggaggaggaggatgaggaggatgaagaagatgaggaggaggaggaggatgaggaggatgaagatgaggaggaggatgatgatgatgaatag

SEQ ID NO: 155275 - DNA, 648 bp, Artificial Sequence; identical to SEQ ID NO: 155274
  Description of Artificial Sequence: Synthetic coding sequence

SEQ ID NO: 155276 - DNA, 294 bp, Artificial Sequence
  Description of Artificial Sequence: Synthetic coding sequence
atgggcaaaggagaccccaagaagccccggggcaagatgagcagctatgccttctttgtgcagacctgccgggaggagcacaagaagaagcacccagatgcctctgtgaacttcagcgagttcagcaagaagtgcagcgagcgctggaagaccatgtctgccaaggagaagggcaagtttgaggacatggccaaggctgacaaggcccgctatgagcgggagatgaagacctacatcccccccaagggggagaccaagaagaagttcaaggaccccaatgcccccaagaggtag

SEQ ID NO: 155277 - DNA, 477 bp, Artificial Sequence; identical to SEQ ID NO: 155273
  Description of Artificial Sequence: Synthetic coding sequence

SEQ ID NO: 155278 - DNA, 648 bp, Artificial Sequence; identical to SEQ ID NO: 155274
  Description of Artificial Sequence: Synthetic coding sequence

SEQ ID NO: 155279 - DNA, 648 bp, Artificial Sequence; identical to SEQ ID NO: 155274
  Description of Artificial Sequence: Synthetic coding sequence

SEQ ID NO: 155280 - DNA, 489 bp, Artificial Sequence
  Description of Artificial Sequence: Synthetic coding sequence
atgggcaaaggagaccccaagaagccccggggcaagatgagcagctatgccttctttgtgcagacctgccgggaggagcacaagaagaagcacccagatgcctctgtgaacttcagcgagttcagcaagaagtgcagcgagcgctggaagaccatgtctgccaaggagaagggcaagtttgaggacatggccaaggctgacaaggcccgctatgagcgggagatgaagacctacatcccccccaagggggagaccaagaagaagttcaaggaccccaatgcccccaagaggcctcccagcgccttcttcctgttctgcagcgagtaccggcccaagatcaagggggagcaccctggcctgagcattggagatgtggccaagaagctgggggagatgtggaacaacacagctgctgatgacaagcagccctatgagaagatcctgctgcacatcgagctgaaggagagcctgatgcagcagaagaggtag

SEQ ID NO: 155281 - DNA, 630 bp, Artificial Sequence
  Description of Artificial Sequence: Synthetic coding sequence
atgggcaaaggagaccccaacaagccccggggcaagatgagcagctatgccttctttgtgcagacctgccgggaggagcacaagaagaagcacccagacagctctgtgaactttgctgagttcagcaagaagtgcagcgagcgctggaagaccatgtctgccaaggagaagagcaagtttgaggacatggccaagagtgacaaggcccgctatgaccgggagatgaagaactacgtgccccccaagggggacaagaagggcaagaagaaggaccccaatgcccccaagaggcctcccagcgccttcttcctgttctgcagcgagcaccggcccaagatcaagtctgagcaccctggcctgagcatcggggacacagccaagaagctgggggagatgtggagcgagcagagcgccaaggacaagcagccctatgagcagaaggccgccaagctgaaggagaagtatgagaaggacattgctgcctaccgggccaagggcaagtctgaggccggcaagaagggccctggccggcccaccggcagcaagaagaagaatgaaccagaagatgaggaggaggaggaggaggaggaggatgaagatgaggaggaggaggatgaagatgaggagtag

SEQ ID NO: 155282 - DNA, 630 bp, Artificial Sequence; identical to SEQ ID NO: 155281
  Description of Artificial Sequence: Synthetic coding sequence

SEQ ID NO: 155283 - DNA, 630 bp, Artificial Sequence; identical to SEQ ID NO: 155281
  Description of Artificial Sequence: Synthetic coding sequence

SEQ ID NO: 155284 - DNA, 405 bp, Artificial Sequence
  Description of Artificial Sequence: Synthetic coding sequence
atgggcaaaggagaccccaacaagccccggggcaagatgagcagctatgccttctttgtgcagacctgccgggaggagcacaagaagaagcacccagacagctctgtgaactttgctgagttcagcaagaagtgcagcgagcgctggaagaccatgtctgccaaggagaagagcaagtttgaggacatggccaagagtgacaaggcccgctatgaccgggagatgaagaactacgtgccccccaagggggacaagaagggcaagaagaaggaccccaatgcccccaagaggcctcccagcgccttcttcctgttctgcagcgagcaccggcccaagatcaagtctgagcaccctggcctgagcatcggggacacagccaagaagctgggggagatgtggagctag

SEQ ID NO: 155285 - DNA, 603 bp, Artificial Sequence
  Description of Artificial Sequence: Synthetic coding sequence
atggccaagggggaccccaagaagcccaagggcaagatgtctgcctatgccttctttgtgcagacctgccgggaggagcacaagaagaagaaccctgaggtgcctgtgaactttgctgagttcagcaagaagtgcagcgagcgctggaagaccatgtctgggaaggagaagagcaagtttgatgagatggccaaggctgacaaggtgcgctatgaccgggagatgaaggactatggccctgccaagggcggcaagaagaagaaggaccccaatgcccccaagaggcctcccagcggcttcttcctgttctgcagcgagttccggcccaagatcaagagcaccaaccctggcatcagcattggagatgtggccaagaagctgggggagatgtggaacaacctgaatgattctgagaagcagccctacatcaccaaggccgccaagctgaaggagaagtatgagaaggatgtggccgactacaagagcaagggcaagtttgatggagccaagggccctgccaaggtggccaggaagaaggtggaggaggaggatgaggaggaggaggaggaggaggaggaggaggaggaggaggaggatgaatag

SEQ ID NO: 155286 - DNA, 567 bp, Artificial Sequence
  Description of Artificial Sequence: Synthetic coding sequence
atggccaagggggaccccaagaagcccaagggcaagatgtctgcctatgccttctttgtgcagacctgccgggaggagcacaagaagaagaaccctgaggtgcctgtgaactttgctgagttcagcaagaagtgcagcgagcgctggaagaccatgtctgggaaggagaagagcaagtttgatgagatggccaaggctgacaaggtgcgctatgaccgggagatgaaggactatggccctgccaagggcggcaagaagaagaaggaccccaatgcccccaagaggcctcccagcggcttcttcctgttctgcagcgagttccggcccaagatcaagagcaccaaccctggcatcagcattggagatgtggccaagaagctgggggagatgtggaacaacctgaatgattctgagaagcagccctacatcaccaaggccgccaagctgaaggagaagtatgagaaggatgtggccgactacaagagcaagggcaagtttgatggagccaagggccctgccaaggtggccaggaagaaggtggaggaggaggatgaggaggaggagtag

SEQ ID NO: 155287 - DNA, 462 bp, Artificial Sequence
  Description of Artificial Sequence: Synthetic coding sequence
atggccaagggggaccccaagaagcccaagggcaagatgtctgcctatgccttctttgtgcagacctgccgggaggagcacaagaagaagaaccctgaggtgcctgtgaactttgctgagttcagcaagaagtgcagcgagcgctggaagaccatgtctgggaaggagaagagcaagtttgatgagatggccaaggctgacaaggtgcgctatgaccgggagatgaaggactatggccctgccaagggcggcaagaagaagaaggaccccaatgcccccaagaggcctcccagcggcttcttcctgttctgcagcgagttccggcccaagatcaagagcaccaaccctggcatcagcattggagatgtggccaagaagctgggggagatgtggaacaacctgaatgattctgagaagcagccctacatcaccaaggccgccaagctgaaggagaagtactag

SEQ ID NO: 155288 - DNA, 603 bp, Artificial Sequence; identical to SEQ ID NO: 155285
  Description of Artificial Sequence: Synthetic coding sequence

SEQ ID NO: 155289 - DNA, 582 bp, Artificial Sequence
  Description of Artificial Sequence: Synthetic coding sequence
atggccaagggggaccccaagaagcccaagggcaagatgtctgcctatgccttctttgtgcagacctgccgggaggagcacaagaagaagaaccctgaggtgcctgtgaactttgctgagttcagcaagaagtgcagcgagcgctggaagaccatgtctgggaaggagaagagcaagtttgatgagatggccaaggctgacaaggtgcgctatgaccgggagatgaaggactatggccctgccaagggcggcaagaagaagaaggaccccaatgcccccaagaggcctcccagcggcttcttcctgttctgcagcgagttccggcccaagatcaagagcaccaaccctggcatcagcattggagatgtggccaagaagctgggggagatgtggaacaacctgaatgattctgagaagcagccctacatcaccaaggccgccaagctgaaggagaagtatgagaaggatgtggccgactacaagagcaagggcaagtttgatggagccaagggccctgccaaggtggccaggaagaaggtggaggaggaggatgaggaggaggaggaggaggaggaggagtag

SEQ ID NO: 155290 - DNA, 273 bp, Artificial Sequence
  Description of Artificial Sequence: Synthetic coding sequence
atgcccaagaggaaggccgagggagatgccaagggggacaaggccaaggtgaaggatgagccccagaggagaagtgcccggctgagcgccaagccagccccacccaagccagagcccaagcccaagaaggccccagccaagaagggggagaaggtgcccaagggcaagaagggcaaggcagatgctgggaaggagggcaacaacccagcagaaaatggagatgccaagacagaccaggcccagaaggccgagggcgctggagatgccaagtag

SEQ ID NO: 155291 - DNA, 234 bp, Artificial Sequence
  Description of Artificial Sequence: Synthetic coding sequence
atgcccaagaggaagagccctgagaacacagagggcaaggatggcagcaaggtgaccaagcaggagcccaccaggagaagtgcccggctgagcgccaagccagccccacccaagccagagcccaagcccaggaagaccagcgccaagaaggagcccggggccaagatcagcagaggagccaagggcaagaaggaggagaagcaggaggccggcaaggagggcacagagaactag

SEQ ID NO: 155292 - DNA, 300 bp, Artificial Sequence
  Description of Artificial Sequence: Synthetic coding sequence
atgcccaagaggaagagccctgagaacacagagggcaaggatggcagcaaggtgaccaagcaggagcccaccaggagaagtgcccggctgagcgccaagccagccccacccaagccagagcccaagcccaggaagaccagcgccaagaaggagcccggggccaagatcagcagaggagccaagggcaagaaggaggagaagcaggaggccggcaaggagggcacagcccccagtgaaaatggagagaccaaggccgaggaggcccagaagacagaatctgtggacaatgaaggagagtag

SEQ ID NO: 155293 - DNA, 507 bp, Artificial Sequence
  Description of Artificial Sequence: Synthetic coding sequence
atggtgctcttcttccgcatcaacctgcagaccaagaagtgcaagcagaagggcaaaggagagcagcgggagaaccggcccaagtggctgaccaagaagctgaagaagacctacctgaggaagacaggcaagaggcggctgcggcgggtgcagcccctgatgaagcaggagaggaagaagcccagcctcatcaacaaccacatcccctgcctgatcagcggcccctgcctgcccagctgcaccatccagaggaacatcttcatcaactactttgtgaatgccagcttcctggtggccctggagaccttcctgcggcggcgggagagccacctgatccccttcttcaagtgcaagtgcttcttcctgcggggggagatcatctgctggctgttcatcttctggtacaaccagaagatcgtgtgggacatcgagctgtgggaggccctgactgtgtctggagtgtccctgaccttccaccgctggggcgtgtccttctacatcctgtag

SEQ ID NO: 155294 - DNA, 303 bp, Artificial Sequence
  Description of Artificial Sequence: Synthetic coding sequence
atgcccaagaggaaggtgagcagcgctgagggcgccgccaaggaggagcccaagagaagaagtgcccggctgagcgccaagcccccagccaaggtggaggccaagcccaagaaggccgccgccaaggacaagagcagtgacaagaaggtgcagaccaagggcaagagaggagccaagggcaagcaggccgaggtggccaaccaggagaccaaggaggacctgcctgcagaaaatggagagaccaagacagaggagagccctgccagtgatgaggccggggagaaggaggccaagagtgactag

SEQ ID NO: 155295 - DNA, 582 bp, Artificial Sequence
  Description of Artificial Sequence: Synthetic coding sequence
atgggcaagcagaacagcaagctgcggcctgagatgctgcaggacctgcgggagaacacagagttcagcgagctggagctgcaggagtggtacaagggcttcctgaaggactgccccaccggcatcctgaatgtggatgagttcaagaagatctatgccaacttcttcccctatggagatgccagcaagtttgctgagcacgtgttccgcacctttgacaccaacagtgatggcaccatcgacttccgggagttcatcatcgccctgtctgtgaccagccggggccgcctggagcagaagctgatgtgggccttctccatgtatgacctggatggaaatggctacatcagccgggaggagatgctggagatcgtgcaggccatctacaagatggtgtcctctgtgatgaagatgccagaagatgagagcaccccagagaagaggacagagaagatcttccggcagatggacaccaacaatgatggcaagctgagcctggaggagttcatccggggggccaagagtgaccccagcatcgtgcggctgctgcagtgtgaccccagcagcgccagccagttctag

SEQ ID NO: 155296 - DNA, 582 bp, Artificial Sequence
  Description of Artificial Sequence: Synthetic coding sequence
atgggcaagcagaacagcaagctgcggcctgaggtgctgcaggacctgcgggagaacacagagttcacagaccacgagctgcaggagtggtacaagggcttcctgaaggactgccccaccggccacctgactgtggatgagttcaagaagatctatgccaacttcttcccctatggagatgccagcaagtttgctgagcacgtgttccgcacctttgacaccaatggagatggcaccatcgacttccgggagttcatcatcgccctgtctgtgaccagccggggcaagctggagcagaagctgaagtgggccttctccatgtatgacctggatggaaatggctacatcagccgctctgagatgctggagatcgtgcaggccatctacaagatggtgtcctctgtgatgaagatgccagaagatgagagcaccccagagaagaggacagacaagatcttccggcagatggacaccaacaatgatggcaagctgagcctggaggagttcatccggggggccaagagtgaccccagcatcgtgcggctgctgcagtgtgaccccagcagcgccagccagttctag

SEQ ID NO: 155297 - DNA, 582 bp, Artificial Sequence; identical to SEQ ID NO: 155296
  Description of Artificial Sequence: Synthetic coding sequence

SEQ ID NO: 155298 - DNA, 93 bp, Artificial Sequence
  Description of Artificial Sequence: Synthetic coding sequence
atgggcaagcagaacagcaagctgcggcctgaggtgctgcaggacctgcgggagaacacagagttcacagaccacgagctgcaggagtggtag

SEQ ID NO: 155299 - DNA, 3054 bp, Artificial Sequence
  Description of Artificial Sequence: Synthetic coding sequence
atgaagctgctgaagcccacctgggtgaaccacaacgggaagcccatcttctctgtggacatccacccagatggcaccaagtttgccaccggcggccagggccaggacagcggcaaggtggtgatctggaacatgagccctgtgctgcaggaggatgatgagaaggatgagaacatccccaagatgctgtgccagatggacaaccacctggcctgtgtgaactgtgtgcgctggagcaacagcggcatgtacctggccagcggaggagatgacaagctgatcatggtgtggaagagggccacctacatcggccccagcacagtgtttggcagcagcggcaagctggccaacgtggagcagtggaggtgtgtgtccatcctgaggaaccacagcggagatgtgatggatgtggcctggagcccccatgatgcctggctggccagctgcagcgtggacaacacagtggtgatctggaatgctgtgaagtttcctgagatcctggccaccctgcggggccacagcggcctggtgaagggcctgacctgggaccctgtgggcaagtacatcgccagccaggctgatgacaggagcctgaaggtgtggaggaccctggactggcagctggagaccagcatcaccaagccctttgatgaatgtggcggcaccacccacgtgctgcggctgtcctggagcccagatggccactacctggtgtctgcccacgccatgaacaacagcggccccacagcccagatcatcgagcgggagggctggaagaccaacatggactttgtgggccacaggaaggctgtgacagtggtgaagttcaaccccaagatcttcaagaagaagcagaagaatggcagcagcgccaagcccagctgcccctactgctgctgtgctgtgggcagcaaggacaggagcctgtctgtgtggctgacctgcctgaagaggcccctggtggtgatccacgagctgtttgacaagagcatcatggacatctcctggaccctgaatggcctgggcatcctggtgtgcagcatggatggctctgtggccttcctggacttcagccaggatgagctgggggaccccctgtctgaggaggagaagagccgcatccaccagagcacctacggcaagagcctggccatcatgacagaggcccagctgagcacagctgtgattgaaaatcctgagatgctgaagtaccagaggcggcagcagcagcagcagctggaccagaagtctgctgccacccgggagatgggcagcgccacctctgtggccggcgtggtgaatggagagagcctggaggacatcaggaagaacctgctgaagaagcaggtggagaccaggacagcagatggaagaagacgcatcacccccctgtgcatcgcccagctggacacaggagacttcagcacagccttcttcaacagcatccccctgagcggcagcctggccggcaccatgctgagcagccacagcagcccccagctgctgcccctggacagcagcacccccaacagctttggagccagcaagccctgcacagagcctgtggtggccgccagcgcccggcctgctggggacagcgtgaacaaggacagcatgaatgccaccagcaccccagctgccctgagccccagcgtgctgaccacccccagcaagattgagcccatgaaggcctttgacagccgcttcacagagaggagcaaggccacccctggggccccagccctgacctccatgacccccacagctgtggagcggctgaaggagcagaacctggtgaaggagctgcggccccgggacctgctggagagcagcagtgacagtgatgagaaggtgcccctggccaaggccagcagcctgagcaagaggaagctggagctggaggtggagaccgtggagaagaagaagaagggccggcccaggaaggacagccggctgatgcctgtgtccctgtctgtgcagagccctgctgccctgacagctgagaaggaggccatgtgcctgagcgccccagccctggccctgaagctgcccatccccagcccccagagggccttcaccctgcaggtgtccagtgaccccagcatgtacatcgaggtggagaatgaggtgacagtggtgggcggcgtgaagctgagccggctgaagtgcaaccgggagggcaaggagtgggagaccgtgctgaccagccgcatcctgacagctgctggcagctgtgatgtggtgtgtgtggcctgtgagaagaggatgctgagcgtcttcagcacctgtggccgccgcctgctgagccccatcctgctgcccagccccatcagcaccctgcactgcaccggcagctatgtgatggccctgacagctgctgccaccctgtctgtgtgggatgtgcaccggcaggtggtggtggtgaaggaggagagcctgcacagcatcctggccggcagtgacatgacagtgtcccagatcctgctgacccagcacggcatccctgtgatgaacctgagtgatggcaaggcctactgcttcaaccccagcctgagcacctggaacctggtgtctgacaagcaggacagcctggcccagtgtgccgacttccgcagcagcctgcccagccaggatgccatgctgtgcagcggccccctggccatcatccagggccgcaccagcaacagcggccggcaggccgcccggctcttctctgtgccccacgtggtgcagcaggagaccaccctggcctacctggagaaccaggtggccgccgccctgaccctgcagagcagccatgagtaccgccactggctgctggtgtatgcccgctacctggtgaatgaaggatttgagtaccgcctgcgggagatctgcaaggacctgctgggccctgtgcactacagcacaggcagccagtgggagagcacagtggtgggcctgaggaagcgggagctgctgaaggagctgctgcccgtcatcggccagaacctgcgcttccagaggctcttcacagagtgccaggagcagctggacatcctgcgggacaagtag

SEQ ID NO: 155300 - DNA, 2433 bp, Artificial Sequence
  Description of Artificial Sequence: Synthetic coding sequence
atgaagctgctgaagcccacctgggtgaaccacaacgggaagcccatcttctctgtggacatccacccagatggcaccaagtttgccaccggcggccagggccaggacagcggcaaggtggtgatctggaacatgagccctgtgctgcaggaggatgatgagaaggatgagaacatccccaagatgctgtgccagatggacaaccacctggcctgtgtgaactgtgtgcgctggagcaacagcggcatgtacctggccagcggaggagatgacaagctgatcatggtgtggaagagggccacctacatcggccccagcacagtgtttggcagcagcggcaagctggccaacgtggagcagtggaggtgtgtgtccatcctgaggaaccacagcggagatgtgatggatgtggcctggagcccccatgatgcctggctggccagctgcagcgtggacaacacagtggtgatctggaatgctgtgaagtttcctgagatcctggccaccctgcggggccacagcggcctggtgaagggcctgacctgggaccctgtgggcaagtacatcgccagccaggctgatgacaggagcctgaaggtgtggaggaccctggactggcagctggagaccagcatcaccaagccctttgatgaatgtggcggcaccacccacgtgctgcggctgtcctggagcccagatggccactacctggtgtctgcccacgccatgaacaacagcggccccacagcccagatcatcgagcgggagggctggaagaccaacatggactttgtgggccacaggaaggctgtgacagtggtgaagttcaaccccaagatcttcaagaagaagcagaagaatggcagcagcgccaagcccagctgcccctactgctgctgtgctgtgggcagcaaggacaggagcctgtctgtgtggctgacctgcctgaagaggcccctggtggtgatccacgagctgtttgacaagagcatcatggacatctcctggaccctgaatggcctgggcatcctggtgtgcagcatggatggctctgtggccttcctggacttcagccaggatgagctgggggaccccctgtctgaggaggagaagagccgcatccaccagagcacctacggcaagagcctggccatcatgacagaggcccagctgagcacagctgtgattgaaaatcctgagatgctgaagtaccagaggcggcagcagcagcagcagctggaccagaagtctgctgccacccgggagatgggcagcgccacctctgtggccggcgtggtgaatggagagagcctggaggacatcaggaagaacctgctgaagaagcaggtggagaccaggacagcagatggaagaagacgcatcacccccctgtgcatcgcccagctggacacaggagacttcagcacagccttcttcaacagcatccccctgagcggcagcctggccggcaccatgctgagcagccacagcagcccccagctgctgcccctggacagcagcacccccaacagctttggagccagcaagccctgcacagagcctgtggtggccgccagcgcccggcctgctggggacagcgtgaacaaggacagcatgaatgccaccagcaccccagctgccctgagccccagcgtgctgaccacccccagcaagattgagcccatgaaggcctttgacagccgcttcacagagaggagcaaggccacccctggggccccagccctgacctccatgacccccacagctgtggagagagatgtgcaccggcaggtggtggtggtgaaggaggagagcctgcacagcatcctggccggcagtgacatgacagtgtcccagatcctgctgacccagcacggcatccctgtgatgaacctgagtgatggcaaggcctactgcttcaaccccagcctgagcacctggaacctggtgtctgacaagcaggacagcctggcccagtgtgccgacttccgcagcagcctgcccagccaggatgccatgctgtgcagcggccccctggccatcatccagggccgcaccagcaacagcggccggcaggccgcccggctcttctctgtgccccacgtggtgcagcaggagaccaccctggcctacctggagaaccaggtggccgccgccctgaccctgcagagcagccatgagtaccgccactggctgctggtgtatgcccgctacctggtgaatgaaggatttgagtaccgcctgcgggagatctgcaaggacctgctgggccctgtgcactacagcacaggcagccagtgggagagcacagtggtgggcctgaggaagcgggagctgctgaaggagctgctgcctgtgattggccagaacctgcgcttccagaggctcttcacagagtgccaggagcagctggacatcctgcgggacaagtag

SEQ ID NO: 155301 - DNA, 1815 bp, Artificial Sequence
  Description of Artificial Sequence: Synthetic coding sequence
atgctgagcagccacagcagcccccagctgctgcccctggacagcagcacccccaacagctttggagccagcaagccctgcacagagcctgtggtggccgccagcgcccggcctgctggggacagcgtgaacaaggacagcatgaatgccaccagcaccccagctgccctgagccccagcgtgctgaccacccccagcaagattgagcccatgaaggcctttgacagccgcttcacagagaggagcaaggccacccctggggccccagccctgacctccatgacccccacagctgtggagcggctgaaggagcagaacctggtgaaggagctgcggccccgggacctgctggagagcagcagtgacagtgatgagaaggtgcccctggccaaggccagcagcctgagcaagaggaagctggagctggaggtggagaccgtggagaagaagaagaagggccggcccaggaaggacagccggctgatgcctgtgtccctgtctgtgcagagccctgctgccctgacagctgagaaggaggccatgtgcctgagcgccccagccctggccctgaagctgcccatccccagcccccagagggccttcaccctgcaggtgtccagtgaccccagcatgtacatcgaggtggagaatgaggtgacagtggtgggcggcgtgaagctgagccggctgaagtgcaaccgggagggcaaggagtgggagaccgtgctgaccagccgcatcctgacagctgctggcagctgtgatgtggtgtgtgtggcctgtgagaagaggatgctgtctgtgttcagcacctgtggccggcggctgctgagccccatcctgctgcccagccccatcagcaccctgcactgcaccggcagctatgtgatggccctgacagctgctgccaccctgtctgtgtgggatgtgcaccggcaggtggtggtggtgaaggaggagagcctgcacagcatcctggccggcagtgacatgacagtgtcccagatcctgctgacccagcacggcatccctgtgatgaacctgagtgatggcaaggcctactgcttcaaccccagcctgagcacctggaacctggtgtctgacaagcaggacagcctggcccagtgtgccgacttccgcagcagcctgcccagccaggatgccatgctgtgcagcggccccctggccatcatccagggccgcaccagcaacagcggccggcaggccgcccggctcttctctgtgccccacgtggtgcagcaggagaccaccctggcctacctggagaaccaggtggccgccgccctgaccctgcagagcagccatgagtaccgccactggctgctggtgtatgcccgctacctggtgaatgaaggcagcgctgaggagggcgctgctgagggcgccgccaccagccacagagctgagccccccatcccagcccccctgcaccgggtgtctggaacagcccggcaccctgagggccaggtggcctgccccagcctgccctggctgcagcagggccagggccacaccctggccgcagatgacatgcaggaccggctgagcccagaccaggccgtgggcggcggggacacaggaagaagatgtgctgtgctgcaccagaggcagcccagcagcctgggccgctgtgccctgtgccccggcagtgacatcgccagcggcggcggcagcagcagcctgccccccagcccccgctgtggggcccgggccggggccctgccccgctgccctggggccagcaaggctgtgcccggcctgcccagccctgcccggccccagggcggccactag

SEQ ID NO: 155302 - DNA, 2922 bp, Artificial Sequence
  Description of Artificial Sequence: Synthetic coding sequence
atgagccctgtgctgcaggaggatgatgagaaggatgagaacatccccaagatgctgtgccagatggacaaccacctggcctgtgtgaactgtgtgcgctggagcaacagcggcatgtacctggccagcggaggagatgacaagctgatcatggtgtggaagagggccacctacatcggccccagcacagtgtttggcagcagcggcaagctggccaacgtggagcagtggaggtgtgtgtccatcctgaggaaccacagcggagatgtgatggatgtggcctggagcccccatgatgcctggctggccagctgcagcgtggacaacacagtggtgatctggaatgctgtgaagtttcctgagatcctggccaccctgcggggccacagcggcctggtgaagggcctgacctgggaccctgtgggcaagtacatcgccagccaggctgatgacaggagcctgaaggtgtggaggaccctggactggcagctggagaccagcatcaccaagccctttgatgaatgtggcggcaccacccacgtgctgcggctgtcctggagcccagatggccactacctggtgtctgcccacgccatgaacaacagcggccccacagcccagatcatcgagcgggagggctggaagaccaacatggactttgtgggccacaggaaggctgtgacagtggtgaagttcaaccccaagatcttcaagaagaagcagaagaatggcagcagcgccaagcccagctgcccctactgctgctgtgctgtgggcagcaaggacaggagcctgtctgtgtggctgacctgcctgaagaggcccctggtggtgatccacgagctgtttgacaagagcatcatggacatctcctggaccctgaatggcctgggcatcctggtgtgcagcatggatggctctgtggccttcctggacttcagccaggatgagctgggggaccccctgtctgaggaggagaagagccgcatccaccagagcacctacggcaagagcctggccatcatgacagaggcccagctgagcacagctgtgattgaaaatcctgagatgctgaagtaccagaggcggcagcagcagcagcagctggaccagaagtctgctgccacccgggagatgggcagcgccacctctgtggccggcgtggtgaatggagagagcctggaggacatcaggaagaacctgctgaagaagcaggtggagaccaggacagcagatggaagaagacgcatcacccccctgtgcatcgcccagctggacacaggagacttcagcacagccttcttcaacagcatccccctgagcggcagcctggccggcaccatgctgagcagccacagcagcccccagctgctgcccctggacagcagcacccccaacagctttggagccagcaagccctgcacagagcctgtggtggccgccagcgcccggcctgctggggacagcgtgaacaaggacagcatgaatgccaccagcaccccagctgccctgagccccagcgtgctgaccacccccagcaagattgagcccatgaaggcctttgacagccgcttcacagagaggagcaaggccacccctggggccccagccctgacctccatgacccccacagctgtggagcggctgaaggagcagaacctggtgaaggagctgcggccccgggacctgctggagagcagcagtgacagtgatgagaaggtgcccctggccaaggccagcagcctgagcaagaggaagctggagctggaggtggagaccgtggagaagaagaagaagggccggcccaggaaggacagccggctgatgcctgtgtccctgtctgtgcagagccctgctgccctgacagctgagaaggaggccatgtgcctgagcgccccagccctggccctgaagctgcccatccccagcccccagagggccttcaccctgcaggtgtccagtgaccccagcatgtacatcgaggtggagaatgaggtgacagtggtgggcggcgtgaagctgagccggctgaagtgcaaccgggagggcaaggagtgggagaccgtgctgaccagccgcatcctgacagctgctggcagctgtgatgtggtgtgtgtggcctgtgagaagaggatgctgagcgtcttcagcacctgtggccgccgcctgctgagccccatcctgctgcccagccccatcagcaccctgcactgcaccggcagctatgtgatggccctgacagctgctgccaccctgtctgtgtgggatgtgcaccggcaggtggtggtggtgaaggaggagagcctgcacagcatcctggccggcagtgacatgacagtgtcccagatcctgctgacccagcacggcatccctgtgatgaacctgagtgatggcaaggcctactgcttcaaccccagcctgagcacctggaacctggtgtctgacaagcaggacagcctggcccagtgtgccgacttccgcagcagcctgcccagccaggatgccatgctgtgcagcggccccctggccatcatccagggccgcaccagcaacagcggccggcaggccgcccggctcttctctgtgccccacgtggtgcagcaggagaccaccctggcctacctggagaaccaggtggccgccgccctgaccctgcagagcagccatgagtaccgccactggctgctggtgtatgcccgctacctggtgaatgaaggatttgagtaccgcctgcgggagatctgcaaggacctgctgggccctgtgcactacagcacaggcagccagtgggagagcacagtggtgggcctgaggaagcgggagctgctgaaggagctgctgcccgtcatcggccagaacctgcgcttccagaggctcttcacagagtgccaggagcagctggacatcctgcgggacaagtag

SEQ ID NO: 155303 - DNA, 2421 bp, Artificial Sequence
  Description of Artificial Sequence: Synthetic coding sequence
atgagccctgtgctgcaggaggatgatgagaaggatgagaacatccccaagatgctgtgccagatggacaaccacctggcctgtgtgaactgtgtgcgctggagcaacagcggcatgtacctggccagcggaggagatgacaagctgatcatggtgtggaagagggccacctacatcggccccagcacagtgtttggcagcagcggcaagctggccaacgtggagcagtggaggtgtgtgtccatcctgaggaaccacagcggagatgtgatggatgtggcctggagcccccatgatgcctggctggccagctgcagcgtggacaacacagtggtgatctggaatgctgtgaagtttcctgagatcctggccaccctgcggggccacagcggcctggtgaagggcctgacctgggaccctgtgggcaagtacatcgccagccaggctgatgacaggagcctgaaggtgtggaggaccctggactggcagctggagaccagcatcaccaagccctttgatgaatgtggcggcaccacccacgtgctgcggctgtcctggagcccagatggccactacctggtgtctgcccacgccatgaacaacagcggccccacagcccagatcatcgagcgggagggctggaagaccaacatggactttgtgggccacaggaaggctgtgacagtggtgaagttcaaccccaagatcttcaagaagaagcagaagaatggcagcagcgccaagcccagctgcccctactgctgctgtgctgtgggcagcaaggacaggagcctgtctgtgtggctgacctgcctgaagaggcccctggtggtgatccacgagctgtttgacaagagcatcatggacatctcctggaccctgaatggcctgggcatcctggtgtgcagcatggatggctctgtggccttcctggacttcagccaggatgagctgggggaccccctgtctgaggaggagaagagccgcatccaccagagcacctacggcaagagcctggccatcatgacagaggcccagctgagcacagctgtgattgaaaatcctgagatgctgaagtaccagaggcggcagcagcagcagcagctggaccagaagtctgctgccacccgggagatgggcagcgccacctctgtggccggcgtggtgaatggagagagcctggaggacatcaggaagaacctgctgaagaagcaggtggagaccaggacagcagatggaagaagacgcatcacccccctgtgcatcgcccagctggacacaggagacttcagcacagccttcttcaacagcatccccctgagcggcagcctggccggcaccatgctgagcagccacagcagcccccagctgctgcccctggacagcagcacccccaacagctttggagccagcaagccctgcacagagcctgtggtggccgccagcgcccggcctgctggggacagcgtgaacaaggacagcatgaatgccaccagcaccccagctgccctgagccccagcgtgctgaccacccccagcaagattgagcccatgaaggcctttgacagccgcttcacagagaggagcaaggccacccctggggccccagccctgacctccatgacccccacagctgtggagcggctgaaggagcagaacctggtgaaggagctgcggccccgggacctgctggagagcagcagtgacagtgatgagaaggtgcccctggccaaggccagcagcctgagcaagaggaagctggagctggaggtggagaccgtggagaagaagaagaagggccggcccaggaaggacagccggctgatgcctgtgtccctgtctgtgcagagccctgctgccctgacagctgagaaggaggccatgtgcctgagcgccccagccctggccctgaagctgcccatccccagcccccagagggccttcaccctgcaggtgtccagtgaccccagcatgtacatcgaggtggagaatgaggtgacagtggtgggcggcgtgaagctgagccggctgaagtgcaaccgggagggcaaggagtgggagaccgtgctgaccagccgcatcctgacagctgctggcagctgtgatgtggtgtgtgtggcctgtgagaagaggatgctgagcgtcttcagcacctgtggccgccgcctgctgagccccatcctgctgcccagccccatcagcaccctgcactgcaccggcagctatgtgatggccctgacagctgctgccaccctgtctgtgtgggatgtgcaccggcaggtggtggtggtgaaggaggagagcctgcacagcatcctggccggcacctggttcctgaccagcaggacccactggctgtctgtgcagaccctgggcgccgcctgccaccccaggaccccctgctgtgcccaggacagatag

SEQ ID NO: 155304 - DNA, 156 bp, Artificial Sequence
  Description of Artificial Sequence: Synthetic coding sequence
atggccagctccatgaggagcctcttcagtgaccacggcaagtatgtggagagcttccgccgcttcctgaaccacagcacagagcaccagtgcatgcaggagttcatggacaagaagctgcccggcatcatcggccgctaccagaactgctgctag

SEQ ID NO: 155305 - DNA, 879 bp, Artificial Sequence
  Description of Artificial Sequence: Synthetic coding sequence
atggccagctccatgaggagcctcttcagtgaccacggcaagtatgtggagagcttccgccgcttcctgaaccacagcacagagcaccagtgcatgcaggagttcatggacaagaagctgcccggcatcatcggcagaattggagacaccaagtctgagatcaagatcctgagcattggaggaggagctggggagattgacctgcagatcctgagcaaggtgcaggcccagtacccaggagtgtgcatcaacaatgaggtggtggagcccagcgctgagcagatcgccaagtacaaggagctggtggccaagaccagcaacctggagaatgtgaagtttgcctggcacaaggagaccagcagcgagtaccagagcaggatgctggagaagaaggagctgcagaagtgggacttcatccacatgatccagatgctgtactacgtgaaggacatcccagccaccctgaagttcttccacagcctgctgggcaccaatgccaagatgctgatcatcgtggtgtctggcagcagcggctgggacaagctgtggaagaagtatggcagccgcttcccccaggatgacctgtgccagtacatcaccagtgatgacctgacccagatgctggacaacctgggcctgaagtatgagtgctatgacctgctgagcaccatggacatcagtgactgcttcattgatggaaatgaaaatggagacctgctgtgggacttcctgacagagacctgcaacttcaatgccacagcccccccagacctgcgggcagagctgggcaaggacctgcaggagcctgagttcagcgccaagaaggagggcaaggtgctcttcaacaacaccctgtccttcatcgtcatcgaggcctag

SEQ ID NO: 155306 - DNA, 381 bp, Artificial Sequence
  Description of Artificial Sequence: Synthetic coding sequence
atggccagctccatgaggagcctcttcagtgaccacggcaagtatgtggagagcttccgccgcttcctgaaccacagcacagagcaccagtgcatgcaggagttcatggacaagaagctgcccggcatcatcggcagaattggagacaccaagtctgagatcaagatcctgagcattggaggcggcgctgactgcctgatccggggcagcagccgggtgctgaagaggaacagctgcttcatcctgtgcagcacccggcagaaggacaagccaggcatgagaattcatgatgagaggagcagcgagctgccctttggagctgcccggctggagagcaagagcgccttccccagcttcctggtgtccttcatcctcttctag

SEQ ID NO: 155307 - DNA, 879 bp, Artificial Sequence; identical to SEQ ID NO: 155305
  Description of Artificial Sequence: Synthetic coding sequence

SEQ ID NO: 155308 - DNA, 1464 bp, Artificial Sequence
  Description of Artificial Sequence: Synthetic coding sequence
atgagcctgcccaacagcagctgcctgctggaggacaagatgtgtgagggcaacaagaccaccatggccagcccccagctgatgcccctggtggtggtgctgagcaccatctgcctggtgacagtgggcctgaacctgctggtgctgtatgctgtgcgctctgagaggaagctgcacacagtgggcaacctgtacatcgtgtccctgtctgtggccgacctgattgtgggcgctgtggtgatgcccatgaacatcctgtacctgctgatgagcaagtggagcctgggccggcccctgtgcctcttctggctgtccatggactatgtggccagcacagccagcatcttctctgtgttcatcctgtgcatcgaccgctacagatctgtgcagcagcccctgcgctacctgaagtaccgcaccaagacccgggccagcgccaccatcctgggcgcctggttcctgtccttcctgtgggtgatccccatcctgggctggaaccacttcatgcagcagacctctgtgagaagagaagataaatgtgaaacagacttctatgatgtgacctggttcaaggtgatgacagccatcatcaacttctacctgcccaccctgctgatgctgtggttctacgccaagatctacaaggctgtgcggcagcactgccagcaccgggagctgatcaacagaagcctgcccagcttcagcgagatcaagctgcggcctgagaaccccaagggagatgccaagaagccaggcaaggagagcccctgggaggtgctgaagaggaagcccaaggatgctgggggcggctctgtgctgaagagccccagccagacccccaaggagatgaagagccctgtggtgttcagccaggaggatgaccgggaggtggacaagctgtactgcttccccctggacatcgtgcacatgcaggccgctgctgagggcagcagccgggactatgtggccgtgaacagaagccacggccagctgaagacagatgagcagggcctgaacacccatggagccagcgagatcagcgaggaccagatgctgggggacagccagagcttcagcaggacagacagcgacaccaccacagaaacagcccctgggaagggcaagctgcggagcggcagcaacacaggcctggactacatcaagttcacctggaagaggctgcggagccacagccggcagtatgtgtctggcctgcacatgaaccgggagaggaaggccgccaagcagctgggcttcatcatggccgccttcatcctgtgctggatcccctacttcatcttcttcatggtgattgccttctgcaagaactgctgcaatgagcacctgcacatgttcaccatctggctgggctacatcaacagcaccctgaaccccctcatctaccccctgtgcaatgaaaacttcaagaagaccttcaagaggatcctgcacatccgctcctag

SEQ ID NO: 155309 - DNA, 39 bp, Artificial Sequence; identical to SEQ ID NO: 84513
  Description of Artificial Sequence: Synthetic coding sequence

SEQ ID NO: 155310 - DNA, 1464 bp, Artificial Sequence; identical to SEQ ID NO: 155308
  Description of Artificial Sequence: Synthetic coding sequence

SEQ ID NO: 155311 - DNA, 1464 bp, Artificial Sequence; identical to SEQ ID NO: 155308
  Description of Artificial Sequence: Synthetic coding sequence

SEQ ID NO: 155312 - DNA, 816 bp, Artificial Sequence
  Description of Artificial Sequence: Synthetic coding sequence
atggccgccccccaggatgtgcacgtgcgcatctgcaaccaggagatcgtgaagtttgacctggaggtgaaggccctgatccaggacatccgggactgcagcggccccctgagcgccctgacagagctgaacaccaaggtgaaggagaagttccagcagctgcggcaccgcatccagcctgtgctgtaccagagggccttcatctggacagccagcaccttcttcttcaagctgacctacagcctgacagacttcagcagcacccagcacgacttcaacagccccaccacccctgtgaccttcagtgacctggagcagctggccaaggagcaggacaaggagagcgagaagcagctgctgctgcaggaggtggagaaccacaagaagcagatgctgagcaaccaggcctcctggaggaaggccaacctgacctgcaagatcgccatcgacaacctggagaaggccgagctgctgcagggcggggacctgctgcggcagaggaagaccaccaaggagagcctggcccagaccagcagcaccatcacagagagcctgatgggcatcagcaggatgatggcccagcaggtgcagcagagcgaggaggccatgcagagcctggtgaccagcagcaggaccatcctggatgccaatgaggagttcaagtccatgagcggcaccatccagctgggcaggaagctgatcaccaagtacaacagaagagagctgacagacaagctgctgatcttcctggccctggccctcttcctggccaccgtgctgtacatcgtgaagaagaggctcttccccttcctgtag

SEQ ID NO: 155313 - DNA, 1194 bp, Artificial Sequence
  Description of Artificial Sequence: Synthetic coding sequence
atggcccccaacggcacagccagcagcttctgcctggacagcacagcctgcaagatcaccatcaccgtggtgctggccgtgctgatcctgatcaccgtggccggaaatgtggtggtgtgcctggccgtgggcctgaacagaaggctgaggaacctgaccaactgcttcatcgtgtccctggccatcacagacctgctgctgggcctgctggtgctgcccttcagcgccatctaccagctgagctgcaagtggagctttgggaaggtgttctgcaacatctacaccagcctggatgtgatgctgtgcacagccagcatcctgaacctcttcatgatcagcctggaccgctactgtgctgtgatggaccccctgcgctaccctgtgctggtgacccctgtgcgggtggccatcagcctggtgctgatctgggtgatcagcatcaccctgtccttcctgagcatccacctgggctggaacagcagaaatgagaccagcaagggcaaccacaccaccagcaagtgcaaggtgcaggtgaatgaggtgtatggcctggtggatggcctggtgaccttctacctgcccctgctgatcatgtgcatcacctactaccgcatcttcaaggtggcccgggaccaggccaagaggatcaaccacatcagctcctggaaggccgccaccatccgggagcacaaggccaccgtgaccctggccgctgtgatgggcgccttcatcatctgctggttcccctacttcaccgcctttgtgtaccggggcctgcggggagatgatgccatcaatgaggtgctggaggccatcgtgctgtggctgggctacgccaacagcgccctgaaccccatcctgtatgctgccctgaacagagacttcagaacaggctaccagcagctgttctgctgccgcctggccaacagaaacagccacaagaccagcctgcggagcaatgccagccagctgagcaggacccagagccgggagccccggcagcaggaggagaagcccctgaagctgcaggtgtggagcggcacagaggtgacagccccccagggcgccacagaccggccctggctgtgcctgcctgagtgctggagcgtggagctgacccacagcttcatccacctgttcatccacagctttgccaacatccaccccatccccaccacctgccaggagctgtag

SEQ ID NO: 155314 - DNA, 1173 bp, Artificial Sequence
  Description of Artificial Sequence: Synthetic coding sequence
atgccagacaccaacagcaccatcaacctgagcctgagcaccagggtgaccctggccttcttcatgagcctggtggcctttgccatcatgctgggcaatgccctggtgatcctggcctttgtggtggacaagaacctgcggcacaggagcagctacttcttcctgaacctggccatcagtgacttctttgtgggcgtcatcagcatccccctgtacatcccccacaccctgtttgagtgggactttgggaaggagatctgtgtgttctggctgaccacagactacctgctgtgcacagcctctgtgtacaacatcgtgctgatctcctatgaccgctacctgtctgtgtccaatgctgtgtcctaccgcacccagcacactggagtgctgaagatcgtgaccctgatggtggccgtgtgggtgctggccttcctggtgaatggccccatgatcctggtgtctgagagctggaaggatgagggctctgaatgtgagcccggcttcttcagcgagtggtacatcctggccatcaccagcttcctggagtttgtgattcctgtgatcctggtggcctacttcaacatgaacatctactggagcctgtggaagagggaccacctgagccgctgccagagccaccctggcctgacagctgtgagcagcaacatctgtggccacagcttccggggccgcctgagcagcagaagaagcctgagcgccagcacagaggtgcctgccagcttccacagcgagcggcagaggaggaagagcagcctgatgttcagcagcaggaccaagatgaacagcaacaccatcgccagcaagatgggcagcttcagccagagcgacagcgtggccctgcaccagcgggagcacgtggagctgctgcgggcccggcggctggccaagagcctggccatcctgctgggcgtgtttgctgtgtgctgggccccctacagcctcttcaccatcgtgctgtccttctacagcagcgccaccggccccaagtctgtgtggtaccgcatcgccttctggctgcagtggttcaacagctttgtgaaccccctgctgtaccccctgtgccacaagcgcttccagaaggccttcctgaagatcttctgcatcaagaagcagcccctgcccagccagcacagccgctctgtgagcagctag

SEQ ID NO: 155315 - DNA, 909 bp, Artificial Sequence
  Description of Artificial Sequence: Synthetic coding sequence
atgccagacaccaacagcaccatcaacctgagcctgagcaccagggtgaccctggccttcttcatgagcctggtggcctttgccatcatgctgggcaatgccctggtgatcctggcctttgtggtggacaagaacctgcggcacaggagcagctacttcttcctgaacctggccatcagtgacttctttgtggtgtctgagagctggaaggatgagggctctgaatgtgagcccggcttcttcagcgagtggtacatcctggccatcaccagcttcctggagtttgtgattcctgtgatcctggtggcctacttcaacatgaacatctactggagcctgtggaagagggaccacctgagccgctgccagagccaccctggcctgacagctgtgagcagcaacatctgtggccacagcttccggggccgcctgagcagcagaagaagcctgagcgccagcacagaggtgcctgccagcttccacagcgagcggcagaggaggaagagcagcctgatgttcagcagcaggaccaagatgaacagcaacaccatcgccagcaagatgggcagcttcagccagagcgacagcgtggccctgcaccagcgggagcacgtggagctgctgcgggcccggcggctggccaagagcctggccatcctgctgggcgtgtttgctgtgtgctgggccccctacagcctcttcaccatcgtgctgtccttctacagcagcgccaccggccccaagtctgtgtggtaccgcatcgccttctggctgcagtggttcaacagctttgtgaaccccctgctgtaccccctgtgccacaagcgcttccagaaggccttcctgaagatcttctgcatcaagaagcagcccctgcccagccagcacagccgctctgtgagcagctag

SEQ ID NO: 155316 - DNA, 174 bp, Artificial Sequence
  Description of Artificial Sequence: Synthetic coding sequence
atgaagttctttgtgtttgccctggtgctggccctgatgatctccatgatctctgctgacagccatgagaagaggcaccacggctacagaaggaagttccacgagaagcaccacagccaccgggagttccccttctacggggactatggcagcaactacctgtatgacaactag

SEQ ID NO: 155317 - DNA, 174 bp, Artificial Sequence; identical to SEQ ID NO: 155316
  Description of Artificial Sequence: Synthetic coding sequence

SEQ ID NO: 155318 - DNA, 156 bp, Artificial Sequence
  Description of Artificial Sequence: Synthetic coding sequence
atgaagttctttgtgtttgccctgatcctggccctgatgctgtccatgactggagctgacagccacgccaagaggcaccacggctacaagaggaagttccacgagaagcaccacagccaccggggctaccgcagcaactacctgtatgacaactag

SEQ ID NO: 155319 - DNA, 156 bp, Artificial Sequence; identical to SEQ ID NO: 155318
  Description of Artificial Sequence: Synthetic coding sequence

SEQ ID NO: 155320 - DNA, 1989 bp, Artificial Sequence
  Description of Artificial Sequence: Synthetic coding sequence
atgatggagcctgaggagtaccgggagcggggccgggagatggtggactacatctgccagtacctgagcacagtgcgggagcggcgggtgaccccagatgtgcagcccggctacctgcgggcccagctgcctgagagcgccccagaagatcctgacagctgggacagcatctttggagacatcgagcgcatcatcatgcctggggtggtgcactggcagagcccccacatgcacgcctactacccagccctgacctcctggcccagcctgctgggggacatgctggctgatgccatcaactgcctgggcttcacctgggccagcagccctgcctgcacagagctggagatgaatgtgatggactggctggccaagatgctgggcctgcctgagcacttcctgcaccaccaccccagcagccagggcggcggcgtgctgcagagcacagtgtctgagagcaccctcatcgccctgctggccgccaggaagaacaagatcctggagatgaagaccagcgagccagatgctgatgagagctgcctgaatgcccggctggtggcctatgccagtgaccaggcccacagctctgtggagaaggccggcctcatcagcctggtgaagatgaagttcctgcctgtggatgacaacttcagcctgcggggggaggccctgcagaaggccatcgaggaggacaagcagaggggcctggtgcctgtgtttgtgtgtgccaccctgggcaccaccggggtgtgtgcctttgactgcctgtctgagctgggccccatctgtgcccgggagggcctgtggctgcacattgatgctgcctatgccggcacagccttcctgtgcccagagttccggggcttcctgaagggcattgaatatgctgacagcttcaccttcaaccccagcaagtggatgatggtgcactttgactgcaccggcttctgggtgaaggacaagtacaagctgcagcagaccttctctgtgaaccccatctacctgcggcatgccaacagcggcgtggccacagacttcatgcactggcagatccccctgagccgccgcttccgctctgtgaagctgtggtttgtgatccgcagctttggagtgaagaacctgcaggcccacgtgcgccacggcacagagatggccaagtactttgagagcctggtgagaaatgaccccagctttgagatcccagccaagaggcacctgggcctggtggtgttccggctgaagggccccaactgcctgacagaaaatgtgctgaaggagatcgccaaggccggccgcctcttcctgatcccagccaccatccaggacaagctgatcatccgcttcaccgtgaccagccagttcaccaccagagatgacatcctgcgggactggaacctgatcagagatgctgccaccctcatcctgagccagcactgcaccagccagcccagcccccgggtgggcaacctgatcagccagatccggggggcccgggcctgggcctgtggcaccagcctgcagagcgtgtctggagctggagatgatcctgtgcaggccaggaagatcatcaagcagccccagagggtgggcgccggccccatgaagagagaaaatggcctgcacctggagaccctgctggaccctgtggatgactgcttcagcgaggaggccccagatgccaccaagcacaagctgagcagcttcctgttctcctacctgtctgtgcagaccaagaagaagacagtgcgcagcctgagctgcaacagcgtgcctgtgtctgcccagaagcccctgcccacagaggcctctgtgaagaatggaggcagcagccgggtgcgcatcttcagccgcttccctgaggacatgatgatgctgaagaagagcgccttcaagaagctgatcaagttctacagcgtgcccagcttccctgagtgcagcagccagtgtggcctgcagctgccctgctgccccctgcaggccatggtgtag

SEQ ID NO: 155321 - DNA, 2100 bp, Artificial Sequence
  Description of Artificial Sequence: Synthetic coding sequence
atgggccaccaccggccctggctgcacgcctctgtgctgtgggccggcgtggccagcctgctgctgcccccagccatgacccagcagctgcggggagatggcctgggcttcaggaacagaaacaacagcactggagtggccggcctgtctgaggaggccagcgctgagctgcggcaccacctgcacagcccccgggaccacccagatgagaacaaggatgtgtccacagaaaatggccaccacttctggagccacccagaccgggagaaggaggatgaagatgtgtccaaggagtatggccacctgctgcccggccacaggagccaggaccacaaggtgggagatgaaggagtgtctggagaggaggtgtttgctgagcacggcggccaggcccggggccaccggggccacggcagcgaggacacagaagattctgctgagcaccgccaccacctgcccagccacaggagccacagccaccaggatgaagatgaagatgaggtggtgtcctctgagcaccaccaccacatcctgcggcacggccaccggggccatgatggagaagatgatgaaggagaggaggaggaggaggaggaggaggaggaggaggaggccagcacagaatatggccaccaggcccaccgccaccggggccacggctctgaagaagatgaagatgtgtctgatggccaccaccaccacggccccagccaccgccaccagggccatgaagaagatgatgatgatgatgatgatgatgatgatgatgatgatgatgatgatgtgtccattgagtaccgccaccaggcccaccgccaccagggccacggcatcgaggaggatgaagatgtgtctgatggccaccaccaccgggaccccagccaccgccacaggagccatgaggaggatgacaatgatgatgatgatgtgtccacagaatatggccaccaggcccaccgccaccaggaccacaggaaggaggaggtggaggccgtgtctggagagcaccaccaccacgtgcctgaccaccgccaccagggccacagagatgaggaggaggatgaagatgtgtccacagagcgctggcaccagggcccccagcacgtgcaccacggcctggtggatgaggaggaggaggaggaggagatcaccgtgcagtttggccactacgtggccagccaccagccccggggccacaagagtgatgaggaggacttccaggatgagtacaagacagaggtgccccaccaccaccaccaccgggtgccccgggaggaggatgaggaggtgtctgctgagctgggccaccaggcccccagccaccggcagagccaccaggatgaggagaccggccacggccagaggggcagcatcaaggagatgagccaccaccccccaggccacacagtggtgaaggacaggagccacctgaggaaggatgacagcgaggaggagaaggagaaggaggaggaccccggcagccatgaagaagatgatgagagcagcgagcagggcgagaagggcacccaccacggcagccgggaccaggaggatgaggaggatgaggaggagggccacggcctgagcctgaaccaggaggaggaggaggaggaggacaaggaggaggaggaggaggaggaggatgaggagcggcgggaggagcgggcagaggtgggcgcccccctgagcccagaccacagcgaggaggaggaggaggaggaggagggcctggaggaggatgagccccgcttcaccatcatccccaaccccctggacagaagagaggaggccggcggggccagcagcgaggaggagagcggggaggacaccggcccccaggatgcccaggagtatggcaactaccagcccggcagcctgtgtggctactgcagcttctgcaaccgctgcacagaatgtgagagctgccactgtgatgaggagaacatgggagagcactgtgaccagtgccagcactgccagttctgctacctgtgccccctggtgtgtgaaacagtgtgtgcccctggcagctatgtggactacttcagcagcagcctgtaccaggccctggccgacatgctggagaccccagagccctag

SEQ ID NO: 155322 - DNA, 1170 bp, Artificial Sequence
  Description of Artificial Sequence: Synthetic coding sequence
gaagatgacaatgatgatgatgatgtgtccacagaatatggccaccaggcccaccgccaccaggaccacaggaaggaggaggtggaggccgtgtctggagagcaccaccaccacgtgcctgaccaccgccaccagggccacagagatgaggaggaggatgaagatgtgtccacagagcgctggcaccagggcccccagcacgtgcaccacggcctggtggatgaggaggaggaggaggaggagatcaccgtgcagtttggccactacgtggccagccaccagccccggggccacaagagtgatgaggaggacttccaggatgagtacaagacagaggtgccccaccaccaccaccaccgggtgccccgggaggaggatgaggaggtgtctgctgagctgggccaccaggcccccagccaccggcagagccaccaggatgaggagactggacatggccagaggggcagcatcaaggagatgagccaccaccccccaggccacacagtggtgaaggacaggagccacctgaggaaggatgattctgaggaggagaaggagaaggaggaggaccccggcagccatgaggaggatgatgagagcagcgagcagggcgagaagggcacccaccacggcagccgggaccaggaggatgaagaagatgaggaggagggccacggcctgagcctgaaccaggaggaggaggaggaggaggatgaggagcggcgggaggagcgggcagaggtgggcgcccccctgagcccagaccacagcgaggaggaggaggaggaggaggagggcctggaggaggatgagccccgcttcaccatcatccccaaccccctggacagaagagaggaggccggcggggccagcagcgaggaggagagcggggaggacaccggcccccaggatgcccaggagtatggcaactaccagcccggcagcctgtgtggctactgcagcttctgcaaccgctgcacagaatgtgagagctgccactgtgatgaggagaacatgggagagcactgtgaccagtgccagcactgccagttctgctacctgtgccccctggtgtgtgaaacagtgtgtgcccctggcagctatgtggactacttcagcagcagcctgtaccaggccctggccgacatgctggagaccccagagccctag

SEQ ID NO: 155323 - DNA, 1365 bp, Artificial Sequence
  Description of Artificial Sequence: Synthetic coding sequence
atgggccaccaccggccctggctgcacgcctctgtgctgtgggccggcgtggccagcctgctgctgcccccagccatgacccagcagctgcggggagatggcctgggcttcaggaacagaaacaaggatgtgtccacagaaaatggccaccacttctggagccacccagaccgggagaaggaggatgaagatgtgtccaaggagtatggccacctgctgcccggccacaggagccaggaccacaaggtgggagatgaaggagtgtctggagaggaggtgtttgctgagcacggcggccaggcccggggccaccggggccacggcagcgaggacacagaagattctgctgagcaccgccaccacctgcccagccacaggagccacagccaccaggatgaagatgaagatgaggtggtgtcctctgagcaccaccaccacatcctgcggcacggccaccggggccatgatggagaagatgatgaaggagaggaggaggaggaggaggaggaggaggaggaggaggccagcacagaatatggccaccaggcccaccgccaccggggccacggctctgaagaagatgaagatgtgtctgatggccaccaccaccacggccccagccaccgccaccagggccatgaagaagatgatgatgatgatgatgatgatgatgatgatgatgatgatgatgatgtgtccattgagtaccgccaccaggcccaccgccaccagggccacggcatcgaggaggatgaagatgtgtctgatggccaccaccaccgggaccccagccaccgccacaggagccatgaggaggatgacaatgatgatgatgatgtgtccacagaatatggccaccaggcccaccgccaccaggaccacaggaaggaggaggtggaggccgtgtctggagagcaccaccaccacgtgcctgaccaccgccaccagggccacagagatgaggaggaggatgaagatgtgtccacagagcgctggcaccagggcccccagcacgtgcaccacggcctggtggatgaggaggaggaggaggaggagatcaccgtgcagtttggccactacgtggccagccaccagccccggggccacaagagtgatgaggaggacttccaggatgagtacaagacagaggtgccccaccaccaccaccaccgggtgccccgggaggaggatgaggaggtgtctgctgagctgggccaccaggcccccagccaccggcagagccaccaggatgaggagaccggccacggccagaggggcagcatcaaggagatgagccaccaccccccaggccacacagtggtgaaggacaggagccacctgaggaaggatgacagcgaggagtag

SEQ ID NO: 155324 - DNA, 381 bp, Artificial Sequence
  Description of Artificial Sequence: Synthetic coding sequence
atggctgatgaaattgccaaggcccaggtggcccggcctggaggagacaccatctttgggaagatcatcaggaaggagatcccagccaagatcatctttgaagatgaccgctgcctggccttccatgacatcagcccccaggcccccacccacttcctggtgatccccaagaagcacatcagccagatctctgtggctgaagatgatgatgagagcctgctgggccacctgatgattgtgggcaagaagtgtgccgctgacctgggcctgaacaagggctacaggatggtggtgaatgaaggaagtgatggcggccagagcgtgtaccacgtgcacctgcacgtgctgggcggccggcagatgcactggcccccaggatag

SEQ ID NO: 155325 - DNA, 492 bp, Artificial Sequence
  Description of Artificial Sequence: Synthetic coding sequence
atggctgctgctgtggtgctggccgccggcctgcgggccgccaggagagctgtggccgccactggagtgcggggcggccaggtgagaggagctgctggggtgacagatggaaatgaggtggccaaggcccagcaggccacccctgggggcgccgcccccaccatcttcagccgcatcctggacaagagcctgcctgctgacatcctgtatgaggaccagcagtgcctggtgttcagagatgtggccccccaggcccctgtgcacttcctggtgatccccaagaagcccatcccccgcatcagccaggccgaggaggaggaccagcagctgctgggccacctgctgctggtggccaagcagacagccaaggccgagggcctgggagatggctaccgcctggtgatcaatgatggcaagctgggcgcccagagcgtgtaccacctgcacatccacgtgctgggcggccggcagctgcagtggcccccaggatag

SEQ ID NO: 155326 - DNA, 615 bp, Artificial Sequence
  Description of Artificial Sequence: Synthetic coding sequence
atggccaaggtgcaggtgaacaacgtggtggtgctggacaaccccagccccttctacaaccccttccagtttgagatcacctttgaatgtattgaggacctgtctgaggacctggagtggaagatcatctacgtgggcagcgctgagagcgaggagtatgaccaggtgctggacagcgtgctggtgggccctgtgcctgctggccgccacatgtttgtgttccaggctgatgcccccaaccctggcctcatcccagatgctgatgctgtgggcgtgacagtggtgctgatcacctgcacctaccggggccaggagttcatccgggtgggctactacgtgaacaatgagtacacagaaacagagctgcgggagaacccccctgtgaagccagacttcagcaagctgcagaggaacatcctggccagcaacccccgggtgacccgcttccacatcaactgggaggacaacacagagaagctggaggatgctgagagcagcaaccccaacctgcagagcctgctgagcacagatgccctgcccagcgccagcaagggctggagcaccagcgagaacagcctgaatgtgatgctggagagccacatggactgcatgtag

SEQ ID NO: 155327 - DNA, 1329 bp, Artificial Sequence
  Description of Artificial Sequence: Synthetic coding sequence
atggccggggagggggaccagcaggatgctgcccacaacatgggcaaccacctgcccctgctgcctgctgagagcgaggaggaggatgagatggaggtggaggaccaggacagcaaggaggccaagaagcccaacatcatcaactttgacaccagcctgcccaccagccacacctacctgggcgctgacatggaggagttccacggccgcaccctgcatgatgatgacagctgccaggtgattcctgtgctgccccaggtgatgatgatcctgatccctggccagaccctgcccctgcagctgttccacccccaggaggtgtccatggtgaggaacctgatccagaaggacaggacctttgctgtgctggcctacagcaatgtgcaggagcgggaggcccagtttggcaccacagctgagatctatgcctaccgggaggagcaggactttggcatcgagatcgtgaaggtgaaggccatcggccggcagcgcttcaaggtgctggagctgcggacccagagtgatggcatccagcaggccaaggtgcagatcctgcctgaatgtgtgctgcccagcaccatgtctgctgtgcagctggagagcctgaacaagtgccagatcttccccagcaagcctgtgtcccgggaggaccagtgcagctacaagtggtggcagaagtaccagaagaggaagttccactgtgccaacctgacctcctggccccgctggctgtacagcctgtatgatgctgagaccctgatggaccgcatcaagaagcagctgcgggagtgggatgagaacctgaaggatgacagcctgcccagcaaccccatcgacttctcctacagagtggccgcctgcctgcccattgatgatgtgctgcgcatccagctgctgaagattggcagcgccatccagaggctgcgctgtgagctggacatcatgaacaagtgcaccagcctgtgctgcaagcagtgccaggagacagagatcaccaccaagaatgagatcttcagcctgagcctgtgtggccccatggccgcctacgtgaacccccacggctacgtgcatgagaccctgactgtgtacaaggcctgcaacctgaacctgattggccggcccagcacagagcacagctggttccctggctacgcctggacagtggcccagtgcaagatctgtgccagccacatcggctggaagttcaccgccaccaagaaggacatgagcccccagaagttctggggcctgaccaggtctgccctgctgcccaccatcccagacacagaagatgagatcagcccagacaaggtgatcctgtgcctgtag

SEQ ID NO: 155328 - DNA, 1308 bp, Artificial Sequence
  Description of Artificial Sequence: Synthetic coding sequence
atggccgagagagctgccctggaggagctggtgaagctgcagggcgagcgggtgcggggcctgaagcagcagaaggccagcgctgagctgattgaggaggaggtggccaagctgctgaagctgaaggcccagctgggcccagatgagagcaagcagaagtttgtgctgaagacccccaagggcacccgggactacagcccccggcagatggctgtgcgggagaaggtgtttgatgtgatcatccgctgcttcaagagacatggagctgaggtgattgacacccctgtgtttgagctgaaggactttgatattgctggcaactttgaccccatgatcccagatgctgagtgcctgaagatcatgtgtgagatcctgagcagcctgcagatcggggacttcctggtgaaggtgaatgaccggcgcatcctggatggcatgtttgccatctgtggggtgtctgacagcaagttccgcaccatctgcagctctgtggacaagctggacaaggtgtcctgggaggaggtgaagaatgagatggtgggggagaagggcctggcccctgaggtggccgacagaattggagactatgtgcagcagcacggcggcgtgtccctggtggagcagctgctgcaggaccccaagctgagccagaacaagcaggccctggagggcctgggggacctgaagctgctgtttgagtacctgaccctgtttggaattgatgacaagatcagctttgacctgagcctggcccggggcctggactactacacaggagtcatctatgaggccgtgctgctgcagaccccagcccaggccggggaggagcccctgggcgtgggctctgtggccgccggcggccgctatgatggcctggtgggcatgtttgaccccaagggcaggaaggtgccctgtgtgggcctgagcattggagtggagcgcatcttcagcatcgtggagcagaggctggaggccctggaggagaagatccgcaccacagagacccaggtgctggtggccagcgcccagaagaagctgctggaggagcggctgaagctggtgtctgagctgtgggatgctggcatcaaggccgagctgctgtacaagaagaaccccaagctgctgaaccagctgcagtactgtgaggaggccggcatccccctggtggccatcatcggggagcaggagctgaaggatggagtcatcaagctgcggtctgtgaccagccgggaggaggtggatgtgcggcgggaggacctggtggaggagatcaagagaagaacaggccagcccctgtgcatctgctag

SEQ ID NO: 155329 - DNA, 1188 bp, Artificial Sequence
  Description of Artificial Sequence: Synthetic coding sequence
atggccgagagagctgccctggaggagctggtgaagctgcagggcgagcgggtgcggggcctgaagcagcagaaggccagcgctgagctgattgaggaggaggtggccaagctgctgaagctgaaggcccagctgggcccagatgagagcaagcagaagtttgtgctgaagacccccaaggactttgatattgctggcaactttgaccccatgatcccagatgctgagtgcctgaagatcatgtgtgagatcctgagcagcctgcagatcggggacttcctggtgaaggtgaatgaccggcgcatcctggatggcatgtttgccatctgtggggtgtctgacagcaagttccgcaccatctgcagctctgtggacaagctggacaaggtgtcctgggaggaggtgaagaatgagatggtgggggagaagggcctggcccctgaggtggccgacagaattggagactatgtgcagcagcacggcggcgtgtccctggtggagcagctgctgcaggaccccaagctgagccagaacaagcaggccctggagggcctgggggacctgaagctgctgtttgagtacctgaccctgtttggaattgatgacaagatcagctttgacctgagcctggcccggggcctggactactacacaggagtcatctatgaggccgtgctgctgcagaccccagcccaggccggggaggagcccctgggcgtgggctctgtggccgccggcggccgctatgatggcctggtgggcatgtttgaccccaagggcaggaaggtgccctgtgtgggcctgagcattggagtggagcgcatcttcagcatcgtggagcagaggctggaggccctggaggagaagatccgcaccacagagacccaggtgctggtggccagcgcccagaagaagctgctggaggagcggctgaagctggtgtctgagctgtgggatgctggcatcaaggccgagctgctgtacaagaagaaccccaagctgctgaaccagctgcagtactgtgaggaggccggcatccccctggtggccatcatcggggagcaggagctgaaggatggagtcatcaagctgcggtctgtgaccagccgggaggaggtggatgtgcggcgggaggacctggtggaggagatcaagagaagaacaggccagcccctgtgcatctgctag

SEQ ID NO: 155330 - DNA, 1410 bp, Artificial Sequence
  Description of Artificial Sequence: Synthetic coding sequence
atggccgagagagctgccctggaggagctggtgaagctgcagggcgagcgggtgcggggcctgaagcagcagaaggccagcgctgagctgattgaggaggaggtggccaagctgctgaagctgaaggcccagctgggcccagatgagagcaagcagaagtttgtgctgaagacccccaaggagaccctgatgggcaagtatggagaggacagcaagctgatctatgacctgaaggaccagggcggggagctgctgagcctgcgctatgacctgactgtgccctttgcccgctacctggccatgaacaagctgaccaacatcaagcgctaccacatcgccaaggtgtacagaagagacaacccagccatgacccggggccgctaccgggagttctaccagtgtgactttgatattgctggcaactttgaccccatgatcccagatgctgagtgcctgaagatcatgtgtgagatcctgagcagcctgcagatcggggacttcctggtgaaggtgaatgaccggcgcatcctggatggcatgtttgccatctgtggggtgtctgacagcaagttccgcaccatctgcagctctgtggacaagctggacaaggtgtcctgggaggaggtgaagaatgagatggtgggggagaagggcctggcccctgaggtggccgacagaattggagactatgtgcagcagcacggcggcgtgtccctggtggagcagctgctgcaggaccccaagctgagccagaacaagcaggccctggagggcctgggggacctgaagctgctgtttgagtacctgaccctgtttggaattgatgacaagatcagctttgacctgagcctggcccggggcctggactactacacaggagtcatctatgaggccgtgctgctgcagaccccagcccaggccggggaggagcccctgggcgtgggctctgtggccgccggcggccgctatgatggcctggtgggcatgtttgaccccaagggcaggaaggtgccctgtgtgggcctgagcattggagtggagcgcatcttcagcatcgtggagcagaggctggaggccctggaggagaagatccgcaccacagagacccaggtgctggtggccagcgcccagaagaagctgctggaggagcggctgaagctggtgtctgagctgtgggatgctggcatcaaggccgagctgctgtacaagaagaaccccaagctgctgaaccagctgcagtactgtgaggaggccggcatccccctggtggccatcatcggggagcaggagctgaaggatggagtcatcaagctgcggtctgtgaccagccgggaggaggtggatgtgcggcgggaggacctggtggaggagatcaagagaagaacaggccagcccctgtgcatctgctag

SEQ ID NO: 155331 - DNA, 945 bp, Artificial Sequence
  Description of Artificial Sequence: Synthetic coding sequence
atgacccggggccgctaccgggagttctaccagtgtgactttgatattgctggcaactttgaccccatgatcccagatgctgagtgcctgaagatcatgtgtgagatcctgagcagcctgcagatcggggacttcctggtgaaggtgtcctgggaggaggtgaagaatgagatggtgggggagaagggcctggcccctgaggtggccgaccgcatcggggactatgtgcagcagcacggcggcgtgtccctggtggagcagctgctgcaggaccccaagctgagccagaacaagcaggccctggagggcctgggggacctgaagctgctgtttgagtacctgaccctgtttggaattgatgacaagatcagctttgacctgagcctggcccggggcctggactactacacaggagtcatctatgaagctgtgctgctgcagaccccagcccaggccggggaggagcccctgggcgtgggctctgtggccgccggcggccgctatgatggcctggtgggcatgtttgaccccaagggcaggaaggtgccctgtgtgggcctgagcattggagtggagcgcatcttcagcatcgtggagcagaggctggaggccctggaggagaagatccgcaccacagagacccaggtgctggtggccagcgcccagaagaagctgctggaggagcggctgaagctggtgtctgagctgtgggatgctggcatcaaggccgagctgctgtacaagaagaaccccaagctgctgaaccagctgcagtactgtgaggaggccggcatccccctggtggccatcattggagagcaggagctgaaggatggagtcatcaagctgcggtctgtgaccagccgggaggaggtggatgtgagaagagaggacctggtggaggagatcaagagaagaacaggccagcccctgtgcatctgctag

SEQ ID NO: 155332 - DNA, 1530 bp, Artificial Sequence
  Description of Artificial Sequence: Synthetic coding sequence
atggccgagagagctgccctggaggagctggtgaagctgcagggcgagcgggtgcggggcctgaagcagcagaaggccagcgctgagctgattgaggaggaggtggccaagctgctgaagctgaaggcccagctgggcccagatgagagcaagcagaagtttgtgctgaagacccccaagggcacccgggactacagcccccggcagatggctgtgcgggagaaggtgtttgatgtgatcatccgctgcttcaagagacatggagctgaggtgattgacacccctgtgtttgagctgaaggagaccctgatgggcaagtatggagaggacagcaagctgatctatgacctgaaggaccagggcggggagctgctgagcctgcgctatgacctgactgtgccctttgcccgctacctggccatgaacaagctgaccaacatcaagcgctaccacatcgccaaggtgtacagaagagacaacccagccatgacccggggccgctaccgggagttctaccagtgtgactttgatattgctggcaactttgaccccatgatcccagatgctgagtgcctgaagatcatgtgtgagatcctgagcagcctgcagatcggggacttcctggtgaaggtgaatgaccggcgcatcctggatggcatgtttgccatctgtggggtgtctgacagcaagttccgcaccatctgcagctctgtggacaagctggacaaggtgtcctgggaggaggtgaagaatgagatggtgggggagaagggcctggcccctgaggtggccgacagaattggagactatgtgcagcagcacggcggcgtgtccctggtggagcagctgctgcaggaccccaagctgagccagaacaagcaggccctggagggcctgggggacctgaagctgctgtttgagtacctgaccctgtttggaattgatgacaagatcagctttgacctgagcctggcccggggcctggactactacacaggagtcatctatgaggccgtgctgctgcagaccccagcccaggccggggaggagcccctgggcgtgggctctgtggccgccggcggccgctatgatggcctggtgggcatgtttgaccccaagggcaggaaggtgccctgtgtgggcctgagcattggagtggagcgcatcttcagcatcgtggagcagaggctggaggccctggaggagaagatccgcaccacagagacccaggtgctggtggccagcgcccagaagaagctgctggaggagcggctgaagctggtgtctgagctgtgggatgctggcatcaaggccgagctgctgtacaagaagaaccccaagctgctgaaccagctgcagtactgtgaggaggccggcatccccctggtggccatcatcggggagcaggagctgaaggatggagtcatcaagctgcggtctgtgaccagccgggaggaggtggatgtgcggcgggaggacctggtggaggagatcaagagaagaacaggccagcccctgtgcatctgctag

SEQ ID NO: 155333 - DNA, 1323 bp, Artificial Sequence
  Description of Artificial Sequence: Synthetic coding sequence
atggctgtgcgggagaaggtgtttgatgtgatcatccgctgcttcaagagacatggagctgaggtgattgacacccctgtgtttgagctgaaggagaccctgatgggcaagtacggggaggacagcaagctgatctatgacctgaaggaccagggcggggagctgctgagcctgcgctatgacctgactgtgccctttgcccgctacctggccatgaacaagctgaccaacatcaagcgctaccacatcgccaaggtgtaccgccgggacaacccagccatgacccggggccgctaccgggagttctaccagtgtgactttgatattgctggcaactttgaccccatgatcccagatgctgaatgtctgaagatcatgtgtgagatcctgagcagcctgcagattggagacttcctggtgaaggtgaatgaccggcgcatcctggatggcatgtttgccatctgtggggtgtctgacagcaagttccgcaccatctgcagctctgtggacaagctggacaaggtgtcctgggaggaggtgaagaatgagatggtgggggagaagggcctggcccctgaggtggccgaccgcatcggggactatgtgcagcagcacggcggcgtgtccctggtggagcagctgctgcaggaccccaagctgagccagaacaagcaggccctggagggcctgggggacctgaagctgctgtttgagtacctgaccctgtttggaattgatgacaagatcagctttgacctgagcctggcccggggcctggactactacacaggagtcatctatgaagctgtgctgctgcagaccccagcccaggccggggaggagcccctgggcgtgggctctgtggccgccggcggccgctatgatggcctggtgggcatgtttgaccccaagggcaggaaggtgccctgtgtgggcctgagcattggagtggagcgcatcttcagcatcgtggagcagaggctggaggccctggaggagaagatccgcaccacagagacccaggtgctggtggccagcgcccagaagaagctgctggaggagcggctgaagctggtgtctgagctgtgggatgctggcatcaaggccgagctgctgtacaagaagaaccccaagctgctgaaccagctgcagtactgtgaggaggccggcatccccctggtggccatcattggagagcaggagctgaaggatggagtcatcaagctgcggtctgtgaccagccgggaggaggtggatgtgagaagagaggacctggtggaggagatcaagagaagaacaggccagcccctgtgcatctgctag

SEQ ID NO: 155334 - DNA, 867 bp, Artificial Sequence
  Description of Artificial Sequence: Synthetic coding sequence
atggccgagagagctgccctggaggagctggtgaagctgcagggcgagcgggtgcggggcctgaagcagcagaaggccagcgctgagctgattgaggaggaggtggccaagctgctgaagctgaaggcccagctgggcccagatgagagcaagcagaagtttgtgctgaagacccccaagggcacccgggactacagcccccggcagatggctgtgcgggagaaggtgtttgatgtgatcatccgctgcttcaagagacatggagctgaggtgattgacacccctgtgtttgagctgaaggtgaatgaccggcgcatcctggatggcatgtttgccatctgtggggtgtctgacagcaagttccgcaccatctgcagctctgtggacaagctggacaaggtgtcctgggaggaggtgaagaatgagatggtgggggagaagggcctggcccctgaggtggccgacagaattggagactatgtgcagcagcacggcggcgtgtccctggtggagcagctgctgcaggaccccaagctgagccagaacaagcaggccctggagggcctgggggacctgaagctgctgtttgagtacctgaccctgtttggaattgatgacaagatcagctttgacctgagcctggcccggggcctggactactacacaggagtcatctatgaggccgtgctgctgcagaccccagcccaggccggggaggagcccctgggcgtgggctctgtggccgccggcggccgctatgatggcctggtgggcatgtttgaccccaagggcaggaaggtgccctgtgtgggcctgagcattggagtggagcgcatcttcagcatcgtggagcagaggctggagtag

SEQ ID NO: 155335 - DNA, 1350 bp, Artificial Sequence
  Description of Artificial Sequence: Synthetic coding sequence
atggccgagagagctgccctggaggagctggtgaagctgcagggcgagcgggtgcggggcctgaagcagcagaaggccagcgctgagctgattgaggaggaggtggccaagctgctgaagctgaaggcccagctgggcccagatgagagcaagcagaagtttgtgctgaagacccccaaggagaccctgatgggcaagtatggagaggacagcaagctgatctatgacctgaaggaccagggcggggagctgctgagcctgcgctatgacctgactgtgccctttgcccgctacctggccatgaacaagctgaccaacatcaagcgctaccacatcgccaaggactttgatattgctggcaactttgaccccatgatcccagatgctgagtgcctgaagatcatgtgtgagatcctgagcagcctgcagatcggggacttcctggtgaaggtgaatgaccggcgcatcctggatggcatgtttgccatctgtggggtgtctgacagcaagttccgcaccatctgcagctctgtggacaagctggacaaggtgtcctgggaggaggtgaagaatgagatggtgggggagaagggcctggcccctgaggtggccgacagaattggagactatgtgcagcagcacggcggcgtgtccctggtggagcagctgctgcaggaccccaagctgagccagaacaagcaggccctggagggcctgggggacctgaagctgctgtttgagtacctgaccctgtttggaattgatgacaagatcagctttgacctgagcctggcccggggcctggactactacacaggagtcatctatgaggccgtgctgctgcagaccccagcccaggccggggaggagcccctgggcgtgggctctgtggccgccggcggccgctatgatggcctggtgggcatgtttgaccccaagggcaggaaggtgccctgtgtgggcctgagcattggagtggagcgcatcttcagcatcgtggagcagaggctggaggccctggaggagaagatccgcaccacagagacccaggtgctggtggccagcgcccagaagaagctgctggaggagcggctgaagctggtgtctgagctgtgggatgctggcatcaaggccgagctgctgtacaagaagaaccccaagctgctgaaccagctgcagtactgtgaggaggccggcatccccctggtggccatcatcggggagcaggagctgaaggatggagtcatcaagctgcggtctgtgaccagccgggaggaggtggatgtgcggcgggaggacctggtggaggagatcaagagaagaacaggccagcccctgtgcatctgctag

SEQ ID NO: 155336 - DNA, 1470 bp, Artificial Sequence
  Description of Artificial Sequence: Synthetic coding sequence
atggccgagagagctgccctggaggagctggtgaagctgcagggcgagcgggtgcggggcctgaagcagcagaaggccagcgctgagctgattgaggaggaggtggccaagctgctgaagctgaaggcccagctgggcccagatgagagcaagcagaagtttgtgctgaagacccccaagggcacccgggactacagcccccggcagatggctgtgcgggagaaggtgtttgatgtgatcatccgctgcttcaagagacatggagctgaggtgattgacacccctgtgtttgagctgaaggagaccctgatgggcaagtatggagaggacagcaagctgatctatgacctgaaggaccagggcggggagctgctgagcctgcgctatgacctgactgtgccctttgcccgctacctggccatgaacaagctgaccaacatcaagcgctaccacatcgccaaggactttgatattgctggcaactttgaccccatgatcccagatgctgagtgcctgaagatcatgtgtgagatcctgagcagcctgcagatcggggacttcctggtgaaggtgaatgaccggcgcatcctggatggcatgtttgccatctgtggggtgtctgacagcaagttccgcaccatctgcagctctgtggacaagctggacaaggtgtcctgggaggaggtgaagaatgagatggtgggggagaagggcctggcccctgaggtggccgacagaattggagactatgtgcagcagcacggcggcgtgtccctggtggagcagctgctgcaggaccccaagctgagccagaacaagcaggccctggagggcctgggggacctgaagctgctgtttgagtacctgaccctgtttggaattgatgacaagatcagctttgacctgagcctggcccggggcctggactactacacaggagtcatctatgaggccgtgctgctgcagaccccagcccaggccggggaggagcccctgggcgtgggctctgtggccgccggcggccgctatgatggcctggtgggcatgtttgaccccaagggcaggaaggtgccctgtgtgggcctgagcattggagtggagcgcatcttcagcatcgtggagcagaggctggaggccctggaggagaagatccgcaccacagagacccaggtgctggtggccagcgcccagaagaagctgctggaggagcggctgaagctggtgtctgagctgtgggatgctggcatcaaggccgagctgctgtacaagaagaaccccaagctgctgaaccagctgcagtactgtgaggaggccggcatccccctggtggccatcatcggggagcaggagctgaaggatggagtcatcaagctgcggtctgtgaccagccgggaggaggtggatgtgcggcgggaggacctggtggaggagatcaagagaagaacaggccagcccctgtgcatctgctag

SEQ ID NO: 155337 - DNA, 1017 bp, Artificial Sequence
  Description of Artificial Sequence: Synthetic coding sequence
atgatggccatgaacagcaagcagcccttcggcatgcaccctgtgctgcaggagcccaagttcagcagcctgcacagcggcagcgaggccatgagaagagtgtgcctgcctgccccccagctgcagggcaacatcttcggcagctttgatgagagcctgctggcccgggcagaggccctggccgctgtggacatcgtgagccacggcaagaaccaccccttcaagccagatgccacctaccacaccatgagctctgtgccctgcaccagcaccagcagcacagtgcccatcagccaccctgctgccctgaccagccacccccaccacgctgtgcaccagggcctggagggggacctgctggagcacatcagccccaccctgtctgtgtctggcctgggcgcccctgagcacagcgtgatgcctgcccagatccacccccaccacctgggcgccatgggccacctgcaccaggccatgggcatgagccacccccacacagtggccccccacagcgccatgcctgcctgcctgagtgatgtggagagtgacccccgggagctggaggcctttgctgagcgcttcaagcagaggcgcatcaagctgggcgtgacccaggctgatgtgggcgccgccctggccaacctgaagatccctggggtgggcagcctgagccagagcaccatctgccgctttgagagcctgaccctgagccacaacaacatgattgccctgaagcctgtgctgcaggcctggctggaggaggccgaggccgcctaccgggagaagaacagcaagccagagctgttcaacggcagcgagaggaagaggaagaggaccagcattgctgcccctgagaagaggagcctggaggcctactttgccatccagccccggcccagcagcgagaagattgctgccatcgccgagaagctggacctgaagaagaatgtggtgcgggtgtggttctgcaaccagaggcagaagcagaagaggatgaagtacagcgctgtgcactag

SEQ ID NO: 155338 - DNA, 1038 bp, Artificial Sequence
  Description of Artificial Sequence: Synthetic coding sequence
atgaccctgctggaggtgccctttgcccgctacctggccatgaacaaggtgaagaagatgaagcgctaccacgtgggcaaggtgtggaggcgggagagccccaccatcgtgcagggccgctaccgggagttctgccagtgtgactttgatattgctggccagtttgaccccatgatcccagatgctgaatgtctgaagatcatgtgtgagatcctgagcggcctgcagctgggggacttcctgatcaagatggcctggaaggatgtgagacatgagatggtggtgaagaagggcctggcccctgaggtggccgacagaattggagactatgtgcagtgccacggcggcgtgtccctggtggagcagatgttccaggacccccggctgagccagaacaagcaggccctggagggcctgggggacctgaagctgctgtttgagtacctgaccctgtttggaattgctgacaagatcagctttgacctgagcctggcccggggcctggactactacacaggagtcatctatgaggccgtgctgctgcagacccccacccaggccggggaggagcccctgaatgtgggctctgtggccgccggcggccgctatgatggcctggtgggcatgtttgaccccaagggccacaaggtgccctgtgtgggcctgagcattggagtggagcgcatcttctacatcgtggagcagaggatgaagaccaagggggagaaggtgaggaccacagagacccaggtgtttgtggccaccccccagaagaacttcctgcaggagcggctgaagctgattgctgagctgtgggacagcggcatcaaggccgagatgctgtacaagaacaaccccaagctgctgacccagctgcactactgtgagagcacaggcatccccctggtggtgatcatcggggagcaggagctgaaggagggcgtcatcaagatccgctctgtggccagccgggaggaggtggccatcaagcgggagaactttgtggccgagatccagaagaggctgtctgagagctag

SEQ ID NO: 155339 - DNA, 1179 bp, Artificial Sequence
  Description of Artificial Sequence: Synthetic coding sequence
atgcccctgctgggcctgctgccccggcgggcctgggccagcctgctgagccagctgctgcggcccccctgtgccagctgcaccggggctgtgcgctgccagagccaggtggccgaggccgtgctgaccagccagctgaaggcccaccaggagaagcccaacttcatcatcaagacccccaaggactttgatattgctggccagtttgaccccatgatcccagatgctgaatgtctgaagatcatgtgtgagatcctgagcggcctgcagctgggggacttcctgatcaaggtgaatgacagaagaattgtggatggcatgtttgctgtgtgtggggtgcctgagagcaagttccgggccatctgcagcagcattgacaagctggacaagatggcctggaaggatgtgagacatgagatggtggtgaagaagggcctggcccctgaggtggccgaccgcatcggggactatgtgcagtgccacggcggcgtgtccctggtggagcagatgttccaggacccccggctgagccagaacaagcaggccctggagggcctgggggacctgaagctgctgtttgagtacctgaccctgtttggaattgctgacaagatcagctttgacctgagcctggcccggggcctggactactacacaggagtcatctatgaagctgtgctgctgcagacccccacccaggccggggaggagcccctgaatgtgggctctgtggccgccggcggccgctatgatggcctggtgggcatgtttgaccccaagggccacaaggtgccctgtgtgggcctgagcattggagtggagcgcatcttctacatcgtggagcagaggatgaagaccaagggggagaaggtgaggaccacagagacccaggtgtttgtggccaccccccagaagaacttcctgcaggagcggctgaagctgattgctgagctgtgggacagcggcatcaaggccgagatgctgtacaagaacaaccccaagctgctgacccagctgcactactgtgagagcacaggcatccccctggtggtgatcattggagagcaggagctgaaggagggcgtcatcaagatccgctctgtggccagccgggaggaggtggccatcaagagagaaaattttgtggccgagatccagaagaggctgtctgagagctag

SEQ ID NO: 155340 - DNA, 1401 bp, Artificial Sequence
  Description of Artificial Sequence: Synthetic coding sequence
atgcccctgctgggcctgctgccccggcgggcctgggccagcctgctgagccagctgctgcggcccccctgtgccagctgcaccggggctgtgcgctgccagagccaggtggccgaggccgtgctgaccagccagctgaaggcccaccaggagaagcccaacttcatcatcaagacccccaaggagaccctgacagagaagtacggggaggacagcggcctgatgtatgacctgaaggaccagggcggggagctgctgagcctgcgctatgacctgactgtgccctttgcccgctacctggccatgaacaaggtgaagaagatgaagcgctaccacgtgggcaaggtgtggaggcgggagagccccaccatcgtgcagggccgctaccgggagttctgccagtgtgactttgatattgctggccagtttgaccccatgatcccagatgctgaatgtctgaagatcatgtgtgagatcctgagcggcctgcagctgggggacttcctgatcaaggtgaatgacagaagaattgtggatggcatgtttgctgtgtgtggggtgcctgagagcaagttccgggccatctgcagcagcattgacaagctggacaagatggcctggaaggatgtgagacatgagatggtggtgaagaagggcctggcccctgaggtggccgaccgcatcggggactatgtgcagtgccacggcggcgtgtccctggtggagcagatgttccaggacccccggctgagccagaacaagcaggccctggagggcctgggggacctgaagctgctgtttgagtacctgaccctgtttggaattgctgacaagatcagctttgacctgagcctggcccggggcctggactactacacaggagtcatctatgaagctgtgctgctgcagacccccacccaggccggggaggagcccctgaatgtgggctctgtggccgccggcggccgctatgatggcctggtgggcatgtttgaccccaagggccacaaggtgccctgtgtgggcctgagcattggagtggagcgcatcttctacatcgtggagcagaggatgaagaccaagggggagaaggtgaggaccacagagacccaggtgtttgtggccaccccccagaagaacttcctgcaggagcggctgaagctgattgctgagctgtgggacagcggcatcaaggccgagatgctgtacaagaacaaccccaagctgctgacccagctgcactactgtgagagcacaggcatccccctggtggtgatcattggagagcaggagctgaaggagggcgtcatcaagatccgctctgtggccagccgggaggaggtggccatcaagagagaaaattttgtggccgagatccagaagaggctgtctgagagctag

SEQ ID NO: 155341 - DNA, 1005 bp, Artificial Sequence
  Description of Artificial Sequence: Synthetic coding sequence
atgcccctgctgggcctgctgccccggcgggcctgggccagcctgctgagccagctgctgcggcccccctgtgccagctgcaccggggctgtgcgctgccagagccaggactttgatattgctggccagtttgaccccatgatcccagatgctgagtgcctgaagatcatgtgtgagatcctgagcggcctgcagctgggggacttcctgatcaagatggcctggaaggatgtgagacatgagatggtggtgaagaagggcctggcccctgaggtggccgaccgcatcggggactatgtgcagtgccacggcggcgtgtccctggtggagcagatgttccaggacccccggctgagccagaacaagcaggccctggagggcctgggggacctgaagctgctgtttgagtacctgaccctgtttggaattgctgacaagatcagctttgacctgagcctggcccggggcctggactactacacaggagtcatctatgaagctgtgctgctgcagacccccacccaggccggggaggagcccctgaatgtgggctctgtggccgccggcggccgctatgatggcctggtgggcatgtttgaccccaagggccacaaggtgccctgtgtgggcctgagcattggagtggagcgcatcttctacatcgtggagcagaggatgaagaccaagggggagaaggtgaggaccacagagacccaggtgtttgtggccaccccccagaagaacttcctgcaggagcggctgaagctgattgctgagctgtgggacagcggcatcaaggccgagatgctgtacaagaacaaccccaagctgctgacccagctgcactactgtgagagcacaggcatccccctggtggtgatcattggagagcaggagctgaaggagggcgtcatcaagatccgctctgtggccagccgggaggaggtggccatcaagagagaaaattttgtggccgagatccagaagaggctgtctgagagctag

SEQ ID NO: 155342 - DNA, 1446 bp, Artificial Sequence
  Description of Artificial Sequence: Synthetic coding sequence
atgcccctgctgggcctgctgccccggcgggcctgggccagcctgctgagccagctgctgcggcccccctgtgccagctgcaccggggctgtgcgctgccagagccagggcacccgggacctgagcccccagcacatggtggtgcgggagaagatcctggacctggtgatcagctgcttcaagagacatggagccaagggcatggacaccccagcctttgagctgaaggagaccctgacagagaagtatggagaagattctggcctgatgtatgacctgaaggaccagggcggggagctgctgagcctgcgctatgacctgactgtgccctttgcccgctacctggccatgaacaaggtgaagaagatgaagcgctaccacgtgggcaaggtgtggaggcgggagagccccaccatcgtgcagggccgctaccgggagttctgccagtgtgactttgatattgctggccagtttgaccccatgatcccagatgctgagtgcctgaagatcatgtgtgagatcctgagcggcctgcagctgggggacttcctgatcaaggtgaatgaccggcgcatcgtggatggcatgtttgctgtgtgtggggtgcctgagagcaagttccgggccatctgcagcagcattgacaagctggacaagatggcctggaaggatgtgagacatgagatggtggtgaagaagggcctggcccctgaggtggccgacagaattggagactatgtgcagtgccacggcggcgtgtccctggtggagcagatgttccaggacccccggctgagccagaacaagcaggccctggagggcctgggggacctgaagctgctgtttgagtacctgaccctgtttggaattgctgacaagatcagctttgacctgagcctggcccggggcctggactactacacaggagtcatctatgaggccgtgctgctgcagacccccacccaggccggggaggagcccctgaatgtgggctctgtggccgccggcggccgctatgatggcctggtgggcatgtttgaccccaagggccacaaggtgccctgtgtgggcctgagcattggagtggagcgcatcttctacatcgtggagcagaggatgaagaccaagggggagaaggtgaggaccacagagacccaggtgtttgtggccaccccccagaagaacttcctgcaggagcggctgaagctgattgctgagctgtgggacagcggcatcaaggccgagatgctgtacaagaacaaccccaagctgctgacccagctgcactactgtgagagcacaggcatccccctggtggtgatcatcggggagcaggagctgaaggagggcgtcatcaagatccgctctgtggccagccgggaggaggtggccatcaagcgggagaactttgtggccgagatccagaagaggctgtctgagagctag

SEQ ID NO: 155343 - DNA, 1185 bp, Artificial Sequence
  Description of Artificial Sequence: Synthetic coding sequence
atggattctgccctgagtgacccccacaacggcagcgctgaggccggcggccccaccaacagcaccaccaggcctcccagcaccccagagggcatcgccctggcctacggcagcctgctgctgatggccctgctgcccatcttctttggagccctgcggtctgtgcgctgtgcccggggcaagaatgccagtgacatgcctgagaccatcaccagcagagatgctgcccgcttccccatcatcgccagctgcaccctgctgggcctgtacctgttcttcaagatcttcagccaggagtacatcaacctgctgctgtccatgtacttctttgtgctgggcatcctggccctgagccacaccatcagccccttcatgaacaagttcttccctgccagcttccccaaccggcagtaccagctgctcttcacccagggcagcggggagaacaaggaggagatcatcaactatgaatttgacaccaaggacctggtgtgcctgggcctgagcagcatcgtgggcgtgtggtacctgctgaggaagcactggatcgccaacaacctgtttggcctggccttcagcctgaatggagtggagctgctgcacctgaacaacgtgtccacaggctgcatcctgctgggcggcctcttcatctatgatgtgttctgggtgtttggcaccaacgtgatggtgacagtggccaagagctttgaggcccccatcaagctggtgttcccccaggacctgctggagaagggcctggaggccaacaactttgccatgctgggcctgggagatgtggtgattcctggcatcttcatcgccctgctgctgcgctttgacatcagcctgaagaagaacacccacacctacttctacaccagctttgctgcctacatcttcggcctgggcctgaccatcttcatcatgcacatcttcaagcacgcccagcctgccctgctgtacctggtgcctgcctgcatcggcttccctgtgctggtggccctggccaagggggaggtgacagagatgttctcctatgagagcagcgctgagatcctgccccacaccccccggctgacccacttccccaccgtgtctggcagccctgccagcctggccgacagcatgcagcagaagctggccggccccaggagaagaagaccccagaaccccagcgccatgtag

SEQ ID NO: 155344 - DNA, 1134 bp, Artificial Sequence
  Description of Artificial Sequence: Synthetic coding sequence
atggattctgccctgagtgacccccacaacggcagcgctgaggccggcggccccaccaacagcaccaccaggcctcccagcaccccagagggcatcgccctggcctacggcagcctgctgctgatggccctgctgcccatcttctttggagccctgcggtctgtgcgctgtgcccggggcaagaatgccagtgacatgcctgagaccatcaccagcagagatgctgcccgcttccccatcatcgccagctgcaccctgctgggcctgtacctgttcttcaagatcttcagccaggagtacatcaacctgctgctgtccatgtacttctttgtgctgggcatcctggccctgagccacaccatcagccccttcatgaacaagttcttccctgccagcttccccaaccggcagtaccagctgctcttcacccagggcagcggggagaacaaggaggagatcatcaactatgaatttgacaccaaggacctggtgtgcctgggcctgagcagcatcgtgggcgtgtggtacctgctgaggaagcactggatcgccaacaacctgtttggcctggccttcagcctgaatggagtggagctgctgcacctgaacaacgtgtccacaggctgcatcctgctgggcggcctcttcatctatgatgtgttctgggtgtttggcaccaacgtgatggtgacagtggccaagagctttgaggcccccatcaagctggtgttcccccaggacctgctggagaagggcctggaggccaacaactttgccatgctgggcctgggagatgtggtgattcctggcatcttcatcgccctgctgctgcgctttgacatcagcctgaagaagaacacccacacctacttctacaccagctttgctgcctacatcttcggcctgggcctgaccatcttcatcatgcacatcttcaagcacgcccagcctgccctgctgtacctggtgcctgcctgcatcggcttccctgtgctggtggccctggccaagggggaggtgacagagatgttctcctatgaggagagcaaccccaaggaccctgctgctgtgacagagagcaaggagggcacagaggccagcgccagcaagggcctggagaagaaggagaagtag

SEQ ID NO: 155345 - DNA, 1008 bp, Artificial Sequence
  Description of Artificial Sequence: Synthetic coding sequence
atggattctgccctgagtgacccccacaacggcagcgctgaggccggcggccccaccaacagcaccaccaggcctcccagcaccccagagggcatcgccctggcctacggcagcctgctgctgatggccctgctgcccatcttctttggagccctgcggtctgtgcgctgtgcccggggcaagaatgccagtgacatgcctgagaccatcaccagcagagatgctgcccgcttccccatcatcgccagctgcaccctgctgggcctgtacctgttcttcaagatcttcagccaggagtacatcaacctgctgctgtccatgtacttctttgtgctgggcatcctggccctgagccacaccatcagccccttcatgaacaagttcttccctgccagcttccccaaccggcagtaccagctgctcttcacccagggcagcggggagaacaaggaggagatcatcaactatgaatttgacaccaaggacctggtgtgcctgggcctgagcagcatcgtgggcgtgtggtacctgctgaggaaggtgtttggcaccaacgtgatggtgacagtggccaagagctttgaggcccccatcaagctggtgttcccccaggacctgctggagaagggcctggaggccaacaactttgccatgctgggcctgggagatgtggtgattcctggcatcttcatcgccctgctgctgcgctttgacatcagcctgaagaagaacacccacacctacttctacaccagctttgctgcctacatcttcggcctgggcctgaccatcttcatcatgcacatcttcaagcacgcccagcctgccctgctgtacctggtgcctgcctgcatcggcttccctgtgctggtggccctggccaagggggaggtgacagagatgttctcctatgaggagagcaaccccaaggaccctgctgctgtgacagagagcaaggagggcacagaggccagcgccagcaagggcctggagaagaaggagaagtag

SEQ ID NO: 155346 - DNA, 1281 bp, Artificial Sequence
  Description of Artificial Sequence: Synthetic coding sequence
atggattctgccctgagtgacccccacaacggcagcgctgaggccggcggccccaccaacagcaccaccaggcctcccagcaccccagagggcatcgccctggcctacggcagcctgctgctgatggccctgctgcccatcttctttggagccctgcggtctgtgcgctgtgcccggggcaagaatgccagtgacatgcctgagaccatcaccagcagagatgctgcccgcttccccatcatcgccagctgcaccctgctgggcctgtacctgttcttcaagatcttcagccaggagtacatcaacctgctgctgtccatgtacttctttgtgctgggcatcctggccctgagccacaccatcagccccttcatgaacaagttcttccctgccagcttccccaaccggcagtaccagctgctcttcacccagggcagcggggagaacaaggaggagatcatcaactatgaatttgacaccaaggacctggtgtgcctgggcctgagcagcatcgtgggcgtgtggtacctgctgaggaagcactggatcgccaacaacctgtttggcctggccttcagcctgaatggagtggagctgctgcacctgaacaacgtgtccacaggctgcatcctgctgggcggcctcttcatctatgatgtgttctgggtgtttggcaccaacgtgatggtgacagtggccaagagctttgaggcccccatcaagctggtgttcccccaggacctgctggagaagggcctggaggccaacaactttgccatgctgggcctgggagatgtggtgattcctggcatcttcatcgccctgctgctgcgctttgacatcagcctgaagaagaacacccacacctacttctacaccagctttgctgcctacatcttcggcctgggcctgaccatcttcatcatgcacatcttcaagcacgcccagcctgccctgctgtacctggtgcctgcctgcatcggcttccctgtgctggtggccctggccaagggggaggtgacagagatgttctcctatgagagcagcgctgagatcctgccccacaccccccggctgacccacttccccaccgtgtctggcagccctgccagcctggccgacagcatgcagcagaagctggccggccccaggagaagaagaccccagaaccccagcgccatctatgaggagagcaaccccaaggaccctgctgctgtgacagagagcaaggagggcacagaggccagcgccagcaagggcctggagaagaaggagaagtag

SEQ ID NO: 155347 - DNA, 3411 bp, Artificial Sequence
  Description of Artificial Sequence: Synthetic coding sequence
atgttcagcaggaagaagcgggagctgatgaagacccccagcatcagcaagaagaacagagctggcagccccagcccccagcccagcggggagctgcccaggaaggatggagcagatgctgtgtttcctggccccagcctggagcccccagctggcagcagcggcgtgaaggccaccggcaccctgaagaggcccaccagcctgagcagacatgccagcgctgctggcttccccctgagcggggccgcctcctggaccctgggccgcagccacaggagccccctgacagctgccagccctggagagctgcccacagaaggagctggcccagatgtggtggaggacatcagccacctgctggctgatgtggccaggtttgctgagggcctggagaagctgaaggaatgtgtgctgagagatgacctgctggaggcccggcggccccgggcccacgagtgcctgggggaggccctgcgggtgatgcaccagatcatcagcaagtaccccctgctgaacacagtggagaccctgacagctgctggcaccctcatcgccaaggtgaaggccttccactatgagagcaacaatgacctggagaagcaggagtttgagaaggccctggagaccatcgctgtggccttcagcagcacagtgtctgagttcctgatgggagaggtggacagcagcaccctgctggccgtgcccccaggggacagcagccagagcatggagagcctgtatggccctggcagcgagggcaccccacccagcctggaggactgtgatgctggctgcctgcctgctgaggaggtggatgtgctgctgcagagatgtgagggcggcgtggatgctgccctgctgtatgccaagaacatggccaagtacatgaaggacctgatctcctacctggagaagaggaccaccctggagatggagtttgccaagggcctgcagaagatcgcccacaactgccggcagagcgtgatgcaggagccccacatgcccctgctgagcatctacagcctggccctggagcaggacctggagtttggccacagcatggtgcaggccgtgggcaccctgcagacccagaccttcatgcagcccctgaccctgcggcggctggagcacgagaagaggaggaaggagatcaaggaggcctggcaccgggcccagaggaagctgcaggaggccgagagcaacctgaggaaggccaagcagggctacgtgcagagatgtgaggaccatgacaaggcccgcttcctggtggccaaggccgaggaggagcaggccggcagcgcccctggagctggcagcacagccaccaagaccctggacaagagaagaaggctggaggaggaggccaagaacaaggccgaggaggccatggccacctaccgcacctgtgtggctgatgccaagacccagaagcaggagctggaggacaccaaggtgacagccctgcggcagatccaggaggtgatccggcagagcgaccagaccatcaagagcgccaccatctcctactaccagatgatgcacatgcagacagcccccctgcctgtgcacttccagatgctgtgtgagagcagcaagctgtatgaccccggccagcagtatgccagccacgtgcggcagctgcagagggaccaggagccagatgtgcactatgactttgagccccacgtgtctgccaatgcctggagccctgtgatgagggccaggaagagcagcttcaacgtgtctgatgtggcccggcctgaggccgccggcagccccccagaggagggcggctgcacagagggcaccccagccaaggaccaccgggccggccggggccaccaggtgcacaagtcctggcccctgagcatcagtgacagcgacagcggcctggaccccggccctggagctggggacttcaagaagtttgagaggaccagcagcagcggcaccatgagcagcacagaggagctggtggaccctgatggaggagctggggccagcgcctttgagcaggccgacctgaatggcatgaccccagagctgcctgtggccgtgcccagcggccccttcagacatgagggcctgagcaaggccgcccggacccaccggctgaggaagctgcggaccccagccaagtgccgggagtgcaacagctatgtgtacttccagggcgcagaatgtgaggagtgctgcctggcctgccacaagaagtgcctggagaccctggccatccagtgtggccacaagaagctgcagggccgcctgcagctgtttggccaggacttcagccacgccgcccggagcgccccagatggagtgcccttcatcgtgaagaagtgtgtgtgtgaaattgaaagaagagccctgcggaccaagggcatctacagagtgaatggagtgaagaccagggtggagaagctgtgccaggcctttgaaaatggcaaggagctggtggagctgagccaggccagcccccatgacatcagcaatgtgctgaagctgtacctgcggcagctgcctgagcccctcatctccttccggctgtaccacgagctggtgggcctggccaaggacagcctgaaggccgaggccgaggccaaggccgccagccggggccggcaggacggcagcgagagcgaggccgtggccgtggccctggccggccgcctgcgggagctgctgcgggacctgcccccagaaaatagagccagcctgcagtacctgctgcggcacctgcggcgcatcgtggaggtggagcaggacaacaagatgaccccaggcaacctgggcatcgtgtttggccccaccctgctgcggccccggcccacagaggccaccgtgtccctgagcagcctggtggactacccccaccaggcccgggtgattgagaccctgattgtgcactacggcctggtgtttgaggaggagcctgaggagacccctgggggccaggatgagagcagcaaccagagagctgaggtggtggtgcaggtgccctacctggaggccggggaggccgtggtgtaccccctgcaggaggccgctgctgatggctgccgggagagccgggtggtgtccaatgacagcgacagcgacctggaggaggccagcgagctgctgagcagcagcgaggccagcgccctgggccacctgtccttcctggagcagcagcagagcgaggccagcctggaggtggccagcggcagccacagcggcagcgaggagcagctggaggccacagcccgggaggatggagatggagatgaagatggccctgcccagcagctgagcggcttcaacaccaaccagagcaacaacgtgctgcaggcccccctgccccccatgaggctgcggggcggccgcatgaccctgggcagctgccgggagcggcagcctgagtttgtgtag

SEQ ID NO: 155348 - DNA, 3393 bp, Artificial Sequence
  Description of Artificial Sequence: Synthetic coding sequence
tcctacagcccctacagagctggccggcagggcccccagcagaggggccgggaccccggcatccagctgacagagctgcccaggaaggatggagcagatgctgtgtttcctggccccagcctggagcccccagctggcagcagcggcgtgaaggccaccggcaccctgaagaggcccaccagcctgagcagacatgccagcgctgctggcttccccctgagcggggccgcctcctggaccctgggccgcagccacaggagccccctgacagctgccagccctggagagctgcccacagaaggagctggcccagatgtggtggaggacatcagccacctgctggctgatgtggccaggtttgctgagggcctggagaagctgaaggaatgtgtgctgagagatgacctgctggaggcccggcggccccgggcccacgagtgcctgggggaggccctgcgggtgatgcaccagatcatcagcaagtaccccctgctgaacacagtggagaccctgacagctgctggcaccctcatcgccaaggtgaaggccttccactatgagagcaacaatgacctggagaagcaggagtttgagaaggccctggagaccatcgctgtggccttcagcagcacagtgtctgagttcctgatgggagaggtggacagcagcaccctgctggccgtgcccccaggggacagcagccagagcatggagagcctgtatggccctggcagcgagggcaccccacccagcctggaggactgtgatgctggctgcctgcctgctgaggaggtggatgtgctgctgcagagatgtgagggcggcgtggatgctgccctgctgtatgccaagaacatggccaagtacatgaaggacctgatctcctacctggagaagaggaccaccctggagatggagtttgccaagggcctgcagaagatcgcccacaactgccggcagagcgtgatgcaggagccccacatgcccctgctgagcatctacagcctggccctggagcaggacctggagtttggccacagcatggtgcaggccgtgggcaccctgcagacccagaccttcatgcagcccctgaccctgcggcggctggagcacgagaagaggaggaaggagatcaaggaggcctggcaccgggcccagaggaagctgcaggaggccgagagcaacctgaggaaggccaagcagggctacgtgcagagatgtgaggaccatgacaaggcccgcttcctggtggccaaggccgaggaggagcaggccggcagcgcccctggagctggcagcacagccaccaagaccctggacaagagaagaaggctggaggaggaggccaagaacaaggccgaggaggccatggccacctaccgcacctgtgtggctgatgccaagacccagaagcaggagctggaggacaccaaggtgacagccctgcggcagatccaggaggtgatccggcagagcgaccagaccatcaagagcgccaccatctcctactaccagatgatgcacatgcagacagcccccctgcctgtgcacttccagatgctgtgtgagagcagcaagctgtatgaccccggccagcagtatgccagccacgtgcggcagctgcagagggaccaggagccagatgtgcactatgactttgagccccacgtgtctgccaatgcctggagccctgtgatgagggccaggaagagcagcttcaacgtgtctgatgtggcccggcctgaggccgccggcagccccccagaggagggcggctgcacagagggcaccccagccaaggaccaccgggccggccggggccaccaggtgcacaagtcctggcccctgagcatcagtgacagcgacagcggcctggaccccggccctggagctggggacttcaagaagtttgagaggaccagcagcagcggcaccatgagcagcacagaggagctggtggaccctgatggaggagctggggccagcgcctttgagcaggccgacctgaatggcatgaccccagagctgcctgtggccgtgcccagcggccccttcagacatgagggcctgagcaaggccgcccggacccaccggctgaggaagctgcggaccccagccaagtgccgggagtgcaacagctatgtgtacttccagggcgcagaatgtgaggagtgctgcctggcctgccacaagaagtgcctggagaccctggccatccagtgtggccacaagaagctgcagggccgcctgcagctgtttggccaggacttcagccacgccgcccggagcgccccagatggagtgcccttcatcgtgaagaagtgtgtgtgtgaaattgaaagaagagccctgcggaccaagggcatctacagagtgaatggagtgaagaccagggtggagaagctgtgccaggcctttgaaaatggcaaggagctggtggagctgagccaggccagcccccatgacatcagcaatgtgctgaagctgtacctgcggcagctgcctgagcccctcatctccttccggctgtaccacgagctggtgggcctggccaaggacagcctgaaggccgaggccgaggccaaggccgccagccggggccggcaggacggcagcgagagcgaggccgtggccgtggccctggccggccgcctgcgggagctgctgcgggacctgcccccagaaaatagagccagcctgcagtacctgctgcggcacctgcggcgcatcgtggaggtggagcaggacaacaagatgaccccaggcaacctgggcatcgtgtttggccccaccctgctgcggccccggcccacagaggccaccgtgtccctgagcagcctggtggactacccccaccaggcccgggtgattgagaccctgattgtgcactacggcctggtgtttgaggaggagcctgaggagacccctgggggccaggatgagagcagcaaccagagagctgaggtggtggtgcaggtgccctacctggaggccggggaggccgtggtgtaccccctgcaggaggccgctgctgatggctgccgggagagccgggtggtgtccaatgacagcgacagcgacctggaggaggccagcgagctgctgagcagcagcgaggccagcgccctgggccacctgtccttcctggagcagcagcagagcgaggccagcctggaggtggccagcggcagccacagcggcagcgaggagcagctggaggccacagcccgggaggatggagatggagatgaagatggccctgcccagcagctgagcggcttcaacaccaaccagagcaacaacgtgctgcaggcccccctgccccccatgaggctgcggggcggccgcatgaccctgggcagctgccgggagcggcagcctgagtttgtgtag

SEQ ID NO: 155349 - DNA, 3015 bp, Artificial Sequence
  Description of Artificial Sequence: Synthetic coding sequence
atgcaccagatcatcagcaagtaccccctgctgaacacagtggagaccctgacagctgctggcaccctcatcgccaaggtgaaggccttccactatgagagcaacaatgacctggagaagcaggagtttgagaaggccctggagaccatcgctgtggccttcagcagcacagtgtctgagttcctgatgggagaggtggacagcagcaccctgctggccgtgcccccaggggacagcagccagagcatggagagcctgtatggccctggcagcgagggcaccccacccagcctggaggactgtgatgctggctgcctgcctgctgaggaggtggatgtgctgctgcagagatgtgagggcggcgtggatgctgccctgctgtatgccaagaacatggccaagtacatgaaggacctgatctcctacctggagaagaggaccaccctggagatggagtttgccaagggcctgcagaagatcgcccacaactgccggcagagcgtgatgcaggagccccacatgcccctgctgagcatctacagcctggccctggagcaggacctggagtttggccacagcatggtgcaggccgtgggcaccctgcagacccagaccttcatgcagcccctgaccctgcggcggctggagcacgagaagaggaggaaggagatcaaggaggcctggcaccgggcccagaggaagctgcaggaggccgagagcaacctgaggaaggccaagcagggctacgtgcagagatgtgaggaccatgacaaggcccgcttcctggtggccaaggccgaggaggagcaggccggcagcgcccctggagctggcagcacagccaccaagaccctggacaagagaagaaggctggaggaggaggccaagaacaaggccgaggaggccatggccacctaccgcacctgtgtggctgatgccaagacccagaagcaggagctggaggacaccaaggtgacagccctgcggcagatccaggaggtgatccggcagagcgaccagaccatcaagagcgccaccatctcctactaccagatgatgcacatgcagacagcccccctgcctgtgcacttccagatgctgtgtgagagcagcaagctgtatgaccccggccagcagtatgccagccacgtgcggcagctgcagagggaccaggagccagatgtgcactatgactttgagccccacgtgtctgccaatgcctggagccctgtgatgagggccaggaagagcagcttcaacgtgtctgatgtggcccggcctgaggccgccggcagccccccagaggagggcggctgcacagagggcaccccagccaaggaccacagaggagaatgtcctgctggcccccggggcggccgctggctgcctgccacccaccctggccccagccctgagacccccctgagccctgctggccggggccaccaggtgcacaagtcctggcccctgagcatcagtgacagcgacagcggcctggaccccggccctggagctggggacttcaagaagtttgagaggaccagcagcagcggcaccatgagcagcacagaggagctggtggaccctgatggaggagctggggccagcgcctttgagcaggccgacctgaatggcatgaccccagagctgcctgtggccgtgcccagcggccccttcagacatgagggcctgagcaaggccgcccggacccaccggctgaggaagctgcggaccccagccaagtgccgggagtgcaacagctatgtgtacttccagggcgcagaatgtgaggagtgctgcctggcctgccacaagaagtgcctggagaccctggccatccagtgtggccacaagaagctgcagggccgcctgcagctgtttggccaggacttcagccacgccgcccggagcgccccagatggagtgcccttcatcgtgaagaagtgtgtgtgtgaaattgaaagaagagccctgcggaccaagggcatctacagagtgaatggagtgaagaccagggtggagaagctgtgccaggcctttgaaaatggcaaggagctggtggagctgagccaggccagcccccatgacatcagcaatgtgctgaagctgtacctgcggcagctgcctgagcccctcatctccttccggctgtaccacgagctggtgggcctggccaaggacagcctgaaggccgaggccgaggccaaggccgccagccggggccggcaggacggcagcgagagcgaggccgtggccgtggccctggccggccgcctgcgggagctgctgcgggacctgcccccagaaaatagagccagcctgcagtacctgctgcggcacctgcggcgcatcgtggaggtggagcaggacaacaagatgaccccaggcaacctgggcatcgtgtttggccccaccctgctgcggccccggcccacagaggccaccgtgtccctgagcagcctggtggactacccccaccaggcccgggtgattgagaccctgattgtgcactacggcctggtgtttgaggaggagcctgaggagacccctgggggccaggatgagagcagcaaccagagagctgaggtggtggtgcaggtgccctacctggaggccggggaggccgtggtgtaccccctgcaggaggccgctgctgatggctgccgggagagccgggtggtgtccaatgacagcgacagcgacctggaggaggccagcgagctgctgagcagcagcgaggccagcgccctgggccacctgtccttcctggagcagcagcagagcgaggccagcctggaggtggccagcggcagccacagcggcagcgaggagcagctggaggccacagcccgggaggatggagatggagatgaagatggccctgcccagcagctgagcggcttcaacaccaaccagagcaacaacgtgctgcaggcccccctgccccccatgaggctgcggggcggccgcatgaccctgggcagctgccgggagcggcagcctgagtttgtgtag

SEQ ID NO: 155350 - DNA, 3459 bp, Artificial Sequence
  Description of Artificial Sequence: Synthetic coding sequence
atgagccggggccagagggtgctgaagggcctgctgggctgggtgtgcacctggacctgggcctggagggcccggctgggcgcccggggctgcggcctgcacgtgctgtgcccccgggacctgcccctgcccccagaggagctgcccaggaaggatggagcagatgctgtgtttcctggccccagcctggagcccccagctggcagcagcggcgtgaaggccaccggcaccctgaagaggcccaccagcctgagcagacatgccagcgctgctggcttccccctgagcggggccgcctcctggaccctgggccgcagccacaggagccccctgacagctgccagccctggagagctgcccacagaaggagctggcccagatgtggtggaggacatcagccacctgctggctgatgtggccaggtttgctgagggcctggagaagctgaaggaatgtgtgctgagagatgacctgctggaggcccggcggccccgggcccacgagtgcctgggggaggccctgcgggtgatgcaccagatcatcagcaagtaccccctgctgaacacagtggagaccctgacagctgctggcaccctcatcgccaaggtgaaggccttccactatgagagcaacaatgacctggagaagcaggagtttgagaaggccctggagaccatcgctgtggccttcagcagcacagtgtctgagttcctgatgggagaggtggacagcagcaccctgctggccgtgcccccaggggacagcagccagagcatggagagcctgtatggccctggcagcgagggcaccccacccagcctggaggactgtgatgctggctgcctgcctgctgaggaggtggatgtgctgctgcagagatgtgagggcggcgtggatgctgccctgctgtatgccaagaacatggccaagtacatgaaggacctgatctcctacctggagaagaggaccaccctggagatggagtttgccaagggcctgcagaagatcgcccacaactgccggcagagcgtgatgcaggagccccacatgcccctgctgagcatctacagcctggccctggagcaggacctggagtttggccacagcatggtgcaggccgtgggcaccctgcagacccagaccttcatgcagcccctgaccctgcggcggctggagcacgagaagaggaggaaggagatcaaggaggcctggcaccgggcccagaggaagctgcaggaggccgagagcaacctgaggaaggccaagcagggctacgtgcagagatgtgaggaccatgacaaggcccgcttcctggtggccaaggccgaggaggagcaggccggcagcgcccctggagctggcagcacagccaccaagaccctggacaagagaagaaggctggaggaggaggccaagaacaaggccgaggaggccatggccacctaccgcacctgtgtggctgatgccaagacccagaagcaggagctggaggacaccaaggtgacagccctgcggcagatccaggaggtgatccggcagagcgaccagaccatcaagagcgccaccatctcctactaccagatgatgcacatgcagacagcccccctgcctgtgcacttccagatgctgtgtgagagcagcaagctgtatgaccccggccagcagtatgccagccacgtgcggcagctgcagagggaccaggagccagatgtgcactatgactttgagccccacgtgtctgccaatgcctggagccctgtgatgagggccaggaagagcagcttcaacgtgtctgatgtggcccggcctgaggccgccggcagccccccagaggagggcggctgcacagagggcaccccagccaaggaccaccgggccggccggggccaccaggtgcacaagtcctggcccctgagcatcagtgacagcgacagcggcctggaccccggccctggagctggggacttcaagaagtttgagaggaccagcagcagcggcaccatgagcagcacagaggagctggtggaccctgatggaggagctggggccagcgcctttgagcaggccgacctgaatggcatgaccccagagctgcctgtggccgtgcccagcggccccttcagacatgagggcctgagcaaggccgcccggacccaccggctgaggaagctgcggaccccagccaagtgccgggagtgcaacagctatgtgtacttccagggcgcagaatgtgaggagtgctgcctggcctgccacaagaagtgcctggagaccctggccatccagtgtggccacaagaagctgcagggccgcctgcagctgtttggccaggacttcagccacgccgcccggagcgccccagatggagtgcccttcatcgtgaagaagtgtgtgtgtgaaattgaaagaagagccctgcggaccaagggcatctacagagtgaatggagtgaagaccagggtggagaagctgtgccaggcctttgaaaatggcaaggagctggtggagctgagccaggccagcccccatgacatcagcaatgtgctgaagctgtacctgcggcagctgcctgagcccctcatctccttccggctgtaccacgagctggtgggcctggccaaggacagcctgaaggccgaggccgaggccaaggccgccagccggggccggcaggacggcagcgagagcgaggccgtggccgtggccctggccggccgcctgcgggagctgctgcgggacctgcccccagaaaatagagccagcctgcagtacctgctgcggcacctgcggcgcatcgtggaggtggagcaggacaacaagatgaccccaggcaacctgggcatcgtgtttggccccaccctgctgcggccccggcccacagaggccaccgtgtccctgagcagcctggtggactacccccaccaggcccgggtgattgagaccctgattgtgcactacggcctggtgtttgaggaggagcctgaggagacccctgggggccaggatgagagcagcaaccagagagctgaggtggtggtgcaggtgccctacctggaggccggggaggccgtggtgtaccccctgcaggaggccgctgctgatggctgccgggagagccgggtggtgtccaatgacagcgacagcgacctggaggaggccagcgagctgctgagcagcagcgaggccagcgccctgggccacctgtccttcctggagcagcagcagagcgaggccagcctggaggtggccagcggcagccacagcggcagcgaggagcagctggaggccacagcccgggaggatggagatggagatgaagatggccctgcccagcagctgagcggcttcaacaccaaccagagcaacaacgtgctgcaggcccccctgccccccatgaggctgcggggcggccgcatgaccctgggcagctgccgggagcggcagcctgagtttgtgtag

SEQ ID NO: 155351 - DNA, 3060 bp, Artificial Sequence
  Description of Artificial Sequence: Synthetic coding sequence
atgtgcatctgtggcacagcccaccctgtgctggatgagggccctgtgcgctgccgggccggcccccgggacctgctggaggcccggcggccccgggcccatgaatgtctgggggaggccctgcgggtgatgcaccagatcatcagcaagtaccccctgctgaacacagtggagaccctgacagctgctggcaccctgattgccaaggtgaaggccttccactatgagagcaacaatgacctggagaagcaggagtttgagaaggccctggagaccatcgctgtggccttcagcagcacagtgtctgagttcctgatgggagaggtggacagcagcaccctgctggccgtgcccccaggggacagcagccagagcatggagagcctgtatggccctggcagcgagggcaccccacccagcctggaggactgtgatgctggctgcctgcctgctgaggaggtggatgtgctgctgcagagatgtgagggcggcgtggatgctgccctgctgtatgccaagaacatggccaagtacatgaaggacctgatctcctacctggagaagaggaccaccctggagatggagtttgccaagggcctgcagaagatcgcccacaactgccggcagagcgtgatgcaggagccccacatgcccctgctgagcatctacagcctggccctggagcaggacctggagtttggccacagcatggtgcaggccgtgggcaccctgcagacccagaccttcatgcagcccctgaccctgcggcggctggagcacgagaagaggaggaaggagatcaaggaggcctggcaccgggcccagaggaagctgcaggaggccgagagcaacctgaggaaggccaagcagggctacgtgcagagatgtgaagatcatgacaaggcccgcttcctggtggccaaggccgaggaggagcaggccggcagcgcccctggggccggcagcacagccaccaagaccctggacaagagaagaaggctggaggaggaggccaagaacaaggccgaggaggccatggccacctaccgcacctgtgtggctgatgccaagacccagaagcaggagctggaggacaccaaggtgacagccctgcggcagatccaggaggtgatccggcagagcgaccagaccatcaagagcgccaccatctcctactaccagatgatgcacatgcagacagcccccctgcctgtgcacttccagatgctgtgtgagagcagcaagctgtatgaccccggccagcagtatgccagccacgtgcggcagctgcagagggaccaggagccagatgtgcactatgactttgagccccacgtgtctgccaatgcctggagccctgtgatgagggccaggaagagcagcttcaacgtgtctgatgtggcccggcctgaggccgccggcagccccccagaggagggcggctgcacagagggcaccccagccaaggaccacagagctggccggggccaccaggtgcacaagtcctggcccctgagcatcagtgacagcgacagcggcctggaccccggccctggggccggggacttcaagaagtttgagaggaccagcagcagcggcaccatgagcagcacagaggagctggtggaccctgatggaggagctggggccagcgcctttgagcaggccgacctgaatggcatgaccccagagctgcctgtggccgtgcccagcggccccttcagacatgagggcctgagcaaggccgcccggacccaccggctgaggaagctgcggaccccagccaagtgccgggagtgcaacagctatgtgtacttccagggcgcagaatgtgaggagtgctgcctggcctgccacaagaagtgcctggagaccctggccatccagtgtggccacaagaagctgcagggccgcctgcagctgtttggccaggacttcagccatgctgcccggagcgccccagatggagtgcccttcatcgtgaagaagtgtgtgtgtgaaattgaaagaagagccctgcggaccaagggcatctacagagtgaatggagtgaagaccagggtggagaagctgtgccaggcctttgaaaatggcaaggagctggtggagctgagccaggccagcccccatgacatcagcaatgtgctgaagctgtacctgcggcagctgcctgagcccctcatctccttccggctgtaccacgagctggtgggcctggccaaggacagcctgaaggccgaggccgaggccaaggccgccagccggggccggcaggacggcagcgagagcgaggccgtggccgtggccctggccggccgcctgcgggagctgctgcgggacctgcccccagagaacagagccagcctgcagtacctgctgcggcacctgcggagaattgtggaggtggagcaggacaacaagatgaccccaggcaacctgggcatcgtgtttggccccaccctgctgcggccccggcccacagaggccaccgtgtccctgagcagcctggtggactacccccaccaggcccgggtcatcgagaccctcatcgtgcactacggcctggtgtttgaggaggagcctgaggagaccccaggcggccaggatgagagcagcaaccagagagctgaggtggtggtgcaggtgccctacctggaggccggggaggccgtggtgtaccccctgcaggaggccgctgctgatggctgccgggagagccgggtggtgtccaatgacagcgacagcgacctggaggaggccagcgagctgctgagcagcagcgaggccagcgccctgggccacctgtccttcctggagcagcagcagagcgaggccagcctggaggtggccagcggcagccacagcggcagcgaggagcagctggaggccacagccagagaagatggagatggagatgaagatggccctgcccagcagctgagcggcttcaacaccaaccagagcaacaacgtgctgcaggcccccctgccccccatgaggctgcggggcggccgcatgaccctgggcagctgccgggagcggcagcctgagtttgtgtag

SEQ ID NO: 155352 - DNA, 2847 bp, Artificial Sequence
  Description of Artificial Sequence: Synthetic coding sequence
atgttcagcaggaagaagcgggagctgatgaagacccccagcatcagcaagaagaacagagctggcagccccagcccccagcccagcggggagctgcccaggaaggatggagcagatgctgtgtttcctggccccagcctggagcccccagctggcagcagcggcgtgaaggccaccggcaccctgaagaggcccaccagcctgagcagacatgccagcgctgctggcttccccctgagcggggccgcctcctggaccctgggccgcagccacaggagccccctgacagctgccagccctggagagctgcccacagaaggagctggcccagatgtggtggaggacatcagccacctgctggctgatgtggccaggtttgctgagggcctggagaagctgaaggaatgtgtgctgagagatgacctgctggaggcccggcggccccgggcccacgagtgcctgggggaggccctgcgggtgatgcaccagatcatcagcaagtaccccctgctgaacacagtggagaccctgacagctgctggcaccctcatcgccaaggtgaaggccttccactatgagagcaacaatgacctggagaagcaggagtttgagaaggccctggagaccatcgctgtggccttcagcagcacagtgtctgagttcctgatgggagaggtggacagcagcaccctgctggccgtgcccccaggggacagcagccagagcatggagagcctgtatggccctggcagcgagggcaccccacccagcctggaggactgtgatgctggctgcctgcctgctgaggaggtggatgtgctgctgcagagatgtgagggcggcgtggatgctgccctgctgtatgccaagaacatggccaagtacatgaaggacctgatctcctacctggagaagaggaccaccctggagatggagtttgccaagggcctgcagaagatcgcccacaactgccggcagagcgtgatgcaggagccccacatgcccctgctgagcatctacagcctggccctggagcaggacctggagtttggccacagcatggtgcaggccgtgggcaccctgcagacccagaccttcatgcagcccctgaccctgcggcggctggagcacgagaagaggaggaaggagatcaaggaggcctggcaccgggcccagaggaagctgcaggaggccgagagcaacctgaggaaggccaagcagggctacgtgcagagatgtgaggaccatgacaaggcccgcttcctggtggccaaggccgaggaggagcaggccggcagcgcccctggagctggcagcacagccaccaagaccctggacaagagaagaaggctggaggaggaggccaagaacaaggccgaggaggccatggccacctaccgcacctgtgtggctgatgccaagacccagaagcaggagctggaggacaccaaggtgacagccctgcggcagatccaggaggtgatccggcagagcgaccagaccatcaagagcgccaccatctcctactaccagatgatgcacatgcagacagcccccctgcctgtgcacttccagatgctgtgtgagagcagcaagctgtatgaccccggccagcagtatgccagccacgtgcggcagctgcagagggaccaggagccagatgtgcactatgactttgagccccacgtgtctgccaatgcctggagccctgtgatgagggccaggaagagcagcttcaacgtgtctgatgtggcccggcctgaggccgccggcagccccccagaggagggcggctgcacagagggcaccccagccaaggaccaccgggccggccggggccaccaggtgcacaagtcctggcccctgagcatcagtgacagcgacagcggcctggaccccggccctggagctggggacttcaagaagtttgagaggaccagcagcagcggcaccatgagcagcacagaggagctggtggaccctgatggaggagctggggccagcgcctttgagcaggccgacctgaatggcatgaccccagagctgcctgtggccgtgcccagcggccccttcagacatgagggcctgagcaaggccgcccggacccaccggctgaggaagctgcggaccccagccaagtgccgggagtgcaacagctatgtgtacttccagggcgcagaatgtgaggagtgctgcctggcctgccacaagaagtgcctggagaccctggccatccagtgtggccacaagaagctgcagggccgcctgcagctgtttggccaggacttcagccacgccgcccggagcgccccagatggagtgcccttcatcgtgaagaagtgtgtgtgtgaaattgaaagaagagccctgcggaccaagggcatctacagagtgaatggagtgaagaccagggtggagaagctgtgccaggcctttgaaaatggcaaggagctggtggagctgagccaggccagcccccatgacatcagcaatgtgctgaagctgtacctgcggcagctgcctgagcccctcatctccttccggctgtaccacgagctggtgggcctggccaaggacagcctgaaggccgaggccgaggccaaggccgccagccggggccggcaggacggcagcgagagcgaggccgtggccgtggccctggccggccgcctgcgggagctgctgcgggacctgcccccagaaaatagagccagcctgcagtacctgctgcggcacctgcggcgcatcgtggaggtggagcaggacaacaagatgacccccatgaggctgcggggcggccgcatgaccctgggcagctgccgggagcggcagcctgagtttgtgtag

SEQ ID NO: 155353 - DNA, 3492 bp, Artificial Sequence
  Description of Artificial Sequence: Synthetic coding sequence
atgttcagcaggaagaagcgggagctgatgaagacccccagcatcagcaagaagaacagagctggcagccccagcccccagcccagcggcccccacttcatctctggagaaacagaggccgtgtccaggcctgagaaccccttcaatgagctgcccagcgacctgcccaaggagctgcccaggaaggatggagcagatgctgtgtttcctggccccagcctggagcccccagctggcagcagtggagtgaaggccaccggcaccctgaagaggcccaccagcctgagcagacatgccagcgctgctggcttccccctgtctggagctgcctcctggaccctgggccgcagccacaggagccccctgacagctgccagccctggagagctgcccacagagggcgccggcccagatgtggtggaggacatcagccacctgctggctgatgtggccaggtttgctgagggcctggagaagctgaaggaatgtgtgctgagagatgacctgctggaggcccggcggccccgggcccatgaatgtctgggggaggccctgcgggtgatgcaccagatcatcagcaagtaccccctgctgaacacagtggagaccctgacagctgctggcaccctgattgccaaggtgaaggccttccactatgagagcaacaatgacctggagaagcaggagtttgagaaggccctggagaccatcgctgtggccttcagcagcacagtgtctgagttcctgatgggagaggtggacagcagcaccctgctggccgtgcccccaggggacagcagccagagcatggagagcctgtatggccctggcagcgagggcaccccacccagcctggaggactgtgatgctggctgcctgcctgctgaggaggtggatgtgctgctgcagagatgtgagggcggcgtggatgctgccctgctgtatgccaagaacatggccaagtacatgaaggacctgatctcctacctggagaagaggaccaccctggagatggagtttgccaagggcctgcagaagatcgcccacaactgccggcagagcgtgatgcaggagccccacatgcccctgctgagcatctacagcctggccctggagcaggacctggagtttggccacagcatggtgcaggccgtgggcaccctgcagacccagaccttcatgcagcccctgaccctgcggcggctggagcacgagaagaggaggaaggagatcaaggaggcctggcaccgggcccagaggaagctgcaggaggccgagagcaacctgaggaaggccaagcagggctacgtgcagagatgtgaagatcatgacaaggcccgcttcctggtggccaaggccgaggaggagcaggccggcagcgcccctggggccggcagcacagccaccaagaccctggacaagagaagaaggctggaggaggaggccaagaacaaggccgaggaggccatggccacctaccgcacctgtgtggctgatgccaagacccagaagcaggagctggaggacaccaaggtgacagccctgcggcagatccaggaggtgatccggcagagcgaccagaccatcaagagcgccaccatctcctactaccagatgatgcacatgcagacagcccccctgcctgtgcacttccagatgctgtgtgagagcagcaagctgtatgaccccggccagcagtatgccagccacgtgcggcagctgcagagggaccaggagccagatgtgcactatgactttgagccccacgtgtctgccaatgcctggagccctgtgatgagggccaggaagagcagcttcaacgtgtctgatgtggcccggcctgaggccgccggcagccccccagaggagggcggctgcacagagggcaccccagccaaggaccacagagctggccggggccaccaggtgcacaagtcctggcccctgagcatcagtgacagcgacagcggcctggaccccggccctggggccggggacttcaagaagtttgagaggaccagcagcagcggcaccatgagcagcacagaggagctggtggaccctgatggaggagctggggccagcgcctttgagcaggccgacctgaatggcatgaccccagagctgcctgtggccgtgcccagcggccccttcagacatgagggcctgagcaaggccgcccggacccaccggctgaggaagctgcggaccccagccaagtgccgggagtgcaacagctatgtgtacttccagggcgcagaatgtgaggagtgctgcctggcctgccacaagaagtgcctggagaccctggccatccagtgtggccacaagaagctgcagggccgcctgcagctgtttggccaggacttcagccatgctgcccggagcgccccagatggagtgcccttcatcgtgaagaagtgtgtgtgtgaaattgaaagaagagccctgcggaccaagggcatctacagagtgaatggagtgaagaccagggtggagaagctgtgccaggcctttgaaaatggcaaggagctggtggagctgagccaggccagcccccatgacatcagcaatgtgctgaagctgtacctgcggcagctgcctgagcccctcatctccttccggctgtaccacgagctggtgggcctggccaaggacagcctgaaggccgaggccgaggccaaggccgccagccggggccggcaggacggcagcgagagcgaggccgtggccgtggccctggccggccgcctgcgggagctgctgcgggacctgcccccagagaacagagccagcctgcagtacctgctgcggcacctgcggagaattgtggaggtggagcaggacaacaagatgaccccaggcaacctgggcatcgtgtttggccccaccctgctgcggccccggcccacagaggccaccgtgtccctgagcagcctggtggactacccccaccaggcccgggtcatcgagaccctcatcgtgcactacggcctggtgtttgaggaggagcctgaggagaccccaggcggccaggatgagagcagcaaccagagagctgaggtggtggtgcaggtgccctacctggaggccggggaggccgtggtgtaccccctgcaggaggccgctgctgatggctgccgggagagccgggtggtgtccaatgacagcgacagcgacctggaggaggccagcgagctgctgagcagcagcgaggccagcgccctgggccacctgtccttcctggagcagcagcagagcgaggccagcctggaggtggccagcggcagccacagcggcagcgaggagcagctggaggccacagccagagaagatggagatggagatgaagatggccctgcccagcagctgagcggcttcaacaccaaccagagcaacaacgtgctgcaggcccccctgccccccatgaggctgcggggcggccgcatgaccctgggcagctgccgggagcggcagcctgagtttgtgtag

SEQ ID NO: 155354 - DNA, 420 bp, Artificial Sequence
  Description of Artificial Sequence: Synthetic coding sequence
atgagcatcagcagcgccctggccatggtgttcatgggcgccaagggcaacacagctgcccagatgagccaggccctgtgcttcagcaagattggaggagaagatggagacatccaccggggcttccagagcctgctggtggccatcaacagaacagacacagaatatgtgctgaggacagccaacggcctgtttggagagaagagctatgacttcctgaccggcttcacagacagctgtgggaagttctaccaggccaccatcaagcagctggactttgtgaatgacacagagaagagcaccaccagggtgaacagctgggtggccgacaagaccaagggggagaacatcctgctcttctactttgacaacatcctgaacagcttcatcgtgagcagcctgcagaactgccagatctag

SEQ ID NO: 155355 - DNA, 162 bp, Artificial Sequence
  Description of Artificial Sequence: Synthetic coding sequence
atggagatcttcatcgaggtgttcagccacttcctgctgcagctgacagagctgaccctgaacatgtgcctggagctgcccaccggcagcctggagaagagcctgatgatcagcagccaggtgctgcagatccctgtggccaacagcaccaagcagaggtag

SEQ ID NO: 155356 - DNA, 648 bp, Artificial Sequence
  Description of Artificial Sequence: Synthetic coding sequence
atgtctgagaccgtgcccccagccccagctgccagcgctgcccctgagaagcccctggccggcaagaaggccaagaagccagccaaggctgctgctgccagcaagaagaagccagctggccccagcgtgtctgagctgattgtgcaggccgccagcagcagcaaggagcggggcggcgtgtccctggccgccctgaagaaggccctggccgccgccggctatgatgtggagaagaacaacagccgcatcaagctgggcatcaagagcctggtgtccaagggcaccctggtgcagaccaagggcaccggggccagcggcagcttcaagctgaacaagaaggccagctctgtggagaccaagccaggggccagcaaggtggccaccaagaccaaggccactggagccagcaagaagctgaagaaggccactggagccagcaagaagtctgtgaagacccccaagaaggccaagaagccagctgccaccaggaagagcagcaagaaccccaagaagcccaagacagtgaagcccaagaaggtggccaagagccctgccaaggccaaggctgtgaagcccaaggccgccaaggcccgggtgaccaagcccaagacagccaagcccaagaaggccgcccccaagaagaagtag

SEQ ID NO: 155357 - DNA, 681 bp, Artificial Sequence
  Description of Artificial Sequence: Synthetic coding sequence
atgtctgaaacagccccagctgagacagccaccccagcccctgtggagaagagccctgccaagaagaaggccaccaagaaggctgctggagctggagctgccaagaggaaggccactggacctcctgtgtctgagctgatcaccaaggctgtggccgccagcaaggagagaaatggcctgagcctggccgccctgaagaaggccctggccgccggcggctatgatgtggagaagaacaacagccgcatcaagctgggcctgaagagcctggtgtccaagggcaccctggtgcagaccaagggcaccggggccagcggcagcttcaagctgaacaagaaggccgccagcggggaggccaagcccaaggccaagaaggccggggccgccaaggccaagaagccagctggggccacccccaagaaggccaagaaggccgccggggccaagaaggctgtgaagaagacccccaagaaggccaagaagccagctgctgctggggtgaagaaggtggccaagagccccaagaaggccaaggccgccgccaagcccaagaaggccaccaagagccctgccaagcccaaggctgtgaagcccaaggccgccaagcccaaggccgccaagcccaaggccgccaagcccaaggccgccaaggccaagaaggccgccgccaagaagaagtag

SEQ ID NO: 155358 - DNA, 642 bp, Artificial Sequence
  Description of Artificial Sequence: Synthetic coding sequence
atgtctgaaacagccccagctgccccagctgctgcccctcctgctgagaaggcccctgtgaagaagaaggccgccaagaaggccggcggcacccccaggaaggccagcggcccccctgtgtctgagctgatcaccaaggctgtggccgccagcaaggagaggtctggagtgtccctggccgccctgaagaaggccctggccgctgctggctatgatgtggagaagaacaacagccgcatcaagctgggcctgaagagcctggtgtccaagggcaccctggtgcagaccaagggcactggagccagcggcagcttcaagctgaacaagaaggccgccagcggggaggccaagcccaaggtgaagaaggccggcggcaccaagcccaagaagcctgtgggcgccgccaagaagcccaagaaggccgccggcggggccacccccaagaagagcgccaagaagacccccaagaaggccaagaagccagctgctgccaccgtgaccaagaaggtggccaagagccccaagaaggccaaggtggccaagcccaagaaggccgccaagtctgctgccaaggctgtgaagcccaaggccgccaagcccaaggtggtgaagcccaagaaggccgcccccaagaagaagtag

SEQ ID NO: 155359 - DNA, 666 bp, Artificial Sequence
  Description of Artificial Sequence: Synthetic coding sequence
atgtctgaaacagcccccctggcccccaccatcccagccccagctgagaagacccctgtgaagaagaaggccaagaaggccggggccacagctgggaagaggaaggccagcggcccccctgtgtctgagctgatcaccaaggctgtggccgccagcaaggagaggtctggagtgtccctggccgccctgaagaaggccctggccgccgccggctatgatgtggagaagaacaacagccgcatcaagctgggcctgaagagcctggtgtccaagggcaccctggtgcagaccaagggcaccggggccagcggcagcttcaagctgaacaagaaggccgccagcggggagggcaagcccaaggccaagaaggccggggccgccaagcccaggaagccagctggagctgccaagaagcccaagaaggtggccggggccgccacccccaagaagagcatcaagaagacccccaagaaggtgaagaagccagccacagctgctggcaccaagaaggtggccaagagcgccaagaaggtgaagaccccccagcccaagaaggccgccaagagccctgccaaggccaaggcccccaagcccaaggccgccaagcccaagagcggcaagcccaaggtgaccaaggccaagaaggccgcccccaagaagaagtag

SEQ ID NO: 155360 - DNA, 660 bp, Artificial Sequence
  Description of Artificial Sequence: Synthetic coding sequence
atgtctgaaacagccccagctgccccagctgccccagccccagctgagaagacccctgtgaagaagaaggccaggaagtctgctggggccgccaagaggaaggccagcggcccccctgtgtctgagctgatcaccaaggctgtggccgccagcaaggagaggtctggagtgtccctggccgccctgaagaaggccctggccgctgctggctatgatgtggagaagaacaacagccgcatcaagctgggcctgaagagcctggtgtccaagggcaccctggtgcagaccaagggcactggagccagcggcagcttcaagctgaacaagaaggccgccagcggggaggccaagcccaaggccaagaaggccggggccgccaaggccaagaagccagctggggccgccaagaagcccaagaaggccaccggggccgccacccccaagaagagcgccaagaagacccccaagaaggccaagaagccagctgctgctgctggggccaagaaggccaagagccccaagaaggccaaggccgccaagcccaagaaggcccccaagagccctgccaaggccaaggctgtgaagcccaaggccgccaagcccaagacagccaagcccaaggccgccaagcccaagaaggctgctgccaagaagaagtag

SEQ ID NO: 155361 - DNA, 624 bp, Artificial Sequence
  Description of Artificial Sequence: Synthetic coding sequence
atgtctgagaccgtgcctgctgccagcgccagcgctggggtggccgccatggagaagctgcccaccaagaagaggggcaggaagccagctggcctcatcagcgccagcaggaaggtgcccaacctgtctgtgtccaagctgatcacagaggccctgtctgtgtcccaggagcgggtgggcatgagcctggtggccctgaagaaggccctggccgctgctggctatgatgtggagaagaacaacagccgcatcaagctgagcctgaagagcctggtgaacaagggcatcctggtgcagacccggggcactggagccagcggcagcttcaagctgagcaagaaggtgatccccaagagcaccaggagcaaggccaagaagtctgtgtctgccaagaccaagaagctggtgctgagccgggacagcaagagccccaagacagccaagaccaacaagagggccaagaagccccgggccaccacccccaagacagtgcgcagcggcaggaaggccaagggggccaagggcaagcagcagcagaagagccctgtgaaggcccgggccagcaagagcaagctgacccagcaccacgaggtgaatgtgaggaaggccaccagcaagaagtag

SEQ ID NO: 155362 - DNA, 393 bp, Artificial Sequence
  Description of Artificial Sequence: Synthetic coding sequence
atgagcggccggggcaagcagggcggcaaggcccgggccaaggccaagaccaggagcagccgggccggcctgcagtttcctgtgggccgggtgcaccggctgctgaggaaaggaaactacagcgagcgggtgggcgctggggcccctgtgtacctggccgctgtgctggagtacctgacagctgagatcctggagctggccggaaatgctgcccgggacaacaagaagacccgcatcatccccaggcacctgcagctggccatcagaaatgatgaggagctgaacaagctgctgggccgggtgaccatcgcccagggcggcgtgctgcccaacatccaggccgtgctgctgcccaagaagacagagagccaccacaaggccaagggcaagtag

SEQ ID NO: 155363 - DNA, 393 bp, Artificial Sequence
  Description of Artificial Sequence: Synthetic coding sequence
atgagcggccggggcaagcagggcggcaaggcccgggccaaggccaagagccgcagcagccgggccggcctgcagtttcctgtgggccgggtgcaccggctgctgaggaaaggaaattatgcagagcgggtgggcgctggggcccctgtgtacctggccgctgtgctggagtacctgacagctgagatcctggagctggccggaaatgctgcccgggacaacaagaagacccgcatcatccccaggcacctgcagctggccatcagaaatgatgaggagctgaacaagctgctgggccgggtgaccatcgcccagggcggcgtgctgcccaacatccaggccgtgctgctgcccaagaagacagagagccaccacaaggccaagggcaagtag

SEQ ID NO: 155364 - DNA, 393 bp, Artificial Sequence; identical to SEQ ID NO: 155363
  Description of Artificial Sequence: Synthetic coding sequence

SEQ ID NO: 155365 - DNA, 393 bp, Artificial Sequence
  Description of Artificial Sequence: Synthetic coding sequence
atgagcggccggggcaagcagggcggcaaggcccgggccaaggccaagaccaggagcagccgggccggcctgcagtttcctgtgggccgggtgcaccggctgctgaggaaaggaaactacagcgagcgggtgggcgctggggcccctgtgtacctggccgctgtgctggagtacctgacagctgagatcctggagctggccggaaatgctgcccgggacaacaagaagacccgcatcatccccaggcacctgcagctggccatcagaaatgatgaggagctgaacaagctgctgggcaaggtgaccatcgcccagggcggcgtgctgcccaacatccaggccgtgctgctgcccaagaagacagagagccaccacaaggccaagggcaagtag

SEQ ID NO: 155366 - DNA, 393 bp, Artificial Sequence; identical to SEQ ID NO: 155362
  Description of Artificial Sequence: Synthetic coding sequence

SEQ ID NO: 155367 - DNA, 393 bp, Artificial Sequence
  Description of Artificial Sequence: Synthetic coding sequence
atgagcggccggggcaagcagggcggcaaggcccgggccaaggccaagaccaggagcagccgggccggcctgcagtttcctgtgggccgggtgcaccggctgctgaggaaaggaaattatgcagagcgggtgggcgctggggcccctgtgtacctggccgctgtgctggagtacctgacagctgagatcctggagctggccggaaatgctgcccgggacaacaagaagacccgcatcatccccaggcacctgcagctggccatcagaaatgatgaggagctgaacaagctgctgggcaaggtgaccatcgcccagggcggcgtgctgcccaacatccaggccgtgctgctgcccaagaagacagagagccaccacaaggccaagggcaagtag

SEQ ID NO: 155368 - DNA, 387 bp, Artificial Sequence
  Description of Artificial Sequence: Synthetic coding sequence
atgagcggccggggcaagcagggcggcaaggcccgggccaaggccaagaccaggagcagccgggccggcctgcagtttcctgtgggccgggtgcaccggctgctgaggaaaggaaattatgcagagcgggtgggcgctggggcccctgtgtacctggccgctgtgctggagtacctgacagctgagatcctggagctggccggaaatgctgcccgggacaacaagaagacccgcatcatccccaggcacctgcagctggccatcagaaatgatgaggagctgaacaagctgctgggcaaggtgaccatcgcccagggcggcgtgctgcccaacatccaggccgtgctgctgcccaagaagacagagagccaccacaagaccaagtag

SEQ ID NO: 155369 - DNA, 393 bp, Artificial Sequence; identical to SEQ ID NO: 155367
  Description of Artificial Sequence: Synthetic coding sequence

SEQ ID NO: 155370 - DNA, 393 bp, Artificial Sequence; identical to SEQ ID NO: 155367
  Description of Artificial Sequence: Synthetic coding sequence

SEQ ID NO: 155371 - DNA, 393 bp, Artificial Sequence; identical to SEQ ID NO: 155367
  Description of Artificial Sequence: Synthetic coding sequence

SEQ ID NO: 155372 - DNA, 384 bp, Artificial Sequence
  Description of Artificial Sequence: Synthetic coding sequence
atgcctgaggtgagcagcaaaggagccaccatcagcaagaagggcttcaagaaggctgtggtgaagacccagaagaaggagggcaagaagaggaagaggaccaggaaggagagctacagcatctacatctacaaggtgctgaagcaggtgcacccagacaccggcatcagcagcaaggccatgagcatcatgaacagctttgtgacagacatctttgaaagaattgccagcgaggccagccggctggcccactacagcaagaggagcaccatcagcagccgggagatccagacagctgtgcggctgctgctgcctggagagctggccaagcatgctgtgtctgagggcaccaaggctgtgaccaagtacaccagcagcaagtag

SEQ ID NO: 155373 - DNA, 381 bp, Artificial Sequence
  Description of Artificial Sequence: Synthetic coding sequence
atgcctgagcccagcaagagcgccccagcccccaagaagggcagcaagaaggccatcaccaaggcccagaagaaggatggcaagaagaggaagaggagcaggaaggagagctacagcatctacgtgtacaaggtgctgaagcaggtgcacccagacaccggcatcagcagcaaggccatgggcatcatgaacagctttgtgaatgacatctttgaaagaattgctggggaggccagccggctggcccactacaacaagaggagcaccatcaccagccgggagatccagacagctgtgcggctgctgctgcccggggagctggccaagcatgctgtgtctgagggcaccaaggctgtgaccaagtacaccagcagcaagtag

SEQ ID NO: 155374 - DNA, 381 bp, Artificial Sequence
  Description of Artificial Sequence: Synthetic coding sequence
atgcctgagcccgccaagagcgccccagcccccaagaagggcagcaagaaggctgtgaccaaggcccagaagaaggatggcaagaagaggaagaggagcaggaaggagagctacagcgtgtatgtgtacaaggtgctgaagcaggtgcacccagacaccggcatcagcagcaaggccatgggcatcatgaacagctttgtgaatgacatctttgaaagaattgctggggaggccagccggctggcccactacaacaagaggagcaccatcaccagccgggagatccagacagctgtgcggctgctgctgcccggggagctggccaagcatgctgtgtctgagggcaccaaggctgtgaccaagtacaccagcagcaagtag

SEQ ID NO: 155375 - DNA, 381 bp, Artificial Sequence; identical to SEQ ID NO: 155374
  Description of Artificial Sequence: Synthetic coding sequence

SEQ ID NO: 155376 - DNA, 381 bp, Artificial Sequence
  Description of Artificial Sequence: Synthetic coding sequence
atgcctgagcccaccaagagcgccccagcccccaagaagggcagcaagaaggctgtgaccaaggcccagaagaaggatggcaagaagaggaagaggagcaggaaggagagctacagcgtgtatgtgtacaaggtgctgaagcaggtgcacccagacaccggcatcagcagcaaggccatgggcatcatgaacagctttgtgaatgacatctttgaaagaattgctggggaggccagccggctggcccactacaacaagaggagcaccatcaccagccgggagatccagacagctgtgcggctgctgctgcccggggagctggccaagcatgctgtgtctgagggcaccaaggctgtgaccaagtacaccagcagcaagtag

SEQ ID NO: 155377 - DNA, 381 bp, Artificial Sequence; identical to SEQ ID NO: 155376
  Description of Artificial Sequence: Synthetic coding sequence

SEQ ID NO: 155378 - DNA, 381 bp, Artificial Sequence; identical to SEQ ID NO: 155374
  Description of Artificial Sequence: Synthetic coding sequence

SEQ ID NO: 155379 - DNA, 381 bp, Artificial Sequence; identical to SEQ ID NO: 155374
  Description of Artificial Sequence: Synthetic coding sequence

SEQ ID NO: 155380 - DNA, 381 bp, Artificial Sequence; identical to SEQ ID NO: 155374
  Description of Artificial Sequence: Synthetic coding sequence

SEQ ID NO: 155381 - DNA, 381 bp, Artificial Sequence
  Description of Artificial Sequence: Synthetic coding sequence
atgccagaccctgccaagagcgccccagcccccaagaagggcagcaagaaggctgtgaccaaggcccagaagaaggatggcaagaagaggaagaggagcaggaaggagagctacagcgtgtatgtgtacaaggtgctgaagcaggtgcacccagacaccggcatcagcagcaaggccatgggcatcatgaacagctttgtgaatgacatctttgaaagaattgctggggaggccagccggctggcccactacaacaagaggagcaccatcaccagccgggagatccagacagctgtgcggctgctgctgcccggggagctggccaagcatgctgtgtctgagggcaccaaggctgtgaccaagtacaccagcagcaagtag

SEQ ID NO: 155382 - DNA, 381 bp, Artificial Sequence; identical to SEQ ID NO: 155374
  Description of Artificial Sequence: Synthetic coding sequence

SEQ ID NO: 155383 - DNA, 381 bp, Artificial Sequence
  Description of Artificial Sequence: Synthetic coding sequence
atgcctgagctggccaagagcgccccagcccccaagaagggcagcaagaaggctgtgaccaaggcccagaagaaggatggcaagaagaggaagaggagcaggaaggagagctacagcgtgtatgtgtacaaggtgctgaagcaggtgcacccagacaccggcatcagcagcaaggccatgggcatcatgaacagctttgtgaatgacatctttgagcgcatcgccagcgaggccagccggctggcccactacaacaagaggagcaccatcaccagccgggagatccagacagctgtgcggctgctgctgcccggggagctggccaagcatgctgtgtctgagggcaccaaggctgtgaccaagtacaccagcagcaagtag

SEQ ID NO: 155384 - DNA, 381 bp, Artificial Sequence
  Description of Artificial Sequence: Synthetic coding sequence
atgcctgagcctgtgaagagcgcccctgtgcccaagaagggcagcaagaaggccatcaacaaggcccagaagaaggatggcaagaagaggaagaggagcaggaaggagagctacagcgtgtatgtgtacaaggtgctgaagcaggtgcacccagacaccggcatcagcagcaaggccatgggcatcatgaacagctttgtgaatgacatctttgaaagaattgctggggaggccagccggctggcccactacaacaagaggagcaccatcaccagccgggagatccagacagctgtgcggctgctgctgcccggggagctggccaagcatgctgtgtctgagggcaccaaggctgtgaccaagtacaccagcagcaagtag

SEQ ID NO: 155385 - DNA, 381 bp, Artificial Sequence
  Description of Artificial Sequence: Synthetic coding sequence
atgcctgagcccagcaagagcgccccagcccccaagaagggcagcaagaaggctgtgaccaaggcccagaagaaggatggcaagaagaggaagaggagcaggaaggagagctacagcgtgtatgtgtacaaggtgctgaagcaggtgcacccagacaccggcatcagcagcaaggccatgggcatcatgaacagctttgtgaatgacatctttgaaagaattgctggggaggccagccggctggcccactacaacaagaggagcaccatcaccagccgggagatccagacagctgtgcggctgctgctgcccggggagctggccaagcatgctgtgtctgagggcaccaaggctgtgaccaagtacaccagcagcaagtag

SEQ ID NO: 155386 - DNA, 381 bp, Artificial Sequence; identical to SEQ ID NO: 155385
  Description of Artificial Sequence: Synthetic coding sequence

SEQ ID NO: 155387 - DNA, 381 bp, Artificial Sequence
  Description of Artificial Sequence: Synthetic coding sequence
atgccagaccctgccaagagcgccccagcccccaagaagggcagcaagaaggctgtgaccaaggcccagaagaaggatggcaagaagaggaagaggagcaggaaggagagctacagcatctacgtgtacaaggtgctgaagcaggtgcacccagacaccggcatcagcagcaaggccatgggcatcatgaacagctttgtgaatgacatctttgaaagaattgctggggaggccagccggctggcccactacaacaagaggagcaccatcaccagccgggagatccagacagctgtgcggctgctgctgcccggggagctggccaagcatgctgtgtctgagggcaccaaggctgtgaccaagtacaccagcagcaagtag

SEQ ID NO: 155388 - DNA, 411 bp, Artificial Sequence
  Description of Artificial Sequence: Synthetic coding sequence
atggcccggaccaagcagacagccaggaagagcactggaggcaaggcccccaggaagcagctggccaccaaggccgccaggaagagcgccccagccactggaggagtgaagaagccccaccgctaccggcccggcaccgtggccctgcgggagatccgccgctaccagaagagcacagagctgctgatcaggaagctgcccttccagaggctggtgcgggagatcgcccaggacttcaagacagacctgcgcttccagagcagcgctgtgatggccctgcaggaggcctgtgaggcctacctggtgggcctgtttgaggacaccaacctgtgtgccatccacgccaagagggtgaccatcatgcccaaggacatccagctggcccggcgcatccggggggagcgggcctag

SEQ ID NO: 155389 - DNA, 411 bp, Artificial Sequence; identical to SEQ ID NO: 155388
  Description of Artificial Sequence: Synthetic coding sequence

SEQ ID NO: 155390 - DNA, 411 bp, Artificial Sequence; identical to SEQ ID NO: 155388
  Description of Artificial Sequence: Synthetic coding sequence

SEQ ID NO: 155391 - DNA, 411 bp, Artificial Sequence; identical to SEQ ID NO: 155388
  Description of Artificial Sequence: Synthetic coding sequence

SEQ ID NO: 155392 - DNA, 411 bp, Artificial Sequence; identical to SEQ ID NO: 155388
  Description of Artificial Sequence: Synthetic coding sequence

SEQ ID NO: 155393 - DNA, 411 bp, Artificial Sequence; identical to SEQ ID NO: 155388
  Description of Artificial Sequence: Synthetic coding sequence

SEQ ID NO: 155394 - DNA, 411 bp, Artificial Sequence; identical to SEQ ID NO: 155388
  Description of Artificial Sequence: Synthetic coding sequence

SEQ ID NO: 155395 - DNA, 411 bp, Artificial Sequence; identical to SEQ ID NO: 155388
  Description of Artificial Sequence: Synthetic coding sequence

SEQ ID NO: 155396 - DNA, 411 bp, Artificial Sequence; identical to SEQ ID NO: 155388
  Description of Artificial Sequence: Synthetic coding sequence

SEQ ID NO: 155397 - DNA, 411 bp, Artificial Sequence; identical to SEQ ID NO: 155388
  Description of Artificial Sequence: Synthetic coding sequence

SEQ ID NO: 155398 - DNA, 411 bp, Artificial Sequence; identical to SEQ ID NO: 155388
  Description of Artificial Sequence: Synthetic coding sequence

SEQ ID NO: 155399 - DNA, 339 bp, Artificial Sequence
  Description of Artificial Sequence: Synthetic coding sequence
atgagcggccggggcaagggcggcaagggcctggccaaggccaagacctgcagcagcctgcccggcctgcagtttcctggccgggtgcgccacctgttcagaaaaggaaactactttgagcctgtgggcgctggggcccctgtgtacctgcagtacctggccgctgagatcctggagctggtgggcagcgccatccgggacaagaccaggagcatcatccccaggcacctgcagctggccatcagaaatgatgaggaggtgaacaagcagctgggcaatgtgaccatcgcccagggcggcgtgctgagcaacatccaggccgtgctgctgcccaagtag

SEQ ID NO: 155400 - DNA, 312 bp, Artificial Sequence
  Description of Artificial Sequence: Synthetic coding sequence
atgagcggccggggcaagggcggcaagggcctgggcaaaggaggagccaagaggcacaggaaggtgctgcgggacaacatccagggcatcaccaagccagccatccggcggctggcccggcggggcggcgtgaagaggatcagcggcctcatctatgaggagacccggggcgtgctgaaggtgttcctggagaatgtcatcagagatgctgtgacctacacagagcacgccaagaggaagacagtgacagccatggatgtggtgtatgccctgaagaggcagggccgcaccctgtatggctttggaggatag

SEQ ID NO: 155401 - DNA, 312 bp, Artificial Sequence; identical to SEQ ID NO: 155400
  Description of Artificial Sequence: Synthetic coding sequence

SEQ ID NO: 155402 - DNA, 312 bp, Artificial Sequence; identical to SEQ ID NO: 155400
  Description of Artificial Sequence: Synthetic coding sequence

SEQ ID NO: 155403 - DNA, 312 bp, Artificial Sequence; identical to SEQ ID NO: 155400
  Description of Artificial Sequence: Synthetic coding sequence

SEQ ID NO: 155404 - DNA, 312 bp, Artificial Sequence; identical to SEQ ID NO: 155400
  Description of Artificial Sequence: Synthetic coding sequence

SEQ ID NO: 155405 - DNA, 312 bp, Artificial Sequence; identical to SEQ ID NO: 155400
  Description of Artificial Sequence: Synthetic coding sequence

SEQ ID NO: 155406 - DNA, 297 bp, Artificial Sequence
  Description of Artificial Sequence: Synthetic coding sequence
atgtctgtgcggggcaaggccggcaagggcctgggcaaaggaggagccaagtgccacaggaaggtgctgagtgacaacatccagggcatcaccaagtgcaccatccggcggctggcccggcatggaggagtgaagaggatcctgggcctcatctatgaggagacccggcgggtcttcaaggtgttcctggagaatgtcatctggtatgctgtgaccaacacagagcacgccaagaggaagacagtgacagccatggctgtggtgtatgtgctgaagaggcagggccgcaccctgtag

SEQ ID NO: 155407 - DNA, 312 bp, Artificial Sequence; identical to SEQ ID NO: 155400
  Description of Artificial Sequence: Synthetic coding sequence

SEQ ID NO: 155408 - DNA, 312 bp, Artificial Sequence; identical to SEQ ID NO: 155400
  Description of Artificial Sequence: Synthetic coding sequence

SEQ ID NO: 155409 - DNA, 312 bp, Artificial Sequence; identical to SEQ ID NO: 155400
  Description of Artificial Sequence: Synthetic coding sequence

SEQ ID NO: 155410 - DNA, 312 bp, Artificial Sequence; identical to SEQ ID NO: 155400
  Description of Artificial Sequence: Synthetic coding sequence

SEQ ID NO: 155411 - DNA, 312 bp, Artificial Sequence; identical to SEQ ID NO: 155400
  Description of Artificial Sequence: Synthetic coding sequence

SEQ ID NO: 155412 - DNA, 312 bp, Artificial Sequence; identical to SEQ ID NO: 155400
  Description of Artificial Sequence: Synthetic coding sequence

SEQ ID NO: 155413 - DNA, 390 bp, Artificial Sequence
  Description of Artificial Sequence: Synthetic coding sequence
atgagcggccggggcaagcagggcggcaaggcccgggccaaggccaagagccgcagcagccgggccggcctgcagtttcctgtgggccgggtgcaccggctgctgaggaaaggaaattatgcagagcgggtgggcgctggggcccctgtgtacatggctgctgtgctggagtacctgacagctgagatcctggagctggccggaaatgctgcccgggacaacaagaagacccgcatcatccccaggcacctgcagctggccatcagaaatgatgaggagctgaacaagctgctgggcaaggtgaccatcgcccagggcggcgtgctgcccaacatccaggccgtgctgctgcccaagaagacagagagccacaaggccaagagcaagtag

SEQ ID NO: 155414 - DNA, 381 bp, Artificial Sequence
  Description of Artificial Sequence: Synthetic coding sequence
atgcctgagcccgccaagagcgccccagcccccaagaagggcagcaagaaggctgtgaccaaggcccagaagaaggatggcaagaagaggaagaggagcaggaaggagagctacagcatctacgtgtacaaggtgctgaagcaggtgcacccagacaccggcatcagcagcaaggccatgggcatcatgaacagctttgtgaatgacatctttgaaagaattgctggggaggccagccggctggcccactacaacaagaggagcaccatcaccagccgggagatccagacagctgtgcggctgctgctgcccggggagctggccaagcatgctgtgtctgagggcaccaaggctgtgaccaagtacaccagcagcaagtag

SEQ ID NO: 155415 - DNA, 411 bp, Artificial Sequence
  Description of Artificial Sequence: Synthetic coding sequence
atggcccggaccaagcagacagccaggaagagcactggaggcaaggcccccaggaagcagctggccaccaaggccgccaggaagagcgccccagccactggaggagtgaagaagccccaccgctaccggcccggcaccgtggccctgcgggagatccgccgctaccagaagagcacagagctgctgatcaggaagctgcccttccagaggctggtgcgggagatcgcccaggacttcaagacagacctgcgcttccagagcagcgctgtgatggccctgcaggaggccagcgaggcctacctggtgggcctgtttgaggacaccaacctgtgtgccatccacgccaagagggtgaccatcatgcccaaggacatccagctggcccggcgcatccggggggagcgggcctag

SEQ ID NO: 155416 - DNA, 411 bp, Artificial Sequence
  Description of Artificial Sequence: Synthetic coding sequence
atggcccggaccaagcagacagccaggaagagcactggaggcaaggcccccaggaagcagctggccaccaaggtggccaggaagagcgccccagccactggaggagtgaagaagccccaccgctaccggcccggcaccgtggccctgcgggagatccgccgctaccagaagagcacagagctgctgatcaggaagctgcccttccagaggctgatgagagaaattgcccaggacttcaagacagacctgcgcttccagagcagcgctgtgatggccctgcaggaggcctgtgagagctacctggtgggcctgtttgaggacaccaacctgtgtgtgatccacgccaagagggtgaccatcatgcccaaggacatccagctggcccggcgcatccggggggagcgggcctag

SEQ ID NO: 155417 - DNA, 684 bp, Artificial Sequence
  Description of Artificial Sequence: Synthetic coding sequence
atggagggccagagcggccgctgcaagatcgtggtggtgggagatgctgaatgtgggaagacagccctgctgcaggtgtttgccaaggatgcctacccaggcagctatgtgcccaccgtgtttgagaactacacagccagctttgaaattgacaagagaagaattgagctgaacatgtgggacaccagcggcagcagctactatgacaacgtgcggcccctggcctacccagacagtgatgctgtgctgatctgctttgacatcagcaggcctgagaccctggacagcgtgctgaagaagtggcagggcgagacccaggagttctgccccaatgccaaggtggtgctggtgggctgcaagctggacatgaggacagacctggccaccctgcgggagctgagcaagcagaggctcatccctgtgacccatgagcagggcaccgtgctggccaagcaggtgggcgctgtgtcctatgtggagtgcagcagccgcagcagcgagaggtctgtgagagatgtgttccacgtggccaccgtggccagcctgggccggggccaccggcagctgcggaggacagacagcagaagaggcatgcagaggtctgcccagctgagcggccgcccagacagaggaaatgaaggagagatccacaaggaccgggccaagagctgcaacctgatgtag

SEQ ID NO: 155418 - DNA, 3114 bp, Artificial Sequence
  Description of Artificial Sequence: Synthetic coding sequence
atgaacagccccaatgaaagtgatggcatgagcggccgggagcccagcctggagatcctgcccaggaccagcctgcacagcatccctgtgacagtggaggtgaagcctgtgctgccccgggccatgcccagctccatgggcggcggcggcggcggcagccccagccctgtggagctgcggggggccctggtgggctctgtggaccccaccctgcgggagcagcagctgcagcaggagctgctggccctgaagcagcagcagcagctgcagaagcagctgctgtttgctgagttccagaagcagcacgaccacctgacccggcagcacgaggtgcagctgcagaagcacctgaagcagcagcaggagatgctggccgccaagcagcagcaggagatgctggccgccaagaggcagcaggagctggagcagcagaggcagcgggagcagcagaggcaggaggagctggagaagcagaggctggagcagcagctgctgatcctgaggaacaaggagaagagcaaggagagcgccatcgccagcacagaggtgaagctgcggctgcaggagttcctgctgagcaagagcaaggagcccacccctgggggcctgaaccacagcctgccccagcaccccaagtgctggggcgcccaccacgccagcctggaccagagcagccccccccagagcggccccccaggcaccccacccagctacaagctgcccctgcccggcccctatgacagcagagatgacttccccctgaggaagacagccagcgagcccaacctgaaggtgcgcagccggctgaagcagaaggtggccgagcggcgcagcagccccctgctgcggaggaaggatggcaccgtcatcagcaccttcaagaagagagctgtggagatcactggagctggccctggggccagctctgtgtgcaacagcgcccctggcagcggccccagcagccccaacagcagccacagcaccatcgcagaaaatggcttcaccggctctgtgcccaacatccccacagagatgctgccccagcaccgggccctgcccctggacagcagccccaaccagttcagcctgtacaccagccccagcctgcccaacatcagcctgggcctgcaggccaccgtgacagtgaccaacagccacctgacagccagccccaagctgagcacccagcaggaggccgagcggcaggccctgcagagcctgcggcagggcggcaccctgaccgggaagttcatgagcaccagcagcatccctggctgcctgctgggcgtggccctggagggagatggcagcccccacggccacgccagcctgctgcagcacgtgctgctgctggagcaggcccggcagcagagcaccctgattgctgtgcccctgcacggccagagccccctggtgactggagagcgggtggccacctccatgaggacagtgggcaagctgcccaggcaccggcccctgagcaggacccagagcagccccctgccccagagcccccaggccctgcagcagctggtgatgcagcagcagcaccagcagttcctggagaagcagaagcagcagcagctgcagctgggcaagatcctgaccaagacaggagagctgccccggcagcccaccacccaccctgaggagacagaggaggagctgacagagcagcaggaggtgctgctgggggagggcgccctgaccatgccccgggagggcagcacagaaagtgagagcacccaggaggacctggaggaggaggatgaggaggatgatggagaggaggaggaggactgcatccaggtgaaggatgaggagggggagagcggggctgaggagggccctgacctggaggagcccggggccggctacaagaagctgttcagtgatgcccagcccctgcagcccctgcaggtgtaccaggcccccctgagcctggccaccgtgccccaccaggccctgggccgcacccagagcagccctgctgcccctgggggcatgaagagccccccagaccagcctgtgaagcacctgttcaccaccggccccatcagccagaagatgtatgctgtgctgccctgtggcggcattggagtggacagcgacacagtgtggaatgagatgcacagcagcagcgctgtgaggatggctgtgggctgcctgctggagctggccttcaaggtggccgccggggagctgaagaatggatttgccatcatccggcccccaggccaccacgccgaggagagcacagccatgggcttctgcttcttcaacagcgtggccatcacagccaagctgctgcagcagaagctgaatgtgggcaaggtgctgattgtggactgggacatccaccacggcaatggcacccagcaggccttctacaatgaccccagcgtgctgtacatcagcctgcacagatatgacaatggaaacttcttccctggcagcggggcccctgaggaggtgggcggcggccctggggtgggctacaacgtgaatgtggcctggacaggaggagtggacccccccatcggagatgtggagtacctgacagccttcagaacagtggtgatgcccatcgcccacgagttctccccagatgtggtgctggtgtctgctggctttgatgctgtggagggccacctgagccccctgggcggctacagcgtgacagcccgctgcttcggccacctgacccggcagctgatgaccctggccggcggccgggtggtgctggccctggagggcggccatgacctgacagccatctgtgatgccagcgaggcctgtgtgtctgccctgctgtctgtggagctgcagcccctggatgaggccgtgctgcagcagaagcccaacatcaatgctgtggccaccctggagaaggtgattgagatccagagcaagcactggagctgtgtgcagaagtttgctgctggcctgggccgcagcctgcgggaggcccaggccggggagacagaggaggccgagaccgtgtctgccatggccctgctgtctgtgggcgctgagcaggcccaggccgccgccgcccgggagcacagccccaggcctgctgaggagcccatggagcaggagcccgccctgtag

SEQ ID NO: 155419 - DNA, 3369 bp, Artificial Sequence
  Description of Artificial Sequence: Synthetic coding sequence
atgaacagccccaatgaaagtgatggcatgagcggccgggagcccagcctggagatcctgcccaggaccagcctgcacagcatccctgtgacagtggaggtgaagcctgtgctgccccgggccatgcccagctccatgggcggcggcggcggcggcagccccagccctgtggagctgcggggggccctggtgggctctgtggaccccaccctgcgggagcagcagctgcagcaggagctgctggccctgaagcagcagcagcagctgcagaagcagctgctgtttgctgagttccagaagcagcacgaccacctgacccggcagcacgaggtgcagctgcagaagcacctgaagcagcagcaggagatgctggccgccaagcagcagcaggagatgctggccgccaagaggcagcaggagctggagcagcagaggcagcgggagcagcagaggcaggaggagctggagaagcagaggctggagcagcagctgctgatcctgaggaacaaggagaagagcaaggagagcgccatcgccagcacagaggtgaagctgcggctgcaggagttcctgctgagcaagagcaaggagcccacccctgggggcctgaaccacagcctgccccagcaccccaagtgctggggcgcccaccacgccagcctggaccagagcagccccccccagagcggccccccaggcaccccacccagctacaagctgcccctgcccggcccctatgacagcagagatgacttccccctgaggaagacagccagcgagcccaacctgaaggtgcgcagccggctgaagcagaaggtggccgagcggcgcagcagccccctgctgcggaggaaggatggcaccgtcatcagcaccttcaagaagagagctgtggagatcactggagctggccctggggccagctctgtgtgcaacagcgcccctggcagcggccccagcagccccaacagcagccacagcaccatcgcagaaaatggcttcaccggctctgtgcccaacatccccacagagatgctgccccagcaccgggccctgcccctggacagcagccccaaccagttcagcctgtacaccagccccagcctgcccaacatcagcctgggcctgcaggccaccgtgacagtgaccaacagccacctgacagccagccccaagctgagcacccagcaggaggccgagcggcaggccctgcagagcctgcggcagggcggcaccctgaccgggaagttcatgagcaccagcagcatccctggctgcctgctgggcgtggccctggagggagatggcagcccccacggccacgccagcctgctgcagcacgtgctgctgctggagcaggcccggcagcagagcaccctgattgctgtgcccctgcacggccagagccccctggtgactggagagcgggtggccacctccatgaggacagtgggcaagctgcccaggcaccggcccctgagcaggacccagagcagccccctgccccagagcccccaggccctgcagcagctggtgatgcagcagcagcaccagcagttcctggagaagcagaagcagcagcagctgcagctgggcaagatcctgaccaagacaggagagctgccccggcagcccaccacccaccctgaggagacagaggaggagctgacagagcagcaggaggtgctgctgggggagggcgccctgaccatgccccgggagggcagcacagaaagtgagagcacccaggaggacctggaggaggaggatgaggaggatgatggagaggaggaggaggactgcatccaggtgaaggatgaggagggggagagcggggctgaggagggccctgacctggaggagcccggggccggctacaagaagctgttcagtgatgcccagcccctgcagcccctgcaggtgtaccaggcccccctgagcctggccaccgtgccccaccaggccctgggccgcacccagagcagccctgctgcccctgggggcatgaagagccccccagaccagcctgtgaagcacctgttcaccactggagtggtgtatgacaccttcatgctgaagcaccagtgcatgtgtggcaacacccacgtgcaccctgagcacgccggccgcatccagagcatctggagccggctgcaggagaccggcctgctgagcaaatgtgagcgcatccggggcaggaaggccaccctggatgagatccagacagtgcacagcgagtaccacaccctgctgtatggcaccagccccctgaaccggcagaagctggacagcaagaagctgctgggccccatcagccagaagatgtatgctgtgctgccctgtggcggcatcggcgtggacagcgacacagtgtggaatgagatgcacagcagcagcgctgtgaggatggctgtgggctgcctgctggagctggccttcaaggtggccgccggggagctgaagaatggatttgccatcatccggcccccaggccaccacgccgaggagagcacagccatgggcttctgcttcttcaacagcgtggccatcacagccaagctgctgcagcagaagctgaatgtgggcaaggtgctgattgtggactgggacatccaccacggcaatggcacccagcaggccttctacaatgaccccagcgtgctgtacatcagcctgcacagatatgacaatggaaacttcttccctggcagcggggcccctgaggaggtgggcggcggccctggggtgggctacaacgtgaatgtggcctggacaggaggagtggacccccccatcggagatgtggagtacctgacagccttcagaacagtggtgatgcccatcgcccacgagttctccccagatgtggtgctggtgtctgctggctttgatgctgtggagggccacctgagccccctgggcggctacagcgtgacagcccgctgcttcggccacctgacccggcagctgatgaccctggccggcggccgggtggtgctggccctggagggcggccatgacctgacagccatctgtgatgccagcgaggcctgtgtgtctgccctgctgtctgtggagctgcagcccctggatgaagctgtgctgcagcagaagcccaacatcaatgctgtggccaccctggagaaggtgattgagatccagagcaagcactggagctgtgtgcagaagtttgctgctggcctgggccgcagcctgcgggaggcccaggccggggagacagaggaggccgagaccgtgtctgccatggccctgctgtctgtgggcgctgagcaggcccaggccgctgctgcccgggagcacagccccaggcctgctgaggagcccatggagcaggagcccgccctgtag

SEQ ID NO: 155420 - DNA, 1776 bp, Artificial Sequence
  Description of Artificial Sequence: Synthetic coding sequence
atgatgagcagccctgcccagagccgcagcccagacctgatgtggaacctggtgccctgggtgctcttctgtggctgctgccgcatcttcccagatggagtggccggccgggagcagctgctggcccagcagaggatgcacagcatgatcagctctgtggatgtgaagtctgaggtgcctgtgggcctggagcccatcagccccctggacctgaggacagacctgaggatgatgatgcctgtggtggaccctgtggtgcgggagaagcagctgcagcaggagctgctgctgatccagcagcagcagcagatccagaagcagctgctgattgctgagttccagaagcagcacgagaacctgacccggcagcaccaggcccagctgcaggagcacatcaaggagctgctggccatcaagcagcagcaggagctgctggagaaggagcagaagctggagcagcagaggcaggagcaggaggtggagcggcaccggcgggagcagcagctgccccccctgcggggcaaggaccggggccgggagagagctgtggccagcacagaggtgaagcagaagctgcaggagttcctgctgagcaagagcgccaccaaggacacccccaccaacgggaagaaccacagcgtgagccgccaccccaagctgtggtacacagctgcccaccacaccagcctggaccagagcagcccccccctgagcggcaccagccccagctacaagtacaccctgcccggggcccaggatgccaaggatgacttccccctgaggaagacagagagctctgtgagcagcagcagccctggcagcggccccagcagccccaacaacggccccaccggctctgtgacagaaaatgagacctctgtgctgccccccacccctcatgctgagcagatggtgtcccagcagaggatcctgattcatgaggacagcatgaacctgctgagcctgtacaccagccccagcctgcccaacatcaccctgggcctgcctgctgtgcccagccagctgaatgccagcaacagcctgaaggagaagcagaagtgtgagacccagaccctgcggcagggcgtgcccctgcccggccagtatggaggcagcatcccagccagcagcagccacccccacgtgaccctggagggcaagccacccaacagcagccaccaggccctgctgcagcacctgctgctgaaggagcagatgaggcagcagaagctgctggtggccggcggcgtgcccctgcacccccagagccccctggccaccaaggagcgcatcagccctggcatccggggcacccacaagctgcccaggcaccggcccctgaacagaacccagagcgcccccctgccccagagcaccctggcccagctggtgatccagcagcagcaccagcagttcctggagaagcagaagcagtaccagcagcagatccacatgaacaagctgctgagcaagagcattgagcagctgaagcagcccggcagccacctggaggaggccgaggaggagctgcagggcgaccaggccatgcaggaggaccgggcccccagcagcggcaacagcaccaggagtgacagcagcgcctgtgtggatgacaccctgggccaggtgggcgctgtgaaggtgaaggaggagcctgtggacagtgatgaagatgcccagatccaggagatggagagcggggagcaggccgccttcatgcagcaggtgattggcaaggacctggcccctggctttgtgatcaaggtgatcatctag

SEQ ID NO: 155421 - DNA, 2772 bp, Artificial Sequence
  Description of Artificial Sequence: Synthetic coding sequence
ctgcacaagctgagcagcctggtggatgtgaagtctgaggtgcctgtgggcctggagcccatcagccccctggacctgaggacagacctgaggatgatgatgcctgtggtggaccctgtggtgcgggagaagcagctgcagcaggagctgctgctgatccagcagcagcagcagatccagaagcagctgctgattgctgagttccagaagcagcacgagaacctgacccggcagcaccaggcccagctgcaggagcacatcaaggagctgctggccatcaagcagcagcaggagctgctggagaaggagcagaagctggagcagcagaggcaggagcaggaggtggagcggcacagaagagagcagcagctgccccccctgcggggcaaggaccggggccgggagagagctgtggccagcacagaggtgaagcagaagctgcaggagttcctgctgagcaagagcgccaccaaggacacccccaccaacgggaagaaccacagcgtgagccgccaccccaagctgtggtacacagctgcccaccacaccagcctggaccagagcagcccccccctgagcggcaccagccccagctacaagtacaccctgcccggggcccaggatgccaaggatgacttccccctgaggaagacagccagcgagcccaacctgaaggtgcgcagccggctgaagcagaaggtggccgagaggaggagcagccccctgctgcggaggaaggatggaaatgtggtgaccagcttcaagaagaggatgtttgaggtgacagagagctctgtgagcagcagcagccctggcagcggccccagcagccccaacaacggccccactggatctgtgacagaaaatgagacctctgtgctgccccccacccctcatgctgagcagatggtgtcccagcagaggatcctgattcatgaagattccatgaacctgctgagcctgtacaccagccccagcctgcccaacatcaccctgggcctgcctgctgtgcccagccagctgaatgccagcaacagcctgaaggagaagcagaagtgtgagacccagaccctgcggcagggcgtgcccctgcccggccagtatggaggcagcatcccagccagcagcagccacccccacgtgaccctggagggcaagccacccaacagcagccaccaggccctgctgcagcacctgctgctgaaggagcagatgaggcagcagaagctgctggtggccggcggcgtgcccctgcacccccagagccccctggccaccaaggagcgcatcagccctggcatccggggcacccacaagctgcccaggcaccggcccctgaacagaacccagagcgcccccctgccccagagcaccctggcccagctggtgatccagcagcagcaccagcagttcctggagaagcagaagcagtaccagcagcagatccacatgaacaagcccttcctggagcccacccacacccgggccctgtctgtgcggcaggcccccctggccgctgtgggcatggatggcctggagaagcaccggctggtgtccaggacccacagcagccctgctgcctctgtgctgccccacccagccatggaccggcccctgcagcccggcagcgccactggaattgcctatgaccccctgatgctgaagcaccagtgtgtgtgtggcaacagcaccacccaccctgagcacgccggccgcatccagagcatctggagccggctgcaggagaccggcctgctgaacaagtgtgagcgcatccagggcaggaaggccagcctggaggagatccagctggtgcacagcgagcaccacagcctgctgtatggcaccaaccccctggatggccagaagctggacccccgcatcctgctgggagatgacagccagaagttcttcagcagcctgccctgtggcggcctgggcgtggacagcgacaccatctggaatgagctgcacagcagcggggccgccaggatggctgtgggctgtgtgattgagctggccagcaaggtggccagcggggagctgaagaatggatttgctgtggtgcggcccccaggccaccacgccgaggagagcacagccatgggcttctgcttcttcaacagcgtggccatcacagccaagtacctgcgggaccagctgaacatcagcaagatcctgattgtggacctggatgtgcaccacggcaatggcacccagcaggccttctatgctgaccccagcatcctgtacatcagcctgcacagatatgatgagggcaacttcttccctggcagcggggccccaaatgaggtgggcaccggcctgggggagggctacaacatcaacatcgcctggacaggaggcctggacccccccatgggagatgtggagtacctggaggccttccgcaccatcgtgaagcctgtggccaaggagtttgatcctgacatggtgctggtgtctgctggctttgatgccctggagggccacaccccacccctgggcggctacaaggtgacagccaagtgcttcggccacctgaccaagcagctgatgaccctggctgatggccgggtggtgctggccctggagggcggccatgacctgacagccatctgtgatgccagcgaggcctgtgtgaatgccctgctgggcaatgagctggagcccctggccgaggacatcctgcaccagagccccaacatgaatgctgtgatcagcctgcagaagatcatcgagatccagagcatgagcctgaagttctcctag

SEQ ID NO: 155422 - DNA, 3078 bp, Artificial Sequence
  Description of Artificial Sequence: Synthetic coding sequence
atgcacagcatgatcagctctgtggatgtgaagtctgaggtgcctgtgggcctggagcccatcagccccctggacctgaggacagacctgaggatgatgatgcctgtggtggaccctgtggtgcgggagaagcagctgcagcaggagctgctgctgatccagcagcagcagcagatccagaagcagctgctgattgctgagttccagaagcagcacgagaacctgacccggcagcaccaggcccagctgcaggagcacatcaagctgcagcaggagctgctggccatcaagcagcagcaggagctgctggagaaggagcagaagctggagcagcagaggcaggagcaggaggtggagcggcaccggcgggagcagcagctgccccccctgcggggcaaggaccggggccgggagagagctgtggccagcacagaggtgaagcagaagctgcaggagttcctgctgagcaagagcgccaccaaggacacccccaccaacgggaagaaccacagcgtgagccgccaccccaagctgtggtacacagctgcccaccacaccagcctggaccagagcagcccccccctgagcggcaccagccccagctacaagtacaccctgcccggggcccaggatgccaaggatgacttccccctgaggaagacagagagctctgtgagcagcagcagccctggcagcggccccagcagccccaacaacggccccaccggctctgtgacagaaaatgagacctctgtgctgccccccacccctcatgctgagcagatggtgtcccagcagaggatcctgattcatgaggacagcatgaacctgctgagcctgtacaccagccccagcctgcccaacatcaccctgggcctgcctgctgtgcccagccagctgaatgccagcaacagcctgaaggagaagcagaagtgtgagacccagaccctgcggcagggcgtgcccctgcccggccagtatggaggcagcatcccagccagcagcagccacccccacgtgaccctggagggcaagccacccaacagcagccaccaggccctgctgcagcacctgctgctgaaggagcagatgaggcagcagaagctgctggtggccggcggcgtgcccctgcacccccagagccccctggccaccaaggagcgcatcagccctggcatccggggcacccacaagctgcccaggcaccggcccctgaacagaacccagagcgcccccctgccccagagcaccctggcccagctggtgatccagcagcagcaccagcagttcctggagaagcagaagcagtaccagcagcagatccacatgaacaagctgctgagcaagagcattgagcagctgaagcagcccggcagccacctggaggaggccgaggaggagctgcagggcgaccaggccatgcaggaggaccgggcccccagcagcggcaacagcaccaggagtgacagcagcgcctgtgtggatgacaccctgggccaggtgggcgctgtgaaggtgaaggaggagcctgtggacagtgatgaagatgcccagatccaggagatggagagcggggagcaggccgccttcatgcagcagcccttcctggagcccacccacacccgggccctgtctgtgcggcaggcccccctggccgctgtgggcatggatggcctggagaagcaccggctggtgtccaggacccacagcagccctgctgcctctgtgctgccccacccagccatggaccggcccctgcagcccggcagcgccaccggcatcgcctatgaccccctgatgctgaagcaccagtgtgtgtgtggcaacagcaccacccaccctgagcacgccggccgcatccagagcatctggagccggctgcaggagaccggcctgctgaacaagtgtgagcgcatccagggcaggaaggccagcctggaggagatccagctggtgcacagcgagcaccacagcctgctgtatggcaccaaccccctggatggccagaagctggacccccgcatcctgctgggagatgacagccagaagttcttcagcagcctgccctgtggcggcctgggcgtggacagcgacaccatctggaatgagctgcacagcagtggagctgccaggatggctgtgggctgcgtcatcgagctggccagcaaggtggccagcggggagctgaagaatggatttgctgtggtgcggcccccaggccaccacgccgaggagagcacagccatgggcttctgcttcttcaacagcgtggccatcacagccaagtacctgcgggaccagctgaacatcagcaagatcctgattgtggacctggatgtgcaccacggcaatggcacccagcaggccttctacgccgaccccagcatcctgtacatcagcctgcacagatatgatgagggcaacttcttccctggcagcggggccccaaatgaggtgggcaccggcctgggggagggctacaacatcaacatcgcctggacaggaggcctggacccccccatgggagatgtggagtacctggaggccttccgcaccatcgtgaagcctgtggccaaggagtttgatcctgacatggtgctggtgtctgctggctttgatgccctggagggccacaccccacccctgggcggctacaaggtgacagccaagtgcttcggccacctgaccaagcagctgatgaccctggctgatggccgggtggtgctggccctggagggcggccatgacctgacagccatctgtgatgccagcgaggcctgtgtgaatgccctgctgggcaatgagctggagcccctggccgaggacatcctgcaccagagccccaacatgaatgctgtgatcagcctgcagaagatcatcgagatccagagcaagtactggaagtctgtgaggatggtggccgtgccccggggctgtgccctggccggggcccagctgcaggaggagacagagaccgtgtctgccctggccagcctgactgtggatgtggagcagccctttgcccaggaggacagcaggacagctggggagcccatggaggaggagcccgccctgtag

SEQ ID NO: 155423 - DNA, 1773 bp, Artificial Sequence
  Description of Artificial Sequence: Synthetic coding sequence
atgcacagcatgatcagctctgtggatgtgaagtctgaggtgcctgtgggcctggagcccatcagccccctggacctgaggacagacctgaggatgatgatgcctgtggtggaccctgtggtgcgggagaagcagctgcagcaggagctgctgctgatccagcagcagcagcagatccagaagcagctgctgattgctgagttccagaagcagcacgagaacctgacccggcagcaccaggcccagctgcaggagcacatcaaggagctgctggccatcaagcagcagcaggagctgctggagaaggagcagaagctggagcagcagaggcaggagcaggaggtggagcggcacagaagagagcagcagctgccccccctgcggggcaaggaccggggccgggagagagctgtggccagcacagaggtgaagcagaagctgcaggagttcctgctgagcaagagcgccaccaaggacacccccaccaacgggaagaaccacagcgtgagccgccaccccaagctgtggtacacagctgcccaccacaccagcctggaccagagcagcccccccctgagcggcaccagccccagctacaagtacaccctgcccggggcccaggatgccaaggatgacttccccctgaggaagacagccagcgagcccaacctgaaggtgcgcagccggctgaagcagaaggtggccgagaggaggagcagccccctgctgcggaggaaggatggaaatgtggtgaccagcttcaagaagaggatgtttgaggtgacagagagctctgtgagcagcagcagccctggcagcggccccagcagccccaacaacggccccactggatctgtgacagaaaatgagacctctgtgctgccccccacccctcatgctgagcagatggtgtcccagcagaggatcctgattcatgaagattccatgaacctgctgagcctgtacaccagccccagcctgcccaacatcaccctgggcctgcctgctgtgcccagccagctgaatgccagcaacagcctgaaggagaagcagaagtgtgagacccagaccctgcggcagggcgtgcccctgcccggccagtatggaggcagcatcccagccagcagcagccacccccacgtgaccctggagggcaagccacccaacagcagccaccaggccctgctgcagcacctgctgctgaaggagcagatgaggcagcagaagctgctggtggccggcggcgtgcccctgcacccccagagccccctggccaccaaggagcgcatcagccctggcatccggggcacccacaagctgcccaggcaccggcccctgaacagaacccagagcgcccccctgccccagagcaccctggcccagctggtgatccagcagcagcaccagcagttcctggagaagcagaagcagtaccagcagcagatccacatgaacaagctgctgagcaagagcattgagcagctgaagcagcccggcagccacctggaggaggccgaggaggagctgcagggcgaccaggccatgcaggaggaccgggcccccagcagcggcaacagcaccaggagtgacagcagcgcctgtgtggatgacaccctgggccaggtgggcgctgtgaaggtgaaggaggagcctgtggacagtgatgaagatgcccagatccaggagatggagagcggggagcaggccgccttcatgcagcaggtgattggcaaggacctggcccctggcttcgtcatcaaggtgatcatctag

SEQ ID NO: 155424 - DNA, 1734 bp, Artificial Sequence
  Description of Artificial Sequence: Synthetic coding sequence
atgctgcagaccatctatgaaagtgacagctgcttcagcagtgatggagtggccggccgggagcagctgctggcccagcagaggatgcacagcatgatcagctctgtggatgtgaagtctgaggtgcctgtgggcctggagcccatcagccccctggacctgaggacagacctgaggatgatgatgcctgtggtggaccctgtggtgcgggagaagcagctgcagcaggagctgctgctgatccagcagcagcagcagatccagaagcagctgctgattgctgagttccagaagcagcacgagaacctgacccggcagcaccaggcccagctgcaggagcacatcaagctgcagcaggagctgctggccatcaagcagcagcaggagctgctggagaaggagcagaagctggagcagcagaggcaggagcaggaggtggagcggcaccggcgggagcagcagctgccccccctgcggggcaaggaccggggccgggagagagctgtggccagcacagaggtgaagcagaagctgcaggagttcctgctgagcaagagcgccaccaaggacacccccaccaacgggaagaaccacagcgtgagccgccaccccaagctgtggtacacagctgcccaccacaccagcctggaccagagcagcccccccctgagcggcaccagccccagctacaagtacaccctgcccggggcccaggatgccaaggatgacttccccctgaggaagacagagagctctgtgagcagcagcagccctggcagcggccccagcagccccaacaacggccccaccggctctgtgacagaaaatgagacctctgtgctgccccccacccctcatgctgagcagatggtgtcccagcagaggatcctgattcatgaggacagcatgaacctgctgagcctgtacaccagccccagcctgcccaacatcaccctgggcctgcctgctgtgcccagccagctgaatgccagcaacagcctgaaggagaagcagaagtgtgagacccagaccctgcggcagggcgtgcccctgcccggccagtatggaggcagcatcccagccagcagcagccacccccacgtgaccctggagggcaagccacccaacagcagccaccaggccctgctgcagcacctgctgctgaaggagcagatgaggcagcagaagctgctggtggccggcggcgtgcccctgcacccccagagccccctggccaccaaggagcgcatcagccctggcatccggggcacccacaagctgcccaggcaccggcccctgaacagaacccagagcgcccccctgccccagagcaccctggcccagctggtgatccagcagcagcaccagcagttcctggagaagcagaagcagtaccagcagcagatccacatgaacaagctgctgagcaagagcattgagcagctgaagcagcccggcagccacctggaggaggccgaggaggagctgcagggcgaccaggccatgcaggaggaccgggcccccagcagcggcaacagcaccaggagtgacagcagcgcctgtgtggatgacaccctgggccaggtgggcgctgtgaaggtgaaggaggagcctgtggacagtgatgaagatgcccagatccaggagatggagagcggggagcaggccgccttcatgcagcaggtgattggcaaggacctggcccctggctttgtgatcaaggtgatcatctag

SEQ ID NO: 155425 - DNA, 3201 bp, Artificial Sequence
  Description of Artificial Sequence: Synthetic coding sequence
atgcacagcatgatcagctctgtggatgtgaagtctgaggtgcctgtgggcctggagcccatcagccccctggacctgaggacagacctgaggatgatgatgcctgtggtggaccctgtggtgcgggagaagcagctgcagcaggagctgctgctgatccagcagcagcagcagatccagaagcagctgctgattgctgagttccagaagcagcacgagaacctgacccggcagcaccaggcccagctgcaggagcacatcaaggagctgctggccatcaagcagcagcaggagctgctggagaaggagcagaagctggagcagcagaggcaggagcaggaggtggagcggcacagaagagagcagcagctgccccccctgcggggcaaggaccggggccgggagagagctgtggccagcacagaggtgaagcagaagctgcaggagttcctgctgagcaagagcgccaccaaggacacccccaccaacgggaagaaccacagcgtgagccgccaccccaagctgtggtacacagctgcccaccacaccagcctggaccagagcagcccccccctgagcggcaccagccccagctacaagtacaccctgcccggggcccaggatgccaaggatgacttccccctgaggaagacagccagcgagcccaacctgaaggtgcgcagccggctgaagcagaaggtggccgagaggaggagcagccccctgctgcggaggaaggatggaaatgtggtgaccagcttcaagaagaggatgtttgaggtgacagagagctctgtgagcagcagcagccctggcagcggccccagcagccccaacaacggccccactggatctgtgacagaaaatgagacctctgtgctgccccccacccctcatgctgagcagatggtgtcccagcagaggatcctgattcatgaagattccatgaacctgctgagcctgtacaccagccccagcctgcccaacatcaccctgggcctgcctgctgtgcccagccagctgaatgccagcaacagcctgaaggagaagcagaagtgtgagacccagaccctgcggcagggcgtgcccctgcccggccagtatggaggcagcatcccagccagcagcagccacccccacgtgaccctggagggcaagccacccaacagcagccaccaggccctgctgcagcacctgctgctgaaggagcagatgaggcagcagaagctgctggtggccggcggcgtgcccctgcacccccagagccccctggccaccaaggagcgcatcagccctggcatccggggcacccacaagctgcccaggcaccggcccctgaacagaacccagagcgcccccctgccccagagcaccctggcccagctggtgatccagcagcagcaccagcagttcctggagaagcagaagcagtaccagcagcagatccacatgaacaagctgctgagcaagagcattgagcagctgaagcagcccggcagccacctggaggaggccgaggaggagctgcagggcgaccaggccatgcaggaggaccgggcccccagcagcggcaacagcaccaggagtgacagcagcgcctgtgtggatgacaccctgggccaggtgggcgctgtgaaggtgaaggaggagcctgtggacagtgatgaagatgcccagatccaggagatggagagcggggagcaggccgccttcatgcagcagcccttcctggagcccacccacacccgggccctgtctgtgcggcaggcccccctggccgctgtgggcatggatggcctggagaagcaccggctggtgtccaggacccacagcagccctgctgcctctgtgctgccccacccagccatggaccggcccctgcagcccggcagcgccactggaattgcctatgaccccctgatgctgaagcaccagtgtgtgtgtggcaacagcaccacccaccctgagcacgccggccgcatccagagcatctggagccggctgcaggagaccggcctgctgaacaagtgtgagcgcatccagggcaggaaggccagcctggaggagatccagctggtgcacagcgagcaccacagcctgctgtatggcaccaaccccctggatggccagaagctggacccccgcatcctgctgggagatgacagccagaagttcttcagcagcctgccctgtggcggcctgggcgtggacagcgacaccatctggaatgagctgcacagcagcggggccgccaggatggctgtgggctgtgtgattgagctggccagcaaggtggccagcggggagctgaagaatggatttgctgtggtgcggcccccaggccaccacgccgaggagagcacagccatgggcttctgcttcttcaacagcgtggccatcacagccaagtacctgcgggaccagctgaacatcagcaagatcctgattgtggacctggatgtgcaccacggcaatggcacccagcaggccttctatgctgaccccagcatcctgtacatcagcctgcacagatatgatgagggcaacttcttccctggcagcggggccccaaatgaggtgggcaccggcctgggggagggctacaacatcaacatcgcctggacaggaggcctggacccccccatgggagatgtggagtacctggaggccttccgcaccatcgtgaagcctgtggccaaggagtttgatcctgacatggtgctggtgtctgctggctttgatgccctggagggccacaccccacccctgggcggctacaaggtgacagccaagtgcttcggccacctgaccaagcagctgatgaccctggctgatggccgggtggtgctggccctggagggcggccatgacctgacagccatctgtgatgccagcgaggcctgtgtgaatgccctgctgggcaatgagctggagcccctggccgaggacatcctgcaccagagccccaacatgaatgctgtgatcagcctgcagaagatcatcgagatccagagcaagtactggaagtctgtgaggatggtggccgtgccccggggctgtgccctggccggggcccagctgcaggaggagacagaaacagtgtctgccctggccagcctgactgtggatgtggagcagccctttgcccaggaggacagcaggacagctggggagcccatggaggaggagcccgccctgtag

SEQ ID NO: 155426 - DNA, 447 bp, Artificial Sequence
  Description of Artificial Sequence: Synthetic coding sequence
atgcacagcatgatcagctctgtggatgtgaagtctgaggtgcctgtgggcctggagcccatcagccccctggacctgaggacagacctgaggatgatgatgcctgtggtggaccctgtggtgcgggagaagcagctgcagcaggagctgctgctgatccagcagcagcagcagatccagaagcagctgctgattgctgagttccagaagcagcacgagaacctgacccggcagcaccaggcccagctgcaggagcacatcaagctgcagcaggagctgctggccatcaagcagcagcaggagctgctggagaaggagcagaagctggagcagcagaggcaggagcaggaggtggagcggcaccggcgggagcagcagctgccccccctgcggggcaaggaccggggccgggagagagctgtggccagcacagaggtgaagcagtag

SEQ ID NO: 155427 - DNA, 417 bp, Artificial Sequence
  Description of Artificial Sequence: Synthetic coding sequence
atgcacagcatgatcagctctgtggatgtgaagtctgaggtgcctgtgggcctggagcccatcagccccctggacctgaggacagacctgaggatgatgatgcctgtggtggaccctgtggtgcgggagaagcagctgcagcaggagctgctgctgatccagcagcagcagcagatccagaagcagctgctgattgctgagttccagaagcagcacgagaacctgacccggcagcaccaggcccagctgcaggagcacatcaagctgcagcaggagctgctggccatcaagcagcagcaggagctgctggagaaggagcagaagctggagcagcagaggcaggagcaggaggtggagcggcaccggcgggagcagcagctgccccccctgcggggcaaggaccggggccgggagtag

SEQ ID NO: 155428 - DNA, 1767 bp, Artificial Sequence
  Description of Artificial Sequence: Synthetic coding sequence
atgatgagcagccctgcccagcctgacctgatgtggaacctggtgccctgggtgctcttctgtggctgctgccgcatcttcccagatggagtggccggccgggagcagctgctggcccagcagaggatgcacagcatgatcagctctgtggatgtgaagtctgaggtgcctgtgggcctggagcccatcagccccctggacctgaggacagacctgaggatgatgatgcctgtggtggaccctgtggtgcgggagaagcagctgcagcaggagctgctgctgatccagcagcagcagcagatccagaagcagctgctgattgctgagttccagaagcagcacgagaacctgacccggcagcaccaggcccagctgcaggagcacatcaaggagctgctggccatcaagcagcagcaggagctgctggagaaggagcagaagctggagcagcagaggcaggagcaggaggtggagcggcacagaagagagcagcagctgccccccctgcggggcaaggaccggggccgggagagagctgtggccagcacagaggtgaagcagaagctgcaggagttcctgctgagcaagagcgccaccaaggacacccccaccaacgggaagaaccacagcgtgagccgccaccccaagctgtggtacacagctgcccaccacaccagcctggaccagagcagcccccccctgagcggcaccagccccagctacaagtacaccctgcccggggcccaggatgccaaggatgacttccccctgaggaagacagagagctctgtgagcagcagcagccctggcagcggccccagcagccccaacaacggccccactggatctgtgacagaaaatgagacctctgtgctgccccccacccctcatgctgagcagatggtgtcccagcagaggatcctgattcatgaagattccatgaacctgctgagcctgtacaccagccccagcctgcccaacatcaccctgggcctgcctgctgtgcccagccagctgaatgccagcaacagcctgaaggagaagcagaagtgtgagacccagaccctgcggcagggcgtgcccctgcccggccagtatggaggcagcatcccagccagcagcagccacccccacgtgaccctggagggcaagccacccaacagcagccaccaggccctgctgcagcacctgctgctgaaggagcagatgaggcagcagaagctgctggtggccggcggcgtgcccctgcacccccagagccccctggccaccaaggagcgcatcagccctggcatccggggcacccacaagctgcccaggcaccggcccctgaacagaacccagagcgcccccctgccccagagcaccctggcccagctggtgatccagcagcagcaccagcagttcctggagaagcagaagcagtaccagcagcagatccacatgaacaagctgctgagcaagagcattgagcagctgaagcagcccggcagccacctggaggaggccgaggaggagctgcagggcgaccaggccatgcaggaggaccgggcccccagcagcggcaacagcaccaggagtgacagcagcgcctgtgtggatgacaccctgggccaggtgggcgctgtgaaggtgaaggaggagcctgtggacagtgatgaagatgcccagatccaggagatggagagcggggagcaggccgccttcatgcagcaggtgattggcaaggacctggcccctggcttcgtcatcaaggtgatcatctag

SEQ ID NO: 155429 - DNA, 1641 bp, Artificial Sequence
  Description of Artificial Sequence: Synthetic coding sequence
atgcacagcatgatcagctctgtggatgtgaagtctgaggtgcctgtgggcctggagcccatcagccccctggacctgaggacagacctgaggatgatgatgcctgtggtggaccctgtggtgcgggagaagcagctgcagcaggagctgctgctgatccagcagcagcagcagatccagaagcagctgctgattgctgagttccagaagcagcacgagaacctgacccggcagcaccaggcccagctgcaggagcacatcaaggagctgctggccatcaagcagcagcaggagctgctggagaaggagcagaagctggagcagcagaggcaggagcaggaggtggagcggcacagaagagagcagcagctgccccccctgcggggcaaggaccggggccgggagagagctgtggccagcacagaggtgaagcagaagctgcaggagttcctgctgagcaagagcgccaccaaggacacccccaccaacgggaagaaccacagcgtgagccgccaccccaagctgtggtacacagctgcccaccacaccagcctggaccagagcagcccccccctgagcggcaccagccccagctacaagtacaccctgcccggggcccaggatgccaaggatgacttccccctgaggaagacagagagctctgtgagcagcagcagccctggcagcggccccagcagccccaacaacggccccactggatctgtgacagaaaatgagacctctgtgctgccccccacccctcatgctgagcagatggtgtcccagcagaggatcctgattcatgaagattccatgaacctgctgagcctgtacaccagccccagcctgcccaacatcaccctgggcctgcctgctgtgcccagccagctgaatgccagcaacagcctgaaggagaagcagaagtgtgagacccagaccctgcggcagggcgtgcccctgcccggccagtatggaggcagcatcccagccagcagcagccacccccacgtgaccctggagggcaagccacccaacagcagccaccaggccctgctgcagcacctgctgctgaaggagcagatgaggcagcagaagctgctggtggccggcggcgtgcccctgcacccccagagccccctggccaccaaggagcgcatcagccctggcatccggggcacccacaagctgcccaggcaccggcccctgaacagaacccagagcgcccccctgccccagagcaccctggcccagctggtgatccagcagcagcaccagcagttcctggagaagcagaagcagtaccagcagcagatccacatgaacaagctgctgagcaagagcattgagcagctgaagcagcccggcagccacctggaggaggccgaggaggagctgcagggcgaccaggccatgcaggaggaccgggcccccagcagcggcaacagcaccaggagtgacagcagcgcctgtgtggatgacaccctgggccaggtgggcgctgtgaaggtgaaggaggagcctgtggacagtgatgaagatgcccagatccaggagatggagagcggggagcaggccgccttcatgcagcaggtgattggcaaggacctggcccctggcttcgtcatcaaggtgatcatctag

SEQ ID NO: 155430 - DNA, 3036 bp, Artificial Sequence
  Description of Artificial Sequence: Synthetic coding sequence
atgcacagcatgatcagctctgtggatgtgaagtctgaggtgcctgtgggcctggagcccatcagccccctggacctgaggacagacctgaggatgatgatgcctgtggtggaccctgtggtgcgggagaagcagctgcagcaggagctgctgctgatccagcagcagcagcagatccagaagcagctgctgattgctgagttccagaagcagcacgagaacctgacccggcagcaccaggcccagctgcaggagcacatcaaggagctgctggccatcaagcagcagcaggagctgctggagaaggagcagaagctggagcagcagaggcaggagcaggaggtggagcggcacagaagagagcagcagctgccccccctgcggggcaaggaccggggccgggagagagctgtggccagcacagaggtgaagcagaagctgcaggagttcctgctgagcaagagcgccaccaaggacacccccaccaacgggaagaaccacagcgtgagccgccaccccaagctgtggtacacagctgcccaccacaccagcctggaccagagcagcccccccctgagcggcaccagccccagctacaagtacaccctgcccggggcccaggatgccaaggatgacttccccctgaggaagacagccagcgagcccaacctgaaggtgcgcagccggctgaagcagaaggtggccgagaggaggagcagccccctgctgcggaggaaggatggaaatgtggtgaccagcttcaagaagaggatgtttgaggtgacagagagctctgtgagcagcagcagccctggcagcggccccagcagccccaacaacggccccactggatctgtgacagaaaatgagacctctgtgctgccccccacccctcatgctgagcagatggtgtcccagcagaggatcctgattcatgaagattccatgaacctgctgagcctgtacaccagccccagcctgcccaacatcaccctgggcctgcctgctgtgcccagccagctgaatgccagcaacagcctgaaggagaagcagaagtgtgagacccagaccctgcggcagggcgtgcccctgcccggccagtatggaggcagcatcccagccagcagcagccacccccacgtgaccctggagggcaagccacccaacagcagccaccaggccctgctgcagcacctgctgctgaaggagcagatgaggcagcagaagctgctggtggccggcggcgtgcccctgcacccccagagccccctggccaccaaggagcgcatcagccctggcatccggggcacccacaagctgcccaggcaccggcccctgaacagaacccagagcgcccccctgccccagagcaccctggcccagctggtgatccagcagcagcaccagcagttcctggagaagcagaagcagtaccagcagcagatccacatgaacaagctgctgagcaagagcattgagcagctgaagcagcccggcagccacctggaggaggccgaggaggagctgcagggcgaccaggccatgcaggaggaccgggcccccagcagcggcaacagcaccaggagtgacagcagcgcctgtgtggatgacaccctgggccaggtgggcgctgtgaaggtgaaggaggagcctgtggacagtgatgaagatgcccagatccaggagatggagagcggggagcaggccgccttcatgcagcagcccttcctggagcccacccacacccgggccctgtctgtgcggcaggcccccctggccgctgtgggcatggatggcctggagaagcaccggctggtgtccaggacccacagcagccctgctgcctctgtgctgccccacccagccatggaccggcccctgcagcccggcagcgccactggaattgcctatgaccccctgatgctgaagcaccagtgtgtgtgtggcaacagcaccacccaccctgagcacgccggccgcatccagagcatctggagccggctgcaggagaccggcctgctgaacaagtgtgagcgcatccagggcaggaaggccagcctggaggagatccagctggtgcacagcgagcaccacagcctgctgtatggcaccaaccccctggatggccagaagctggacccccgcatcctgctgggagatgacagccagaagttcttcagcagcctgccctgtggcggcctgggcgtggacagcgacaccatctggaatgagctgcacagcagcggggccgccaggatggctgtgggctgtgtgattgagctggccagcaaggtggccagcggggagctgaagaatggatttgctgtggtgcggcccccaggccaccacgccgaggagagcacagccatgggcttctgcttcttcaacagcgtggccatcacagccaagtacctgcgggaccagctgaacatcagcaagatcctgattgtggacctggatgtgcaccacggcaatggcacccagcaggccttctatgctgaccccagcatcctgtacatcagcctgcacagatatgatgagggcaacttcttccctggcagcggggccccaaatgaggtgggcaccggcctgggggagggctacaacatcaacatcgcctggacaggaggcctggacccccccatgggagatgtggagtacctggaggccttccgcaccatcgtgaagcctgtggccaaggagtttgatcctgacatggtgctggtgtctgctggctttgatgccctggagggccacaccccacccctgggcggctacaaggtgacagccaagtgcttcggccacctgaccaagcagctgatgaccctggctgatggccgggtggtgctggccctggagggcggccatgacctgacagccatctgtgatgccagcgaggcctgtgtgaatgccctgctgggcaatgagctggagcccctggccgaggacatcctgcaccagagccccaacatgaatgctgtgatcagcctgcagaagatcatcgagatccagagcatgagcctgaagttctcctag

SEQ ID NO: 155431 - DNA, 72 bp, Artificial Sequence
  Description of Artificial Sequence: Synthetic coding sequence
atgcacagcatgatcagctctgtggatgtgaagtctgaggtgcctgtgggcctggagcccatcagcccctag

SEQ ID NO: 155432 - DNA, 3210 bp, Artificial Sequence
  Description of Artificial Sequence: Synthetic coding sequence
atgcacagcatgatcagctctgtggatgtgaagtctgaggtgcctgtgggcctggagcccatcagccccctggacctgaggacagacctgaggatgatgatgcctgtggtggaccctgtggtgcgggagaagcagctgcagcaggagctgctgctgatccagcagcagcagcagatccagaagcagctgctgattgctgagttccagaagcagcacgagaacctgacccggcagcaccaggcccagctgcaggagcacatcaagctgcagcaggagctgctggccatcaagcagcagcaggagctgctggagaaggagcagaagctggagcagcagaggcaggagcaggaggtggagcggcaccggcgggagcagcagctgccccccctgcggggcaaggaccggggccgggagagagctgtggccagcacagaggtgaagcagaagctgcaggagttcctgctgagcaagagcgccaccaaggacacccccaccaacgggaagaaccacagcgtgagccgccaccccaagctgtggtacacagctgcccaccacaccagcctggaccagagcagcccccccctgagcggcaccagccccagctacaagtacaccctgcccggggcccaggatgccaaggatgacttccccctgaggaagacagccagcgagcccaacctgaaggtgcgcagccggctgaagcagaaggtggccgagcggcgcagcagccccctgctgcggaggaaggatggaaatgtggtgaccagcttcaagaagaggatgtttgaggtgacagagagctctgtgagcagcagcagccctggcagcggccccagcagccccaacaacggccccaccggctctgtgacagaaaatgagacctctgtgctgccccccacccctcatgctgagcagatggtgtcccagcagaggatcctgattcatgaggacagcatgaacctgctgagcctgtacaccagccccagcctgcccaacatcaccctgggcctgcctgctgtgcccagccagctgaatgccagcaacagcctgaaggagaagcagaagtgtgagacccagaccctgcggcagggcgtgcccctgcccggccagtatggaggcagcatcccagccagcagcagccacccccacgtgaccctggagggcaagccacccaacagcagccaccaggccctgctgcagcacctgctgctgaaggagcagatgaggcagcagaagctgctggtggccggcggcgtgcccctgcacccccagagccccctggccaccaaggagcgcatcagccctggcatccggggcacccacaagctgcccaggcaccggcccctgaacagaacccagagcgcccccctgccccagagcaccctggcccagctggtgatccagcagcagcaccagcagttcctggagaagcagaagcagtaccagcagcagatccacatgaacaagctgctgagcaagagcattgagcagctgaagcagcccggcagccacctggaggaggccgaggaggagctgcagggcgaccaggccatgcaggaggaccgggcccccagcagcggcaacagcaccaggagtgacagcagcgcctgtgtggatgacaccctgggccaggtgggcgctgtgaaggtgaaggaggagcctgtggacagtgatgaagatgcccagatccaggagatggagagcggggagcaggccgccttcatgcagcagcccttcctggagcccacccacacccgggccctgtctgtgcggcaggcccccctggccgctgtgggcatggatggcctggagaagcaccggctggtgtccaggacccacagcagccctgctgcctctgtgctgccccacccagccatggaccggcccctgcagcccggcagcgccaccggcatcgcctatgaccccctgatgctgaagcaccagtgtgtgtgtggcaacagcaccacccaccctgagcacgccggccgcatccagagcatctggagccggctgcaggagaccggcctgctgaacaagtgtgagcgcatccagggcaggaaggccagcctggaggagatccagctggtgcacagcgagcaccacagcctgctgtatggcaccaaccccctggatggccagaagctggacccccgcatcctgctgggagatgacagccagaagttcttcagcagcctgccctgtggcggcctgggcgtggacagcgacaccatctggaatgagctgcacagcagtggagctgccaggatggctgtgggctgcgtcatcgagctggccagcaaggtggccagcggggagctgaagaatggatttgctgtggtgcggcccccaggccaccacgccgaggagagcacagccatgggcttctgcttcttcaacagcgtggccatcacagccaagtacctgcgggaccagctgaacatcagcaagatcctgattgtggacctggatgtgcaccacggcaatggcacccagcaggccttctacgccgaccccagcatcctgtacatcagcctgcacagatatgatgagggcaacttcttccctggcagcggggccccaaatgaggtgggcaccggcctgggggagggctacaacatcaacatcgcctggacaggaggcctggacccccccatgggagatgtggagtacctggaggccttccgcaccatcgtgaagcctgtggccaaggagtttgatcctgacatggtgctggtgtctgctggctttgatgccctggagggccacaccccacccctgggcggctacaaggtgacagccaagtgcttcggccacctgaccaagcagctgatgaccctggctgatggccgggtggtgctggccctggagggcggccatgacctgacagccatctgtgatgccagcgaggcctgtgtgaatgccctgctgggcaatgagctggagcccctggccgaggacatcctgcaccagagccccaacatgaatgctgtgatcagcctgcagaagatcatcgagatccagagcaagtactggaagtctgtgaggatggtggccgtgccccggggctgtgccctggccggggcccagctgcaggaggagacagagaccgtgtctgccctggccagcctgactgtggatgtggagcagccctttgcccaggaggacagcaggacagctggggagcccatggaggaggagcccgccctgtag

SEQ ID NO: 155433 - DNA, 1689 bp, Artificial Sequence
  Description of Artificial Sequence: Synthetic coding sequence
atgatgatgcctgtggtggaccctgtggtgcgggagaagcagctgcagcaggagctgctgctgatccagcagcagcagcagatccagaagcagctgctgattgctgagttccagaagcagcacgagaacctgacccggcagcaccaggcccagctgcaggagcacatcaagctgcagcaggagctgctggccatcaagcagcagcaggagctgctggagaaggagcagaagctggagcagcagaggcaggagcaggaggtggagcggcacagaagagagcagcagctgccccccctgcggggcaaggaccggggccgggagagagctgtggccagcacagaggtgaagcagaagctgcaggagttcctgctgagcaagagcgccaccaaggacacccccaccaacgggaagaaccacagcgtgagccgccaccccaagctgtggtacacagctgcccaccacaccagcctggaccagagcagcccccccctgagcggcaccagccccagctacaagtacaccctgcccggggcccaggatgccaaggatgacttccccctgaggaagacagccagcgagcccaacctgaaggtgcgcagccggctgaagcagaaggtggccgagaggaggagcagccccctgctgcggaggaaggatggaaatgtggtgaccagcttcaagaagaggatgtttgaggtgacagagagctctgtgagcagcagcagccctggcagcggccccagcagccccaacaacggccccactggatctgtgacagaaaatgagacctctgtgctgccccccacccctcatgctgagcagatggtgtcccagcagaggatcctgattcatgaagattccatgaacctgctgagcctgtacaccagccccagcctgcccaacatcaccctgggcctgcctgctgtgcccagccagctgaatgccagcaacagcctgaaggagaagcagaagtgtgagacccagaccctgcggcagggcgtgcccctgcccggccagtatggaggcagcatcccagccagcagcagccacccccacgtgaccctggagggcaagccacccaacagcagccaccaggccctgctgcagcacctgctgctgaaggagcagatgaggcagcagaagctgctggtggccggcggcgtgcccctgcacccccagagccccctggccaccaaggagcgcatcagccctggcatccggggcacccacaagctgcccaggcaccggcccctgaacagaacccagagcgcccccctgccccagagcaccctggcccagctggtgatccagcagcagcaccagcagttcctggagaagcagaagcagtaccagcagcagatccacatgaacaagctgctgagcaagagcattgagcagctgaagcagcccggcagccacctggaggaggccgaggaggagctgcagggcgaccaggccatgcaggaggaccgggcccccagcagcggcaacagcaccaggagtgacagcagcgcctgtgtggatgacaccctgggccaggtgggcgctgtgaaggtgaaggaggagcctgtggacagtgatgaagatgcccagatccaggagatggagagcggggagcaggccgccttcatgcagcaggtgattggcaaggacctggcccctggcttcgtcatcaaggtgatcatctag

SEQ ID NO: 155434 - DNA, 1542 bp, Artificial Sequence
  Description of Artificial Sequence: Synthetic coding sequence
atgatgatgcctgtggtggaccctgtggtgcgggagaagcagctgcagcaggagctgctgctgatccagcagcagcagcagatccagaagcagctgctgattgctgagttccagaagcagcacgagaacctgacccggcagcaccaggcccagctgcaggagcacatcaaggagctgctggccatcaagcagcagcaggagctgctggagaaggagcagaagctggagcagcagaggcaggagcaggaggtggagcggcaccggcgggagcagcagctgccccccctgcggggcaaggaccggggccgggagagagctgtggccagcacagaggtgaagcagaagctgcaggagttcctgctgagcaagagcgccaccaaggacacccccaccaacgggaagaaccacagcgtgagccgccaccccaagctgtgggccgcccaccacaccagcctggaccagagcagcccccccctgagcggcaccagccccagctacaagtacaccctgcccggggcccaggatgccaaggatgacttccccctgaggaagacagagagctctgtgagcagcagcagccctggcagcggccccagcagccccaacaacggccccaccggctctgtgacagaaaatgagacctctgtgctgccccccacccctcatgctgagcagatggtgtcccagcagaggatcctgattcatgaggacagcatgaacctgctgagcctgtacaccagccccagcctgcccaacatcaccctgggcctgcctgctgtgcccagccagctgaatgccagcaacagcctgaaggagaagcagaagtgtgagacccagaccctgcggcagggcgtgcccctgcccggccagtatggaggcagcatcccagccagcagcagccacccccacgtgaccctggagggcaagccacccaacagcagccaccaggccctgctgcagcacctgctgctgaaggagcagatgaggcagcagaagctgctggtggccggcggcgtgcccctgcacccccagagccccctggccaccaaggagcgcatcagccctggcatccggggcacccacaagctgcccaggcaccggcccctgaacagaacccagagcgcccccctgccccagagcaccctggcccagctggtgatccagcagcagcaccagcagttcctggagaagcagaagcagtaccagcagcagatccacatgaacaagctgctgagcaagagcattgagcagctgaagcagcccggcagccacctggaggaggccgaggaggagctgcagggcgaccaggccatgcaggaggaccgggcccccagcagcggcaacagcaccaggagtgacagcagcgcctgtgtggatgacaccctgggccaggtgggcgctgtgaaggtgaaggaggagcctgtggacagtgatgaagatgcccagatccaggagatggagagcggggagcaggccgccttcatgcagcaggtgattggcaaggacctggcccctggctttgtgatcaaggtgatcatctag

SEQ ID NO: 155435 - DNA, 1980 bp, Artificial Sequence
  Description of Artificial Sequence: Synthetic coding sequence
atgagggtgaaccacacagtgtccaccatgctgcccacctgcatggtgcaccggcagaccatgagctgcagcggggccggcggcatcacagcctttgtggccttcagagatgtggccgtgtacttcacccaggaggagtggaggctgctgagccctgcccagaggaccctgcaccgggaggtgatgctggagacctacaaccacctggtgtccctggagatccccagcagcaagcccaagctgattgcccagctggagcggggggaggccccctggagggaggagaggaaatgtcccctggacctgtgcccagagagcaagccagagatccagctgagccccagctgccccctcatcttcagcagccagcaggccctgagccagcacgtgtggctgagccacctgagccagctgttcagcagcctgtgggccggcaaccccctgcacctgggcaagcactacccagaggaccagaagcagcagcaggaccccttctgcttcagcggcaaggccgagtggatccaggagggggaggacagccggctgctgtttggccgggtgtccaagaatggcaccagcaaggccctgagcagccccccagaggagcagcagcctgcccagagcaaggaggacaacacagtggtggacatcggcagcagccctgagaggagagctgacctggaggagacagacaaggtgctgcacggcctggaggtgtctggctttggagagatcaagtatgaggagtttggacctggcttcatcaaggagagcaacctgctgagcctgcagaagacccagacaggagagaccccctacatgtacacagagtggggagacagctttggctccatgtctgtgctgatcaagaaccccaggacccacagcggcggcaagccctacgtgtgcagagaatgtggccggggcttcacctggaagagcaacctgatcacccaccagaggacccacagcggggagaagccctacgtgtgcaaggactgtggccggggcttcacctggaagagcaacctcttcacccaccagaggacccacagcggcctgaagccctacgtgtgcaaggaatgtggccagagcttcagcctgaagagcaacctgatcacccaccagagggcccacactggagagaagccctacgtgtgcagagaatgtggccggggcttccggcagcacagccacctggtgcgccacaagaggacccacagcggggagaagccctacatctgcagagaatgtgagcagggcttcagccagaagagccacctgatccgccacctgcggacccacactggagagaagccctacgtgtgcacagaatgtggccgccacttctcctggaagagcaacctgaagacccaccagaggacccacagcggcgtgaagccctacgtgtgcctggagtgtggccagtgcttcagcctgaagagcaacctgaacaagcaccagaggagccacactggagagaagccctttgtgtgcacagaatgtggccggggcttcaccaggaagagcaccctgagcacccaccagaggacccacagcggggagaagccctttgtgtgtgctgaatgtggccggggcttcaatgacaagagcaccctcatcagccaccagaggacccacagcggggagaagcccttcatgtgcagagaatgtggccgccgcttccggcagaagcccaacctcttccgccacaagagggcccacagcggggcctttgtgtgcagagaatgtggccagggcttctgtgccaagctgaccctcatcaagcaccagagggcccacgccggcggcaagccccacgtgtgcagagaatgtggccagggcttcagccggcagagccacctgatccgccaccagaggacccacagcggggagaagccctacatctgcaggaaatgtggccggggcttcagcaggaagagcaacctgatccgccaccagaggacccacagcggctag

SEQ ID NO: 155436 - DNA, 1923 bp, Artificial Sequence
  Description of Artificial Sequence: Synthetic coding sequence
atggccaccggcctgctgcgggccaagaaggaggcctttgtggccttcagagatgtggccgtgtacttcacccaggaggagtggaggctgctgagccctgcccagaggaccctgcaccgggaggtgatgctggagacctacaaccacctggtgtccctggagatccccagcagcaagcccaagctgattgcccagctggagcggggggaggccccctggagggaggagaggaagtgccccctggacctgtgcccagagagcaagccagagatccagctgagccccagctgccccctcatcttcagcagccagcaggccctgagccagcacgtgtggctgagccacctgagccagctgttcagcagcctgtgggccggcaaccccctgcacctgggcaagcactacccagaggaccagaagcagcagcaggaccccttctgcttcagcggcaaggccgagtggatccaggagggggaggacagccggctgctgtttggccgggtgtccaagaatggcaccagcaaggccctgagcagccccccagaggagcagcagcctgcccagagcaaagaagacaacacagtggtggacatcggcagcagccctgagcggcgggctgacctggaggagacagacaaggtgctgcacggcctggaggtgtctggctttggagagatcaagtatgaggagtttggacctggcttcatcaaggagagcaacctgctgagcctgcagaagacccagacaggagagaccccctacatgtacacagagtggggagacagctttggctccatgtctgtgctgatcaagaaccccaggacccacagcggcggcaagccctacgtgtgccgggagtgtggccggggcttcacctggaagagcaacctgatcacccaccagaggacccacagcggggagaagccctacgtgtgcaaggactgtggccggggcttcacctggaagagcaacctcttcacccaccagaggacccacagcggcctgaagccctacgtgtgcaaggaatgtggccagagcttcagcctgaagagcaacctgatcacccaccagagggcccacactggagagaagccctacgtgtgccgggagtgtggccggggcttccggcagcacagccacctggtgcgccacaagaggacccacagcggggagaagccctacatctgccgggagtgtgagcagggcttcagccagaagagccacctgatccgccacctgcggacccacactggagagaagccctacgtgtgcacagaatgtggccgccacttctcctggaagagcaacctgaagacccaccagaggacccacagcggcgtgaagccctacgtgtgcctggagtgtggccagtgcttcagcctgaagagcaacctgaacaagcaccagaggagccacactggagagaagccctttgtgtgcacagaatgtggccggggcttcaccaggaagagcaccctgagcacccaccagaggacccacagcggggagaagccctttgtgtgtgccgagtgtggccggggcttcaatgacaagagcaccctcatcagccaccagaggacccacagcggggagaagcccttcatgtgccgggagtgtggccgccgcttccggcagaagcccaacctcttccgccacaagagggcccacagcggggcctttgtgtgccgggagtgtggccagggcttctgtgccaagctgaccctcatcaagcaccagagggcccatgctgggggcaagccccacgtgtgccgggagtgtggccagggcttcagccggcagagccacctgatccgccaccagaggacccacagcggggagaagccctacatctgcaggaaatgtggccggggcttcagcaggaagagcaacctgatccgccaccagaggacccacagcggctag

SEQ ID NO: 155437 - DNA, 1317 bp, Artificial Sequence
  Description of Artificial Sequence: Synthetic coding sequence
atgctggagacctacaaccacctggtgtccctggagatccccagcagcaagcccaagctgattgcccagctggagcggggggaggccccctggagggaggagaggaagtgccccctggacctgtgcccagagagcaagccagagatccagctgagccccagctgccccctcatcttcagcagccagcaggccctgagccagcacgtgtggctgagccacctgagccagctgttcagcagcctgtgggccggcaaccccctgcacctgggcaagcactacccagaggaccagaagcagcagcaggaccccttctgcttcagcggcaaggccgagtggatccaggagggggaggacagccggctgctgtttggccgggtgtccaagaatggcaccagcaaggccctgagcagccccccagaggagcagcagcctgcccagagcaaagaagacaacacagtggtggacatcggcagcagccctgagcggcgggctgacctggaggagacagacaaggtgctgcacggcctggaggtgtctggctttggagagatcaagtatgaggagtttggacctggcttcatcaaggagagcaacctgctgagcctgcagaagagccacctgatccgccacctgcggacccacactggagagaagccctacgtgtgcacagaatgtggccgccacttctcctggaagagcaacctgaagacccaccagaggacccacagcggcgtgaagccctacgtgtgcctggagtgtggccagtgcttcagcctgaagagcaacctgaacaagcaccagaggagccacactggagagaagccctttgtgtgcacagaatgtggccggggcttcaccaggaagagcaccctgagcacccaccagaggacccacagcggggagaagccctttgtgtgtgccgagtgtggccggggcttcaatgacaagagcaccctcatcagccaccagaggacccacagcggggagaagcccttcatgtgccgggagtgtggccgccgcttccggcagaagcccaacctcttccgccacaagagggcccacagcggggcctttgtgtgccgggagtgtggccagggcttctgtgccaagctgaccctcatcaagcaccagagggcccatgctgggggcaagccccacgtgtgccgggagtgtggccagggcttcagccggcagagccacctgatccgccaccagaggacccacagcggggagaagccctacatctgcaggaaatgtggccggggcttcagcaggaagagcaacctgatccgccaccagaggacccacagcggctag

SEQ ID NO: 155438 - DNA, 1797 bp, Artificial Sequence
  Description of Artificial Sequence: Synthetic coding sequence
atgctggagacctacaaccacctggtgtccctggagatccccagcagcaagcccaagctgattgcccagctggagcggggggaggccccctggagggaggagaggaagtgccccctggacctgtgcccagagagcaagccagagatccagctgagccccagctgccccctcatcttcagcagccagcaggccctgagccagcacgtgtggctgagccacctgagccagctgttcagcagcctgtgggccggcaaccccctgcacctgggcaagcactacccagaggaccagaagcagcagcaggaccccttctgcttcagcggcaaggccgagtggatccaggagggggaggacagccggctgctgtttggccgggtgtccaagaatggcaccagcaaggccctgagcagccccccagaggagcagcagcctgcccagagcaaagaagacaacacagtggtggacatcggcagcagccctgagcggcgggctgacctggaggagacagacaaggtgctgcacggcctggaggtgtctggctttggagagatcaagtatgaggagtttggacctggcttcatcaaggagagcaacctgctgagcctgcagaagacccagacaggagagaccccctacatgtacacagagtggggagacagctttggctccatgtctgtgctgatcaagaaccccaggacccacagcggcggcaagccctacgtgtgccgggagtgtggccggggcttcacctggaagagcaacctgatcacccaccagaggacccacagcggggagaagccctacgtgtgcaaggactgtggccggggcttcacctggaagagcaacctcttcacccaccagaggacccacagcggcctgaagccctacgtgtgcaaggaatgtggccagagcttcagcctgaagagcaacctgatcacccaccagagggcccacactggagagaagccctacgtgtgccgggagtgtggccggggcttccggcagcacagccacctggtgcgccacaagaggacccacagcggggagaagccctacatctgccgggagtgtgagcagggcttcagccagaagagccacctgatccgccacctgcggacccacactggagagaagccctacgtgtgcacagaatgtggccgccacttctcctggaagagcaacctgaagacccaccagaggacccacagcggcgtgaagccctacgtgtgcctggagtgtggccagtgcttcagcctgaagagcaacctgaacaagcaccagaggagccacactggagagaagccctttgtgtgcacagaatgtggccggggcttcaccaggaagagcaccctgagcacccaccagaggacccacagcggggagaagccctttgtgtgtgccgagtgtggccggggcttcaatgacaagagcaccctcatcagccaccagaggacccacagcggggagaagcccttcatgtgccgggagtgtggccgccgcttccggcagaagcccaacctcttccgccacaagagggcccacagcggggcctttgtgtgccgggagtgtggccagggcttctgtgccaagctgaccctcatcaagcaccagagggcccatgctgggggcaagccccacgtgtgccgggagtgtggccagggcttcagccggcagagccacctgatccgccaccagaggacccacagcggggagaagccctacatctgcaggaaatgtggccggggcttcagcaggaagagcaacctgatccgccaccagaggacccacagcggctag

SEQ ID NO: 155439 - DNA, 2190 bp, Artificial Sequence
  Description of Artificial Sequence: Synthetic coding sequence
tcctggctgggccctgggaaggccagcctgctgcgctccttcccccacctgtgcaccctgctgcctgacttccggctgcaggacccccagagggccccagccttccacctgagcagcgagaccctgcccttcagcaggaagagcacccaggagaccaggaagatggccaccggcctgctgcgggccaagaaggaggcctttgtggccttcagagatgtggccgtgtacttcacccaggaggagtggaggctgctgagccctgcccagaggaccctgcaccgggaggtgatgctggagacctacaaccacctggtgtccctggagatccccagcagcaagcccaagctgattgcccagctggagcggggggaggccccctggagggaggagaggaagtgccccctggacctgtgcccagctgagagcaagccagagatccagctgagccccagctgccccctcatcttcagcagccagcaggccctgagccagcacgtgtggctgagccacctgagccagctgttcagcagcctgtgggccggcaaccccctgcacctgggcaagcactacccagaggaccagaagcagcagcaggaccccttctgcttcagcggcaaggccgagtggatccaggagggggaggacagccggctgctgtttggccgggtgtccaagaatggcaccagcaaggccctgagcagccccccagaggagcagcagcctgcccagagcaaggaggacaacacagtggtggacatcggcagcagccctgagaggagagctgacctggaggagacagacaaggtgctgcacggcctggaggtgtctggctttggagagatcaagtatgaggagtttggacctggcttcatcaaggagagcaacctgctgagcctgcagaagacccagacaggagagaccccctacatgtacacagagtggggagacagctttggctccatgtctgtgctgatcaagaaccccaggacccacagcggcggcaagccctacgtgtgcagagaatgtggccggggcttcacctggaagagcaacctgatcacccaccagaggacccacagcggggagaagccctacgtgtgcaaggactgtggccggggcttcacctggaagagcaacctcttcacccaccagaggacccacagcggcctgaagccctacgtgtgcaaggaatgtggccagagcttcagcctgaagagcaacctgatcacccaccagagggcccacactggagagaagccctacgtgtgcagagaatgtggccggggcttccggcagcacagccacctggtgcgccacaagaggacccacagcggggagaagccctacatctgcagagaatgtgagcagggcttcagccagaagagccacctgatccgccacctgcggacccacactggagagaagccctacgtgtgcacagaatgtggccgccacttctcctggaagagcaacctgaagacccaccagaggacccacagcggcgtgaagccctacgtgtgcctggagtgtggccagtgcttcagcctgaagagcaacctgaacaagcaccagaggagccacactggagagaagccctttgtgtgcacagaatgtggccggggcttcaccaggaagagcaccctgagcacccaccagaggacccacagcggggagaagccctttgtgtgtgctgaatgtggccggggcttcaatgacaagagcaccctcatcagccaccagaggacccacagcggggagaagcccttcatgtgcagagaatgtggccgccgcttccggcagaagcccaacctcttccgccacaagagggcccacagcggggcctttgtgtgcagagaatgtggccagggcttctgtgccaagctgaccctcatcaagcaccagagggcccatggaggcagcctgatgtgtgccggctctgtgggcaaggccctggccggcagccacaccagcctggacacccggggccacatccaggagaggagcctcatctttgctgagagcgtggatggagccctggtgggcagccccaccctgagtgacatccggggccacacccaggacaggaacttcatgtgcattggaaatgtggtgcagcccctggcccggagccacaccagcagtgacacccggggccacacccagtgctgcggcttcttcagccactgctag

SEQ ID NO: 155440 - DNA, 1161 bp, Artificial Sequence
  Description of Artificial Sequence: Synthetic coding sequence
atgtacacagagtggggagacagctttggctccatgtctgtgctgatcaagaaccccaggacccacagcggcggcaagccctacgtgtgccgggagtgtggccggggcttcacctggaagagcaacctgatcacccaccagaggacccacagcggggagaagccctacgtgtgcaaggactgtggccggggcttcacctggaagagcaacctcttcacccaccagaggacccacagcggcctgaagccctacgtgtgcaaggaatgtggccagagcttcagcctgaagagcaacctgatcacccaccagagggcccacactggagagaagccctacgtgtgccgggagtgtggccggggcttccggcagcacagccacctggtgcgccacaagaggacccacagcggggagaagccctacatctgccgggagtgtgagcagggcttcagccagaagagccacctgatccgccacctgcggacccacactggagagaagccctacgtgtgcacagaatgtggccgccacttctcctggaagagcaacctgaagacccaccagaggacccacagcggcgtgaagccctacgtgtgcctggagtgtggccagtgcttcagcctgaagagcaacctgaacaagcaccagaggagccacactggagagaagccctttgtgtgcacagaatgtggccggggcttcaccaggaagagcaccctgagcacccaccagaggacccacagcggggagaagccctttgtgtgtgccgagtgtggccggggcttcaatgacaagagcaccctcatcagccaccagaggacccacagcggggagaagcccttcatgtgccgggagtgtggccgccgcttccggcagaagcccaacctcttccgccacaagagggcccacagcggggcctttgtgtgccgggagtgtggccagggcttctgtgccaagctgaccctcatcaagcaccagagggcccatgctgggggcaagccccacgtgtgccgggagtgtggccagggcttcagccggcagagccacctgatccgccaccagaggacccacagcggggagaagccctacatctgcaggaaatgtggccggggcttcagcaggaagagcaacctgatccgccaccagaggacccacagcggctag

SEQ ID NO: 155441 - DNA, 612 bp, Artificial Sequence
  Description of Artificial Sequence: Synthetic coding sequence
atgggcggcagcctgcgggtggccgtgctgggcgcccctggggtgggcaagacagccatcatccggcagttcctgtttggagactacccagagcggcaccggcccacagatggcccccggctgtacagacctgctgtgctgctggatggagctgtgtatgacctgagcatcagagatggagatgtggccggccctggcagcagccctgggggccctgaggagtggccagatgccaaggactggagcctgcaggacacagatgcctttgtgctggtgtatgacatctgcagcccagacagctttgattatgtgaaggccctgcggcagagaattgctgagaccaggcctgctggggcccctgaggcccccatcctggtggtgggcaacaagagggaccggcagaggctgcgcttcggcccccggcgggccctggccgccctggtgagaagaggctggaggtgtggctacctggagtgcagcgccaagtacaactggcacgtgctgcggctcttccgggagctgctgcgctgtgccctggtgcgggcccggcctgcccacccagccctgcggctgcagggcgccctgcacccagcccgctgcagcctgatgtag

SEQ ID NO: 155442 - DNA, 1479 bp, Artificial Sequence
  Description of Artificial Sequence: Synthetic coding sequence
atggacctgctgaaggccatcaccagccccctggccgccggcagcaagcccagcaagaagacaggagagaagagcagcggcagcagcagccacagcgagagcaagaaggagcaccacaggaagaaggtgtctggcagcagtggagagctgcccctggaggatggcggcagccacaagagcaagaagatgaagcccctgtatgtgaacacagagaccctgaccctgcgggagccagatggcctgaagatgaagctgatcctgagccccaaggagaagggcagcagctctgtggatgaggagagcttccagtaccccagccagcaggccaccgtgaagaagagcagcaagaagagcgccagagatgagcagggcgccctgctgctgggccacgagctgcagagcttcctgaagacagccaggaagaagcacaagagcagcagtgatgcccacagcagccctggccctgagggctgcggcagtgatgccagccagtttgctgagagccacagcgccaacctggacctgagcggcctggagcccatcctggtggagagtgacagcagcagtggaggagagctggaggccggggagctggtgattgatgacagctaccgggagatcaagaagaagaagaagagcaagaagagcaagaagaagaaggacaaggagaagcacaaggagaagaggcacagcaagagcaagaggagcctgggcctgtctgctgtgcctgtgggggaggtgacagtgaccagcggccccccacccagcatcccctatgctggagctgctgccccacccctgcccctgcccggcctgcacacagatggccacagcgagaagaagaagaagaaggaggagaaggacaaggagcgggagcggggggagaagcccaagaagaagaacatgtctgcctaccaggtgttctgcaaggagtacagagtgaccatcgtggccgaccaccctggcatcgactttggagagctgagcaagaagctggccgaggtgtggaagcagctgcctgagaaggacaagctgatctggaagcagaaggcccagtacctgcagcacaagcagaacaaggccgaggccaccaccgtgaagaggaaggccagcagcagcgagggctccatgaaggtgaaggccagctctgtgggcgtgctgagcccccagaagaagagcccccccaccaccatgctgctgcctgccagccctgccaaggcccctgagacagagcccattgatgtggccgcccacctgcagctgctgggggagagcctgagcctgattggccaccggctgcaggagacagagggcatggtggccgtgtctggcagcctgtctgtgctgctggacagcatcatctgtgccctgggccccctggcctgcctgaccacccagctgcctgagctgaatggctgccccaagcaggtgctgagcaacaccctggacaacatcgcctacatcatgcctggcctgtag

SEQ ID NO: 155443 - DNA, 1896 bp, Artificial Sequence
  Description of Artificial Sequence: Synthetic coding sequence
atggtgtccaagctgagccagctgcagacagagctgctggccgccctgctggagagcggcctgagcaaggaggccctgatccaggccctgggggagcccggcccctacctgctggccggggagggccccctggacaagggggagagctgtggcggcggccgcggggagctggccgagctgcccaacggcctgggggagacccggggctctgaagatgaaacagatgatgatggagaggacttcaccccacccatcctgaaggagctggagaacctgagccctgaggaggccgcccaccagaaggctgtggtggagaccctgctgcaggaggacccctggagggtggccaagatggtgaagagctacctgcagcagcacaacatcccccagcgggaggtggtggacaccaccggcctgaaccagagccacctgagccagcacctgaacaagggcacccccatgaagacccagaagagagctgccctgtacacctggtacgtgaggaagcagcgggaggtggcccagcagttcacccacgccggccagggcggcctcatcgaggagcccactggagatgagctgcccaccaagaagggcagaagaaaccgcttcaagtggggccctgccagccagcagatcctcttccaggcctatgaaaggcagaagaaccccagcaaggaggagcgggagaccctggtggaggagtgcaacagagctgagtgcatccagaggggcgtgagccccagccaggcccagggcctgggcagcaacctggtgacagaggtgcgggtgtacaactggtttgccaacagaaggaaggaggaggccttccgccacaagctggccatggacacctacagcggccccccacctggccctggccctggccctgccctgcctgcccacagcagccctggcctgcccccaccagccctgagccccagcaaggtgcacggcgtgcgctatggccagcctgccaccagcgagacagctgaggtgcccagcagcagcggcggccccctggtgacagtgtccacccccctgcaccaggtgagccccaccggcctggagcccagccacagcctgctgagcacagaggccaagctggtgtctgctgctgggggccccctgccccctgtgtccaccctgacagccctgcacagcctggagcagaccagccctggcctgaaccagcagccccagaacctgatcatggccagcctgcccggggtgatgaccatcggccctggagagcccgccagcctgggccccaccttcaccaacacaggagccagcaccctggtgattggcctggccagcacccaggcccagagcgtgcctgtgatcaacagcatgggcagcagcctgaccaccctgcagcctgtgcagttcagccagcccctgcaccccagctaccagcagcccctgatgcctcctgtgcagagccacgtgacccagagccccttcatggccaccatggcccagctgcagagcccccacgccctgtacagccacaagccagaggtggcccagtacacccacacaggcctgctgccccagaccatgctgatcacagacaccaccaacctgagcgccctggccagcctgacccccaccaagcaggtgttcaccagtgacacagaggccagcagcgagagcggcctgcacaccccagccagccaggccaccaccctgcacgtgcccagccaggaccctgccagcatccagcacctgcagcctgcccaccggctgagcgccagccccaccgtgagcagcagcagcctggtgctgtaccagagcagtgacagcagcaatggccagagccacctgctgcccagcaaccacagcgtcatcgagaccttcatcagcacccagatggccagcagcagccagtag

SEQ ID NO: 155444 - DNA, 1719 bp, Artificial Sequence
  Description of Artificial Sequence: Synthetic coding sequence
atggtgtccaagctgagccagctgcagacagagctgctggccgccctgctggagagcggcctgagcaaggaggccctgatccaggccctgggggagcccggcccctacctgctggccggggagggccccctggacaagggggagagctgtggcggcggccgcggggagctggccgagctgcccaacggcctgggggagacccggggctctgaagatgaaacagatgatgatggagaggacttcaccccacccatcctgaaggagctggagaacctgagccctgaggaggccgcccaccagaaggctgtggtggagaccctgctgcaggaggacccctggagggtggccaagatggtgaagagctacctgcagcagcacaacatcccccagcgggaggtggtggacaccaccggcctgaaccagagccacctgagccagcacctgaacaagggcacccccatgaagacccagaagagagctgccctgtacacctggtacgtgaggaagcagcgggaggtggcccagcagttcacccacgccggccagggcggcctcatcgaggagcccactggagatgagctgcccaccaagaagggcagaagaaaccgcttcaagtggggccctgccagccagcagatcctcttccaggcctatgaaaggcagaagaaccccagcaaggaggagcgggagaccctggtggaggagtgcaacagagctgagtgcatccagaggggcgtgagccccagccaggcccagggcctgggcagcaacctggtgacagaggtgcgggtgtacaactggtttgccaacagaaggaaggaggaggccttccgccacaagctggccatggacacctacagcggccccccacctggccctggccctggccctgccctgcctgcccacagcagccctggcctgcccccaccagccctgagccccagcaaggtgcacggcgtgcgctatggccagcctgccaccagcgagacagctgaggtgcccagcagcagcggcggccccctggtgacagtgtccacccccctgcaccaggtgagccccaccggcctggagcccagccacagcctgctgagcacagaggccaagctggtgtctgctgctgggggccccctgccccctgtgtccaccctgacagccctgcacagcctggagcagaccagccctggcctgaaccagcagccccagaacctgatcatggccagcctgcccggggtgatgaccatcggccctggagagcccgccagcctgggccccaccttcaccaacacaggagccagcaccctggtgattggcctggccagcacccaggcccagagcgtgcctgtgatcaacagcatgggcagcagcctgaccaccctgcagcctgtgcagttcagccagcccctgcaccccagctaccagcagcccctgatgcctcctgtgcagagccacgtgacccagagccccttcatggccaccatggcccagctgcagagcccccacggggagaggcctgtgccccacacagctggagatgatgaccggggctggctgtccatggatgctggggagcggggggcctggcaggccctgcagagcgcctgtgtgtctggcacctctgtgttcccctacagcagcaatggccagagccacctgctgcccagcaaccacagcgtgattgagaccttcatcagcacccagatggccagcagcagccagtag

SEQ ID NO: 155445 - DNA, 1566 bp, Artificial Sequence
  Description of Artificial Sequence: Synthetic coding sequence
atggtgtccaagctgagccagctgcagacagagctgctggccgccctgctggagagcggcctgagcaaggaggccctgatccaggccctgggggagcccggcccctacctgctggccggggagggccccctggacaagggggagagctgtggcggcggccgcggggagctggccgagctgcccaacggcctgggggagacccggggctctgaagatgaaacagatgatgatggagaggacttcaccccacccatcctgaaggagctggagaacctgagccctgaggaggccgcccaccagaaggctgtggtggagaccctgctgcaggaggacccctggagggtggccaagatggtgaagagctacctgcagcagcacaacatcccccagcgggaggtggtggacaccaccggcctgaaccagagccacctgagccagcacctgaacaagggcacccccatgaagacccagaagagagctgccctgtacacctggtacgtgaggaagcagcgggaggtggcccagcagttcacccacgccggccagggcggcctcatcgaggagcccactggagatgagctgcccaccaagaagggcagaagaaaccgcttcaagtggggccctgccagccagcagatcctcttccaggcctatgaaaggcagaagaaccccagcaaggaggagcgggagaccctggtggaggagtgcaacagagctgagtgcatccagaggggcgtgagccccagccaggcccagggcctgggcagcaacctggtgacagaggtgcgggtgtacaactggtttgccaacagaaggaaggaggaggccttccgccacaagctggccatggacacctacagcggccccccacctggccctggccctggccctgccctgcctgcccacagcagccctggcctgcccccaccagccctgagccccagcaaggtgcacggcgtgcgctatggccagcctgccaccagcgagacagctgaggtgcccagcagcagcggcggccccctggtgacagtgtccacccccctgcaccaggtgagccccaccggcctggagcccagccacagcctgctgagcacagaggccaagctggtgtctgctgctgggggccccctgccccctgtgtccaccctgacagccctgcacagcctggagcagaccagccctggcctgaaccagcagccccagaacctgatcatggccagcctgcccggggtgatgaccatcggccctggagagcccgccagcctgggccccaccttcaccaacacaggagccagcaccctggtgattggcaagctggtgggcatgggcggccacctgggcggccgcctgatgggccagccccagaaccctggagctggccgggccaccggcacccacagcttcatccaccagcacgtgttcatccagtgcctgctgtggaccagccactgtgccaccagcgtcatccctggggacagcagcaatggccagagccacctgctgcccagcaaccacagcgtcatcgagaccttcatcagcacccagatggccagcagcagccagtag

SEQ ID NO: 155446 - DNA, 1572 bp, Artificial Sequence
  Description of Artificial Sequence: Synthetic coding sequence
atggtgtccaagctgagccagctgcagacagagctgctggccgccctgctggagagcggcctgagcaaggaggccctgatccaggccctgggggagcccggcccctacctgctggccggggagggccccctggacaagggggagagctgtggcggcggccgcggggagctggccgagctgcccaacggcctgggggagacccggggctctgaagatgaaacagatgatgatggagaggacttcaccccacccatcctgaaggagctggagaacctgagccctgaggaggccgcccaccagaaggctgtggtggagaccctgctgcaggaggacccctggagggtggccaagatggtgaagagctacctgcagcagcacaacatcccccagcgggaggtggtggacaccaccggcctgaaccagagccacctgagccagcacctgaacaagggcacccccatgaagacccagaagagagctgccctgtacacctggtacgtgaggaagcagcgggaggtggcccagcagttcacccacgccggccagggcggcctcatcgaggagcccactggagatgagctgcccaccaagaagggcagaagaaaccgcttcaagtggggccctgccagccagcagatcctcttccaggcctatgaaaggcagaagaaccccagcaaggaggagcgggagaccctggtggaggagtgcaacagagctgagtgcatccagaggggcgtgagccccagccaggcccagggcctgggcagcaacctggtgacagaggtgtctgctgctgggggccccctgccccctgtgtccaccctgacagccctgcacagcctggagcagaccagccctggcctgaaccagcagccccagaacctgatcatggccagcctgcccggggtgatgaccatcggccctggagagcccgccagcctgggccccaccttcaccaacacaggagccagcaccctggtgattggcctggccagcacccaggcccagagcgtgcctgtgatcaacagcatgggcagcagcctgaccaccctgcagcctgtgcagttcagccagcccctgcaccccagctaccagcagcccctgatgcctcctgtgcagagccacgtgacccagagccccttcatggccaccatggcccagctgcagagcccccacgccctgtacagccacaagccagaggtggcccagtacacccacacaggcctgctgccccagaccatgctgatcacagacaccaccaacctgagcgccctggccagcctgacccccaccaagcaggtgttcaccagtgacacagaggccagcagcgagagcggcctgcacaccccagccagccaggccaccaccctgcacgtgcccagccaggaccctgccagcatccagcacctgcagcctgcccaccggctgagcgccagccccaccgtgagcagcagcagcctggtgctgtaccagagcagtgacagcagcaatggccagagccacctgctgcccagcaaccacagcgtcatcgagaccttcatcagcacccagatggccagcagcagccagtag

SEQ ID NO: 155447 - DNA, 1812 bp, Artificial Sequence
  Description of Artificial Sequence: Synthetic coding sequence
atggtgtccaagctgagccagctgcagacagagctgctggccgccctgctggagagcggcctgagcaaggaggccctgatccaggccctgggggagcccggcccctacctgctggccggggagggccccctggacaagggggagagctgtggcggcggccgcggggagctggccgagctgcccaacggcctgggggagacccggggctctgaagatgaaacagatgatgatggagaggacttcaccccacccatcctgaaggagctggagaacctgagccctgaggaggccgcccaccagaaggctgtggtggagaccctgctgcaggaggacccctggagggtggccaagatggtgaagagctacctgcagcagcacaacatcccccagcgggaggtggtggacaccaccggcctgaaccagagccacctgagccagcacctgaacaagggcacccccatgaagacccagaagagagctgccctgtacacctggtacgtgaggaagcagcgggaggtggcccagcagttcacccacgccggccagggcggcctcatcgaggagcccactggagatgagctgcccaccaagaagggcagaagaaaccgcttcaagtggggccctgccagccagcagatcctcttccaggcctatgaaaggcagaagaaccccagcaaggaggagcgggagaccctggtggaggagtgcaacagagctgagtgcatccagaggggcgtgagccccagccaggcccagggcctgggcagcaacctggtgacagaggtgcgggtgtacaactggtttgccaacagaaggaaggaggaggccttccgccacaagctggccatggacacctacagcggccccccacctggccctggccctggccctgccctgcctgcccacagcagccctggcctgcccccaccagccctgagccccagcaaggtgcacggcgtgcgctatggccagcctgccaccagcgagacagctgaggtgcccagcagcagcggcggccccctggtgacagtgtccacccccctgcaccaggtgagccccaccggcctggagcccagccacagcctgctgagcacagaggccaagctggtgtctgctgctgggggccccctgccccctgtgtccaccctgacagccctgcacagcctggagcagaccagccctggcctgaaccagcagccccagaacctgatcatggccagcctgcccggggtgatgaccatcggccctggagagcccgccagcctgggccccaccttcaccaacacaggagccagcaccctggtgattggcctggccagcacccaggcccagagcgtgcctgtgatcaacagcatgggcagcagcctgaccaccctgcagcctgtgcagttcagccagcccctgcaccccagctaccagcagcccctgatgcctcctgtgcagagccacgtgacccagagccccttcatggccaccatggcccagctgcagagcccccacgccctgtacagccacaagccagaggtggcccagtacacccacacaggcctgctgccccagaccatgctgatcacagacaccaccaacctgagcgccctggccagcctgacccccaccaagcaggtgttcaccagtgacacagaggccagcagcgagagcggcctgcacaccccagccagccaggccaccaccctgcacgtgcccagccaggaccctgccagcatccagcacctgcagcctgcccaccggctgagcgccagccccaccgtgagcagcagcagcctggtgctgtaccagagcctgggcctgtag

SEQ ID NO: 155448 - DNA, 837 bp, Artificial Sequence
  Description of Artificial Sequence: Synthetic coding sequence
atggtgtccaagctgagccagctgcagacagagctgctggccgccctgctggagagcggcctgagcaaggaggccctgatccaggccctgggggagcccggcccctacctgctggccggggagggccccctggacaagggggagagctgtggcggcggccgcggggagctggccgagctgcccaacggcctgggggagacccggggctctgaagatgaaacagatgatgatggagaggacttcaccccacccatcctgaaggagctggagaacctgagccctgaggaggccgcccaccagaaggctgtggtggagaccctgctgcaggaggacccctggagggtggccaagatggtgaagagctacctgcagcagcacaacatcccccagcgggaggtggtggacaccaccggcctgaaccagagccacctgagccagcacctgaacaagggcacccccatgaagacccagaagagagctgccctgtacacctggtacgtgaggaagcagcgggaggtggcccagaggagaaatgccagccgggagggctgcccccaccaccgccaccggggctgggcccccaccagcagccgccgctgtgtgtccaccaccggcctgcccaccggggccaagaagaagcccagcggcacctcctggccctggaccaggacagctggccccccccagggccaggcccgggacctgcgctgccccctgacagcccccctggcctgcctgcacctgcccagcccccctgtgcgcagcacagtgtgtgccatggacagcctgcggcctgtgcggctgcagaagtacccccaggccgctgctgtgccctag

SEQ ID NO: 155449 - DNA, 360 bp, Artificial Sequence
  Description of Artificial Sequence: Synthetic coding sequence
atggtgtccaagctgagccagctgcagacagagctgctggccgccctgctggagagcggcctgagcaaggaggccctgatccaggccctgggggagcccggcccctacctgctggccggggagggccccctggacaagggggagagctgtggcggcggccgcggggagctggccgagctgcccaacggcctgggggagacccggggctctgaagatgaaacagatgatgatggagaggacttcaccccacccatcctgaaggagctggagaacctgagccctgaggaggccgcccaccagaaggctgtggtggagaccctgctgcaggtgcacccctgcagagctggccgggctgactag

SEQ ID NO: 155450 - DNA, 1989 bp, Artificial Sequence
  Description of Artificial Sequence: Synthetic coding sequence
atggtgtccaagctgagccagctgcagacagagctgctggccgccctgctggagagcggcctgagcaaggaggccctgatccaggccctgggggagcccggcccctacctgctggccggggagggccccctggacaagggggagagctgtggcggcggccgcggggagctggccgagctgcccaacggcctgggggagacccggggctctgaagatgaaacagatgatgatggagaggacttcaccccacccatcctgaaggagctggagaacctgagccctgaggaggccgcccaccagaaggctgtggtggagaccctgctgcaggaggacccctggagggtggccaagatggtgaagagctacctgcagcagcacaacatcccccagcgggaggtggtggacaccaccggcctgaaccagagccacctgagccagcacctgaacaagggcacccccatgaagacccagaagagagctgccctgtacacctggtacgtgaggaagcagcgggaggtggcccagcagttcacccacgccggccagggcggcctcatcgaggagcccactggagatgagctgcccaccaagaagggcagaagaaaccgcttcaagtggggccctgccagccagcagatcctcttccaggcctatgaaaggcagaagaaccccagcaaggaggagcgggagaccctggtggaggagtgcaacagagctgagtgcatccagaggggcgtgagccccagccaggcccagggcctgggcagcaacctggtgacagaggtgcgggtgtacaactggtttgccaacagaaggaaggaggaggccttccgccacaagctggccatggacacctacagcggccccccacctggccctggccctggccctgccctgcctgcccacagcagccctggcctgcccccaccagccctgagccccagcaaggtgcacggcgtgcgctatggccagcctgccaccagcgagacagctgaggtgcccagcagcagcggcggccccctggtgacagtgtccacccccctgcaccaggtgagccccaccggcctggagcccagccacagcctgctgagcacagaggccaagctggtgtctgctgctgggggccccctgccccctgtgtccaccctgacagccctgcacagcctggagcagaccagccctggcctgaaccagcagccccagaacctgatcatggccagcctgcccggggtgatgaccatcggccctggagagcccgccagcctgggccccaccttcaccaacacaggagccagcaccctggtgattggcctggccagcacccaggcccagagcgtgcctgtgatcaacagcatgggcagcagcctgaccaccctgcagcctgtgcagttcagccagcccctgcaccccagctaccagcagcccctgatgcctcctgtgcagagccacgtgacccagagccccttcatggccaccatggcccagctgcagagcccccacgccctgtacagccacaagccagaggtggcccagtacacccacacaggcctgctgccccagaccatgctgatcacagacaccaccaacctgagcgccctggccagcctgacccccaccaagcaggtgcgcagcaggcctgctggcccccccctggcctgtgaccgggccccccacccccacatcccccgggcccaggaggccgccctgctgccccaggtgttcaccagtgacacagaggccagcagcgagagcggcctgcacaccccagccagccaggccaccaccctgcacgtgcccagccaggaccctgccagcatccagcacctgcagcctgcccaccggctgagcgccagccccaccgtgagcagcagcagcctggtgctgtaccagagcagtgacagcagcaatggccagagccacctgctgcccagcaaccacagcgtgattgagaccttcatcagcacccagatggccagcagcagccagtag

SEQ ID NO: 155451 - DNA, 744 bp, Artificial Sequence
  Description of Artificial Sequence: Synthetic coding sequence
atggtgtccaagctgagccagctgcagacagagctgctggccgccctgctggagagcggcctgagcaaggaggccctgatccaggccctgggggagcccggcccctacctgctggccggggagggccccctggacaagggggagagctgtggcggcggccgcggggagctggccgagctgcccaacggcctgggggagacccggggctctgaagatgaaacagatgatgatggagaggacttcaccccacccatcctgaaggagctggagaacctgagccctgaggaggccgcccaccagaaggctgtggtggagaccctgctgcaggaggacccctggagggtggccaagatggtgaagagctacctgcagcagcacaacatcccccagcgggaggtggtggacaccaccggcctgaaccagagccacctgagccagcacctgaacaagggcacccccatgaagacccagaagagagctgccctgtacacctggtacgtgaggaagcagcgggaggtggcccagcagttcacccacgccggccagggcggcctcatcgaggagcccactggagatgagctgcccaccaagaagggcagaagaaaccgcttcaagtggggccctgccagccagcagatcctcttccaggcctatgaaaggcagaagaaccccagcaaggaggagcgggagaccctggtggaggagtgcaacagatgtgccctgtggacagcctgtgaccagtag

SEQ ID NO: 155452 - DNA, 1359 bp, Artificial Sequence
  Description of Artificial Sequence: Synthetic coding sequence
atggtgtccaagctgagccagctgcagacagagctgctggccgccctgctggagagcggcctgagcaaggaggccctgatccaggccctgggggagcccggcccctacctgctggccggggagggccccctggacaagggggagagctgtggcggcggccgcggggagctggccgagctgcccaacggcctgggggagacccggggctctgaagatgaaacagatgatgatggagaggacttcaccccacccatcctgaaggagctggagaacctgagccctgaggaggccgcccaccagaaggctgtggtggagaccctgctgcaggaggacccctggagggtggccaagatggtgaagagctacctgcagcagcacaacatcccccagcgggaggtggtggacaccaccggcctgaaccagagccacctgagccagcacctgaacaagggcacccccatgaagacccagaagagagctgccctgtacacctggtacgtgaggaagcagcgggaggtggcccagcagttcacccacgccggccagggcggcctcatcgaggagcccactggagatgagctgcccaccaagaagggcagaagaaaccgcttcaagtggggccctgccagccagcagaccagccctggcctgaaccagcagccccagaacctgatcatggccagcctgcccggggtgatgaccatcggccctggagagcccgccagcctgggccccaccttcaccaacacaggagccagcaccctggtgattggcctggccagcacccaggcccagagcgtgcctgtgatcaacagcatgggcagcagcctgaccaccctgcagcctgtgcagttcagccagcccctgcaccccagctaccagcagcccctgatgcctcctgtgcagagccacgtgacccagagccccttcatggccaccatggcccagctgcagagcccccacgccctgtacagccacaagccagaggtggcccagtacacccacacaggcctgctgccccagaccatgctgatcacagacaccaccaacctgagcgccctggccagcctgacccccaccaagcaggtgttcaccagtgacacagaggccagcagcgagagcggcctgcacaccccagccagccaggccaccaccctgcacgtgcccagccaggaccctgccagcatccagcacctgcagcctgcccaccggctgagcgccagccccaccgtgagcagcagcagcctggtgctgtaccagagcagtgacagcagcaatggccagagccacctgctgcccagcaaccacagcgtgattgagaccttcatcagcacccagatggccagcagcagccagtag

SEQ ID NO: 155453 - DNA, 1212 bp, Artificial Sequence
  Description of Artificial Sequence: Synthetic coding sequence
atggtgaagagctacctgcagcagcacaacatcccccagcgggaggtggtggacaccaccggcctgaaccagagccacctgagccagcacctgaacaagggcacccccatgaagacccagaagagagctgccctgtacacctggtacgtgaggaagcagcgggaggtggcccagcagttcacccatgctggccagggcggcctgattgaggagcccactggagatgagctgcccaccaagaagggcagaagaaaccgcttcaagtggggccctgccagccagcagatcctcttccaggcctatgagcggcagaagaaccccagcaaggaggagcgggagaccctggtggaggagtgcaacagagctgagtgcatccagaggggcgtgagccccagccaggcccagggcctgggcagcaacctggtgacagaggtgcgggtgtacaactggtttgccaacagaaggaaggaggaggccttccgccacaagctggccatggacacctacagcggccccccacctggccctggccctggccctgccctgcctgcccacagcagccctggcctgcccccaccagccctgagccccagcaaggtgcatggagtgcgctatggccagcctgccaccagcgagacagctgaggtgcccagcagcagcggcggccccctggtgacagtgtccacccccctgcaccaggtgagccccaccggcctggagcccagccacagcctgctgagcacagaggccaagctggtgtctgctgctgggggccccctgccccctgtgtccaccctgacagccctgcacagcctggagcagaccagccctggcctgaaccagcagccccagaacctgatcatggccagcctgcccggggtgatgaccatcggccctggagagcccgccagcctgggccccaccttcaccaacacaggagccagcaccctggtgattggcaagctggtgggcatgggcggccacctgggcggccgcctgatgggccagccccagaaccctggggccggccgggccaccggcacccacagcttcatccacaccacctgcatctaccctgtgcccaccctggaccagagcctgtgctacatcagtgacacctgggtgaaccagacagaccagaacctgagcaacagcagccgggaggccggcaccaagcacaacaccagcatcctgtggtacctgcggaggtag

SEQ ID NO: 155454 - DNA, 1185 bp, Artificial Sequence
  Description of Artificial Sequence: Synthetic coding sequence
atggtgtccaagctgagccagctgcagacagagctgctggccgccctgctggagagcggcctgagcaaggaggccctgatccaggccctgggggagcccggcccctacctgctggccggggagggccccctggacaagggggagagctgtggcggcggccgcggggagctggccgagctgcccaacggcctgggggagacccggggctctgaagatgaaacagatgatgatggagaggacttcaccccacccatcctgaaggagctggagaacctgagccctgaggaggccgcccaccagaaggctgtggtggagaccctgctgcaggaggacccctggagggtggccaagatggtgaagagctacctgcagcagcacaacatcccccagcgggaggtggtggacaccaccggcctgaaccagagccacctgagccagcacctgaacaagggcacccccatgaagacccagaagagagctgccctgtacacctggtacgtgaggaagcagcgggaggtggcccagcagttcacccacgccggccagggcggcctcatcgaggagcccactggagatgagctgcccaccaagaagggcagaagaaaccgcttcaagtggggccctgccagccagcagatcctcttccaggcctatgaaaggcagaagaaccccagcaaggaggagcgggagaccctggtggaggagtgcaacagagctgagtgcatccagaggggcgtgagccccagccaggcccagggcctgggcagcaacctggtgacagaggtgcgggtgtacaactggtttgccaacagaaggaaggaggaggccttccgccacaagctggccatggacacctacagcggccccccacctggccctggccctggccctgccctgcctgcccacagcagccctggcctgcccccaccagccctgagccccagcaaggtgcacggcgtgcgctatggccagcctgccaccagcgagacagctgaggtgcccagcagcagcggcggccccctggtgacagtgtccacccccctgcaccaggtgagccccaccggcctggagcccagccacagcctgctgagcacagaggccaagctggtgtctgctgctgggggccccctgcccccagctgcctgcagccagcccggccgggtggcccggctcttcaacttctag

SEQ ID NO: 155455 - DNA, 1917 bp, Artificial Sequence
  Description of Artificial Sequence: Synthetic coding sequence
atggtgtccaagctgagccagctgcagacagagctgctggccgccctgctggagagcggcctgagcaaggaggccctgatccaggccctgggggagcccggcccctacctgctggccggggagggccccctggacaagggggagagctgtggcggcggccgcggggagctggccgagctgcccaacggcctgggggagacccggggctctgaagatgaaacagatgatgatggagaggacttcaccccacccatcctgaaggagctggagaacctgagccctgaggaggccgcccaccagaaggctgtggtggagaccctgctgcaggaggacccctggagggtggccaagatggtgaagagctacctgcagcagcacaacatcccccagcgggaggtggtggacaccaccggcctgaaccagagccacctgagccagcacctgaacaagggcacccccatgaagacccagaagagagctgccctgtacacctggtacgtgaggaagcagcgggaggtggcccagcagttcacccacgccggccagggcggcctcatcgaggagcccactggagatgagctgcccaccaagaagggcagaagaaaccgcttcaagtggggccctgccagccagcagatcctcttccaggcctatgaaaggcagaagaaccccagcaaggaggagcgggagaccctggtggaggagtgcaacagagctgagtgcatccagaggggcgtgagccccagccaggcccagggcctgggcagcaacctggtgacagaggtgcgggtgtacaactggtttgccaacagaaggaaggaggaggccttccgccacaagctggccatggacacctacagcggccccccacctggccctggccctggccctgccctgcctgcccacagcagccctggcctgcccccaccagccctgagccccagcaaggtgcacggcgtgcgctatggccagcctgccaccagcgagacagctgaggtgcccagcagcagcggcggccccctggtgacagtgtccacccccctgcaccaggtgagccccaccggcctggagcccagccacagcctgctgagcacagaggccaagctggtgtctgctgctgggggccccctgccccctgtgtccaccctgacagccctgcacagcctggagcagaccagccctggcctgaaccagcagccccagaacctgatcatggccagcctgcccggggtgatgaccatcggccctggagagcccgccagcctgggccccaccttcaccaacacaggagccagcaccctggtgattggcctggccagcacccaggcccagagcgtgcctgtgatcaacagcatgggcagcagcctgaccaccctgcagcctgtgcagttcagccagcccctgcaccccagctaccagcagcccctgatgcctcctgtgcagagccacgtgacccagagccccttcatggccaccatggcccagctgcagagcccccacgccctgtacagccacaagccagaggtggcccagtacacccacacaggcctgctgccccagaccatgctgatcacagacaccaccaacctgagcgccctggccagcctgacccccaccaagcaggaggccgccctgctgccccaggtgttcaccagtgacacagaggccagcagcgagagcggcctgcacaccccagccagccaggccaccaccctgcacgtgcccagccaggaccctgccagcatccagcacctgcagcctgcccaccggctgagcgccagccccaccgtgagcagcagcagcctggtgctgtaccagagcagtgacagcagcaatggccagagccacctgctgcccagcaaccacagcgtgattgagaccttcatcagcacccagatggccagcagcagccagtag

SEQ ID NO: 155456 - DNA, 1416 bp, Artificial Sequence
  Description of Artificial Sequence: Synthetic coding sequence
atggtgtccaagctgagccagctgcagacagagctgctggccgccctgctggagagcggcctgagcaaggaggccctgatccaggccctgggggagcccggcccctacctgctggccggggagggccccctggacaagggggagagctgtggcggcggccgcggggagctggccgagctgcccaacggcctgggggagacccggggctctgaagatgaaacagatgatgatggagaggacttcaccccacccatcctgaaggagctggagaacctgagccctgaggaggccgcccaccagaaggctgtggtggagaccctgctgcaggaggacccctggagggtggccaagatggtgaagagctacctgcagcagcacaacatcccccagcgggaggtggtggacaccaccggcctgaaccagagccacctgagccagcacctgaacaagggcacccccatgaagacccagaagagagctgccctgtacacctggtacgtgaggaagcagcgggaggtggcccagcagttcacccacgccggccagggcggcctcatcgaggagcccactggagatgagctgcccaccaagaagggcagaagaaaccgcttcaagtggggccctgccagccagcagatcctcttccaggcctatgaaaggcagaagaaccccagcaaggaggagcgggagaccctggtggaggagtgcaacagagctgagtgcatccagaggggcgtgagccccagccaggcccagggcctgggcagcaacctggtgacagaggtgcgggtgtacaactggtttgccaacagaaggaaggaggaggccttccgccacaagctggccatggacacctacagcggccccccacctggccctggccctggccctgccctgcctgcccacagcagccctggcctgcccccaccagccctgagccccagcaaggtgcacggcgtgcgctatggccagcctgccaccagcgagacagctgaggtgcccagcagcagcggcggccccctggtgacagtgtccacccccctgcaccaggtgagccccaccggcctggagcccagccacagcctgctgagcacagaggccaagctggtgtctgctgctgggggccccctgccccctgtgtccaccctgacagccctgcacagcctggagcagaccagccctggcctgaaccagcagccccagaacctgatcatggccagcctgcccggggtgatgaccatcggccctggagagcccgccagcctgggccccaccttcaccaacacaggagccagcaccctggtgattggcctggccagcacccaggcccagagcgtgcctgtgatcaacagcatgggcagcagcctgaccaccctgcagcctgtgcagttcagccagcagggccccagcagctag

SEQ ID NO: 155457 - DNA, 1359 bp, Artificial Sequence
  Description of Artificial Sequence: Synthetic coding sequence
atggtgtccaagctgagccagctgcagacagagctgctggccgccctgctggagagcggcctgagcaaggaggccctgatccaggccctgggggagcccggcccctacctgctggccggggagggccccctggacaagggggagagctgtggcggcggccgcggggagctggccgagctgcccaacggcctgggggagacccggggctctgaagatgaaacagatgatgatggagaggacttcaccccacccatcctgaaggagctggagaacctgagccctgaggaggccgcccaccagaaggctgtggtggagaccctgctgcaggaggacccctggagggtggccaagatggtgaagagctacctgcagcagcacaacatcccccagcgggaggtggtggacaccaccggcctgaaccagagccacctgagccagcacctgaacaagggcacccccatgaagacccagaagagagctgccctgtacacctggtacgtgaggaagcagcgggaggtggcccagcagttcacccacgccggccagggcggcctcatcgaggagcccactggagatgagctgcccaccaagaagggcagaagaaaccgcttcaagtggggccctgccagccagcagatcctcttccaggcctatgaaaggcagaagaaccccagcaaggaggagcgggagaccctggtggaggagtgcaacagagctgagtgcatccagaggggcgtgagccccagccaggcccagggcctgggcagcaacctggtgacagaggtgcgggtgtacaactggtttgccaacagaaggaaggaggaggccttccgccacaagctggccatggacacctacagcggccccccacctggccctggccctggccctgccctgcctgcccacagcagccctggcctgcccccaccagccctgagccccagcaaggtgcacggcgtgcgctatggccagcctgccaccagcgagacagctgaggtgcccagcagcagcggcggccccctggtgacagtgtccacccccctgcaccaggtgagccccaccggcctggagcccagccacagcctgctgagcacagaggccaagctggtgtctgctgctgggggccccctgccccctgtgtccaccctgacagccctgcacagcctggagcagaccagccctggcctgaaccagcagccccagaacctgatcatggccagcctgcccggggtgatgaccatcggccctggagagcccgccagcctgggccccaccttcaccaacacaggagccagcaccctgcccctgtttggagctggggtggccgagctgacccggcagcagggccccagcagctag

SEQ ID NO: 155458 - DNA, 1071 bp, Artificial Sequence
  Description of Artificial Sequence: Synthetic coding sequence
tgatggctggtgggcttctggggcggcagcggctgcaaggagtttggcctgtgcctgcctgctggccggcagacccagcccacccgctggggccggcggctggcctggtggacccgggccgcctggccctgtggcagccgggccatggtgtccaagctgagccagctgcagacagagctgctggccgccctgctggagagcggcctgagcaaggaggccctgatccaggccctgggggagcccggcccctacctgctggccggggagggccccctggacaagggggagagctgtggcggcggccgcggggagctggccgagctgcccaacggcctgggggagacccggggctctgaagatgaaacagatgatgatggagaggacttcaccccacccatcctgaaggagctggagaacctgagccctgaggaggccgcccaccagaaggctgtggtggagaccctgctgcaggaggacccctggagggtggccaagatggtgaagagctacctgcagcagcacaacatcccccagcgggaggtggtggacaccaccggcctgaaccagagccacctgagccagcacctgaacaagggcacccccatgaagacccagaagagagctgccctgtacacctggtacgtgaggaagcagcgggaggtggcccagcagttcacccacgccggccagggcggcctcatcgaggagcccactggagatgagctgcccaccaagaagggcagaagaaaccgcttcaagtggggccctgccagccagcagatcctcttccaggcctatgaaaggcagaagaaccccagcaaggaggagcgggagaccctggtggaggagtgcaacagagctgagtgcatccagaggggcgtgagccccagccagccccagcctgctgagtaccgcagccaggccggcctgagctcctggggccccccaccaccctgccagcacccagacagcacagcccagctgggcgctgacatcccccggccccagcctgctgcccctgagccccaccacggcctgacctcctggggccatgaccaccgggcctggtag

SEQ ID NO: 155459 - DNA, 2247 bp, Artificial Sequence
  Description of Artificial Sequence: Synthetic coding sequence
atgctgggcaccctgcgggccatggagggagaagatgtggaggatgaccagctgctgcagaagctgcgggccagcagaagacgcttccagaggaggatgcagaggctgattgagaagtacaaccagccctttgaggacacccctgtggtgcagatggccaccctgacctatgagaccccccagggcctgcgcatctggggcggccgcctcatcaaggagagaaatgaaggagagatccaggacagctccatgaagccagctgacagaacagatggctctgtgcaggccgccgcctggggccctgagctgcccagccacaggacagtgctgggcgctgacagcaagagcggggaggtggatgccaccagtgaccaggaggagagcgtggcctgggccctggccccagctgtgccccagagccccctgaagaatgagctgcggaggaagtacctgacccaggtggacatcctgctgcagggcgctgagtactttgaatgtgccggcaacagagctggaagagatgtgcgggtgacccccctgcccagcctggccagccctgctgtgcctgcccctggctactgcagccgcatcagcaggaagagccctggggaccctgccaagccagccagcagcccccgggagtgggaccccctgcaccccagcagcacagacatggccctggtgcccagaaatgacagcctgagcctgcaggagaccagcagcagcagcttcctgagcagccagccctttgaagatgatgacatctgcaatgtgaccatcagtgacctgtatgccggcatgctgcacagcatgagccggctgctgagcaccaagcccagcagcatcatcagcaccaagaccttcatcatgcagaactggaacagcagaagaagacaccgctacaagagcaggatgaacaagacctactgcaagggggcccggcgcagccagaggagcagcaaggagaacttcatcccctgcagcgagcctgtgaagggcaccggggccctgcgggactgcaagaatgtgctggatgtgtcctgcaggaagacaggcctgaagctggagaaggccttcctggaggtgaaccggccccagatccacaagctggaccccagctggaaggagaggaaggtgacccccagcaagtacagcagcctcatctactttgacagcagcgccacctacaacctggatgaagaaaatcgcttccgcaccctgaagtggctgatcagccctgtgaagatcgtgtcccggcccaccatccggcagggccacggggagaaccggcagcgggagattgagatccgctttgaccagctgcaccgggagtactgcctgagccccaggaaccagcccaggaggatgtgcctgcctgacagctgggccatgaacatgtacagaggaggccctgccagccctgggggcctgcagggcctggagacccggcggctgagcctgcccagcagcaaggccaaggccaagagcctgtctgaggcctttgagaacctgggcaagaggagcctggaggccggccgctgcctgcccaagagtgacagcagcagcagcctgcccaagaccaaccccacccacagcgccacccggccccagcagaccagtgacctgcacgtgcagggcaacagcagcggcatcttcaggaagtctgtgagccccagcaagaccctgtctgtgcctgacaaggaggtgcccggccacggcaggaacagatatgatgagatcaaggaggagtttgacaagctgcaccagaagtactgcctgaagagccctggccagatgacagtgcccctgtgcattggagtgtccacagacaaggcctccatggaggtgcgctaccagacagagggcttcctgggcaagctgaacccagacccccacttccagggcttccagaagctgcccagcagccccctgggctgcaggaagagcctgctgggcagcacagccatcgaggcccccagcagcacctgtgtggcccgggccatcaccagagatggcacccgggaccaccagtttcctgccaagaggccccggctgtctgagccccagggcagcggccggcagggcaacagcctgggcgccagtgatggagtggacaacacagtgcggcctggggaccagggcagcagcagccagcccaacagcgaggagcggggggagaacaccagctacaggatggaggagaagagtgacttcatgctggagaagctggagaccaagtctgtgtag

SEQ ID NO: 155460 - DNA, 2085 bp, Artificial Sequence
  Description of Artificial Sequence: Synthetic coding sequence
atgctgggcaccctgcgggccatggagggagaagatgtggaggatgaccagctgctgcagaagctgcgggccagcagaagacgcttccagaggaggatgcagaggctgattgagaagtacaaccagccctttgaggacacccctgtggtgcagatggccaccctgacctatgagaccccccagggcctgcgcatctggggcggccgcctcatcaaggagagaaatgaaggagagatccagcctgctgtgccccagagccccctgaagaatgagctgcggaggaagtacctgacccaggtggacatcctgctgcagggcgctgagtactttgaatgtgccggcaacagagctggaagagatgtgcgggtgacccccctgcccagcctggccagccctgctgtgcctgcccctggctactgcagccgcatcagcaggaagagccctggggaccctgccaagccagccagcagcccccgggagtgggaccccctgcaccccagcagcacagacatggccctggtgcccagaaatgacagcctgagcctgcaggagaccagcagcagcagcttcctgagcagccagccctttgaagatgatgacatctgcaatgtgaccatcagtgacctgtatgccggcatgctgcacagcatgagccggctgctgagcaccaagcccagcagcatcatcagcaccaagaccttcatcatgcagaactggaacagcagaagaagacaccgctacaagagcaggatgaacaagacctactgcaagggggcccggcgcagccagaggagcagcaaggagaacttcatcccctgcagcgagcctgtgaagggcaccggggccctgcgggactgcaagaatgtgctggatgtgtcctgcaggaagacaggcctgaagctggagaaggccttcctggaggtgaaccggccccagatccacaagctggaccccagctggaaggagaggaaggtgacccccagcaagtacagcagcctcatctactttgacagcagcgccacctacaacctggatgaagaaaatcgcttccgcaccctgaagtggctgatcagccctgtgaagatcgtgtcccggcccaccatccggcagggccacggggagaaccggcagcgggagattgagatccgctttgaccagctgcaccgggagtactgcctgagccccaggaaccagcccaggaggatgtgcctgcctgacagctgggccatgaacatgtacagaggaggccctgccagccctgggggcctgcagggcctggagacccggcggctgagcctgcccagcagcaaggccaaggccaagagcctgtctgaggcctttgagaacctgggcaagaggagcctggaggccggccgctgcctgcccaagagtgacagcagcagcagcctgcccaagaccaaccccacccacagcgccacccggccccagcagaccagtgacctgcacgtgcagggcaacagcagcggcatcttcaggaagtctgtgagccccagcaagaccctgtctgtgcctgacaaggaggtgcccggccacggcaggaacagatatgatgagatcaaggaggagtttgacaagctgcaccagaagtactgcctgaagagccctggccagatgacagtgcccctgtgcattggagtgtccacagacaaggcctccatggaggtgcgctaccagacagagggcttcctgggcaagctgaacccagacccccacttccagggcttccagaagctgcccagcagccccctgggctgcaggaagagcctgctgggcagcacagccatcgaggcccccagcagcacctgtgtggcccgggccatcaccagagatggcacccgggaccaccagtttcctgccaagaggccccggctgtctgagccccagggcagcggccggcagggcaacagcctgggcgccagtgatggagtggacaacacagtgcggcctggggaccagggcagcagcagccagcccaacagcgaggagcggggggagaacaccagctacaggatggaggagaagagtgacttcatgctggagaagctggagaccaagtctgtgtag

SEQ ID NO: 155461 - DNA, 1992 bp, Artificial Sequence
  Description of Artificial Sequence: Synthetic coding sequence
atgctgggcaccctgcgggccatggagggagaagatgtggaggatgaccagctgctgcagaagctgcgggccagcagaagacgcttccagaggaggatgcagaggctgattgagaagtacaaccagccctttgaggacacccctgtggtgcagatggccaccctgacctatgagaccccccagggcctgcgcatctggggcggccgcctcatcaaggagagaaatgaaggagagatccagtgtgccggcaacagagctggaagagatgtgcgggtgacccccctgcccagcctggccagccctgctgtgcctgcccctggctactgcagccgcatcagcaggaagagccctggggaccctgccaagccagccagcagcccccgggagtgggaccccctgcaccccagcagcacagacatggccctggtgcccagaaatgacagcctgagcctgcaggagaccagcagcagcagcttcctgagcagccagccctttgaagatgatgacatctgcaatgtgaccatcagtgacctgtatgccggcatgctgcacagcatgagccggctgctgagcaccaagcccagcagcatcatcagcaccaagaccttcatcatgcagaactggaacagcagaagaagacaccgctacaagagcaggatgaacaagacctactgcaagggggcccggcgcagccagaggagcagcaaagaaaacttcatcccctgcagcgagcctgtgaagggcactggagccctgcgggactgcaagaatgtgctggatgtgtcctgcaggaagacaggcctgaagctggagaaggccttcctggaggtgaaccggccccagatccacaagctggaccccagctggaaggagaggaaggtgacccccagcaagtacagcagcctcatctactttgacagcagcgccacctacaacctggatgaggagaaccgcttccgcaccctgaagtggctgatcagccctgtgaagatcgtgtcccggcccaccatccggcagggccatggagaaaatcggcagcgggagattgagatccgctttgaccagctgcaccgggagtactgcctgagccccaggaaccagcccaggaggatgtgcctgcctgacagctgggccatgaacatgtaccggggcggccctgccagccctgggggcctgcagggcctggagacccggcggctgagcctgcccagcagcaaggccaaggccaagagcctgtctgaggcctttgagaacctgggcaagaggagcctggaggccggccgctgcctgcccaagagtgacagcagcagcagcctgcccaagaccaaccccacccacagcgccacccggccccagcagaccagtgacctgcacgtgcagggcaacagcagcggcatcttcaggaagtctgtgagccccagcaagaccctgtctgtgcctgacaaggaggtgcccggccatggaagaaacagatatgatgagatcaaggaggagtttgacaagctgcaccagaagtactgcctgaagagccctggccagatgacagtgcccctgtgcatcggcgtgtccacagacaaggcctccatggaggtgcgctaccagacagagggcttcctgggcaagctgaacccagacccccacttccagggcttccagaagctgcccagcagccccctgggctgcaggaagagcctgctgggcagcacagccatcgaggcccccagcagcacctgtgtggcccgggccatcaccagagatggcacccgggaccaccagtttcctgccaagaggccccggctgtctgagccccagggcagcggccggcagggcaacagcctgggcgccagtgatggagtggacaacacagtgcggcctggggaccagggcagcagcagccagcccaacagcgaggagagaggagagaacaccagctacaggatggaggagaagagtgacttcatgctggagaagctggagaccaagtctgtgtag

SEQ ID NO: 155462 - DNA, 2181 bp, Artificial Sequence
  Description of Artificial Sequence: Synthetic coding sequence
atggaggaccggctgcacatggacaatggcctggtgccccagaagatcgtgtctgtgcacctgcaggacagcaccctgaaggaggtgaaggaccaggtgagcaacaagcaggcccagatcctggagcccaagccagagcccagcctggagatcaagccagagcaggacggcatggagcacgtgggcagagatgaccccaaggccctgggggaggagcccaagcagaggcggggcagcgccagcggcagcgagcctgctggggacagcgaccggggcggcggccctgtggagcactaccacctgcacctgagcagctgccacgagtgcctggagctggagaacagcaccattgaatctgtgaagtttgccagcgctgagaacatcccagacctgccctatgactacagcagcagcctggagagcgtggctgatgagaccagccctgagcgggagggcagaagagtgaacctgaccgggaaggcccccaacatcctgctgtatgtgggcagtgacagccaggaggccctgggccgcttccacgaggtgcgctctgtgctggccgactgtgtggacatcgacagctacatcctgtaccacctgctggaggacagcgccctgcgggacccctggacagacaactgcctgctgctggtgattgccacccgggagagcatcccagaagatctctaccagaagttcatggcctacctgagccagggcggcaaggtgctgggcctgagcagcagcttcaccttcggcggcttccaggtgaccagcaagggggccctgcacaagacagtgcagaacctggtgttcagcaaggctgaccagagcgaggtgaagctgtctgtgctgagcagcggctgccgctaccaggagggccctgtgcggctgagccctggccgcctgcagggccacctggagaatgaagacaaggacaggatgattgtgcacgtgcccttcggcacccggggcggggaggccgtgctgtgccaggtgcacctggagctgccccccagcagcaacatcgtgcagaccccagaggacttcaacctgctgaagagcagcaacttcagaagatatgaggtgctgcgggagatcctgaccaccctgggcctgagctgtgacatgaagcaggtgcctgccctgacccccctgtacctgctgtctgctgctgaggagatccgggaccccctgatgcagtggctgggcaagcacgtggacagcgagggggagatcaagagcggccagctgagcctgcgctttgtgtcctcctatgtgtctgaggtggagatcacccccagctgcatccctgtggtgaccaacatggaggccttcagcagcgagcacttcaacctggagatctaccggcagaacctgcagaccaagcagctgggcaaggtgatcctgtttgctgaggtgacccccaccaccatgaggctgctggatggcctgatgttccagaccccccaggagatgggcctcatcgtgattgctgcccggcagacagagggcaagggccggggcggcaatgtgtggctgagccctgtgggctgtgccctgagcaccctgctgatcagcatccccctgcggagccagctgggccagaggatcccctttgtgcagcacctgatgtctgtggccgtggtggaggccgtgcgcagcatccctgagtaccaggacatcaacctgcgggtgaagtggcccaatgacatctactacagcgacctgatgaagattggaggagtgctggtgaacagcaccctgatgggagagaccttctacatcctgattggctgcggcttcaacgtgaccaacagcaaccccaccatctgcatcaatgacctgatcacagagtacaacaagcagcacaaggccgagctgaagcccctgcgggctgactacctgattgcccgggtggtgacagtgctggagaagctgatcaaggagttccaggacaagggccccaacagcgtgctgcccctgtactaccgctactgggtgcacagcggccagcaggtgcacctgggcagcgctgagggccccaaggtgtccatcgtgggcctggatgacagcggcttcctgcaggtgcaccaggagggcggggaggtggtgacagtgcacccagatggcaacagctttgacatgctgaggaacctgatcctgcccaagagaagatag

SEQ ID NO: 155463 - DNA, 2181 bp, Artificial Sequence; identical to SEQ ID NO: 155462
  Description of Artificial Sequence: Synthetic coding sequence

SEQ ID NO: 155464 - DNA, 264 bp, Artificial Sequence
  Description of Artificial Sequence: Synthetic coding sequence
atggaggaccggctgcacatggacaatggcctggtgccccagaagatcgtgtctgtgcacctgcaggacagcaccctgaaggaggtgaaggaccaggtgagcaacaagcaggcccagatcctggagcccaagccagagcccagcctggagatcaagccagagcaggacggcatggagcacgtgggcagagatgaccccaaggccctgggggaggagcccaagcagaggcggggcagcgccagcggcagcgagcccgccggctag

SEQ ID NO: 155465 - DNA, 234 bp, Artificial Sequence
  Description of Artificial Sequence: Synthetic coding sequence
atggaggaccggctgcacatggacaatggcctggtgccccagaagatcgtgtctgtgcacctgcaggacagcaccctgaaggaggtgaaggaccaggtgagcaacaagcaggcccagatcctggagcccaagccagagcccagcctggagatcaagccagagcaggacggcatggagcacgtgggcagagatgaccccaaggccctgggggaggagcccaagcagaggaggtag

SEQ ID NO: 155466 - DNA, 279 bp, Artificial Sequence
  Description of Artificial Sequence: Synthetic coding sequence
atggaggaccggctgcacatggacaatggcctggtgccccagaagatcgtgtctgtgcacctgcaggacagcaccctgaaggaggtgaaggaccaggtgagcaacaagcaggcccagatcctggagcccaagccagagcccagcctggagatcaagccagagcaggacggcatggagcacgtgggcagagatgaccccaaggccctgggggaggagcccaagcagaggcggggcagcgccagcggcagcgagcctgctggggacagcgaccggggctag

SEQ ID NO: 155467 - DNA, 807 bp, Artificial Sequence
  Description of Artificial Sequence: Synthetic coding sequence
atgggcctgagccccagcgccccagctgtggccgtgcaggccagcaatgccagcgccagccccccatctggctgccccatgcatgagggcaagatgaagggctgccctgtgaacacagagcccagcggccccacctgtgagaagaagacctacagcgtgcctgcccaccaggagcgggcctatgaatatgtggagtgccccatccggggcacagctgctgagaacaaggagaacctggaccccagcaacctgatgcccccacccaaccagaccccagccccagaccagccctttgccctgagcacagtgcgggaggagagcagcatccccagggctgacagcgagaagaagtgggtgtaccccagcgagcagatgttctggaatgccatgctgaagaagggctggaagtggaaggatgaggacatcagccagaaggacatgtacaacatcatccgcatccacaaccagaacaatgagcaggcctggaaggagatcctgaagtgggaggccctgcatgctgctgaatgtccctgtggccccagcctcatccgctttggaggcaaggccaaggagtacagcccccgggcccgcatccgctcctggatgggctatgagctgccctttgacagacatgactggatcatcaacagatgtggcacagaggtgcgctacgtgattgactactatgatggaggagaggtgaacaaggactaccagttcaccatcctggatgtgcggcctgccctggacagcctgtctgctgtgtgggacaggatgaaggtggcctggtggcgctggaccagctag

SEQ ID NO: 155468 - DNA, 807 bp, Artificial Sequence; identical to SEQ ID NO: 155467
  Description of Artificial Sequence: Synthetic coding sequence

SEQ ID NO: 155469 - DNA, 807 bp, Artificial Sequence; identical to SEQ ID NO: 155467
  Description of Artificial Sequence: Synthetic coding sequence

SEQ ID NO: 155470 - DNA, 1008 bp, Artificial Sequence
  Description of Artificial Sequence: Synthetic coding sequence
atggacaatgccaggatgaacagcttcctggagtaccccatcctgagcagcggggacagcggcacctgcagcgcccgggcctaccccagcgaccaccgcatcaccaccttccagagctgtgctgtgtctgccaacagctgtggaggagatgaccgcttcctggtgggccggggcgtgcagatcggcagcccccaccaccaccaccaccaccaccaccgccacccccagcctgccacctaccagaccagcggcaacctgggcgtgtcctacagccacagcagctgtggccccagctatggcagccagaacttcagcgccccctacagcccctatgccctgaaccaggaggctgatgtgtctgggggctacccccagtgtgccccagctgtgtacagcggcaacctgagcagccccatggtgcagcaccaccaccaccaccagggctacgccggcggcgctgtgggcagcccccagtacatccaccacagctatggccaggagcaccagagcctggccctggccacctacaacaacagcctgagccccctgcacgccagccaccaggaggcctgccgcagccctgccagcgagaccagcagccctgcccagacctttgactggatgaaggtgaagaggaacccccccaagacaggcaaggtgggggagtatggctacctgggccagcccaatgctgtgaggaccaacttcaccaccaagcagctgacagagctggagaaggagttccacttcaacaagtacctgacccgggcccggcgggtggagattgctgccagcctgcagctgaatgagacccaggtgaagatctggttccagaacagaaggatgaagcagaagaagcgggagaaggagggcctgctgcccatcagccctgccaccccacctggaaatgatgagaaggccgaggagagcagcgagaagagcagcagcagcccctgtgtgcccagccctggcagcagcaccagtgacaccctgaccaccagccactag

SEQ ID NO: 155471 - DNA, 414 bp, Artificial Sequence
  Description of Artificial Sequence: Synthetic coding sequence
atggacaatgccaggatgaacagcttcctggagtaccccatcctgagcagcggggacagcggcacctgcagcgcccgggcctaccccagcgaccaccgcatcaccaccttccagagctgtgctgtgtctgccaacagctgtggaggagatgaccgcttcctggtgggccggggcgtgcagatcggcagcccccaccaccaccaccaccaccaccaccgccacccccagcctgccacctaccagaccagcggcaacctgggcgtgtcctacagccacagcagctgtggccccagctatggcagccagaacttcagcgccccctacagcccctatgccctgaaccaggaggccgaccccccaagaagcctgagcctgccccgcatcggggacatcttcagcagcgctgacttctag

SEQ ID NO: 155472 - DNA, 1233 bp, Artificial Sequence
  Description of Artificial Sequence: Synthetic coding sequence
atgtctgccaggaagggctacctgctgcccagccccaactaccccaccaccatgagctgcagcgagagccctgctgccaacagcttcctggtggacagcctcatcagcagcggccgcggggaggccggcggcggcggcggcggggccggcggcggcggcggcggcggctactatgcccacggcggcgtgtacctgcccccagctgctgacctgccctacggcctgcagagctgtggcctcttccccaccctgggcggcaagagaaatgaagctgccagccctggcagcggcggcggcggcggcggcctgggccctggggcccacggctacggccccagccccatcgacctgtggctggatgcccccaggagctgcaggatggagcccccagatggccccccacctccaccccagcagcagcccccacctccaccccagcccccccagcctgccccccaggccaccagctgcagctttgcccagaacatcaaggaggagagcagctactgcctgtatgacagcgctgacaagtgccccaaggtgtctgccacagctgctgagctggcccccttcccccggggccccccaccagatggctgtgccctgggcaccagcagcggcgtgcctgtgcccggctacttccggctgagccaggcctacggcacagccaagggctacggcagcggcggcggcggggcccagcagctgggcgccggccccttccctgcccagcccccaggccggggctttgacctgcccccagccctggccagcggcagcgcagatgctgccaggaaggagcgggccctggacagccccccaccacccaccctggcctgtggcagcggcggcggcagccagggagatgaggaggcccacgccagcagcagcgctgctgaggagctgagccctgcccccagcgagagcagcaaggccagccctgagaaggacagcctgggcaacagcaaaggagaaaatgctgccaactggctgacagccaagagcggcaggaagaagcgctgcccctacaccaagcaccagaccctggagctggagaaggagttcctgttcaacatgtacctgacccgggagcggcggctggagatcagccgctctgtgcacctgacagaccggcaggtgaagatctggttccagaacagaaggatgaagctgaagaagatgaacagagaaaatcgcatccgggagctgacagccaacttcaacttctcctag

SEQ ID NO: 155473 - DNA, 609 bp, Artificial Sequence
  Description of Artificial Sequence: Synthetic coding sequence
atgagctgcagcgagagccctgctgccaacagcttcctggtggacagcctcatcagcagcggccgcggggaggccggcggcggcggcggcggggccggcggcggcggcggcggcggctactatgcccatggaggagtgtacctgcccccagctgctgacctgccctacggcctgcagagctgtggcctcttccccaccctgggcggcaagagaaatgaggccgccagccctggcagcggcggcggcggcggcggcctgggccctggggcccacggctacggccccagccccatcgacctgtggctggatgcccccaggagctgcagaagaagagctgccacccggggctggcctgtgccccgggccgcccctggggcccgcttccgcagccctgcccgggccagcctgcggctgggccgctgtggccctgagggcgccagccccaggtttgctgctgcccctcatgctggcctgcggcagaggcggggcctggccggcagaagaggaggagcccgggtggtgctgggccggggcggggccctgcccggccccttccgggagcagcagagcctggccggggagggcttccctggccagttccagaggtag

SEQ ID NO: 155474 - DNA, 285 bp, Artificial Sequence
  Description of Artificial Sequence: Synthetic coding sequence
atgtgccagggcaacagcaaaggagaaaatgctgccaactggctgacagccaagagcggcaggaagaagcgctgcccctacaccaagcaccagaccctggagctggagaaggagttcctgttcaacatgtacctgacccgggagcggcggctggagatcagccgctctgtgcacctgacagaccggcaggtgaagatctggttccagaacagaaggatgaagctgaagaagatgaacagagaaaatcgcatccgggagctgacagccaacttcaacttctcctag

SEQ ID NO: 155475 - DNA, 942 bp, Artificial Sequence
  Description of Artificial Sequence: Synthetic coding sequence
atggactttgatgagcggggcccctgcagcagcaacatgtacctgcccagctgcacctactacgtgtctggccctgacttcagcagcctgcccagcttcctgccccagacccccagcagccggcccatgacctacagctacagcagcaacctgccccaggtgcagcctgtgcgggaggtgaccttccgggagtatgccattgaaccagccaccaagtggcacccccggggcaacctggcccactgctacagcgctgaggagctggtgcaccgggactgcctgcaggcccccagcgctgctggggtgcctggagatgtgctggccaagagcagcgccaacgtgtaccaccaccccaccccagctgtgagcagcaacttctacagcacagtgggcagaaatggagtgctgccccaggcctttgaccagttctttgaaacagcctacggcaccccagagaacctggccagcagtgactacccaggggacaagtctgctgagaagggccccccagctgccacagccaccagcgctgctgctgctgctgctgccaccggggccccagccaccagcagcagtgacagcggcggcggcggcggctgccgggagacagctgctgctgctgaggagaaggagaggagaagaagacctgagagcagcagcagccctgagagcagcagcggccacacagaggacaaggccggcggcagcagcggccagaggaccaggaagaagcgctgcccctacaccaagtaccagatccgggagctggagcgggagttcttcttctctgtgtacatcaacaaggagaagaggctgcagctgagcaggatgctgaacctgacagaccggcaggtgaagatctggttccagaacagaaggatgaaggagaagaagatcaacagagaccggctgcagtactacagcgccaaccccctgctgtag

SEQ ID NO: 155476 - DNA, 918 bp, Artificial Sequence
  Description of Artificial Sequence: Synthetic coding sequence
atggcccgggaggacagcgtgaagtgcctgcgctgcctgctgtatgccctgaacctgctcttctggctgatgagcatctctgtgctggccgtgtctgcctggatgagggactacctgaacaacgtgctgaccctgacagctgagaccagggtggaggaggccgtcatcctgacctacttccctgtggtgcaccctgtgatgattgctgtgtgctgcttcctgatcatcgtgggcatgctgggctactgcggcaccgtgaagaggaacctgctgctgctggcctggtacttcggcagcctgctggtgatcttctgtgtggagctggcctgtggggtgtggacctatgagcaggagctgatggtgcctgtgcagtggagcgacatggtgaccctgaaggccaggatgaccaactacggcctgccccgctaccgctggctgacccacgcctggaacttcttccagcgggagttcaagtgctgcggcgtggtgtacttcacagactggctggagatgacagagatggactggcccccagacagctgctgcgtgcgggagttccctggctgcagcaagcaggcccaccaggaggacctgagtgacctgtaccaggagggctgtgggaagaagatgtacagcttcctgcggggcaccaagcagctgcaggtgctgcgcttcctgggcatcagcattggagtgacccagatcctggccatgatcctgaccatcaccctgctgtgggccctgtactatgaccggcgggagcctggaacagaccagatgatgagcctgaagaatgacaacagccagcacctgagctgccccagcgtggagctgctgaagcccagcctgagccgcatctttgagcacacctccatggccaacagcttcaacacccactttgagatggaggagctgtag

SEQ ID NO: 155477 - DNA, 489 bp, Artificial Sequence
  Description of Artificial Sequence: Synthetic coding sequence
atgggcctggagacagagaaggcagatgtgcagctgttcatggatgatgacagctacagccaccacagcggcctggagtatgctgaccctgagaagtttgctgacagcgaccaggaccgggacccccaccggctgaacagccacctgaagctgggctttgaagatgtgattgctgagcctgtgaccacccacagctttgacaaggtgtggatctgcagccacgccctgtttgagatcagcaaatatgtgatgtacaagttcctgactgtgttcctggccatccccctggccttcatcgccggcatcctgtttgccaccctgagctgcctgcacatctggatcctgatgccctttgtgaagacctgcctgatggtgctgcccagcgtgcagaccatctggaagtctgtgacagatgtgatcatcgcccccctgtgcacctctgtgggccgctgcttcagctctgtgtccctgcagctgagccaggactag

SEQ ID NO: 155478 - DNA, 963 bp, Artificial Sequence
  Description of Artificial Sequence: Synthetic coding sequence
atgaccatgagcagcttcctgatcaacagcaactacatcgagcccaagttccccccatttgaggagtatgcccagcacagcggcagcggcggcgcagatggcggccctgggggcggccctggctaccagcagcccccagccccacccacccagcacctgcccctgcagcagccccagctgccccatgctgggggcggccgggagcccacagccagctactatgcccccaggacagcccgggagcccgcctacccagctgctgccctgtacccagcccatggagctgctgacacagcctacccctacggctaccggggcggggccagccctggccggcccccccagcctgagcagcccccagcccaggccaagggccctgcccacggcctgcacgccagccacgtgctgcagccccagctgcccccacccctgcagcccagggctgtgcccccagctgccccccggcgctgtgaggccgccccagccaccccaggagtgcctgctgggggcagcgccccagcctgccccctgctgctggccgacaagagccccctgggcctgaagggcaaggagcctgtggtgtacccctggatgaagaagatccacgtgtctgctgtgaaccccagctacaatggaggagagcccaagaggagcaggacagcctacacccggcagcaggtgctggagctggagaaggagttccacttcaaccgctacctgaccaggagaagacgcatcgagatcgcccacaccctgtgcctgtctgagcggcaggtgaagatctggttccagaacagaaggatgaagtggaagaaggaccacaagctgcccaacaccaagatgaggagcagcaacagcgccagcgccagcgctggccccccaggcaaggcccagacccagagcccccacctgcacccccacccccaccccagcaccagcacccctgtgcccagcagcatctag

SEQ ID NO: 155479 - DNA, 963 bp, Artificial Sequence; identical to SEQ ID NO: 155478
  Description of Artificial Sequence: Synthetic coding sequence

SEQ ID NO: 155480 - DNA, 1140 bp, Artificial Sequence
  Description of Artificial Sequence: Synthetic coding sequence
atgctgaagagatgtggccgccgcctgctgctggccctggccggggccctgctggcctgcctgctggtgctgacagctgaccccccacctccacccctgcctgctgagcggggcagaagagccctgcggagcctggccggccctgctggagctgccccagcccctggcctgggcgctgctgctgctgcccctggggccctggtgagagatgtgcacagcctgtctgagtacttcagcctgctgacccgggccaggagagatgctggccccccacctggggccgcccccaggcctgcagatggccacccccggcccctggccgagcccctggcccccagagatgtgttcatcgctgtgaagaccaccaagaagttccaccgggcccggctggacctgctgctggagacctggatcagccgccacaaggagatgaccttcatcttcacagatggagaagatgaggccctggcccggcacactggaaatgtggtgatcaccaactgcagcgctgcccacagccggcaggccctgagctgcaagatggctgtggagtatgaccgcttcattgaaagtggcaggaagtggttctgccacgtggatgatgacaactacgtgaacctgcgggccctgctgcggctgctggccagctacccccacaccagagatgtgtatgtgggcaagcccagcctggaccggcccatccaggccatggagcgggtgtctgagaacaaggtgcggcctgtgcacttctggtttgccaccggcggggccggcttctgcatcagccggggcctggccctgaagatgagcccctgggccagcggcggccacttcatgaacacagctgagcgcatccggctgcctgatgactgcaccatcggctacatcgtggaggccctgctgggcgtgcccctcatccgcagcggcctcttccacagccacctggagaacctgcagcaggtgcccaccagcgagctgcacgagcaggtgaccctgtcctatggcatgtttgagaacaagagaaatgctgtgcacgtgaagggccccttctctgtggaggccgaccccagccgcttccgcagcatccactgccacctgtacccagacaccccctggtgccccaggacagccatcttctag

SEQ ID NO: 155481 - DNA, 813 bp, Artificial Sequence
  Description of Artificial Sequence: Synthetic coding sequence
atgagcagctactttgtgaacagcttctgtggccgctacccaaatggaccagactaccagctgcacaactacggggaccacagctctgtgtctgagcagttccgggacagcgcctccatgcacagcggccgctatggctacggctacaacggcatggacctgtctgtgggccgcagcggcagcggccacttcggcagcggggagcgggcccggagctatgctgccagcgccagcgctgccccagctgagccccgctacagccagcctgccaccagcacccacagcccccagcctgaccccctgccctgcagcgctgtggcccccagccctggcagtgacagccaccacggcggcaagaacagcctgagcaacagcagcggggccagcgcagatgctggcagcacccacatcagcagccgggagggcgtgggcacagccagcggggctgaagaagatgccccagccagcagcgagcaggccagcgcccagagcgagcccagccctgcccccccagcccagccccagatctacccctggatgaggaagctgcacatcagccatgacaacatcggcggccctgagggcaagagggccaggacagcctacacccgctaccagaccctggagctggagaaggagttccacttcaaccgctacctgaccaggagaagacgcatcgagatcgcccacgccctgtgcctgtctgagcggcagatcaagatctggttccagaacagaaggatgaagtggaagaaggacaacaagctgaagtccatgtccatggctgctgctgggggcgccttccggccctag

SEQ ID NO: 155482 - DNA, 693 bp, Artificial Sequence
  Description of Artificial Sequence: Synthetic coding sequence
atgagcagcagctactacgtgaatgccctcttcagcaagtacacagctggggccagcctcttccagaatgctgagcccaccagctgcagctttgcccccaacagccagaggagcggctacggggccggggccggggcctttgccagcacagtgcccggcctgtacaacgtgaacagccccctgtaccagagcccctttgccagcggctacggcctgggcgcagatgcctacggcaacctgccctgtgccagctatgaccagaacatccctggcctgtgcagcgacctggccaagggggcctgtgacaagacagatgaaggagccctgcacggggctgctgaggccaacttccgcatctacccctggatgaggagcagcggccctgacaggaagaggggccggcagacctacacccgctaccagaccctggagctggagaaggagttccacttcaaccgctacctgaccaggagaagaagaattgaaattgcccacgccctgtgcctgacagagcggcagatcaagatctggttccagaacagaaggatgaagtggaagaaggagcacaaggatgagggccccacagctgctgctgcccctgagggcgctgtgcccagcgctgctgccacagctgctgctgacaaggcagatgaagaagatgatgatgaggaggaggaggatgaggaggagtag

SEQ ID NO: 155483 - DNA, 93 bp, Artificial Sequence
  Description of Artificial Sequence: Synthetic coding sequence
atgagcagcagctactacgtgaatgccctcttcagcaagtacacagctggggccagcctcttccagaatgctgagcccaccagctgcagctag

SEQ ID NO: 155484 - DNA, 792 bp, Artificial Sequence
  Description of Artificial Sequence: Synthetic coding sequence
caccactggggcggcaactactacgtggacagcttcctgctgggcgcagatgctgctgatgagctgtctgtgggcatgagaagaggcccctggccaccccggcaggccgccaccctggccgagcacccagacttcagcccctgcagcttccagagcaaggccaccgtgtttggagcctcctggaaccctgtgcaccgggcccccaccctgtaccctgtgtaccaccaccaccaccaccacccctacgtgcacccccaggcccctgtggccgccgccgccccagatggccgctacatgaggtcctggctggagcccacccctggggccctgagctttgctggcctgcccagcagccggccctacggcatcaagccagagcccctgagcgccaggagaggagactgccccaccctggacacccacaccctgagcctgacagattatgcctgtggcagcccccctgtggaccgggagaagcagcccagcgagggcgccttcagcgagaacaatgcagaaaatgaaagtggaggagacaagccacccatcgaccccaacaacccagctgccaactggctgcacgcccggagcaccaggaagaagcgctgcccctacaccaagcaccagaccctggagctggagaaggagttcctgttcaacatgtacctgacccgggaccggcgctatgaggtggcccggctgctgaacctgacagagcggcaggtgaagatctggttccagaacagaaggatgaagatgaagaagatcaacaaggaccgggccaaggatgaatag

SEQ ID NO: 155485 - DNA, 819 bp, Artificial Sequence
  Description of Artificial Sequence: Synthetic coding sequence
atggccaccaccggggccctgggcaactactacgtggacagcttcctgctgggcgcagatgctgctgatgagctgtctgtgggccgctatgcccctggcaccctgggccagcccccccggcaggccgccaccctggccgagcacccagacttcagcccctgcagcttccagagcaaggccaccgtgtttggagcctcctggaaccctgtgcacgccgccggggccaatgctgtgcctgctgctgtgtaccaccaccaccaccaccacccctacgtgcacccccaggcccctgtggccgctgctgccccagatggccgctacatgaggtcctggctggagcccacccctggggccctgagctttgctggcctgcccagcagccggccctacggcatcaagccagagcccctgagcgcccggcggggggactgccccaccctggacacccacaccctgagcctgacagattatgcctgtggcagcccccctgtggaccgggagaagcagcccagcgagggcgccttctctgaaaataatgcagaaaatgaaagtggaggagacaagccacccatcgaccccaacaacccagctgccaactggctgcacgcccggagcaccaggaagaagcgctgcccctacaccaagcaccagaccctggagctggagaaggagttcctgttcaacatgtacctgacccgggacagaagatatgaggtggcccggctgctgaacctgacagagcggcaggtgaagatctggttccagaacagaaggatgaagatgaagaagatcaacaaggaccgggccaaggatgaatag

SEQ ID NO: 155486 - DNA, 591 bp, Artificial Sequence
  Description of Artificial Sequence: Synthetic coding sequence
atggccggcttcagcccctggaggcggcggcagaggagaagaagaagaagaagaagagcccggcagagcagagctgcccctgagctggtgggggacctgggcagcttcctgctgctgggcagcaccttcctgagcacagcccggcactgcttcatcacctctgtggagatcgtgagccgctacctgtgtgcccggggcagcggccgggccggccaccacggccctggccgggcccggcctgctgtggccaccagcgccttccctgcccaggagcccagggtcttcctgcggagcgccctgcctgctggccgcctgagccccagcaccacccacctgcacctggtgacagctgacaacccagctgccaactggctgcacgcccggagcaccaggaagaagcgctgcccctacaccaagcaccagaccctggagctggagaaggagttcctgttcaacatgtacctgacccgggacagaagatatgaggtggcccggctgctgaacctgacagagcggcaggtgaagatctggttccagaacagaaggatgaagatgaagaagatcaacaaggaccgggccaaggatgaatag

SEQ ID NO: 155487 - DNA, 906 bp, Artificial Sequence
  Description of Artificial Sequence: Synthetic coding sequence
atggactacaacaggatgaacagcttcctggagtaccccctgtgcaacagaggccccagcgcctacagcgcccacagcgcccccaccagcttcccccccagcagcgcccaggccgtggacagctatgccagcgagggccgctatggaggcggcctgagcagccctgccttccagcagaacagcggctacccagcccagcagccccccagcaccctgggcgtgcccttccccagcagcgcccccagcggctacgccccagctgcctgcagccccagctatggccccagccagtactaccccctgggccagagtgaaggagatggcggctacttccaccccagcagctatggagcccagctgggcggcctgagtgatggctatggagctggaggagctggccctggcccctacccaccccagcaccccccctatggaaatgagcagacagccagctttgccccagcctatgctgacctgctgtctgaggacaaggagaccccctgccccagcgagcccaacacccccacagcccggacctttgactggatgaaggtgaagagaaatccacccaagacagccaaggtgtctgagcccggcctgggcagccccagcggcctgcggaccaacttcaccacccggcagctgacagagctggagaaggagttccacttcaacaagtacctgagccgggcccggcgggtggagattgctgccaccctggagctgaatgagacccaggtgaagatctggttccagaacagaaggatgaagcagaagaagcgggagcgggaggagggccgggtgcccccagcccctcctggctgccccaaggaggccgctggagatgccagtgaccagagcacctgcaccagccctgaggccagccccagctctgtgaccagctag

SEQ ID NO: 155488 - DNA, 855 bp, Artificial Sequence
  Description of Artificial Sequence: Synthetic coding sequence
atggagcccggcaactatgccaccctggatggagccaaggacatcgagggcctgctgggcgccggcggcggcaggaacctggtggcccacagccccctgaccagccaccctgctgcccccaccctgatgcctgctgtgaactatgcccccctggacctgcccggcagcgctgagccccccaagcagtgccacccctgccctggggtgccccagggcaccagccctgcccctgtgccctacggctactttggaggcggctactacagctgccgggtgagccgcagcagcctgaagccctgtgcccaggccgccaccctggccgcctacccagctgagacccccacagctggggaggagtaccccagccggcccacagaatttgccttctacccaggctacccaggcacctaccagcccatggccagctacctggatgtgtctgtggtgcagaccctgggcgcccctggagagcccaggcatgacagcctgctgcctgtggacagctaccagagctgggccctggccggcggctggaacagccagatgtgctgccagggcgagcagaaccccccaggccccttctggaaggccgcctttgctgacagcagcggccagcaccccccagatgcctgtgccttccggcggggcaggaagaagaggatcccctacagcaagggccagctgcgggagctggagcgggagtatgctgccaacaagttcatcaccaaggacaagaggaggaagatctctgctgccaccagcctgtctgagcggcagatcaccatctggttccagaacagaagagtgaaggagaagaaggtgctggccaaggtgaagaacagcgccaccccctag

SEQ ID NO: 155489 - DNA, 531 bp, Artificial Sequence
  Description of Artificial Sequence: Synthetic coding sequence
ccccgctgccccccaggcccccgggtgcccctggatgagcgggaggagatccggcaggagacccagcccatccgccacgtgtccttcagcggccgcctgcggcgcagcggcggcgtgggcagccctgcagatggcctgggccggcggctggtggccgccggccaggccgcccacggcctgcaccagcacgccgccgccggcaccggggagttccacttcaacaagtacctgtgccggcccaggagagtggagattgctgccctgctggacctgacagagcggcaggtgaaggtgtggttccagaacagaaggatgaagcacaagaggcagacccagcaccgggagcccccagatggagagcccgcctgccctggggccctggaggacatctgtgaccctgctgaggagcctgctgccagccctgggggccccctggccggcggcgtgggcagcctgctgagccctgctgggggcggggccggcggcctgaagaggggccccccagccttcagccgcagcctgcggggctag

SEQ ID NO: 155490 - DNA, 1071 bp, Artificial Sequence
  Description of Artificial Sequence: Synthetic coding sequence
atgaactttgaatttgagcgggagatcggcttcatcaacagccagcccagcctggccgagtgcctgaccagcttccctgctgtgctggagaccttccagaccagcagcatcaaggagagcaccctcatccccccacctcctccatttgagcagaccttccccagcctgcagcccggggccagcaccctgcagaggcccaggagccagaagagagcagaagatggccctgccctgcccccacctcctcctccacccctgcctgctgcccccccagcccctgagttcccctggatgaaggagaagaagagcgccaagaagcccagccagagcgccaccagccccagccctgctgccagcgctgtgcctgccagcggcgtgggcagccctgcagatggcctgggcctgcctgaggccggcggcggcggggcccggcggctgaggacagcctacaccaacacccagctgctggagctggagaaggagttccacttcaacaagtacctgtgccggccccggcgggtggagattgctgccctgctggacctgacagagcggcaggtgaaggtgtggttccagaacagaaggatgaagcacaagaggcagacccagcaccgggagcccccagatggagagcccgcctgccctggggccctggaggacatctgtgaccctgctgaggagcctgctgccagccctgggggccccagcgccagccgggccgcctgggaggcctgctgccaccccccagaggtggtgcctggggccctgtctgctgacccccggcccctggccgtgcggctggagggcgctggggccagcagccctggctgtgccctgcggggggccggcggcctggagcccggccccctgcctgaagatgtgttcagcggccggcaggacagccccttcctgcctgacctgaacttctttgctgctgacagctgcctgcagctgagcggcggcctgagccccagcctgcagggcagcctggacagccctgtgcccttcagcgaggaggagctggacttcttcaccagcaccctgtgtgccatcgacctgcagttcccctag

SEQ ID NO: 155491 - DNA, 1296 bp, Artificial Sequence
  Description of Artificial Sequence: Synthetic coding sequence
atgcagaaggccacctactatgacaatgctgctgctgccctgtttggaggctacagcagctacccaggcagcaatggatttggatttgatgtgcccccccagccccccttccaggccgccacccacctggagggggactaccagaggtctgcctgcagcctgcagagcctgggcaatgctgcccctcatgccaagagcaaggagctgaatggcagctgcatgaggcctggcctggcccctgagcccctgagcgcccctcctggcagccccccaccttctgctgcccccaccagcgccaccagcaacagcagcaatggaggcggccccagcaagagcggcccccccaagtgtggccctggcaccaacagcaccctgaccaagcagatcttcccctggatgaaggagagccggcagaccagcaagctgaagaacaacagccctggaacagctgagggctgcggcggcggcggcggcggcggcggcggcggcggcagcggcggcagcggcggcggcggcggcggcggcggcggcggggacaagagccccccaggcagcgctgccagcaagagggccaggacagcctacaccagcgcccagctggtggagctggagaaggagttccacttcaaccgctacctgtgccggcccaggagagtggagatggccaacctgctgaacctgtctgagcggcagatcaagatctggttccagaacagaaggatgaagtacaagaaggaccagaaggccaagggcctggccagcagcagcggcggccccagccctgctggcagccccccccagcccatgcagagcacagctggcttcatgaatgccctgcacagcatgacccccagctatgagagccccagccccccagccttcggcaaggcccaccagaatgcctatgccctgcccagcaactaccagccccccctgaagggctgtggggccccccagaagtacccacccaccccagccccagaatatgagccccacgtgctgcaggccaatggaggagcctacggcacccccaccatgcagggcagccctgtgtatgtgggcggcggcggctatgctgaccccctgcccccacctgctggccccagcctgtatggcctgaaccacctgagccaccaccccagcggcaacctggactacaatggagccccacccatggcccccagccagcaccacggcccctgtgagccccaccccacctacacagacctgagcagccaccacgcccccccaccccagggccgcatccaggaggcccccaagctgacccacctgtag

SEQ ID NO: 155492 - DNA, 900 bp, Artificial Sequence
  Description of Artificial Sequence: Synthetic coding sequence
atgaaggagagccggcagaccagcaagctgaagaacaacagccctggaacagctgagggctgcggcggcggcggcggcggcggcggcggcggcggcagcggcggcagcggcggcggcggcggcggcggcggcggcggggacaagagccccccaggcagcgctgccagcaagagggccaggacagcctacaccagcgcccagctggtggagctggagaaggagttccacttcaaccgctacctgtgccggcccaggagagtggagatggccaacctgctgaacctgtctgagcggcagatcaagatctggttccagaacagaaggatgaagtacaagaaggaccagaaggccaagggcctggccagcagcagcggcggccccagccctgctggcagccccccccagcccatgcagagcacagctggcttcatgaatgccctgcacagcatgacccccagctatgagagccccagccccccagccttcggcaaggcccaccagaatgcctatgccctgcccagcaactaccagccccccctgaagggctgtggggccccccagaagtacccacccaccccagccccagaatatgagccccacgtgctgcaggccaatggaggagcctacggcacccccaccatgcagggcagccctgtgtatgtgggcggcggcggctatgctgaccccctgcccccacctgctggccccagcctgtatggcctgaaccacctgagccaccaccccagcggcaacctggactacaatggagccccacccatggcccccagccagcaccacggcccctgtgagccccaccccacctacacagacctgagcagccaccacgcccccccaccccagggccgcatccaggaggcccccaagctgacccacctgtag

SEQ ID NO: 155493 - DNA, 1296 bp, Artificial Sequence; identical to SEQ ID NO: 155491
  Description of Artificial Sequence: Synthetic coding sequence

SEQ ID NO: 155494 - DNA, 1077 bp, Artificial Sequence
  Description of Artificial Sequence: Synthetic coding sequence
atgaggcctggcctggcccctgagcccctgagcgcccctcctggcagccccccacccagcgctgcccccaccagcgccaccagcaacagcagcaatggaggcggccccagcaagagcggcccccccaagtgtggccctggcaccaacagcaccctgaccaagcagatcttcccctggatgaaggagagccggcagaccagcaagctgaagaacaacagccctggaacagctgagggctgcggcggcggcggcggcggcggcggcggcggcggcagcggcggcagcggcggcggcggcggcggcggcggcggcggggacaagagccccccaggcagcgctgccagcaagagggccaggacagcctacaccagcgcccagctggtggagctggagaaggagttccacttcaaccgctacctgtgccggccccggcgggtggagatggccaacctgctgaacctgtctgagcggcagatcaagatctggttccagaacagaaggatgaagtacaagaaggaccagaaggccaagggcctggccagcagcagcggcggccccagccctgctggcagccccccccagcccatgcagagcacagctggcttcatgaatgccctgcacagcatgacccccagctatgagagccccagccccccagccttcggcaaggcccaccagaatgcctatgccctgcccagcaactaccagccccccctgaagggctgtggggccccccagaagtacccacccaccccagccccagaatatgagccccacgtgctgcaggccaacggcggggcctacggcacccccaccatgcagggcagccctgtgtatgtgggcggcggcggctacgccgaccccctgcccccacctgctggccccagcctgtatggcctgaaccacctgagccaccaccccagcggcaacctggactacaacggggccccacccatggcccccagccagcaccacggcccctgtgagccccaccccacctacacagacctgagcagccaccacgcccccccaccccagggccgcatccaggaggcccccaagctgacccacctgtag

SEQ ID NO: 155495 - DNA, 1296 bp, Artificial Sequence; identical to SEQ ID NO: 155491
  Description of Artificial Sequence: Synthetic coding sequence

SEQ ID NO: 155496 - DNA, 900 bp, Artificial Sequence; identical to SEQ ID NO: 155492
  Description of Artificial Sequence: Synthetic coding sequence

SEQ ID NO: 155497 - DNA, 1077 bp, Artificial Sequence; identical to SEQ ID NO: 155494
  Description of Artificial Sequence: Synthetic coding sequence

SEQ ID NO: 155498 - DNA, 1296 bp, Artificial Sequence; identical to SEQ ID NO: 155491
  Description of Artificial Sequence: Synthetic coding sequence

SEQ ID NO: 155499 - DNA, 756 bp, Artificial Sequence
  Description of Artificial Sequence: Synthetic coding sequence
atggccatgagcagcttcctgatcaacagcaactacgtggaccccaagttccccccctgtgaggagtacagccagagcgactacctgcccagcgaccacagccctggctactatgccggcggccagaggcgggagagcagcttccagcctgaggccggcttcggccggcgggccgcctgcaccgtgcagagatatgctgcctgccgggaccccggccccccacctcctcctcctcctcctcctcctcctcctcctcctcctggcctgagcccccgggccccagcccctcctcctgctggggccctgctgcctgagcccggccagagatgtgaggccgtgagcagcagccccccacctccaccctgtgcccagaaccccctgcaccccagccccagccacagcgcctgcaaggagcctgtggtgtacccctggatgaggaaggtgcacgtgtccacagtgaaccccaactatgctggaggagagcccaagaggagcaggacagcctacacccggcagcaggtgctggagctggagaaggagttccactacaaccgctacctgaccaggagaagaagagtggagatcgcccacgccctgtgcctgtctgagcggcagatcaagatctggttccagaacagaaggatgaagtggaagaaggaccacaagctgcccaacaccaagatccgcagcggcggggccgccggcagcgctgggggccccccaggccggcccaatggaggcccccgggccctgtag

SEQ ID NO: 155500 - DNA, 810 bp, Artificial Sequence
  Description of Artificial Sequence: Synthetic coding sequence
atgagcagctactttgtgaacagcttcagcggccgctacccaaatggaccagactaccagctgctgaactacggcagcggcagcagcctgagcggcagctacagagatcctgctgccatgcacacaggcagctatggctacaactacaacggcatggacctgtctgtgaacagaagcagcgccagcagcagccactttggagctgtgggggagagcagccgggccttccctgccccagcccaggagccccgcttccggcaggccgccagcagctgcagcctgagcagccctgagagcctgccctgcaccaacggggacagccacggggccaagcccagcgccagcagccccagcgaccaggccaccagcgccagcagcagcgccaacttcacagaaattgatgaggccagcgccagcagcgagcctgaggaggccgccagccagctgagcagccccagcctggcccgggcccagcctgagcccatggccaccagcacagctgcccctgagggccagaccccccagatcttcccctggatgaggaagctgcacatcagccatgacatgacaggcccagatggcaagagggccaggacagcctacacccgctaccagaccctggagctggagaaggagttccacttcaaccgctacctgaccaggagaagaagaattgaaattgcccacgccctgtgcctgtctgagcggcagatcaagatctggttccagaacagaaggatgaagtggaagaaggacaacaagctgaagtccatgagcctggccacagctggcagcgccttccagccctag

SEQ ID NO: 155501 - DNA, 1179 bp, Artificial Sequence
  Description of Artificial Sequence: Synthetic coding sequence
atggccgccctgcggcagccccaggtggccgagctgctggccgaggcccggcgggccttccgggaggagtttggagctgagcctgagctggccgtgtctgcccctggccgggtgaacctgattggagagcacacagactacaaccagggcctggtgctgcccatggccctggagctgatgacagtgctggtgggcagccccaggaaggatggcctggtgtccctgctgaccaccagcgagggcgcagatgagccccagaggctgcagttccccctgcccacagcccagaggagcctggagcccggcaccccccgctgggccaactacgtgaagggcgtcatccagtactacccagctgcccccctgcccggcttctctgctgtggtggtgtcctctgtgcccctgggcggcggcctgagcagcagcgccagcctggaggtggccacctacaccttcctgcagcagctgtgcccagacagcggcaccatcgccgcccgggcccaggtgtgccagcaggccgagcacagctttgctggcatgccctgtggcatcatggaccagttcatcagcctgatgggccagaagggccacgccctgctgattgactgccgcagcctggagaccagcctggtgcccctgagtgaccccaagctggccgtgctgatcaccaacagcaatgtgcgccacagcctggccagcagcgagtaccctgtgagaagacggcagtgtgaggaggtggcccgggccctgggcaaggagagcctgcgggaggtgcagctggaggagctggaggccgcccgggacctggtgtccaaggagggcttccggcgggcccggcacgtggtgggggagatccggaggacagcccaggccgctgctgccctgcggcggggggactaccgggccttcggccgcctgatggtggagagccacaggagcctgagagatgattatgaggtgtcctgcccagagctggaccagctggtggaggccgccctggccgtgcctggggtgtatggcagcaggatgactggaggcggctttggaggctgcaccgtgaccctgctggaggccagcgctgcccctcatgccatgaggcacatccaggagcactacggcggcacagccaccttctacctgagccaggccgcagatggagccaaggtgctgtgcctgtag

SEQ ID NO: 155502 - DNA, 675 bp, Artificial Sequence
  Description of Artificial Sequence: Synthetic coding sequence
atgagcagctactttgtgaacagcaccttccctgtgaccctggccagcggccaggagagcttcctgggccagctgcccctgtacagcagcggctatgctgaccccctgcggcactacccagccccctacggccctggccctggccaggacaagggctttgccaccagcagctactaccccccagctgggggcggctacggccgggccgccccctgtgactatggccctgccccagccttctaccgggagaaggagagcgcctgtgccctgtctggagcagatgagcagccccccttccaccctgagcccaggaagagtgactgtgcccaggacaagtctgtgtttggagaaacagaggagcagaagtgcagcacccctgtgtacccctggatgcagaggatgaacagctgcaacagcagcagctttggccccagcggcagaagaggccggcagacctacacccgctaccagaccctggagctggagaaggagttccactacaaccgctacctgaccaggagaagaagaattgaaattgcccacgccctgtgcctgacagagcggcagatcaagatctggttccagaacagaaggatgaagtggaagaaggagagcaagctgctgagcgccagccagctgtctgctgaggaggaggaggagaagcaggccgagtag

SEQ ID NO: 155503 - DNA, 654 bp, Artificial Sequence
  Description of Artificial Sequence: Synthetic coding sequence
atgagcagcctgtactatgccaacaccctcttcagcaagtacccagccagcagctctgtgtttgccactggagccttccctgagcagaccagctgtgcctttgccagcaacccccagaggcctggctatggagctggcagcggggccagctttgctgcctccatgcagggcctgtacccaggcggcggcggcatggccggccagagcgctgctggggtgtatgctgctggctacggcctggagcccagcagcttcaacatgcactgtgccccctttgagcagaacctgtctggagtgtgccctggggacagcgccaaggccgccggggccaaggagcagagggacagcgacctggccgctgagagcaacttccgcatctacccctggatgaggagcagcggcacagacaggaagaggggccggcagacctacacccgctaccagaccctggagctggagaaggagttccactacaaccgctacctgaccaggagaagacgcatcgagatcgcccacaccctgtgcctgacagagcggcagatcaagatctggttccagaacagaaggatgaagtggaagaaggagaacaagacagctggccctggcaccaccggccaggacagagctgaggccgaggaggaggaggaggagtag

SEQ ID NO: 155504 - DNA, 87 bp, Artificial Sequence
  Description of Artificial Sequence: Synthetic coding sequence
atgaagtggaagaaggagaacaagacagctggccctggcaccaccggccaggacagagctgaggccgaggaggaggaggaggagtag

SEQ ID NO: 155505 - DNA, 732 bp, Artificial Sequence
  Description of Artificial Sequence: Synthetic coding sequence
atgagcagctactttgtgaacagcctcttcagcaagtacaagacaggagagagcctgcggcccaactactatgactgtggctttgcccaggacctgggcggccggcccaccgtggtgtatggccccagcagcggcggcagcttccagcaccccagccagatccaggagttctaccacggccccagcagcctgagcacagccccctaccagcagaacccctgtgctgtggcctgccacggggaccccggcaacttctacggctatgaccccctgcagaggcagagcctgtttggagcccaggaccctgacctggtgcagtatgctgactgcaagctggccgccgccagcggcctgggggaggaggccgagggcagcgagcagagccccagccccacccagctgttcccctggatgaggccccaggccgccgccggcagaagaagaggccggcagacctacagccgctaccagaccctggagctggagaaggagttcctgttcaacccctacctgaccaggaagagaagaattgaggtgtcccatgccctgggcctgacagagcggcaggtgaagatctggttccagaacagaaggatgaagtggaagaaggagaacaacaaggacaagttccccagcagcaaatgtgagcaggaggagctggagaagcagaagctggagcgggcccctgaggccgcagatgaaggagatgcccagaagggggacaagaagtag

SEQ ID NO: 155506 - DNA, 753 bp, Artificial Sequence
  Description of Artificial Sequence: Synthetic coding sequence
atgagcatcagcggcaccctgagcagctactacgtggacagcatcatcagccatgaaagtgaagatgcccccccagccaagttccccagcggccagtatgccagcagccggcagcccggccacgccgagcacctggagttccccagctgcagcttccagcccaaggcccctgtgtttggagcctcctgggcccccctgagcccccacgccagcggcagcctgcccagcgtgtaccacccctacatccagccccagggcgtgcccccagctgagagccgctacctgcggacctggctggagcccgcccccagaggagaggccgcccctggccagggccaggccgctgtgaaggccgagcccctgctgggcgcccctggagagctgctgaagcagggcaccccagagtacagcctggagaccagcgctggccgggaggccgtgctgagcaaccagaggcctggctatggagacaacaagatctgtgagggcagcgaggacaaggagaggccagaccagaccaaccccagcgccaactggctgcacgcccggagcagcaggaagaagcgctgcccctacaccaagtaccagaccctggagctggagaaggagttcctgttcaacatgtacctgacccgggacagaagacatgaggtggcccggctgctgaacctgtctgagcggcaggtgaagatctggttccagaacagaaggatgaagatgaagaagatgaacaaggagcagggcaaggagtag

SEQ ID NO: 155507 - DNA, 387 bp, Artificial Sequence
  Description of Artificial Sequence: Synthetic coding sequence
atgagcatcagcggcaccctgagcagctactacgtggacagcatcatcagccatgaaagtgaagatgcccccccagccaagttccccagcggccagtatgccagcagccggcagcccggccacgccgagcacctggagttccccagctgcagcttccagcccaaggcccctgtgtttggagcctcctgggcccccctgagcccccacgccagcggcagcctgcccagcgtgtaccacccctacatccagccccagggcgtgcccccagctgagagccgctacctgcggacctggctggagcccgccccccggggcggggccgcccagacaggccacgcccgggtgcagtttggaaactttggaggccagggcggccgggctgtgtag

SEQ ID NO: 155508 - DNA, 1029 bp, Artificial Sequence
  Description of Artificial Sequence: Synthetic coding sequence
atgacctgccccagaaatgtgacccccaacagctatgcagagcccctggccgcccctgggggcggggagcgctacagccgctctgctggcatgtacatgcagagcggcagtgacttcaactgtggggtgatgaggggctgcggcctggcccccagcctgagcaagagagatgagggcagcagccccagcctggccctgaacacctaccccagctacctgagccagctggacagctggggagaccccaaggccgcctaccgcctggagcagcctgtgggccggcccctgagcagctgcagctacccacccagcgtgaaggaggagaatgtgtgctgcatgtacagcgctgagaagagggccaagagcggccctgaggccgccctgtacagccaccccctgcctgagagctgcctgggggagcacgaggtgcctgtgcccagctactaccgggccagccccagctacagcgccctggacaagaccccccactgcagcggggccaatgactttgaggccccctttgagcagagggccagcctgaaccccagggctgagcacctggagagcccccagctgggcggcaaggtgtccttccctgagacccccaagagtgacagccagacccccagccccaatgagatcaagacagagcagagcctggccggccccaagggcagccccagcgagagcgagaaggagcgggccaaggctgctgacagcagcccagacaccagtgacaatgaggccaaggaggagatcaaggccgagaacaccactggaaactggctgacagccaagagcggcaggaagaagcgctgcccctacaccaagcaccagaccctggagctggagaaggagttcctgttcaacatgtacctgacccgggagcggcggctggagatcagcaagaccatcaacctgacagaccggcaggtgaagatctggttccagaacagaaggatgaagctgaagaagatgaacagagaaaatcgcatccgggagctgaccagcaacttcaacttcacctag

SEQ ID NO: 155509 - DNA, 915 bp, Artificial Sequence
  Description of Artificial Sequence: Synthetic coding sequence
atgttcaacagcgtgaacctgggcaacttctgcagccccagcaggaaggagagaggagctgactttggagagcggggcagctgtgccagcaacctgtacctgcccagctgcacctactacatgcctgagttcagcacagtgtcctccttcctgccccaggcccccagccggcagatctcctacccctacagcgcccaggtgccccctgtgcgggaggtgtcctatggcctggagcccagcggcaagtggcaccacaggaacagctacagcagctgctacgccgctgctgatgagctgatgcacagagaatgtctgccccccagcacagtgacagagatcctgatgaagaatgaaggcagctatggaggccaccaccaccccagcgcccctcatgccaccccagctggcttctacagctctgtgaacaagaacagcgtgctgccccaggcctttgaccgcttctttgacaatgcctactgcggcggcggggaccccccagctgagcccccctgcagcggcaagggggaggccaagggggagcctgaggcccccccagccagcggcctggccagcagagctgaggccggggctgaggccgaggccgaggaggagaacaccaaccccagcagcagcggcagcgcccacagcgtggccaaggagcccgccaagggagctgccccaaatgcccccaggaccaggaagaagcgctgcccctacagcaagttccagatccgggagctggagcgggagttcttcttcaacgtgtacatcaacaaggagaagaggctgcagctgagcaggatgctgaacctgacagaccggcaggtgaagatctggttccagaacagaaggatgaaggagaagaagctgagccgggaccggctgcagtacttcagcggcaaccccctgctgtag

SEQ ID NO: 155510 - DNA, 849 bp, Artificial Sequence
  Description of Artificial Sequence: Synthetic coding sequence
atgggagagcacaacctgctgaaccctggctttgtgggccccctggtgaacatccacactggagacaccttctacttccccaacttccgggccagcggggcccagctgcccggcctgcccagcctgagctacccccggcgggacaacgtgtgcagcctgtcctggcccagcgctgagccctgcaatggctacccccagccctacctgggcagccctgtgtccctgaaccccccatttggaagaacctgtgagctggcccgggtggaggatggcaagggctactaccgggagccctgtgccgagggcggcggcggcggcctgaagcgggaggagcggggccgggaccccggggccggccctggggccgccctgctgcccctggagcccagcggccccccagccctgggcttcaagtatgactatgctgctgggggcggcggcggagatggcggcggcggggccggcccccctcatgacccccccagctgccagagcctggagagtgacagcagcagcagcctgctgaatgaaggcaacaagggggccggggccggggaccccggcagcctggtgagccccctgaaccctgggggcggcctgagcgccagcggggccccctggtaccccatcaacagccgcagcaggaagaagaggaagccctacagcaagctgcagctggccgagctggagggggagttcctggtgaatgagttcatcacccggcagaggcggcgggagctgagtgaccggctgaacctgagtgaccagcaggtgaagatctggttccagaacagaaggatgaagaagaagaggctgctgctgcgggagcaggccctgtccttcttctag

SEQ ID NO: 155511 - DNA, 993 bp, Artificial Sequence
  Description of Artificial Sequence: Synthetic coding sequence
atgaccaccagcctgctgctgcacccccgctggccagagagcctgatgtatgtgtatgaggacagcgctgctgagagcggcatcggcggcggcggcggcggcggcggcggcggcactggaggagctgggggcggctgcagcggggccagccctgggaaggcccccagcatggatggcctgggcagcagctgcccagccagccactgccgggacctgctgccccaccctgtgctgggccggcccccagcccccctgggcgccccccagggcgctgtgtacacagacatcccagcccctgaggccgcccggcagtgtgcccctcctccagccccacccaccagcagcagcgccaccctgggctacggctacccctttggaggcagctactacggctgccgcctgagccacaacgtgaacctgcagcagaagccctgtgcctaccaccctggggacaagtacccagagcccagcggggccctgcctggagatgacctgagcagccgggccaaggagtttgccttctaccccagctttgccagcagctaccaggccatgcctggctacctggatgtgtctgtggtgcccggcatcagcggccaccctgagcccaggcatgatgccctgatccctgtggagggctaccagcactgggccctgagcaatggctgggacagccaggtgtactgcagcaaggagcagagccagagcgcccacctgtggaagagccccttcccagatgtggtgcccctgcagcctgaggtgagcagctaccgccggggcaggaagaagagggtgccctacaccaaggtgcagctgaaggagctggagaaggagtatgctgccagcaagttcatcaccaaggagaagagaagacgcatcagcgccaccaccaacctgtctgagcggcaggtgaccatctggttccagaacagaagagtgaaggagaagaaggtggtgtccaagagcaaggccccccacctgcacagcacctag

SEQ ID NO: 155512 - DNA, 795 bp, Artificial Sequence
  Description of Artificial Sequence: Synthetic coding sequence
atgatcatgagcagctacctgatggacagcaactacatcgaccccaagttccccccctgtgaggagtacagccagaacagctacatccctgagcacagccctgagtactacggccgcacccgggagagcggcttccagcaccaccaccaggagctgtacccacctcctccaccccggcccagctacccagagcggcagtacagctgcaccagcctgcagggccctggcaacagccggggccacggccctgcccaggccggccaccaccaccctgagaagagccagagcctgtgtgagcccgcccccctgagcggggccagcgccagccccagccctgcccccccagcctgcagccagcctgccccagaccaccccagcagcgctgccagcaagcagcccatcgtgtacccctggatgaagaagatccacgtgtccacagtgaaccccaactacaacggcggggagcccaagaggagcaggacagcctacacccggcagcaggtgctggagctggagaaggagttccactacaaccgctacctgaccaggagaagaagaattgaaattgcccacagcctgtgcctgtctgagcggcagatcaagatctggttccagaacagaaggatgaagtggaagaaggaccaccggctgcccaacaccaaggtgcgcagcgcccccccagctggggccgcccccagcaccctgtctgctgccaccccaggcaccagcgaggaccacagccagagcgccaccccacctgagcagcagagagctgaggacatcacccggctgtag

SEQ ID NO: 155513 - DNA, 795 bp, Artificial Sequence; identical to SEQ ID NO: 155512
  Description of Artificial Sequence: Synthetic coding sequence

SEQ ID NO: 155514 - DNA, 669 bp, Artificial Sequence
  Description of Artificial Sequence: Synthetic coding sequence
atgagcagctatgtggccaacagcttctacaagcagagccccaacatcccagcctacaacatgcagacctgtggcaactacggcagcgccagcgaggtgcaggccagccgctactgctacggcggcctggacctgagcatcaccttccccccaccagcccccagcaacagcctgcatggagtggacatggccgccaacccccgggcccacccagacaggcctgcctgcagcgctgctgctgcccctggccacgcccctggaagagatgaagctgcccccctgaaccctggcatgtacagccagaaggccgcccggcctgccctggaggagcgggccaagagcagtggagagatcaaggaggagcaggcccagacaggccagcctgctggcctgagccagcccccagccccaccccagatctacccctggatgaccaagctgcacatgagccatgaaacagatggcaagaggagcaggaccagctacacccgctaccagaccctggagctggagaaggagttccacttcaaccgctacctgaccaggagaagacgcatcgagatcgccaacaacctgtgcctgaatgaaaggcagatcaagatctggttccagaacagaaggatgaagtggaagaaggacagcaagatgaagagcaaggaggccctgtag

SEQ ID NO: 155515 - DNA, 708 bp, Artificial Sequence
  Description of Artificial Sequence: Synthetic coding sequence
atgaacagctacttcaccaaccccagcctgagctgccacctggccggcggccaggatgtgctgcccaacgtggccctgaacagcacagcctatgaccctgtgcgccacttcagcacctacggggctgctgtggcccagaaccgcatctacagcacccccttctacagcccccaggagaatgtggtgttcagcagcagccggggcccctatgactatggcagcaacagcttctaccaggagaaggacatgctgagcaactgccggcagaacaccctgggccacaacacccagaccagcatcgcccaggacttcagcagcgagcagggccgcacagccccccaggaccagaaggccagcatccagatctacccctggatgcagaggatgaacagccacagcggcgtgggctatggagctgacagaagaagaggccggcagatctacagccgctaccagaccctggagctggagaaggagttccacttcaaccgctacctgaccaggagaagacgcatcgagatcgccaatgccctgtgcctgacagagcggcagatcaagatctggttccagaacagaaggatgaagtggaagaaggagagcaacctgaccagcaccctgagcggcggcggcggcggggccacagctgacagcctgggcggcaaggaggagaagcgggaggagacagaggaggagaagcagaaggagtag

SEQ ID NO: 155516 - DNA, 462 bp, Artificial Sequence
  Description of Artificial Sequence: Synthetic coding sequence
atgctgagcaactgccggcagaacaccctgggccacaacacccagaccagcatcgcccaggacttcagcagcgagcagggccgcacagccccccaggaccagaaggccagcatccagatctacccctggatgcagaggatgaacagccacagcggcgtgggctatggagctgacagaagaagaggccggcagatctacagccgctaccagaccctggagctggagaaggagttccacttcaaccgctacctgaccaggagaagacgcatcgagatcgccaatgccctgtgcctgacagagcggcagatcaagatctggttccagaacagaaggatgaagtggaagaaggagagcaacctgaccagcaccctgagcggcggcggcggcggggccacagctgacagcctgggcggcaaggaggagaagcgggaggagacagaggaggagaagcagaaggagtag

SEQ ID NO: 155517 - DNA, 159 bp, Artificial Sequence
  Description of Artificial Sequence: Synthetic coding sequence
atgctgagcaactgccggcagaacaccctgggccacaacacccagaccagcatcgcccaggacttcagcagcgagcagggccgcacagccccccaggaccagaaggccagcatccagatctacccctggatgcagaggatgaacagccacagcggctag

SEQ ID NO: 155518 - DNA, 216 bp, Artificial Sequence
  Description of Artificial Sequence: Synthetic coding sequence
atgctgagcaactgccggcagaacaccctgggccacaacacccagaccagcatcgcccaggacttcagcagcgagcagggccgcacagccccccaggaccagaaggccagcatccagatctacccctggatgcagaggatgaacagccacagcgtgtgctttgtgcccggcagcctgggcgtgggctatggagctgacagaagaagaggaagatag

SEQ ID NO: 155519 - DNA, 729 bp, Artificial Sequence
  Description of Artificial Sequence: Synthetic coding sequence
atgagcagctactttgtgaaccccctcttcagcaagtacaaggccggggagagcctggagcccgcctactatgactgccgcttcccccagagcgtgggccgcagccacgccctggtgtatggccctgggggcagcgcccctggcttccagcacgccagccaccacgtgcaggacttcttccaccacggcaccagcggcatcagcaacagcggctaccagcagaacccctgcagcctgagctgccacggagatgccagcaagttctacggctatgaggccctgccccggcagagcctgtatggagcccagcaggaggcctctgtggtgcagtacccagactgcaagagcagcgccaacaccaacagcagcgagggccagggccacctgaaccagaacagcagccccagcctgatgttcccctggatgaggcctcatgcccctggaagaagaagtggccggcagacctacagccgctaccagaccctggagctggagaaggagttcctgttcaacccctacctgaccaggaagaggcgcatcgaggtgagccacgccctgggcctgacagagcggcaggtgaagatctggttccagaacagaaggatgaagtggaagaaggagaacaacaaggacaagctgcccggggccagagatgaggagaaggtggaggaggagggcaatgaggaggaggagaaggaggaggaggagaaggaggagaacaaggactag

SEQ ID NO: 155520 - DNA, 783 bp, Artificial Sequence
  Description of Artificial Sequence: Synthetic coding sequence
atgtctgccaccggccccatcagcaactactacgtggacagcctcatcagccatgacaatgaagacctgctggccagccgcttccctgccactggagcccaccctgctgctgcccggcccagcggcctggtgcctgactgcagcgacttccccagctgcagctttgcccccaagccagctgtgttcagcacctcctgggcccctgtgcccagccagagctctgtggtgtaccacccctacggcccccagccccacctgggcgctgacacccgctacatgaggacctggctggagcccctgtctggagctgtgtccttccccagcttccctgctgggggccgccactacgccctgaagccagatgcctacccaggccggcgggctgactgtggccctggagagggccgcagctacccagactacatgtatggcagccctggagagctgcgggaccgggccccccagaccctgcccagccctgaggctgatgccctggccggcagcaagcacaaggaggagaaggctgacctggaccccagcaaccctgtggccaactggatccacgcccggagcaccaggaagaagcgctgcccctacaccaagtaccagaccctggagctggagaaggagttcctgttcaacatgtacctgacccgggacagaagatatgaggtggcccgggtgctgaacctgacagagcggcaggtgaagatctggttccagaacagaaggatgaagatgaagaagatgaacaaggagaagacagacaaggagcagagctag

SEQ ID NO: 155521 - DNA, 783 bp, Artificial Sequence; identical to SEQ ID NO: 155520
  Description of Artificial Sequence: Synthetic coding sequence

SEQ ID NO: 155522 - DNA, 987 bp, Artificial Sequence
  Description of Artificial Sequence: Synthetic coding sequence
atgagcagctacctggagtatgtgtcctgcagcagcagtggaggagtgggcggagatgtgctgagcctggcccccaagttctgccgcagtgatgcccggcctgtggccctgcagcctgccttccccctgggcaatggagatggagcctttgtgtcctgcctgcccctggccgccgcccggcccagccccagccccccagctgccccagcccggcccagcgtgcccccacctgctgccccccagtatgcccagtgcaccctggagggcgcctatgagcctggagctgccccagctgctgctgctggaggagctgactatggcttcctgggcagcggccctgcctatgacttccctggggtgctgggccgggctgctgatgatggcggcagccacgtgcactacgccaccagcgctgtgttttctgggggcggcagcttcctgctgagcggccaggtggactatgctgcctttggagagcccggccccttccctgcctgcctgaaggccagcgcagatggccaccctggggccttccagacagccagccctgcccctggcacctaccccaagtctgtgtccccagccagcggcctgcctgctgccttcagcacctttgagtggatgaaggtgaagagaaatgccagcaagaagggcaagctggccgagtatggagctgccagccccagcagcgccatccgcaccaacttcagcaccaagcagctgacagagctggagaaggagttccacttcaacaagtacctgacccgggcccggcgcatcgagatcgccaactgcctgcacctgaatgacacccaggtgaagatctggttccagaacagaaggatgaagcagaagaagcgggagcgggagggcctgctggccacagccatccctgtggcccccctgcagctgcccctgagcggcaccacccccaccaagttcatcaagaaccctggcagccccagccagagccaggagcccagctag

SEQ ID NO: 155523 - DNA, 630 bp, Artificial Sequence
  Description of Artificial Sequence: Synthetic coding sequence
ctggagcgggccgcccgggtggagcgggccggcggggccgcccagacagctgctgtgctgctgagcctgtgcccagccccctacagcggccctggcctgcggccccacctggcctttgcccctggccggcccagggctgctgtgaggacagccagcggccgggcccctgtgcgggctgtgcaccctgggggcggcctgcggacctggtgcaggacctgccggggctcctggggccggggcctgcggctgcccggggtgcgggccggcgtgcggctgcccggccgggccggggccggcggccccttccctgcctgcctgaaggccagcgcagatggccaccctggggccttccagacagccagccctgcccctggcacctaccccaagtctgtgtccccagccagcggcctgcctgctgccttcagcacctttgagtggatgaaggtgaagagaaatgccagcaagaaggacagcggcctgggctttgtggaggagaccaggagccgggccaacagcatggagagcgccagcagcacagattctgaaaatgtgcccggcatcgagaagatcagcggccgcagcagcccctggaacttctcctggcagacccggcgggtgtggggccgctag

SEQ ID NO: 155524 - DNA, 1023 bp, Artificial Sequence
  Description of Artificial Sequence: Synthetic coding sequence
atgtccttccccaacagcagccctgctgccaacaccttcctggtggacagcctcatcagcgcctgccgcagtgacagcttctacagcagcagcgcctccatgtacatgcccccacccagcgctgacatgggcacctacggcatgcagacctgtggcctgctgcccagcctggccaagcgggaggtgaaccaccagaacatgggcatgaatgtgcacccctacatcccccaggtggacagctggacagaccccaacagaagctgccgcatcgagcagcctgtgacccagcaggtgcccacctgcagcttcaccaccaacatcaaggaggagagcaactgctgcatgtacagcgacaagaggaacaagctgatctctgctgaggtgcccagctaccagaggctggtgcctgagagctgccctgtggagaaccctgaggtgcctgtgcccggctacttccggctgagccagacctacgccaccgggaagacccaggagtacaacaacagccctgagggcagcagcacagtgatgctgcagctgaaccccagaggagctgccaagccccagctgtctgctgcccagctgcagatggagaagaagatgaatgaacctgtgtctggccaggagcccaccaaggtgtcccaggtggagagccctgaggccaagggcggcctgcctgaggagaggagctgcctggccgaggtgtctgtgagcagccctgaggtgcaggagaaggagagcaaggaggagatcaagagtgacacccccaccagcaactggctgacagccaagagcggcaggaagaagcgctgcccctacaccaagcaccagaccctggagctggagaaggagttcctgttcaacatgtacctgacccgggagcggcggctggagatcagcaagtctgtgaacctgacagaccggcaggtgaagatctggttccagaacagaaggatgaagctgaagaagatgagcagagaaaatcgcatccgggagctgacagccaacctgaccttctcctag

SEQ ID NO: 155525 - DNA, 1017 bp, Artificial Sequence
  Description of Artificial Sequence: Synthetic coding sequence
atgaatgactttgatgaatgtggccagagcgctgcctccatgtacctgcccggctgtgcctactacgtggcccccagcgactttgccagcaagcccagcttcctgagccagcccagcagctgccagatgaccttcccctacagcagcaacctggccccccacgtgcagcctgtgcgggaggtggccttccgggactatggcctggagcgggccaagtggccctacagaggaggcggcggcggcggcagcgctgggggcggcagcagcggcggcggccctgggggcggcggcggcggggccggcggctacgccccctactatgctgctgctgctgctgctgctgctgctgctgctgctgctgaggaggccgccatgcagcgggagctgctgcccccagctggaagaagaccagatgtgctcttcaaggcccctgagcctgtgtgtgccgcccctggcccccctcatggccctgctggggccgccagcaacttctacagcgctgtgggcagaaatggcatcctgccccagggctttgaccagttctatgaggccgcccctggccccccatttgctggcccccagcccccacctcctccagccccaccccagcctgagggcgctgctgacaagggggaccccaggactggagctgggggcggcggcggcagcccctgcaccaaggccaccccaggcagcgagcccaagggagctgctgagggcagcggaggagatggagagggccccccaggagaggccggggctgagaagagcagcagcgctgtggccccccagaggagcaggaagaagcgctgcccctacaccaagtaccagatccgggagctggagcgggagttcttcttcaacgtgtacatcaacaaggagaagaggctgcagctgagcaggatgctgaacctgacagaccggcaggtgaagatctggttccagaacagaaggatgaaggagaagaagctgaacagagaccggctgcagtacttcaccggcaaccccctcttctag

SEQ ID NO: 155526 - DNA, 480 bp, Artificial Sequence
  Description of Artificial Sequence: Synthetic coding sequence
atgtacctgcccggctgtgcctactacgtggcccccagcgactttgccagcaagcccagcttcctgagccagcccagcagctgccagatgaccttcccctacagcagcaacctggcccctgggggcggcagcccctgcaccaaggccaccccaggcagcgagcccaagggagctgctgagggcagcggaggagatggagagggccccccaggagaggccggggctgagaagagcagcagcgctgtggccccccagaggagcaggaagaagcgctgcccctacaccaagtaccagatccgggagctggagcgggagttcttcttcaacgtgtacatcaacaaggagaagaggctgcagctgagcaggatgctgaacctgacagaccggcaggtgaagatctggttccagaacagaaggatgaaggagaagaagctgaacagagaccggctgcagtacttcaccggcaaccccctcttctag

SEQ ID NO: 155527 - DNA, 813 bp, Artificial Sequence
  Description of Artificial Sequence: Synthetic coding sequence
atgtgtgagaggagcctgtacagagctggctacgtgggcagcctgctgaacctgcagagcccagacagcttctacttcagcaacctgcggcccaacggcggccagctggccgccctgccccccatctcctaccccaggggggccctgccctgggccgccaccccagccagctgtgccccagcccagcctgctggggccacagcctttggaggcttcagccagccctacctggccggcagcggccccctgggcctgcagcccccaacagccaaggatggccctgaggagcaggccaagttctacgcccctgaggccgctgctggccctgaggagcggggccgcacccggcccagctttgcccctgagagcagcctggccccagctgtggccgccctgaaggccgccaagtatgactatgctggggtgggccgggccaccccaggcagcaccaccctgctgcagggcgccccctgtgcccctggcttcaaggatgacaccaagggccccctgaacctgaacatgacagtgcaggccgccggcgtggccagctgcctgcggcccagcctgcctgatggcctgccctggggcgccgcccctggccgggccaggaagaagaggaagccctacaccaagcagcagattgctgagctggagaatgagttcctggtgaatgagttcatcaaccggcagaagaggaaggagctgagcaaccggctgaacctgagtgaccagcaggtgaagatctggttccagaacagaaggatgaagaagaagagggtggtgctgcgggagcaggccctggccctgtactag

SEQ ID NO: 155528 - DNA, 1299 bp, Artificial Sequence
  Description of Artificial Sequence: Synthetic coding sequence
atgctgtttgagcagggccagcaggccctggagctgcctgagtgcaccatgcagaaggccgcctactatgagaaccctggcctgtttggaggctacggctacagcaagaccacagacacctacggctacagcaccccccaccagccctacccacctcctgctgctgccagcagcctggacacagactacccaggcagcgcctgcagcatccagagcagcgcccccctgcgggccccagcccacaagggagctgagctgaatggcagctgcatgaggcctggcactggaaacagccagggcggcggcggcggcagccagcccccaggcctgaacagcgagcagcagcccccccagcccccacctcctccacccaccctgccccccagcagccccaccaaccctgggggcggcgtgcctgccaagaagcccaagggcggccccaatgccagcagcagcagcgccaccatcagcaagcagatcttcccctggatgaaggagagccggcagaacagcaagcagaagaacagctgtgccacagctggggagagctgtgaggacaagagccccccaggccctgccagcaagagggtgaggacagcctacaccagcgcccagctggtggagctggagaaggagttccacttcaaccgctacctgtgccggcccaggagagtggagatggccaacctgctgaacctgacagagcggcagatcaagatctggttccagaacagaaggatgaagtacaagaaggaccagaaggccaagggcatcctgcacagccctgccagccagagccctgagaggagcccccccctgggcggcgctgctggccacgtggcctacagcggccagctgccccctgtgcccggcctggcctatgatgcccccagccccccagcctttgccaagagccagcccaacatgtatggcctggccgcctacacagcccccctgagcagctgcctgccccagcagaagagatatgctgcccctgagtttgagccccaccccatggccagcaatggaggcggctttgccagcgccaacctgcagggcagccctgtgtatgtgggcggcaactttgtggagagcatggccccagccagcggccctgtgttcaacctgggccacctgagccaccccagcagcgcctctgtggactacagctgtgccgcccagatccctggcaaccaccaccacggcccctgtgacccccaccccacctacacagacctgagcgcccaccacagcagccagggccgcctgcctgaggcccccaagctgacccacctgtag

SEQ ID NO: 155529 - DNA, 1299 bp, Artificial Sequence; identical to SEQ ID NO: 155528
  Description of Artificial Sequence: Synthetic coding sequence

SEQ ID NO: 155530 - DNA, 303 bp, Artificial Sequence
  Description of Artificial Sequence: Synthetic coding sequence
atgctgtttgagcagggccagcaggccctggagctgcctgagtgcaccatgcagaaggccgcctactatgagaaccctggcctgtttggaggctacggctacagcaagaccacagacacctacggctacagcaccccccaccagccctacccacctcctgctgctgccagcagcctggacacagactacccaggcagcgcctgcagcatccagagcagcgcccccctgcgggccccagcccacaagggagctgagctgaatggcagctgcatgaggcctggcactggaaacagccagggctag

SEQ ID NO: 155531 - DNA, 1299 bp, Artificial Sequence; identical to SEQ ID NO: 155528
  Description of Artificial Sequence: Synthetic coding sequence

SEQ ID NO: 155532 - DNA, 768 bp, Artificial Sequence
  Description of Artificial Sequence: Synthetic coding sequence
atggtgatgagcagctacatggtgaacagcaaatatgtggaccccaagttccccccctgtgaggagtacctgcagggcggctacctgggggagcagggcgctgactactatggaggaggagcccagggcgctgacttccagcccccaggcctgtaccccaggccagactttggagagcagccctttggaggcagcggccctggccctggcagcgccctgcctgcccggggccacggccaggagcccggcggccctgggggccactacgccgcccctggagagccctgcccagcccccccagcccctcctccagcccccctgcccggggcccgggcctacagccagagcgaccccaagcagcccccatctggaacagccctgaagcagcctgctgtggtgtacccctggatgaagaaggtgcacgtgaacagcgtgaaccccaactacacaggaggagagcccaagaggagcaggacagcctacacccggcagcaggtgctggagctggagaaggagttccacttcaaccgctacctgaccaggagaagaagaattgaaattgcccacaccctgtgcctgtctgagcggcagatcaagatctggttccagaacagaaggatgaagtggaagaaggaccacaagctgcccaacaccaagggccgcagcagcagcagcagcagcagcagcagctgcagcagctctgtggcccccagccagcacctgcagcccatggccaaggaccaccacacagacctgaccaccctgtag

SEQ ID NO: 155533 - DNA, 873 bp, Artificial Sequence
  Description of Artificial Sequence: Synthetic coding sequence
atgagcagctactttgtgaaccccctgtacagcaagtacaaggctgctgctgctgctgctgctgctgctggggaggccatcaaccccacctactatgactgccactttgcccctgaggtgggcggcagacatgctgctgctgctgctgccctgcagctgtatggcaacagcgctgctggcttcccccacgccccaccccaggcccacgcccacccccaccccagccccccaccttctggaacaggctgcggcggccgggagggccggggccaggagtacttccaccctgggggcggcagccctgctgctgcctaccaggccgcccctcctcctccaccccaccccccacctcctcctcctcctccaccctgtggcggcatcgcctgccacggggagcccgccaagttctacggctatgacaacctgcagaggcagcccatcttcaccacccagcaggaggccgagctggtgcagtacccagactgcaagagcagcagcggcaacattggagaagatcctgaccacctgaaccagagcagcagccccagccagatgttcccctggatgaggccccaggccgcccctggaagaagaagaggccggcagacctacagccgcttccagaccctggagctggagaaggagttcctgttcaacccctacctgaccaggaagaggcgcatcgaggtgagccacgccctggccctgacagagcggcaggtgaagatctggttccagaacagaaggatgaagtggaagaaggagaacaacaaggacaagtttcctgtgtcccggcaggaggtgaaggatggagagaccaagaaggaggcccaggagctggaggaggacagagctgagggcctgaccaactag

SEQ ID NO: 155534 - DNA, 870 bp, Artificial Sequence
  Description of Artificial Sequence: Synthetic coding sequence
atgagcagctactttgtgaaccccctgtacagcaagtacaaggctgctgctgctgctgctgctgctgctggggaggccatcaaccccacctactatgactgccactttgcccctgaggtgggcggcagacatgctgctgctgctgctgccctgcagctgtatggcaacagcgctgctggcttcccccacgccccaccccaggcccacgcccacccccaccccagccccccaccttctggaacaggctgcggcggccgggagggccggggccaggagtacttccaccctgggggcggcagccctgctgctgcctaccaggccgcccctcctcctccaccccaccccccacctcctcctcctcctccaccctgtggcggcatcgcctgccacggggagcccgccaagttctacggctatgacaacctgcagaggcagcccatcttcaccacccagcaggaggccgagctggtgcagtacccagactgcaagagcagcagcggcaacattggagaagatcctgaccacctgaaccagagcagcagccccagccagatgttcccctggatgaggccccaggcccctggaagaagaagaggccggcagacctacagccgcttccagaccctggagctggagaaggagttcctgttcaacccctacctgaccaggaagagaagaattgaggtgtcccatgccctggccctgacagagcggcaggtgaagatctggttccagaacagaaggatgaagtggaagaaggagaacaacaaggacaagtttcctgtgtcccggcaggaggtgaaggatggagagaccaagaaggaggcccaggagctggaggaggacagagctgagggcctgaccaactag

SEQ ID NO: 155535 - DNA, 870 bp, Artificial Sequence; identical to SEQ ID NO: 155534
  Description of Artificial Sequence: Synthetic coding sequence

SEQ ID NO: 155536 - DNA, 321 bp, Artificial Sequence
  Description of Artificial Sequence: Synthetic coding sequence
atgttcccctggatgaggccccaggccgcccctggaagaagaagaggccggcagacctacagccgcttccagaccctggagctggagaaggagttcctgttcaacccctacctgaccaggaagaggcgcatcgaggtgagccacgccctggccctgacagagcggcaggtgaagatctggttccagaacagaaggatgaagtggaagaaggagaacaacaaggacaagtttcctgtgtcccggcaggaggtgaaggatggagagaccaagaaggaggcccaggagctggaggaggacagagctgagggcctgaccaactag

SEQ ID NO: 155537 - DNA, 1059 bp, Artificial Sequence
  Description of Artificial Sequence: Synthetic coding sequence
atgctgggcggcagcgctggccgcctgaagatgagcagcagcggcaccctgagcaactactacgtggacagcctcatcggccacgagggagatgaggtgtttgctgcccgcttcggccccccaggccctggggcccagggccggcctgctggggtggctgatggccctgctgccacagctgctgagtttgccagctgcagctttgcccccaggtctgctgtgttcagcgcctcctggagcgctgtgcccagccagcccccagctgctgctgccatgagcggcctgtaccacccctacgtgcccccaccacccctggccgccagcgccagcgagcccggccgctacgtgcgctcctggatggagcccctgcccggcttccctggaggagctgggggcggcggcggcggcggcggcggcggccctggccggggccccagccctggccccagcggccctgccaacggccgccactacggcatcaagccagagacccgggccgccccagccccagccacagctgccagcaccaccagcagcagcagcaccagcctgagcagcagcagcaagaggacagagtgcagcgtggcccgggagagccagggcagcagcggccctgagttcagctgcaacagcttcctgcaggagaaggctgctgctgccactggaggcaccggccctggggccggcatcggggccgccaccggcaccggcggcagcagcgagcccagcgcctgcagcgaccaccccatccctggctgcagcctgaaggaggaggagaagcagcacagccagccccagcagcagcagctggaccccaacaacccagctgccaactggattcatgcccggagcaccaggaagaagcgctgcccctacaccaagtaccagaccctggagctggagaaggagttcctgttcaacatgtacctgacccgggaccggcgctatgaggtggcccgcatcctgaacctgacagagcggcaggtgaagatctggttccagaacagaaggatgaagatgaagaagatgagcaaggagaagtgccccaagggggactag

SEQ ID NO: 155538 - DNA, 2757 bp, Artificial Sequence
  Description of Artificial Sequence: Synthetic coding sequence
ctgcagcctgtgtatgaatccatggccagccacgtgcaggtgttcagcccccacaccctgcagagcagcgccttctgcagcgtgaagaagctgaagattgagcccagcagcaactgggacatgacaggctacggcagccacagcaaggtgtacagccagagcaagaacatccccctgagccagcctgccaccaccaccgtgtccaccagcctgcctgtgcccaaccccagcctgccctatgagcagaccatcgtgtttcctggcagcacaggccacatcgtggtgaccagcgccagcagcacctctgtgacaggccaggtgctgggcggcccccacaacctgatgaggaggagcacagtgtccctgctggacacctaccagaagtgtggcctgaagaggaagtctgaggagattgagaacaccagctctgtgcagatcatcgaggagcacccccccatgatccagaacaatgccagcggggccaccgtggccacagccaccaccagcacagccaccagcaagaacagcggcagcaacagcgagggggactaccagctggtgcagcacgaggtgctgtgcagcatgaccaacacctatgaggtgctggagttcctgggccggggcaccttcggccaggtggtgaagtgctggaagaggggcaccaatgagatcgtggccatcaagatcctgaagaaccaccccagctatgcccggcagggccagatcgaggtgtccatcctggcccggctgagcacagagagcgcagatgactacaactttgtgcgggcctatgagtgcttccagcacaagaaccacacctgcctggtgtttgagatgctggagcagaacctgtatgacttcctgaagcagaacaagttcagccccctgcccctgaagtacatccggcctgtgctgcagcaggtggccacagccctgatgaagctgaagagcctgggcctcatccatgctgacctgaagccagagaacatcatgctggtggaccccagccggcagccctacagagtgaaggtgattgactttggaagtgccagccacgtgtccaaggctgtgtgcagcacctacctgcagagccgctactaccgggcccctgagatcatcctgggcctgcccttctgtgaggccatcgacatgtggagcctgggctgtgtgattgctgagctgttcctgggctggcccctgtacccaggggcctctgaatatgaccagatccgctacatcagccagacccagggcctgcctgctgagtacctgctgtctgctggcaccaagaccacccgcttcttcaacagagacacagacagcccctaccccctgtggaggctgaagaccccagatgaccacgaggccgagaccggcatcaagagcaaggaggccaggaagtacatcttcaactgcctggatgacatggcccaggtgaacatgaccacagacctggagggcagtgacatgctggtggagaaggctgacagaagagagttcatcgacctgctgaagaagatgctgaccattgatgctgacaagaggatcacccccatcgagaccctgaaccacccctttgtgaccatgacccacctgctggacttcccccacagcacccacgtgaagagctgcttccagaacatggagatctgcaagagaagagtgaacatgtatgacacagtgaaccagagcaagacccccttcatcacccacgtggcccccagcaccagcaccaacctgaccatgaccttcaacaaccagctgaccaccgtgcacaaccaggcccccagcagcaccagcgccaccatcagcctggccaaccctgaggtgtccatcctgaactaccccagcaccctgtaccagcccagcgctgcctccatggctgctgtggcccagaggtccatgcccctgcagacaggaacagcccagatctgtgcccggccagaccccttccagcaggccctgattgtgtgccccccaggcttccagggcctgcaggccagccccagcaagcatgctggctacagcgtgaggatggagaatgctgtgcccatcgtgacccaggcccctggggcccagcccctgcagatccagcccggcctgctggcccagcaggcctggcccagcggcacccagcagatcctgctgcccccagcctggcagcagctgactggagtggccacccacacctctgtgcagcacgccaccgtcatccctgagaccatggccggcacccagcagctggccgactggaggaacacccacgcccacggcagccactacaaccccatcatgcagcagcctgccctgctgaccggccacgtgaccctgcctgctgcccagcccctgaatgtgggcgtggcccacgtgatgaggcagcagcccaccagcaccaccagcagcaggaagagcaagcagcaccagagcagccagaggaagaatgtcatcagctgtgtgacagtgcatgacagcccctacagcgacagcagcagcaacaccagcccctacagcgtgcagcagagagctggccacaacaatgccaatgcctttgacaccaagggcagcctggagaaccactgcaccggcaaccccaggaccatcatcgtgccccccctgaagacccaggccagcgaggtgctggtggagtgtgacagcctggtgcccggcaacctgggccctggccagggcaggaacctgagcctggagagcggcttccctgccttcctgctgctggagatgctgctgtatggcagctag

SEQ ID NO: 155539 - DNA, 3597 bp, Artificial Sequence
  Description of Artificial Sequence: Synthetic coding sequence
atggcccctgtgtatgagggcatggccagccacgtgcaggtgttcagcccccacaccctgcagagcagcgccttctgcagcgtgaagaagctgaagattgagcccagcagcaactgggacatgacaggctacggcagccacagcaaggtgtacagccagagcaagaacatccccctgagccagcctgccaccaccaccgtgtccaccagcctgcctgtgcccaaccccagcctgccctatgagcagaccatcgtgtttcctggcagcacaggccacatcgtggtgaccagcgccagcagcacctctgtgacaggccaggtgctgggcggcccccacaacctgatgaggaggagcacagtgtccctgctggacacctaccagaagtgtggcctgaagaggaagtctgaggagattgagaacaccagctctgtgcagatcatcgaggagcacccccccatgatccagaacaatgccagcggggccaccgtggccacagccaccaccagcacagccaccagcaagaacagcggcagcaacagcgagggggactaccagctggtgcagcacgaggtgctgtgcagcatgaccaacacctatgaggtgctggagttcctgggccggggcaccttcggccaggtggtgaagtgctggaagaggggcaccaatgagatcgtggccatcaagatcctgaagaaccaccccagctatgcccggcagggccagatcgaggtgtccatcctggcccggctgagcacagagagcgcagatgactacaactttgtgcgggcctatgagtgcttccagcacaagaaccacacctgcctggtgtttgagatgctggagcagaacctgtatgacttcctgaagcagaacaagttcagccccctgcccctgaagtacatccggcctgtgctgcagcaggtggccacagccctgatgaagctgaagagcctgggcctcatccatgctgacctgaagccagagaacatcatgctggtggaccccagccggcagccctacagagtgaaggtgattgactttggaagtgccagccacgtgtccaaggctgtgtgcagcacctacctgcagagccgctactaccgggcccctgagatcatcctgggcctgcccttctgtgaggccatcgacatgtggagcctgggctgtgtgattgctgagctgttcctgggctggcccctgtacccaggggcctctgaatatgaccagatccgctacatcagccagacccagggcctgcctgctgagtacctgctgtctgctggcaccaagaccacccgcttcttcaacagagacacagacagcccctaccccctgtggaggctgaagaccccagatgaccacgaggccgagaccggcatcaagagcaaggaggccaggaagtacatcttcaactgcctggatgacatggcccaggtgaacatgaccacagacctggagggcagtgacatgctggtggagaaggctgacagaagagagttcatcgacctgctgaagaagatgctgaccattgatgctgacaagaggatcacccccatcgagaccctgaaccacccctttgtgaccatgacccacctgctggacttcccccacagcacccacgtgaagagctgcttccagaacatggagatctgcaagagaagagtgaacatgtatgacacagtgaaccagagcaagacccccttcatcacccacgtggcccccagcaccagcaccaacctgaccatgaccttcaacaaccagctgaccaccgtgcacaaccaggcccccagcagcaccagcgccaccatcagcctggccaaccctgaggtgtccatcctgaactaccccagcaccctgtaccagcccagcgctgcctccatggctgctgtggcccagaggtccatgcccctgcagacaggaacagcccagatctgtgcccggccagaccccttccagcaggccctgattgtgtgccccccaggcttccagggcctgcaggccagccccagcaagcatgctggctacagcgtgaggatggagaatgctgtgcccatcgtgacccaggcccctggggcccagcccctgcagatccagcccggcctgctggcccagcaggcctggcccagcggcacccagcagatcctgctgcccccagcctggcagcagctgactggagtggccacccacacctctgtgcagcacgccaccgtcatccctgagaccatggccggcacccagcagctggccgactggaggaacacccacgcccacggcagccactacaaccccatcatgcagcagcctgccctgctgaccggccacgtgaccctgcctgctgcccagcccctgaatgtgggcgtggcccacgtgatgaggcagcagcccaccagcaccaccagcagcaggaagagcaagcagcaccagagctctgtgagaaatgtgtccacctgtgaggtgagcagcagccaggccatcagcagcccccagaggagcaagagggtgaaggagaacaccccaccccgctgtgccatggtgcacagcagccctgcctgcagcacctctgtgacctgtggctggggagatgtggccagcagcaccacccgggagcggcagaggcagaccatcgtcatcccagacacccccagccccaccgtgtctgtcatcaccatcagcagtgacacagatgaggaggaggagcagaagcacgcccccaccagcacagtgtccaagcagaggaagaatgtcatcagctgtgtgacagtgcatgacagcccctacagcgacagcagcagcaacaccagcccctacagcgtgcagcagagagctggccacaacaatgccaatgcctttgacaccaagggcagcctggagaaccactgcaccggcaaccccaggaccatcatcgtgccccccctgaagacccaggccagcgaggtgctggtggagtgtgacagcctggtgcctgtgaacaccagccaccacagcagcagctacaagagcaagagcagcagcaatgtgaccagcaccagcggccacagcagcggcagcagcagcggggccatcacctaccggcagcagaggcctggcccccacttccagcagcagcagcccctgaacctgagccaggcccagcagcacatcaccacagacagaacaggcagccaccggcggcagcaggcctacatcacccccaccatggcccaggccccctacagcttcccccacaacagccccagccacggcaccgtgcacccccacctggccgctgctgctgctgctgcccacctgcccacccagccccacctgtacacctacacagccccagctgccctgggcagcacaggcaccgtggcccacctggtggccagccagggcagcgcccggcacacagtgcagcacacagcctacccagccagcatcgtgcaccaggtgcctgtgtccatgggcccccgggtgctgcccagccccaccatccaccccagccagtacccagcccagtttgcccaccagacctacatcagcgccagccctgccagcacagtgtacacaggctaccccctgagccctgccaaggtgaaccagtacccctacatctag

SEQ ID NO: 155540 - DNA, 3516 bp, Artificial Sequence
  Description of Artificial Sequence: Synthetic coding sequence
atggcccctgtgtatgagggcatggccagccacgtgcaggtgttcagcccccacaccctgcagagcagcgccttctgcagcgtgaagaagctgaagattgagcccagcagcaactgggacatgacaggctacggcagccacagcaaggtgtacagccagagcaagaacatccccctgagccagcctgccaccaccaccgtgtccaccagcctgcctgtgcccaaccccagcctgccctatgagcagaccatcgtgtttcctggcagcacaggccacatcgtggtgaccagcgccagcagcacctctgtgacaggccaggtgctgggcggcccccacaacctgatgaggaggagcacagtgtccctgctggacacctaccagaagtgtggcctgaagaggaagtctgaggagattgagaacaccagctctgtgcagatcatcgaggagcacccccccatgatccagaacaatgccagcggggccaccgtggccacagccaccaccagcacagccaccagcaagaacagcggcagcaacagcgagggggactaccagctggtgcagcacgaggtgctgtgcagcatgaccaacacctatgaggtgctggagttcctgggccggggcaccttcggccaggtggtgaagtgctggaagaggggcaccaatgagatcgtggccatcaagatcctgaagaaccaccccagctatgcccggcagggccagatcgaggtgtccatcctggcccggctgagcacagagagcgcagatgactacaactttgtgcgggcctatgagtgcttccagcacaagaaccacacctgcctggtgtttgagatgctggagcagaacctgtatgacttcctgaagcagaacaagttcagccccctgcccctgaagtacatccggcctgtgctgcagcaggtggccacagccctgatgaagctgaagagcctgggcctcatccatgctgacctgaagccagagaacatcatgctggtggaccccagccggcagccctacagagtgaaggtgattgactttggaagtgccagccacgtgtccaaggctgtgtgcagcacctacctgcagagccgctactaccgggcccctgagatcatcctgggcctgcccttctgtgaggccatcgacatgtggagcctgggctgtgtgattgctgagctgttcctgggctggcccctgtacccaggggcctctgaatatgaccagatccgctacatcagccagacccagggcctgcctgctgagtacctgctgtctgctggcaccaagaccacccgcttcttcaacagagacacagacagcccctaccccctgtggaggctgaagaccccagatgaccacgaggccgagaccggcatcaagagcaaggaggccaggaagtacatcttcaactgcctggatgacatggcccaggtgaacatgaccacagacctggagggcagtgacatgctggtggagaaggctgacagaagagagttcatcgacctgctgaagaagatgctgaccattgatgctgacaagaggatcacccccatcgagaccctgaaccacccctttgtgaccatgacccacctgctggacttcccccacagcacccacgtgaagagctgcttccagaacatggagatctgcaagagaagagtgaacatgtatgacacagtgaaccagagcaagacccccttcatcacccacgtggcccccagcaccagcaccaacctgaccatgaccttcaacaaccagctgaccaccgtgcacaaccagcccagcgctgcctccatggctgctgtggcccagaggtccatgcccctgcagacaggaacagcccagatctgtgcccggccagaccccttccagcaggccctgattgtgtgccccccaggcttccagggcctgcaggccagccccagcaagcacgccggctacagcgtgaggatggagaatgctgtgcccatcgtgacccaggcccctggggcccagcccctgcagatccagcccggcctgctggcccagcaggcctggcccagcggcacccagcagatcctgctgcccccagcctggcagcagctgactggagtggccacccacacctctgtgcagcacgccaccgtcatccctgagaccatggccggcacccagcagctggccgactggaggaacacccacgcccacggcagccactacaaccccatcatgcagcagcctgccctgctgactggacatgtgaccctgcctgctgcccagcccctgaatgtgggcgtggcccacgtgatgaggcagcagcccaccagcaccaccagcagcaggaagagcaagcagcaccagagctctgtgagaaatgtgtccacctgtgaggtgagcagcagccaggccatcagcagcccccagaggagcaagagggtgaaggagaacaccccaccccgctgtgccatggtgcacagcagccctgcctgcagcacctctgtgacctgtggctggggagatgtggccagcagcaccacccgggagcggcagaggcagaccatcgtcatcccagacacccccagccccaccgtgtctgtcatcaccatcagcagtgacacagatgaggaggaggagcagaagcacgcccccaccagcacagtgtccaagcagaggaagaatgtcatcagctgtgtgacagtgcatgacagcccctacagcgacagcagcagcaacaccagcccctacagcgtgcagcagagagctggccacaacaatgccaatgcctttgacaccaagggcagcctggagaaccactgcaccggcaaccccaggaccatcatcgtgccccccctgaagacccaggccagcgaggtgctggtggagtgtgacagcctggtgcctgtgaacaccagccaccacagcagcagctacaagagcaagagcagcagcaatgtgaccagcaccagcggccacagcagcggcagcagcagcggggccatcacctaccggcagcagaggcctggcccccacttccagcagcagcagcccctgaacctgagccaggcccagcagcacatcaccacagacagaacaggcagccaccggcggcagcaggcctacatcacccccaccatggcccaggccccctacagcttcccccacaacagccccagccatggaacagtgcacccccacctggccgctgctgctgctgctgcccacctgcccacccagccccacctgtacacctacacagccccagctgccctgggcagcactggaacagtggcccacctggtggccagccagggcagcgcccggcacacagtgcagcacacagcctacccagccagcatcgtgcaccaggtgcctgtgtccatgggcccccgggtgctgcccagccccaccatccaccccagccagtacccagcccagtttgcccaccagacctacatcagcgccagccctgccagcacagtgtacacaggctaccccctgagccctgccaaggtgaaccagtacccctacatctag

SEQ ID NO: 155541 - DNA, 3648 bp, Artificial Sequence
  Description of Artificial Sequence: Synthetic coding sequence
atggccagccaggtgctggtgtacccaccctacgtgtaccagacccagagcagcgccttctgcagcgtgaagaagctgaaggtggagcccagcagctgtgtgttccaggagaggaactaccccaggacctacgtgaatggaagaaactttggaaacagccacccccccaccaagggcagcgccttccagaccaagatccccttcaaccggccccggggccacaacttcagcctgcagaccagcgctgtggtgctgaagaacacagctggggccaccaaggtgattgctgcccaggcccagcaggcccacgtgcaggccccccagattggagcctggaggaaccggctgcacttcctggagggcccccagagatgtggcctgaagaggaagtctgaggagctggacaaccacagcagcgccatgcagatcgtggatgagctgagcatcctgcctgccatgctgcagaccaacatgggcaaccctgtgacagtggtgacagccaccaccggcagcaagcagaactgcaccactggagagggggactaccagctggtgcagcacgaggtgctgtgcagcatgaagaacacctatgaggtgctggacttcctgggccggggcaccttcggccaggtggtgaagtgctggaagaggggcaccaatgagatcgtggccatcaagatcctgaagaaccaccccagctatgcccggcagggccagatcgaggtgtccatcctggcccggctgagcacagaaaatgctgatgagtacaactttgtgcgggcctatgagtgcttccagcacaggaaccacacctgcctggtgtttgagatgctggagcagaacctgtatgacttcctgaagcagaacaagttcagccccctgcccctgaaggtgatccggcccatcctgcagcaggtggccacagccctgaagaagctgaagagcctgggcctcatccatgctgacctgaagccagagaacatcatgctggtggaccctgtgcggcagccctacagagtgaaggtgattgactttggaagtgccagccacgtgtccaagacagtgtgcagcacctacctgcagagccgctactaccgggcccctgagatcatcctgggcctgcccttctgtgaggccatcgacatgtggagcctgggctgtgtgattgctgagctgttcctgggctggcccctgtacccaggggccctggagtatgaccagatccgctacatcagccagacccagggcctgcccggggagcagctgctgaatgtgggcaccaagagcacccgcttcttctgcaaggagacagacatgagccacagcggctggaggctgaagaccctggaggagcacgaggccgagaccggcatgaagagcaaggaggccaggaagtacatcttcaacagcctggatgatgtggcccacgtgaacacagtgatggacctggagggcagtgacctgctggccgagaaggctgacagaagagaatttgtgtccctgctgaagaagatgctgctgattgatgctgacctgcgcatcaccccagctgagaccctgaaccacccctttgtgaacatgaagcacctgctggacttcccccacagcaaccacgtgaagagctgcttccacatcatggacatctgcaagagccacctgaacagctgtgacaccaacaaccacaacaagaccagcctgctgcggcctgtggccagcagcagcacagccaccctgacagccaacttcaccaagattggcaccctgcggagccaggccctgaccaccagcgcccacagcgtggtgcaccacggcatccccctgcaggccggcacagcccagtttggctgtggagatgccttccagcagaccctcatcatctgccccccagccatccagggcatcccagccacccacggcaagcccaccagctacagcatccgggtggacaacacagtgcccctggtgacccaggccccagctgtgcagcccctgcagatccggcctggggtgctgagccagacctggagcggccgcacccagcagatgctggtgcctgcctggcagcaggtgacccccctggccccagccaccaccaccctgaccagcgagagcgtggccggcagccaccggctgggggactggggcaagatgatcagctgcagcaaccactacaacagcgtgatgccccagcccctgctgaccaaccagatcaccctgagcgccccccagcctgtgtctgtgggcatcgcccacgtggtgtggccccagcctgccaccaccaagaagaacaagcagtgccagaacagaggcatcctggtgaagctgatggagtgggagcccggccgggaggagatcaatgccttctcctggagcaacagcctgcagaacaccaacatcccccacagcgccttcatcagccccaagatcatcaatggcaaggatgtggaggaggtgtcctgcatcgagacccaggacaaccagaacagcgagggggaggccaggaactgctgtgagaccagcatccggcaggacagcgacagctctgtgtctgacaagcagaggcagaccatcatcatcgctgacagccccagccctgctgtgtctgtcatcaccatcagcagtgacacagatgaggaggagaccagccagaggcacagcctgagagaatgtaaaggcagcctggactgtgaggcctgccagagcaccctgaacatcgacaggatgtgcagcctgagcagcccagacagcaccctgagcaccagcagcagcggccagagcagccccagcccctgcaagaggcccaacagcatgtctgatgaggagcaggagagcagctgtgacacagtggatggcagccccaccagtgacagcagcggccatgacagcccctttgctgagagcacctttgtggaggacacccatgaaaatacagagctggtgagcagcgctgacacagagaccaagccagctgtgtgcagcgtggtggtgccccctgtggagctggagaatggcctgaatgctgatgagcacatggccaacacagacagcatctgccagcccctcatcaagggccgcagcgcccctggccgcctgaaccagcccagcgctgtgggcacccggcagcagaagctgaccagcgccttccagcagcagcacctgaacttcagccaggtgcagcactttggaagtggccaccaggagtggaatggaaactttggccaccggcggcagcaggcctacatccccacctctgtgaccagcaaccccttcaccctgagccacggcagccccaaccacacagctgtgcacgcccacctggccggcaacacccacctgggcggccagcccaccctgctgccctaccccagcagcgccaccctgagcagcgctgcccctgtggcccacctgctggccagcccctgcaccagccggcccatgctgcagcaccccacctacaacatcagccaccccagcggcatcgtgcaccaggtgcctgtgggcctgaacccccggctgctgcccagccccaccatccaccagacccagtacaagcccatcttccccccccacagctacatcgccgccagccctgcctacacaggcttccccctgagccccaccaagctgagccagtacccctacatgtag

SEQ ID NO: 155542 - DNA, 3585 bp, Artificial Sequence
  Description of Artificial Sequence: Synthetic coding sequence
atggccagccaggtgctggtgtacccaccctacgtgtaccagacccagagcagcgccttctgcagcgtgaagaagctgaaggtggagcccagcagctgtgtgttccaggagaggaactaccccaggacctacgtgaatggaagaaactttggaaacagccacccccccaccaagggcagcgccttccagaccaagatccccttcaaccggccccggggccacaacttcagcctgcagaccagcgctgtggtgctgaagaacacagctggggccaccaaggtgattgctgcccaggcccagcaggcccacgtgcaggccccccagattggagcctggaggaaccggctgcacttcctggagggcccccagagatgtggcctgaagaggaagtctgaggagctggacaaccacagcagcgccatgcagatcgtggatgagctgagcatcctgcctgccatgctgcagaccaacatgggcaaccctgtgacagtggtgacagccaccaccggcagcaagcagaactgcaccactggagagggggactaccagctggtgcagcacgaggtgctgtgcagcatgaagaacacctatgaggtgctggacttcctgggccggggcaccttcggccaggtggtgaagtgctggaagaggggcaccaatgagatcgtggccatcaagatcctgaagaaccaccccagctatgcccggcagggccagatcgaggtgtccatcctggcccggctgagcacagaaaatgctgatgagtacaactttgtgcgggcctatgagtgcttccagcacaggaaccacacctgcctggtgtttgagatgctggagcagaacctgtatgacttcctgaagcagaacaagttcagccccctgcccctgaaggtgatccggcccatcctgcagcaggtggccacagccctgaagaagctgaagagcctgggcctcatccatgctgacctgaagccagagaacatcatgctggtggaccctgtgcggcagccctacagagtgaaggtgattgactttggaagtgccagccacgtgtccaagacagtgtgcagcacctacctgcagagccgctactaccgggcccctgagatcatcctgggcctgcccttctgtgaggccatcgacatgtggagcctgggctgtgtgattgctgagctgttcctgggctggcccctgtacccaggggccctggagtatgaccagatccgctacatcagccagacccagggcctgcccggggagcagctgctgaatgtgggcaccaagagcacccgcttcttctgcaaggagacagacatgagccacagcggctggaggctgaagaccctggaggagcacgaggccgagaccggcatgaagagcaaggaggccaggaagtacatcttcaacagcctggatgatgtggcccacgtgaacacagtgatggacctggagggcagtgacctgctggccgagaaggctgacagaagagaatttgtgtccctgctgaagaagatgctgctgattgatgctgacctgcgcatcaccccagctgagaccctgaaccacccctttgtgaacatgaagcacctgctggacttcccccacagcaaccacgtgaagagctgcttccacatcatggacatctgcaagagccacctgaacagctgtgacaccaacaaccacaacaagaccagcctgctgcggcctgtggccagcagcagcacagccaccctgacagccaacttcaccaagattggcaccctgcggagccaggccctgaccaccagcgcccacagcgtggtgcaccacggcatccccctgcaggccggcacagcccagtttggctgtggagatgccttccagcagaccctcatcatctgccccccagccatccagggcatcccagccacccacggcaagcccaccagctacagcatccgggtggacaacacagtgcccctggtgacccaggccccagctgtgcagcccctgcagatccggcctggggtgctgagccagacctggagcggccgcacccagcagatgctggtgcctgcctggcagcaggtgacccccctggccccagccaccaccaccctgaccagcgagagcgtggccggcagccaccggctgggggactggggcaagatgatcagctgcagcaaccactacaacagcgtgatgccccagcccctgctgaccaaccagatcaccctgagcgccccccagcctgtgtctgtgggcatcgcccacgtggtgtggccccagcctgccaccaccaagaagaacaagcagtgccagaacagaagcaacagcctgcagaacaccaacatcccccacagcgccttcatcagccccaagatcatcaacgggaaggatgtggaggaggtgtcctgcatcgagacccaggacaaccagaacagcgagggggaggccaggaactgctgtgagaccagcatccggcaggacagcgacagctctgtgtctgacaagcagaggcagaccatcatcatcgctgacagccccagccctgctgtgtctgtcatcaccatcagcagtgacacagatgaggaggagaccagccagaggcacagcctgcgggagtgcaagggcagcctggactgtgaggcctgccagagcaccctgaacatcgacaggatgtgcagcctgagcagcccagacagcaccctgagcaccagcagcagcggccagagcagccccagcccctgcaagaggcccaacagcatgtctgatgaggagcaggagagcagctgtgacacagtggatggcagccccaccagtgacagcagcggccatgacagcccctttgctgagagcacctttgtggaggacacccatgagaacacagagctggtgtcctctgctgacacagagaccaagccagctgtgtgcagcgtggtggtgccccctgtggagctggagaatggcctgaatgctgatgagcacatggccaacacagacagcatctgccagcccctcatcaagggccgcagcgcccctggccgcctgaaccagcccagcgctgtgggcacccggcagcagaagctgaccagcgccttccagcagcagcacctgaacttcagccaggtgcagcacttcggcagcggccaccaggagtggaatggaaactttggccaccggcggcagcaggcctacatccccacctctgtgaccagcaaccccttcaccctgagccacggcagccccaaccacacagctgtgcacgcccacctggccggcaacacccacctgggcggccagcccaccctgctgccctaccccagcagcgccaccctgagcagcgctgcccctgtggcccacctgctggccagcccctgcaccagccggcccatgctgcagcaccccacctacaacatcagccaccccagcggcatcgtgcaccaggtgcctgtgggcctgaacccccggctgctgcccagccccaccatccaccagacccagtacaagcccatcttccccccccacagctacatcgccgccagccctgcctacacaggcttccccctgagccccaccaagctgagccagtacccctacatgtag

SEQ ID NO: 155543 - DNA, 3585 bp, Artificial Sequence; identical to SEQ ID NO: 155542
  Description of Artificial Sequence: Synthetic coding sequence

SEQ ID NO: 155544 - DNA, 3585 bp, Artificial Sequence; identical to SEQ ID NO: 155542
  Description of Artificial Sequence: Synthetic coding sequence

SEQ ID NO: 155545 - DNA, 231 bp, Artificial Sequence
  Description of Artificial Sequence: Synthetic coding sequence
atggccagccaggtgctggtgtacccaccctacgtgtaccagacccagagcagcgccttctgcagcgtgaagaagctgaaggtggagcccagcagctgtgtgttccaggagaggaactaccccaggacctacgtgaatggaagaaactttggaaacagccacccccccaccaagggcagcgccttccagaccaagatccccttcaaccggccccggggccacaacttctag

SEQ ID NO: 155546 - DNA, 1851 bp, Artificial Sequence
  Description of Artificial Sequence: Synthetic coding sequence
atgagcaccatccagagcgagacagactgctatgacatcatcgaggtgctgggcaagggcaccttcggggaggtggccaagggctggaggaggagcactggagagatggtggccatcaagatcctgaagaatgatgcctacagaaaccgcatcatcaagaatgagctgaagctgctgcactgcatgaggggcctggaccctgaggaggcccacgtgatccgcttcctggagttcttccatgatgccctgaagttctacctggtgtttgagctgctggagcagaacctgtttgagttccagaaggagaacaactttgcccccctgcctgcccggcacatcagaacagtgaccctgcaggtgctgacagccctggcccggctgaaggagctggccatcatccatgctgacctgaagccagagaacatcatgctggtggaccagacccgctgccccttccgggtgaaggtgattgactttggaagtgccagcatcttcagcgaggtgcgctacgtgaaggagccctacatccagagccgcttctaccgggcccctgagatcctgctgggcctgcccttctgtgagaaggtggatgtgtggagcctgggctgtgtgatggccgagctgcacctgggctggcccctgtacccaggcaacaatgaatatgaccaggtgcgctacatctgtgagacccagggcctgcccaagccccacctgctgcatgctgcctgcaaggcccaccacttcttcaagaggaacccccacccagatgctgccaacccctggcagctgaagagcagcgctgactacctggccgagaccaaggtgcggcccctggagaggaggaagtacatgctgaagagcctggaccagattgaaacagtgaatggaggctctgtggccagccggctgaccttcccagaccgggaggccctggccgagcacgccgacctgaagtccatggtggagctgatcaagaggatgctgacctgggagagccatgagcgcatcagccccagcgctgccctgcggcacccctttgtgtccatgcagcagctgcggagcgcccacgagaccacccactactaccagctgagcctgcggagctaccgcctgagcctgcaggtggagggcaagccacccacccctgtggtggccgcagaagatggcaccccctactactgcctggccgaggagaaggaggccgccggcatgggctctgtggccggcagcagccccttcttccgggaggagaaggcccctggcatgcagagggccatcgaccagctggatgacctgagcctgcaggaggccggccacggcctgtggggcgagacctgcaccaatgctgtgtctgacatgatggtgcccctgaaggccgccatcaccggccaccacgtgcctgattctggccctgagcccatcctggccttctacagcagccggctggccggccgccacaaggccaggaagcccccagctggcagcaagagtgacagcaacttcagcaacctgatccggctgagccaggtgtccccagaagatgaccggccctgccggggcagctcctgggaggagggggagcacctgggcgccagcgctgagcccctggccatcctgcagagagatgaagatggccccaacatcgacaacatgaccatggaggccgagaggccagaccctgagctgtttgaccccagcagctgccctggagagtggctgtctgagccagactgcaccctggagagcgtgcggggcccccgggcccagggcctgcccccccggcgcagccaccagcacggcccccccaggggggccaccagcttcctgcagcacgtgacaggccaccactag

SEQ ID NO: 155547 - DNA, 1746 bp, Artificial Sequence
  Description of Artificial Sequence: Synthetic coding sequence
atggtggccatcaagatcctgaagaatgatgcctacagaaaccgcatcatcaagaatgagctgaagctgctgcactgcatgaggggcctggaccctgaggaggcccacgtgatccgcttcctggagttcttccatgatgccctgaagttctacctggtgtttgagctgctggagcagaacctgtttgagttccagaaggagaacaactttgcccccctgcctgcccggcacatcagaacagtgaccctgcaggtgctgacagccctggcccggctgaaggagctggccatcatccacgccgacctgaagccagagaacatcatgctggtggaccagacccgctgccccttccgggtgaaggtgattgactttggcagcgccagcatcttcagcgaggtgcgctacgtgaaggagccctacatccagagccgcttctaccgggcccctgagatcctgctgggcctgcccttctgtgagaaggtggatgtgtggagcctgggctgtgtgatggccgagctgcacctgggctggcccctgtacccaggcaacaatgaatatgaccaggtgcgctacatctgtgagacccagggcctgcccaagccccacctgctgcacgccgcctgcaaggcccaccacttcttcaagaggaacccccacccagatgctgccaacccctggcagctgaagagcagcgctgactacctggccgagaccaaggtgcggcccctggagaggaggaagtacatgctgaagagcctggaccagatcgagaccgtgaatggaggctctgtggccagccggctgaccttcccagaccgggaggccctggccgagcacgccgacctgaagtccatggtggagctgatcaagaggatgctgacctgggagagccatgagcgcatcagccccagcgctgccctgcggcacccctttgtgtccatgcagcagctgcggagcgcccacgagaccacccactactaccagctgagcctgcggagctaccgcctgagcctgcaggtggagggcaagccacccacccctgtggtggccgcagaagatggcaccccctactactgcctggccgaggagaaggaggccgccggcatgggctctgtggccggcagcagccccttcttccgggaggagaaggcccctggcatgcagagggccatcgaccagctggatgacctgagcctgcaggaggccggccacggcctgtggggcgagacctgcaccaatgctgtgtctgacatgatggtgcccctgaaggccgccatcaccggccaccacgtgcctgacagcggccctgagcccatcctggccttctacagcagccggctggccggccgccacaaggccaggaagcccccagctggcagcaagagtgacagcaacttcagcaacctgatccggctgagccaggtgtccccagaagatgaccggccctgccggggcagctcctgggaggagggggagcacctgggcgccagcgctgagcccctggccatcctgcagagagatgaagatggccccaacatcgacaacatgaccatggaggccgagaggccagaccctgagctgtttgaccccagcagctgccctggagagtggctgtctgagccagactgcaccctggagagcgtgcggggcccccgggcccagggcctgcccccaagaagaagccaccagcacggcccccccaggggggccaccagcttcctgcagcacgtgacaggccaccactag

SEQ ID NO: 155548 - DNA, 675 bp, Artificial Sequence
  Description of Artificial Sequence: Synthetic coding sequence
atgggagagcagcccatcttcagcacccgggcccacgtgttccagattgaccccaacaccaagaagaactgggtgcccaccagcaagcatgctgtgacagtgtcctacttctatgacagcaccagaaatgtgtaccgcatcatcagcctggatggcagcaaggccatcatcaacagcaccatcacccccaacatgaccttcaccaagaccagccagaagtttggccagtgggccgacagccgggccaacacagtgtatggcctgggcttcagcagcgagcaccacctgagcaaggtgacagagctggagtgtgtgagcagccaggccaatgctgtgcacacccacaagacagagctgaaccagaccatccaggagctggaggagaccctgaagctgaaggaggaggagattgagcggctgaagcaggagattgacaatgcccgggagctgcaggagcagagggacagcctgacccagaagctgcaggaggtggagatccggaacaaggacctggagggccagctgagtgacctggagcagaggctggagaagagccagaatgagcaggaggccttcaggaacaacctgaagaccctgctggagatcctggatggcaagatctttgagctgacagagctgcgggacaacctggccaagctgctggagtgcagctag

SEQ ID NO: 155549 - DNA, 1065 bp, Artificial Sequence
  Description of Artificial Sequence: Synthetic coding sequence
atgggagagcagcccatcttcagcacccgggcccacgtgttccagattgaccccaacaccaagaagaactgggtgcccaccagcaagcatgctgtgacagtgtcctacttctatgacagcaccagaaatgtgtaccgcatcatcagcctggatggcagcaaggccatcatcaacagcaccatcacccccaacatgaccttcaccaagaccagccagaagtttggccagtgggccgacagccgggccaacacagtgtatggcctgggcttcagcagcgagcaccacctgagcaagtttgctgagaagttccaggagttcaaggaggccgcccggctggccaaggagaagagccaggagaagatggagctgaccagcacccccagccaggagagcgctggaggagacctgcagagccccctgaccccagagagcatcaatggaacagatgatgagaggaccccagatgtgacccagaacagcgagcccagggctgagcccacccagaatgccctgcccttcagccacagcagcgccatcagcaagcactgggaggccgagctggccaccctgaagggcaacaatgccaagctgacagctgccctgctggagagcacagccaacgtgaagcagtggaagcagcagctggccgcctaccaggaggaggccgagcggctgcacaagagggtgacagagctggagtgtgtgagcagccaggccaatgctgtgcacacccacaagacagagctgaaccagaccatccaggagctggaggagaccctgaagctgaaggaggaggagattgagcggctgaagcaggagattgacaatgcccgggagctgcaggagcagagggacagcctgacccagaagctgcaggaggtggagatccggaacaaggacctggagggccagctgagtgacctggagcagaggctggagaagagccagaatgagcaggaggccttcaggaacaacctgaagaccctgctggagatcctggatggcaagatctttgagctgacagagctgcgggacaacctggccaagctgctggagtgcagctag

SEQ ID NO: 155550 - DNA, 534 bp, Artificial Sequence
  Description of Artificial Sequence: Synthetic coding sequence
atgggagagcagcccatcttcagcacccgggcccacgtgttccagattgaccccaacaccaagaagaactgggtgcccaccagcaagcatgctgtgacagtgtcctacttctatgacagcaccagaaatgtgtaccgcatcatcagcctggatggcagcaaggccatcatcaacagcaccatcacccccaacatgaccttcaccaagaccagccagaagtttggccagtgggccgacagccgggccaacacagtgtatggcctgggcttcagcagcgagcaccacctgagcaagtttgctgagaagttccaggagttcaaggaggccgcccggctggccaaggagaagagccaggagaagatggagctgaccagcacccccagccaggagagcgctggaggagacctgcagagccccctgaccccagagagcatcaatggaacagatgatgagaggaccccagatgtgacccagaacagcgagcccagggctgagcccacccagaatgccctgcccttcagccacaggaagtag

SEQ ID NO: 155551 - DNA, 543 bp, Artificial Sequence
  Description of Artificial Sequence: Synthetic coding sequence
atgggcagcgccatcagcaagcactgggaggccgagctggccaccctgaagggcaacaatgccaagctgacagctgccctgctggagagcacagccaacgtgaagcagtggaagcagcagctggccgcctaccaggaggaggccgagcggctgcacaagagggtgacagagctggagtgtgtgagcagccaggccaatgctgtgcacacccacaagacagagctgaaccagaccatccaggagctggaggagaccctgaagctgaaggaggaggagattgagcggctgaagcaggagattgacaatgcccgggagctgcaggagcagagggacagcctgacccagaagctgcaggaggtggagatccggaacaaggacctggagggccagctgagtgacctggagcagaggctggagaagagccagaatgagcaggaggccttcaggaacaacctgaagaccctgctggagatcctggatggcaagatctttgagctgacagagctgcgggacaacctggccaagctgctggagtgcagctag

SEQ ID NO: 155552 - DNA, 1065 bp, Artificial Sequence
  Description of Artificial Sequence: Synthetic coding sequence
atgggagagcagcccatcttcaccacccgggcccacgtgttccagattgaccccaacaccaagaagaactggatgcctgccagcaagcaggccgtgacagtgtcctacttctatgatgtgaccaggaacagctaccgcatcatctctgtggatggagccaaggtgatcatcaacagcaccatcacccccaacatgaccttcaccaagaccagccagaagtttggccagtgggccgacagccgggccaacacagtgtttggcctgggcttcagcagcgagcagcagctgaccaagtttgctgagaagttccaggaggtgaaggaggccgccaagatcgccaaggacaagacccaggagaagattgagaccagcagcaaccacagccaggagagcggccgggagacccccagcagcacccaggccagctctgtgaatggaacagatgatgagaaggccagccatgctggccctgccaacacccacctgaagtcagaaaatgacaagctgaagatcgccctgacccagagcgctgccaacgtgaagaagtgggagattgagctgcagaccctgcgggagagcaatgcccggctgaccacagccctgcaggagagcgctgcctctgtggagcagtggaagaggcagttcagcatctgcagagatgaaaatgaccggctgaggaacaagattgatgagctggaggagcagtgcagcgagatcaaccgggagaaggagaagaacacccagctgaagagaagaattgaggagctggaggccgagctgcgggagaaggagacagagctgaaggacctgaggaagcagagcgagatcatcccccagctgatgtctgaatgtgaatatgtgtctgagaagctggaggccgctgagcgggacaaccagaacctggaggacaaggtgcgcagcctgaagacagacatcgaggagagcaagtaccggcagaggcacctgaaggtggagctgaagagcttcctggaggtgctggatggcaagattgatgacctgcatgacttccggcggggcctgagcaagctgggcacagacaactag

SEQ ID NO: 155553 - DNA, 867 bp, Artificial Sequence
  Description of Artificial Sequence: Synthetic coding sequence
atgggagagcagcccatcttcaccacccgggcccacgtgttccagattgaccccaacaccaagaagaactggatgcctgccagcaagcaggccgtgacagtgtcctacttctatgatgtgaccaggaacagctaccgcatcatctctgtggatggagccaaggtgatcatcaacagcaccatcacccccaacatgaccttcaccaagaccagccagaagtttggccagtgggccgacagccgggccaacacagtgtttggcctgggcttcagcagcgagcagcagctgaccaagtttgctgagaagttccaggaggtgaaggaggccgccaagatcgccaaggacaagacccaggagaagattgagaccagcagcaaccacagccaggccagctctgtgaatggaacagatgatgagaaggccagccacgccggccctgccaacacccacctgaagtcagaaaatgacaagctgaagatcgccctgacccagagcgctgccaacgtgaagaatgagatcaaccgggagaaggagaagaacacccagctgaagagaagaattgaggagctggaggccgagctgcgggagaaggagacagagctgaaggacctgaggaagcagagcgagatcatcccccagctgatgtctgaatgtgaatatgtgtctgagaagctggaggccgctgagcgggacaaccagaacctggaggacaaggtgcgcagcctgaagacagacatcgaggagagcaagtaccggcagaggcacctgaaggtggagctgaagagcttcctggaggtgctggatggcaagattgatgacctgcatgacttccggcggggcctgagcaagctgggcacagacaactag

SEQ ID NO: 155554 - DNA, 900 bp, Artificial Sequence
  Description of Artificial Sequence: Synthetic coding sequence
atgggagagcagcccatcttcaccacccgggcccacgtgttccagattgaccccaacaccaagaagaactggatgcctgccagcaagcaggccgtgacagtgtcctacttctatgatgtgaccaggaacagctaccgcatcatctctgtggatggagccaaggtgatcatcaacagcaccatcacccccaacatgaccttcaccaagaccagccagaagtttggccagtgggccgacagccgggccaacacagtgtttggcctgggcttcagcagcgagcagcagctgaccaagtttgctgagaagttccaggaggtgaaggaggccgccaagatcgccaaggacaagacccaggagaagattgagaccagcagcaaccacagccaggagagcggccgggagacccccagcagcacccaggccagctctgtgaatggaacagatgatgagaaggccagccatgctggccctgccaacacccacctgaagtcagaaaatgacaagctgaagatcgccctgacccagagcgctgccaacgtgaagaatgagatcaaccgggagaaggagaagaacacccagctgaagaggcgcatcgaggagctggaggccgagctgcgggagaaggagacagagctgaaggacctgaggaagcagagcgagatcatcccccagctgatgtctgaatgtgaatatgtgtctgagaagctggaggccgctgagcgggacaaccagaacctggaggacaaggtgcgcagcctgaagacagacatcgaggagagcaagtaccggcagaggcacctgaaggtggagctgaagagcttcctggaggtgctggatggcaagattgatgacctgcatgacttcagaagaggcctgagcaagctgggcacagacaactag

SEQ ID NO: 155555 - DNA, 1032 bp, Artificial Sequence
  Description of Artificial Sequence: Synthetic coding sequence
atgggagagcagcccatcttcaccacccgggcccacgtgttccagattgaccccaacaccaagaagaactggatgcctgccagcaagcaggccgtgacagtgtcctacttctatgatgtgaccaggaacagctaccgcatcatctctgtggatggagccaaggtgatcatcaacagcaccatcacccccaacatgaccttcaccaagaccagccagaagtttggccagtgggccgacagccgggccaacacagtgtttggcctgggcttcagcagcgagcagcagctgaccaagtttgctgagaagttccaggaggtgaaggaggccgccaagatcgccaaggacaagacccaggagaagattgagaccagcagcaaccacagccaggccagctctgtgaatggaacagatgatgagaaggccagccacgccggccctgccaacacccacctgaagtcagaaaatgacaagctgaagatcgccctgacccagagcgctgccaacgtgaagaagtgggagattgagctgcagaccctgcgggagagcaatgcccggctgaccacagccctgcaggagagcgctgcctctgtggagcagtggaagaggcagttcagcatctgcagagatgaaaatgaccggctgaggaacaagattgatgagctggaggagcagtgcagcgagatcaaccgggagaaggagaagaacacccagctgaagaggcgcatcgaggagctggaggccgagctgcgggagaaggagacagagctgaaggacctgaggaagcagagcgagatcatcccccagctgatgtctgaatgtgaatatgtgtctgagaagctggaggccgctgagcgggacaaccagaacctggaggacaaggtgcgcagcctgaagacagacatcgaggagagcaagtaccggcagaggcacctgaaggtggagctgaagagcttcctggaggtgctggatggcaagattgatgacctgcatgacttcagaagaggcctgagcaagctgggcacagacaactag

SEQ ID NO: 155556 - DNA, 15 bp, Artificial Sequence
  Description of Artificial Sequence: Synthetic coding sequence
tgaacagacaactag

SEQ ID NO: 155557 - DNA, 4176 bp, Artificial Sequence
  Description of Artificial Sequence: Synthetic coding sequence
atggctgtggagggcagcaccatcaccagccgcatcaagaacctgctgcggagccccagcatcaagctgcggcgcagcaaggccggcaacagaagagaggacctgagcagcaaggtgaccctggagaaggtgctgggcatcaccgtgtctgggggccggggcctggcctgtgaccccaggagcggcctggtggcctacccagctggctgtgtggtggtgctcttcaaccccaggaagcacaagcagcaccacatcctgaacagcagcaggaagaccatcacagccctggccttctccccagatggcaagtacctggtgactggagagagcggccacatgcctgctgtgcgggtgtgggatgtggccgagcacagccaggtggccgagctgcaggagcacaagtatggagtggcctgtgtggccttcagccccagcgccaagtacatcgtgtctgtgggctaccagcacgacatgattgtgaatgtgtgggcctggaagaagaacatcgtggtggccagcaacaaggtgagcagccgggtgacagctgtgtccttcagcgaggactgcagctactttgtgacagctggcaacagacacatcaagttctggtacctggatgacagcaagaccagcaaggtgaatgccaccgtgcccctgctgggccgcagcggcctgctgggggagctgaggaacaacctcttcacagatgtggcctgtggccggggcaagaaggctgacagcaccttctgcatcaccagcagcggcctgctgtgtgagttcagtgaccggcggctgctggacaagtgggtggagctgcgggtgtacccagaggtgaaggacagcaaccaggcctgcctgccccccagcagcttcatcacctgcagcagtgacaacaccatccggctgtggaacacagagagcagcggcgtgcacggcagcaccctgcacaggaacatcctgagcagtgacctgatcaagatcatctacgtggatggcaacacccaggccctgctggacacagagctgcctggaggagacaaggcagatgccagcctgctggacccccgggtgggcatccgctctgtgtgtgtgagccccaacggccagcacctggccagcggggacaggatgggcaccctgcgggtgcatgagctgcagagcctgtctgagatgctgaaggtggaggcccatgattctgagatcctgtgcctggagtacagcaagccagacaccggcctgaagctgctggccagcgccagccgggacaggctcatccacgtgctggatgctggccgggagtacagcctgcagcagaccctggatgagcacagcagcagcatcacagctgtgaagtttgctgccagtgatggccaggtgaggatgatcagctgtggggctgacaagagcatctacttcagaacagcccagaagtctggagatggagtgcagttcaccaggacccaccacgtggtgaggaagaccaccctgtatgacatggatgtggagcccagctggaagtacacagccatcggctgccaggacaggaacatccgcatcttcaacatcagcagcggcaagcagaagaagctgttcaagggcagccagggagaagatggcaccctcatcaaggtgcagacagaccccagcggcatctacatcgccaccagctgcagcgacaagaacctgagcatctttgacttcagcagtggagaatgtgtggccaccatgtttggccacagcgagatcgtgacaggcatgaagttcagcaatgactgcaagcacctgatctctgtgtctggggacagctgcatctttgtgtggaggctgagcagcgagatgaccatctccatgaggcagaggctggccgagctgcggcagaggcagaggggcggcaagcagcagggccccagcagcccccagagggccagcggccccaacagacaccaggcccccagcatgctgagccctggccctgccctgagcagtgacagcgacaaggagggagaagatgagggcacagaggaggagctgcctgccctgcctgtgctggccaagagcaccaagaaggccctggcctctgtgcccagccctgccctgcccaggagcctgagccactgggagatgagccgggcccaggagagcgtgggcttcctggaccctgccccagctgccaaccctggcccccggcggcggggccgctgggtgcagcccggggtggagctgtctgtgcgctccatgctggacctgcggcagctggagaccctggcccccagcctgcaggaccccagccaggacagcctggccatcatccccagcggccccaggaagcacggccaggaggccctggagaccagcctgaccagccagaatgagaagccaccccggccccaggccagccagccctgcagctacccccacatcatccggctgctgagccaggaggagggcgtgtttgcccaggacctggagcccgcccccattgaagatggcatcgtgtacccagagcccagcgacaaccccaccatggacaccagcgagttccaggtgcaggccccagcccggggcaccctgggccgggtgtacccaggcagccgcagcagcgagaagcacagcccagacagcgcctgcagcgtggactacagcagcagctgcctgagcagccctgagcaccccacagaagattctgagagcacagagcccctgtctgtggatggcatcagcagtgacctggaggagccagcagaaggagatgaggaggaggaggaggaggagggcggcatgggcccctacggcctgcaggagggcagcccccagaccccagaccaggagcagttcctgaagcagcactttgagaccctggccagcggggccgcccctggggcccctgtgcaggtgcctgagaggtctgagagccgcagcatcagcagccgcttcctgctgcaggtgcagacccggcccctgcgggagcccagccccagcagcagcagcctggccctgatgagcaggcctgcccaggtgccccaggccagcggggagcagcccagaggaaatggagccaaccccccaggggcccctcctgaggtggagcccagcagcggcaaccccagcccccagcaggccgcctctgtgctgctgccccgctgccgcctgaacccagacagctcctgggcccccaagagggtggccacagccagccccttcagcggcctgcagaaggcccagagcgtgcacagcctggtgccccaggagagacatgaggccagcctgcaggcccccagccctggggccctgctgagccgggagattgaggcccaggacggcctgggcagcctgcccccagcagatggccggcccagccggccccacagctaccagaaccccaccaccagctccatggccaagatcagccgcagcatctctgtgggggagaacctgggcctggtggccgagccccaggcccacgcccccatccgggtgagccccctgagcaagctggccctgcccagccgggcccacctggtgctggacatccccaagcccctgcctgaccggcccaccctggccgccttcagccctgtgaccaagggccgggcccctggagaggccgagaagccaggcttccctgtgggcctgggcaaggcccacagcaccacagagcgctgggcctgcctgggggagggcaccacccccaagcccaggacagagtgccaggcccaccctggccccagcagcccctgtgcccagcagctgcctgtgagcagcctcttccagggccctgagaacctgcagcccccacctcctgagaagacccccaaccccatggagtgcaccaagccaggagctgccctgagccaggacagcgagcctgctgtgtccctggagcagtgtgagcagctggtggccgagctgcggggctctgtgcggcaggccgtgcggctgtaccacagcgtggccggctgcaagatgcccagcgctgagcagagccgcatcgcccagctgctgcgggacaccttcagctctgtgcggcaggagctggaggccgtggccggggctgtgctgagcagccctggcagcagccctggagctgtgggcgctgagcagacccaggccctgctggagcagtacagcgagctgctgctgcgggctgtggagaggaggatggagaggaagctgtag

SEQ ID NO: 155558 - DNA, 1077 bp, Artificial Sequence
  Description of Artificial Sequence: Synthetic coding sequence
atgagcacagcccgggagcagcccatcttcagcacccgggcccacgtgttccagattgatcctgccaccaagaggaactggatcccagctgggaagcacgccctgactgtgtcctacttctatgatgccaccagaaatgtgtaccgcatcatcagcattggaggagccaaggccatcatcaacagcacagtgacccccaacatgaccttcaccaagaccagccagaagtttggccagtgggccgacagccgggccaacacagtgtatggcctgggctttgccagcgagcagcacctgacccagtttgctgagaagttccaggaggtgaaggaggccgcccggctggcccgggagaagagccaggacggcggggagctgaccagccctgccctgggcctggccagccaccaggtgccccccagccccctggtgtctgccaatggacctggagaggagaagctgttccgcagccagagcgcagatgcccctggccccacagagcgggagcggctgaagaagatgctgtctgagggctctgtgggggaggtgcagtgggaggccgagttctttgccctgcaggacagcaacaacaagctggccggggccctgcgggaggccaatgctgctgctgcccagtggaggcagcagctggaggcccagagagctgaggccgagcggctgcggcagagggtggccgagctggaggcccaggccgccagcgaggtgacccccactggagagaaggagggcctgggccagggccagagcctggagcagctggaggccctggtgcagaccaaggaccaggagatccagaccctgaagagccagacaggaggcccccgggaggccctggaggccgctgagcgggaggagacccagcagaaggtgcagaccagaaatgctgagctggagcaccagctgcgggccatggagaggagcctggaggaggcccgggcagagcgggagcgggcccgggcagaggtgggccgggccgcccagctgctggatgtgtccctgtttgagctgtctgagctgcgggagggcctggcccggctggccgaggccgccccctag

SEQ ID NO: 155559 - DNA, 438 bp, Artificial Sequence
  Description of Artificial Sequence: Synthetic coding sequence
atgagcacagcccgggagcagcccatcttcagcacccgggcccacgtgttccagattgatcctgccaccaagaggaactggatcccagctgggaagcacgccctgactgtgtcctacttctatgatgccaccagaaatgtgtaccgcatcatcagcattggaggagccaaggccatcatcaacagcacagtgacccccaacatgaccttcaccaagaccagccagaagtttggccagtgggccgacagccgggccaacacagtgtatggcctgggctttgccagcgagcagcacctgacccagtttgctgagaagttccaggaggtgaaggaggccgcccggctggcccgggagaagagccaggacggctggggcggcccccagagcgccctggtggtgggcagctttggagctgtgtttgagctgctgattgtgtag

SEQ ID NO: 155560 - DNA, 1086 bp, Artificial Sequence
  Description of Artificial Sequence: Synthetic coding sequence
atgagcacagcccgggagcagcccatcttcagcacccgggcccacgtgttccagattgatcctgccaccaagaggaactggatcccagctgggaagcacgccctgactgtgtcctacttctatgatgccaccagaaatgtgtaccgcatcatcagcattggaggagccaaggccatcatcaacagcacagtgacccccaacatgaccttcaccaagaccagccagaagtttggccagtgggccgacagccgggccaacacagtgtatggcctgggctttgccagcgagcagcacctgacccagtttgctgagaagttccaggaggtgaaggaggccgcccggctggcccgggagaagagccaggacggcggggagctgaccagccctgccctgggcctggccagccaccaggtgccccccagccccctggtgtctgccaatggacctggagaggagaagctgttccgcagccagagcgcagatgcccctggccccacagagcgggagcggctgaagaagatgctgtctgagggctctgtgggggaggtgcagtgggaggccgagttctttgccctgcaggacagcaacaacaagctggccggggccctgcgggaggccaatgctgctgctgcccagtggaggcagcagctggaggcccagagagctgaggccgagcggctgcggcagagggtggccgagctggaggcccaggccgccagcgaggtgacccccactggagagaaggagggcctgggccagggccagagcctggagcagctggaggccctggtgcagaccaaggaccaggagatccagaccctgaagagccagacaggaggcccccgggaggccctggaggccgctgagcgggaggagacccagcagaaggtgcaggacctggagaccagaaatgctgagctggagcaccagctgcgggccatggagaggagcctggaggaggcccgggcagagcgggagcgggcccgggcagaggtgggccgggccgcccagctgctggatgtgtccctgtttgagctgtctgagctgcgggagggcctggcccggctggccgaggccgccccctag

SEQ ID NO: 155561 - DNA, 1077 bp, Artificial Sequence; identical to SEQ ID NO: 155558
  Description of Artificial Sequence: Synthetic coding sequence

SEQ ID NO: 155562 - DNA, 1086 bp, Artificial Sequence; identical to SEQ ID NO: 155560
  Description of Artificial Sequence: Synthetic coding sequence

SEQ ID NO: 155563 - DNA, 1086 bp, Artificial Sequence; identical to SEQ ID NO: 155560
  Description of Artificial Sequence: Synthetic coding sequence

SEQ ID NO: 155564 - DNA, 978 bp, Artificial Sequence; identical to SEQ ID NO: 146592
  Description of Artificial Sequence: Synthetic coding sequence

SEQ ID NO: 155565 - DNA, 1176 bp, Artificial Sequence
  Description of Artificial Sequence: Synthetic coding sequence
atggagagcgagacagagcctgagcctgtgaccctgctggtgaagagccccaaccagaggcaccgggacctggagctgagcggggaccggggctggagcgtgggccacctgaaggcccacctgagccgggtgtacccagagcggcccaggcctgaggaccagaggctcatctacagcggcaagctgctgctggaccaccagtgcctgcgggacctgctgcccaagcaggagaagagacatgtgctgcacctggtgtgcaatgtgaagagccccagcaagatgcctgagatcaatgccaaggtggccgagagcacagaggagcctgctggcagcaacagaggccagtacccagaggacagcagcagtgatggcctgcggcagcgggaggtgctgaggaacctgagcagccctggctgggagaacatcagcaggcctgaggccgcccagcaggccttccagggcctgggccctggcttcagcggctacaccccctacggctggctgcagctgtcctggttccagcagatctatgcccggcagtactacatgcagtacctggccgccacagctgccagcggggcctttgtgcccccacccagcgcccaggagatccctgtggtgtctgccccagccccagcccccatccacaaccagtttcctgctgagaaccagcctgccaaccagaatgctgccccccaggtggtggtgaaccctggggccaaccagaacctgaggatgaatgcccagggcggccccatcgtggaggaggatgatgagatcaacagagactggctggactggacctacagcgctgccaccttctctgtgttcctgagcatcctgtacttctacagcagcctgagccgcttcctgatggtgatgggcgccaccgtggtgatgtacctgcaccacgtgggctggttccccttccggcccaggcctgtgcagaacttccccaatgatggccccccaccagatgtggtgaaccaggaccccaacaacaacctgcaggagggcacagatcctgagacagaggaccccaaccacctgcccccagacagagatgtgctggatggagagcagaccagccccagcttcatgagcacagcctggctggtgttcaagaccttctttgccagcctgctgcctgagggccccccagccatcgccaactag

SEQ ID NO: 155566 - DNA, 699 bp, Artificial Sequence
  Description of Artificial Sequence: Synthetic coding sequence
atggagagcgagacagagcctgagcctgtgaccctgctggtgaagagccccaaccagaggcaccgggacctggagctgagcggggaccggggctggagcgtgggccacctgaaggcccacctgagccgggtgtacccagagcggcccaggcctgaggaccagaggctcatctacagcggcaagctgctgctggaccaccagtgcctgcgggacctgctgcccaaggagaagagacatgtgctgcacctggtgtgcaatgtgaagagccccagcaagatgcctgagatcaatgccaaggtggccgagagcacagaggagcccgccggcagcaacagaggccagtacccagaggacagcagcagtgatggcctgcggcagcgggaggtgctgaggaacctgagcagccctggctgggagaacatcagccgccaccacgtgggctggttccccttccggcccaggcctgtgcagaacttccccaatgatggccccccaccagatgtggtgaaccaggaccccaacaacaacctgcaggagggcacagatcctgagacagaggaccccaaccacctgcccccagacagagatgtgctggatggagagcagaccagccccagcttcatgagcacagcctggctggtgttcaagaccttctttgccagcctgctgcctgagggccccccagccatcgccaactag

SEQ ID NO: 155567 - DNA, 1101 bp, Artificial Sequence
  Description of Artificial Sequence: Synthetic coding sequence
atggagagcgagacagagcctgagcctgtgaccctgctggtgaagagccccaaccagaggcaccgggacctggagctgagcggggaccggggctggagcgtgggccacctgaaggcccacctgagccgggtgtacccagagcggcccaggcctgaggaccagaggctcatctacagcggcaagctgctgctggaccaccagtgcctgcgggacctgctgcccaaggtggccgagagcacagaggagcccgccggcagcaacagaggccagtacccagaggacagcagcagtgatggcctgcggcagcgggaggtgctgaggaacctgagcagccctggctgggagaacatcagcaggcctgaggccgcccagcaggccttccagggcctgggccctggcttcagcggctacaccccctacggctggctgcagctgtcctggttccagcagatctatgcccggcagtactacatgcagtacctggccgccacagctgccagcggggcctttgtgcccccaccttctgcccaggagatccctgtggtgtctgccccagccccagcccccatccacaaccagtttcctgctgagaaccagcctgccaaccagaatgctgccccccaggtggtggtgaaccctggggccaaccagaacctgaggatgaatgcccagggcggccccatcgtggaggaggatgatgagatcaacagagactggctggactggacctacagcgctgccaccttcagcgtcttcctgagcatcctgtacttctacagcagcctgagccgcttcctgatggtgatgggcgccaccgtggtgatgtacctgcaccacgtgggctggttccccttccggcccaggcctgtgcagaacttccccaatgatggccccccaccagatgtggtgaaccaggaccccaacaacaacctgcaggagggcacagatcctgagacagaggaccccaaccacctgcccccagacagagatgtgctggatggagagcagaccagccccagcttcatgagcacagcctggctggtgttcaagaccttctttgccagcctgctgcctgagggccccccagccatcgccaactag

SEQ ID NO: 155568 - DNA, 1173 bp, Artificial Sequence
  Description of Artificial Sequence: Synthetic coding sequence
atggagagcgagacagagcctgagcctgtgaccctgctggtgaagagccccaaccagaggcaccgggacctggagctgagcggggaccggggctggagcgtgggccacctgaaggcccacctgagccgggtgtacccagagcggcccaggcctgaggaccagaggctcatctacagcggcaagctgctgctggaccaccagtgcctgcgggacctgctgcccaaggagaagagacatgtgctgcacctggtgtgcaatgtgaagagccccagcaagatgcctgagatcaatgccaaggtggccgagagcacagaggagcccgccggcagcaacagaggccagtacccagaggacagcagcagtgatggcctgcggcagcgggaggtgctgaggaacctgagcagccctggctgggagaacatcagcaggcctgaggccgcccagcaggccttccagggcctgggccctggcttcagcggctacaccccctacggctggctgcagctgtcctggttccagcagatctatgcccggcagtactacatgcagtacctggccgccacagctgccagcggggcctttgtgcccccaccttctgcccaggagatccctgtggtgtctgccccagccccagcccccatccacaaccagtttcctgctgagaaccagcctgccaaccagaatgctgccccccaggtggtggtgaaccctggggccaaccagaacctgaggatgaatgcccagggcggccccatcgtggaggaggatgatgagatcaacagagactggctggactggacctacagcgctgccaccttcagcgtcttcctgagcatcctgtacttctacagcagcctgagccgcttcctgatggtgatgggcgccaccgtggtgatgtacctgcaccacgtgggctggttccccttccggcccaggcctgtgcagaacttccccaatgatggccccccaccagatgtggtgaaccaggaccccaacaacaacctgcaggagggcacagatcctgagacagaggaccccaaccacctgcccccagacagagatgtgctggatggagagcagaccagccccagcttcatgagcacagcctggctggtgttcaagaccttctttgccagcctgctgcctgagggccccccagccatcgccaactag

SEQ ID NO: 155569 - DNA, 1338 bp, Artificial Sequence
  Description of Artificial Sequence: Synthetic coding sequence
atggccgagctgaagtacatcagcggctttggaaatgaatgttcttctgaggacccccgctgccccggcagcctgcctgagggccagaacaacccccaggtgtgcccctacaacctgtatgcagagcagctgagcggcagcgccttcacctgccccaggagcaccaacaagaggtcctggctgtaccgcatcctgcccagcgtgagccacaagccctttgagagcattgatgagggccaggtgacccacaactgggatgaggtggaccctgaccccaaccagctgcgctggaagccctttgagatccccaaggccagccagaagaaggtggactttgtgtctggcctgcacaccctgtgtggggccggggacatcaagagcaacaacggcctggccatccacatcttcctgtgcaacacctccatggagaaccgctgcttctacaacagtgatggagacttcctgattgtgccccagaagggcaacctgctgatctacacagaatttgggaagatgctggtgcagcccaatgagatctgtgtgatccagaggggcatgaggttcagcattgatgtgtttgaggagacccggggctacatcctggaggtgtatggagtgcactttgagctgcctgacctgggccccatcggggccaacggcctggccaacccccgggacttcctgatccccatcgcctggtatgaagatcggcaggtgcctgggggctacaccgtcatcaacaagtaccagggcaagctgtttgctgccaagcaggatgtgagccccttcaacgtggtggcctggcacggcaactacaccccctacaagtacaacctgaagaacttcatggtgatcaacagcgtggcctttgaccatgctgaccccagcatcttcaccgtgctgacagccaagtctgtgcggcctggggtggccatcgctgactttgtgatcttccccccacgctggggcgtggccgacaagaccttccggcccccctactaccacaggaactgcatgtctgagttcatgggcctcatccggggccactatgaggccaagcagggcggcttcctgcccggcggcggcagcctgcacagcaccatgacccctcatggcccagatgctgactgctttgagaaggccagcaaggtgaagctggcccctgagagaattgctgatggcaccatggccttcatgtttgagagcagcctgagcctggccgtgaccaagtggggcctgaaggccagccgctgcctggatgagaactaccacaagtgctgggagcccctgaagagccacttcacccccaacagcagaaatcctgctgagcccaactag

SEQ ID NO: 155570 - DNA, 2187 bp, Artificial Sequence
  Description of Artificial Sequence: Synthetic coding sequence
atggaggagacccagcccccaccccagcccaagctgcccctgtgtgacagcctgatgatctggctgcagaccttcaacacagccagcccctgccaggatgtgaagcagctgaccagcggcgtggccatggcccaggtgctgcaccagattgatgctgcctggttcaatgaatcctggctgagccgcatcaaggaggatgtgggggacaactggaggatcaaggccagcaatgtgaagaaggtgctgcagggcatcatgagctactaccacgagttcctgggccagcagatcagcgaggccctgatcccagacctgaaccagatcacagagtgcagcgaccctgtggagctgggccgcctgctgcagctgatcctgggctgtgccatcaactgtgagaagaagcaggagcacatccagaacatcatgaccctggaggagagcgtgcagcacgtggtgatgacagccatccaggagctgatgagcaaggagatcctgagcagccccccaaatgatgctgtgggggagctggagcagcagctgaagagggccctggaggagctgcaggaggccctggccgagaaggaggagctgcggcagagatgtgaggagctggacatgcaggtgaccaccctgcaggatgagaagaacagcctggtgtctgaaaatgagatgatgaatgagaagctggaccagctggatggcagctttgatgaccccaacacagtggtggccaagaagtacttccacgcccagctgcagctggagcagctgcaggaggagaacttccggctggaggccgccaaggatgactacagagtgcactgtgaggagctggagaagcagctgattgagttccagcacagaaatgatgagctgaccagcctggccgaggagacccgggccctgaaggatgaaattgatgtgctgcgggccaccagtgacaaggccaacaagctggagagcacagtggagatctaccggcagaagctgcaggacctgaatgacctgaggaagcaggtgaagaccctgcaggagaccaacatgatgtacatgcacaacacagtgtccctggaggaggagctgaagaaggccaatgctgcccggacccagctggagacctacaagaggcaggtgcaggacctgcacgtgaagctgagcagcgagagcaagagagctgacaccctggcctttgagatgaagaggctggaggagaagcatgaggccctgctgaaggagaaggagcggctgattgagcagagggacaccctgaaggagaccaatgaggagctgcgctgcagccaggtgcagcaggaccacctgaaccagacagatgccagcgccaccaagagctatgagaacctggccgctgagatcatgcctgtggagtaccgggaggtgttcatccggctgcagcacgagaacaagatgctgcggctgcagcaggagggctctgaaaatgaaagaattgaggagctgcaggagcagctggagcagaagcacaggaagatgaatgagctggagacagagcagaggctgagcaaggagcgcatccgggagctgcagcagcagatcgaggacctgcagaagagcctgcaggagcagggcagcaagtctgagggggagagcagcagcaagctgaagcagaagctggaggcccacatggagaagctgacagaggtgcatgaggagctgcagaagaagcaggagctgattgaggacctgcagcctgacatcaaccagaatgtgcagaagatcaatgagctggaggccgccctgcagaagaaggatgaggacatgaaggccatggaggagcgctacaagatgtacctggagaaggccagaaatgtcatcaagaccctggaccccaagctgaacccagccagcgctgagatcatgctgctgaggaagcagctggccgagaaggagaggagaattgagatcctggagagcgagtgcaaggtggccaagttccgggactatgaggagaagctgattgtgtctgcctggtacaacaagagcctggccttccagaagctgggcatggagagccggctggtgtctgggggcggggcctgcagcgacacaggagcctgcaccccagcccgctccttcctggcccagcagaggcacatcaccaacaccaggaggaacctgtctgtgaaggtgcctgccaccaccagtgactag

SEQ ID NO: 155571 - DNA, 2061 bp, Artificial Sequence
  Description of Artificial Sequence: Synthetic coding sequence
atggcccaggtgctgcaccagattgatgctgcctggttcaatgaatcctggctgagccgcatcaaggaggatgtgggggacaactggaggatcaaggccagcaatgtgaagaaggtgctgcagggcatcatgagctactaccacgagttcctgggccagcagatcagcgaggccctgatcccagacctgaaccagatcacagagtgcagcgaccctgtggagctgggccgcctgctgcagctgatcctgggctgtgccatcaactgtgagaagaagcaggagcacatccagaacatcatgaccctggaggagagcgtgcagcacgtggtgatgacagccatccaggagctgatgagcaaggagatcctgagcagccccccaaatgatgctgtgggggagctggagcagcagctgaagagggccctggaggagctgcaggaggccctggccgagaaggaggagctgcggcagagatgtgaggagctggacatgcaggtgaccaccctgcaggatgagaagaacagcctggtgtctgaaaatgagatgatgaatgagaagctggaccagctggatggcagctttgatgaccccaacacagtggtggccaagaagtacttccacgcccagctgcagctggagcagctgcaggaggagaacttccggctggaggccgccaaggatgactacagagtgcactgtgaggagctggagaagcagctgattgagttccagcacagaaatgatgagctgaccagcctggccgaggagacccgggccctgaaggatgaaattgatgtgctgcgggccaccagtgacaaggccaacaagctggagagcacagtggagatctaccggcagaagctgcaggacctgaatgacctgaggaagcaggtgaagaccctgcaggagaccaacatgatgtacatgcacaacacagtgtccctggaggaggagctgaagaaggccaatgctgcccggacccagctggagacctacaagaggcaggtgcaggacctgcacgtgaagctgagcagcgagagcaagagagctgacaccctggcctttgagatgaagaggctggaggagaagcatgaggccctgctgaaggagaaggagcggctgattgagcagagggacaccctgaaggagaccaatgaggagctgcgctgcagccaggtgcagcaggaccacctgaaccagacagatgccagcgccaccaagagctatgagaacctggccgctgagatcatgcctgtggagtaccgggaggtgttcatccggctgcagcacgagaacaagatgctgcggctgcagcaggagggctctgaaaatgaaagaattgaggagctgcaggagcagctggagcagaagcacaggaagatgaatgagctggagacagagcagaggctgagcaaggagcgcatccgggagctgcagcagcagatcgaggacctgcagaagagcctgcaggagcagggcagcaagtctgagggggagagcagcagcaagctgaagcagaagctggaggcccacatggagaagctgacagaggtgcatgaggagctgcagaagaagcaggagctgattgaggacctgcagcctgacatcaaccagaatgtgcagaagatcaatgagctggaggccgccctgcagaagaaggatgaggacatgaaggccatggaggagcgctacaagatgtacctggagaaggccagaaatgtcatcaagaccctggaccccaagctgaacccagccagcgctgagatcatgctgctgaggaagcagctggccgagaaggagaggagaattgagatcctggagagcgagtgcaaggtggccaagttccgggactatgaggagaagctgattgtgtctgcctggtacaacaagagcctggccttccagaagctgggcatggagagccggctggtgtctgggggcggggcctgcagcgacacaggagcctgcaccccagcccgctccttcctggcccagcagaggcacatcaccaacaccaggaggaacctgtctgtgaaggtgcctgccaccaccagtgactag

SEQ ID NO: 155572 - DNA, 414 bp, Artificial Sequence
  Description of Artificial Sequence: Synthetic coding sequence
atggaggagacccagcccccaccccagcccaagctgcccctgtgtgacagcctgatgatctggctgcagaccttcaacacagccagcccctgccaggatgtgaagcagctgaccagcggcgtggccatggcccaggtgctgcaccagattgatgctgcctggttcaatgaatcctggctgagccgcatcaaggaggatgtgggggacaactggaggatcaaggccagcaatgtgaagaaggtgctgcagggcatcatgagctactaccacgagttcctgggccagcagatcagcgaggccctgatcccagacctgaaccagatcacagagtgcagcgaccctgtggagctgggccgcctgctgcagctgatcctgggctgtgccatcaactgtgagaagaagcaggagcactag

SEQ ID NO: 155573 - DNA, 2154 bp, Artificial Sequence
  Description of Artificial Sequence: Synthetic coding sequence
atgtctgtggacaaggccgagctgtgtggcagcctgctgacctggctgcagaccttccacgtgcccagcccctgtgccagcccccaggacctgagcagcggcctggccgtggcctacgtgctgaaccagattgaccccagctggttcaatgaggcctggctgcagggcatcagtgaagatcctggccccaactggaagctgaaggtgagcaacctgaagatggtgctgcggagcctggtggagtacagccaggatgtgctggcccaccctgtgtctgaggagcacctgcctgatgtgtccctcatcggggagttcagtgaccctgctgagctgggcaagctgctgcagctggtgctgggctgtgccatcagctgtgagaagaagcaggaccacatccagaggatcatgaccctggaggagagcgtgcagcacgtggtgatggaggccatccaggagctgatgaccaaggacaccccagacagcctgagccctgagacctacggcaactttgacagccagagccgccgctactacttcctgtctgaggaggccgaggagggagatgagctgcagcagcgctgcctggacctggagcggcagctgatgctgctgtctgaggagaagcagagcctggcccaggagaatgccggcctgcgggagaggatgggccggcctgagggggagggcaccccaggcctgacagccaagaagctgctgctgctgcagagccagctggagcagctgcaggaggagaacttccggctggagagcggccgggaggatgagcggctgcgctgtgccgagctggagcgggaggtggccgagctgcagcacaggaaccaggccctgaccagcctggcccaggaggcccaggccctgaaggatgagatggatgagctgcggcagagcagcgagagagctggccagctggaggccaccctgaccagctgcagaagaaggctgggggagctgcgggagctgcggcggcaggtgcggcagctggaggagagaaatgccggccacgccgagaggacccggcagctggaggatgagctgcggcgggccggcagcctgcgggcccagctggaggcccagaggcggcaggtgcaggagctgcagggccagaggcaggaggaggccatgaaggccgagaagtggctgtttgaatgtagaaacctggaggagaagtatgaatctgtgaccaaggagaaggagcggctgctggccgagcgggacagcctgcgggaggccaatgaggagctgcgctgtgcccagctgcagccccggggcctgacccaggccgaccccagcctggaccccaccagcacccctgtggacaacctggccgctgagatcctgcctgctgagctgcgggagaccctgctgcggctgcagctggagaacaagaggctgtgccggcaggaggccgctgaccgggagcggcaggaggagctgcagaggcacctggaggatgccaacagagcccggcacggcctggagacccagcaccggctgaaccagcagcagctgtctgagctgcgggcccaggtggaggacctgcagaaggccctgcaggagcagggcggcaagacagaggacagcatcctgctgaagaggaagctggaggagcacctgcagaagctgcatgaagctgacctggagctgcagaggaagcgggagtacatcgaggagctggagcccccaacagacagcagcacagccaggagaattgaggagctgcagcacaacctgcagaagaaggatgctgacctgcgggccatggaggagcgctacagaagatatgtggacaaggccaggatggtgatgcagaccatggagcccaagcagaggcctgctgctggggcccctcctgagctgcacagcctgcggacccagctgcgggagagagatgtgcgcatccgccacctggagatggactttgagaagagccgcagccagcgggagcaggaggagaagctgctgatcagcgcctggtacaacatgggcatggccctgcagcagagagctggggaggagcgggccccagcccacgcccagagcttcctggcccagcagaggctggccaccaacagcagaagaggccccctgggccgcctggccagcctgaacctgcggcccacagacaagcactag

SEQ ID NO: 155574 - DNA, 2160 bp, Artificial Sequence
  Description of Artificial Sequence: Synthetic coding sequence
atgtctgtggacaaggccgagctgtgtggcagcctgctgacctggctgcagaccttccacgtgcccagcccctgtgccagcccccaggacctgagcagcggcctggccgtggcctacgtgctgaaccagattgaccccagctggttcaatgaggcctggctgcagggcatcagtgaagatcctggccccaactggaagctgaaggtgagcaacctgaagatggtgctgcggagcctggtggagtacagccaggatgtgctggcccaccctgtgtctgaggagcacctgcctgatgtgtccctcatcggggagttcagtgaccctgctgagctgggcaagctgctgcagctggtgctgggctgtgccatcagctgtgagaagaagcaggaccacatccagaggatcatgaccctggaggagagcgtgcagcacgtggtgatggaggccatccaggagctgatgaccaaggacaccccagacagcctgagccctgagacctacggcaactttgacagccagagccgccgctactacttcctgtctgaggaggccgaggagggagatgagctgcagcagcgctgcctggacctggagcggcagctgatgctgctgtctgaggagaagcagagcctggcccaggagaatgccggcctgcgggagaggatgggccggcctgagggggagggcaccccaggcctgacagccaagaagctgctgctgctgcagagccagctggagcagctgcaggaggagaacttccggctggagagcggccgggaggatgagcggctgcgctgtgccgagctggagcgggaggtggccgagctgcagcacaggaaccaggccctgaccagcctggcccaggaggcccaggccctgaaggatgagatggatgagctgcggcagagcagcgagagagctggccagctggaggccaccctgaccagctgcagaagaaggctgggggagctgcgggagctgcggcggcaggtgcggcagctggaggagagaaatgccggccacgccgagaggacccggcagctggaggatgagctgcggcgggccggcagcctgcgggcccagctggaggcccagaggcggcaggtgcaggagctgcagggccagaggcaggaggaggccatgaaggccgagaagtggctgtttgaatgtagaaacctggaggagaagtatgaatctgtgaccaaggagaaggagcggctgctggccgagcgggacagcctgcgggaggccaatgaggagctgcgctgtgcccagctgcagccccggggcctgacccaggccgaccccagcctggaccccaccagcacccctgtggacaacctggccgctgagatcctgcctgctgagctgcgggagaccctgctgcggctgcagctggagaacaagaggctgtgccggcaggaggccgctgaccgggagcggcaggaggagctgcagaggcacctggaggatgccaacagagcccggcacggcctggagacccagcaccggctgaaccagcagcagctgtctgagctgcgggcccaggtggaggacctgcagaaggccctgcaggagcagggcggcaagacagaagatgccatcagcatcctgctgaagaggaagctggaggagcacctgcagaagctgcatgaagctgacctggagctgcagaggaagcgggagtacatcgaggagctggagcccccaacagacagcagcacagccaggagaattgaggagctgcagcacaacctgcagaagaaggatgctgacctgcgggccatggaggagcgctacagaagatatgtggacaaggccaggatggtgatgcagaccatggagcccaagcagaggcctgctgctggggcccctcctgagctgcacagcctgcggacccagctgcgggagagagatgtgcgcatccgccacctggagatggactttgagaagagccgcagccagcgggagcaggaggagaagctgctgatcagcgcctggtacaacatgggcatggccctgcagcagagagctggggaggagcgggccccagcccacgcccagagcttcctggcccagcagaggctggccaccaacagcagaagaggccccctgggccgcctggccagcctgaacctgcggcccacagacaagcactag

SEQ ID NO: 155575 - DNA, 2157 bp, Artificial Sequence
  Description of Artificial Sequence: Synthetic coding sequence
atgttttctgtggagagcctggagcgggcagagctgtgtgagagcctgctgacctggatccagaccttcaacgtggatgccccctgccagacagtggaggacctgaccaatggagtggtgatggcccaggtgctgcagaagattgatcctgcctactttgatgagaactggctgaaccgcatcaagacagaggtgggggacaactggaggctgaagatcagcaacctgaagaagatcctgaagggcatcctggactacaaccacgagatcctgggccagcagatcaatgacttcaccctgcctgatgtgaacctgattggagagcacagtgatgctgctgagctgggccgcatgctgcagctgatcctgggctgtgctgtgaactgtgagcagaagcaggagtacatccaggccatcatgatgatggaggagagcgtgcagcacgtggtgatgacagccatccaggagctgatgagcaaggagagccctgtgtctgctggaaatgatgcctacgtggacctggaccggcagctgaagaagaccacagaggagctgaatgaggccctgagcgccaaggaggagatcgcccagcgctgccacgagctggacatgcaggtggccgccctgcaggaggagaagagcagcctgctggccgagaaccaggtgctgatggagcggctgaaccagagcgacagcattgaggaccccaacagccctgctggccgccgccacctgcagctgcagacccagctggagcagctgcaggaggagaccttccggctggaggccgccaaggatgactaccgcatccgctgtgaggagctggagaaggagatcagcgagctgcggcagcagaatgatgagctgaccaccctggctgatgaggcccagagcctgaaggatgaaattgatgtgctgcggcacagcagtgacaaggtgtccaagctggagggccaggtggagagctacaagaagaagctggaggacctgggggacctgcggcggcaggtgaagctgctggaggagaagaacaccatgtacatgcagaacacagtgtccctggaggaggagctgaggaaggccaatgctgcccggagccagctggagacctacaagaggcaggtggtggagctgcagaaccggctgtctgaggagagcaagaaggctgacaagctggactttgagtacaagaggctgaaggagaaggtggacagcctgcagaaggagaaggaccggctgaggacagagcgggacagcctgaaggagaccatcgaggagctgcgctgtgtgcaggcccaggagggccagctgaccacccagggcctgatgcccctgggcagccaggagagcagtgacagcctggccgctgagatcgtgaccccagagatccgggagaagctgatccggctgcagcacgagaacaagatgctgaagctgaaccaggagggcagtgacaatgagaagatcgccctgctgcagagcctgctggatgatgccaacctgaggaagaatgagctggagacagaaaatcggctggtgaaccagaggctgctggaggtgcagagccaggtggaggagctgcagaagagcctgcaggaccagggcagcaaggcagaagattctgtgctgctgaagaagaagctggaggagcacctggagaagctgcacgaggccaacaatgagctgcagaagaagagggccatcatcgaggacctggagccccgcttcaacaacagcagcctgaagattgaggagctgcaggaggccctgaggaagaaggaggaggagatgaagcagatggaggagcgctacaagaagtacctggagaaggccaagagcgtcatccgcaccctggaccccaagcagaaccagggcgccgcccctgagatccaggccctgaagaaccagctgcaggagcgggacaggctcttccacagcctggagaaggagtatgagaagaccaagagccagcgggagatggaggagaagtacatcgtgtctgcctggtacaacatgggcatgaccctgcacaagaaggctgctgaggaccggctggccagcacaggcagcggccagagcttcctggcccggcagaggcaggccaccagcagcagaagaagctacccaggccacgtgcagcctgccacagccaggtag

SEQ ID NO: 155576 - DNA, 222 bp, Artificial Sequence
  Description of Artificial Sequence: Synthetic coding sequence
atgtctgctgagacagccagcggccccacagaggaccaggtggagatcctggagtacaacttcaacaaggtggacaagcacccagacagcaccaccctgtgcctgattgctgctgaggccggcctgtctgaggaggagacccagaagtggttcaagcagaggctggccaagtggaggagaagtgagggcctgcccagtgaatgtagatctgtgacagactag

SEQ ID NO: 155577 - DNA, 222 bp, Artificial Sequence; identical to SEQ ID NO: 155576
  Description of Artificial Sequence: Synthetic coding sequence

SEQ ID NO: 155578 - DNA, 222 bp, Artificial Sequence; identical to SEQ ID NO: 155576
  Description of Artificial Sequence: Synthetic coding sequence

SEQ ID NO: 155579 - DNA, 285 bp, Artificial Sequence
  Description of Artificial Sequence: Synthetic coding sequence
atgtctgctgagacagccagcggccccacagaggaccaggtggagatcctggagtacaacttcaacaaggtggacaagcacccagacagcaccaccctgtgcctgattgctgctgaggccggcctgtctgaggaggagacccagggcagtgacctgatcagccgcagcaagatctggcaccctgagagcagcccccagcgggagggctacccccatgacagcctgccctgcctggcctttgactacttcagcctgctgcccccccagtgcaaggagatggtgtag

SEQ ID NO: 155580 - DNA, 276 bp, Artificial Sequence
  Description of Artificial Sequence: Synthetic coding sequence
atgctgatcttcctgggctgctacagaagaaggctggaggagcgggccggcaccatgtctgctgagacagccagcggccccacagaggaccaggtggagatcctggagtacaacttcaacaaggtggacaagcacccagacagcaccaccctgtgcctgattgctgctgaggccggcctgtctgaggaggagacccagaagtggttcaagcagaggctggccaagtggaggagaagtgagggcctgcccagtgaatgtagatctgtgacagactag

SEQ ID NO: 155581 - DNA, 222 bp, Artificial Sequence; identical to SEQ ID NO: 155576
  Description of Artificial Sequence: Synthetic coding sequence

SEQ ID NO: 155582 - DNA, 285 bp, Artificial Sequence; identical to SEQ ID NO: 155579
  Description of Artificial Sequence: Synthetic coding sequence

SEQ ID NO: 155583 - DNA, 222 bp, Artificial Sequence; identical to SEQ ID NO: 155576
  Description of Artificial Sequence: Synthetic coding sequence

SEQ ID NO: 155584 - DNA, 276 bp, Artificial Sequence; identical to SEQ ID NO: 155580
  Description of Artificial Sequence: Synthetic coding sequence

SEQ ID NO: 155585 - DNA, 285 bp, Artificial Sequence; identical to SEQ ID NO: 155579
  Description of Artificial Sequence: Synthetic coding sequence

SEQ ID NO: 155586 - DNA, 222 bp, Artificial Sequence; identical to SEQ ID NO: 155576
  Description of Artificial Sequence: Synthetic coding sequence

SEQ ID NO: 155587 - DNA, 222 bp, Artificial Sequence; identical to SEQ ID NO: 155576
  Description of Artificial Sequence: Synthetic coding sequence

SEQ ID NO: 155588 - DNA, 339 bp, Artificial Sequence
  Description of Artificial Sequence: Synthetic coding sequence
atgctgatcttcctgggctgctacagaagaaggctggaggagcgggccggcaccatgtctgctgagacagccagcggccccacagaggaccaggtggagatcctggagtacaacttcaacaaggtggacaagcacccagacagcaccaccctgtgcctgattgctgctgaggccggcctgtctgaggaggagacccagggcagtgacctgatcagccgcagcaagatctggcaccctgagagcagcccccagcgggagggctacccccatgacagcctgccctgcctggcctttgactacttcagcctgctgcccccccagtgcaaggagatggtgtag

SEQ ID NO: 155589 - DNA, 222 bp, Artificial Sequence; identical to SEQ ID NO: 155576
  Description of Artificial Sequence: Synthetic coding sequence

SEQ ID NO: 155590 - DNA, 222 bp, Artificial Sequence; identical to SEQ ID NO: 155576
  Description of Artificial Sequence: Synthetic coding sequence

SEQ ID NO: 155591 - DNA, 222 bp, Artificial Sequence; identical to SEQ ID NO: 155576
  Description of Artificial Sequence: Synthetic coding sequence

SEQ ID NO: 155592 - DNA, 144 bp, Artificial Sequence
  Description of Artificial Sequence: Synthetic coding sequence
atgtctgctgagacagccagcggccccacagaggaccaggtggagatcctggagtacaacttcaacaaggtggacaagcacccagacagcaccaccctgtgcctgattgctgctgaggccggcctgtctgaggaggagacctag

SEQ ID NO: 155593 - DNA, 1164 bp, Artificial Sequence
  Description of Artificial Sequence: Synthetic coding sequence
atggccacagcccagctgcagaggacccccatgtctgccctggtgttccccaacaagatcagcacagagcaccagagcctggtgctggtgaagaggctgctggccgtgtctgtgtcctgcatcacctacctgcggggcatcttcccagaatgtgcctacggcacccgctacctggatgacctgtgtgtgaagatcctgcgggaggacaagaactgccccggcagcacccagctggtgaagtggatgctgggctgctatgatgccctgcagaagaagtatgtgtacaccaaccctgaggacccccagaccatcagcgagtgctaccagttcaagttcaagtacaccaacaacggccccctgatggacttcatcagcaagaaccagagcaatgaaagctccatgctgagcacagacaccaagaaggccagcatcctgctgatcaggaagatctacatcctgatgcagaacctgggccccctgcccaatgatgtgtgcctgaccatgaagctgttctactatgatgaggtgaccccaccagactaccagcccccaggcttcaaggatggagactgtgaaggagtcatctttgaaggagagcccatgtacctgaatgtgggggaggtgtccacccccttccacatcttcaaggtgaaggtgaccacagagcgggagaggatggagaacatcgacagcaccatcctgagccccaagcagatcaagacccccttccagaagatcctgcgggacaaggatgtggaggatgagcaggagcactacaccagtgatgacctggacatcgagaccaagatggaggagcaggagaagaacccagccagcagcgagctggaggagcccagcctggtgtgtgaagaagatgagatcatgaggagcaaggagagcccagacctgagcatcagccacagccaggtggagcagctggtgaacaagaccagcgagctggacatgtctgagagcaagaccaggtctgggaaggtgttccagaacaagatggccaatggaaaccagcctgtgaagagcagcaaagaaaataggaagaggagccagcacgagagcggcagaattgtgctgcaccactttgacagcagcagccaggagagcgtgcccaagaggaggaagttcagcgagcccaaggagcacatctag

SEQ ID NO: 155594 - DNA, 1185 bp, Artificial Sequence
  Description of Artificial Sequence: Synthetic coding sequence
atggccacagcccagctgcagaggacccccatgtctgccctggtgttccccaacaagatcagcacagagcaccagagcctggtgctggtgaagaggctgctggccgtgtctgtgtcctgcatcacctacctgcggggcatcttcccagaatgtgcctacggcacccgctacctggatgacctgtgtgtgaagatcctgcgggaggacaagaactgccccggcagcacccagctggtgaagtggatgctgggctgctatgatgccctgcagaagaagtacctgaggatggtggtgctggccgtgtacaccaaccctgaggacccccagaccatcagcgagtgctaccagttcaagttcaagtacaccaacaacggccccctgatggacttcatcagcaagaaccagagcaatgaaagctccatgctgagcacagacaccaagaaggccagcatcctgctgatcaggaagatctacatcctgatgcagaacctgggccccctgcccaatgatgtgtgcctgaccatgaagctgttctactatgatgaggtgaccccaccagactaccagcccccaggcttcaaggatggagactgtgagggcgtcatctttgaaggagagcccatgtacctgaatgtgggggaggtgtccacccccttccacatcttcaaggtgaaggtgaccacagagcgggagaggatggagaacatcgacagcaccatcctgagccccaagcagatcaagacccccttccagaagatcctgcgggacaaggatgtggaggatgagcaggagcactacaccagtgatgacctggacatcgagaccaagatggaggagcaggagaagaacccagccagcagcgagctggaggagcccagcctggtgtgtgaggaggatgagatcatgaggagcaaggagagcccagacctgagcatcagccacagccaggtggagcagctggtgaacaagaccagcgagctggacatgtctgagagcaagaccaggtctgggaaggtgttccagaacaagatggccaacggcaaccagcctgtgaagagcagcaaggagaacaggaagaggagccagcatgaaagtggccgcatcgtgctgcaccactttgacagcagcagccaggagagcgtgcccaagaggaggaagttcagcgagcccaaggagcacatctag

SEQ ID NO: 155595 - DNA, 573 bp, Artificial Sequence
  Description of Artificial Sequence: Synthetic coding sequence
atgaggctgtggaacaagatcagccgctggatgctgggctgctatgatgccctgcagaagaagtacctgaggatggtggtgctggccgtgtacaccaaccctgaggacccccagaccatcagcgagtgctaccagttcaagttcaagtacaccaacaacggccccctgatggacttcatcagcaagaaccagagcaatgaaagctccatgctgagcacagacaccaagaaggccagcatcctgctgatcaggaagatctacatcctgatgcagaacctgggccccctgcccaatgatgtgtgcctgaccatgaagctgttctactatgatgaggtgaccccaccagactaccagcccccaggcttcaaggatggagactgtgaaggagtcatctttgaaggagagcccatgtacctgaatgtgggggaggtgtccacccccttccacatcttcaaggtgaaggtgaccacagagcgggagaggatggagaacatcgacagcaccatcctgagccccaagcagatcaagacccccttccagaagatcctgcgggacaaggatgtggaggactag

SEQ ID NO: 155596 - DNA, 972 bp, Artificial Sequence
  Description of Artificial Sequence: Synthetic coding sequence
atgaggctgtggaacaagatcagccgctggatgctgggctgctatgatgccctgcagaagaagtacctgaagatcatggagctgactgtgtacaccaaccctgaggacccccagaccatcagcgagtgctaccagttcaagttcaagtacaccaacaacggccccctgatggacttcatcagcaagaaccagagcaatgaaagctccatgctgagcacagacaccaagaaggccagcatcctgctgatcaggaagatctacatcctgatgcagaacctgggccccctgcccaatgatgtgtgcctgaccatgaagctgttctactatgatgaggtgaccccaccagactaccagcccccaggcttcaaggatggagactgtgaaggagtcatctttgaaggagagcccatgtacctgaatgtgggggaggtgtccacccccttccacatcttcaaggtgaaggtgaccacagagcgggagaggatggagaacatcgacagcaccatcctgagccccaagcagatcaagacccccttccagaagatcctgcgggacaaggatgtggaggatgagcaggagcactacaccagtgatgacctggacatcgagaccaagatggaggagcaggagaagaacccagccagcagcgagctggaggagcccagcctggtgtgtgaagaagatgagatcatgaggagcaaggagagcccagacctgagcatcagccacagccaggtggagcagctggtgaacaagaccagcgagctggacatgtctgagagcaagaccaggtctgggaaggtgttccagaacaagatggccaatggaaaccagcctgtgaagagcagcaaagaaaataggaagaggagccagcacgagagcggcagaattgtgctgcaccactttgacagcagcagccaggagagcgtgcccaagaggaggaagttcagcgagcccaaggagcacatctag

SEQ ID NO: 155597 - DNA, 1185 bp, Artificial Sequence
  Description of Artificial Sequence: Synthetic coding sequence
atggccacagcccagctgcagaggacccccatgtctgccctggtgttccccaacaagatcagcacagagcaccagagcctggtgctggtgaagaggctgctggccgtgtctgtgtcctgcatcacctacctgcggggcatcttcccagaatgtgcctacggcacccgctacctggatgacctgtgtgtgaagatcctgcgggaggacaagaactgccccggcagcacccagctggtgaagtggatgctgggctgctatgatgccctgcagaagaagtacctgaagatcatggagctgactgtgtacaccaaccctgaggacccccagaccatcagcgagtgctaccagttcaagttcaagtacaccaacaacggccccctgatggacttcatcagcaagaaccagagcaatgaaagctccatgctgagcacagacaccaagaaggccagcatcctgctgatcaggaagatctacatcctgatgcagaacctgggccccctgcccaatgatgtgtgcctgaccatgaagctgttctactatgatgaggtgaccccaccagactaccagcccccaggcttcaaggatggagactgtgagggcgtcatctttgaaggagagcccatgtacctgaatgtgggggaggtgtccacccccttccacatcttcaaggtgaaggtgaccacagagcgggagaggatggagaacatcgacagcaccatcctgagccccaagcagatcaagacccccttccagaagatcctgcgggacaaggatgtggaggatgagcaggagcactacaccagtgatgacctggacatcgagaccaagatggaggagcaggagaagaacccagccagcagcgagctggaggagcccagcctggtgtgtgaggaggatgagatcatgaggagcaaggagagcccagacctgagcatcagccacagccaggtggagcagctggtgaacaagaccagcgagctggacatgtctgagagcaagaccaggtctgggaaggtgttccagaacaagatggccaacggcaaccagcctgtgaagagcagcaaggagaacaggaagaggagccagcatgaaagtggccgcatcgtgctgcaccactttgacagcagcagccaggagagcgtgcccaagaggaggaagttcagcgagcccaaggagcacatctag

SEQ ID NO: 155598 - DNA, 945 bp, Artificial Sequence
  Description of Artificial Sequence: Synthetic coding sequence
atgaggctgtggaacaagatcagccgctggatgctgggctgctatgatgccctgcagaagaagtacctgaggatggtggtgctggccaccatcagcgagtgctaccagttcaagttcaagtacaccaacaacggccccctgatggacttcatcagcaagaaccagagcaatgaaagctccatgctgagcacagacaccaagaaggccagcatcctgctgatcaggaagatctacatcctgatgcagaacctgggccccctgcccaatgatgtgtgcctgaccatgaagctgttctactatgatgaggtgaccccaccagactaccagcccccaggcttcaaggatggagactgtgagggcgtcatctttgaaggagagcccatgtacctgaatgtgggggaggtgtccacccccttccacatcttcaaggtgaaggtgaccacagagcgggagaggatggagaacatcgacagcaccatcctgagccccaagcagatcaagacccccttccagaagatcctgcgggacaaggatgtggaggatgagcaggagcactacaccagtgatgacctggacatcgagaccaagatggaggagcaggagaagaacccagccagcagcgagctggaggagcccagcctggtgtgtgaggaggatgagatcatgaggagcaaggagagcccagacctgagcatcagccacagccaggtggagcagctggtgaacaagaccagcgagctggacatgtctgagagcaagaccaggtctgggaaggtgttccagaacaagatggccaacggcaaccagcctgtgaagagcagcaaggagaacaggaagaggagccagcatgaaagtggccgcatcgtgctgcaccactttgacagcagcagccaggagagcgtgcccaagaggaggaagttcagcgagcccaaggagcacatctag

SEQ ID NO: 155599 - DNA, 495 bp, Artificial Sequence
  Description of Artificial Sequence: Synthetic coding sequence
atgaggctgtggaacaagatcagccgctggatgctgggctgctatgatgccctgcagaagaagtatgtgtacaccaaccctgaggacccccagaccatcagcgagtgctaccagttcaagttcaagtacaccaacaacggccccctgatggacttcatcagcaagaaccagagcaatgaaagctccatgctgagcacagacaccaagaaggccagcatcctgctgatcaggaagatctacatcctgatgcagaacctgggccccctgcccaatgatgtgtgcctgaccatgaagctgttctactatgatgaggtgaccccaccagactaccagcccccaggcttcaaggatggagactgtgagggcgtcatctttgaaggagagcccatgtacctgaatgtgggggaggtgtccacccccttccacatcttcaaggtgaaggtgaccacagagcgggagaggatggagaacatcgacagcaccatcctgtcctag

SEQ ID NO: 155600 - DNA, 945 bp, Artificial Sequence
  Description of Artificial Sequence: Synthetic coding sequence
atgaggctgtggaacaagatcagccgctggatgctgggctgctatgatgccctgcagaagaagtacctgcgctacttcctgttcaagaccatcagcgagtgctaccagttcaagttcaagtacaccaacaacggccccctgatggacttcatcagcaagaaccagagcaatgaaagctccatgctgagcacagacaccaagaaggccagcatcctgctgatcaggaagatctacatcctgatgcagaacctgggccccctgcccaatgatgtgtgcctgaccatgaagctgttctactatgatgaggtgaccccaccagactaccagcccccaggcttcaaggatggagactgtgagggcgtcatctttgaaggagagcccatgtacctgaatgtgggggaggtgtccacccccttccacatcttcaaggtgaaggtgaccacagagcgggagaggatggagaacatcgacagcaccatcctgagccccaagcagatcaagacccccttccagaagatcctgcgggacaaggatgtggaggatgagcaggagcactacaccagtgatgacctggacatcgagaccaagatggaggagcaggagaagaacccagccagcagcgagctggaggagcccagcctggtgtgtgaggaggatgagatcatgaggagcaaggagagcccagacctgagcatcagccacagccaggtggagcagctggtgaacaagaccagcgagctggacatgtctgagagcaagaccaggtctgggaaggtgttccagaacaagatggccaacggcaaccagcctgtgaagagcagcaaggagaacaggaagaggagccagcatgaaagtggccgcatcgtgctgcaccactttgacagcagcagccaggagagcgtgcccaagaggaggaagttcagcgagcccaaggagcacatctag

SEQ ID NO: 155601 - DNA, 6108 bp, Artificial Sequence
  Description of Artificial Sequence: Synthetic coding sequence
atggccagcgctgtgtccccagccaacctgcctgctgtgctgctgcagccccgctggaagagggtggtgggctggagcggccctgtgccccggcccaggcatggccacagagctgtggccatcaaggagctgattgtggtgtttggaggcggcaatgaaggaattgtggatgagctgcacgtgtacaacacagccaccaaccagtggttcatcccagctgtgcggggggacatccccccaggctgtgccgcctacggctttgtgtgtgatggcacccggctgctggtgtttggaggcatggtggagtatggcaagtacagcaatgacctgtatgagctgcaggccagccgctgggagtggaagaggctgaaggccaagacccccaagaatggccccccaccctgcccccggctgggccacagcttcagcctggtgggcaacaagtgctacctgtttggaggcctggccaatgattctgaggaccccaagaacaacatcccccgctacctgaatgacctgtacatcctggagctgcggcccggcagcggcgtggtggcctgggacatccccatcacctatggagtgctgcccccaccccgggagagccacacagctgtggtgtacacagagaaggacaacaagaagagcaagctggtgatctatggaggcatgagcggctgccgcctgggggacctgtggaccctggacatcgacaccctgacctggaacaagcccagcctgagcggcgtggcccccctgcccaggagcctgcacagcgccaccaccatcggcaacaagatgtatgtgtttggaggctgggtgcccctggtgatggatgatgtgaaggtggccacccatgagaaggagtggaagtgcaccaacaccctggcctgcctgaacctggacaccatggcctgggagaccatcctgatggacaccctggaggacaacatcccccgggcccgggccggccactgtgctgtggccatcaacacccggctgtacatctggagcggcagagatggctacaggaaggcctggaacaaccaggtgtgctgcaaggacctgtggtacctggagacagagaagcccccacctccagcccgggtgcagctggtgcgggccaacaccaacagcctggaggtgtcctggggcgctgtggccacagctgacagctacctgctgcagctgcagaagtatgacatcccagccacagctgccacagccaccagccccacccccaaccctgtgcccagcgtgcctgccaacccccccaagagccctgccccagctgctgctgccccagctgtgcagcccctgacccaggtgggcatcaccctgctgccccaggccgccccagccccacccaccaccaccaccatccaggtgctgcccaccgtgcccggcagcagcatctctgtgcccacagctgcccggacccagggcgtgcctgctgtgctgaaggtgacaggcccccaggccaccaccggcacccccctggtgaccatgaggcctgccagccaggccggcaaggcccctgtgacagtgaccagcctgcctgctggggtgaggatggtggtgcccacccagagcgcccagggcaccgtgattggcagcagcccccagatgagcggcatggccgccctggccgctgctgctgctgccacccagaagatcccccccagcagcgcccccaccgtgctgtctgtgcctgctggcaccaccatcgtgaagaccatggctgtgaccccaggcaccaccaccctgcctgccaccgtgaaggtggccagcagccctgtgatggtgagcaacccagccaccaggatgctgaagacagctgctgcccaggtgggcacctctgtgtcctctgccaccaacaccagcacccggcccatcatcaccgtgcacaagagcggcaccgtgacagtggcccagcaggcccaggtggtgaccaccgtggtgggcggcgtgaccaagaccatcaccctggtgaagagccccatctctgtgcctgggggcagcgccctgatcagcaacctgggcaaggtgatgtctgtggtgcagaccaagcctgtgcagaccagcgctgtgacaggccaggccagcactggacctgtgacccagatcatccagaccaagggccccctgcctgctggcaccatcctgaagctggtgaccagcgcagatggcaagcccaccaccatcatcaccaccacccaggccagcggggccggcaccaagcccaccatcctgggcatcagctctgtgagccccagcaccaccaagccaggcaccaccaccatcatcaagaccatccccatgtctgccatcatcacccaggccggggccaccggggtgaccagcagccctggcatcaagagccccatcaccatcatcaccaccaaggtgatgaccagcggcaccggggccccagccaagatcatcacagctgtgcccaagatcgccactggacatggccagcagggcgtgacccaggtggtgctgaagggggcccctggccagcccggcaccatcctgaggacagtgcccatgggcggcgtgcggctggtgacccctgtgacagtgtctgctgtgaagccagctgtgaccaccctggtggtgaagggcaccaccggggtgaccaccctgggcaccgtgactggaacagtgtccaccagcctggccggggccggcggccacagcaccagcgccagcctggccacccccatcaccaccctgggcaccatcgccaccctgagcagccaggtgatcaaccccacagccatcaccgtgtctgctgcccagaccaccctgacagctgctgggggcctgaccacccccaccatcaccatgcagcctgtgtcccagcccacccaggtgaccctcatcacagcccccagcggcgtggaggcccagcctgtgcatgacctgcctgtgtccatcctggccagccccaccacagagcagcccacagccaccgtgaccatcgctgacagcggccagggagatgtgcagcccggcaccgtgaccctggtgtgcagcaaccccccctgtgagacccatgaaacaggcaccaccaacacagccaccaccaccgtggtggccaacctgggcggccacccccagcccacccaggtgcagtttgtgtgtgaccggcaggaggccgccgccagcctggtgaccagcacagtgggccagcagaatggatctgtggtgcgggtgtgcagcaaccccccctgtgagacccatgaaacaggcaccaccaacacagccaccacagccaccagcaacatggccggccagcacggctgcagcaaccccccctgtgagacccatgagaccggcaccaccaacacagccaccacagccatgagctctgtgggcgccaaccaccagagagatgcccggcgggcctgtgccgccggcaccccagctgtgatccgcatctctgtggccactggagccctggaggccgcccagggcagcaagagccagtgccagacccggcagaccagcgccaccagcaccaccatgacagtgatggccactggagccccctgcagcgctggccccctgctgggccccagcatggcccgggagcccggcggccgcagccctgcctttgtgcagctggcccccctgagcagcaaggtgcggctgagcagccccagcatcaaggacctgcctgctggccgccacagccatgctgtgtccacagctgccatgaccaggagctctgtgggcgctggggagcccaggatggcccctgtgtgtgagagcctgcagggcggcagccccagcaccaccgtgacagtgacagccctggaggccctgctgtgccccagcgccaccgtgacccaggtgtgcagcaaccccccctgtgagacccatgaaacaggcaccaccaacacagccaccaccagcaatgccggcagcgcccagagggtgtgcagcaaccccccctgtgagacccatgaaacaggcaccacccacacagccaccacagccaccagcaatggaggcaccggccagcctgagggcggccagcagcccccagctggccggccctgtgagacccaccagaccaccagcacaggcaccaccatgtctgtgtctgtgggcgccctgctgcctgatgccaccagcagccacaggacagtggagagcggcctggaggtggccgccgcccccagcgtgaccccccaggccggcacagccctgctggcccccttccccacccagagggtgtgcagcaaccccccctgtgagacccatgaaacaggcaccacccacacagccaccaccgtgaccagcaacatgagcagcaaccaggaccccccacctgctgccagtgaccagggcgaggtggagagcacccagggcgacagcgtgaacatcaccagcagcagcgccatcaccaccaccgtgagcagcaccctgaccagggctgtgaccaccgtgacccagagcacccctgtgcccggccccagcgtgcccccacctgaggagctgcaggtgtccccaggcccccggcagcagctgcccccccggcagctgctgcagagcgccagcacagccctgatgggagagagcgctgaggtgctgagcgccagccagaccccagagctgcctgctgctgtggacctgagcagcactggagagcccagcagcggccaggagagcgctggcagcgctgtggtggccaccgtggtggtgcagcccccaccacccacccagagcgaggtggaccagctgagcctgccccaggagctgatggccgaggcccaggccggcaccaccaccctgatggtgacaggcctgaccccagaggagctggccgtgacagctgctgctgaggccgccgcccaggccgccgccacagaggaggcccaggccctggccatccaggccgtgctgcaggccgcccagcaggccgtgatgggcactggagagcccatggacaccagcgaggccgccgccaccgtgacccaggccgagctgggccacctgtctgctgagggccaggagggccaggccaccaccatccccatcgtgctgacccagcaggagctggccgccctggtgcagcagcagcagctgcaggaggcccaggcccagcagcagcaccaccacctgcccacagaggccctggccccagctgacagcctgaatgaccctgccatcgagagcaactgcctgaatgagctggccggcaccgtgcccagcacagtggccctgctgcccagcacagccacagagagcctggcccccagcaacacctttgtggccccccagcctgtggtggtggccagccctgccaagctgcaggccgccgccaccctgacagaggtggccaacggcatcgagagcctgggcgtgaagccagacctgcccccaccacccagcaaggcccccatgaagaaggagaaccagtggtttgatgtgggcgtcatcaagggcaccaacgtgatggtgacccactacttcctgcccccagatgatgctgtgcccagtgatgatgacctgggcaccgtgcctgactacaaccagctgaagaagcaggagctgcagcccggcacagcctacaagttccgggtggccggcatcaatgcctgtggccggggccccttcagcgagatcagcgccttcaagacctgcctgcccggcttccctggggccccctgtgccatcaagatcagcaagagcccagatggagcccacctgacctgggagccccccagcgtgaccagcggcaagatcatcgagtacagcgtgtacctggccatccagagcagccaggccggcggggagctgaagagcagcaccccagcccagctggccttcatgagggtgtactgcggccccagccccagctgcctggtgcagagcagcagcctgagcaatgcccacatcgactacaccaccaagccagccatcatcttcagaattgctgccagaaatgagaagggctacggccctgccacccaggtgcgctggctgcaggagaccagcaaggacagcagcggcaccaagccagccaacaagaggcccatgagcagccctgagatgaagagcgcccccaagaagagcaaggcagatggccagtag

SEQ ID NO: 155602 - DNA, 5901 bp, Artificial Sequence
  Description of Artificial Sequence: Synthetic coding sequence
atggccagcgctgtgtccccagccaacctgcctgctgtgctgctgcagccccgctggaagagggtggtgggctggagcggccctgtgccccggcccaggcatggccacagagctgtggccatcaaggagctgattgtggtgtttggaggcggcaatgaaggaattgtggatgagctgcacgtgtacaacacagccaccaaccagtggttcatcccagctgtgcggggggacatccccccaggctgtgccgcctacggctttgtgtgtgatggcacccggctgctggtgtttggaggcatggtggagtatggcaagtacagcaatgacctgtatgagctgcaggccagccgctgggagtggaagaggctgaaggccaagacccccaagaatggccccccaccctgcccccggctgggccacagcttcagcctggtgggcaacaagtgctacctgtttggaggcctggccaatgattctgaggaccccaagaacaacatcccccgctacctgaatgacctgtacatcctggagctgcggcccggcagcggcgtggtggcctgggacatccccatcacctatggagtgctgcccccaccccgggagagccacacagctgtggtgtacacagagaaggacaacaagaagagcaagctggtgatctatggaggcatgagcggctgccgcctgggggacctgtggaccctggacatcgacaccctgacctggaacaagcccagcctgagcggcgtggcccccctgcccaggagcctgcacagcgccaccaccatcggcaacaagatgtatgtgtttggaggctgggtgcccctggtgatggatgatgtgaaggtggccacccatgagaaggagtggaagtgcaccaacaccctggcctgcctgaacctggacaccatggcctgggagaccatcctgatggacaccctggaggacaacatcccccgggcccgggccggccactgtgctgtggccatcaacacccggctgtacatctggagcggcagagatggctacaggaaggcctggaacaaccaggtgtgctgcaaggacctgtggtacctggagacagagaagcccccacctccagcccgggtgcagctggtgcgggccaacaccaacagcctggaggccgccccagccccacccaccaccaccaccatccaggtgctgcccaccgtgcccggcagcagcatctctgtgcccacagctgcccggacccagggcgtgcctgctgtgctgaaggtgacaggcccccaggccaccaccggcacccccctggtgaccatgaggcctgccagccaggccggcaaggcccctgtgacagtgaccagcctgcctgctggggtgaggatggtggtgcccacccagagcgcccagggcaccgtcatcggcagcagcccccagatgagcggcatggccgccctggccgctgctgctgctgccacccagaagatcccccccagcagcgcccccaccgtgctgtctgtgcctgctggcaccaccatcgtgaagaccatggctgtgaccccaggcaccaccaccctgcctgccaccgtgaaggtggccagcagccctgtgatggtgagcaacccagccaccaggatgctgaagacagctgctgcccaggtgggcacctctgtgagcagcgccaccaacaccagcacccggcccatcatcaccgtgcacaagtctggaacagtgacagtggcccagcaggcccaggtggtgaccaccgtggtgggcggcgtgaccaagaccatcaccctggtgaagagccccatctctgtgcctgggggcagcgccctgatcagcaacctgggcaaggtgatgtctgtggtgcagaccaagcctgtgcagaccagcgctgtgacaggccaggccagcacaggccctgtgacccagatcatccagaccaagggccccctgcctgctggcaccatcctgaagctggtgaccagcgcagatggcaagcccaccaccatcatcaccaccacccaggccagcggggccggcaccaagcccaccatcctgggcatcagctctgtgagccccagcaccaccaagccaggcaccaccaccatcatcaagaccatccccatgtctgccatcatcacccaggccggggccactggagtgaccagcagccctggcatcaagagccccatcaccatcatcaccaccaaggtgatgaccagcggcactggagccccagccaagatcatcacagctgtgcccaagatcgccaccggccacggccagcagggcgtgacccaggtggtgctgaagggggcccctggccagcccggcaccatcctgaggacagtgcccatgggcggcgtgcggctggtgacccctgtgacagtgtctgctgtgaagccagctgtgaccaccctggtggtgaagggcaccactggagtgaccaccctgggcaccgtgacaggcaccgtgtccaccagcctggccggggccggcggccacagcaccagcgccagcctggccacccccatcaccaccctgggcaccatcgccaccctgagcagccaggtgatcaaccccacagccatcaccgtgtctgctgcccagaccaccctgacagctgctgggggcctgaccacccccaccatcaccatgcagcctgtgtcccagcccacccaggtgaccctcatcacagcccccagcggcgtggaggcccagcctgtgcatgacctgcctgtgtccatcctggccagccccaccacagagcagcccacagccaccgtgaccatcgctgacagcggccagggagatgtgcagcccggcaccgtgaccctggtgtgcagcaaccccccctgtgagacccatgagaccggcaccaccaacacagccaccaccaccgtggtggccaacctgggcggccacccccagcccacccaggtgcagtttgtgtgtgaccggcaggaggccgccgccagcctggtgaccagcacagtgggccagcagaatggatctgtggtgcgggtgtgcagcaaccccccctgtgagacccatgagaccggcaccaccaacacagccaccacagccaccagcaacatggccggccagcacggctgcagcaaccccccctgtgagacccatgaaacaggcaccaccaacacagccaccacagccatgagctctgtgggcgccaaccaccagagagatgcccggcgggcctgtgccgccggcaccccagctgtgatccgcatctctgtggccaccggggccctggaggccgcccagggcagcaagagccagtgccagacccggcagaccagcgccaccagcaccaccatgacagtgatggccaccggggccccctgcagcgctggccccctgctgggccccagcatggcccgggagcccggcggccgcagccctgcctttgtgcagctggcccccctgagcagcaaggtgcggctgagcagccccagcatcaaggacctgcctgctggccgccacagccatgctgtgtccacagctgccatgaccaggagctctgtgggcgctggggagcccaggatggcccctgtgtgtgagagcctgcagggcggcagccccagcaccaccgtgacagtgacagccctggaggccctgctgtgccccagcgccaccgtgacccaggtgtgcagcaaccccccctgtgagacccatgagaccggcaccaccaacacagccaccaccagcaatgccggcagcgcccagagggtgtgcagcaaccccccctgtgagacccatgagaccggcaccacccacacagccaccacagccaccagcaatggaggcaccggccagcctgagggcggccagcagcccccagctggccggccctgtgagacccaccagaccaccagcacaggcaccaccatgtctgtgtctgtgggcgccctgctgcctgatgccaccagcagccacaggacagtggagagcggcctggaggtggccgccgcccccagcgtgaccccccaggccggcacagccctgctggcccccttccccacccagagggtgtgcagcaaccccccctgtgagacccatgagaccggcaccacccacacagccaccaccgtgaccagcaacatgagcagcaaccaggaccccccacctgctgccagtgaccagggcgaggtggagagcacccagggcgacagcgtgaacatcaccagcagcagcgccatcaccaccaccgtgagcagcaccctgaccagggctgtgaccaccgtgacccagagcacccctgtgcccggccccagcgtgcccccacctgaggagctgcaggtgtccccaggcccccggcagcagctgcccccccggcagctgctgcagagcgccagcacagccctgatgggagagagcgctgaggtgctgagcgccagccagaccccagagctgcctgctgctgtggacctgagcagcactggagagcccagcagcggccaggagagcgctggcagcgctgtggtggccaccgtggtggtgcagcccccaccacccacccagagcgaggtggaccagctgagcctgccccaggagctgatggccgaggcccaggccggcaccaccaccctgatggtgacaggcctgaccccagaggagctggccgtgacagctgctgctgaggccgccgcccaggccgccgccacagaggaggcccaggccctggccatccaggccgtgctgcaggccgcccagcaggccgtgatgggcaccggggagcccatggacaccagcgaggccgccgccaccgtgacccaggccgagctgggccacctgtctgctgagggccaggagggccaggccaccaccatccccatcgtgctgacccagcaggagctggccgccctggtgcagcagcagcagctgcaggaggcccaggcccagcagcagcaccaccacctgcccacagaggccctggccccagctgacagcctgaatgaccctgccatcgagagcaactgcctgaatgagctggccggcaccgtgcccagcacagtggccctgctgcccagcacagccacagagagcctggcccccagcaacacctttgtggccccccagcctgtggtggtggccagccctgccaagctgcaggccgccgccaccctgacagaggtggccaatggaattgagagcctgggcgtgaagccagacctgcccccaccacccagcaaggcccccatgaagaaggagaaccagtggtttgatgtgggcgtcatcaagggcaccaacgtgatggtgacccactacttcctgcccccagatgatgctgtgcccagtgatgatgacctgggcaccgtgcctgactacaaccagctgaagaagcaggagctgcagcctggaacagcctacaagttccgggtggccggcatcaatgcctgtggccggggccccttcagcgagatcagcgccttcaagacctgcctgcccggcttccctggggccccctgtgccatcaagatcagcaagagcccagatggagcccacctgacctgggagcccccatctgtgaccagcggcaagatcatcgagtacagcgtgtacctggccatccagagcagccaggccggcggggagctgaagagcagcaccccagcccagctggccttcatgagggtgtactgcggccccagccccagctgcctggtgcagagcagcagcctgagcaatgcccacatcgactacaccaccaagccagccatcatcttcagaattgctgccagaaatgagaagggctacggccctgccacccaggtgcgctggctgcaggagaccagcaaggacagcagcggcaccaagccagccaacaagaggcccatgagcagccctgagatgaagagcgcccccaagaagagcaaggcagatggccagtag

SEQ ID NO: 155603 - DNA, 6243 bp, Artificial Sequence
  Description of Artificial Sequence: Synthetic coding sequence
atggccagcgctgtgtccccagccaacctgcctgctgtgctgctgcagccccgctggaagagggtggtgggctggagcggccctgtgccccggcccaggcatggccacagagctgtggccatcaaggagctgattgtggtgtttggaggcggcaatgaaggaattgtggatgagctgcacgtgtacaacacagccaccaaccagtggttcatcccagctgtgcggggggacatccccccaggctgtgccgcctacggctttgtgtgtgatggcacccggctgctggtgtttggaggcatggtggagtatggcaagtacagcaatgacctgtatgagctgcaggccagccgctgggagtggaagaggctgaaggccaagacccccaagaatggccccccaccctgcccccggctgggccacagcttcagcctggtgggcaacaagtgctacctgtttggaggcctggccaatgattctgaggaccccaagaacaacatcccccgctacctgaatgacctgtacatcctggagctgcggcccggcagcggcgtggtggcctgggacatccccatcacctatggagtgctgcccccaccccgggagagccacacagctgtggtgtacacagagaaggacaacaagaagagcaagctggtgatctatggaggcatgagcggctgccgcctgggggacctgtggaccctggacatcgacaccctgacctggaacaagcccagcctgagcggcgtggcccccctgcccaggagcctgcacagcgccaccaccatcggcaacaagatgtatgtgtttggaggctgggtgcccctggtgatggatgatgtgaaggtggccacccatgagaaggagtggaagtgcaccaacaccctggcctgcctgaacctggacaccatggcctgggagaccatcctgatggacaccctggaggacaacatcccccgggcccgggccggccactgtgctgtggccatcaacacccggctgtacatctggagcggcagagatggctacaggaaggcctggaacaaccaggtgtgctgcaaggacctgtggtacctggagacagagaagcccccacctccagcccgggtgcagctggtgcgggccaacaccaacagcctggaggtgtcctggggcgctgtggccacagctgacagctacctgctgcagctgcagaagtatgacatcccagccacagctgccacagccaccagccccacccccaaccctgtgcccagcgtgcctgccaacccccccaagagccctgccccagctgctgctgccccagctgtgcagcccctgacccaggtgggcatcaccctgctgccccaggccgccccagccccacccaccaccaccaccatccaggtgctgcccaccgtgcccggcagcagcatctctgtgcccacagctgcccggacccagggcgtgcctgctgtgctgaaggtgacaggcccccaggccaccaccggcacccccctggtgaccatgaggcctgccagccaggccggcaaggcccctgtgacagtgaccagcctgcctgctggggtgaggatggtggtgcccacccagagcgcccagggcaccgtgattggcagcagcccccagatgagcggcatggccgccctggccgctgctgctgctgccacccagaagatcccccccagcagcgcccccaccgtgctgtctgtgcctgctggcaccaccatcgtgaagaccatggctgtgaccccaggcaccaccaccctgcctgccaccgtgaaggtggccagcagccctgtgatggtgagcaacccagccaccaggatgctgaagacagctgctgcccaggtgggcacctctgtgtcctctgccaccaacaccagcacccggcccatcatcaccgtgcacaagagcggcaccgtgacagtggcccagcaggcccaggtggtgaccaccgtggtgggcggcgtgaccaagaccatcaccctggtgaagagccccatctctgtgcctgggggcagcgccctgatcagcaacctgggcaaggtgatgtctgtggtgcagaccaagcctgtgcagaccagcgctgtgacaggccaggccagcactggacctgtgacccagatcatccagaccaagggccccctgcctgctggcaccatcctgaagctggtgaccagcgcagatggcaagcccaccaccatcatcaccaccacccaggccagcggggccggcaccaagcccaccatcctgggcatcagctctgtgagccccagcaccaccaagccaggcaccaccaccatcatcaagaccatccccatgtctgccatcatcacccaggccggggccaccggggtgaccagcagccctggcatcaagagccccatcaccatcatcaccaccaaggtgatgaccagcggcaccggggccccagccaagatcatcacagctgtgcccaagatcgccactggacatggccagcagggcgtgacccaggtggtgctgaagggggcccctggccagcccggcaccatcctgaggacagtgcccatgggcggcgtgcggctggtgacccctgtgacagtgtctgctgtgaagccagctgtgaccaccctggtggtgaagggcaccaccggggtgaccaccctgggcaccgtgactggaacagtgtccaccagcctggccggggccggcggccacagcaccagcgccagcctggccacccccatcaccaccctgggcaccatcgccaccctgagcagccaggtgatcaaccccacagccatcaccgtgtctgctgcccagaccaccctgacagctgctgggggcctgaccacccccaccatcaccatgcagcctgtgtcccagcccacccaggtgaccctcatcacagcccccagcggcgtggaggcccagcctgtgcatgacctgcctgtgtccatcctggccagccccaccacagagcagcccacagccaccgtgaccatcgctgacagcggccagggagatgtgcagcccggcaccgtgaccctggtgtgcagcaaccccccctgtgagacccatgaaacaggcaccaccaacacagccaccaccaccgtggtggccaacctgggcggccacccccagcccacccaggtgcagtttgtgtgtgaccggcaggaggccgccgccagcctggtgaccagcacagtgggccagcagaatggatctgtggtgcgggtgtgcagcaaccccccctgtgagacccatgaaacaggcaccaccaacacagccaccacagccaccagcaacatggccggccagcacggctgcagcaaccccccctgtgagacccatgagaccggcaccaccaacacagccaccacagccatgagctctgtgggcgccaaccaccagagagatgcccggcgggcctgtgccgccggcaccccagctgtgatccgcatctctgtggccactggagccctggaggccgcccagggcagcaagagccagtgccagacccggcagaccagcgccaccagcaccaccatgacagtgatggccactggagccccctgcagcgctggccccctgctgggccccagcatggcccgggagcccggcggccgcagccctgcctttgtgcagctggcccccctgagcagcaaggtgcggctgagcagccccagcatcaaggacctgcctgctggccgccacagccatgctgtgtccacagctgccatgaccaggagctctgtgggcgctggggagcccaggatggcccctgtgtgtgagagcctgcagggcggcagccccagcaccaccgtgacagtgacagccctggaggccctgctgtgccccagcgccaccgtgacccaggtgtgcagcaaccccccctgtgagacccatgaaacaggcaccaccaacacagccaccaccagcaatgccggcagcgcccagagggtgtgcagcaaccccccctgtgagacccatgaaacaggcaccacccacacagccaccacagccaccagcaatggaggcaccggccagcctgagggcggccagcagcccccagctggccggccctgtgagacccaccagaccaccagcacaggcaccaccatgtctgtgtctgtgggcgccctgctgcctgatgccaccagcagccacaggacagtggagagcggcctggaggtggccgccgcccccagcgtgaccccccaggccggcacagccctgctggcccccttccccacccagagggtgtgcagcaaccccccctgtgagacccatgaaacaggcaccacccacacagccaccaccgtgaccagcaacatgagcagcaaccaggaccccccacctgctgccagtgaccagggcgaggtggagagcacccagggcgacagcgtgaacatcaccagcagcagcgccatcaccaccaccgtgagcagcaccctgaccagggctgtgaccaccgtgacccagagcacccctgtgcccggccccagcgtgcccaagatcagctccatgacagaaacagccccccgggccctgaccacagaggtgcccatcccagccaagatcaccgtgaccatcgccaacacagagaccagtgacatgcccttctctgctgtggacatcctgcagcccccagaggagctgcaggtgtccccaggcccccggcagcagctgcccccccggcagctgctgcagagcgccagcacagccctgatgggagagagcgctgaggtgctgagcgccagccagaccccagagctgcctgctgctgtggacctgagcagcactggagagcccagcagcggccaggagagcgctggcagcgctgtggtggccaccgtggtggtgcagcccccaccacccacccagagcgaggtggaccagctgagcctgccccaggagctgatggccgaggcccaggccggcaccaccaccctgatggtgacaggcctgaccccagaggagctggccgtgacagctgctgctgaggccgccgcccaggccgccgccacagaggaggcccaggccctggccatccaggccgtgctgcaggccgcccagcaggccgtgatggccggcaccggggagcccatggacaccagcgaggccgccgccaccgtgacccaggccgagctgggccacctgtctgctgagggccaggagggccaggccaccaccatccccatcgtgctgacccagcaggagctggccgccctggtgcagcagcagcagctgcaggaggcccaggcccagcagcagcaccaccacctgcccacagaggccctggccccagctgacagcctgaatgaccctgccatcgagagcaactgcctgaatgagctggccggcaccgtgcccagcacagtggccctgctgcccagcacagccacagagagcctggcccccagcaacacctttgtggccccccagcctgtggtggtggccagccctgccaagctgcaggccgccgccaccctgacagaggtggccaatggaattgagagcctgggcgtgaagccagacctgcccccaccacccagcaaggcccccatgaagaaggagaaccagtggtttgatgtgggcgtcatcaagggcaccaacgtgatggtgacccactacttcctgcccccagatgatgctgtgcccagtgatgatgacctgggcaccgtgcctgactacaaccagctgaagaagcaggagctgcagcctggaacagcctacaagttccgggtggccggcatcaatgcctgtggccggggccccttcagcgagatcagcgccttcaagacctgcctgcccggcttccctggggccccctgtgccatcaagatcagcaagagcccagatggagcccacctgacctgggagcccccatctgtgaccagcggcaagatcatcgagtacagcgtgtacctggccatccagagcagccaggccggcggggagctgaagagcagcaccccagcccagctggccttcatgagggtgtactgcggccccagccccagctgcctggtgcagagcagcagcctgagcaatgcccacatcgactacaccaccaagccagccatcatcttcagaattgctgccagaaatgagaagggctacggccctgccacccaggtgcgctggctgcaggagaccagcaaggacagcagcggcaccaagccagccaacaagaggcccatgagcagccctgagatgaagagcgcccccaagaagagcaaggcagatggccagtag

SEQ ID NO: 155604 - DNA, 1305 bp, Artificial Sequence
  Description of Artificial Sequence: Synthetic coding sequence
atggattctgtggagaagggggccgccacctctgtgagcaacccccggggccggcccagccggggccggccccccaagctgcagaggaacagcagaggaggccagggccggggcgtggagaagccaccccacctggccgccctgatcctggcccggggcggcagcaagggcatccccctgaagaacatcaagcacctggccggcgtgcccctcatcggctgggtgctgcgggccgccctggacagcggggccttccagagcgtgtgggtgtccacagaccatgatgaaattgaaaatgtggccaagcagtttggagcccaggtgcaccggcgcagcagcgaggtgtccaaggacagcagcaccagcctggatgccatcatcgagttcctgaactaccacaatgaggtggacatcgtgggcaacatccaggccaccagcccctgcctgcaccccacagacctgcagaaggtggccgagatgatccgggaggagggctatgacagcgtcttctctgtggtgcggcggcaccagttccgctggagcgagatccagaagggcgtgcgggaggtgacagagcccctgaacctgaacccagccaagaggccccggcggcaggactgggatggagagctgtatgaaaatggcagcttctactttgccaagaggcacctgattgagatgggctacctgcagggcggcaagatggcctactatgagatgagagctgagcacagcgtggacattgatgtggacatcgactggcccatcgccgagcagagggtgctgcgctatggctactttgggaaggagaagctgaaggagatcaagctgctggtgtgcaacattgatggctgcctgaccaacggccacatctacgtgtctggggaccagaaggagatcatctcctatgatgtgaaggatgccatcggcatcagcctgctgaagaagtctggaattgaggtgcggctcatcagcgagcgggcctgcagcaagcagaccctgagcagcctgaagctggactgcaagatggaggtgtctgtgtctgacaagctggccgtggtggatgagtggaggaaggagatgggcctgtgctggaaggaggtggcctacctgggcaatgaggtgtctgatgaagaatgtctgaagagggtgggcctgagcggggccccagcagatgcctgcagcacagcccagaaggctgtgggctacatctgcaagtgcaatggaggccgcggggccatccgggagtttgctgagcacatctgcctgctgatggagaaggtgaacaacagctgccagaagtag

SEQ ID NO: 155605 - DNA, 507 bp, Artificial Sequence
  Description of Artificial Sequence: Synthetic coding sequence
atggccttcaatgactgcttcagcctgaactacccaggcaacccctgccctggggacctgattgaggtgttccggcccggctaccagcactgggccctgtacctgggagatggctacgtgatcaacatcgcccctgtggatggcatcccagccagcttcaccagcgccaagagcgtcttcagcagcaaggccctggtgaagatgcagctgctgaaggatgtggtgggcaatgacacctaccgcatcaacaacaagtatgatgagacctacccacccctgcctgtggaggagatcatcaagagaagtgaatttgtgattggccaggaggtggcctacaacctgctggtgaacaactgtgagcactttgtgaccctgctgcgctacggggagggcgtgtctgagcaggccaacagagccatcagcacagtggagtttgtgacagctgctgtgggcgtcttctccttcctgggcctcttccccaagggccagagggccaagtactactag

SEQ ID NO: 155606 - DNA, 489 bp, Artificial Sequence
  Description of Artificial Sequence: Synthetic coding sequence
atggccctggcccggccccggccccggctgggggacctgattgagatcagcagatttggctacgcccactgggccatctacgtgggagatggctacgtggtgcacctggccccagccagcgagattgctggagctggagctgcctctgtgctgagcgccctgaccaacaaggccatcgtgaagaaggagctgctgtctgtggtggccggcggggacaactacagagtgaacaacaagcatgatgaccgctacacccccctgcccagcaacaagatcgtgaagagagctgaggagctggtgggccaggagctgccctacagcctgaccagtgacaactgtgagcactttgtgaaccacctgcgctatggagtgtccagaagtgaccaggtgactggagctgtgaccaccgtgggcgtggccgccggcctgctggccgccgccagcctggtgggcatcctgctggcccggagcaagcgggagcggcagtag

SEQ ID NO: 155607 - DNA, 1023 bp, Artificial Sequence
  Description of Artificial Sequence: Synthetic coding sequence
atgaaggaggaccaggtggtggccgaggagcccggcttccaggatgaggaggagagcctcttccaggacatcgacctgctgcagaagcacggcatcaacgtggccgacatcaagaagctgaagtctgtgggcatctgcaccatcaagggcatccagatgaccacccggcgggccctgtgcaatgtgaagggcctgtctgaggccaaggtggacaagatcaaggaggccgccaacaagctgattgagcccggcttcctgacagcctttgagtacagcgagaagaggaagatggtgttccacatcaccaccggcagccaggagtttgacaagctgctgggcggcggcatcgagagcatggccatcacagaggcctttggagagttcagaacaggcaagacccagctgagccacaccctgtgtgtgacagcccagctgcccggggccggcggctacccaggcggcaagatcatcttcatcgacacagagaacaccttccggccagaccggctgcgggacattgctgaccgcttcaacgtggaccatgatgctgtgctggacaacgtgctgtatgcccgggcctacaccagcgagcaccagatggagctgctggactatgtggccgccaagttccacgaggaggccggcatcttcaagctgctgatcatcgacagcatcatggccctcttccgggtggacttcagcggccgcggggagctggccgagcggcagcagaagctggcccagatgctgagccggctgcagaagatcagcgaggagtacaacgtggccgtgtttgtgaccaaccagatgacagctgaccccggggccaccatgaccttccaggccgaccccaagaagcccatcggcggccacatcctggcccacgccagcaccacccgcatcagcctgaggaagggccgcggggagctgcgcatcgccaagatctatgacagccctgagatgccagaaaatgaggccacctttgccatcacagctgggggcattggagatgccaaggagtag

SEQ ID NO: 155608 - DNA, 1080 bp, Artificial Sequence
  Description of Artificial Sequence: Synthetic coding sequence
atgtctgatgagggcagccggggcagccggctgcccctggccctgcccccagccagccagggctgcagcagcggcggcggcggcggcggcagcagcgctgggggcagcggcaacagccggcccccaagaaacctgcagggcctgctgcagatggccatcacagctggcagcgaggagccagaccccccacctgagcccatgtctgaggagcggcggcagtggctgcaggaggccatgtctgctgccttccggggccagcgggaggaggtggagcagatgaagagctgcctgcgggtgctgagccagcccatgccacccacagctggggaggccgagcaggccgctgaccagcaggagcgggagggcgccctggagctgctggccgacctgtgtgagaacatggacaatgctgctgacttctgccagctgagcggcatgcacctgctggtgggccgctacctggaggccggggctgctggcctgcgctggagggctgcccagctgattggcacctgcagccagaatgtggccgccatccaggagcaggtgctgggcctgggcgccctgaggaagctgctgcggctgctggacagagatgcctgtgacacagtgcgggtgaaggccctgtttgccatcagctgcctggtgcgggagcaggaggccggcctgctgcagttcctgcggctggatggcttctctgtgctgatgagggccatgcagcagcaggtgcagaagctgaaggtgaagagcgccttcctgctgcagaacctgctggtgggccaccctgagcacaagggcaccctgtgcagcatgggcatggtgcagcagctggtggccctggtgaggacagagcacagccccttccatgaacatgtgctgggcgccctgtgcagcctggtgacagacttcccccagggcgtgagagaatgtcgggagcctgagctgggcctggaggagctgctgcggcaccgctgccagctgctgcagcagcacgaggagtaccaggaggagctggagttctgtgagaagctgctgcagacctgcttcagcagccctgcagatgacagcatggacagatag

SEQ ID NO: 155609 - DNA, 774 bp, Artificial Sequence
  Description of Artificial Sequence: Synthetic coding sequence
atgtctgatgagggcagccggggcagccggctgcccctggccctgcccccagccagccagggctgcagcagcggcggcggcggcggcggcagcagcgctgggggcagcggcaacagccggcccccaagaaacctgcagggcctgctgcagatggccatcacagctggcagcgaggagccagaccccccacctgagcccatgtctgaggagcggcggcagtggctgcaggaggccatgtctgctgccttccggggccagcgggaggaggtggagcagatgaagagctgcctgcgggtgctgagccagcccatgccacccacagctggggaggccgagcaggccgctgaccagcaggagcgggagggcgccctggagctgctggccgacctgtgtgagaacatggacaatgctgctgacttctgccagctgagcggcatgcacctgctggtgggccgctacctggaggccggggctgctggcctgcgctggagggctgcccagctgattggcacctgcagccagaatgtggccgccatccaggagcaggtgctgggcctgggcgccctgaggaagctgctgcggctgctggacagagatgcctgtgacacaggagtgagagaatgtcgggagcctgagctgggcctggaggagctgctgcggcaccgctgccagctgctgcagcagcacgaggagtaccaggaggagctggagttctgtgagaagctgctgcagacctgcttcagcagccctgcagatgacagcatggacagatag

SEQ ID NO: 155610 - DNA, 1080 bp, Artificial Sequence; identical to SEQ ID NO: 155608
  Description of Artificial Sequence: Synthetic coding sequence

SEQ ID NO: 155611 - DNA, 1443 bp, Artificial Sequence
  Description of Artificial Sequence: Synthetic coding sequence
atgcagatcccccgggccgccctgctgcccctgctgctgctgctgctggccgccccagccagcgcccagctgagcagagctggccgcagcgcccccctggccgccggctgcccagacagatgtgagcccgcccgctgccccccccagcctgagcactgtgagggcggccgggccagagatgcctgtggctgctgtgaggtgtgtggggcccctgagggcgccgcctgtggcctgcaggagggcccctgtggggagggcctgcagtgtgtggtgccctttggagtgcctgccagcgccaccgtgagaagaagagcccaggccggcctgtgtgtgtgtgccagcagcgagcctgtgtgtggcagtgatgccaacacctacgccaacctgtgccagctgcgggccgccagcagaagaagtgagcggctgcacaggcctcctgtgattgtgctgcagagaggagcctgtggccagggccaggaggaccccaacagcctgcggcacaagtacaacttcatcgcagatgtggtggagaagatcgccccagctgtggtgcacatcgagctgttcaggaagctgcccttcagcaagcgggaggtgcctgtggccagcggcagcggcttcatcgtgtctgaagatggcctgattgtgaccaatgcccacgtggtgaccaacaagcaccgggtgaaggtggagctgaagaatggagccacctatgaggccaagatcaaggatgtggatgagaaggctgacatcgccctgatcaagattgaccaccagggcaagctgcctgtgctgctgctgggccgcagcagcgagctgcggcctggagaatttgtggtggccatcggcagccccttcagcctgcagaacacagtgaccaccggcatcgtgtccaccacccagagaggaggcaaggagctgggcctgaggaacagcgacatggactacatccagacagatgccatcatcaactacggcaacagcggcggccccctggtgaacctggatggagaggtgattggcatcaacaccctgaaggtgacagctggcatcagctttgccatccccagcgacaagatcaagaagttcctgacagagagccatgaccggcaggccaagggcaaggccatcaccaagaagaagtacatcggcatccgcatgatgagcctgaccagcagcaaggccaaggagctgaaggacagacaccgggacttcccagatgtgatcagcggggcctacatcattgaagtcatcccagacaccccagctgaggccggcggcctgaaggaaaatgatgtgatcatcagcatcaatggccagagcgtggtgtctgccaatgatgtgtctgatgtgatcaagcgggagagcaccctgaacatggtggtgagaagaggaaatgaagacatcatgatcaccgtcatccctgaggagattgacccctag

SEQ ID NO: 155612 - DNA, 666 bp, Artificial Sequence
  Description of Artificial Sequence: Synthetic coding sequence
gggaagctgcctgtgctgctgctgggccgcagcagcgagctgcggcctggagaatttgtggtggccatcggcagccccttcagcctgcagaacacagtgaccactggaattgtgtccaccacccagaggggcggcaaggagctgggcctgaggaacagcgacatggactacatccagacagatgccatcatcaactacggcaacagcggcggccccctggtgaacctggatggagaggtgattggcatcaacaccctgaaggtgacagctggcatcagctttgccatccccagcgacaagatcaagaagttcctgacagagagccatgaccggcaggccaagggcaaggccatcaccaagaagaagtacatcggcatccgcatgatgagcctgaccagcagcaaggccaaggagctgaaggacagacaccgggacttcccagatgtgatcagcggggcctacatcatcgaggtgatcccagacaccccagctgaggccggcggcctgaaggaaaatgatgtgatcatcagcatcaatggccagagcgtggtgtctgccaatgatgtgtctgatgtgatcaagcgggagagcaccctgaacatggtggtgagaagaggaaatgaagacatcatgatcaccgtcatccctgaggagattgacccctag

SEQ ID NO: 155613 - DNA, 1344 bp, Artificial Sequence
  Description of Artificial Sequence: Synthetic coding sequence
atgggctgggccgcccggccccgggccctggccccagctgcccctgaggccctgctgcacagcccccggcggcgcagccctgccctggccctgtctgctgccacagctgctgctgcccggggccctggccgggtgcggctgctgcggggcgtgcggcgggcccggggcagaagagtgcggcctgctgggggccctgtgagaagaggagctgctgtgcggggggccctgcggggggccagcctgggccatggagctgctgcccgggccggccggcccctgtgtgtgcggcagcagctgcgggccgccagccgccgctctgagcggctgcaccggccccctgtgattgtgctgcagagaggagcctgtggccagggccaggaggaccccaacagcctgcggcacaagtacaacttcatcgcagatgtggtggagaagatcgccccagctgtggtgcacatcgagctgttcaggaagctgcccttcagcaagcgggaggtgcctgtggccagcggcagcggcttcatcgtgtctgaagatggcctcatcgtgaccaatgcccacgtggtgaccaacaagcaccgggtgaaggtggagctgaagaatggagccacctatgaggccaagatcaaggatgtggatgagaaggctgacatcgccctgatcaagattgaccaccagggcaagctgcctgtgctgctgctgggccgcagcagcgagctgcggcctggagaatttgtggtggccatcggcagccccttcagcctgcagaacacagtgaccactggaattgtgtccaccacccagaggggcggcaaggagctgggcctgaggaacagcgacatggactacatccagacagatgccatcatcaactacggcaacagcggcggccccctggtgaacctggatggagaggtgattggcatcaacaccctgaaggtgacagctggcatcagctttgccatccccagcgacaagatcaagaagttcctgacagagagccatgaccggcaggccaagggcaaggccatcaccaagaagaagtacatcggcatccgcatgatgagcctgaccagcagcaaggccaaggagctgaaggacagacaccgggacttcccagatgtgatcagcggggcctacatcatcgaggtgatcccagacaccccagctgaggccggcggcctgaaggaaaatgatgtgatcatcagcatcaatggccagagcgtggtgtctgccaatgatgtgtctgatgtgatcaagcgggagagcaccctgaacatggtggtgagaagaggaaatgaagacatcatgatcaccgtcatccctgaggagattgacccctag

SEQ ID NO: 155614 - DNA, 1377 bp, Artificial Sequence
  Description of Artificial Sequence: Synthetic coding sequence
atggccgccccccgggccggccgcggggccggctggagcctgcgggcctggagggccctgggcggcatccgctggggcagaagaccccggctgaccccagacctgcgggccctgctgaccagcggcaccagtgacccccgggcccgggtgacctacggcacccccagcctgtgggcccggctgtctgtgggcgtgacagagccccgggcctgcctgaccagcggcaccccaggcccccgggcccagctgacagctgtgaccccagacaccaggacccgggaggcctctgaaaattctggcaccaggagccgggcctggctggccgtggccctgggcgccggcggcgctgtgctgctgctgctgtggggcggcggccggggccccccagctgtgctggccgctgtgcccagccccccaccagccagccccaggagccagtacaacttcatcgcagatgtggtggagaagacagccccagctgtggtgtacatcgagatcctggacagacaccccttcctgggccgggaggtgcccatcagcaatggaagtggctttgtggtggccgcagatggcctgattgtgaccaatgcccacgtggtggccgacagaagaagagtgcgggtgcggctgctgagcggggacacctatgaggccgtggtgacagctgtggaccctgtggccgacatcgccaccctgcgcatccagaccaaggagcccctgcccaccctgcccctgggccgctctgcagatgtgcggcagggcgagtttgtggtggccatgggcagcccctttgccctgcagaacaccatcaccagcggcatcgtgtcctctgcccagaggcctgcccgggacctgggcctgccccagaccaacgtggagtacatccagacagatgctgccatcgactttggaaacagcggcggccccctggtgaacctggatggagaggtgattggagtgaacaccatgaaggtgacagctggcatcagctttgccatccccagcgaccggctgcgggagttcctgcacagaggagagaagaagaacagcagcagcggcatcagcggcagccagaggcgctacatcggcgtgatgatgctgaccctgagccccagcatcctggccgagctgcagctgcgggagcccagcttcccagatgtgcagcacggcgtgctgatccacaaggtgatcctgggcagccctgcccacagagctggcctgcggcctggagatgtgatcctggccatcggggagcagatggtgcagaatgcagaagatgtgtatgaggccgtgaggacccagagccagctggccgtgcagatccggcggggccgggagaccctgaccctgtatgtgaccccagaggtgacagaatag

SEQ ID NO: 155615 - DNA, 1086 bp, Artificial Sequence
  Description of Artificial Sequence: Synthetic coding sequence
atggccgccccccgggccggccgcggggccggctggagcctgcgggcctggagggccctgggcggcatccgctggggcagaagaccccggctgaccccagacctgcgggccctgctgaccagcggcaccagtgacccccgggcccgggtgacctacggcacccccagcctgtgggcccggctgtctgtgggcgtgacagagccccgggcctgcctgaccagcggcaccccaggcccccgggcccagctgacagctgtgaccccagacaccaggacccgggaggcctctgaaaattctggcaccaggagccgggcctggctggccgtggccctgggcgccggcggcgctgtgctgctgctgctgtggggcggcggccggggccccccagctgtgctggccgctgtgcccagccccccaccagccagccccaggagccagtacaacttcatcgcagatgtggtggagaagacagccccagctgtggtgtacatcgagatcctggacagacaccccttcctgggccgggaggtgcccatcagcaatggaagtggctttgtggtggccgcagatggcctgattgtgaccaatgcccacgtggtggccgacagaagaagagtgcgggtgcggctgctgagcggggacacctatgaggccgtggtgacagctgtggaccctgtggccgacatcgccaccctgcgcatccagaccaagtttggaaattctgggggccccctggtgaacctggatggagaggtgattggagtgaacaccatgaaggtgacagctggcatcagctttgccatccccagcgaccggctgcgggagttcctgcacagaggagagaagaagaacagcagcagcggcatcagcggcagccagaggcgctacatcggcgtgatgatgctgaccctgagcccccgggccggcctgcggcctggagatgtgatcctggccatcggggagcagatggtgcagaatgcagaagatgtgtatgaagctgtgaggacccagagccagctggccgtgcagatcagaagaggccgggagaccctgaccctgtatgtgaccccagaggtgacagaatag

SEQ ID NO: 155616 - DNA, 1362 bp, Artificial Sequence
  Description of Artificial Sequence: Synthetic coding sequence
atgcaggcccgggccctgctgctggccgccctggccgccctggccctggcccgggagcccccagctgccccctgcccagcccgctgtgatgtgagccgctgccccagcccccgctgccctgggggctacgtgcctgacctgtgcaactgctgcctggtgtgtgccgccagcgagggggagccctgtggcggccccctggacagcccctgtggggagagcctggagtgtgtgcggggcctgtgccgctgccgctggagccatgctgtgtgtggcacagatggccacacctacgccaacgtgtgtgccctgcaggccgccagccggcgggccctgcagctgagcggcacccctgtgcggcagctgcagaagggggcctgccccctgggcctgcaccagctgagcagcccccgctacaagttcaacttcatcgcagatgtggtggagaagatcgccccagctgtggtgcacatcgagctgttcctgcggcaccccctgtttggaagaaatgtgcccctgagcagcggcagcggcttcatcatgtctgaggccggcctcatcatcaccaatgcccacgtggtgagcagcaacagcgctgcccctggccggcagcagctgaaggtgcagctgcagaatggagacagctatgaggccaccatcaaggacatcgacaagaagagtgacatcgccaccatcaagatccaccccaagaagaagctgcctgtgctgctgctgggccacagcgctgacctgcggcctggagaatttgtggtggccatcggcagcccctttgccctgcagaacacagtgaccactggaattgtgtccacagcccagcgggagggccgggagctgggcctgcgggacagcgacatggactacatccagacagatgccatcatcaactacggcaacagcggcggccccctggtgaacctggatggagaggtgattggcatcaacaccctgaaggtgacagctggcatcagctttgccatccccagcgaccgcatcacccgcttcctgacagagttccaggacaagcagatcaaggactggaagaagcgcttcatcggcatccgcatgaggaccatcacccccagcctggtggatgagctgaaggccagcaacccagacttccctgaggtgagcagcggcatctacgtgcaggaggtggcccccaacagccccagccagaggggcggcatccaggatggagacatcatcgtgaaggtgaatggccggcccctggtggacagcagcgagctgcaggaggccgtgctgacagagagccccctgctgctggaggtgagaagaggaaatgatgacctgctcttcagcatcgcccctgaggtggtgatgtag

SEQ ID NO: 155617 - DNA, 1431 bp, Artificial Sequence
  Description of Artificial Sequence: Synthetic coding sequence
atgatccggccccagctgaggacagctggcctgggccgctgcctgctgcccggcctgctgctgctgctggtgcctgtgctgtgggccggggctgagaagctgcacacccagcccagctgcccagctgtgtgccagcccacccgctgcccagccctgcccacctgtgccctgggcaccacccctgtgtttgacctgtgccgctgctgccgggtgtgcccagctgctgagcgggaggtgtgtggcggggcccagggccagccctgtgcccctggcctgcagtgcctgcagcccctgcggcccggcttccccagcacctgtggctgccccaccctgggcggcgctgtgtgtggcagtgacaggaggacctaccccagcatgtgtgccctgcgggcagagaacagagctgcccggcggctgggcaaggtgcctgctgtgcctgtgcagtggggcaactgtggggacaccggcaccaggtctgctggccccctgcggaggaactacaacttcatcgctgctgtggtggagaaggtggcccccagcgtggtgcacgtgcagctgtggggccgcctgctgcacggcagccggctggtgcctgtgtacagcggcagcggcttcatcgtgtctgaagatggcctcatcatcaccaatgcccacgtggtgaggaaccagcagtggattgaggtggtgctgcagaatggagcccgctatgaggccgtggtgaaggacatcgacctgaagctggacctggccgtcatcaagattgagagcaatgctgagctgcctgtgctgatgctgggccgcagcagtgacctgcgggccggggagtttgtggtggccctgggcagccccttcagcctgcagaacacagccacagctggcatcgtgtccaccaagcagagaggaggcaaggagctgggcatgaaggacagcgacatggactatgtgcagattgatgccaccatcaactacggcaacagcggcggccccctggtgaacctggatggagatgtgattggagtgaacagcctgcgggtgacagatggcatcagctttgccatccccagcgacagagtgcggcagttcctggccgagtaccacgagcaccagatgaagggcaaggccttcagcaacaagaagtacctgggcctgcagatgctgagcctgactgtgcccctgtctgaggagctgaagatgcactacccagacttcccagatgtgagcagcggcgtgtatgtgtgcaaggtggtggagggcacagctgcccagagcagcggcctgcgggaccatgatgtgattgtgaacatcaacgggaagcccatcaccaccaccacagatgtggtgaaggccctggacagcgacagcctgtccatggctgtgctgcggggcaaggacaacctgctgctgaccgtcatccctgagaccatcaactag

SEQ ID NO: 155618 - DNA, 8157 bp, Artificial Sequence
  Description of Artificial Sequence: Synthetic coding sequence
atgcccaggaccaagcagatccaccccaggaacctgcgggacaagattgaggaggcccagaaggagctgaatggagctgaggtgtccaagaaggagatcctgcaggccggcgtgaagggcaccagcgagagcctgaagggcgtgaagaggaagaagatcgtggccgagaaccacctgaagaagatccccaagagccccctgaggaaccccctgcaggccaagcacaagcagaacacagaggagagcagctttgctgtgctgcacagcgccagcgagagccacaagaagcagaactacatccctgtgaagaatggcaagcagttcaccaagcagaatggagagaccccaggcatcatcgccgaggccagcaagtctgaggagagcgtgagccccaagaagcccctcttcctgcagcagcccagcgagctgcggcgctggaggtctgagggcgctgaccctgccaagttcagtgacctggatgagcagtgtgacagcagcagcctgagcagcaagaccaggacagacaacagcgagtgcatcagcagccactgcggcaccaccagccccagctacaccaacacagcctttgatgtgctgctgaaggccatggagcctgagctgagcaccctgagccagaagggcagcccctgtgccatcaagacagagaagctgcggcccaacaagacagcccggagcccccccaagctgaagaacagctccatggatgcccccaaccagaccagccaggagctggtggccgagagccagagcagctgcaccagctacacagtgcacatgtctgctgcccagaagaatgagcagggcgccatgcagagcgccagccacctgtaccaccagcacgagcactttgtgcccaagagcaaccagcacaaccagcagctgcccggctgcagcggcttcaccggcagcctgaccaacctgcagaaccaggagaatgccaagctggagcaggtgtacaacattgctgtgaccagctctgtgggcctgaccagccccagcagccgcagccaggtgaccccccagaaccagcagatggacagcgccagccccctgagcatcagccctgccaacagcacccagagcccccccatgcccatctacaacagcacccacgtggcctctgtggtgaaccagagcgtggagcagatgtgcaacctgctgctgaaggaccagaagcccaagaagcagggcaagtacatctgtgagtactgcaacagagcctgtgccaagcccagcgtgctgctgaagcacatccgcagccacactggagagcggccctacccctgtgtgacctgtggcttctccttcaagaccaagagcaacctgtacaagcacaagaagagccacgcccacaccatcaagctgggcctggtgctgcagccagatgctgggggcctcttcctgagccatgagagccccaaggccctgagcatccacagtgatgtggaggacagcggggagagcgaggaggagggcgccacagatgagcggcagcacgacctgggcgccatggagctgcagcctgtgcacatcatcaagaggatgagcaatgctgagaccctgctgaagagcagcttcacccccagcagcccagaaaatgtcatcggggacttcctgctgcaggacagatctgctgagagccaggccgtgacagagctgcccaaggtggtggtgcaccacgtgacagtgagccccctgaggacagacagccccaaggccatggaccccaagccagagctgagcagcgcccagaagcagaaggacctgcaggtgaccaacgtgcagcccctgagcgccaacatgagccagggcggcgtgtcccggctggagaccaatgaaaacagccaccagaagggggacatgaaccccctggagggcaagcaggacagccacgtgggcaccgtgcacgcccagctgcagaggcagcaggccacagactacagccaggagcagcagggcaagctgctgagccccaggagcctgggcagcacagattctggctacttcagccgctctgagagcgctgaccagacagtgagcccccccaccccatttgcccggcggctgcccagcacagagcaggacagcggccgcagcaatggccccagcgctgccctggtgaccaccagcacccccagcgccctgcccaccggggagaaggccctgctgctgcccggccagatgaggcctcccctggccaccaagaccctggaggagcgcatcagcaagctgatcagtgacaatgaggccctggtggatgacaagcagctggacagcgtgaagcccaggaggaccagcctgagccggcggggcagcattgacagccccaagagctacatcttcaaggacagcttccagtttgacctgaagcctgtgggccgccgcaccagcagcagcagtgacatccccaagagccccttcacccccacagagaagagcaagcaggtgttcctgctgtctgtgcccagcctggactgcctgcccatcaccaggagcaacagcatgcccaccaccggctacagcgctgtgcctgccaacatcatccccccaccccaccccctgcggggcagccagagctttgatgacaagattggcaccttctatgatgatgtgtttgtgtctggccccaatgcccctgtgccccagagcggccaccccaggaccctggtgcggcaggccgccatcgaggacagcagcgccaatgaaagccacgtgctgggcaccggccagagcctggatgagagccaccagggctgccacgccgccggggaggccatgtctgtgcgcagcaaggccctggcccagggcccccacatcgagaagaagaagagccaccagggccggggcaccatgtttgaatgtgagacctgcaggaaccgctacaggaagctggagaactttgagaaccacaagaagttctactgcagcgagctgcacggccccaagaccaaggtggccatgagggagcctgagcacagccctgtgcctgggggcctgcagccccagatcctgcactacagagtggccggcagcagcggcatctgggagcagaccccccagatcaggaagaggaggaagatgaagtctgtgggagatgatgaggagctgcagcagaatgaaagtggcaccagccccaagagcagcgagggcctgcagttccagaatgccctgggctgcaaccccagcctgcccaagcacaacgtgaccatccgcagtgaccagcagcacaagaacatccagctgcagaacagccacatccacctggtggcccggggccctgagcagaccatggaccccaagctgagcaccatcatggagcagcagatcagcagcgctgcccaggacaagattgagctgcagagacatggaacaggcatcagcgtcatccagcacaccaacagcctgagccggcccaacagctttgacaagccagagccctttgagcgggccagccctgtgtccttccaggagctgaacagaacaggcaagagcggcagcctgaaggtgattggcatcagccaggaggagagccaccccagcagagatggcagccacccccaccagctggccctgagtgatgccctgcggggggagctgcaggagagcagcaggaagagccccagcgagcggcacgtgctgggccagcccagccggctggtgcggcagcacaacatccaggtgcctgagatcctggtgacagaggagccagaccgggacctggaggcccagtgccacgaccaggagaagtctgagaagttctcctggccccagaggtctgagaccctgagcaagctgcccacagagaagctgccccccaagaagaagaggctgcggctggccgagattgagcacagcagcacagagagcagctttgacagcaccctgagccgcagcctgagccgggagagcagcctgagccacaccagcagcttcagcgccagcctggacattgaagatgtgtccaagacagaggccagccccaagattgacttcctgaacaaggccgagttcctgatgatcccagctggcctgaacaccctgaatgtgcccggctgccaccgggagatgagaagaacagccagcgagcagatcaactgcacccagacctccatggaggtgtctgacctgcggagcaagagctttgactgtggcagcatcaccccaccccagaccacccccctgacagagctgcagccccccagcagccccagccgggtgggcgtgacaggccacgtgcccctgctggagaggagaagaggccccctggtgcggcagatcagcctgaacatcgccccagacagccacctgagccctgtgcaccccaccagcttccagaacacagccctgcccagcgtgaatgctgtgccctaccagggcccccagctgaccagcaccagcctggccgagttcagcgccaacaccctgcacagccagacccaggtgaaggacctgcaggccgagaccagcaacagcagcagcaccaacgtgtttcctgtgcagcagctgtgtgacatcaacctgctgaaccagatccacgccccacccagccaccagagcacccagctgagcctgcaggtgtccacccagggcagcaagccagacaagaacagcgtgctgagcggcagcagcaagtctgaggactgctttgcccccaagtaccagctgcactgccaggtgttcaccagcggccccagctgcagcagcaaccctgtgcacagcctgcccaaccaggtgatcagtgaccctgtgggcacagaccactgtgtgaccagcgccaccctgcccaccaagctgattgacagcatgagcaacagccaccccctgctgcccccagagctgcggcccctgggcagccaggtgcagaaggtgcccagcagcttcatgctgcccatccggctgcagagctctgtgcctgcctactgctttgccaccctgaccagcctgccccagatcctggtgacccaggacctgcccaaccagcccatctgccagaccaaccacagcgtggtgcccatcagcgaggagcagaacagcgtgcccaccctgcagaagggccaccagaatgccctgcccaaccctgagaaggagttcctgtgtgaaaatgtgttttctgagatgagccagaacagcagcctgtctgagagcctgcccatcacccagaagatctctgtgggccgcctgagcccccagcaggagagcagcgccagcagcaagaggatgctgagccctgccaacagcctggacatcgccatggagaagcaccagaagagggccaaggatgaaaatggagctgtgtgtgccacagatgtgcggcccctggaggccctgagcagccgggtgaatgaggccagcaagcagaagaagcccatcctggtgcggcaggtgtgcaccacagagcccctggatggagtgatgctggagaaggatgtgttcagccagcctgagatcagcaatgaagctgtgaacctgaccaacgtgctgcctgctgacaacagcagcacaggctgcagcaagtttgtggtgattgagcccatcagcgagctgcaggagtttgagaacatcaagagcagcaccagcctgaccctgactgtgcgcagcagccctgcccccagcgagaacacccacatcagccccctgaagtgcacagacaacaaccaggagaggaagagccctggggtgaagaaccagggcgacaaggtgaacatccaggagcagagccagcagcctgtgaccagcctgagcctcttcaacatcaaggacacccagcagctggccttccccagcctgaagaccaccaccaacttcacctggtgctacctgctgcggcagaagagcctgcacctgccccagaaggaccagaagaccagcgcctacacagactggacagtgtctgccagcaaccccaaccccctgggcctgcccaccaaggtggccctggccctgctgaacagcaagcagaacacaggcaagagcctgtactgccaggccatcaccacccacagcaagagtgacctgctggtgtacagcagcaagtggaagagcagcctgagcaagagggccctgggcaaccagaagagcacagtggtggagttcagcaacaaggatgccagcgagatcaacagcgagcaggacaaggagaacagcctcatcaagtctgagccccggcgcatcaagatctttgatggcggctacaagagcaatgaggagtatgtgtatgtgcggggccggggccggggcaagtacatctgtgaggagtgtggcatccgctgcaagaagcccagcatgctgaagaagcacatccgcacccacacagatgtgcggccctaccactgcacctactgcaacttctccttcaagaccaagggcaacctgaccaagcacatgaagagcaaggcccacagcaagaagtgtgtggacctgggcgtgtctgtgggcctgattgatgagcaggacacagaggagagtgatgagaagcagcgcttctcctatgaaagaagtggctatgacctggaggagagtgatggcccagatgaagatgacaatgaaaatgaagatgatgatgaggacagccaggccgagagcgtgctgagcgccacccccagcgtgacagccagcccccagcacctgcccagccgcagcagcctgcaggaccctgtgtccacagatgaagatgtgcgcatcacagactgcttctctggagtgcacacagaccccatggatgtgctgccccgggccctgctgaccaggatgacagtgctgagcacagcccagagcgactacaacaggaagaccctgagccctgggaaggcccggcagagagctgccagagatgaaaatgacaccatccccagcgtggacaccagccgcagcccctgccaccagatgtctgtggactacccagagagcgaggagatcctgcggagctccatggccggcaaggctgtggccatcacccagagccccagctctgtgcggctgcccccagctgctgctgagcacagcccccagacagctgctggcatgcccagcgtggccagcccccacccagacccccaggagcagaagcagcagatcaccctgcagcccaccccaggcctgcccagcccccacacccacctgttcagccacctgcccctgcacagccagcagcagagcaggaccccctacaacatggtgcctgtgggcggcatccacgtggtgcctgctggcctgacctacagcacctttgtgcccctgcaggccggccctgtgcagctgaccatcccagctgtgtctgtggtgcacaggaccctgggcacccacaggaacacagtgacagaggtgtctggcaccaccaacccagctggggtggccgagctgagctctgtggtgccctgcatccccatcggccagatccgggtgcccggcctgcagaacctgagcaccccaggcctgcagagcctgcccagcctgtccatggagaccgtgaacatcgtgggcctggccaacaccaacatggccccccaggtgcaccccccaggcctggccctgaatgctgtgggcctgcaggtgctgacagccaaccccagcagccagagcagccctgccccccaggcccacatccctggcctgcagatcctgaacatcgccctgcccaccctcatccccagcgtgtcccaggtggccgtggatgcccagggcgcccctgagatgcctgccagccagagcaaggcctgtgagacccagcccaagcagacctctgtggccagcgccaaccaggtgtccaggacagagagcccccagggcctgcccaccgtgcagagagaaaatgccaagaaggtgctgaaccccccagccccagctggggaccacgcccggctggatggcctgagcaagatggacacagagaaggccgccagcgccaaccacgtgaagcccaagccagagctgaccagcatccagggccagcctgccagcaccagccagcccctgctgaaggcccacagcgaggtgttcaccaagcccagcggccagcagaccctgagcccagaccggcaggtgccccggcccacagccctgccccggcggcagcccaccgtgcacttcagtgatgtgtccagtgatgatgatgaagatcggctggtgattgccacctag

SEQ ID NO: 155619 - DNA, 387 bp, Artificial Sequence
  Description of Artificial Sequence: Synthetic coding sequence
atgcccaggaccaagcagatccaccccaggaacctgcgggacaagattgaggaggcccagaaggagctgaatggagctgaggtgtccaagaaggagatcctgcaggccggcgtgaagggcaccagcgagagcctgaagggcgtgaagaggaagaagatcgtggccgagaaccacctgaagaagatccccaagagccccctgaggaaccccctgcaggccaagcacaagcagaacacagaggagagcagctttgctgtgctgcacagcgccagcgagagccacaagaagcagaactacatccctgtgaagaatggcaagcagttcaccaagcagaatggagagaccccaggcatcatcgccgaggccagcaagtctgaggagagctag

SEQ ID NO: 155620 - DNA, 429 bp, Artificial Sequence
  Description of Artificial Sequence: Synthetic coding sequence
atgcccaggaccaagcagatccaccccaggaacctgcgggacaagattgaggaggcccagaaggagctgaatggagctgaggtgtccaagaaggagatcctgcaggccggcgtgaagggcaccagcgagagcctgaagggcgtgaagaggaagaagatcgtggccgagaaccacctgaagaagatccccaagagccccctgaggaaccccctgcaggccaagcacaagcagaacacagaggagagcagctttgctgtgctgcacagcgccagcgagagccacaagaagcagaactacatccctgtgaagaatggcaagcagttcaccaagcagaatggagagaccccaggcatcatcgccgaggccagcaagtctgaggagagcgtgagccccaagaagcccctcttcctgcagcagcccagcgagtag

SEQ ID NO: 155621 - DNA, 363 bp, Artificial Sequence
  Description of Artificial Sequence: Synthetic coding sequence
atgcccaggaccaagcagatccaccccaggaacctgcgggacaagattgaggaggcccagaaggagctgaatggagctgaggtgtccaagaaggagatcctgcaggccggcgtgaagggcaccagcgagagcctgaagggcgtgaagaggaagaagatcgtggccgagaaccacctgaagaagatccccaagagccccctgaggaaccccctgcaggccaagcacaagcagaacacagaggagagcagctttgctgtgctgcacagcgccagcgagagccacaagaagcagaactacatccctgtgaagaatggcaagcagttcaccaagcagaatggagagaccccaggcatcatcgcctag

SEQ ID NO: 155622 - DNA, 1752 bp, Artificial Sequence
  Description of Artificial Sequence: Synthetic coding sequence
atgctgaagaagcacatccgcacccacacagatgtgcggccctaccactgcacctactgcaacttctccttcaagaccaaggatgagaagcagcgcttctcctatgaaagaagtggctatgacctggaggagagtgatggcccagatgaagatgacaatgaaaatgaagatgatgatgaggacagccaggccgagagcgtgctgagcgccaccccatctgtgacagccagcccccagcacctgcccagccgcagcagcctgcaggaccctgtgtccacagatgaagatgtgcgcatcacagactgcttcagcggcgtgcacacagaccccatggatgtgctgccccgggccctgctgaccaggatgacagtgctgagcacagcccagagcgactacaacaggaagaccctgagccctgggaaggcccggcagagagctgccagagatgaaaatgacaccatccccagcgtggacaccagccgcagcccctgccaccagatgtctgtggactacccagagagcgaggagatcctgcggagctccatggccggcaaggctgtggccatcacccagagccccagctctgtgcggctgcccccagctgctgctgagcacagcccccagacagctgctggcatgcccagcgtggccagcccccacccagacccccaggagcagaagcagcagatcaccctgcagcccaccccaggcctgcccagcccccacacccacctgttcagccacctgcccctgcacagccagcagcagagcaggaccccctacaacatggtgcctgtgggcggcatccacgtggtgcctgctggcctgacctacagcacctttgtgcccctgcaggccggccctgtgcagctgaccatcccagctgtgtctgtggtgcacaggaccctgggcacccacaggaacacagtgacagaggtgtctggcaccaccaacccagctggggtggccgagctgagctctgtggtgccctgcatccccatcggccagatccgggtgcccggcctgcagaacctgagcaccccaggcctgcagagcctgcccagcctgtccatggagaccgtgaacatcgtgggcctggccaacaccaacatggccccccaggtgcaccccccaggcctggccctgaatgctgtgggcctgcaggtgctgacagccaaccccagcagccagagcagccctgccccccaggcccacatccctggcctgcagatcctgaacatcgccctgcccaccctcatccccagcgtgtcccaggtggccgtggatgcccagggcgcccctgagatgcctgccagccagagcaaggcctgtgagacccagcccaagcagacctctgtggccagcgccaaccaggtgtccaggacagagagcccccagggcctgcccaccgtgcagcgggagaatgccaagaaggtgctgaaccccccagccccagctggggaccacgcccggctggatggcctgagcaagatggacacagagaaggccgccagcgccaaccacgtgaagcccaagccagagctgaccagcatccagggccagcctgccagcaccagccagcccctgctgaaggcccacagcgaggtgttcaccaagcccagcggccagcagaccctgagcccagaccggcaggtgccccggcccacagccctgccccggcggcagcccaccgtgcacttcagtgatgtgtccagtgatgatgatgaggaccggctggtgattgccacctag

SEQ ID NO: 155623 - DNA, 2103 bp, Artificial Sequence
  Description of Artificial Sequence: Synthetic coding sequence
ggggacaagttctccttccagagggccctgggcaaccagaagagcacagtggtggagttcagcaacaaggatgccagcgagatcaacagcgagcaggacaaggagaacagcctcatcaagtctgagccccggcgcatcaagatctttgatggcggctacaagagcaatgaggagtatgtgtatgtgcggggccggggccggggcaagtacatctgtgaggagtgtggcatccgctgcaagaagcccagcatgctgaagaagcacatccgcacccacacagatgtgcggccctaccactgcacctactgcaacttctccttcaagaccaagggcaacctgaccaagcacatgaagagcaaggcccacagcaagaagtgtgtggacctgggcgtgtctgtgggcctgattgatgagcaggacacagaggagagtgatgagaagcagcgcttctcctatgaaagaagtggctatgacctggaggagagtgatggcccagatgaagatgacaatgaaaatgaagatgatgatgaggacagccaggccgagagcgtgctgagcgccacccccagcgtgacagccagcccccagcacctgcccagccgcagcagcctgcaggaccctgtgtccacagatgaagatgtgcgcatcacagactgcttctctggagtgcacacagaccccatggatgtgctgccccgggccctgctgaccaggatgacagtgctgagcacagcccagagcgactacaacaggaagaccctgagccctgggaaggcccggcagagagctgccagagatgaaaatgacaccatccccagcgtggacaccagccgcagcccctgccaccagatgtctgtggactacccagagagcgaggagatcctgcggagctccatggccggcaaggctgtggccatcacccagagccccagctctgtgcggctgcccccagctgctgctgagcacagcccccagacagctgctggcatgcccagcgtggccagcccccacccagacccccaggagcagaagcagcagatcaccctgcagcccaccccaggcctgcccagcccccacacccacctgttcagccacctgcccctgcacagccagcagcagagcaggaccccctacaacatggtgcctgtgggcggcatccacgtggtgcctgctggcctgacctacagcacctttgtgcccctgcaggccggccctgtgcagctgaccatcccagctgtgtctgtggtgcacaggaccctgggcacccacaggaacacagtgacagaggtgtctggcaccaccaacccagctggggtggccgagctgagctctgtggtgccctgcatccccatcggccagatccgggtgcccggcctgcagaacctgagcaccccaggcctgcagagcctgcccagcctgtccatggagaccgtgaacatcgtgggcctggccaacaccaacatggccccccaggtgcaccccccaggcctggccctgaatgctgtgggcctgcaggtgctgacagccaaccccagcagccagagcagccctgccccccaggcccacatccctggcctgcagatcctgaacatcgccctgcccaccctcatccccagcgtgtcccaggtggccgtggatgcccagggcgcccctgagatgcctgccagccagagcaaggcctgtgagacccagcccaagcagacctctgtggccagcgccaaccaggtgtccaggacagagagcccccagggcctgcccaccgtgcagagagaaaatgccaagaaggtgctgaaccccccagccccagctggggaccacgcccggctggatggcctgagcaagatggacacagagaaggccgccagcgccaaccacgtgaagcccaagccagagctgaccagcatccagggccagcctgccagcaccagccagcccctgctgaaggcccacagcgaggtgttcaccaagcccagcggccagcagaccctgagcccagaccggcaggtgccccggcccacagccctgccccggcggcagcccaccgtgcacttcagtgatgtgtccagtgatgatgatgaagatcggctggtgattgccacctag

SEQ ID NO: 155624 - DNA, 7341 bp, Artificial Sequence
  Description of Artificial Sequence: Synthetic coding sequence
atggacacaggagacacagccctgggccagaaggccaccagccgcagcggggagacagacaaggccagcggccgctggaggcaggagcagagcgctgtgatcaagatgagcaccttcggcagccatgagggccagaggcagccccagatcgagcctgagcagatcggcaacacagccagcgcccagctgtttggcagcggcaagctggccagccccagcgaggtggtgcagcaggtggccgagaagcagtacccaccccaccggcccagcccctacagctgccagcacagcctgtccttcccccagcacagcctgccccagggcgtgatgcacagcaccaagccccaccagagcctggagggccccccctggctgtttcctggccccctgcccagcgtggccagcgaggacctcttccccttccccatccacggccacagcggcggctaccccaggaagaagatcagcagcctgaacccagcctacagccagtacagccagaagagcattgagcaggccgaggaggcccacaagaaggagcacaagcccaagaagccaggcaagtacatctgcccctactgcagccgggcctgtgccaagcccagcgtgctgaagaagcacatccgcagccacactggagagcggccctacccctgcatcccctgtggcttctccttcaagaccaagagcaacctgtacaagcacaggaagagccacgcccacgccatcaaggccggcctggtgcccttcacagaatctgctgtgtccaagctggacctggaggccggcttcattgatgtggaggccgagatccacagtgatggagagcagagcacagacacagatgaggagagcagcctgtttgctgaggccagtgacaagatgagccctggcccccccatccccctggacatcgccagcagaggaggctaccacggcagcctggaggagagcctgggcggccccatgaaggtgcccatcctgatcatccccaagagcggcatccccctgcccaatgaaagcagccagtacatcggccctgacatgctgcccaaccccagcctgaacaccaaggcagatgacagccacacagtgaagcagaagctggccctgcggctgtctgagaagaagggccaggacagcgagcccagcctgaacctgctgagcccccacagcaagggcagcacagacagcggctacttcagccgctctgagagcgctgagcagcagatcagcccccccaacaccaatgccaagagctatgaggagatcatctttgggaagtactgccgcctgagccccagaaatgccctgtctgtgaccaccaccagccaggagcgggccgccatgggcaggaagggcatcatggagcccctgccccacgtgaacacccggctggatgtgaagatgtttgaggaccctgtgtcccagctgatccccagcaaaggagatgtggaccccagccagacctccatgctgaagagcaccaagttcaacagcgagagccggcagccccagatcatccccagcagcatcagaaatgaaggcaagctgtacccagccaacttccagggcagcaaccctgtgctgctggaggcccctgtggacagcagccccctcatccgcagcaacagcgtgcccaccagcagcgccaccaacctgaccatcccccccagcctgcggggcagccacagctttgatgagaggatgactggaagtgatgatgtgttctacccaggcaccgtgggcatccccccccagaggatgctgcggcggcaggccgcctttgagctgcccagcgtgcaggagggccacgtggaggtggagcaccacggccgcatgctgaagggcatcagcagcagcagcctgaaggagaagaagctgagccctggggacagagtgggctatgactatgatgtgtgcaggaagccctacaagaagtgggaggacagcgagacccccaagcagaactacagagacatcagctgcctgagcagcctgaagcatggaggagagtacttcatggaccctgtggtgcccctgcagggcgtgcccagcatgtttggcaccacctgtgaaaataggaagaggaggaaggagaagtctgtgggagatgaggaggacacccccatgatctgcagcagcatcgtgtccacccctgtgggcatcatggccagtgactatgaccccaagctgcagatgcaggagggcgtgcgcagcggctttgccatggccggccacgagaacctgagccacggccacacagaaagatttgacccctgccggccccagctgcagcccggcagccccagcctggtgtctgaggagagccccagcgccatcgacagcgacaagatgtctgacctgggcggcaggaagcccccaggaaatgtcatcagcgtcatccagcacaccaacagcctgagccggcccaacagctttgagaggtctgagagcgctgagctggtggcctgcacccaggacaaggcccccagccccagcgagacctgtgacagcgagatcagcgaggcccctgtgtccccagagtgggcccctcctggagatggagctgagagcggcggcaagcccagccccagccagcaggtgcagcagcagagctaccacacccagccccggctggtgcggcagcacaacatccaggtgcctgagatccgggtgacagaggagccagacaagccagagaaggagaaggaggcccagagcaaggagcctgagaagcctgtggaggagttccagtggccccagaggtctgagaccctgagccagctgcctgctgagaagctgccccccaagaagaagaggctgcggctggccgacatggagcacagcagtggagagagcagctttgagagcactggaacaggcctgagccgcagccccagccaggagagcaacctgagccacagcagcagcttctccatgagctttgagcgggaggagaccagcaagctgagcgccctgcccaagcaggatgaatttgggaagcacagcgagttcctgactgtgcctgctggcagctacagcctgtctgtgcccggccaccaccaccagaaggagatgaggcgctgcagcagcgagcagatgccctgcccccaccctgctgaggtgcctgaggtgcgcagcaagagctttgattatggcaacctgagccacgcccctgtgtctggagctgctgccagcacagtgagccccagccgggagaggaagaagtgcttcctggtgcggcaggccagcttcagcggcagccctgagatcagccagggcgaggtgggcatggaccagagcgtgaagcaggagcagctggagcacctgcatgctggcctgcggagcggctggcaccacggccccccagctgtgctgccccccctgcagcaggaggaccccgggaagcaggtggccggcccctgcccccccctgagcagcggccccctgcacctggcccagccccagatcatgcacatggacagccaggagagcctgaggaaccccctcatccagcccaccagctacatgaccagcaagcacctgcctgagcagccccacctgttcccccaccaggagaccatccccttcagccccatccagaatgccctcttccagttccagtaccccaccgtgtgcatggtgcacctgcctgcccagcagcccccctggtggcaggcccacttcccccacccctttgcccagcacccccagaagagctatggcaagcccagcttccagacagagatccacagcagctaccccctggagcacgtggccgagcacacaggcaagaagccagcagaatatgcccacaccaaggagcagacctacccctgctacagcggggccagcggcctgcaccccaagaacctgctgcccaagttccccagcgaccagagcagcaagagcacagagacccccagcgagcaggtgctgcaggaggactttgccagcgccaatgccggcagcctgcagagcctgcccggcaccgtggtgcctgtgcgcatccagacccacgtgcccagctatggctctgtgatgtacaccagcatcagccagatcctgggccagaacagccctgccatcgtcatctgcaaggtggatgagaacatgacccagaggaccctggtgaccaatgctgccatgcagggcatcggcttcaacatcgcccaggtgctgggccagcacgccggcctggagaagtaccccatctggaaggccccccagaccctgcccctgggcctggagagcagcatccccctgtgcctgcccagcaccagtgacagcgtggccaccctgggcggcagcaagaggatgctgagccctgccagcagcctggagctgttcatggagaccaagcagcagaagagggtgaaggaggagaagatgtatggccagatcgtggaggagctgtctgctgtggagctgaccaacagcgacatcaagaaggacctgagccggccccagaagccccagctggtgcggcagggctgtgccagcgagcccaaggatggcctgcagagcggcagcagcagcttcagcagcctgagccccagcagcagccaggactaccccagcgtgagccccagcagccgggagcccttcctgcccagcaaggagatgctgagcggcagccgggcccccctgcccggccagaagagcagcggccccagcgagagcaaggagagcagtgatgagctggacattgatgaaacagccagtgacatgtccatgagcccccagagcagcagcctgcctgctggagatggccagctggaggaggagggcaagggccacaagaggcctgtgggcatgctggtgaggatggccagcgcccccagcggaaatgtggccgacagcaccctgctgctgacagacatggctgacttccagcagatcctgcagttccccagcctgcggaccaccaccaccgtgtcctggtgcttcctgaactacaccaagcccaactacgtgcagcaggccaccttcaagagctctgtgtatgcctcctggtgcatcagcagctgcaaccccaaccccagcggcctgaacaccaagaccaccctggccctgctgcggagcaagcagaagatcacagctgagatctacaccctggccgccatgcacaggcctggcaccgggaagctgaccagcagcagcgcctggaagcagttcacccagatgaagccagatgccagcttcctgtttggcagcaagctggagaggaagctggtgggcaacatcctgaaggagcggggcaagggggacatccacggggacaaggacatcggcagcaagcagacagagcccatccgcatcaagatctttgagggcggctacaagagcaatgaagattatgtgtatgtgcggggccggggccggggcaagtacatctgtgaagaatgtggcatccgctgcaagaagcccagcatgctgaagaagcacatccgcacccacacagatgtgcggccctacgtgtgcaagctgtgcaactttgccttcaagaccaagggcaacctgaccaagcacatgaagagcaaggcccacatgaagaagtgcctggagctgggcgtgtccatgacctctgtggatgacacagaaacagaggaggccgagaacctggaggacctgcacaaggctgctgagaagcacagcatgagcagcatcagcacagaccaccagttcagtgatgctgaggagagtgatggagaagatggagatgacaatgatgatgatgatgaagatgaagatgactttgatgaccagggcgacctgacccccaagaccaggagccgcagcaccagcccccagcccccacgcttcagcagcctgcctgtgaatgtgggcgctgtgccccatggagtgcccagcgacagcagcctgggccacagcagcctcatctcctacctggtgaccctgcccagcatccgggtgacccagctgatgacccccagcgacagctgtgaggacacccagatgacagagtaccagaggctcttccagagcaagagcacagattctgagccagacaaggaccggctggacatccccagctgcatggatgaggagtgcatgctgcccagcgagcccagcagcagcccccgggacttcagccccagcagccaccacagcagccctggctatgacagcagcccctgccgggacaacagccccaagcgctacctgatccccaagggggacctgagccccaggaggcacctgagcccccggcgggacctgagccccatgaggcacctgagccccaggaaggaggccgccctgcggcgggagatgagccagagagatgtgagcccccggcggcacctgagcccccggcggcctgtgtccccaggcaaggacatcacagcccggcgggacctgagcccccggcgggagcggcgctacatgaccaccatccgggcccccagcccccggcgggccctgtaccacaacccccccctgtccatgggccagtacctgcaggccgagcccatcgtgctgggcccccccaacctgcggcggggcctgccccaggtgccctacttcagcctgtatggagaccaggagggcgcctatgagcaccctggcagcagcctcttccctgagggccccaatgactatgtgttcagccacctgcccctgcacagccagcagcaggtgcgggcccccatccccatggtgcctgtgggcggcatccagatggtgcacagcatgcccccagccctgagcagcctgcaccccagccccaccctgcccctgcccatggagggctttgaggagaagaagggggccagcggggagagcttcagcaaggacccctacgtgctgagcaagcagcacgagaagaggggcccccacgccctgcagagcagcggcccccccagcacccccagcagcccccggctgctgatgaagcagagcaccagcgaggacagcctgaatgccacagagcgggagcaggaggagaacatccagacctgcaccaaggccatcgccagcctgcgcatcgccacagaggaggccgccctgctgggccctgaccagcctgcccgggtgcaggagccccaccagaaccccctgggcagcgcccacgtgtccatccgccacttcagcaggcctgagcccggccagccctgcaccagcgccacccacccagacctgcatgatggagagaaggacaactttggcaccagccagacccccctggcccacagcaccttctacagcaagagctgtgtggatgacaagcagctggacttccacagcagcaaggagctgagcagcagcacagaggagagcaaggaccccagcagcgagaagagccagctgcactag

SEQ ID NO: 155625 - DNA, 7341 bp, Artificial Sequence; identical to SEQ ID NO: 155624
  Description of Artificial Sequence: Synthetic coding sequence

SEQ ID NO: 155626 - DNA, 7341 bp, Artificial Sequence; identical to SEQ ID NO: 155624
  Description of Artificial Sequence: Synthetic coding sequence

SEQ ID NO: 155627 - DNA, 7221 bp, Artificial Sequence
  Description of Artificial Sequence: Synthetic coding sequence
atggaccctgagcagagcgtgaagggcaccaagaaggccgagggcagccccaggaagaggctgaccaagggggaggccatccagacctctgtgagcagctctgtgccctacccaggcagcggcacagctgccacccaggagagccctgcccaggagctgctggccccccagcccttccctggccccagctctgtgctgcgggagggcagccaggagaagacaggccagcagcagaagccacccaagaggcctcccatcgaggcctctgtgcacatcagccagctgccccagcaccccctgaccccagccttcatgagccctgggaagccagagcacctgctggagggcagcacctggcagctggtggaccccatgaggcctggccccagcggcagctttgtggcccctggcctgcacccccagagccagctgctgcccagccacgccagcatcatccccccagaggacctgcccggggtgcccaaggtgtttgtgccccggcccagccaggtgtccctgaagcccacagaggaggcccacaagaaggagaggaagccccagaagccaggcaagtacatctgccagtactgcagccggccctgtgccaagcccagcgtgctgcagaagcacatccgcagccacactggagagcggccctacccctgtggcccctgtggcttctccttcaagaccaagagcaacctgtacaagcacaggaagagccacgcccaccgcatcaaggccggcctggccagcggcatgggcggggagatgtacccccacggcctggagatggagcgcatccctggagaggagtttgaggagcccacagaaggagagagcacagacagcgaggaggagaccagcgccaccagcggccaccctgctgagctgagcccccggcccaagcagcccctgctgagcagcggcctgtacagcagcggcagccacagcagcagccatgagcgctgcagcctgagccagagcagcacagcccagagcctggaggaccccccaccatttgtggagcccagcagcgagcaccccctgagccacaagccagaggacacccacaccatcaagcagaagctggccctgcggctgtctgagaggaagaaggtgattgatgagcaggccttcctgagccctggcagcaagggcagcacagaaagtggctacttcagccgctctgagagcgctgagcagcaggtgagcccccccaacaccaatgccaagagctatgcagagatcatctttggaaaatgtggcagaattggccagaggacagccatgctgacagccaccagcacccagcccctgctgcccctgagcacagaggacaagcccagcctggtgcccctgtctgtgcccaggacccaggtgattgagcacatcaccaagctgatcaccatcaatgaggccgtggtggacaccagcgagattgattctgtgaagcccaggaggagcagcctgagcagaagaagctccatggagagccccaagagcagcctgtaccgggagcccctgagcagccacagcgagaagaccaagccagagcagagcctgctgagcctgcagcacccccccagcacagcccctcctgtgcccctgctgcggagccacagcatgcccagcgctgcctgcaccatcagcaccccccaccaccccttccggggcagctacagctttgatgaccacatcacagacagcgaggccctgagccacagcagccacgtgttcaccagccaccccaggatgctgaagaggcagcctgccatcgagctgcccctgggcggggagtacagcagcgaggagcccggccccagcagcaaggacacagccagcaagcccagtgatgaggtggagcccaaggagagcgagctgaccaagaagaccaagaagggcctgaagaccaagggcgtcatctatgagtgcaacatctgtggggcccgctacaagaagagggacaactatgaggcccacaagaagtactactgcagcgagctgcagatcgccaagcccatctctgctggcacccacaccagccctgaggccgagaagagccagatcgagcacgagccctggagccagatgatgcactacaagctgggcaccaccctggagctgacccccctgaggaagaggaggaaggagaagagcctgggagatgaggaggagcccccagcctttgagagcaccaagagccagtttggcagccctggccccagtgatgctgccaggaacctgcccctggagagcaccaagagccctgctgagcccagcaagtctgtgcccagcctggagggccccaccggcttccagcccaggacccccaagccaggcagcggcagcgagagcggcaaggagaggaggaccaccagcaaggagatcagcgtcatccagcacaccagcagctttgagaagagtgacagcctggagcagcccagcggcctggagggggaggacaagcccctggcccagttccccagccccccaccagccccccacggccgcagcgcccacagcctgcagcccaagctggtgcggcagcccaacatccaggtgcctgagatcctggtgacagaggagccagacagaccagacacagagcctgagcccccacccaaggagcctgagaagacagaggagttccagtggccccagaggagccagaccctggcccagctgcctgctgagaagctgccccccaagaagaagaggctgcggctggccgagatggcccagagcagtggagagagcagctttgagagctctgtgcccctgagccgcagccccagccaggagagcaatgtgtccctgagcggcagcagccgcagcgccagctttgaaagagatgaccacggcaaggccgaggcccccagccccagcagtgacatgaggcccaagcccctgggcacccacatgctgactgtgcccagccaccacccccacgcccgggagatgagaagaagtgccagcgagcagagccccaacgtgagccacagcgcccacatgacagagaccaggagcaagagctttgattatggcagcctgagcctgaccggccccagcgccccagcccctgtggcccccccagcccgggtggcccctcctgagaggaggaagtgcttcctggtgcggcaggccagcctgagccggcccccagagagcgagctggaggtggcccccaagggccggcaggagagcgaggagccccagcccagcagcagcaagcccagcgccaagagcagcctgagccagatcagcagcgctgccaccagccatggaggccccccaggcggcaagggccctggccaggacaggcctcccctgggccccaccgtgccctacacagaggccctgcaggtgttccaccaccctgtggcccagacccccctgcacgagaagccctacctgcccccacctgtgtccctcttctccttccagcacctggtgcagcacgagcccggccagagccctgagttcttcagcacccaggccatgagcagcctgctgagcagcccctacagcatgccacccctgccccccagcctcttccaggccccacccctgcccctgcagcccaccgtgctgcaccctggccagctgcacctgccccagctgatgccccacccagccaacatccccttccggcagccccccagcttcctgcccatgccctaccccaccagcagcgccctgagcagcggcttcttcctgcccctgcagagccagtttgccctgcagctgcctggagatgtggagagccacctgccccagatcaagaccagcctggcccccctggccaccggcagcgctggcctgagccccagcacagagtacagcagtgacatccggctgccccctgtggcccccccagccagcagcagcgcccccaccagcgccccacccctggccctgcctgcctgcccagacaccatggtgtccctggtggtgcctgtgcgggtgcagaccaacatgcccagctatggcagcgccatgtacaccaccctgagccagatcctggtgacccagagccagggcagcagcgccaccgtggccctgcccaagtttgaggagccccccagcaagggcaccaccgtgtgtggggctgatgtgcatgaggtgggccctggccccagcggcctgtctgaggagcagagccgggccttccccaccccctacctgcgggtgcctgtgaccctgcctgagaggaagggcaccagcctgagcagcgagagcatcctgagcctggagggcagcagcagcacagctgggggcagcaagagggtgctgagccctgctggcagcctggagctgaccatggagacccagcagcagaagagggtgaaggaggaggaggccagcaaggcagatgagaagctggagctggtgaagccctgcagcgtggtgctgaccagcacagaagatggcaagaggcctgagaagagccacctgggcaaccagggccagggcagaagagagctggagatgctgagcagcctgagcagtgaccccagcgacaccaaggagatcccccccctgccccacccagccctgagccacggcacagcccctggcagcgaggccctgaaggagtacccccagcccagcggcaagccccacagaagaggcctgacccccctgtctgtgaagaaggaggacagcaaggagcagcctgacctgcccagcctggccccacccagcagcctgcccctgtctgagaccagcagcaggcctgccaagagccaggagggcacagacagcaagaaggtgctgcagttccccagcctgcacaccaccaccaacgtgtcctggtgctacctgaactacatcaagcccaaccacatccagcacgccgaccggcgcagctctgtgtatgccggctggtgcatcagcctgtacaaccccaacctgcccggggtgtccaccaaggccgccctgagcctgctgcggagcaagcagaaggtgtccaaggagacctacaccatggccacagccccccaccctgaggccggccgcctggtgcccagcagcagcaggaagcccaggatgacagaggtgcacctgcccagcctggtgtccccagagggccagaaggacctggcccgggtggagaaggaggaggagaggagaggagagccagaagaagatgccccagccagccagagaggagagcccgcccgcatcaagatctttgaaggaggctacaagagcaatgaggagtatgtgtatgtgcggggccggggccggggcaagtatgtgtgtgaggagtgtggcatccgctgcaagaagcccagcatgctgaagaagcacatccgcacccacacagatgtgcggccctacgtgtgcaagcactgccactttgccttcaagaccaagggcaacctgaccaagcacatgaagagcaaggcccacagcaagaagtgccaggagactggagtgctggaggagctggaggccgaggagggcaccagtgatgacctcttccaggacagcgagggccgggagggcagcgaggccgtggaggagcaccagttcagtgacctggaggacagcgacagcgacagcgacctggatgaagatgaagatgaagatgaggaggagagccaggatgagctgagccggcccagcagcgaggcccctcctcctggccccccccacgccctgcgggctgacagcagccccatcctgggcccccagcccccagatgccccagccagcggcacagaggccacccggggcagctctgtgtctgaggccgagcggctgacagccagcagctgcagcatgagcagccagagcatgcctggcctgccctggctgggccctgcccccctgggctctgtggagaaggacaccggcagcgccctgagctacaagcctgtgagcccccggcggccctggagccccagcaaggaggccggcagcaggcctcccctggccaggaagcacagcctgaccaagaatgacagcagcccccagcgctgcagccctgcccgggagccccaggccagcgcccccagccccccaggcctgcacgtggaccccggccggggcatgggcgccctgccctgtggcagcccccggctgcagctgagccccctgaccctgtgccccctgggccgggagctggccccccgggcccacgtgctgagcaagctggagggcaccacagatcctggcctgccccgctacagccccacccggcgctggagccctggccaggccgagagcccccccaggtctgcccctcctgggaagtgggccctggccggccctggcagccccagcgctggggagcacggccctggcctgggcctggacccccgggtgctcttccccccagcccccctgccccacaagctgctgagccgcagccctgagacctgtgccagcccctggcagaaggccgagagccgcagccccagctgcagccctggccctgcccaccccctgagcagccggcccttcagcgccctgcatgacttccacggccacatcctggccaggacagaggagaacatcttcagccacctgcccctgcacagccagcacctgacccgggccccctgccccctcatccccatcggcggcatccagatggtgcaggcccggcctggggcccaccccaccctgctgcccggccccacagctgcctgggtgtctggcttcagcggcggcggcagtgacctgactggagcccgggaggcccaggagcggggccgctggagccccacagagagcagcagcgcctctgtgtcccctgtggccaaggtgtccaagttcaccctgagcagcgagctggagggcggggactaccccaaggagcgggagaggactggaggcggccctggccggcccccagactggaccccccacggcaccggggccccagctgagcccacccccacccacagcccctgcaccccaccagacaccctgccccggcccccccagggccggcgggccgcccagagctggagcccccggctggagagcccccgggcccccaccaaccctgagcccagcgccaccccacccctggacaggagcagctctgtgggctgcctggccgaggccagcgcccgcttccctgcccggaccaggaacctgtctggagagcccaggacccggcaggacagccccaagcccagcggcagcggggagccccgggcccacccccaccagccagaagatagagtgcccccaaatgcctag

SEQ ID NO: 155628 - DNA, 7221 bp, Artificial Sequence; identical to SEQ ID NO: 155627
  Description of Artificial Sequence: Synthetic coding sequence

SEQ ID NO: 155629 - DNA, 7218 bp, Artificial Sequence
  Description of Artificial Sequence: Synthetic coding sequence
atggaccctgagcagagcgtgaagggcaccaagaaggccgagggcagccccaggaagaggctgaccaagggggaggccatccagacctctgtgagcagctctgtgccctacccaggcagcggcacagctgccacccaggagagccctgcccaggagctgctggccccccagcccttccctggccccagctctgtgctgcgggagggcagccaggagaagacaggccagcagcagaagccacccaagaggcctcccatcgaggcctctgtgcacatcagccagctgccccagcaccccctgaccccagccttcatgagccctgggaagccagagcacctgctggagggcagcacctggcagctggtggaccccatgaggcctggccccagcggcagctttgtggcccctggcctgcacccccagagccagctgctgcccagccacgccagcatcatccccccagaggacctgcccggggtgcccaaggtgtttgtgccccggcccagccaggtgtccctgaagcccacagaggaggcccacaagaaggagaggaagccccagaagccaggcaagtacatctgccagtactgcagccggccctgtgccaagcccagcgtgctgcagaagcacatccgcagccacactggagagcggccctacccctgtggcccctgtggcttctccttcaagaccaagagcaacctgtacaagcacaggaagagccacgcccaccgcatcaaggccggcctggccagcggcatgggcggggagatgtacccccacggcctggagatggagcgcatccctggagaggagtttgaggagcccacagaaggagagagcacagacagcgaggaggagaccagcgccaccagcggccaccctgctgagctgagcccccggcccaagcagcccctgctgagcagcggcctgtacagcagcggcagccacagcagcagccatgagcgctgcagcctgagccagagcagcacagcccagagcctggaggaccccccaccatttgtggagcccagcagcgagcaccccctgagccacaagccagaggacacccacaccatcaagcagaagctggccctgcggctgtctgagaggaagaaggtgattgatgagcaggccttcctgagccctggcagcaagggcagcacagaaagtggctacttcagccgctctgagagcgctgagcagcaggtgagcccccccaacaccaatgccaagagctatgcagagatcatctttggaaaatgtggcagaattggccagaggacagccatgctgacagccaccagcacccagcccctgctgcccctgagcacagaggacaagcccagcctggtgcccctgtctgtgcccaggacccaggtgattgagcacatcaccaagctgatcaccatcaatgaggccgtggtggacaccagcgagattgattctgtgaagcccaggaggagcagcctgagcagaagaagctccatggagagccccaagagcagcctgtaccgggagcccctgagcagccacagcgagaagaccaagccagagcagagcctgctgagcctgcagcacccccccagcacagcccctcctgtgcccctgctgcggagccacagcatgcccagcgctgcctgcaccatcagcaccccccaccaccccttccggggcagctacagctttgatgaccacatcacagacagcgaggccctgagccacagcagccacgtgttcaccagccaccccaggatgctgaagaggcagcctgccatcgagctgcccctgggcggggagtacagcagcgaggagcccggccccagcagcaaggacacagccagcaagcccagtgatgaggtggagcccaaggagagcgagctgaccaagaagaccaagaagggcctgaagaccaagggcgtcatctatgagtgcaacatctgtggggcccgctacaagaagagggacaactatgaggcccacaagaagtactactgcagcgagctgcagatcgccaagcccatctctgctggcacccacaccagccctgaggccgagaagagccagatcgagcacgagccctggagccagatgatgcactacaagctgggcaccaccctggagctgacccccctgaggaagaggaggaaggagaagagcctgggagatgaggaggagcccccagcctttgagagcaccaagagccagtttggcagccctggccccagtgatgctgccaggaacctgcccctggagagcaccaagagccctgctgagcccagcaagtctgtgcccagcctggagggccccaccggcttccagcccaggacccccaagccaggcagcggcagcgagagcggcaaggagaggaggaccaccagcaaggagatcagcgtcatccagcacaccagcagctttgagaagagtgacagcctggagcagcccagcggcctggagggggaggacaagcccctggcccagttccccagccccccaccagccccccacggccgcagcgcccacagcctgcagcccaagctggtgcggcagcccaacatccaggtgcctgagatcctggtgacagaggagccagacagaccagacacagagcctgagcccccacccaaggagcctgagaagacagaggagttccagtggccccagaggagccagaccctggcccagctgcctgctgagaagctgccccccaagaagaagaggctgcggctggccgagatggcccagagcagtggagagagcagctttgagagctctgtgcccctgagccgcagccccagccaggagagcaatgtgtccctgagcggcagcagccgcagcgccagctttgaaagagatgaccacggcaaggccgaggcccccagccccagcagtgacatgaggcccaagcccctgggcacccacatgctgactgtgcccagccaccacccccacgcccgggagatgagaagaagtgccagcgagcagagccccaacgtgagccacagcgcccacatgacagagaccaggagcaagagctttgattatggcagcctgagcctgaccggccccagcgccccagcccctgtggcccccccagcccgggtggcccctcctgagaggaggaagtgcttcctggtgcggcaggccagcctgagccggcccccagagagcgagctggaggtggcccccaagggccggcaggagagcgaggagccccagcccagcagcagcaagcccagcgccaagagcagcctgagccagatcagcagcgctgccaccagccatggaggccccccaggcggcaagggccctggccaggacaggcctcccctgggccccaccgtgccctacacagaggccctgcaggtgttccaccaccctgtggcccagacccccctgcacgagaagccctacctgcccccacctgtgtccctcttctccttccagcacctggtgcagcacgagcccggccagagccctgagttcttcagcacccaggccatgagcagcctgctgagcagcccctacagcatgccacccctgccccccagcctcttccaggccccacccctgcccctgcagcccaccgtgctgcaccctggccagctgcacctgccccagctgatgccccacccagccaacatccccttccggcagccccccagcttcctgcccatgccctaccccaccagcagcgccctgagcagcggcttcttcctgcccctgcagagccagtttgccctgcagctgcctggagatgtggagagccacctgccccagatcaagaccagcctggcccccctggccaccggcagcgctggcctgagccccagcacagagtacagcagtgacatccggctgccccctgtggcccccccagccagcagcagcgcccccaccagcgccccacccctggccctgcctgcctgcccagacaccatggtgtccctggtggtgcctgtgcgggtgcagaccaacatgcccagctatggcagcgccatgtacaccaccctgagccagatcctggtgacccagagccagggcagcagcgccaccgtggccctgcccaagtttgaggagccccccagcaagggcaccaccgtgtgtggggctgatgtgcatgaggtgggccctggccccagcggcctgtctgaggagcagagccgggccttccccaccccctacctgcgggtgcctgtgaccctgcctgagaggaagggcaccagcctgagcagcgagagcatcctgagcctggagggcagcagcagcacagctgggggcagcaagagggtgctgagccctgctggcagcctggagctgaccatggagacccagcagcagaagagggtgaaggaggaggaggccagcaaggcagatgagaagctggagctggtgaagccctgcagcgtggtgctgaccagcacagaagatggcaagaggcctgagaagagccacctgggcaaccagggccagggcagaagagagctggagatgctgagcagcctgagcagtgaccccagcgacaccaaggagatcccccccctgccccacccagccctgagccacggcacagcccctggcagcgaggccctgaaggagtacccccagcccagcggcaagccccacagaagaggcctgacccccctgtctgtgaagaaggaggacagcaaggagcagcctgacctgcccagcctggccccacccagcagcctgcccctgtctgagaccagcagcaggcctgccaagagccaggagggcacagacagcaagaaggtgctgcagttccccagcctgcacaccaccaccaacgtgtcctggtgctacctgaactacatcaagcccaaccacatccagcacgccgaccggcgcagctctgtgtatgccggctggtgcatcagcctgtacaaccccaacctgcccggggtgtccaccaaggccgccctgagcctgctgcggagcaagcagaaggtgtccaaggagacctacaccatggccacagccccccaccctgaggccggccgcctggtgcccagcagcagcaggaagcccaggatgacagaggtgcacctgcccagcctggtgtccccagagggccagaaggacctggcccgggtggagaaggaggaggagaggagaggagagccagaagaagatgccccagccagccagagaggagagcccgcccgcatcaagatctttgaaggaggctacaagagcaatgaggagtatgtgtatgtgcggggccggggccggggcaagtatgtgtgtgaggagtgtggcatccgctgcaagaagcccagcatgctgaagaagcacatccgcacccacacagatgtgcggccctacgtgtgcaagcactgccactttgccttcaagaccaagggcaacctgaccaagcacatgaagagcaaggcccacagcaagaagtgccaggagactggagtgctggaggagctggaggccgaggagggcaccagtgatgacctcttccaggacagcgagggccgggagggcagcgaggccgtggaggagcaccagttcagtgacctggaggacagcgacagcgacagcgacctggatgaagatgaagatgaagatgaggaggagagccaggatgagctgagccggcccagcagcgaggcccctcctcctggccccccccacgccctgcgggctgacagcagccccatcctgggcccccagcccccagatgccccagccagcggcacagaggccacccggggcagctctgtgtctgaggccgagcggctgacagccagcagctgcagcatgagcagccagagcatgcctggcctgccctggctgggccctgcccccctgggctctgtggagaaggacaccggcagcgccctgagctacaagcctgtgagcccccggcggccctggagccccagcaaggaggccggcagcaggcctcccctggccaggaagcacagcctgaccaagaatgacagcagcccccagcgctgcagccctgcccgggagccccaggccagcgcccccagccccccaggcctgcacgtggaccccggccggggcatgggcgccctgccctgtggcagcccccggctgcagctgagccccctgaccctgtgccccctgggccgggagctggccccccgggcccacgtgctgagcaagctggagggcaccacagatcctggcctgccccgctacagccccacccggcgctggagccctggccaggccgagagcccccccaggtctgcccctcctgggaagtgggccctggccggccctggcagccccagcgctggggagcacggccctggcctgggcctggacccccgggtgctcttccccccagcccccctgccccacaagctgctgagccgcagccctgagacctgtgccagcccctggaaggccgagagccgcagccccagctgcagccctggccctgcccaccccctgagcagccggcccttcagcgccctgcatgacttccacggccacatcctggccaggacagaggagaacatcttcagccacctgcccctgcacagccagcacctgacccgggccccctgccccctcatccccatcggcggcatccagatggtgcaggcccggcctggggcccaccccaccctgctgcccggccccacagctgcctgggtgtctggcttcagcggcggcggcagtgacctgaccggggcccgggaggcccaggagcggggccgctggagccccacagagagcagcagcgcctctgtgtcccctgtggccaaggtgtccaagttcaccctgagcagcgagctggagggcggggactaccccaaggagcgggagaggactggaggcggccctggccggcccccagactggacccctcatggaactggagccccagctgagcccacccccacccacagcccctgcaccccaccagacaccctgcccaggcctccccagggcagaagagctgcccagagctggagcccccggctggagagcccccgggcccccaccaaccctgagcccagcgccaccccacccctggacaggagcagctctgtgggctgcctggccgaggccagcgcccgcttccctgcccggaccaggaacctgagcggggagcccaggacccggcaggacagccccaagcccagcggcagcggggagccccgggcccacccccaccagcctgaggacagagtgcccccaaatgcctag

SEQ ID NO: 155630 - DNA, 7218 bp, Artificial Sequence; identical to SEQ ID NO: 155629
  Description of Artificial Sequence: Synthetic coding sequence

SEQ ID NO: 155631 - DNA, 9429 bp, Artificial Sequence
  Description of Artificial Sequence: Synthetic coding sequence
atggccaccctggagaagctgatgaaggcctttgagagcctgaagagcttccagcagcagcagcagcagcagcagcagcagcagcagcagcagcagcagcagcagcagcagcagcccccacctcctcctcctcctcctcctccaccccagctgccccagcccccaccccaggcccagcccctgctgccccagccccagcccccacctcctcctcctcctcctcctcctggccctgctgtggccgaggagcccctgcaccggcccaagaaggagctgagcgccaccaagaaggacagagtgaaccactgcctgaccatctgtgagaacatcgtggcccagagcgtgaggaacagccctgagttccagaagctgctgggcatcgccatggagctgttcctgctgtgcagtgatgatgctgagagtgatgtgaggatggtggctgatgaatgtctgaacaaggtgatcaaggccctgatggacagcaacctgccccggctgcagctggagctgtacaaggagatcaagaagaatggagcccccaggagcctgcgggccgccctgtggaggtttgctgagctggcccacctggtgcggccccagaagtgccggccctacctggtgaacctgctgccctgcctgaccaggaccagcaagaggcctgaggagagcgtgcaggagaccctggccgctgctgtgcccaagatcatggccagctttggaaactttgccaatgacaatgagatcaaggtgctgctgaaggccttcatcgccaacctgaagagcagcagccccaccatcagaagaacagctgctggcagcgctgtgtccatctgccagcacagcaggaggacccagtacttctacagctggctgctgaatgtgctgctgggcctgctggtgcctgtggaggatgagcacagcaccctgctgatcctgggcgtgctgctgaccctgcgctacctggtgcccctgctgcagcagcaggtgaaggacaccagcctgaagggcagctttggagtgaccaggaaggagatggaggtgagccccagcgctgagcagctggtgcaggtgtatgagctgaccctgcaccacacccagcaccaggaccacaacgtggtgactggagccctggagctgctgcagcagctgttccgcaccccacctcctgagctgctgcagaccctgacagctgtgggcggcatcggccagctgacagctgccaaggaggagagcggcggccgcagccgcagcggcagcatcgtggagctgattgctgggggcggcagcagctgcagccctgtgctgagcaggaagcagaagggcaaggtgctgctgggggaggaggaggccctggaggatgattctgagagcagaagtgatgtgagcagcagcgccctgacagcctctgtgaaggatgagatctctggagagctggccgccagcagcggcgtgtccaccccaggcagcgctggccatgacatcatcacagagcagcccaggagccagcacaccctgcaggccgacagcgtggacctggccagctgtgacctgaccagcagcgccacagatggagatgaggaggacatcctgagccacagcagcagccaggtgtctgctgtgcccagcgaccctgccatggacctgaatgatggcacccaggccagcagccccatcagtgacagcagccagaccaccacagagggcccagattctgctgtgacccccagcgacagcagcgagatcgtgctggatggaacagacaaccagtacctgggcctgcagatcggccagccccaggatgaagatgaggaggccaccggcatcctgcctgatgaggccagcgaggccttcaggaacagctccatggccctgcagcaggcccacctgctgaagaacatgagccactgccggcagcccagcgacagctctgtggacaagtttgtgctgagagatgaggccacagagcccggggaccaggagaacaagccctgccgcatcaagggggacatcggccagagcacagatgatgacagcgcccccctggtgcactgtgtgcggctgctgagcgccagcttcctgctgactggaggcaagaatgtgctggtgcctgacagagatgtgcgggtgtctgtgaaggccctggccctgagctgtgtgggcgctgctgtggccctgcaccctgagagcttcttcagcaagctgtacaaggtgcccctggacaccacagagtacccagaggagcagtatgtgtctgacatcctgaactacatcgaccatggagacccccaggtgcggggggccacagccatcctgtgtggcaccctcatctgcagcatcctgagccgcagccgcttccacgtgggggactggatgggcaccatccgcaccctgaccggcaacaccttcagcctggccgactgcatccccctgctgaggaagaccctgaaggatgagagctctgtgacctgcaagctggcctgcacagctgtgaggaactgtgtgatgagcctgtgcagcagcagctacagcgagctgggcctgcagctgatcattgatgtgctgaccctgaggaacagcagctactggctggtgaggacagagctgctggagaccctggccgagattgacttccggctggtgtccttcctggaggccaaggccgagaacctgcacagaggagcccaccactacacaggcctgctgaagctgcaggagcgggtgctgaacaacgtggtgatccacctgctgggagatgaggacccccgggtgagacatgtggccgccgccagcctcatccggctggtgcccaagctgttctacaagtgtgaccagggccaggccgaccctgtggtggccgtggcccgggaccagagctctgtgtacctgaagctgctgatgcatgagacccagccccccagccacttctctgtgtccaccatcacccgcatctaccggggctacaacctgctgcccagcatcacagatgtgaccatggagaacaacctgagccgggtgattgctgctgtgtcccatgagctgatcaccagcaccacccgggccctgaccttcggctgctgtgaggccctgtgcctgctgagcacagccttccctgtgtgcatctggagcctgggctggcactgcggcgtgccccccctgagcgccagtgatgagagcaggaagagctgcaccgtgggcatggccaccatgatcctgaccctgctgagcagcgcctggttccccctggacctgagcgcccaccaggatgccctgatcctggccggcaacctgctggccgccagcgcccccaagagcctgcggagctcctgggccagcgaggaggaggccaacccagctgccaccaagcaggaggaggtgtggccagccctgggggaccgggccctggtgcccatggtggagcagctgttcagccacctgctgaaggtgatcaacatctgtgcccacgtgctggatgatgtggcccctggccctgccatcaaggccgccctgcccagcctgaccaacccccccagcctgagccccatccggaggaagggcaaggagaaggagcccggggagcaggcctctgtgcccctgagccccaagaagggcagcgaggccagcgctgccagccggcagagcgacaccagcggccctgtgaccaccagcaagagcagcagcctgggcagcttctaccacctgcccagctacctgaagctgcatgatgtgctgaaggccacccacgccaactacaaggtgaccctggacctgcagaacagcacagagaagtttggaggcttcctgcggagcgccctggatgtgctgagccagatcctggagctggccaccctgcaggacatcggcaaatgtgtggaggagatcctgggctacctgaagagctgcttcagccgggagcccatgatggccaccgtgtgtgtgcagcagctgctgaagaccctgtttggcaccaacctggccagccagtttgatggcctgagcagcaaccccagcaagagccagggccgggcccagaggctgggcagcagctctgtgcggcccggcctgtaccactactgcttcatggccccctacacccacttcacccaggccctggctgatgccagcctgaggaacatggtgcaggccgagcaggagaatgacaccagcggctggtttgatgtgctgcagaaggtgtccacccagctgaagaccaacctgacctctgtgaccaagaacagagctgacaagaatgccatccacaaccacatccggctgtttgagcccctggtgatcaaggccctgaagcagtacaccaccaccacctgtgtgcagctgcagaagcaggtgctggacctgctggcccagctggtgcagctgcgggtgaactactgcctgctggacagcgaccaggtgttcatcggctttgtgctgaagcagtttgagtacatcgaggtgggccagttccgggagagcgaggccatcatccccaacatcttcttcttcctggtgctgctgtcctatgaaagataccacagcaagcagatcatcggcatccccaagatcatccagctgtgtgatggcatcatggccagcggcaggaaggctgtgacccacgccatcccagccctgcagcccatcgtgcatgacctgtttgtgctgcggggcaccaacaaggcagatgctgggaaggagctggagacccagaaggaggtggtggtgtccatgctgctgcggctcatccagtaccaccaggtgctggagatgttcatcctggtgctgcagcagtgccacaaggaaaatgaagacaagtggaagaggctgagccggcagattgctgacatcatcctgcccatgctggccaagcagcagatgcacatcgacagccatgaggccctgggcgtgctgaacaccctgtttgagatcctggcccccagcagcctgcggcctgtggacatgctgctgcgctccatgtttgtgacccccaacaccatggcctctgtgtccacagtgcagctgtggatcagcggcatcctggccatcctgcgggtgctgatcagccagagcacagaagatattgtgctgagccgcatccaggagctgtccttcagcccctacctgatcagctgcaccgtcatcaaccggctgagagatggagacagcaccagcaccctggaggagcacagcgagggcaagcagatcaagaacctgcctgaggagaccttcagccgcttcctgctgcagctggtgggcatcctgctggaggacatcgtgaccaagcagctgaaggtggagatgtctgagcagcagcacaccttctactgccaggagctgggcaccctgctgatgtgcctgatccacatcttcaagagcggcatgttccgccgcatcacagctgctgccaccaggctcttcagaagtgatggctgcggcggcagcttctacaccctggacagcctgaacctgcgggcccgctccatgatcaccacccacccagccctggtgctgctgtggtgccagatcctgctgctggtgaaccacacagactaccgctggtgggccgaggtgcagcagacccccaagaggcacagcctgagcagcaccaagctgctgagcccccagatgtctggagaggaggaggacagcgacctggccgccaagctgggcatgtgcaaccgggagatcgtgagaagaggagccctgatcctcttctgtgactatgtgtgccagaacctgcatgattctgagcacctgacctggctgattgtgaaccacatccaggacctgatcagcctgagccatgagccccctgtgcaggacttcatctctgctgtgcacagaaattctgctgccagcggcctcttcatccaggccatccagagccgctgtgagaacctgagcacccccaccatgctgaagaagaccctgcagtgcctggagggcatccacctgagccagagcggggctgtgctgaccctgtatgtggaccggctgctgtgcacccccttccgggtgctggccaggatggtggacatcctggcctgccggcgggtggagatgctgctggccgccaacctgcagagctccatggcccagctgcccatggaggagctgaaccgcatccaggagtacctgcagagcagcggcctggcccagaggcaccagaggctgtacagcctgctggaccgcttccggctgagcaccatgcaggacagcctgagccccagcccccctgtgagcagccaccccctggatggagatggccacgtgtccctggagaccgtgtccccagacaaggactggtacgtgcacctggtgaagagccagtgctggaccaggagtgacagcgccctgctggagggcgctgagctggtgaaccgcatcccagctgaggacatgaatgccttcatgatgaacagcgagttcaacctgagcctgctggccccctgcctgagcctgggcatgtctgagatcagcggcggccagaagagcgccctgtttgaagctgcccgggaggtgaccctggcccgggtgtctggaacagtgcagcagctgcctgctgtgcaccacgtgttccagcctgagctgcctgctgagcctgctgcctactggagcaagctgaatgacctgtttggagatgctgccctgtaccagagcctgcccaccctggcccgggccctggcccagtacctggtggtggtgtccaagctgcccagccacctgcacctgcccccagagaaggagaaggacatcgtgaagtttgtggtggccaccctggaggccctgtcctggcacctgatccacgagcagatccccctgagcctggacctgcaggccggcctggactgctgctgcctggccctgcagctgcccggcctgtggagcgtggtgagcagcacagaatttgtgacccacgcctgcagcctcatctactgtgtgcacttcatcctggaggccgtggccgtgcagcccggggagcagctgctgagccctgagaggaggaccaacacccccaaggccatcagcgaggaggaggaggaggtggaccccaacacccagaaccccaagtacatcacagctgcctgtgagatggtggccgagatggtggagagcctgcagagcgtgctggccctgggccacaagaggaacagcggcgtgcctgccttcctgacccccctgctgaggaacatcatcatcagcctggcccggctgcccctggtgaacagctacaccagggtgccccccctggtgtggaagctgggctggagccccaagccaggaggagactttggaacagccttccctgagatccctgtggagttcctgcaggagaaggaggtgttcaaggagttcatctaccgcatcaacaccctgggctggaccagcaggacccagtttgaggagacctgggccaccctgctgggcgtgctggtgacccagcccctggtgatggagcaggaggagagccccccagaggaggacacagagaggacccagatcaacgtgctggccgtgcaggccatcaccagcctggtgctgagcgccatgacagtgcctgtggccggcaacccagctgtgtcctgcctggagcagcagcccaggaacaagcccctgaaggccctggacaccaggtttggaaggaagctgagcatcatccggggcatcgtggagcaggagatccaggccatggtgtccaagcgggagaacatcgccacccaccacctgtaccaggcctgggaccctgtgcccagcctgagccctgccaccaccggggccctgatcagccatgagaagctgctgctgcagatcaaccctgagcgggagctgggctccatgagctacaagctgggccaggtgtccatccacagcgtgtggctgggcaacagcatcacccccctgcgggaggaggagtgggatgaggaggaggaggaggaggctgatgccccagcccccagcagcccccccaccagccctgtgaacagcaggaagcaccgggccggcgtggacatccacagctgcagccagttcctgctggagctgtacagccgctggatcctgcccagcagcagcgcccggaggaccccagccatcctgatcagcgaggtggtgcgcagcctgctggtggtgtctgacctcttcacagagaggaaccagtttgagctgatgtatgtgaccctgacagagctgcggcgggtgcaccccagtgaagatgagatcctggcccagtacctggtgcctgccacctgcaaggctgctgctgtgctgggcatggacaaggctgtggccgagcctgtgtcccggctgctggagagcaccctgcggagcagccacctgcccagccgggtgggcgccctgcacggcgtgctgtatgtgctggagtgtgacctgctggatgacacagccaagcagctgatccctgtgatcagtgactacctgctgagcaacctgaagggcatcgcccactgtgtgaacatccacagccagcagcacgtgctggtgatgtgtgccacagccttctacctgattgagaactaccccctggatgtgggccctgagttcagcgccagcatcatccagatgtgtggggtgatgctgagcggcagcgaggagagcacccccagcatcatctaccactgtgccctgcggggcctggagcggctgctgctgtctgagcagctgagccggctggatgctgagagcctggtgaagctgtctgtggacagagtgaatgtgcacagcccccaccgggccatggccgccctgggcctgatgctgacctgcatgtacaccgggaaggagaaggtgtccccaggccgcaccagtgaccccaacccagctgccccagacagcgagagcgtcatcgtggccatggagcgggtgtctgtgctgtttgaccgcatcaggaagggcttcccctgtgaggcccgggtggtggcccgcatcctgccccagttcctggatgacttcttccccccccaggacatcatgaacaaggtgattggagagttcctgagcaaccagcagccctacccccagttcatggccaccgtggtgtacaaggtgttccagaccctgcacagcacaggccagagctccatggtgcgggactgggtgatgctgagcctgagcaacttcacccagagggcccctgtggccatggccacctggagcctgagctgcttctttgtgtctgccagcaccagcccctgggtggccgccatcctgccccacgtgatcagcaggatgggcaagctggagcaggtggatgtgaacctcttctgcctggtggccacagacttctaccgccaccagatcgaggaggagctggacagaagagccttccagagcgtgctggaggtggtggccgcccctggcagcccctaccaccggctgctgacctgcctgagaaatgtgcacaaggtgaccacctgctag

SEQ ID NO: 155632 - DNA, 3114 bp, Artificial Sequence
  Description of Artificial Sequence: Synthetic coding sequence
atggacaggatggccagctccatgaagcaggtgcccaaccccctgcccaaggtgctgagcagaagaggagtgggcgccggcctggaggccgctgagcgggagagctttgagaggacccagacagtgtccatcaacaaggccatcaacacccaggaggtggccgtgaaggagaagcacgcccggacctgcatcctgggcacccaccacgagaagggggcccagaccttctggagcgtggtgaaccggctgcccctgagcagcaatgctgtgctgtgctggaagttctgccacgtgttccacaagctgctgagagatggccaccccaacgtgctgaaggacagcctgcgctacagaaatgagctgagtgacatgagcaggatgtggggccacctgtctgagggctacggccagctgtgcagcatctacctgaagctgctgcggaccaagatggagtaccacaccaagaacccccgcttccctggcaacctgcagatgtctgaccggcagctggatgaagctggggagagtgatgtgaacaacttcttccagctgactgtggagatgtttgactacctggagtgtgagctgaacctcttccagacagtgttcaacagcctggacatgagccgctctgtgtctgtgacagctgctggccagtgccgcctggcccccctcatccaggtgatcctggactgcagccacctgtatgactacacagtgaagctgctcttcaagctgcacagctgcctgcctgctgacaccctgcagggccaccgggaccgcttcatggagcagttcaccaagctgaaggacctcttctaccgcagcagcaacctgcagtacttcaagaggctcatccagatcccccagctgcctgaaaatccacccaacttcctgcgggccagcgccctgtctgagcacatcagccctgtggtggtgatcccagctgaggccagcagcccagattctgagcctgtgctggagaaggatgacctgatggacatggatgccagccagcagaacctgtttgacaacaagtttgatgacatcttcggcagcagcttcagcagtgaccccttcaacttcaacagccagaatggagtgaacaaggatgagaaggaccacctgattgagcggctgtaccgggagatcagcggcctgaaggcccagctggagaacatgaagacagagagccagagggtggtgctgcagctgaagggccacgtgtctgagctggaggccgacctggccgagcagcagcacctgcggcagcaggccgcagatgactgtgagttcctgcgggcagagctggatgagctgcggcggcagcgggaggacacagagaaggcccagaggagcctgtctgaaattgaaaggaaggcccaggccaatgagcagcgctacagcaagctgaaggagaagtacagcgagctggtgcagaaccacgccgacctgctgaggaagaatgctgaggtgaccaagcaggtgtccatggcccggcaggcccaggtggacctggagcgggagaagaaggagctggaggacagcctggagcgcatcagtgaccagggccagaggaagacccaggagcagctggaggtgctggagagcctgaagcaggagctggccaccagccagcgggagctgcaggtgctgcagggcagcctggagaccagcgcccagagcgaggccaactgggccgctgagtttgctgagctggagaaggagcgggacagcctggtgtctggggccgcccaccgggaggaggagctgagcgccctgaggaaggagctgcaggacacccagctgaagctggccagcacagaggagagcatgtgccagctggccaaggaccagaggaagatgctgctggtgggcagcaggaaggctgctgagcaggtgatccaggatgccctgaaccagctggaggagcccccactcatcagctgtgccggcagcgctgaccacctgctgagcacagtgaccagcatcagcagctgcatcgagcagctggagaagtcctggagccagtacctggcctgcccagaggacatcagcggcctgctgcacagcatcaccctgctggcccacctgaccagtgatgccatcgcccatggagccaccacctgcctgcgggcccctcctgagcctgctgacagcctgacagaggcctgcaagcagtatggccgggagaccctggcctacctggccagcctggaggaggagggcagcctggagaatgctgacagcacagccatgaggaactgcctgagcaagatcaaggccatcggggaggagctgctgccccggggcctggacatcaagcaggaggagctgggggacctggtggacaaggagatggccgccaccagcgctgccatcgagacagccacagccagaattgaggagatgctgagcaagagccgggccggggacacaggagtgaagctggaggtgaatgaaagaatcctgggctgctgcaccagcctgatgcaggccatccaggtgctgattgtggccagcaaggacctgcagcgggagatcgtggagagcggccggggcacagccagccccaaggagttctacgccaagaacagccgctggacagagggcctcatcagcgccagcaaggctgtgggctggggcgccaccgtgatggtggatgctgctgacctggtggtgcagggccggggcaagtttgaggagctgatggtgtgcagccatgaaattgctgccagcacagcccagctggtggccgccagcaaggtgaaggctgacaaggacagccccaacctggcccagctgcagcaggccagcagaggagtgaaccaggccacagctggggtggtggccagcaccatcagcggcaagagccagatcgaggagacagacaacatggacttcagctccatgaccctgacccagatcaagaggcaggagatggacagccaggtgcgggtgctggagctggagaatgagctgcagaaggagcggcagaagctgggggagctgaggaagaagcactatgagctggccggcgtggccgagggctgggaggagggcacagaggccagcccccccaccctgcaggaggtggtgacagagaaggagtag

SEQ ID NO: 155633 - DNA, 2961 bp, Artificial Sequence
  Description of Artificial Sequence: Synthetic coding sequence
atggacaggatggccagctccatgaagcaggtgcccaaccccctgcccaaggtgctgagcagaagaggagtgggcgccggcctggaggccgctgagcgggagagctttgagaggacccagacagtgtccatcaacaaggccatcaacacccaggaggtggccgtgaaggagaagcacgcccggacctgcatcctgggcacccaccacgagaagggggcccagaccttctggagcgtggtgaaccggctgcccctgagcagcaatgctgtgctgtgctggaagttctgccacgtgttccacaagctgctgagagatggccaccccaacgtgctgaaggacagcctgcgctacagaaatgagctgagtgacatgagcaggatgtggggccacctgtctgagggctacggccagctgtgcagcatctacctgaagctgctgcggaccaagatggagtaccacaccaagaacccccgcttccctggcaacctgcagatgtctgaccggcagctggatgaagctggggagagtgatgtgaacaacttcttccagctgactgtggagatgtttgactacctggagtgtgagctgaacctcttccagacagtgttcaacagcctggacatgagccgctctgtgtctgtgacagctgctggccagtgccgcctggcccccctcatccaggtgatcctggactgcagccacctgtatgactacacagtgaagctgctcttcaagctgcacagctgcctgcctgctgacaccctgcagggccaccgggaccgcttcatggagcagttcaccaagctgaaggacctcttctaccgcagcagcaacctgcagtacttcaagaggctcatccagatcccccagctgcctgaaaatccacccaacttcctgcgggccagcgccctgtctgagcacatcagccctgtggtggtgatcccagctgaggccagcagcccagattctgagcctgtgctggagaaggatgacctgatggacatggatgccagccagcagaacctgtttgacaacaagtttgatgacatcttcggcagcagcttcagcagtgaccccttcaacttcaacagccagaatggagtgaacaaggatgagaaggaccacctgattgagcggctgtaccgggagatcagcggcctgaaggcccagctggagaacatgaagacagagagccagagggtggtgctgcagctgaagggccacgtgtctgagctggaggccgacctggccgagcagcagcacctgcggcagcaggccgcagatgactgtgagttcctgcgggcagagctggatgagctgcggcggcagcgggaggacacagagaaggcccagaggagcctgtctgaaattgaaaggaaggcccaggccaatgagcagcgctacagcaagctgaaggagaagtacagcgagctggtgcagaaccacgccgacctgctgaggaagaatgctgaggtgaccaagcaggtgtccatggcccggcaggcccaggtggacctggagcgggagaagaaggagctggaggacagcctggagcgcatcagtgaccagggccagaggaagacccaggagcagctggaggtgctggagagcctgaagcaggagctggccaccagccagcgggagctgcaggtgctgcagggcagcctggagaccagcgcccagagcgaggccaactgggccgctgagtttgctgagctggagaaggagcgggacagcctggtgtctggggccgcccaccgggaggaggagctgagcgccctgaggaaggagctgcaggacacccagctgaagctggccagcacagaggagagcatgtgccagctggccaaggaccagaggaagatgctgctggtgggcagcaggaaggctgctgagcaggtgatccaggatgccctgaaccagctggaggagcccccactcatcagctgtgccggcagcgctgaccacctgctgagcacagtgaccagcatcagcagctgcatcgagcagctggagaagtcctggagccagtacctggcctgcccagaggacatcagcggcctgctgcacagcatcaccctgctggcccacctgaccagtgatgccatcgcccatggagccaccacctgcctgcgggcccctcctgagcctgctgacagcctgacagaggcctgcaagcagtatggccgggagaccctggcctacctggccagcctggaggaggagggcagcctggagaatgctgacagcacagccatgaggaactgcctgagcaagatcaaggccatcggggaggagctgctgccccggggcctggacatcaagcaggaggagctgggggacctggtggacaaggagatggccgccaccagcgctgccatcgagacagccacagccagaattgagggcacagccagccccaaggagttctacgccaagaacagccgctggacagagggcctcatcagcgccagcaaggctgtgggctggggcgccaccgtgatggtggatgctgctgacctggtggtgcagggccggggcaagtttgaggagctgatggtgtgcagccatgaaattgctgccagcacagcccagctggtggccgccagcaaggtgaaggctgacaaggacagccccaacctggcccagctgcagcaggccagccggggcgtgaaccaggccacagctggggtggtggccagcaccatcagcggcaagagccagatcgaggagacagacaacatggacttcagctccatgaccctgacccagatcaagaggcaggagatggacagccaggtgcgggtgctggagctggagaatgagctgcagaaggagcggcagaagctgggggagctgaggaagaagcactatgagctggccggcgtggccgagggctgggaggagggcacagaggccagcccccccaccctgcaggaggtggtgacagagaaggagtag

SEQ ID NO: 155634 - DNA, 3207 bp, Artificial Sequence
  Description of Artificial Sequence: Synthetic coding sequence
atgaacagcatcaagaatgtgcctgcccgggtgctgagccggcggcccggccacagcctggaggccgagcgggagcagtttgacaagacccaggccatcagcatcagcaaggccatcaacacccaggaggcccctgtgaaggagaagcacgcccggcgcatcatcctgggcacccaccacgagaagggggccttcaccttctggagctatgccatcggcctgcccctgcccagcagcagcatcctgtcctggaagttctgccacgtgctgcacaaggtgctgagagatggccaccccaacgtgctgcatgactgccagcgctaccgcagcaacatccgggagattggagacctgtggggccacctgcatgacagatatggccagctggtgaatgtgtacaccaagctgctgctgaccaagatctccttccacctgaagcacccccagtttcctgctggcctggaggtgacagatgaggtgctggagaaggctgctggaacagatgtgaacaacatcttccagctgactgtggagatgtttgactacatggactgtgagctgaagctgtctgagagcgtcttccggcagctgaacacagccatcgctgtgtcccagatgagcagcggccagtgccgcctggcccccctcatccaggtgatccaggactgcagccacctgtaccactacacagtgaagctgctcttcaagctgcacagctgcctgcctgctgacaccctgcagggccaccgggaccgcttccacgagcagttccacagcctgaggaacttcttcagaagagccagtgacatgctgtacttcaagaggctcatccagatcccccggctgcctgagggcccccccaacttcctgcgggccagcgccctggccgagcacatcaagcctgtggtggtgattcctgaggaggccccagaagatgaggagcctgagaacctgattgagatcagcactggacctcctgctggggagcctgtggtggtggccgacctgtttgaccagacctttggacctccaaatggatctgtgaaggatgaccgggacctgcagatcgagagcctgaagcgggaggtggagatgctgcggtctgagctggagaagatcaagctggaggcccagcgctacatcgcccagctgaagagccaggtgaatgccctggagggggagctggaggagcagaggaagcagaagcagaaggccctggtggacaatgagcagctgcggcatgagctggcccagctgcgggccgcccagctggagggggagaggagccagggcctgcgggaggaggccgagaggaaggccagcgccacagaggcccgctacaacaagctgaaggagaagcacagcgagctggtgcacgtgcacgccgagctgctgaggaagaatgctgacacagccaagcagctgactgtgacccagcagagccaggaggaggtggcccgggtgaaggagcagctggccttccaggtggagcaggtgaagcgggagagcgagctgaagctggaggagaagagtgaccagctggagaagctgaagcgggagctggaggccaaggccggggagctggcccgggcccaggaggccctgagccacacagagcagagcaagtctgagctgagcagccggctggacaccctgtctgctgagaaggatgccctgagcggggctgtgcggcagcgggaggccgacctgctggccgcccagagcctggtgcgggagacagaggccgccctgagccgggagcagcagaggagcagccaggagcagggcgagctgcagggccgcctggccgagcgggagagccaggagcagggcctgcggcagaggctgctggatgagcagtttgctgtgctgcggggagctgctgctgaggccgccggcatcctgcaggatgctgtgtccaagctggatgaccccctgcacctgcgctgcaccagcagcccagactacctggtgtcccgggcccaggaggccctggatgctgtgtccaccctggaggagggccacgcccagtacctgaccagcctggctgatgccagcgccctggtggccgccctgacccgcttcagccacctggccgctgacaccatcatcaatggaggagccaccagccacctggcccccacagatcctgctgaccggctgattgacacctgcagagaatgtggggcccgggccctggagctgatgggccagctgcaggaccagcaggccctgcggcacatgcaggccagcctggtgaggacccccctgcagggcatcctgcagctgggccaggagctgaagcccaagagcctggatgtgcggcaggaggagctgggcgctgtggtggacaaggagatggccgccaccagcgctgccattgaagatgctgtgagaagaattgaggacatgatgaaccaggcccggcatgccagcagtggagtgaagctggaggtgaatgaaagaatcctgaacagctgcacagacctgatgaaggccatccggctgctggtgaccaccagcaccagcctgcagaaggagatcgtggagagcggcagaggagctgccacccagcaggagttctacgccaagaacagccgctggacagagggcctcatcagcgccagcaaggctgtgggctggggcgccacccagctggtggaggccgctgacaaggtggtgctgcacacaggcaagtatgaggagctgattgtgtgcagccatgaaattgctgccagcacagcccagctggtggccgccagcaaggtgaaggccaacaagcacagcccccacctgagccggctgcaggagtgcagcaggacagtgaatgaaagagctgccaacgtggtggccagcaccaagagcggccaggagcagattgaagatcgggacaccatggacttcagcggcctgagcctcatcaagctgaagaagcaggagatggagacccaggtgcgggtgctggagctggagaagaccctggaggccgagaggatgaggctgggggagctgaggaagcagcactacgtgctggccggggccagcggcagccctggagaggaggtggccatccggcccagcacagcccccaggtctgtgaccaccaagaagccacccctggcccagaagcccagcgtggccccccggcaggaccaccagctggacaagaaggatggcatctacccagcccagctggtgaactactag

SEQ ID NO: 155635 - DNA, 753 bp, Artificial Sequence
  Description of Artificial Sequence: Synthetic coding sequence
atggcccacgtgggcaccagccgggtgggctctgtgctgtccatgagcctgagcatccacctgctggtgcccaccatgaccaagggggagaccgggaagccaggccaccacgaggcccccaggaccctgcaggccttcccctggacctgggcccgggccagccctggggtgtctgtggacatgtctgctggcctgccccagagcctgctgtgctggccaggggcccccctgctgcccaccccacccctgcccagcgccacctacgtgggccacagcctgggcctgccccgggccggcagctctgtgggcccctggttcagcggccgctgggtgggcggggccctggtgcagtggcccctgggcggcggcggccctggctctgtggccgccggcctgggcggccccctggtgcgctggctgctgggcggcggggccctggtgcgctggcccctgggcggcggcggccctggctctgtggccgccggctggggcggcccctggtttggaggccgctgggtgggcggccccccaggctctgtggccgccggctggggcggccctgtgcgctggcccctgggcggcggcggccctggctctgtggccaccggctggggcggcccctggtttggaggccgctgggtgggcggccccccaggctctgtggccgccggctgcggcggggccctggtgcagtggcccctgggcggcggcagcctgcacagcatccccagcttcccccgggcctggaggtag

SEQ ID NO: 155636 - DNA, 2016 bp, Artificial Sequence
  Description of Artificial Sequence: Synthetic coding sequence
atgaggcccaagaggctgggccgctgctgtgccggcagccggctgggccctggggaccctgctgccctgacctgtgcccccagccccagcgccagccctgcccctgagcccagcgcccagccccaggcccggggcaccggccagagggtgggcagccgggccaccagcggcagccagttcctgtctgaggccaggactggagcccggcctgccagcgaggccggggccaaggccggggcccggcggcccagcgccttcagcgccatccagggagatgtgcgctccatgccagacaacagtgatgccccctggaccaggtttgtgttccagggccccttcggcagccgggccaccggccggggcaccgggaaggccgccggcatctggaagaccccagctgcctacgtgggccggcggcctggggtgtctggccctgagcgggccgccttcatccgggagctggaggaggccctgtgccccaacctgcccccacctgtgaagaagatcacccaggaggatgtgaaggtgatgctgtacctgctggaggagctgctgccccctgtgtgggagagcgtgacctacggcatggtgctgcagcgggagcgggacctgaacacagctgcccgcatcggccagagcctggtgaagcagaacagcgtgctgatggaggagaacagcaagctggaggccctgctgggcagcgccaaggaggagatcctgtacctgcggcaccaggtgaacctgagagatgagctgctgcagctgtacagcgacagtgatgaggaggatgaagatgaggaggaggaggaggaggagaaggaggccgaggaggagcaggaggaggaggaggccgaggaggacctgcagtgtgcccacccctgtgatgcccccaagctgatcagccaggaggccctgctgcaccagcaccactgcccccagctggaggccctgcaggagaagctgcggctgctggaggaggagaaccaccagctgcgggaggaggccagccagctggacaccctggaggatgaggagcagatgctgatcctggagtgtgtggagcagttcagcgaggccagccagcagatggccgagctgtctgaggtgctggtgctgcggctggagaactatgagcggcagcagcaggaggtggcccggctgcaggcccaggtgctgaagctgcagcagcgctgcaggatgtatggagctgagacagagaagctgcagaagcagctggccagcgagaaggagatccagatgcagctgcaggaggagagcgtgtgggtgggcagccagctgcaggacctgcgggagaagtacatggactgtggcggcatgctgattgagatgcaggaggaggtgaagaccctgcggcagcagccccctgtgtccactggaagtgccacccactacccctacagcgtgcccctggagaccctgcccggcttccaggagaccctggccgaggagctgcggaccagcctgcggaggatgatcagtgaccctgtgtacttcatggagaggaactatgagatgcccaggggggacaccagcagcctgcgctatgacttccgctacagcgaggaccgggagcaggtgcggggctttgaggccgaggagggcctgatgctggccgctgacatcatgagaggagaggacttcaccccagctgaggagtttgtgccccaggaggagctgggcgccgccaagaaggtgcctgctgaggagggcgtgatggaggaggccgagctggtgtctgaggagacagagggctgggaggaggtggagctggagctggatgaggccaccaggatgaatgtggtgaccagcgccctggaggccagcggcctgggccccagccacctggacatgaactacgtgctgcagcagctggccaactggcaggatgcccactaccgccggcagctgcgctggaagatgctgcagaagggggagtgcccccatggagccctgcctgctgccagcaggaccagctgccgcagcagctgcaggtag

SEQ ID NO: 155637 - DNA, 1809 bp, Artificial Sequence
  Description of Artificial Sequence: Synthetic coding sequence
atgaggcccaagaggctgggccgctgctgtgccggcagccggctgggccctggggaccctgctgccctgacctgtgcccccagccccagcgccagccctgcccctgagcccagcgcccagccccaggcccggggcaccggccagagggtgggcagccgggccaccagcggcagccagttcctgtctgaggccaggactggagcccggcctgccagcgaggccggggccaaggccggggcccggcggcccagcgccttcagcgccatccagggagatgtgcgctccatgccagacaacagtgatgccccctggaccaggtttgtgttccagggccccttcggcagccgggccaccggccggggcaccgggaaggccgccggcatctggaagaccccagctgcctacgtgggccggcggcctggggtgtctggccctgagcgggccgccttcatccgggagctggaggaggccctgtgccccaacctgcccccacctgtgaagaagatcacccaggaggatgtgaaggtgatgctgtacctgctggaggaggtgtgcacagccttcctgatccagctgctgccccctgtgtgggagagcgtgacctacggcatggtgctgcagcgggagcgggacctgaacacagctgcccgcatcggccagagcctggtgaagcagaacagcgtgctgatggaggagaacagcaagctggaggccctgctgggcagcgccaaggaggagatcctgtacctgcggcaccaggtgaacctgagagatgagctgctgcagctgtacagcgacagtgatgaggaggatgaagatgaggaggaggaggaggaggagaaggaggccgaggaggagcaggaggaggaggaggccgaggaggacctgcagtgtgcccacccctgtgatgcccccaagctgatcagccaggaggccctgctgcaccagcaccactgcccccagctggaggccctgcaggagaagctgcggctgctggaggaggagaaccaccagctgcgggaggaggccagccagctggacaccctggaggatgaggagcagatgctgatcctggagtgtgtggagcagttcagcgaggccagccagcagatggccgagctgtctgaggtgctggtgctgcggctggagaactatgagcggcagcagcaggaggtggcccggctgcaggcccaggtgctgaagctgcagcagcgctgcaggatggagaccctgcccggcttccaggagaccctggccgaggagctgcggaccagcctgcggaggatgatcagtgaccctgtgtacttcatggagagaaattatgagatgcccaggggggacaccagcagcctgcgctatgacttccgctacagtgaagatcgggagcaggtgcggggctttgaagctgaggagggcctgatgctggccgctgacatcatgagaggagaggacttcaccccagctgaggagtttgtgccccaggaggagctgggcgccgccaagaaggtgcctgctgaggagggcgtgatggaggaggccgagctggtgtctgaggagacagagggctgggaggaggtggagctggagctggatgaggccaccaggatgaatgtggtgaccagcgccctggaggccagcggcctgggccccagccacctggacatgaactacgtgctgcagcagctggccaactggcaggatgcccactaccgccggcagctgcgctggaagatgctgcagaagggagaatgtccccacggggccctgcctgctgccagcaggaccagctgccgcagcagctgcaggtag

SEQ ID NO: 155638 - DNA, 1860 bp, Artificial Sequence
  Description of Artificial Sequence: Synthetic coding sequence
atgaggcccaagaggctgggccgctgctgtgccggcagccggctgggccctggggaccctgctgccctgacctgtgcccccagccccagcgccagccctgcccctgagcccagcgcccagccccaggcccggggcaccggccagagggtgggcagccgggccaccagcggcagccagttcctgtctgaggccaggactggagcccggcctgccagcgaggccggggccaaggccggggcccggcggcccagcgccttcagcgccatccagggagatgtgcgctccatgccagacaacagtgatgccccctggaccaggtttgtgttccagggccccttcggcagccgggccaccggccggggcaccgggaaggccgccggcatctggaagaccccagctgcctacgtgggccggcggcctggggtgtctggccctgagcgggccgccttcatccgggagctggaggaggccctgtgccccaacctgcccccacctgtgaagaagatcacccaggaggatgtgaaggtgatgctgtacctgctggaggagctgctgccccctgtgtgggagagcgtgacctacggcatggtgctgcagcgggagcgggacctgaacacagctgcccgcatcggccagagcctggtgaagcagaacagcgtgctgatggaggagaacagcaagctggaggccctgctgggcagcgccaaggaggagatcctgtacctgcggcaccaggtgaacctgagagatgagctgctgcagctgtacagcgacagtgatgaggaggatgaagatgaggaggaggaggaggaggagaaggaggccgaggaggagcaggaggaggaggaggccgaggaggacctgcagtgtgcccacccctgtgatgcccccaagctgatcagccaggaggccctgctgcaccagcaccactgcccccagctggaggccctgcaggagaagctgcggctgctggaggaggagaaccaccagctgcgggaggaggccagccagctggacaccctggaggatgaggagcagatgctgatcctggagtgtgtggagcagttcagcgaggccagccagcagatggccgagctgtctgaggtgctggtgctgcggctggagaactatgagcggcagcagcaggaggtggcccggctgcaggcccaggtgctgaagctgcagcagcgctgcaggatgtatggagctgagacagagaagctgcagaagcagctggccagcgagaaggagatccagatgcagctgcaggaggaggagaccctgcccggcttccaggagaccctggccgaggagctgcggaccagcctgcggaggatgatcagtgaccctgtgtacttcatggagaggaactatgagatgcccaggggggacaccagcagcctgcgctatgacttccgctacagcgaggaccgggagcaggtgcggggctttgaggccgaggagggcctgatgctggccgctgacatcatgagaggagaggacttcaccccagctgaggagtttgtgccccaggaggagctgggcgccgccaagaaggtgcctgctgaggagggcgtgatggaggaggccgagctggtgtctgaggagacagagggctgggaggaggtggagctggagctggatgaggccaccaggatgaatgtggtgaccagcgccctggaggccagcggcctgggccccagccacctggacatgaactacgtgctgcagcagctggccaactggcaggatgcccactaccgccggcagctgcgctggaagatgctgcagaagggggagtgcccccatggagccctgcctgctgccagcaggaccagctgccgcagcagctgcaggtag

SEQ ID NO: 155639 - DNA, 1785 bp, Artificial Sequence
  Description of Artificial Sequence: Synthetic coding sequence
atgaggcccaagaggctgggccgctgctgtgccggcagccggctgggccctggggaccctgctgccctgacctgtgcccccagccccagcgccagccctgcccctgagcccagcgcccagccccaggcccggggcaccggccagagggtgggcagccgggccaccagcggcagccagttcctgtctgaggccaggactggagcccggcctgccagcgaggccggggccaaggccggggcccggcggcccagcgccttcagcgccatccagggagatgtgcgctccatgccagacaacagtgatgccccctggaccaggtttgtgttccagggccccttcggcagccgggccaccggccggggcaccgggaaggccgccggcatctggaagaccccagctgcctacgtgggccggcggcctggggtgtctggccctgagcgggccgccttcatccgggagctggaggaggccctgtgccccaacctgcccccacctgtgaagaagatcacccaggaggatgtgaaggtgatgctgtacctgctggaggagctgctgccccctgtgtgggagagcgtgacctacggcatggtgctgcagcgggagcgggacctgaacacagctgcccgcatcggccagagcctggtgaagcagaacagcgtgctgatggaggagaacagcaagctggaggccctgctgggcagcgccaaggaggagatcctgtacctgcggcaccaggtgaacctgagagatgagctgctgcagctgtacagcgacagtgatgaggaggatgaagatgaggaggaggaggaggaggagaaggaggccgaggaggagcaggaggaggaggaggccgaggaggacctgcagtgtgcccacccctgtgatgcccccaagctgatcagccaggaggccctgctgcaccagcaccactgcccccagctggaggccctgcaggagaagctgcggctgctggaggaggagaaccaccagctgcgggaggaggccagccagctggacaccctggaggatgaggagcagatgctgatcctggagtgtgtggagcagttcagcgaggccagccagcagatggccgagctgtctgaggtgctggtgctgcggctggagaactatgagcggcagcagcaggaggtggcccggctgcaggcccaggtgctgaagctgcagcagcgctgcaggatggagaccctgcccggcttccaggagaccctggccgaggagctgcggaccagcctgcggaggatgatcagtgaccctgtgtacttcatggagagaaattatgagatgcccaggggggacaccagcagcctgcgctatgacttccgctacagtgaagatcgggagcaggtgcggggctttgaagctgaggagggcctgatgctggccgctgacatcatgagaggagaggacttcaccccagctgaggagtttgtgccccaggaggagctgggcgccgccaagaaggtgcctgctgaggagggcgtgatggaggaggccgagctggtgtctgaggagacagagggctgggaggaggtggagctggagctggatgaggccaccaggatgaatgtggtgaccagcgccctggaggccagcggcctgggccccagccacctggacatgaactacgtgctgcagcagctggccaactggcaggatgcccactaccgccggcagctgcgctggaagatgctgcagaagggagaatgtccccacggggccctgcctgctgccagcaggaccagctgccgcagcagctgcaggtag

SEQ ID NO: 155640 - DNA, 837 bp, Artificial Sequence
  Description of Artificial Sequence: Synthetic coding sequence
atgaagttccgggccaagatcaccgggaagggctgcctggagctgttcatccacgtgtctggcaccgtggcccggctggccaaggtgtgtgtgctgcgggtgcggccagacagcctgtgctttggacctgctggcagcggcggcctgcacgaggcccggctgtggtgtgaggtgcggcagggcgccttccagcagttcaggatggagggcgtgtctgaggacctggatgagatccacctggagctgacagctgagcacctgagccgggccgcccggtctgctgctggggccagcagcctgaagctgcagctgacccacaagaggcggcccagcctgactgtggccgtggagctggtgagcagcctgggccgggcccggtctgtggtgcatgacctgcctgtgcgggtgctgcccaggagagtgtggagggactgcctgccccccagcctgcgggccagtgatgccagcatccggctgccccgctggaggaccctgcggagcatcgtggagaggatggccaacgtgggcagccacgtgctggtggaggccaacctgagcggccgcatgaccctgagcattgaaacagaggtggtgtccatccagagctacttcaagaacctgggcaaccccccccagagcgctgtgggcgtgcctgaaaatagagacctggagagcatggtgcaggtgcgggtggacaacaggaagctgctgcagttcctggagggccagcagatccaccccaccacagccctgtgcaacatctgggacaacaccctgctgcagctggtgctggtgcaggaggatgtgtccctgcagtacttcatcccagccctgtag

SEQ ID NO: 155641 - DNA, 1065 bp, Artificial Sequence
  Description of Artificial Sequence: Synthetic coding sequence
atgaagagcctgctgctgctggtgctgatcagcatctgctgggccgaccacctgagtgacaactacaccctggaccatgaccgggccatccacatccaggctgaaaatggcccccacctgctggtggaggccgagcaggccaaggtgttcagccaccggggcggcaatgtgaccctgccctgcaagttctacagagaccccacagccttcggcagcggcatccacaagatccgcatcaagtggaccaagctgaccagtgactacctgaaggaggtggatgtgtttgtgtccatgggctaccacaagaagacctatggaggctaccagggccgggtcttcctgaagggcggcagtgacagtgatgccagcctggtgatcacagacctgaccctggaggactatggccgctacaagtgtgaggtgattgagggcctggaggatgacacagtggtggtggccctggacctgcagggcgtggtgttcccctacttcccccggctgggccgctacaacctgaacttccacgaggcccagcaggcctgcctggaccaggatgctgtgattgccagctttgaccagctgtatgatgcctggaggggcggcctggactggtgcaatgccggctggctgagtgatggctctgtgcagtaccccatcaccaagccccgggagccctgtggcggccagaacacagtgcctggggtgaggaactacggcttctgggacaaggacaagagccgctatgatgtgttctgcttcaccagcaacttcaacggccgcttctactacctgatccaccccaccaagctgacctatgatgaagctgtgcaggcctgcctgaatgatggagcccagatcgccaaggtgggccagatctttgctgcctggaagatcctgggctatgacagatgtgatgctggctggctggctgatggctctgtgcgctaccccatcagccggccccggcggcgctgcagccccacagaggccgctgtgcgctttgtgggcttcccagacaagaagcacaagctgtatggagtgtactgcttccgggcctacaactag

SEQ ID NO: 155642 - DNA, 549 bp, Artificial Sequence
  Description of Artificial Sequence: Synthetic coding sequence
atgaagagcctgctgctgctggtgctgatcagcatctgctgggccgaccacctgagtgacaactacaccctggaccatgaccgggccatccacatccaggagaatggcccccacctgctggtggaggccgagcaggccaaggtgttcagccacagaggaggaaatgtgaccctgccctgcaagttctacagagaccccacagcctttggaagtggcatccacaagatccgcatcaagtggaccaagctgaccagtgactacctgaaggaggtggatgtgtttgtgtccatgggctaccacaagaagacctacggcggctaccagggccgggtcttcctgaagggcggcagtgacagtgatgccagcctggtgatcacagacctgaccctggaggactatggccgctacaagtgtgaggtgattgagggcctggaggatgacacagtggtggtggccctggacctgcagggcgtggtgttcccctacttcccccggctgggccgctacaacctgaacttccacgaggcccagcaggcctgcctggactag

SEQ ID NO: 155643 - DNA, 477 bp, Artificial Sequence
  Description of Artificial Sequence: Synthetic coding sequence
atgaagagcctgctgctgctggtgctgatcagcatctgctgggccgaccacctgagtgacaactacaccctggaccatgaccgggccatccacatccaggctgaaaatggcccccacctgctggtggaggccgagcaggccaaggtgttcagccaccggggcggcaatgtgaccctgccctgcaagttctacagagaccccacagccttcggcagcggcatccacaagatccgcatcaagtggaccaagctgaccagtgactacctgaaggaggtggatgtgtttgtgtccatgggctaccacaagaagacctatggaggctaccagggccgggtcttcctgaagggcggcagtgacagtgatgccagcctggtgatcacagacctgaccctggaggactatggccgctacaagtgtgaggtgattgagggcctggaggatgacacagtggtggtggccctggacctgcagggctag

SEQ ID NO: 155644 - DNA, 600 bp, Artificial Sequence
  Description of Artificial Sequence: Synthetic coding sequence
atgaagagcctgctgctgctggtgctgatcagcatctgctgggccgaccacctgagtgacaactacaccctggaccatgaccgggccatccacatccaggctgaaaatggcccccacctgctggtggaggccgagcaggccaaggtgttcagccaccggggcggcaatgtgaccctgccctgcaagttctacagagaccccacagccttcggcagcggcatccacaagatccgcatcaagtggaccaagctgaccagtgactacctgaaggaggtggatgtgtttgtgtccatgggctaccacaagaagacctatggaggctaccagggccgggtcttcctgaagggcggcagtgacagtgatgccagcctggtgatcacagacctgaccctggaggactatggccgctacaagtgtgaggtgattgagggcctggaggatgacacagtggtggtggccctggacctgcagggcgtggtgttcccctacttcccccggctgggccgctacaacctgaacttccacgaggcccagcaggcctgcctggaccaggatgctgtgattgccagctttgaccagctgtatgatgcctggaggtag

SEQ ID NO: 155645 - DNA, 777 bp, Artificial Sequence
  Description of Artificial Sequence: Synthetic coding sequence
atgaagagcctgctgctgctggtgctgatcagcatctgctgggccgaccacctgagtgacaactacaccctggaccatgaccgggccatccacatccaggctgaaaatggcccccacctgctggtggaggccgagcaggccaaggtgttcagccaccggggcggcaatgtgaccctgccctgcaagttctacagagaccccacagccttcggcagcggcatccacaagatccgcatcaagtggaccaagctgaccagtgactacctgaaggaggtggatgtgtttgtgtccatgggctaccacaagaagacctatggaggctaccagggccgggtcttcctgaagggcggcagtgacagtgatgccagcctggtgatcacagacctgaccctggaggactatggccgctacaagtgtgaggtgattgagggcctggaggatgacacagtggtggtggccctggacctgcagggcgtggtgttcccctacttcccccggctgggccgctacaacctgaacttccacgaggcccagcaggcctgcctggaccaggatgctgtgattgccagctttgaccagctgtatgatgcctggaggggcggcctggactggtgcaatgccggctggctgagtgatggctctgtgcagtaccccatcaccaagccccgggagccctgtggcggccagaacacagtgcctggggtgaggaactacggcttctgggacaaggacaagagccgctatgatgtgttctgcttcaccagcaacttcaactag

SEQ ID NO: 155646 - DNA, 462 bp, Artificial Sequence
  Description of Artificial Sequence: Synthetic coding sequence
atgaagagcctgctgctgctggtgctgatcagcatctgctgggccgaccacctgagtgacaactacaccctggaccatgaccgggccatccacatccaggctgaaaatggcccccacctgctggtggaggccgagcaggccaaggtgttcagccaccggggcggcaatgtgaccctgccctgcaagttctacagagaccccacagccttcggcagcggcatccacaagatccgcatcaagtggaccaagctgaccagtgactacctgaaggaggtggatgtgtttgtgtccatgggctaccacaagaagacctatggaggctaccagggccgggtcttcctgaagggcggcagtgacagtgatgccagcctggtgatcacagacctgaccctggaggactatggccgctacaagtgtgaggtgattgagggcctggaggatgacacagtggtggtggcctag

SEQ ID NO: 155647 - DNA, 1683 bp, Artificial Sequence
  Description of Artificial Sequence: Synthetic coding sequence
atgtttgccaggatgtctgacctgcacgtgctgctgctgatggccctggtgggcaagacagcctgtggcttcagcctgatgagcctgctggagagcctggaccctgactggaccccagaccagtatgactacagctatgaggactacaaccaggaggagaacaccagcagcaccctgacccatgctgaaaatccagactggtactacacagaggaccaggccgacccctgccagcccaacccctgtgagcacggcggggactgcctggtgcacggcagcaccttcacctgcagctgcctggcccccttcagcggcaacaagtgccagaaggtgcagaacacctgcaaggacaacccctgtggccggggccagtgcctgatcacccagagccccccctactaccgctgtgtgtgcaagcacccctacacaggccccagctgcagccaggtggtgcctgtgtgccggcccaacccctgccagaatggagccacctgcagccgccacaagaggaggagcaagttcacctgtgcctgcccagaccagttcaagggcaagttctgtgaaattggaagtgatgactgctacgtgggagatggctacagctaccggggcaagatgaacagaacagtgaaccagcacgcctgcctgtactggaacagccacctgctgctgcaggagaactacaacatgttcatggaggatgctgagacccacggcatcggggagcacaacttctgcagaaatccagatgctgatgagaagccctggtgcttcatcaaggtgaccaatgacaaggtgaagtgggagtactgtgatgtgtctgcctgcagcgcccaggatgtggcctacccagaggagagccccacagagcccagcaccaagctgcccggctttgacagctgtgggaagacagaaattgctgagaggaagatcaagaggatctatggaggcttcaagagcacagctgggaagcacccctggcaggccagcctgcagagcagcctgcccctgaccatctccatgccccagggccacttctgtggcggggccctgatccacccctgctgggtgctgacagctgcccactgcacagacatcaagaccaggcacctgaaggtggtgctgggggaccaggacctgaagaaggaggagttccacgagcagagcttccgggtggagaagatcttcaagtacagccactacaatgaaagagatgagatcccccacaatgacatcgccctgctgaagctgaagcctgtggatggccactgtgccctggagagcaaatatgtgaagacagtgtgcctgcctgatggcagcttccccagcggcagcgagtgccacatcagcggctggggcgtgacagaaacaggcaagggcagccggcagctgctggatgccaaggtgaagctgattgccaacaccctgtgcaacagccggcagctgtatgaccacatgattgatgacagcatgatctgtgccggcaacctgcagaagccaggccaggacacctgccagggcgacagcggcggccccctgacctgtgagaaggatggcacctactacgtgtatggcatcgtgtcctggggcctggagtgtgggaagaggcctggggtgtacacccaggtgaccaagttcctgaactggatcaaggccaccatcaagtctgagagcggcttctag

SEQ ID NO: 155648 - DNA, 534 bp, Artificial Sequence
  Description of Artificial Sequence: Synthetic coding sequence
atggaggagaacttcatctgcagcaggaagaccatggccctgagcagcacctggatcctgagccccaagaagacaggccccctgacctccatgatcacagccacccgcatcatcatcaggaagaggacccctgtggcccacctgcccaccctgcgcatcctgaccggcaccaccctgcggaccaagctgattcatgccagccccacccctgtgaacacagtgggcacagccagctccatgggcgcccccagccacgccgccgcctggctgctgagcctgggcatctctgtgaggaagtgcaagatccgggcccggaccacccacgtggccggggccaacgtgtccctgccccgggtgctgcccaccacagctgtgtctgtgaacaccctgacccaggtgcctgctgcccccaagtggttcctgtatgccggccagaccccagccaggatgggcctgcctgcccctggcatcagcggggaccccagcagccctgtgcctgtgcccaccagcagccggggcaacagcgtgaagtag

SEQ ID NO: 155649 - DNA, 843 bp, Artificial Sequence
  Description of Artificial Sequence: Synthetic coding sequence
atgtttgccaggatgtctgacctgcacgtgctgctgctgatggccctggtgggcaagacagcctgtggcttcagcctgatgagcctgctggagagcctggaccctgactggaccccagaccagtatgactacagctatgaggactacaaccaggaggagaacaccagcagcaccctgacccatgctgaaaatccagactggtactacacagaggaccaggccgacccctgccagcccaacccctgtgagcacggcggggactgcctggtgcacggcagcaccttcacctgcagctgcctggcccccttcagcggcaacaagtgccagaaggtgcagaacacctgcaaggacaacccctgtggccggggccagtgcctgatcacccagagccccccctactaccgctgtgtgtgcaagcacccctacacaggccccagctgcagccaggtggtgcctgtgtgccggcccaacccctgccagaatggagccacctgcagccgccacaagaggaggagcaagttcacctgtgcctgcccagaccagttcaagggcaagttctgtgaaattggaagtgatgactgctacgtgggagatggctacagctaccggggcaagatgaacagaacagtgaaccagcacgcctgcctgtactggaacagccacctgctgctgcaggagaactacaacatgttcatggaggatgctgagacccacggcatcggggagcacaacttctgcagaaatccagatgctgatgagaagccctggtgcttcatcaaggtgaccaatgacaaggtgaagtgggagtactgtgatgtgtctgcctgcagcgcccaggcctag

SEQ ID NO: 155650 - DNA, 1605 bp, Artificial Sequence
  Description of Artificial Sequence: Synthetic coding sequence
atgagcctgctggagagcctggaccctgactggaccccagaccagtatgactacagctatgaggactacaaccaggaggagaacaccagcagcaccctgacccatgctgaaaatccagactggtactacacagaggaccaggccgacccctgccagcccaacccctgtgagcacggcggggactgcctggtgcacggcagcaccttcacctgcagctgcctggcccccttcagcggcaacaagtgccagaaggtgcagaacacctgcaaggacaacccctgtggccggggccagtgcctgatcacccagagccccccctactaccgctgtgtgtgcaagcacccctacacaggccccagctgcagccaggtggtgcctgtgtgccggcccaacccctgccagaatggagccacctgcagccgccacaagaggaggagcaagttcacctgtgcctgcccagaccagttcaagggcaagttctgtgaaattggaagtgatgactgctacgtgggagatggctacagctaccggggcaagatgaacagaacagtgaaccagcacgcctgcctgtactggaacagccacctgctgctgcaggagaactacaacatgttcatggaggatgctgagacccacggcatcggggagcacaacttctgcagaaatccagatgctgatgagaagccctggtgcttcatcaaggtgaccaatgacaaggtgaagtgggagtactgtgatgtgtctgcctgcagcgcccaggatgtggcctacccagaggagagccccacagagcccagcaccaagctgcccggctttgacagctgtgggaagacagaaattgctgagaggaagatcaagaggatctatggaggcttcaagagcacagctgggaagcacccctggcaggccagcctgcagagcagcctgcccctgaccatctccatgccccagggccacttctgtggcggggccctgatccacccctgctgggtgctgacagctgcccactgcacagacatcaagaccaggcacctgaaggtggtgctgggggaccaggacctgaagaaggaggagttccacgagcagagcttccgggtggagaagatcttcaagtacagccactacaatgaaagagatgagatcccccacaatgacatcgccctgctgaagctgaagcctgtggatggccactgtgccctggagagcaaatatgtgaagacagtgtgcctgcctgatggcagcttccccagcggcagcgagtgccacatcagcggctggggcgtgacagaaacaggcaagggcagccggcagctgctggatgccaaggtgaagctgattgccaacaccctgtgcaacagccggcagctgtatgaccacatgattgatgacagcatgatctgtgccggcaacctgcagaagccaggccaggacacctgccagggcgacagcggcggccccctgacctgtgagaaggatggcacctactacgtgtatggcatcgtgtcctggggcctggagtgtgggaagaggcctggggtgtacacccaggtgaccaagttcctgaactggatcaaggccaccatcaagtctgagagcggcttctag

SEQ ID NO: 155651 - DNA, 1656 bp, Artificial Sequence
  Description of Artificial Sequence: Synthetic coding sequence
atgctgcccctgctgctgctgcccctgctgtggggcggcagcctgcaggagaagcctgtgtatgagctgcaggtgcagaagtctgtgacagtgcaggagggcctgtgtgtgctggtgccctgcagcttctcctacccctggaggtcctggtacagcagcccccccctgtatgtgtactggttcagagatggagagatcccctactatgcagaggtggtggccaccaacaacccagaccggcgggtgaagccagagacccagggccgcttccggctgctgggagatgtgcagaagaagaactgcagcctgagcattggagatgccaggatggaggacaccggcagctacttcttccgggtggagcggggcagagatgtgaagtacagctaccagcagaacaagctgaacctggaggtgacagccctgattgagaagccagacatccacttcctggagcccctggagagcggccggcccacccggctgagctgcagcctgcccggcagctgtgaggccggcccccccctgaccttctcctggacaggaaatgccctgagccccctggaccctgagaccaccaggagcagcgagctgaccctgacccccaggccagaagatcatggcaccaacctgacctgccagatgaagaggcagggcgcccaggtgaccacagagaggacagtgcagctgaatgtgtcctatgccccccagaccatcaccatcttcagaaatggcatcgccctggagatcctgcagaacaccagctacctgcctgtgctggagggccaggccctgcggctgctgtgtgatgcccccagcaaccccccagcccacctgtcctggttccagggcagccctgccctgaatgccacccccatcagcaacacaggcatcctggagctgcggcgggtgcgctctgctgaggagggcggcttcacctgccgggcccagcaccccctgggcttcctgcagatcttcctgaacctgtctgtgtacagcctgccccagctgctgggccccagctgctcctgggaggccgagggcctgcactgccgctgcagcttccgggcccggcctgcccccagcctgtgctggaggctggaggagaagcccctggagggcaacagcagccagggcagcttcaaggtgaacagcagcagcgctggcccctgggccaacagcagcctcatcctgcatggaggcctgagcagtgacctgaaggtgtcctgcaaggcctggaacatctacggcagccagagcggctctgtgctgctgctgcagggccgcagcaacctgggcaccggggtggtgcctgctgccctgggcggggccggcgtgatggccctgctgtgcatctgcctgtgcctgatcttcttcctgattgtgaaggcccggaggaagcaggccgccggccggcctgagaagatggatgatgaggaccccatcatgggcaccatcaccagcggcagcaggaagaagccctggccagacagccctggggaccaggccagccccccaggagatgccccacccctggaggagcagaaggagctgcactacgccagcctgtccttcagcgagatgaagagccgggagcccaaggaccaggaggcccccagcaccacagagtacagcgagatcaagaccagcaagtag

SEQ ID NO: 155652 - DNA, 558 bp, Artificial Sequence
  Description of Artificial Sequence: Synthetic coding sequence
atgttccgggaggtgtttgctgatgaagatcctgccacctacgtgtgggatggcaactaccaccagccctgggagcctgctgctgctggagctgtgggcgctggggcctaccgggaggtggaggctgaagatcctggccgcctggccgtggaggccctggtgaggacccggcgctgtgtgtgtgtggcccagcgctggggcggcaagcgggaggtgatgtacacagccttcaaggccctgggggacagcgtggactatgtgcagttctgccgggtgtgtgacagcgacacccggctggaccccatggccctgctggagctggtgcgggtgctggatgaggacccccgggtgggcgctgtgggcggagatgtgcgcatcctgaaccccctggacagctgggtgtccttcctgagcagcctgcgctactgggtggccttcaacgtggagcgggcctgccagagctacttccactgtgtgtcctgcatcagcggccccctgggcaccccacctggccctgctgccacccagaggcggccccggcccagctgtggcggctag

SEQ ID NO: 155653 - DNA, 645 bp, Artificial Sequence
  Description of Artificial Sequence: Synthetic coding sequence
atgttccgggaggtgtttgctgatgaagatcctgccacctacgtgtgggatggcaactaccaccagccctgggagcctgctgctgctggagctgtgggcgctggggcctaccgggaggtggaggctgaagatcctggccgcctggccgtggaggccctggtgaggacccggcgctgtgtgtgtgtggcccagcgctggggcggcaagcgggaggtgatgtacacagccttcaaggccctgggggacagcgtggactatgtgcaggtgtgtgacagcgacacccggctggaccccatggccctgctggagctggtgcgggtgctggatgaggacccccgggtgggcgctgtgggcggagatgtgcgcatcctgaaccccctggacagctgggtgtccttcctgagcagcctgcgctactgggtggccttcaacgtggagcgggcctgccagagctacttccactgtgtgtcctgcatcagcggccccctggagagctgccccggcccccgggagcacgccatgatgcccagcttcctggcccctgtgcaggtgcacctgcaggtgcccctgctgctgagagatgccctggtgctgcctgctgtggccgagcctgctgacaccctggtgcaggtggtgctgccctag

SEQ ID NO: 155654 - DNA, 1734 bp, Artificial Sequence
  Description of Artificial Sequence: Synthetic coding sequence
atgaggcaggatgcccccaagcccaccccagctgcctgccgctgcagcggcctggcccggcgggtgctgaccatcgcctttgccctgctgatcctgggcctgatgacctgggcctatgctgctggggtgcccctggccagtgacagatatggcctgctggccttcggcctgtatggagccttcctgagcgcccacctggtggcccagagcctgtttgcctacctggagcaccggcgggtggccgctgctgcccggggccccctggatgctgccacagcccggtctgtggccctgaccatcagcgcctaccaggaggaccctgcctacctgcggcagtgcctggccagcgcccgggccctgctgtacccccgggcccggctgcgggtgctgatggtggtggatggcaacagagcagaagatctctacatggtggacatgttccgggaggtgtttgctgatgaggaccctgccacctacgtgtgggatggcaactaccaccagccctgggagcctgctgctgctggagctgtgggcgctggggcctaccgggaggtggaggccgaggaccccggccgcctggccgtggaggccctggtgaggacccggcgctgtgtgtgtgtggcccagcgctggggcggcaagcgggaggtgatgtacacagccttcaaggccctgggggacagcgtggactatgtgcaggtgtgtgacagcgacacccggctggaccccatggccctgctggagctggtgcgggtgctggatgaggacccccgggtgggcgctgtgggcggagatgtgcgcatcctgaaccccctggacagctgggtgtccttcctgagcagcctgcgctactgggtggccttcaacgtggagcgggcctgccagagctacttccactgtgtgtcctgcatcagcggccccctgggcctgtacagaaacaacctgctgcagcagttcctggaggcctggtacaaccagaagttcctgggcacccactgcacctttggagatgacagacacctgaccaacaggatgctgtccatgggctacgccaccaagtacaccagccgcagccgctgctacagcgagacccccagcagcttcctgcgctggctgagccagcagacccgctggagcaagagctacttccgggagtggctgtacaatgccctgtggtggcaccgccaccacgcctggatgacctatgaggccgtggtgtctggcctcttccccttctttgtggccgccaccgtgctgcggctcttctacgccggccggccctgggccctgctgtgggtgctgctgtgtgtgcagggcgtggccctggccaaggccgcctttgctgcctggctgcggggctgcctgaggatggtgctgctgagcctgtatgcccccctgtacatgtgtggcctgctgcctgccaagttcctggccctggtgaccatgaaccagagcggctggggcaccagcggccgcaggaagctggccgccaactacgtgcccctgctgcccctggccctgtgggccctgctgctgctgggcggcctggtgcgctctgtggcccacgaggcccgggctgactggagcggccccagcagagctgctgaggcctaccacctggccgccggggccggggcctacgtgggctactgggtggccatgctgaccctgtactgggtgggcgtgcggcggctgtgcagaagaagaactggaggctacagagtgcaggtgtag

SEQ ID NO: 155655 - DNA, 1659 bp, Artificial Sequence
  Description of Artificial Sequence: Synthetic coding sequence
atgcactgtgagcgcttcctgtgcatcctgcgcatcatcggcaccaccctgtttggagtgtccctgctgctgggcatcacagctgcctacatcgtgggctaccagttcatccagacagacaactactacttctcctttggcctgtatggagccttcctggccagccacctgatcatccagagcctgtttgccttcctggagcacaggaagatgaagaagagcctggagacccccatcaagctgaacaagacagtggccctgtgcatcgccgcctaccaggaggaccctgactacctgaggaagtgcctgcagagcgtgaagaggctgacctacccaggcatcaaggtggtgatggtgattgatggcaacagtgaagatgacctgtacatgatggacatcttcagcgaggtgatgggccgggacaagagcgccacctacatctggaagaacaacttccacgagaagggccctggagaaacagatgagagccacaaggagagcagccagcacgtgacccagctggtgctgagcaacaagagcatctgcatcatgcagaagtggggcggcaagcgggaggtgatgtacacagccttccgggccctgggccgctctgtggactatgtgcaggtgtgtgacagcgacaccatgctggaccctgccagctctgtggagatggtgaaggtgctggaggaggaccccatggtgggcggcgtgggcggagatgtgcagatcctgaacaagtatgacagctggatctccttcctgagctctgtgcgctactggatggccttcaacatcgagcgggcctgccagagctacttcggctgtgtgcagtgcatcagcggccccctgggcatgtacagaaacagcctgctgcatgaatttgtggaggactggtacaaccaggagttcatgggcaaccagtgcagctttggagatgacagacacctgaccaacagagtgctgagcctgggctacgccaccaagtacacagcccggagcaagtgcctgacagagacccccatcgagtacctgcgctggctgaaccagcagacccgctggagcaagagctacttccgggagtggctgtacaatgccatgtggttccacaagcaccacctgtggatgacctatgaggccatcatcaccggcttcttccccttcttcctgattgccaccgtcatccagctgttctaccggggcaagatctggaacatcctgctcttcctgctgactgtgcagctggtgggcctcatcaagagcagctttgccagctgcctgcggggcaacatcgtgatggtgttcatgagcctgtacagcgtgctgtacatgagcagcctgctgcctgccaagatgtttgccatcgccaccatcaacaaggccggctggggcaccagcggcaggaagaccatcgtggtgaacttcatcggcctcatccctgtgtctgtgtggttcaccatcctgctgggcggcgtcatcttcaccatctacaaggagagcaagaggcccttcagcgagagcaagcagacagtgctgattgtgggcaccctgctgtatgcctgctactgggtgatgctgctgaccctgtatgtggtgctgatcaacaagtgtggccgcaggaagaagggccagcagtatgacatggtgctggatgtgtag

SEQ ID NO: 155656 - DNA, 951 bp, Artificial Sequence
  Description of Artificial Sequence: Synthetic coding sequence
atgcactgtgagcgcttcctgtgcatcctgcgcatcatcggcaccaccctgtttggagtgtccctgctgctgggcatcacagctgcctacatcgtgggctaccagttcatccagacagacaactactacttctcctttggcctgtatggagccttcctggccagccacctgatcatccagagcctgtttgccttcctggagcacaggaagatgaagaagagcctggagacccccatcaagctgaacaagacagtggccctgtgcatcgccgcctaccaggaggaccctgactacctgaggaagtgcctgcagagcgtgaagaggctgacctacccaggcatcaaggtggtgatggtgattgatggcaacagtgaagatgacctgtacatgatggacatcttcagcgaggtgatgggccgggacaagagcgccacctacatctggaagaacaacttccacgagaagggccctggagaaacagatgagagccacaaggagagcagccagcacgtgacccagctggtgctgagcaacaagagcatctgcatcatgcagaagtggggcggcaagcgggaggtgatgtacacagccttccgggccctgggccgctctgtggactatgtgcaggtgtgtgacagcgacaccatgctggaccctgccagctctgtggagatggtgaaggtgctggaggaggaccccatggtgggcggcgtgggcggagatgtgcagatcctgaacaagtatgacagctggatctccttcctgagctctgtgcgctactggatggccttcaacatcgagcgggcctgccagagctacttcggctgtgtgcagtgcatcagcggccccctgggcatgtacagaaacagcctgctgcacgtgctgacctttgctgtgacccacaacaccctggtgcccctgggcgctgtgcagtactgcggcatcagatag

SEQ ID NO: 155657 - DNA, 1389 bp, Artificial Sequence
  Description of Artificial Sequence: Synthetic coding sequence
atggcccaggtgtccatcaacaatgactacagcgagtgggacctgagcacagatgctggggagcgggcccggctgctgcagagcccctgtgtggacacagcccccaagtctgagtgggaggccagccctgggggcctggaccggggcaccaccagcaccctgggcgccatcttcatcgtggtgaatgcctgcctgggcgccggcctgctgaacttccctgctgccttcagcacagctggaggagtggccgccggcatcgccctgcagatgggcatgctggtgttcatcatcagcggcctggtgatcctggcctactgcagccaggccagcaatgaaagaacctaccaggaggtggtgtgggccgtgtgtgggaagctgactggagtgctgtgtgaggtggccatcgctgtgtacaccttcggcacctgcatcgccttcctgatcatcatcggggaccagcaggacaagatcatcgctgtgatggccaaggagcctgagggcgccagcggcccctggtacacagacaggaagttcaccatcagcctgacagccttcctgttcatcctgcccctgagcatcccccgggagatcggcttccagaagtatgccagcttcctgtctgtggtgggcacctggtacgtgacagccatcgtcatcatcaagtacatctggccagacaaggagatgaccccaggcaacatcctgaccaggcctgcctcctggatggctgtgttcaatgccatgcccaccatctgcttcggcttccagtgccacgtgtcctctgtgcctgtgttcaacagcatgcagcagcctgaggtgaagacctggggcggcgtggtgacagctgccatggtgattgccctggccgtgtacatgggcaccggcatctgtggcttcctgaccttcggggctgctgtggaccctgatgtgctgctgagctaccccagcgaggacatggctgtggccgtggcccgggccttcatcatcctgtctgtgctgaccagctaccccatcctgcacttctgtggccgggctgtggtggagggcctgtggctgcgctaccagggcgtgcctgtggaggaggatgtgggccgggagaggagaagaagagtgctgcagaccctggtgtggttcctgctgaccctgctgctggccctcttcatcccagacatcggcaaggtgatcagcgtcatcggcggcctggccgcctgcttcatctttgtgtttcctggcctgtgcctgatccaggccaagctgtctgagatggaggaggtgaagccagcctcctggtgggtgctggtgtcctatggagtgctgctggtgaccctgggcgccttcatcttcggccagaccacagccaatgccatctttgtggacctgctggcctag

SEQ ID NO: 155658 - DNA, 1662 bp, Artificial Sequence
  Description of Artificial Sequence: Synthetic coding sequence
atgcctgtgcagctgaccacagccctgcgggtggtgggcaccagcctgtttgccctggccgtgctgggcggcatcctggccgcctacgtgacaggctaccagttcatccacacagagaagcactacctgagctttggcctgtatggagccatcctgggcctgcacctgctgatccagagcctgtttgccttcctggagcacaggaggatgagaagagctggccaggccctgaagctgcccagcccccggcggggctctgtggccctgtgcatcgccgcctaccaggaggaccctgactacctgaggaagtgcctgcggagcgcccagaggatctccttcccagacctgaaggtggtgatggtggtggatggcaaccggcaggaggatgcctacatgctggacatcttccacgaggtgctgggcggcacagagcaggccggcttctttgtgtggaggagcaacttccacgaggccggggagggggagacagaggccagcctgcaggagggcatggacagagtgagagatgtggtgcgggccagcaccttcagctgcatcatgcagaagtggggcggcaagcgggaggtgatgtacacagccttcaaggccctgggggacagcgtggactacatccaggtgtgtgacagcgacacagtgctggaccctgcctgcaccatcgagatgctgcgggtgctggaggaggacccccaggtgggcggcgtgggcggagatgtgcagatcctgaacaagtatgacagctggatctccttcctgagctctgtgcgctactggatggccttcaacgtggagcgggcctgccagagctacttcggctgtgtgcagtgcatcagcggccccctgggcatgtacagaaacagcctgctgcagcagttcctggaggactggtaccaccagaagttcctgggcagcaaatgttcctttggagatgacagacacctgaccaacagagtgctgagcctgggctaccgcaccaagtacacagcccggagcaagtgcctgacagagacccccaccaagtacctgcgctggctgaaccagcagacccgctggagcaagagctacttccgggagtggctgtacaacagcctgtggttccacaagcaccacctgtggatgacctatgaatctgtggtgacaggcttcttccccttcttcctgattgccaccgtcatccagctgttctaccggggccgcatctggaacatcctgctcttcctgctgactgtgcagctggtgggcatcatcaaggccacctacgcctgcttcctgcggggaaatgctgagatgatcttcatgagcctgtacagcctgctgtacatgagcagcctgctgcctgccaagatctttgccatcgccaccatcaacaagagcggctggggcaccagcggcaggaagaccatcgtggtgaacttcatcggcctcatccctgtgtccatctgggtggccgtgctgctgggcggcctggcctacacagcctactgccaggacctcttcagcgagacagagctggccttcctggtgtctggggccatcctgtatggctgctactgggtggccctgctgatgctgtacctggccatcatcgcccggcgctgtgggaagaagccagagcagtacagcctggcctttgctgaggtgtag

SEQ ID NO: 155659 - DNA, 1308 bp, Artificial Sequence
  Description of Artificial Sequence: Synthetic coding sequence
atggccgcccacctgctgcccatctgtgccctcttcctgaccctgctggacatggcccagggcttccggggccccctgctgcccaaccggcccttcaccaccgtgtggaatgccaacacccagtggtgcctggagagacatggagtggatgtggatgtgtctgtgtttgatgtggtggccaaccctggccagaccttccggggccctgacatgaccatcttctacagcagccagctgggcacctacccctactacacccccaccggggagcctgtgtttggaggcctgccccagaatgccagcctgattgcccacctggcccggaccttccaggacatcctggccgccatcccagccccagacttcagcggcctggccgtcatcgactgggaggcctggaggccccgctgggccttcaactgggacaccaaggacatctaccggcagaggagccgggccctggtgcaggcccagcacccagactggccagccccccaggtggaggccgtggcccaggaccagttccagggcgccgcccgggcctggatggccggcaccctgcagctgggccgggccctgcggccccggggcctgtggggcttctacggcttcccagactgctacaactatgacttcctgagccccaactacacaggccagtgccccagcggcatccgggcccagaatgaccagctgggctggctgtggggccagagccgggccctgtaccccagcatctacatgcctgctgtgctggagggcaccgggaagagccagatgtatgtgcagcaccgggtggccgaggccttccgggtggccgtggccgccggggaccccaacctgcctgtgctgccctacgtgcagatcttctatgacaccaccaaccacttcctgcccctggatgagctggagcacagcctgggggagagcgctgcccagggcgccgccggcgtggtgctgtgggtgtcctgggagaacaccaggaccaaggagagctgccaggccatcaaggagtacatggacaccaccctgggccccttcatcctgaatgtgaccagcggggccctgctgtgcagccaggccctgtgcagcggccacggccgctgtgtgcggaggaccagccaccccaaggccctgctgctgctgaacccagccagcttcagcatccagctgaccccaggcggcggccccctgagcctgcggggggccctgagcctggaggaccaggcccagatggctgtggagttcaagtgccgctgctacccaggctggcaggccccctggtgtgagaggaagtccatgtggtag

SEQ ID NO: 155660 - DNA, 1308 bp, Artificial Sequence; identical to SEQ ID NO: 155659
  Description of Artificial Sequence: Synthetic coding sequence

SEQ ID NO: 155661 - DNA, 1218 bp, Artificial Sequence
  Description of Artificial Sequence: Synthetic coding sequence
atggccgcccacctgctgcccatctgtgccctcttcctgaccctgctggacatggcccagggcttccggggccccctgctgcccaaccggcccttcaccaccgtgtggaatgccaacacccagtggtgcctggagagacatggagtggatgtggatgtgtctgtgtttgatgtggtggccaaccctggccagaccttccggggccctgacatgaccatcttctacagcagccagctgggcacctacccctactacacccccaccggggagcctgtgtttggaggcctgccccagaatgccagcctgattgcccacctggcccggaccttccaggacatcctggccgccatcccagccccagacttcagcggcctggccgtcatcgactgggaggcctggaggccccgctgggccttcaactgggacaccaaggacatctaccggcagaggagccgggccctggtgcaggcccagcacccagactggccagccccccaggtggaggccgtggcccaggaccagttccagggcgccgcccgggcctggatggccggcaccctgcagctgggccgggccctgcggccccggggcctgtggggcttctacggcttcccagactgctacaactatgacttcctgagccccaactacacaggccagtgccccagcggcatccgggcccagaatgaccagctgggctggctgtggggccagagccgggccctgtaccccagcatctacatgcctgctgtgctggagggcaccgggaagagccagatgtatgtgcagcaccgggtggccgaggccttccgggtggccgtggccgccggggaccccaacctgcctgtgctgccctacgtgcagatcttctatgacaccaccaaccacttcctgcccctggagagctgccaggccatcaaggagtacatggacaccaccctgggccccttcatcctgaatgtgaccagcggggccctgctgtgcagccaggccctgtgcagcggccacggccgctgtgtgcggaggaccagccaccccaaggccctgctgctgctgaacccagccagcttcagcatccagctgaccccaggcggcggccccctgagcctgcggggggccctgagcctggaggaccaggcccagatggctgtggagttcaagtgccgctgctacccaggctggcaggccccctggtgtgagaggaagtccatgtggtag

SEQ ID NO: 155662 - DNA, 1308 bp, Artificial Sequence; identical to SEQ ID NO: 155659
  Description of Artificial Sequence: Synthetic coding sequence

SEQ ID NO: 155663 - DNA, 312 bp, Artificial Sequence
  Description of Artificial Sequence: Synthetic coding sequence
atggccgcccacctgctgcccatctgtgccctcttcctgaccctgctggacatggcccagggcttccggggccccctgctgcccaaccggcccttcaccaccgtgtggaatgccaacacccagtggtgcctggagagacatggagtggatgtggatgtgtctgtgtttgatgtggtggccaaccctggccagaccttccggggccctgacatgaccatcttctacagcagccagctgggcacctacccctactacacccccaccggggagcctgtgtttggaggcctgccccagaatgccagcctcatctag

SEQ ID NO: 155664 - DNA, 531 bp, Artificial Sequence
  Description of Artificial Sequence: Synthetic coding sequence
atgtatgtgcagcaccgggtggccgaggccttccgggtggccgtggccgccggggaccccaacctgcctgtgctgccctacgtgcagatcttctatgacaccaccaaccacttcctgcccctggatgagctggagcacagcctgggggagagcgctgcccagggcgctgctggggtggtgctgtgggtgtcctgggagaacaccaggaccaaggagagctgccaggccatcaaggagtacatggacaccaccctgggccccttcatcctgaatgtgaccagcggggccctgctgtgcagccaggccctgtgcagcggccacggccgctgtgtgcggaggaccagccaccccaaggccctgctgctgctgaacccagccagcttcagcatccagctgacccctgggggcggccccctgagcctgcggggggccctgagcctggaggaccaggcccagatggctgtggagttcaagtgccgctgctacccaggctggcaggccccctggtgtgagaggaagtccatgtggtag

SEQ ID NO: 155665 - DNA, 210 bp, Artificial Sequence
  Description of Artificial Sequence: Synthetic coding sequence
atggccgcccacctgctgcccatctgtgccctcttcctgaccctgctggacatggcccagggcttccggggccccctgctgcccaaccggcccttcaccaccgtgtggaatgccaacacccagtggtgcctggagagacatggagtggatgtggatgtgtctgtgtttgatgtggtggccaaccctggccagaccttccggggcccctag

SEQ ID NO: 155666 - DNA, 762 bp, Artificial Sequence
  Description of Artificial Sequence: Synthetic coding sequence
atggccggcaccctgcagctgggccgggccctgcggccccggggcctgtggggcttctacggcttcccagactgctacaactatgacttcctgagccccaactacacaggccagtgccccagcggcatccgggcccagaatgaccagctgggctggctgtggggccagagccgggccctgtaccccagcatctacatgcctgctgtgctggagggcaccgggaagagccagatgtatgtgcagcaccgggtggccgaggccttccgggtggccgtggccgccggggaccccaacctgcctgtgctgccctacgtgcagatcttctatgacaccaccaaccacttcctgcccctggatgagctggagcacagcctgggggagagcgctgcccagggcgccgccggcgtggtgctgtgggtgtcctgggagaacaccaggaccaaggagagctgccaggccatcaaggagtacatggacaccaccctgggccccttcatcctgaatgtgaccagcggggccctgctgtgcagccaggccctgtgcagcggccacggccgctgtgtgcggaggaccagccaccccaaggccctgctgctgctgaacccagccagcttcagcatccagctgaccccaggcggcggccccctgagcctgcggggggccctgagcctggaggaccaggcccagatggctgtggagttcaagtgccgctgctacccaggctggcaggccccctggtgtgagaggaagtccatgtggtag

SEQ ID NO: 155667 - DNA, 1422 bp, Artificial Sequence
  Description of Artificial Sequence: Synthetic coding sequence
atgagagctggccctggccccaccgtgaccctggccctggtgctggccgtgtcctgggccatggagctgaagcccacagccccacccatcttcaccggccggccctttgtggtggcctgggatgtgcccacccaggactgtggcccccggctgaaggtgcccctggacctgaatgcctttgatgtgcaggccagccccaatgaaggatttgtgaaccagaacatcaccatcttctacagagaccggctgggcctgtaccccaggtttgattctgctggccgctctgtgcatggaggagtgccccagaatgtgtccctgtgggcccacaggaagatgctgcagaagagggtggagcactacatccgcacccaggagagcgctggcctggccgtcatcgactgggaggactggaggcctgtgtgggtgaggaactggcaggacaaggatgtgtaccgccgcctgagccggcagctggtggccagccgccacccagactggcccccagacagaattgtgaagcaggcccagtatgaatttgaatttgctgcccagcagttcatgctggagaccctgcgctacgtgaaggctgtgcggcccaggcacctgtggggcttctacctgttcccagactgctacaaccacgactatgtgcagaactgggagagctacacaggccgctgcccagatgtggaggtggccagaaatgaccagctggcctggctgtgggccgagagcacagccctcttccccagcgtgtacctggatgagaccctggccagcagcagacatggaagaaactttgtgtccttccgggtgcaggaggccctgcgggtggcccggacccaccacgccaaccacgccctgcctgtgtatgtgttcacccggcccacctacagccggcggctgaccggcctgtctgagatggacctgatcagcaccatcggggagagcgctgccctgggcgctgctggggtcatcctgtggggagatgctggctacaccaccagcacagagacctgccagtacctgaaggactacctgacccggctgctggtgccctacgtggtgaatgtgtcctgggccacccagtactgcagccgggcccagtgccacggccacggccgctgtgtgagaagaaaccccagcgccagcaccttcctgcacctgagcaccaacagcttccggctggtgcccggccacgcccctggagagccccagctgcggcctgtgggggagctgtcctgggccgacatcgaccacctgcagacccacttccgctgccagtgctacctgggctggagcggggagcagtgccagtgggaccaccggcaggccgccggcggggccagcgaggcctgggccggcagccacctgaccagcctgctggccctggccgccctggccttcacctggaccctgtag

SEQ ID NO: 155668 - DNA, 1422 bp, Artificial Sequence; identical to SEQ ID NO: 155667
  Description of Artificial Sequence: Synthetic coding sequence

SEQ ID NO: 155669 - DNA, 147 bp, Artificial Sequence
  Description of Artificial Sequence: Synthetic coding sequence
atgagagctggccctggccccaccgtgaccctggccctggtgctggccgtgtcctgggccatggagctgaagcccacagccccacccatcttcaccggccggccctttgtggtggcctgggatgtgcccacccaggactgtggctag

SEQ ID NO: 155670 - DNA, 354 bp, Artificial Sequence
  Description of Artificial Sequence: Synthetic coding sequence
atgagagctggccctggccccaccgtgaccctggccctggtgctggccgtgtcctgggccatggagctgaagcccacagccccacccatcttcaccggccggccctttgtggtggcctgggatgtgcccacccaggactgtggcccccggctgaaggtgcccctggacctgaatgcctttgatgtgcaggccagccccaatgaaggatttgtgaaccagaacatcaccatcttctacagagaccggctgggcctgtaccccaggtttgattctgctggccgctctgtgcatggaggagtgccccagaatgtgtccctgtgggcccacaggaagatgctgcagaagagggtgtag

SEQ ID NO: 155671 - DNA, 246 bp, Artificial Sequence
  Description of Artificial Sequence: Synthetic coding sequence
atgagagctggccctggccccaccgtgaccctggccctggtgctggccgtgtcctgggccatggagctgaagcccacagccccacccatcttcaccggccggccctttgtggtggcctgggatgtgcccacccaggactgtggcccccggctgaaggtgcccctggacctgaatgcctttgatgtgcaggccagccccaatgaaggatttgtgaaccagaacatcaccatcttctacagagactag

SEQ ID NO: 155672 - DNA, 231 bp, Artificial Sequence
  Description of Artificial Sequence: Synthetic coding sequence
atgagagctggccctggccccaccgtgaccctggccctggtgctggccgtgtcctgggccatggagctgaagcccacagccccacccatcttcaccggccggccctttgtggtggcctgggatgtgcccacccaggactgtggcccccggctgaaggtgcccctggacctgaatgcctttgatgtgcaggccagccccaatgaaggatttgtgaaccagaacatcacctag

SEQ ID NO: 155673 - DNA, 1422 bp, Artificial Sequence; identical to SEQ ID NO: 155667
  Description of Artificial Sequence: Synthetic coding sequence

SEQ ID NO: 155674 - DNA, 1422 bp, Artificial Sequence; identical to SEQ ID NO: 155667
  Description of Artificial Sequence: Synthetic coding sequence

SEQ ID NO: 155675 - DNA, 366 bp, Artificial Sequence
  Description of Artificial Sequence: Synthetic coding sequence
atgagagctggccctggccccaccgtgaccctggccctggtgctggccgtgtcctgggccatggagctgaagcccacagccccacccatcttcaccggccggccctttgtggtggcctgggatgtgcccacccaggactgtggcccccggctgaaggtgcccctggacctgaatgcctttgatgtgcaggccagccccaatgaaggatttgtgaaccagaacatcaccatcttctacagagaccggctgggcctgtaccccaggtttgattctgctggccgctctgtgcatggaggagtgccccagaatgtgtccctgtgggcccacaggaagatgctgcagaagagggtggagcactacatctag

SEQ ID NO: 155676 - DNA, 1254 bp, Artificial Sequence
  Description of Artificial Sequence: Synthetic coding sequence
atgaccacccagctgggccctgccctggtgctgggcgtggccctgtgcctgggctgcggccagcccctgccccaggtgcctgagcggcccttctctgtgctgtggaatgtgcccagcgcccactgtgaggcccgcttcggcgtgcacctgcccctgaatgccctgggcatcatcgccaacagaggccagcacttccacggccagaacatgaccatcttctacaagaaccagctgggcctgtacccctacttcggcccccggggcacagcccacaacggcggcatcccccaggccctgcccctggacagacacctggccctggccgcctaccagatccaccacagcctgcggcccggctttgctggccctgctgtgctggactgggaggagtggtgccccctgtgggccggcaactggggcagaagaagagcctaccaggccgcctcctgggcctgggcccagcaggtgtttcctgacctggacccccaggagcagctgtacaaggcctacacaggctttgagcaggccgcccgggccctgatggaggacaccctgcgggtggcccaggccctgcggccccacggcctgtggggcttctaccactacccagcctgtggaaatggctggcacagcatggccagcaactacacaggccgctgccacgccgccaccctggccaggaacacccagctgcactggctgtgggccgccagcagcgccctcttccccagcatctacctgcccccccggctgcccccagcccaccaccaggcctttgtgcgccaccggctggaggaggccttccgggtggccctggtgggccaccgccaccccctgcctgtgctggcctacgtgcggctgacccaccggcgcagcggccgcttcctgagccaggatgacctggtgcagagcattggagtgtctgctgccctgggcgccgccggcgtggtgctgtggggagacctgagcctgagcagcagcgaggaggagtgctggcacctgcatgactacctggtggacaccctgggcccctacgtgatcaacgtgacccgggccgccatggcctgcagccaccagcgctgccacggccacggccgctgtgcccggcgggaccccggccagatggaggccttcctgcacctgtggccagatggcagcctgggggactggaagagcttcagctgccactgctactggggctgggccggccccacctgccaggagcccaggcctggccccaaggaggccgtgtag

SEQ ID NO: 155677 - DNA, 1164 bp, Artificial Sequence
  Description of Artificial Sequence: Synthetic coding sequence
atgaccacccagctgggccctgccctggtgctgggcgtggccctgtgcctgggctgcggccagcccctgccccaggtgcctgagcggcccttctctgtgctgtggaatgtgcccagcgcccactgtgaggcccgcttcggcgtgcacctgcccctgaatgccctgggcatcatcgccaacagaggccagcacttccacggccagaacatgaccatcttctacaagaaccagctgggcctgtacccctacttcggcccccggggcacagcccacaacggcggcatcccccaggccctgcccctggacagacacctggccctggccgcctaccagatccaccacagcctgcggcccggctttgctggccctgctgtgctggactgggaggagtggtgccccctgtgggccggcaactggggcagaagaagagcctaccaggccgcctcctgggcctgggcccagcaggtgtttcctgacctggacccccaggagcagctgtacaaggcctacacaggctttgagcaggccgcccgggccctgatggaggacaccctgcgggtggcccaggccctgcggccccacggcctgtggggcttctaccactacccagcctgtggaaatggctggcacagcatggccagcaactacacaggccgctgccacgccgccaccctggccaggaacacccagctgcactggctgtgggccgccagcagcgccctcttccccagcatctacctgcccccccggctgcccccagcccaccaccaggcctttgtgcgccaccggctggaggaggccttccgggtggccctggtgggccaccgccaccccctgcctgtgctggcctacgtgcggctgacccaccggcgcagcggccgcttcctgagccaggaggagtgctggcacctgcatgactacctggtggacaccctgggcccctacgtgatcaacgtgacccgggccgccatggcctgcagccaccagcgctgccacggccacggccgctgtgcccggcgggaccccggccagatggaggccttcctgcacctgtggccagatggcagcctgggggactggaagagcttcagctgccactgctactggggctgggccggccccacctgccaggagcccaggcctggccccaaggaggccgtgtag

SEQ ID NO: 155678 - DNA, 507 bp, Artificial Sequence
  Description of Artificial Sequence: Synthetic coding sequence
atgctgcccccagcccaccaccaggcctttgtgcgccaccggctggaggaggccttccgggtggccctggtgggccaccgccaccccctgcctgtgctggcctacgtgcggctgacccacagaagaagtggccgcttcctgagccaggatgacctggtgcagagcattggagtgtctgctgccctgggcgctgctggggtggtgctgtggggagacctgagcctgagcagcagcgaggaggagtgctggcacctgcatgactacctggtggacaccctgggcccctacgtgatcaacgtgaccagggctgccatggcctgcagccaccagcgctgccacggccacggccgctgtgcccggcgggaccccggccagatggaggccttcctgcacctgtggccagatggcagcctgggggactggaagagcttcagctgccactgctactggggctgggccggccccacctgccaggagccccggcccggccccaaggaggccgtgtag

SEQ ID NO: 155679 - DNA, 483 bp, Artificial Sequence
  Description of Artificial Sequence: Synthetic coding sequence
atgaccacccagctgggccctgccctggtgctgggcgtggccctgtgcctgggctgcggccagcccctgccccaggtgcctgagcggcccttctctgtgctgtggaatgtgcccagcgcccactgtgaggcccgcttcggcgtgcacctgcccctgaatgccctgggcatcatcgccaacagaggccagcacttccacggccagaacatgaccatcttctacaagaaccagctgggcctgtacccctacttcggcccccggggcacagcccacaacggcggcatcccccaggccctgcccctggacagacacctggccctggccgcctaccagatccaccacagcctgcggcccggctttgctggccctgctgtgctggactgggaggagtggtgccccctgtgggccggcaactggggcagaagaagagcctaccaggccgcctcctgggcctgggcccagcaggtgtttcctgacctgtag

SEQ ID NO: 155680 - DNA, 1164 bp, Artificial Sequence; identical to SEQ ID NO: 155677
  Description of Artificial Sequence: Synthetic coding sequence

SEQ ID NO: 155681 - DNA, 417 bp, Artificial Sequence
  Description of Artificial Sequence: Synthetic coding sequence
atgctgcccccagcccaccaccaggcctttgtgcgccaccggctggaggaggccttccgggtggccctggtgggccaccgccaccccctgcctgtgctggcctacgtgcggctgacccacagaagaagtggccgcttcctgagccaggaggagtgctggcacctgcatgactacctggtggacaccctgggcccctacgtgatcaacgtgaccagggctgccatggcctgcagccaccagcgctgccacggccacggccgctgtgcccggcgggaccccggccagatggaggccttcctgcacctgtggccagatggcagcctgggggactggaagagcttcagctgccactgctactggggctgggccggccccacctgccaggagccccggcccggccccaaggaggccgtgtag

SEQ ID NO: 155682 - DNA, 1518 bp, Artificial Sequence
  Description of Artificial Sequence: Synthetic coding sequence
atgagctctgtgcagcagcagcccccaccaccccggcgggtgaccaacgtgggcagcctgctgctgaccccccaggagaatgaaagcctcttcaccttcctgggcaagaagtgtgtgaccatgagcagcgctgtggtgcagctgtatgctgctgacaggaactgcatgtggagcaagaagtgcagcggcgtggcctgcctggtgaaggacaacccccagaggagctacttcctgcgcatctttgacatcaaggatggcaagctgctgtgggagcaggagctgtacaacaactttgtgtacaacagcccccggggctacttccacacctttgctggggacacctgccaggtggccctgaactttgccaatgaggaggaggccaagaagttcaggaaggctgtgacagacctgctgggccggcggcagaggaagtctgagaagaggcgggaccccccaaatggccccaacctgcccatggccaccgtggacatcaagaaccctgagatcaccaccaaccgcttctacggcccccaggtgaacaacatcagccacaccaaggagaagaagaagggcaaggccaagaagaagaggctgaccaaggctgacatcggcacccccagcaacttccagcacatcggccacgtgggctgggaccccaacacaggctttgacctgaacaacctggaccctgagctgaagaacctgtttgacatgtgtggcatcagcgaggcccagctgaaggaccgggagaccagcaaggtgatctatgacttcatcgagaagacaggaggagtggaggccgtgaagaatgagctgcggcggcaggcccctcctcctcctccacccagcagaggaggccccccacctcctcctcctccaccccacaacagcggccccccacctcctccagcccggggccgcggggcccctcctcctccacccagccgggcccccacagctgcccctcctcctcctccacccagccggcccagcgtggccgtgcccccacctccacccaacaggatgtacccacctcctcctccagccctgcccagcagcgcccccagcggccccccacctcctccacccagcgtgctgggcgtgggccctgtggcccctcctcctcctcctcctcctcctcctcctcctggccccccacctcctcctggcctgcccagtgatggagaccaccaggtgcccaccacagctggcaacaaggccgccctgctggaccagatccgggagggcgcccagctgaagaaggtggagcagaacagcaggcctgtgtcctgcagcggcagagatgccctgctggaccagatccggcagggcatccagctgaagtctgtggctgatggccaggagagcaccccacccaccccagcccccaccagcggcatcgtgggcgccctgatggaggtgatgcagaagaggagcaaggccatccacagcagtgatgaagatgaagatgaagatgatgaagaagattttgaagatgatgatgagtgggaggactag

SEQ ID NO: 155683 - DNA, 1446 bp, Artificial Sequence
  Description of Artificial Sequence: Synthetic coding sequence
atgaaggtgctgtctgagggccagctgaagctgtgtgtggtgcagcctgtgcacctgacctcctggctgctgatcttcttcatcctgaagagcatcagctgcctgaagccagcccggctgcccatctaccagaggaagcccttcatcgccgcctggaatgcccccacagaccagtgcctgatcaagtacaacctgcggctgaacctgaagatgtttcctgtgattggcagccccctggccaaggcccggggccagaatgtgaccatcttctacgtgaaccggctgggctactacccctggtacaccagccagggcgtgcccatcaatggaggcctgccccagaacatcagcctgcaggtgcacctggagaaggctgaccaggacatcaactactacatcccagctgaggacttcagcggcctggccgtcatcgactgggagtactggaggccccagtgggccaggaactggaacagcaaggatgtgtaccggcagaagagcaggaagctgatcagtgacatgggcaagaatgtgtctgccacagacatcgagtacctggccaaggtgacctttgaggagagcgccaaggccttcatgaaggagaccatcaagctgggcatcaagagccggcccaagggcctgtggggctactacctgtacccagactgccacaactacaacgtgtatgcccccaactacagcggcagctgcccagaagatgaggtgctgaggaacaatgagctgtcctggctgtggaacagcagcgctgccctgtaccccagcattggagtgtggaagagcctgggggacagcgagaacatcctgcgcttcagcaagttccgggtgcatgagagcatgaggatcagcaccatgaccagccatgactatgccctgcctgtgtttgtgtacacccggctgggctacagagatgagcccctcttcttcctgagcaagcaggacctggtgtccaccatcggggagagcgctgccctgggcgccgccggcatcgtcatctggggagacatgaacctgacagccagcaaggccaactgcaccaaggtgaagcagtttgtgtccagtgacctgggcagctacatcgccaacgtgaccagggctgctgaggtgtgcagcctgcacctgtgcaggaacaacggccgctgcatcaggaagatgtggaatgcccccagctacctgcacctgaacccagccagctaccacatcgaggcctctgaagatggagagttcaccgtgaagggcaaggccagtgacacagacctggccgtgatggctgacaccttcagctgccactgctaccagggctatgaaggagctgactgccgggagatcaagacagcagatggctgcagcggcgtgagccccagccctggcagcctgatgaccctgtgcctgctgctgctggccagctaccgcagcatccagctgtag

SEQ ID NO: 155684 - DNA, 138 bp, Artificial Sequence
  Description of Artificial Sequence: Synthetic coding sequence
atgaaggtgctgtctgagggccagctgaagctgtgtgtggtgcagcctgtgcacctgacctcctggctgctgatcttcttcatcctgaagagcatcagctgcctgaagccagcccggctgcccatctaccagaggtag

SEQ ID NO: 155685 - DNA, 192 bp, Artificial Sequence
  Description of Artificial Sequence: Synthetic coding sequence
atgaaggtgctgtctgagggccagctgaagctgtgtgtggtgcagcctgtgcacctgacctcctggctgctgatcttcttcatcctgaagagcatcagctgcctgaagccagcccggctgcccatctaccagaggaagcccttcatcgccgcctggaatgcccccacagaccagtgcctgatcaagtactag

SEQ ID NO: 155686 - DNA, 15366 bp, Artificial Sequence
  Description of Artificial Sequence: Synthetic coding sequence
atgaccagccggcggctggaggagagcatgggcgctgtgcagatgggcctggtgaacatgttcaagggcttccagagcaaggtgctgccccccctgagccccaaggtggtgacagaggaggaggtgaacaggatgctgaccccatctgagttcctgaaggagatgagcctgaccacagagcagaggctggccaagacccggctgatgtgccggccccagatcatcgagctgctggacatgggagagaccacccaccagaagttctctggaattgacctggaccaggccctcttccagcccttccccagcgagatcatcttccagaactacaccccctgtgaggtgtatgaggtgcccctcatcctgagaaataatgacaagatcccccggctggtgaaggtggtggaggagagcagcccctacttcaaggtgatcagccccaaggacatcggccacaaggtggcccctggggtgcccagcatcttccgcatcctcttcaccccagaggagaacaaggactatgcccacaccctgacctgtgtgacagagcgggagaagttcatcgtgcccatcaaggcccggggggcccgggccatcctggacttcccagacaagctgaacttcagcacctgccctgtgaagtacagcacccagaagatcctgctggtgaggaacatcggcaacaagaatgctgtgttccacatcaagacctgccggcccttcagcattgaaccagccatcggcaccctgaatgtgggggagagcatgcagctggaggtggagtttgagccccagagcgtgggggaccacagcggccgcctgattgtgtgctatgacaccggggagaaggtgtttgtgtccctgtatggagctgccatcgacatgaacatccggctggacaagaacagcctgaccatcgagaagacctacatcagcctggccaaccagaggaccatcaccatccacaacagaagcaacatcatcgcccacttcctgtggaaggtgtttgccacccagcaggaggaggaccgggagaagtaccgggcctgtgatgacctgatcaaggaggagaaggatgaaacagatgagttctttgaggagtgcatcacagaccccctgctgcgggagcacctgtctgtgctgagcaggacctttgccaaccagaggcggctggtgcagggcgacagcaagctgttcttcaacaacgtgttcaccgtggagcccctggagggagatgtgtggcccaacagcagcgctgagatcaccgtgtacttcaaccccctggaggccaagctgtaccagcagaccatctactgtgacatcctgggccgggagatccggctgcccctgcgcatcaagggggagggcatgggccccaagatccacttcaactttgagctgctggacatcggcaaggtgttcaccggcagcgcccactgctatgaggccatcctgtacaacaagggcagcattgatgccctcttcaacatgaccccacccaccagcgccctgggcgcctgctttgtgttcagccccaaggagggcatcatcgagcccagcggcgtgcaggccatccagatctccttcagcagcaccatcctgggcaactttgaggaggagttcctggtgaatgtgaatggcagccctgagcctgtgaagctgaccatccggggctgtgtgattggccccaccttccacttcaacgtgcctgccctgcactttggagatgtgtcctttggcttcccccacaccctcatctgcagcctgaacaacaccagcctcatccccatgacctacaagctgcgcatccctggagatggcctgggccacaagagcatctcctactgtgagcagcacgtggactacaagaggcccagctggaccaaggaggagatcagctccatgaagcccaaggagttcaccatcagcccagactgtggcaccatccggccccagggctttgctgccatccgggtgaccctgtgcagcaacacagtgcagaagtatgagctggccctggtggtggatgtggagggcatcggggaggaggtgctggccctgctgatcacagcccgctgtgtggtgcctgccctgcacctggtgaacacagaggtggactttggccactgcttcctgaagtacccctatgagaagaccctgcagctggccaaccaggatgacctgcccggcttctatgaggtgcagccccaggtgtgtgaggaggtgcccaccgtgctcttcagcagccccaccccatctggagtcatcagccccagcagcaccatccacatccccctggtgctggagacccaggtgactggagagcacaggagcacagtgtacatcagcatcttcggcagccaggacccccccctggtgtgccacctgaagtctgctggggagggccctgtgatctacgtgcaccccaaccaggtggactttggaaacatctacgtgctgaaggacagcagccgcatcctgaacctgtgcaaccagagcttcatcccagccttcttccaggcccacatggcccacaagaagagcctgtggaccatcgagcccaatgaaggcatggtgcccccagagacagatgtgcagctggccctgacagccaacctgaatgacaccctgaccttcaaggactgtgtgatcctggacatcgagaacagcagcacctaccgcatccctgtgcaggccagcggcaccggcagcaccatcgtgtctgacaagccctttgcccctgagctgaacctgggcgcccacttcagcctggacacccactactaccacttcaagctgatcaacaagggccgccgcatccagcagctgttctggatgaatgacagcttccggccccaggccaagctgagcaagaagggccgggtgaagaagggccacgcccacgtgcagccccagcccagcggcagccaggagccccgggacccccagagccctgtgttccacctgcacccagcctccatggagctgtacccaggccaggccattgatgtgatcctggagggctacagcgccaccccaagaattgtgaaggagaagctggtgtgccacgccatcatcggggcccagaagggcaagagcctggtgatggctgtgaacatcacctgtgaatttgtggcccccctcatccagctgagcaccaagcagctgatctaccgcctggagaagaagcccaacagcatcctgaagccagactaccagcccctggccatcaagaacatcagcaccctgcctgtgaacctgctgctgagcaccagcggccccttcttcatctgtgaaacagacaagagcctgctgcctgccaccccagagcccatcaagctggagattgatgaggagaagaacctgctgatcaagtttgaccccagctacagaaatgacctgaacaactgggtggccgaggagatcctggccatcaagtatgtggagcacccccagattgacagcctggacctgcggggggaggtgcactaccccaacctgagctttgagaccaaggagctggactttggctgcatcctgaatgacacagagctgatccgctacgtgaccatcaccaactgcagccccctggtggtgaagttccgctggttcttcctggtgaatgatgaggagaaccagatccgctttgtgaccctgcccaagaagccctacagcgcccctgtgtcccagatggagagcatcccagccaccagcgaggccgccagccccccagccatcctggtgacagtggagagccctgagatggacctgaatgactttgtgaagacagtgctggtggatgaagatgcccggcctgaggagaaggagctgaggaagaccaaggccagcagcgtcatcagtgatgagatcaagatcagcagcacagaaattgagcgcatctacagcagccagagccaggtggaggaccaggagagcctgcagacctgtgagcagaatgagatgctgagcatcggcatcgaggaggtgtttgacatcctgcccctgtttggagtgctgcagccccacagcagccaccagatctccttcaccttctacggccacgccaacatcatcgcccaggccaaggccctgtgtgaggtggaggagggccccacctatgagatcaccctgaagggggaggccagcctggtgaactacagctttgacaccaaggacatccactacggcctgcagctgtttgaccacgtgacagagcgggagatcaccctgaccaacatgggcaaggtgggctttgagttcaaggtgctgacagaccaccagagcagcccagacaacctgctgcccggggtgcccctcatcctgcctgtgtctggcttcatcagcagccaccaggagcaggtgctgaaggtgtactacctgcccggggtgcctgaggtgttcaagaggagcttccagatccagatcgcccacctggaccctgagaacatcaccctgagcggggagggcatcttcccccagatctgcctggacctgcccaggaacctgacagccaatgagaagtatgagatgttcctgaaccaggccaggaagaacacagacaaggagtacaacaagtgtgagatgctggaccactttgacatcatcacagaggaggtgcctgaagatgagcctgctgaggtgtctgcccacctgcagatggaggtggagcggctgattgtgcagagctatgtgctggagcaccagaagaccaccaccccagaccccatggatgacccctgcttcagccacaggagcaggaggaagctggccaagatccagctgcctgagtacatcctggactttggctacatcatcctgggggaggtgaggacccacatcatcaagatcatcaacaccagccacttccctgtgtccttccacgccgacaagagggtgctgcacgagaccggcttcagcacagagctggacagagtgaagaacctgccccactgtgaaacagagatctttgaggtgcgctttgacccccagggcgccaacctgcctgtgggcagcaaggaggtgatcctgcccatcaaggtggtgggcggccccaccgtgcacatctgcctgcaggccaaggtgaccatccccaccatgaccctgagccggggcaaggtggactttgccaccatccagtgtggccagtgcctggtggagaccatccagctgagcaaccacctgcaggtgccctgtgagtggtttgtgcagagccagaagcctgtggacaagctggagaagcacatgcccaagtacctgcggcagaagctgcgggcagagctgaagcccaagacccgcatctttgagatccagcccatctctggagtgctggaccccggggagaagagcaatgtgcaggtgaagttcatgcccaaggaggagaagttctacagccagaccctggtgttccagatcgcccagagcgcccagaagctgaccctgctggcccggggccagggcctggagccccggctggagttcagccccagcgtgctggacctgggccccctgctgctgtgtgcccctggagatgaagctgaggtgattgtgaagaacccctgcaacttccccatcgagttctacagcctggagtttgaccagcagtacctgattgaggagaagatcctgaggaagctgaagggctatgacagctacaacaccctgctgctgccccccaggaaccctggagagaagctgcccccagagctgtatgagtacttcaaggagatcaagaagagcaaggaggagcagatgagggccaagtacctggagaacctggcccaggagaatgaggaggaggacatcaccagcagtgaccagggcaccagcaacagcaccaagaggaccagcctgagccggggcatctctgtgaccagcaacctggaggagtggcacgccctgctggtggagagcaagacctacctggaggaggaggaggatgaggagagcctggagaagatcatcttccagacagacaagctgcagagcattgacagccacagcatggaggaggtgggggaggtggagaacaaccctgtgtccaaggccatcgcccggcacctgggcatcgacatctctgctgagggccgcctggccaagaacagaaaaggaattgccatcatcatccacggcacccccctgagcggcaagagcgccaatgctgtgtctgtggccaagtactacaatgctgcctgcctgagcattgacagcatcgtgctggaggccgtggccaacagcaacaacatccctggcatccgggcccgggagctgtgcatccgggccgccatcgagcagagcgtgaaggagggggaggaggccgcccaggaggccgctgtgggccagaatgtcatcggccagggccgcctgagcacagacaccctgggcaagctggccagcgagatgaccctggtggcccctgagatcaagccaggcaagtctgtgcggggctctgtggtgatcaccaagagcaaggctgacagccacggcagcggcagccagaagcagcaccacagccaccagagcgagaccccccagatcagcagcagccccctgcccccaggccccatccaccgctggctgtctgtgagccccagcgtgggcggggagaccggcctgatgagctgtgtgctgcctgatgagctgctggtgcagatcctggccgagcgcatccagctgagtgactgctaccggggcgtggtgtttgatggcctggacaccctgtttgcccagaatgctgctgctgccctgctgtgcctgctgaaggccatcggcagccgggagcacatctacatcctgaacatggcccaggactatgctgccatgaaggcccaggagaaggccaagaaggagcaggaggagaggaagcacaagggggccctggagaaggagaaggagcggctgcagaacatggatgaggaggagtatgatgccctgacagaggaggagaagctgacctttgaccggggcatccagcaggccctgcgggagaggaagaagcgggagcaggagcggctggccaaggagatgcaggagaagaagctgcagcaggagctggagcggcagaaggaggaggatgagctgaagagaagagtgaagaagggcaagcagggccccatcaaggaggagccccccatgaagaagagccaggccgccaacaagcaggtgccccccctgaccaaggtggatgtgaagatggagaccatcgagaggaagatctctgtgcgggagcagaccatgtctgagaaggaggagctgaacaagaagaagaggaacatgggagatgtgtccatgcacggcctgcccctggtgcaggaccaggaggacagcgagggggacaacagcaaggaccctgacaagcagctggcccccaagttcaagacctatgagctgaccctgaaggatgtgcagaacatcctgatgtactgggacaggaagcagggcgtgcagctgcccccagctggcatggaggaggcccctcatgagccagatgaccagaggcaggtgcccctgggcggcagaagaggaaggaaggaccgggagcgggagcggctggagaaggagaggacagagaaggagcggctggagcgggagaaggccgagcgggagcggctggagaagctgcgggccctggaggagaggagtgactgggagggggagggggaggaggaccacgagggcaagaaggagaaggacctgggcgtgcccttcctggacatccagaccccagactttgagggcctgtcctggaagcaggccctggagagtgacaagctgcccaagggggagcagatcctggacatcctgggcctgggcgccagcggcccccccatccccccaccagccctcttcagcatcgtgtcctaccctgtgaagaggcctcccctgaccatgacagatgacctggagcactttgtgtttgtgattcctccttctgaggacatcagcctggatgagaagaaggagatggagattgaaagtgacttcctggccaccaccaacaccaccaaggcccaggaggagcagaccagcagcagcaagggcggcaagcagaagatgaaggagaagattgaccaggtgtttgagatccagaaggacaagaggcacatggccctgaacaggaaggtgctgtctggagagcctgctggcaccatcagccagctgagtgacacagacctggacaacttcaacggccagcacagccaggagaagttcacccggctgaaccacttccgctggatcgtgcctgccaatggagaggtgaccctgcaggtgcacttcagcagtgatgaatttggaaactttgaccagaccttcaactttgagatcctgggcacctgctgccagtaccagctgtactgccggggcatctgcacctacccctacatctgccaggaccccaaggtggtgttcccccagaggaagatggacatgaagaccaatgaggtgatcttcaagaagtatgtgatgagcacagagacctactacttcggccccctgctgtgtgggaagagccgggacaagtacaagagcagcctcttccctggcaacatggagaccctgaccatcctgaacaccagcctgatggtggtggaggccagcttctacttccagaatgatgtgaaggccaacacctacttcctggagcccaacaccatggtgctgaagcccaatgagaagcagatcctgaatgtgtgggcctaccccacctctgtgggcgtgtttgaagattccatcgtgtgctgcatcaatgacaaccctgagcccgccatcttccagctgagctgccagggcatccggcctgagctggagctggagccccggcagctgcactttgaccggctgctgctgcaccggcaggagagccgggtggtgctgctgagaaatgtgaccctgctgcctgtggcctggaggatcaccagcctggagcacctgggagatgacttcaccgtgtccctgatgcagggcaccatccccccagaggccgagtatggcctgcacctgtacttccagcccaccaagcctgtgaacatcaagaaggccatccggctggaggtgctggatgctgagaacctgctgggcgtggtgcagatcgagaacatcatggtgtttgctgaggcctatgacatcgccctggacatcaccttccccaagggagctgagggcggcctggactttggaattgtgcgggtgacagaggaggccaagcagcccctgcagctgaagaacagaggcaagtatgagatcgccttctccttctctgtggacagcgtgggcatcagcacccccaacatcaacagcatgatctctgtgcagcccaagaagggcagcctgacccccacagagaagcccaccaacgtgcaggtgttcttccacgccaagaaggaggtgaagattgagcaccagcctgtgctgcgctgccagatcatcgagcccaacatcagcgagggcggggagatcatcgccagcatccccatcaagttcagcgccaatgctgtgtacagcaagtacaacatcacccccagcagcgtcatcaactttggagccctgatctgtggcaccaggaagagcaccaccttcaccatcgagaaccagggcgtgacagacttcaagtttgccctgtacaagctgactggagagagccccatccaccagaagaaggccgccagccacgtgagacatgcccggagccgggagagcgagagcttctacaagacaggcagcagccgggccgccaagttcagtgacaccatccagaaggaggtgaccaccaccggccaggccaggtttgcccacggcatgttcaccgtgtacccaggcttcggcagcatccccagcggcggccagcaggtgatcaacgtggactgtgtggctgatgccatgggcaaatgtgaggagttcatcgccatcgacatcagcggccgggaccctgctgtgcaccctgctggcatcctgtacaccctgctggccgaggcctgcctgcctgcctttgtgacagaaaataatgccctgatctttgaggagcaccagatctgcaccagcgccaacctgcaccacatcctgcagaccattgaaagtggcggcctgtttgtggaggatgagaacaagttcatcttctgcaatgtgctggtgggccggcaggccaaggcccgcttcaagatcagcaatgtgggcaagatcacctgtgatgtgaacatcgtggtgcggcccatcagcaacaagccctttgcccgcatcgtggacatctttgaggtggagcccagcaagatgtgcatcgccagccacagccacgcctttgccaccgtgtccttcaccccccagatcatgcagaactaccagtgcatctttgaggccaccctggatggcctgcccagcaccctggccaagagccggggcctggtgtttgatattgctggggagggcaacctgccccgggtgacagtggtgcggcctgtgctgcacaaccagtatggcaaccccctgctgctcttcaagaggctgctgctgggccacagcgagaagctgcccctcatcctgaagaacaatggagtgctgcctgcccagctgcacgtggacctgcaggatgagctgggcgtcttcagcctgaagggccggcccaccacagcctacatctacatcacagaggagaacaagccccacgtgaaggccaagaaggcccacacagccagcctggtggtgtcccctggggacacagctgagtttgatgtggtgttccacagccagaaggtgggccgcatgaggggcatcatccacctgagcgtcatcaacaaccagtatgaggagaccagcatccacatggtgggggagggctatgaagatgacatcaccctggacaacatccacggcctggtggcccccaccagccaggaggacatcagcatcagcgagttcacagagatcatcgaggacaatgacatggaggacctggtggccgccgccctggtggaccacatccagtttggagactgccacatcggccacagctacaatgccagcttcaccgtgaccaaccacagccaggtgaacctgatccgctttgagtggcctgtgtctgccaccatcgccttcagcccccagatgggccacctgcaccctggctgtgccaaggacatcgtggtgaccatgaagagtgatgtgcccatcaacctgaagaacatgaggatccgctgcaagctgagccgcatcatgttccagctgcctgctgaccaggtgcctgactgggatgacaggatgcacacagtgaagtgggtggatgtgcccaggaacatgcctggcaccttcaccaccaagaggaaggtgattgaaacagatcctgagcccgcccacagcgtgctggaggagaactaccaggagctgcagctgcagatcagcgccaacgtggactttgccagctaccactgccaggccagagatgtgcgcttcaaggagaccctggtgtaccagaccagggtgtttgaatttgatgtgatcaacagcggccgggtgcagctggagttctcctgggtgtctgaggacaccagcaaggctgtgtcctttgccaagccagaccaccagggcagcgcccagaaggaccagctgagccagggcaccatgcacacaggcagcaccctggacagcaccatggaccactgggccgagggcagcccccagcccttctctgtggagcccagcagcggcatcgtgcctgtgggcaagatccagaagttcaaggtgaagttcagccccctggacatcggggactttgagagcaacctcttctgccagatccccaacctgcccccaggagagcagggccctgtgctggtggccaagggccgcagcaccctgcccatctgccactttgacctgaaggacagcgactacatcagcggccaccagagaaatcctgagctgcggggcagcagtggaggagccctggaccccaacaccagggtcatcgagttcaccaccgtgggcattggaggcaagaacctgcggaccttcaccatcctgaaccccaccaacagcacctacagcttctgctggatcagcgaggagattgagagcctgcagaacccagctgccttcacctgcctgacagagaagggcttcatccaccctgagaagaaggccgagatcgtgttccagttcacccccttccacctgggcatcacagagagctcctggaccttcctgatccctgagcacaacatcaccgtgcccttcctgctggtgggcaagaccacagagcccctcatcagcctgaacaagagccacctgaacttcagcagcctgctgattggccgggaggcccgggagaccgtgcagatcatcaacaaggaggagcagggctttgacttctccttccaggacaacagccgctacagcgagggcttcagcaacagcctgctggtgtgccccatggagggctggatcccccccctgagccgcttccccatcgacatcttcttcacccccaagcaggagggagatgtgaacttcaacctgatctgcaatgtggagaagaaggtgcaccctgtgaccctgaatgtgaaggccgagggctacaccatgaatgtggagatcaagtgcaaggacagaacaggcagcatcaccctgctgacccccaaccagaccaacatcatcaacttctatgaggtggagctgaatgaatgtgtgcagtgtgagttcaacttcatcaacacaggcaagttcaccttctccttccaggcccagctgtgtggcagcaagaccctgctgcagtacctggagttcagccccatcgacagcacagtggatgtgggccagagcgtgcacgccaccctgtccttccagcccctgaagaagtgtgtgctgacagacctggagctgatcatcaagatcagccacggccccaccttcatgtgcaacatcagcggctgtgctgtgtccccagccatccacttctccttcaccagctacaactttggcacctgcttcatctaccaggccggcatgccaccctacaagcagaccctggtgatcaccaacaaggaggagacccccatgagcattgactgcctgtacaccaacaccacccacctggaggtgaacagccgggtggatgtggtgaagccaggcaacaccctggagatccccatcaccttctacccccgggagagcatcaactaccaggagctgatcccctttgagatcaatggcctgagccagcagacagtggagatcaagggcaagggcaccaagatgaagatcctggtgctggaccctgccaaccgcatcgtgaagctgggcgctgtgctgcccggccaggtggtgaagaggacagtgtccatcatgaacaacagcctggcccagctgaccttcaaccagagcatcctcttcaccatccctgagctgcaggagcccaaggtgctgaccctggcccccttccacaacatcaccctgaagcccaaggaggtgtgcaagctggaggtgatctttgcccccaagaagagggtgccccccttcagcgaggaggtgttcatggagtgcatgggcctgctgcggcccctcttcctgctgagcggctgctgccaggccctggagatcagcctggaccaggagcacatccccttcggccctgtggtgtaccagacccaggccacccggcgcatcctgatgatgaacacaggagatgtgggcgcccgcttcaagtgggacatcaagaagtttgagccccacttcagcatcagccctgaggagggctacatcaccagcggcatggaggtgtcctttgaggtgacctaccaccccacagaggtgggcaaggagagcctgtgcaagaacatcctgtgctacatccagggcggcagccccctgagcctgaccctgagcggcgtgtgtgtgggccccccagctgtgaaggaggtggtgaacttcacctgccaggtgcgcagcaagcacacccagaccatcctgctgagcaacagaaccaaccagacctggaacctgcaccccatctttgaaggagagcactgggagggccctgagttcatcaccctggaggcccaccagcagaacaagccctatgagatcacctaccggcccaggaccatgaacctggagaacaggaagcaccagggcaccctcttcttccccctgcctgatggcaccggctggctgtatgccctgcacggcaccagcgagctgcccaaggctgtggccaacatctaccgggaggtgccctgcaagaccccctacacagagctgctgcccatcaccaactggctgaacaagccccagcgcttccgggtgattgtggagatcctgaagccagagaagccagacctgagcatcaccatgaagggcctggactacattgatgtgctgagcggcagcaagaaggactacaagctgaacttcttcagccacaaggagggcacctatgctgccaaggtgatcttcagaaatgaggtgaccaatgagttcctgtactacaacgtgtccttccgggtcatccccagcggcatcatcaagaccatcgagatggtgacccctgtgcggcaggtggccagcgccagcatcaagctggagaaccccctgccctacagcgtgaccttcagcacagaatgtaggatgccagacatcgccctgcccagccagtttgtggtgcctgccaacagcgagggcaccttctcctttgagttccagcccctgaaggccggggagaccttcggccgcctgaccctgcacaacacagacctgggctactaccagtatgagctgtacctgaaggccaccccagccctgcctgagaagcctgtgcacttccagacagtgctgggcagcagccagatcatcctggtgaagttcatcaactacacccggcagaggacagagtactactgcaggacagactgcacagacttccacgccgagaagctgatcaatgctgcccctgggggccagggcggcacagaggcctctgtggaggtgctgtttgagcccagccacctgggggagaccaagggcatcctgatcctgagcagcctggccggcggggagtacatcatccccctgtttggcatggccctgccccccaagccccagggccccttcagcatccgggccggctacagcatcatcatccccttcaagaatgtgttctaccacatggtgaccttcagcatcatcgtggacaacccagccttcaccatccgggccggggagagcgtgcggcccaagaagatcaacaacatcaccgtgtcctttgagggcaaccccagcggcagcaagacccccatcaccaccaagctgactgtgtcctgccccccaggagagggcagcgagaccggggtgaagtgggtgtactacctgaagggcatcaccctgtag

SEQ ID NO: 155687 - DNA, 2853 bp, Artificial Sequence
  Description of Artificial Sequence: Synthetic coding sequence
atggagagcgctgggggcttcaagctgggcatggagcccctgagcggcggcggcgtgtgtgagaagaagaagctgctgaagatgaccagccggcggctggaggagagcatgggcgctgtgcagatgggcctggtgaacatgttcaagggcttccagagcaaggtgctgccccccctgagccccaaggtggtgacagaggaggaggtgaacaggatgctgacccccagcgagttcctgaaggagatgagcctgaccacagagcagaggctggccaagacccggctgatgtgccggccccagatcatcgagctgctggacatgggagagaccacccaccagaagttcagcggcatcgacctggaccaggccctcttccagcccttccccagcgagatcatcttccagaactacaccccctgtgaggtgtatgaggtgcccctcatcctgaggaacaatgacaagatcccccggctggtgaaggtggtggaggagagcagcccctacttcaaggtgatcagccccaaggacatcggccacaaggtggcccctggggtgcccagcatcttccgcatcctcttcaccccagaggagaacaaggactatgcccacaccctgacctgtgtgacagagcgggagaagttcatcgtgcccatcaaggcccggggggcccgggccatcctggacttcccagacaagctgaacttcagcacctgccctgtgaagtacagcacccagaagatcctgctggtgagaaatattggcaacaagaatgctgtgttccacatcaagacctgccggcccttcagcattgagcccgccatcggcaccctgaatgtgggggagagcatgcagctggaggtggagtttgagccccagagcgtgggggaccacagcggccgcctcatcgtgtgctatgacacaggagagaaggtgtttgtgtccctgtatggagctgccatcgacatgaacatccggctggacaagaacagcctgaccatcgagaagacctacatcagcctggccaaccagaggaccatcaccatccacaacagaagcaacatcatcgcccacttcctgtggaaggtgtttgccacccagcaggaggaggaccgggagaagtaccgggcctgtgatgacctgatcaaggaggagaaggatgaaacagatgagttctttgaggagtgcatcacagaccccctgctgcgggagcacctgtctgtgctgagcaggacctttgccaaccagaggcggctggtgcagggcgacagcaagctgttcttcaacaacgtgttcaccgtggagcccctggagggagatgtgtggcccaacagcagcgctgagatcaccgtgtacttcaaccccctggaggccaagctgtaccagcagaccatctactgtgacatcctgggccgggagatccggctgcccctgcgcatcaagggggagggcatgggccccaagatccacttcaactttgagctgctggacatcggcaaggtgttcaccggcagcgcccactgctatgaggccatcctgtacaacaagggcagcattgatgccctcttcaacatgaccccacccaccagcgccctgggcgcctgctttgtgttcagccccaaggagggcatcatcgagcccagcggcgtgcaggccatccagatctccttcagcagcaccatcctgggcaactttgaggaggagttcctggtgaatgtgaatggcagccctgagcctgtgaagctgaccatccggggctgcgtcatcggccccaccttccacttcaacgtgcctgccctgcactttggagatgtgtcctttggcttcccccacaccctcatctgcagcctgaacaacaccagcctcatccccatgacctacaagctgcgcatccctggagatggcctgggccacaagagcatctcctactgtgagcagcacgtggactacaagaggcccagctggaccaaggaggagatcagctccatgaagcccaaggagttcaccatcagcccagactgtggcaccatccggccccagggctttgctgccatccgggtgaccctgtgcagcaacacagtgcagaagtatgagctggccctggtggtggatgtggagggcattggagaggaggtgctggccctgctgatcacagcccgctgtgtggtgcctgccctgcacctggtgaacacagaggtggactttggccactgcttcctgaagtacccctatgagaagaccctgcagctggccaaccaggatgacctgcccggcttctatgaggtgcagccccaggtgtgtgaggaggtgcccaccgtgctcttcagcagccccacccccagcggggtcatcagccccagcagcaccatccacatccccctggtgctggagacccaggtgactggagagcacaggagcacagtgtacatcagcatcttcggcagccaggacccccccctggtgtgccacctgaagtctgctggggagggccctgtgatctacgtgcaccccaaccaggtggactttggaaacatctacgtgctgaaggacagcagccgcatcctgaacctgtgcaaccagagcttcatcccagccttcttccaggcccacatggcccacaagaagagcctgtggaccatcgagcccaatgaaggcatggtgcccccagagacagatgtgcagctggccctgacagccaacctgaatgacaccctgaccttcaaggactgtgtgatcctggacatcgagaacagcagcacctaccgcatccctgtgcaggccagcggcaccggcagcaccatcgtgtctgacaagccctttgcccctgagctgaacctgggcgcccacttcagatag

SEQ ID NO: 155688 - DNA, 2823 bp, Artificial Sequence
  Description of Artificial Sequence: Synthetic coding sequence
atggagagcgctgggggcttcaagctgggggagaagaagaagctgctgaagatgaccagccggcggctggaggagagcatgggcgctgtgcagatgggcctggtgaacatgttcaagggcttccagagcaaggtgctgccccccctgagccccaaggtggtgacagaggaggaggtgaacaggatgctgacccccagcgagttcctgaaggagatgagcctgaccacagagcagaggctggccaagacccggctgatgtgccggccccagatcatcgagctgctggacatgggagagaccacccaccagaagttcagcggcatcgacctggaccaggccctcttccagcccttccccagcgagatcatcttccagaactacaccccctgtgaggtgtatgaggtgcccctcatcctgaggaacaatgacaagatcccccggctggtgaaggtggtggaggagagcagcccctacttcaaggtgatcagccccaaggacatcggccacaaggtggcccctggggtgcccagcatcttccgcatcctcttcaccccagaggagaacaaggactatgcccacaccctgacctgtgtgacagagcgggagaagttcatcgtgcccatcaaggcccggggggcccgggccatcctggacttcccagacaagctgaacttcagcacctgccctgtgaagtacagcacccagaagatcctgctggtgagaaatattggcaacaagaatgctgtgttccacatcaagacctgccggcccttcagcattgagcccgccatcggcaccctgaatgtgggggagagcatgcagctggaggtggagtttgagccccagagcgtgggggaccacagcggccgcctcatcgtgtgctatgacacaggagagaaggtgtttgtgtccctgtatggagctgccatcgacatgaacatccggctggacaagaacagcctgaccatcgagaagacctacatcagcctggccaaccagaggaccatcaccatccacaacagaagcaacatcatcgcccacttcctgtggaaggtgtttgccacccagcaggaggaggaccgggagaagtaccgggcctgtgatgacctgatcaaggaggagaaggatgaaacagatgagttctttgaggagtgcatcacagaccccctgctgcgggagcacctgtctgtgctgagcaggacctttgccaaccagaggcggctggtgcagggcgacagcaagctgttcttcaacaacgtgttcaccgtggagcccctggagggagatgtgtggcccaacagcagcgctgagatcaccgtgtacttcaaccccctggaggccaagctgtaccagcagaccatctactgtgacatcctgggccgggagatccggctgcccctgcgcatcaagggggagggcatgggccccaagatccacttcaactttgagctgctggacatcggcaaggtgttcaccggcagcgcccactgctatgaggccatcctgtacaacaagggcagcattgatgccctcttcaacatgaccccacccaccagcgccctgggcgcctgctttgtgttcagccccaaggagggcatcatcgagcccagcggcgtgcaggccatccagatctccttcagcagcaccatcctgggcaactttgaggaggagttcctggtgaatgtgaatggcagccctgagcctgtgaagctgaccatccggggctgcgtcatcggccccaccttccacttcaacgtgcctgccctgcactttggagatgtgtcctttggcttcccccacaccctcatctgcagcctgaacaacaccagcctcatccccatgacctacaagctgcgcatccctggagatggcctgggccacaagagcatctcctactgtgagcagcacgtggactacaagaggcccagctggaccaaggaggagatcagctccatgaagcccaaggagttcaccatcagcccagactgtggcaccatccggccccagggctttgctgccatccgggtgaccctgtgcagcaacacagtgcagaagtatgagctggccctggtggtggatgtggagggcattggagaggaggtgctggccctgctgatcacagcccgctgtgtggtgcctgccctgcacctggtgaacacagaggtggactttggccactgcttcctgaagtacccctatgagaagaccctgcagctggccaaccaggatgacctgcccggcttctatgaggtgcagccccaggtgtgtgaggaggtgcccaccgtgctcttcagcagccccacccccagcggggtcatcagccccagcagcaccatccacatccccctggtgctggagacccaggtgactggagagcacaggagcacagtgtacatcagcatcttcggcagccaggacccccccctggtgtgccacctgaagtctgctggggagggccctgtgatctacgtgcaccccaaccaggtggactttggaaacatctacgtgctgaaggacagcagccgcatcctgaacctgtgcaaccagagcttcatcccagccttcttccaggcccacatggcccacaagaagagcctgtggaccatcgagcccaatgaaggcatggtgcccccagagacagatgtgcagctggccctgacagccaacctgaatgacaccctgaccttcaaggactgtgtgatcctggacatcgagaacagcagcacctaccgcatccctgtgcaggccagcggcaccggcagcaccatcgtgtctgacaagccctttgcccctgagctgaacctgggcgcccacttcagatag

SEQ ID NO: 155689 - DNA, 15363 bp, Artificial Sequence
  Description of Artificial Sequence: Synthetic coding sequence
atgaccagccggcggctggaggagagcatgggcgctgtgcagatgggcctggtgaacatgttcaagggcttccagagcaaggtgctgccccccctgagccccaaggtggtgacagaggaggaggtgaacaggatgctgaccccatctgagttcctgaaggagatgagcctgaccacagagcagaggctggccaagacccggctgatgtgccggccccagatcatcgagctgctggacatgggagagaccacccaccagaagttctctggaattgacctggaccaggccctcttccagcccttccccagcgagatcatcttccagaactacaccccctgtgaggtgtatgaggtgcccctcatcctgagaaataatgacaagatcccccggctggtgaaggtggtggaggagagcagcccctacttcaaggtgatcagccccaaggacatcggccacaaggtggcccctggggtgcccagcatcttccgcatcctcttcaccccagaggagaacaaggactatgcccacaccctgacctgtgtgacagagcgggagaagttcatcgtgcccatcaaggcccggggggcccgggccatcctggacttcccagacaagctgaacttcagcacctgccctgtgaagtacagcacccagaagatcctgctggtgaggaacatcggcaacaagaatgctgtgttccacatcaagacctgccggcccttcagcattgaaccagccatcggcaccctgaatgtgggggagagcatgcagctggaggtggagtttgagccccagagcgtgggggaccacagcggccgcctgattgtgtgctatgacaccggggagaaggtgtttgtgtccctgtatggagctgccatcgacatgaacatccggctggacaagaacagcctgaccatcgagaagacctacatcagcctggccaaccagaggaccatcaccatccacaacagaagcaacatcatcgcccacttcctgtggaaggtgtttgccacccagcaggaggaggaccgggagaagtaccgggcctgtgatgacctgatcaaggaggagaaggatgaaacagatgagttctttgaggagtgcatcacagaccccctgctgcgggagcacctgtctgtgctgagcaggacctttgccaaccagaggcggctggtgcagggcgacagcaagctgttcttcaacaacgtgttcaccgtggagcccctggagggagatgtgtggcccaacagcagcgctgagatcaccgtgtacttcaaccccctggaggccaagctgtaccagcagaccatctactgtgacatcctgggccgggagatccggctgcccctgcgcatcaagggggagggcatgggccccaagatccacttcaactttgagctgctggacatcggcaaggtgttcaccggcagcgcccactgctatgaggccatcctgtacaacaagggcagcattgatgccctcttcaacatgaccccacccaccagcgccctgggcgcctgctttgtgttcagccccaaggagggcatcatcgagcccagcggcgtgcaggccatccagatctccttcagcagcaccatcctgggcaactttgaggaggagttcctggtgaatgtgaatggcagccctgagcctgtgaagctgaccatccggggctgtgtgattggccccaccttccacttcaacgtgcctgccctgcactttggagatgtgtcctttggcttcccccacaccctcatctgcagcctgaacaacaccagcctcatccccatgacctacaagctgcgcatccctggagatggcctgggccacaagagcatctcctactgtgagcagcacgtggactacaagaggcccagctggaccaaggaggagatcagctccatgaagcccaaggagttcaccatcagcccagactgtggcaccatccggccccagggctttgctgccatccgggtgaccctgtgcagcaacacagtgcagaagtatgagctggccctggtggtggatgtggagggcatcggggaggaggtgctggccctgctgatcacagcccgctgtgtggtgcctgccctgcacctggtgaacacagaggtggactttggccactgcttcctgaagtacccctatgagaagaccctgcagctggccaaccaggatgacctgcccggcttctatgaggtgcagccccaggtgtgtgaggaggtgcccaccgtgctcttcagcagccccaccccatctggagtcatcagccccagcagcaccatccacatccccctggtgctggagacccaggtgactggagagcacaggagcacagtgtacatcagcatcttcggcagccaggacccccccctggtgtgccacctgaagtctgctggggagggccctgtgatctacgtgcaccccaaccaggtggactttggaaacatctacgtgctgaaggacagcagccgcatcctgaacctgtgcaaccagagcttcatcccagccttcttccaggcccacatggcccacaagaagagcctgtggaccatcgagcccaatgaaggcatggtgcccccagagacagatgtgcagctggccctgacagccaacctgaatgacaccctgaccttcaaggactgtgtgatcctggacatcgagaacagcagcacctaccgcatccctgtgcaggccagcggcaccggcagcaccatcgtgtctgacaagccctttgcccctgagctgaacctgggcgcccacttcagcctggacacccactactaccacttcaagctgatcaacaagggccgccgcatccagcagctgttctggatgaatgacagcttccggccccaggccaagctgagcaagaagggccgggtgaagaagggccacgcccacgtgcagccccagcccagcggcagccaggagccccgggacccccagagccctgtgttccacctgcacccagcctccatggagctgtacccaggccaggccattgatgtgatcctggagggctacagcgccaccccaagaattgtgaaggagaagctggtgtgccacgccatcatcggggcccagaagggcaagagcctggtgatggctgtgaacatcacctgtgaatttgtggcccccctcatccagctgagcaccaagcagctgatctaccgcctggagaagaagcccaacagcatcctgaagccagactaccagcccctggccatcaagaacatcagcaccctgcctgtgaacctgctgctgagcaccagcggccccttcttcatctgtgaaacagacaagagcctgctgcctgccaccccagagcccatcaagctggagattgatgaggagaagaacctgctgatcaagtttgaccccagctacagaaatgacctgaacaactgggtggccgaggagatcctggccatcaagtatgtggagcacccccagattgacagcctggacctgcggggggaggtgcactaccccaacctgagctttgagaccaaggagctggactttggctgcatcctgaatgacacagagctgatccgctacgtgaccatcaccaactgcagccccctggtggtgaagttccgctggttcttcctggtgaatgatgaggagaaccagatccgctttgtgaccctgcccaagaagccctacagcgcccctgtgtcccagatggagagcatcccagccaccagcgaggccgccagccccccagccatcctggtgacagtggagagccctgagatggacctgaatgactttgtgaagacagtgctggtggatgaagatgcccggcctgaggagaaggagctgaggaagaccaaggccagcagcgtcatcagtgatgtgcgctgccccttccacggggaggagcgcatctacagcagccagagccaggtggaggaccaggagagcctgcagacctgtgagcagaatgagatgctgagcattggaattgaggaggtgtttgacatcctgcccctgtttggagtgctgcagccccacagcagccaccagatctccttcaccttctacggccacgccaacatcatcgcccaggccaaggccctgtgtgaggtggaggagggccccacctatgagatcaccctgaagggggaggccagcctggtgaactacagctttgacaccaaggacatccactacggcctgcagctgtttgaccacgtgacagagcgggagatcaccctgaccaacatgggcaaggtgggctttgagttcaaggtgctgacagaccaccagagcagcccagacaacctgctgcccggggtgcccctcatcctgcctgtgtctggcttcatcagcagccaccaggagcaggtgctgaaggtgtactacctgcccggggtgcctgaggtgttcaagaggagcttccagatccagatcgcccacctggaccctgagaacatcaccctgtctggagagggcatcttcccccagatctgcctggacctgcccaggaacctgacagccaatgagaagtatgagatgttcctgaaccaggccaggaagaacacagacaaggagtacaacaagtgtgagatgctggaccactttgacatcatcacagaggaggtgcctgaagatgagcctgctgaggtgtctgcccacctgcagatggaggtggagcggctcatcgtgcagagctatgtgctggagcaccagaagaccaccaccccagaccccatggatgacccctgcttcagccacaggagcaggaggaagctggccaagatccagctgcctgagtacatcctggactttggctacatcatcctgggggaggtgaggacccacatcatcaagatcatcaacaccagccacttccctgtgtccttccacgccgacaagagggtgctgcatgaaacaggcttcagcacagagctggacagagtgaagaacctgccccactgtgaaacagagatctttgaggtgcgctttgacccccagggcgccaacctgcctgtgggcagcaaggaggtgatcctgcccatcaaggtggtgggcggccccaccgtgcacatctgcctgcaggccaaggtgaccatccccaccatgaccctgagccggggcaaggtggactttgccaccatccagtgtggccagtgcctggtggagaccatccagctgagcaaccacctgcaggtgccctgtgagtggtttgtgcagagccagaagcctgtggacaagctggagaagcacatgcccaagtacctgcggcagaagctgcgggcagagctgaagcccaagacccgcatctttgagatccagcccatcagcggcgtgctggaccctggagagaagagcaatgtgcaggtgaagttcatgcccaaggaggagaagttctacagccagaccctggtgttccagatcgcccagagcgcccagaagctgaccctgctggcccggggccagggcctggagccccggctggagttcagccccagcgtgctggacctgggccccctgctgctgtgtgcccctggagatgaggccgaggtgattgtgaagaacccctgcaacttccccatcgagttctacagcctggagtttgaccagcagtacctgattgaggagaagatcctgaggaagctgaagggctatgacagctacaacaccctgctgctgcccccaagaaatcctggagagaagctgcccccagagctgtatgagtacttcaaggagatcaagaagagcaaggaggagcagatgagggccaagtacctggagaacctggcccaggagaatgaggaggaggacatcaccagcagtgaccagggcaccagcaacagcaccaagaggaccagcctgagccggggcatctctgtgaccagcaacctggaggagtggcacgccctgctggtggagagcaagacctacctggaggaggaggaggatgaggagagcctggagaagatcatcttccagacagacaagctgcagagcattgacagccacagcatggaggaggtgggggaggtggagaacaaccctgtgtccaaggccatcgcccggcacctgggcatcgacatctctgctgagggccgcctggccaagaacaggaagggcatcgccatcatcatccacggcacccccctgagcggcaagagcgccaatgctgtgtctgtggccaagtactacaatgctgcctgcctgagcattgacagcatcgtgctggaggccgtggccaacagcaacaacatccctggcatccgggcccgggagctgtgcatccgggccgccatcgagcagagcgtgaaggagggggaggaggccgcccaggaggccgctgtgggccagaatgtgattggccagggccgcctgagcacagacaccctgggcaagctggccagcgagatgaccctggtggcccctgagatcaagccaggcaagtctgtgcggggctctgtggtgatcaccaagagcaaggctgacagccacggcagcggcagccagaagcagcaccacagccaccagagcgagaccccccagatcagcagcagccccctgcccccaggccccatccaccgctggctgtctgtgagccccagcgtgggcggggagaccggcctgatgagctgtgtgctgcctgatgagctgctggtgcagatcctggccgagcgcatccagctgagtgactgctacagaggagtggtgtttgatggcctggacaccctgtttgcccagaatgctgctgctgccctgctgtgcctgctgaaggccatcggcagccgggagcacatctacatcctgaacatggcccaggactatgctgccatgaaggcccaggagaaggccaagaaggagcaggaggagaggaagcacaagggggccctggagaaggagaaggagcggctgcagaacatggatgaggaggagtatgatgccctgacagaggaggagaagctgacctttgaccggggcatccagcaggccctgcgggagaggaagaagcgggagcaggagcggctggccaaggagatgcaggagaagaagctgcagcaggagctggagcggcagaaggaggaggatgagctgaagagaagagtgaagaagggcaagcagggccccatcaaggaggagccccccatgaagaagagccaggccgccaacaagcaggtgccccccctgaccaaggtggatgtgaagatggagaccattgaaaggaagatctctgtgcgggagcagaccatgtctgagaaggaggagctgaacaagaagaagaggaacatgggagatgtgtccatgcacggcctgcccctggtgcaggaccaggaggacagcgagggggacaacagcaaggaccctgacaagcagctggcccccaagttcaagacctatgagctgaccctgaaggatgtgcagaacatcctgatgtactgggacaggaagcagggcgtgcagctgcccccagctggcatggaggaggcccctcatgagccagatgaccagaggcaggtgcccctgggcggccggcggggcaggaaggaccgggagcgggagcggctggagaaggagaggacagagaaggagcggctggagcgggagaaggccgagcgggagcggctggagaagctgcgggccctggaggagaggagtgactgggagggggagggggaggaggaccacgagggcaagaaggagaaggacctgggcgtgcccttcctggacatccagaccccagactttgagggcctgtcctggaagcaggccctggagagtgacaagctgcccaagggggagcagatcctggacatcctgggcctgggcgccagcggcccccccatccccccaccagccctcttcagcatcgtgtcctaccctgtgaagaggcctcccctgaccatgacagatgacctggagcactttgtgtttgtgatccccccatctgaggacatcagcctggatgagaagaaggagatggagattgaaagtgacttcctggccaccaccaacaccaccaaggcccaggaggagcagaccagcagcagcaaaggaggcaagcagaagatgaaggagaagattgaccaggtgtttgagatccagaaggacaagaggcacatggccctgaacaggaaggtgctgagcggggagcccgccggcaccatcagccagctgagtgacacagacctggacaacttcaacggccagcacagccaggagaagttcacccggctgaaccacttccgctggatcgtgcctgccaacggggaggtgaccctgcaggtgcacttcagcagtgatgaatttggaaactttgaccagaccttcaactttgagatcctgggcacctgctgccagtaccagctgtactgccggggcatctgcacctacccctacatctgccaggaccccaaggtggtgttcccccagaggaagatggacatgaagaccaatgaagtcatcttcaagaagtatgtgatgagcacagagacctactacttcggccccctgctgtgtgggaagagccgggacaagtacaagagcagcctcttccctggcaacatggagaccctgaccatcctgaacaccagcctgatggtggtggaggccagcttctacttccagaatgatgtgaaggccaacacctacttcctggagcccaacaccatggtgctgaagcccaatgagaagcagatcctgaatgtgtgggcctaccccacctctgtgggcgtgtttgaggacagcatcgtgtgctgcatcaatgacaaccctgagcccgccatcttccagctgagctgccagggcatccggcctgagctggagctggagccccggcagctgcactttgaccggctgctgctgcaccggcaggagagccgggtggtgctgctgagaaatgtgaccctgctgcctgtggcctggaggatcaccagcctggagcacctgggagatgacttcaccgtgtccctgatgcagggcaccatccccccagaggccgagtatggcctgcacctgtacttccagcccaccaagcctgtgaacatcaagaaggccatccggctggaggtgctggatgctgagaacctgctgggcgtggtgcagatcgagaacatcatggtgtttgctgaggcctatgacatcgccctggacatcaccttccccaagggagctgagggcggcctggactttggcatcgtgcgggtgacagaggaggccaagcagcccctgcagctgaagaacagaggcaagtatgaaattgccttctccttctctgtggacagcgtgggcatcagcacccccaacatcaacagcatgatctctgtgcagcccaagaagggcagcctgacccccacagagaagcccaccaacgtgcaggtgttcttccacgccaagaaggaggtgaagattgagcaccagcctgtgctgcgctgccagatcatcgagcccaacatcagcgagggcggggagatcatcgccagcatccccatcaagttcagcgccaatgctgtgtacagcaagtacaacatcacccccagcagcgtcatcaactttggagccctgatctgtggcaccaggaagagcaccaccttcaccatcgagaaccagggcgtgacagacttcaagtttgccctgtacaagctgaccggggagagccccatccaccagaagaaggccgccagccacgtgagacatgcccggagccgggagagcgagagcttctacaagacaggcagcagcagagctgccaagttcagtgacaccatccagaaggaggtgaccaccaccggccaggccaggtttgcccacggcatgttcaccgtgtacccaggcttcggcagcatccccagcggcggccagcaggtgatcaacgtggactgtgtggctgatgccatgggcaaatgtgaggagttcatcgccatcgacatcagcggccgggaccctgctgtgcaccctgctggcatcctgtacaccctgctggccgaggcctgcctgcctgcctttgtgacagagaacaatgccctgatctttgaggagcaccagatctgcaccagcgccaacctgcaccacatcctgcagaccatcgagagcggcggcctgtttgtggaggatgagaacaagttcatcttctgcaatgtgctggtgggccggcaggccaaggcccgcttcaagatcagcaatgtgggcaagatcacctgtgatgtgaacatcgtggtgcggcccatcagcaacaagccctttgccagaattgtggacatctttgaggtggagcccagcaagatgtgcatcgccagccacagccacgcctttgccaccgtgtccttcaccccccagatcatgcagaactaccagtgcatctttgaggccaccctggatggcctgcccagcaccctggccaagagccggggcctggtgtttgatattgctggggagggcaacctgccccgggtgacagtggtgcggcctgtgctgcacaaccagtatggcaaccccctgctgctcttcaagaggctgctgctgggccacagcgagaagctgcccctcatcctgaagaacaacggggtgctgcctgcccagctgcacgtggacctgcaggatgagctgggcgtcttcagcctgaagggccggcccaccacagcctacatctacatcacagaggagaacaagccccacgtgaaggccaagaaggcccacacagccagcctggtggtgtcccctggggacacagctgagtttgatgtggtgttccacagccagaaggtgggccgcatgaggggcatcatccacctgagcgtcatcaacaaccagtatgaggagaccagcatccacatggtgggggagggctatgaagatgacatcaccctggacaacatccacggcctggtggcccccaccagccaggaggacatcagcatcagcgagttcacagagatcattgaagataatgacatggaggacctggtggccgccgccctggtggaccacatccagtttggagactgccacatcggccacagctacaatgccagcttcaccgtgaccaaccacagccaggtgaacctgatccgctttgagtggcctgtgtctgccaccatcgccttcagcccccagatgggccacctgcaccctggctgtgccaaggacatcgtggtgaccatgaagagtgatgtgcccatcaacctgaagaacatgaggatccgctgcaagctgagccgcatcatgttccagctgcctgctgaccaggtgcctgactgggatgacaggatgcacacagtgaagtgggtggatgtgcccaggaacatgcctggcaccttcaccaccaagaggaaggtgattgaaacagatcctgagcccgcccacagcgtgctggaggagaactaccaggagctgcagctgcagatcagcgccaacgtggactttgccagctaccactgccaggccagagatgtgcgcttcaaggagaccctggtgtaccagaccagggtgtttgaatttgatgtgatcaacagcggccgggtgcagctggagttctcctgggtgtctgaggacaccagcaaggctgtgtcctttgccaagccagaccaccagggcagcgcccagaaggaccagctgagccagggcaccatgcacacaggcagcaccctggacagcaccatggaccactgggccgagggcagcccccagcccttctctgtggagcccagcagcggcatcgtgcctgtgggcaagatccagaagttcaaggtgaagttcagccccctggacattggagactttgagagcaacctcttctgccagatccccaacctgcccccaggagagcagggccctgtgctggtggccaagggccgcagcaccctgcccatctgccactttgacctgaaggacagcgactacatcagcggccaccagaggaaccctgagctgcggggcagcagcggcggggccctggaccccaacaccagggtgattgagttcaccaccgtgggcatcggcggcaagaacctgcggaccttcaccatcctgaaccccaccaacagcacctacagcttctgctggatcagcgaggagattgagagcctgcagaacccagctgccttcacctgcctgacagagaagggcttcatccaccctgagaagaaggccgagatcgtgttccagttcacccccttccacctgggcatcacagagagctcctggaccttcctgatccctgagcacaacatcaccgtgcccttcctgctggtgggcaagaccacagagcccctcatcagcctgaacaagagccacctgaacttcagcagcctgctgattggccgggaggcccgggagaccgtgcagatcatcaacaaggaggagcagggctttgacttctccttccaggacaacagccgctacagcgagggcttcagcaacagcctgctggtgtgccccatggagggctggatcccccccctgagccgcttccccatcgacatcttcttcacccccaagcaggagggagatgtgaacttcaacctgatctgcaatgtggagaagaaggtgcaccctgtgaccctgaatgtgaaggccgagggctacaccatgaatgtggagatcaagtgcaaggacagaacaggcagcatcaccctgctgacccccaaccagaccaacatcatcaacttctatgaggtggagctgaatgaatgtgtgcagtgtgagttcaacttcatcaacacaggcaagttcaccttctccttccaggcccagctgtgtggcagcaagaccctgctgcagtacctggagttcagccccatcgacagcacagtggatgtgggccagagcgtgcacgccaccctgtccttccagcccctgaagaagtgtgtgctgacagacctggagctgatcatcaagatcagccacggccccaccttcatgtgcaacatcagcggctgtgctgtgtccccagccatccacttctccttcaccagctacaactttggcacctgcttcatctaccaggccggcatgccaccctacaagcagaccctggtgatcaccaacaaggaggagacccccatgagcattgactgcctgtacaccaacaccacccacctggaggtgaacagccgggtggatgtggtgaagccaggcaacaccctggagatccccatcaccttctacccccgggagagcatcaactaccaggagctgatcccctttgagatcaatggcctgagccagcagacagtggagatcaagggcaagggcaccaagatgaagatcctggtgctggaccctgccaacagaattgtgaagctgggcgctgtgctgcccggccaggtggtgaagaggacagtgtccatcatgaacaacagcctggcccagctgaccttcaaccagagcatcctcttcaccatccctgagctgcaggagcccaaggtgctgaccctggcccccttccacaacatcaccctgaagcccaaggaggtgtgcaagctggaggtgatctttgcccccaagaagagggtgccccccttcagcgaggaggtgttcatggagtgcatgggcctgctgcggcccctcttcctgctgagcggctgctgccaggccctggagatcagcctggaccaggagcacatcccctttggacctgtggtgtaccagacccaggccacccggcgcatcctgatgatgaacacaggagatgtgggcgcccgcttcaagtgggacatcaagaagtttgagccccacttcagcatcagccctgaggagggctacatcaccagcggcatggaggtgtcctttgaggtgacctaccaccccacagaggtgggcaaggagagcctgtgcaagaacatcctgtgctacatccagggcggcagccccctgagcctgaccctgtctggagtgtgtgtgggccccccagctgtgaaggaggtggtgaacttcacctgccaggtgcgcagcaagcacacccagaccatcctgctgagcaacagaaccaaccagacctggaacctgcaccccatctttgaaggagagcactgggagggccctgagttcatcaccctggaggcccaccagcagaacaagccctatgagatcacctaccggcccaggaccatgaacctggagaacaggaagcaccagggcaccctcttcttccccctgcctgatggcaccggctggctgtatgccctgcacggcaccagcgagctgcccaaggctgtggccaacatctaccgggaggtgccctgcaagaccccctacacagagctgctgcccatcaccaactggctgaacaagccccagcgcttccgggtcatcgtggagatcctgaagccagagaagccagacctgagcatcaccatgaagggcctggactacattgatgtgctgagcggcagcaagaaggactacaagctgaacttcttcagccacaaggagggcacctacgccgccaaggtgatcttcagaaatgaggtgaccaatgagttcctgtactacaacgtgtccttccgggtcatccccagcggcatcatcaagaccatcgagatggtgacccctgtgcggcaggtggccagcgccagcatcaagctggagaaccccctgccctacagcgtgaccttcagcacagagtgcaggatgccagacatcgccctgcccagccagtttgtggtgcctgccaacagcgagggcaccttctcctttgagttccagcccctgaaggccggggagaccttcggccgcctgaccctgcacaacacagacctgggctactaccagtatgagctgtacctgaaggccaccccagccctgcctgagaagcctgtgcacttccagacagtgctgggcagcagccagatcatcctggtgaagttcatcaactacacccggcagaggacagagtactactgcaggacagactgcacagacttccacgccgagaagctgatcaatgctgcccctgggggccagggcggcacagaggcctctgtggaggtgctgtttgagcccagccacctgggggagaccaagggcatcctgatcctgagcagcctggccggcggggagtacatcatccccctgtttggcatggccctgccccccaagccccagggccccttcagcatccgggccggctacagcatcatcatccccttcaagaatgtgttctaccacatggtgaccttcagcatcatcgtggacaacccagccttcaccatccgggccggggagagcgtgcggcccaagaagatcaacaacatcaccgtgtcctttgagggcaaccccagcggcagcaagacccccatcaccaccaagctgactgtgtcctgccccccaggagagggcagcgagactggagtgaagtgggtgtactacctgaagggcatcaccctgtag

SEQ ID NO: 155690 - DNA, 3054 bp, Artificial Sequence
  Description of Artificial Sequence: Synthetic coding sequence
atgaccagccggcggctggaggagagcatgggcgctgtgcagatgggcctggtgaacatgttcaagggcttccagagcaaggtgctgccccccctgagccccaaggtggtgacagaggaggaggtgaacaggatgctgaccccatctgagttcctgaaggagatgagcctgaccacagagcagaggctggccaagacccggctgatgtgccggccccagatcatcgagctgctggacatgggagagaccacccaccagaagttctctggaattgacctggaccaggccctcttccagcccttccccagcgagatcatcttccagaactacaccccctgtgaggtgtatgaggtgcccctcatcctgagaaataatgacaagatcccccggctggtgaaggtggtggaggagagcagcccctacttcaaggtgatcagccccaaggacatcggccacaaggtggcccctggggtgcccagcatcttccgcatcctcttcaccccagaggagaacaaggactatgcccacaccctgacctgtgtgacagagcgggagaagttcatcgtgcccatcaaggcccggggggcccgggccatcctggacttcccagacaagctgaacttcagcacctgccctgtgaagtacagcacccagaagatcctgctggtgaggaacatcggcaacaagaatgctgtgttccacatcaagacctgccggcccttcagcattgaaccagccatcggcaccctgaatgtgggggagagcatgcagctggaggtggagtttgagccccagagcgtgggggaccacagcggccgcctgattgtgtgctatgacaccggggagaaggtgtttgtgtccctgtatggagctgccatcgacatgaacatccggctggacaagaacagcctgaccatcgagaagacctacatcagcctggccaaccagaggaccatcaccatccacaacagaagcaacatcatcgcccacttcctgtggaaggtgtttgccacccagcaggaggaggaccgggagaagtaccgggcctgtgatgacctgatcaaggaggagaaggatgaaacagatgagttctttgaggagtgcatcacagaccccctgctgcgggagcacctgtctgtgctgagcaggacctttgccaaccagaggcggctggtgcagggcgacagcaagctgttcttcaacaacgtgttcaccgtggagcccctggagggagatgtgtggcccaacagcagcgctgagatcaccgtgtacttcaaccccctggaggccaagctgtaccagcagaccatctactgtgacatcctgggccgggagatccggctgcccctgcgcatcaagggggagggcatgggccccaagatccacttcaactttgagctgctggacatcggcaaggtgttcaccggcagcgcccactgctatgaggccatcctgtacaacaagggcagcattgatgccctcttcaacatgaccccacccaccagcgccctgggcgcctgctttgtgttcagccccaaggagggcatcatcgagcccagcggcgtgcaggccatccagatctccttcagcagcaccatcctgggcaactttgaggaggagttcctggtgaatgtgaatggcagccctgagcctgtgaagctgaccatccggggctgtgtgattggccccaccttccacttcaacgtgcctgccctgcactttggagatgtgtcctttggcttcccccacaccctcatctgcagcctgaacaacaccagcctcatccccatgacctacaagctgcgcatccctggagatggcctgggccacaagagcatctcctactgtgagcagcacgtggactacaagaggcccagctggaccaaggaggagatcagctccatgaagcccaaggagttcaccatcagcccagactgtggcaccatccggccccagggctttgctgccatccgggtgaccctgtgcagcaacacagtgcagaagtatgagctggccctggtggtggatgtggagggcatcggggaggaggtgctggccctgctgatcacagcccgctgtgtggtgcctgccctgcacctggtgaacacagaggtggactttggccactgcttcctgaagtacccctatgagaagaccctgcagctggccaaccaggatgacctgcccggcttctatgaggtgcagccccaggtgtgtgaggaggtgcccaccgtgctcttcagcagccccaccccatctggagtcatcagccccagcagcaccatccacatccccctggtgctggagacccaggtgactggagagcacaggagcacagtgtacatcagcatcttcggcagccaggacccccccctggtgtgccacctgaagtctgctggggagggccctgtgatctacgtgcaccccaaccaggtggactttggaaacatctacgtgctgaaggacagcagccgcatcctgaacctgtgcaaccagagcttcatcccagccttcttccaggcccacatggcccacaagaagagcctgtggaccatcgagcccaatgaaggcatggtgcccccagagacagatgtgcagctggccctgacagccaacctgaatgacaccctgaccttcaaggactgtgtgatcctggacatcgagaacagcagcacctaccgcatccctgtgcaggccagcggcaccggcagcaccatcgtgtctgacaagccctttgcccctgagctgaacctgggcgcccacttcagcctggacacccactactaccacttcaagctgatcaacaagggccgccgcatccagcagctgttctggatgaatgacagcttccggccccaggccaagctgagcaagaagggccgggtgaagaagggccacgcccacgtgcagccccagcccagcggcagccaggagccccgggacccccagagccctgtgttccacctgcacccagcctccatggagctgtacccaggccaggccattgatgtgatcctggagggctacagcgccaccccccgggtgcggggctag

SEQ ID NO: 155691 - DNA, 2223 bp, Artificial Sequence
  Description of Artificial Sequence: Synthetic coding sequence
atgaccagccggcggctggaggagagcatgggcgctgtgcagatgggcctggtgaacatgttcaagggcttccagagcaaggtgctgccccccctgagccccaaggtggtgacagaggaggaggtgaacaggatgctgaccccatctgagttcctgaaggagatgagcctgaccacagagcagaggctggccaagacccggctgatgtgccggccccagatcatcgagctgctggacatgggagagaccacccaccagaagttctctggaattgacctggaccaggccctcttccagcccttccccagcgagatcatcttccagaactacaccccctgtgaggtgtatgaggtgcccctcatcctgagaaataatgacaagatcccccggctggtgaaggtggtggaggagagcagcccctacttcaaggtgatcagccccaaggacatcggccacaaggtggcccctggggtgcccagcatcttccgcatcctcttcaccccagaggagaacaaggactatgcccacaccctgacctgtgtgacagagcgggagaagttcatcgtgcccatcaaggcccggggggcccgggccatcctggacttcccagacaagctgaacttcagcacctgccctgtgaagtacagcacccagaagatcctgctggtgaggaacatcggcaacaagaatgctgtgttccacatcaagacctgccggcccttcagcattgaaccagccatcggcaccctgaatgtgggggagagcatgcagctggaggtggagtttgagccccagagcgtgggggaccacagcggccgcctgattgtgtgctatgacaccggggagaaggtgtttgtgtccctgtatggagctgccatcgacatgaacatccggctggacaagaacagcctgaccatcgagaagacctacatcagcctggccaaccagaggaccatcaccatccacaacagaagcaacatcatcgcccacttcctgtggaaggtgtttgccacccagcaggaggaggaccgggagaagtaccgggcctgtgatgacctgatcaaggaggagaaggatgaaacagatgagttctttgaggagtgcatcacagaccccctgctgcgggagcacctgtctgtgctgagcaggacctttgccaaccagaggcggctggtgcagggcgacagcaagctgttcttcaacaacgtgttcaccgtggagcccctggagggagatgtgtggcccaacagcagcgctgagatcaccgtgtacttcaaccccctggaggccaagctgtaccagcagaccatctactgtgacatcctgggccgggagatccggctgcccctgcgcatcaagggggagggcatgggccccaagatccacttcaactttgagctgctggacatcggcaaggtgttcaccggcagcgcccactgctatgaggccatcctgtacaacaagggcagcattgatgccctcttcaacatgaccccacccaccagcgccctgggcgcctgctttgtgttcagccccaaggagggcatcatcgagcccagcggcgtgcaggccatccagatctccttcagcagcaccatcctgggcaactttgaggaggagttcctggtgaatgtgaatggcagccctgagcctgtgaagctgaccatccggggctgtgtgattggccccaccttccacttcaacgtgcctgccctgcactttggagatgtgtcctttgccacccaggagctgcgggacccccaggtgctgatccccttccagcgcttcccccacaccctcatctgcagcctgaacaacaccagcctcatccccatgacctacaagctgcgcatccctggagatggcctgggccacaagagcatctcctactgtgagcagcacgtggactacaagaggcccagctggaccaaggaggagatcagctccatgaagcccaaggagttcaccatcagcccagactgtggcaccatccggccccagggctttgctgccatccgggtgaccctgtgcagcaacacagtgcagaagtatgagctggccctggtggtggatgtggagggcattggagaggaggtgctggccctgctgatcacagccagcgcccctgagctgtgcaacaggaaggtgatgctgtctgtgctgcagtggaagatccaccgggccaagaggagcctgccccgggacacagtggccgtgacctag

SEQ ID NO: 155692 - DNA, 3645 bp, Artificial Sequence
  Description of Artificial Sequence: Synthetic coding sequence
atgaccagccggcggctggaggagagcatgggcgctgtgcagatgggcctggtgaacatgttcaagggcttccagagcaaggtgctgccccccctgagccccaaggtggtgacagaggaggaggtgaacaggatgctgaccccatctgagttcctgaaggagatgagcctgaccacagagcagaggctggccaagacccggctgatgtgccggccccagatcatcgagctgctggacatgggagagaccacccaccagaagttctctggaattgacctggaccaggccctcttccagcccttccccagcgagatcatcttccagaactacaccccctgtgaggtgtatgaggtgcccctcatcctgagaaataatgacaagatcccccggctggtgaaggtggtggaggagagcagcccctacttcaaggtgatcagccccaaggacatcggccacaaggtggcccctggggtgcccagcatcttccgcatcctcttcaccccagaggagaacaaggactatgcccacaccctgacctgtgtgacagagcgggagaagttcatcgtgcccatcaaggcccggggggcccgggccatcctggacttcccagacaagctgaacttcagcacctgccctgtgaagtacagcacccagaagatcctgctggtgaggaacatcggcaacaagaatgctgtgttccacatcaagacctgccggcccttcagcattgaaccagccatcggcaccctgaatgtgggggagagcatgcagctggaggtggagtttgagccccagagcgtgggggaccacagcggccgcctgattgtgtgctatgacaccggggagaaggtgtttgtgtccctgtatggagctgccatcgacatgaacatccggctggacaagaacagcctgaccatcgagaagacctacatcagcctggccaaccagaggaccatcaccatccacaacagaagcaacatcatcgcccacttcctgtggaaggtgtttgccacccagcaggaggaggaccgggagaagtaccgggcctgtgatgacctgatcaaggaggagaaggatgaaacagatgagttctttgaggagtgcatcacagaccccctgctgcgggagcacctgtctgtgctgagcaggacctttgccaaccagaggcggctggtgcagggcgacagcaagctgttcttcaacaacgtgttcaccgtggagcccctggagggagatgtgtggcccaacagcagcgctgagatcaccgtgtacttcaaccccctggaggccaagctgtaccagcagaccatctactgtgacatcctgggccgggagatccggctgcccctgcgcatcaagggggagggcatgggccccaagatccacttcaactttgagctgctggacatcggcaaggtgttcaccggcagcgcccactgctatgaggccatcctgtacaacaagggcagcattgatgccctcttcaacatgaccccacccaccagcgccctgggcgcctgctttgtgttcagccccaaggagggcatcatcgagcccagcggcgtgcaggccatccagatctccttcagcagcaccatcctgggcaactttgaggaggagttcctggtgaatgtgaatggcagccctgagcctgtgaagctgaccatccggggctgtgtgattggccccaccttccacttcaacgtgcctgccctgcactttggagatgtgtcctttggcttcccccacaccctcatctgcagcctgaacaacaccagcctcatccccatgacctacaagctgcgcatccctggagatggcctgggccacaagagcatctcctactgtgagcagcacgtggactacaagaggcccagctggaccaaggaggagatcagctccatgaagcccaaggagttcaccatcagcccagactgtggcaccatccggccccagggctttgctgccatccgggtgaccctgtgcagcaacacagtgcagaagtatgagctggccctggtggtggatgtggagggcatcggggaggaggtgctggccctgctgatcacagcccgctgtgtggtgcctgccctgcacctggtgaacacagaggtggactttggccactgcttcctgaagtacccctatgagaagaccctgcagctggccaaccaggatgacctgcccggcttctatgaggtgcagccccaggtgtgtgaggaggtgcccaccgtgctcttcagcagccccaccccatctggagtcatcagccccagcagcaccatccacatccccctggtgctggagacccaggtgactggagagcacaggagcacagtgtacatcagcatcttcggcagccaggacccccccctggtgtgccacctgaagtctgctggggagggccctgtgatctacgtgcaccccaaccaggtggactttggaaacatctacgtgctgaaggacagcagccgcatcctgaacctgtgcaaccagagcttcatcccagccttcttccaggcccacatggcccacaagaagagcctgtggaccatcgagcccaatgaaggcatggtgcccccagagacagatgtgcagctggccctgacagccaacctgaatgacaccctgaccttcaaggactgtgtgatcctggacatcgagaacagcagcacctaccgcatccctgtgcaggccagcggcaccggcagcaccatcgtgtctgacaagccctttgcccctgagctgaacctgggcgcccacttcagcctggacacccactactaccacttcaagctgatcaacaagggccgccgcatccagcagctgttctggatgaatgacagcttccggccccaggccaagctgagcaagaagggccgggtgaagaagggccacgcccacgtgcagccccagcccagcggcagccaggagccccgggacccccagagccctgtgttccacctgcacccagcctccatggagctgtacccaggccaggccattgatgtgatcctggagggctacagcgccacccccaggaagcccaacagcatcctgaagccagactaccagcccctggccatcaagaacatcagcaccctgcctgtgaacctgctgctgagcaccagcggccccttcttcatctgtgaaacagacaagagcctgctgcctgccaccccagagcccatcaagctggagattgatgaggagaagaacctgctgatcaagtttgaccccagctacagaaatgacctgaacaactgggtggccgaggagatcctggccatcaagtatgtggagcacccccagattgacagcctggacctgcggggggaggtgcactaccccaacctgagctttgagaccaaggagctggactttggctgcatcctgaatgacacagagctgatccgctacgtgaccatcaccaactgcagccccctggtggtgaagttccgctggttcttcctggtgaatgatgaggagaaccagatccgctttgtgaccctgcccaagaagccctacagcgcccctgtgtcccagatggagagcatcccagccaccagcgaggccgccagccccccagccatcctggtgacagtggagagccctgagatggacctgaatgactttgtgaagtag

SEQ ID NO: 155693 - DNA, 3054 bp, Artificial Sequence; identical to SEQ ID NO: 155690
  Description of Artificial Sequence: Synthetic coding sequence

SEQ ID NO: 155694 - DNA, 822 bp, Artificial Sequence
  Description of Artificial Sequence: Synthetic coding sequence
atggccacctgggatgagaaggctgtgacccggcgggccaaggtggccccagctgagaggatgagcaagttcctgcggcacttcaccgtggtgggagatgactaccacgcctggaacatcaactacaagaagtgggagaatgaggaggaggaggaggaggaggagcagcccccacccacccctgtgtctggagaggagggccgggccgccgccccagatgtggccccagcccctggccctgccccccgggcccccctggacttccggggcatgctgaggaagctgttcagcagccaccgcttccaggtgatcatcatctgcctggtggtgctggatgccctgctggtgctggccgagctgatcctggacctgaagatcatccagcctgacaagaacaactatgctgccatggtgttccactacatgagcatcaccatcctggtgttcttcatgatggagatcatcttcaagctgtttgtgttccggctggagttcttccaccacaagtttgagatcctggatgctgtggtggtggtggtgtccttcatcctggacatcgtgctgctcttccaggagcaccagtttgaggccctgggcctgctgatcctgctgcggctgtggagggtggcccgcatcatcaatggcatcatcatctctgtgaagaccaggtctgagcggcagctgctgcggctgaagcagatgaatgtgcagctggccgccaagatccagcacctggagttcagctgcagcgagaaggagcaggagattgaaaggctgaacaagctgctgcggcagcacggcctgctgggggaggtgaactag

SEQ ID NO: 155695 - DNA, 822 bp, Artificial Sequence; identical to SEQ ID NO: 155694
  Description of Artificial Sequence: Synthetic coding sequence

SEQ ID NO: 155696 - DNA, 237 bp, Artificial Sequence
  Description of Artificial Sequence: Synthetic coding sequence
atggccacctgggatgagaaggctgtgacccggcgggccaaggtggccccagctgagaggatgagcaagttcctgcggcacttcaccgtggtgggagatgactaccacgcctggaacatcaactacaagaagtgggagaatgaggaggaggaggaggaggaggagcagcccccacccacccctgtgtctggagaggagggccgggccgccgccccagatgtggccccagccccctag

SEQ ID NO: 155697 - DNA, 900 bp, Artificial Sequence
  Description of Artificial Sequence: Synthetic coding sequence
atggaggagctgctgcctgatggccagatctgggccaacatggaccctgaggagaggatgctggccgccgccacagccttcacccacatctgtgccggccagggcgagggagatgtgcggcgggaggcccagagcatccagtatgacccctacagcaaggcctctgtggcccctgggaagaggcctgccctgcctgtgcagctgcagtacccccacgtggagagcaatgtgcccagcgagaccgtgtctgaggccagccagaggctgaggaagcctgtgatgaagaggaaggtgctgcggaggaagccagatggagaggtgctggtgacagatgagagcatcatcagcgagagcgagagcggcacagaaaatgaccaggacctgtgggacctgcggcagaggctgatgaatgtgcagttccaggaggacaaggagagcagctttgatgtgtcccagaagttcaacctgccccatgagtaccagggcatcagccaggaccagctgatctgcagcctgcagcgggagggcatgggcagccctgcctatgagcaggacctgattgtggccagccggcccaagagcttcatcctgcccaagctggaccagctgagcaggaacagaggcaagacagacagagtggcccgctactttgagtacaagagggactgggacagcatccggctgcctggagaggaccacaggaaggagctgcgctggggcgtgcgggagcagatgctgtgcagagctgagccccagagcaagccccagcacatctacgtgcccaacaactacctggtgcccacagagaagaagaggtctgccctgcgctggggcgtgcgctgtgacctggccaatggagtcatccccaggaagctgcccttccccctgagccccagctag

SEQ ID NO: 155698 - DNA, 900 bp, Artificial Sequence; identical to SEQ ID NO: 155697
  Description of Artificial Sequence: Synthetic coding sequence

SEQ ID NO: 155699 - DNA, 900 bp, Artificial Sequence; identical to SEQ ID NO: 155697
  Description of Artificial Sequence: Synthetic coding sequence

SEQ ID NO: 155700 - DNA, 1113 bp, Artificial Sequence
  Description of Artificial Sequence: Synthetic coding sequence
atgctgcccaggctcatctgcatcaatgactatgagcagcacgccaagtctgtgctgcccaagagcatctatgactactacagaagtggggccaatgatgaggagaccctggccgacaacattgctgccttcagccgctggaagctgtaccccaggatgctgagaaatgtggccgagacagacctgagcacctctgtgctgggccagagggtgtccatgcccatctgtgtgggcgccacagccatgcagaggatggcccacgtggatggagagctggccaccgtgcgggcctgccagagcctgggcaccggcatgatgctgagctcctgggccaccagcagcattgaggaggtggccgaggccggccctgaggccctgcgctggctgcagctgtacatctacaaggaccgggaggtgaccaagaagctggtgcggcaggccgagaagatgggctacaaggccatctttgtgacagtggacaccccctacctgggcaaccggctggatgatgtgaggaaccgcttcaagctgcccccccagctgaggatgaagaactttgagaccagcaccctgtccttctccccagaagaaaattttggagatgattctggcctggccgcctacgtggccaaggccatcgaccccagcatctcctgggaggacatcaagtggctgcggcggctgaccagcctgcccatcgtggccaagggcatcctgcggggagatgatgcccgggaggccgtgaagcacggcctgaatggcatcctggtgagcaaccacggggcccggcagctggatggagtgcctgccaccattgatgtgctgcctgagatcgtggaggccgtggagggcaaggtggaggtgttcctggatggaggagtgaggaagggcacagatgtgctgaaggccctggccctgggcgccaaggctgtgtttgtgggccggcccatcgtgtggggcctggccttccagggcgagaagggcgtgcaggatgtgctggagatcctgaaggaggagttccggctggccatggccctgagcggctgccagaatgtgaaggtgattgacaagaccctggtgaggaagaaccccctggccgtgtccaagatctag

SEQ ID NO: 155701 - DNA, 1056 bp, Artificial Sequence
  Description of Artificial Sequence: Synthetic coding sequence
atgagcctggtgtgcctgacagacttccaggcccacgcccgggagcagctgagcaagagcacccgggacttcattgaaggaggagcagatgacagcatcaccagagatgacaacattgctgccttcaagaggatccggctgcggccccgctacctgagagatgtgtctgaggtggacaccaggaccaccatccagggcgaggagatcagcgcccccatctgcatcgcccccaccggcttccactgcctggtgtggccagatggagagatgagcacagcccgggccgcccaggccgccggcatctgctacatcaccagcacctttgccagctgcagcctggaggacatcgtgattgctgcccctgagggcctgcgctggttccagctgtatgtgcacccagacctgcagctgaacaagcagctgatccagagggtggagagcctgggcttcaaggccctggtgatcaccctggacacccctgtgtgtggcaacagaagacatgacatccggaaccagctgcggaggaacctgaccctgacagacctgcagagccccaagaagggaaatgccatcccctacttccagatgacccccatcagcaccagcctgtgctggaatgacctgtcctggttccagagcatcacccggctgcccatcatcctgaagggcatcctgaccaaggaggatgctgagctggccgtgaagcacaacgtgcagggcatcatcgtgagcaaccacggcggccggcagctggatgaggtgctggccagcattgatgccctgacagaggtggtggccgctgtgaagggcaagattgaggtgtacctggatggaggagtgaggactggaaatgatgtgctgaaggccctggccctgggcgccaagtgcatcttcctgggccggcccatcctgtggggcctggcctgcaagggggagcacggcgtgaaggaggtgctgaacatcctgaccaatgagttccacacctccatggccctgaccggctgccgctctgtggccgagatcaacagaaacctggtgcagttcagccggctgtag

SEQ ID NO: 155702 - DNA, 1095 bp, Artificial Sequence
  Description of Artificial Sequence: Synthetic coding sequence
atggaggacaagatgtggagcgaatgtgagggccctgagatgagcctggtgtgcctgacagacttccaggcccacgcccgggagcagctgagcaagagcacccgggacttcatcgagggcggcgcagatgacagcatcaccagagatgacaacattgctgccttcaagaggatccggctgcggccccgctacctgagagatgtgtctgaggtggacaccaggaccaccatccagggcgaggagatcagcgcccccatctgcatcgcccccaccggcttccactgcctggtgtggccagatggagagatgagcacagcccgggccgcccaggccgccggcatctgctacatcaccagcacctttgccagctgcagcctggaggacatcgtgattgctgcccctgagggcctgcgctggttccagctgtatgtgcacccagacctgcagctgaacaagcagctgatccagagggtggagagcctgggcttcaaggccctggtgatcaccctggacacccctgtgtgtggcaacagaagacatgacatccggaaccagctgcggaggaacctgaccctgacagacctgcagagccccaagaagggaaatgccatcccctacttccagatgacccccatcagcaccagcctgtgctggaatgacctgtcctggttccagagcatcacccggctgcccatcatcctgaagggcatcctgaccaaggaggatgctgagctggccgtgaagcacaacgtgcagggcatcatcgtgagcaaccacggcggccggcagctggatgaggtgctggccagcattgatgccctgacagaggtggtggccgctgtgaagggcaagattgaggtgtacctggatggcggcgtgaggactggaaatgatgtgctgaaggccctggccctgggcgccaagtgcatcttcctgggccggcccatcctgtggggcctggcctgcaagggggagcacggcgtgaaggaggtgctgaacatcctgaccaatgagttccacacctccatggccctgaccggctgccgctctgtggccgagatcaacagaaacctggtgcagttcagccggctgtag

SEQ ID NO: 155703 - DNA, 561 bp, Artificial Sequence
  Description of Artificial Sequence: Synthetic coding sequence
atgagcctggtgtgcctgacagacttccaggcccacgcccgggagcagctgagcaagagcacccgggacttcattgaaggaggagcagatgacagcatcaccagagatgacaacattgctgccttcaagaggatccggctgcggccccgctacctgagagatgtgtctgaggtggacaccaggaccaccatccagggcgaggagatcagcgcccccatctgcatcgcccccaccggcttccactgcctggtgtggccagatggagagatgagcacagcccgggcccctgagggcctgcgctggttccagctgtatgtgcacccagacctgcagctgaacaagcagctgatccagagggtggagagcctgggcttcaaggccctggtgatcaccctggacacccctgtgtgtggcaacagaagacatgacatccggaaccagctgcggaggaacctgaccctgacagacctgcagagccccaagaagggaaatgccatcccctacttccagatgacccccatcagcaccagcctgtgctggaatgacctgtcctggttctag

SEQ ID NO: 155704 - DNA, 2292 bp, Artificial Sequence
  Description of Artificial Sequence: Synthetic coding sequence
atggtggcctgccgggccatcggcatcctgagccgcttcagcgccttccgcatcctgcggagccggggctacatctgcaggaacttcaccggcagcagcgccctgctgaccaggacccacatcaactatggagtgaagggagatgtggccgtggtgcgcatcaacagccccaacagcaaggtgaacaccctgagcaaggagctgcacagcgagttcagcgaggtgatgaatgagatctgggccagtgaccagatccgctctgctgtgctgatcagcagcaagccaggctgcttcatcgccggggctgacatcaacatgctggccgcctgcaagaccctgcaggaggtgacccagctgagccaggaggcccagagaattgtggagaagctggagaagagcaccaagcccatcgtggccgccatcaatggcagctgcctgggcggcggcctggaggtggccatcagctgccagtaccgcatcgccaccaaggacaggaagacagtgctgggcaccccagaggtgctgctgggcgccctgcccggggccggcggcacccagaggctgcccaagatggtgggcgtgcctgctgccctggacatgatgctgaccggccgcagcatccgggctgaccgggccaagaagatgggcctggtggaccagctggtggagcccctgggccctggcctgaagcccccagaggagaggaccatcgagtacctggaggaggtggccatcacctttgccaagggcctggccgacaagaagatcagccccaagagggacaagggcctggtggagaagctgacagcctatgccatgaccatcccctttgtgcggcagcaggtgtacaagaaggtggaggagaaggtgaggaagcagaccaagggcctgtacccagcccccctgaagatcattgatgtggtgaagacaggcatcgagcagggcagtgatgctggctacctgtgtgagagccagaagtttggagagctggtgatgaccaaggagagcaaggccctgatgggcctgtaccacggccaggtgctgtgcaagaagaacaagtttggagccccccagaaggatgtgaagcacctggccatcctgggcgccggcctgatgggcgccggcatcgcccaggtgtctgtggacaagggcctgaagaccatcctgaaggatgccaccctgacagccctggaccggggccagcagcaggtgttcaagggcctgaatgacaaggtgaagaagaaggccctgaccagctttgagcgggacagcatcttcagcaacctgaccggccagctggactaccagggctttgagaaggctgacatggtgattgaagctgtgtttgaggacctgagcctgaagcaccgggtgctgaaggaggtggaggccgtcatcccagaccactgcatctttgccagcaacaccagcgccctgcccatcagcgagattgctgctgtgtccaagaggcctgagaaggtgattggcatgcactacttcagccctgtggacaagatgcagctgctggagatcatcaccacagagaagaccagcaaggacaccagcgccagcgctgtggccgtgggcctgaagcagggcaaggtgatcatcgtggtgaaggatggccctggcttctacaccacccgctgcctggcccccatgatgtctgaggtgatccgcatcctgcaggagggcgtggaccccaagaagctggacagcctgaccaccagctttggcttccctgtgggcgccgccaccctggtggatgaggtgggcgtggatgtggccaagcacgtggccgaggacctgggcaaggtgtttggagagagatttggaggcggcaaccctgagctgctgacccagatggtgtccaagggcttcctgggcaggaagagcggcaagggcttctacatctaccaggagggcgtgaagaggaaggacctgaacagcgacatggacagcatcctggccagcctgaagctgccccccaagtctgaggtgtccagtgatgaggacatccagttccggctggtgaccaggtttgtgaatgaagctgtgatgtgcctgcaggagggcatcctggccaccccagctgagggggacatcggggctgtgtttggcctgggcttccccccctgcctgggcggccccttccgctttgtggacctgtatggagcccagaagatcgtggaccggctgaagaagtatgaggccgcctacggcaagcagttcaccccctgccagctgctggccgaccacgccaacagccccaacaagaagttctaccagtag

SEQ ID NO: 155705 - DNA, 783 bp, Artificial Sequence
  Description of Artificial Sequence: Synthetic coding sequence
atggagagcaagggcatgtggcagctgtttgagctgaccctgcccatccagagcatgctggccgcctgcaagaccctgcaggaggtgacccagctgagccaggaggcccagagaattgtggagaagctggagaagagcaccaagcccatcgtggccgccatcaatggcagctgcctgggcggcggcctggaggtggccatcagctgccagtacagaattgccaccaaggacaggaagacagtgctgggcaccccagaggtgctgctgggcgccctgcctggagctgggggcacccagaggctgcccaagatggtgggcgtgcctgctgccctggacatgatgctgaccggccgcagcatccgggctgaccgggccaagaagatgggcctggtggaccagctggtggagcccctgggccctggcctgaagcccccagaggagaggaccatcgagtacctggaggaggtggccatcacctttgccaagggcctggccgacaagaagatcagccccaagagggacaagggcctggtggagaagctgacagcctatgccatgaccatcccctttgtgcggcagcaggtgtacaagaaggtggaggagaaggtgaggaagcagaccaagggcctgtacccagcccccctgaagatcattgatgtggtgaagacaggaattgagcagggcagtgatgctggctacctgtgtgagagccaggtgaacctcttccccttcaacgtgctgctgtctgtgaagggcaagctgaagatccagagctctgtgtag

SEQ ID NO: 155706 - DNA, 1425 bp, Artificial Sequence
  Description of Artificial Sequence: Synthetic coding sequence
atgaccatcctgacctaccccttcaagaacctgcccacagccagcaagtgggccctgcgcttcagcatccggcccctgagctgcagcagccagctgcgggccgccccagctgtgcagaccaagaccaagaagaccctggccaagcccaacatcagaaatgtggtggtggtggatggagtgaggacccccttcctgctgagcggcaccagctacaaggacctgatgcctcatgacctggcccgggccgccctgaccggcctgctgcacaggacctctgtgcccaaggaggtggtggactacatcatctttggaacagtcatccaggaggtgaagaccagcaatgtggcccgggaggccgccctgggcgccggcttcagtgacaagaccccagcccacacagtgaccatggcctgcatcagcgccaaccaggccatgaccactggagtgggcctcatcgccagcggccagtgtgatgtgattgtggccggcggcgtggagctgatgtctgatgtgcccatccgccacagcaggaagatgaggaagctgatgctggacctgaacaaggccaagtccatgggccagaggctgagcctcatcagcaagttccgcttcaacttcctggcccctgagctgcctgctgtgtctgagttcagcaccagcgagaccatgggccacagcgctgaccggctggccgccgcctttgctgtgtcccggctggagcaggatgaatatgccctgcggagccacagcctggccaagaaggcccaggatgagggcctgctgagtgatgtggtgcccttcaaggtgcctgggaaggacacagtgaccaaggacaatggcatccggcccagcagcctggagcagatggccaagctgaagccagccttcatcaagccctacggcaccgtgacagctgccaacagcagcttcctgacagatggagccagcgccatgctgatcatggccgaggagaaggccctggccatgggctacaagcccaaggcctacctgcgggacttcatgtatgtgtcccaggaccccaaggaccagctgctgctgggccccacctacgccacccccaaggtgctggagaaggccggcctgaccatgaatgacattgatgcctttgagttccacgaggccttcagcggccagatcctggccaacttcaaggccatggacagcgactggtttgctgagaactacatgggcaggaagaccaaggtgggcctgccccccctggagaagttcaacaactggggcggcagcctgagcctgggccacccctttggagccaccggctgccgcctggtgatggctgctgccaaccggctgaggaaggagggcggccagtatggcctggtggccgcctgtgccgccggcggccagggccacgccatgattgtggaggcctaccccaagtag

SEQ ID NO: 155707 - DNA, 258 bp, Artificial Sequence
  Description of Artificial Sequence: Synthetic coding sequence
atgaccatcctgacctaccccttcaagaacctgcccacagccagcaagtgggccctgcgcttcagcatccggcccctgagctgcagcagccagctgcgggccgccccagctgtgcagaccaagaccaagaagaccctggccaagcccaacatcagaaatgtggtggtggtggatggagtgaggacccccttcctgctgagcggcaccagctacaaggacctgatgcctcatgacctggcccgggccgccctgacctag

SEQ ID NO: 155708 - DNA, 531 bp, Artificial Sequence
  Description of Artificial Sequence: Synthetic coding sequence
atgaccatcctgacctaccccttcaagaacctgcccacagccagcaagtgggccctgcgcttcagcatccggcccctgagctgcagcagccagctgcgggccgccccagctgtgcagaccaagaccaagaagaccctggccaagcccaacatcagaaatgtggtggtggtggatggagtgaggacccccttcctgctgagcggcaccagctacaaggacctgatgcctcatgacctggcccgggccgccctgaccggcctgctgcacaggacctctgtgcccaaggaggtggtggactacatcatctttggaacagtcatccaggaggtgaagaccagcaatgtggcccgggaggccgccctgggcgccggcttcagtgacaagaccccagcccacacagtgaccatggcctgcatcagcgccaaccaggccatgaccactggagtgggcctcatcgccagcggccagtgtgatgtgattgtggccggcggcgtggagctgatgtctgatgtgcccatccgccacagctag

SEQ ID NO: 155709 - DNA, 453 bp, Artificial Sequence
  Description of Artificial Sequence: Synthetic coding sequence
atgaccatcctgacctaccccttcaagaacctgcccacagccagcaagtgggccctgcgcttcagcatccggcccctgagctgcagcagccagctgcgggccgccccagctgtgcagaccaagaccaagaagaccctggccaagcccaacatcagaaatgtggtggtggtggatggagtgaggacccccttcctgctgagcggcaccagctacaaggacctgatgcctcatgacctggcccgggccgccctgaccggcctgctgcacaggacctctgtgcccaaggaggtggtggactacatcatctttggaacagtcatccaggaggtgaagaccagcaatgtggcccgggaggccgccctgggcgccggcttcagtgacaagaccccagcccacacagtgaccatggcctgcatcagcgccaaccaggccatgaccactggagtgggctag

SEQ ID NO: 155710 - DNA, 1380 bp, Artificial Sequence
  Description of Artificial Sequence: Synthetic coding sequence
atgaccatcctgacctaccccttcaagaacctgcccacagccagcaagtgggccctgcgcttcagcatccggcccctgagctgcagcagccagctgcgggccgccccagctgtgcagaccaagaccaagaagaccctggccaagcccaacatcagaaatgtggtggtggtggatggagtgaggacccccttcctgctgagcggcaccagcggcctgctgcacaggacctctgtgcccaaggaggtggtggactacatcatcttcggcaccgtcatccaggaggtgaagaccagcaatgtggcccgggaggccgccctgggcgccggcttcagtgacaagaccccagcccacacagtgaccatggcctgcatcagcgccaaccaggccatgaccaccggggtgggcctgattgccagcggccagtgtgatgtgattgtggccggcggcgtggagctgatgtctgatgtgcccatccgccacagcaggaagatgaggaagctgatgctggacctgaacaaggccaagtccatgggccagaggctgagcctcatcagcaagttccgcttcaacttcctggcccctgagctgcctgctgtgtctgagttcagcaccagcgagaccatgggccacagcgctgaccggctggccgccgcctttgctgtgtcccggctggagcaggatgaatatgccctgcggagccacagcctggccaagaaggcccaggatgagggcctgctgagtgatgtggtgcccttcaaggtgcctgggaaggacacagtgaccaaggacaatggcatccggcccagcagcctggagcagatggccaagctgaagccagccttcatcaagccctatggaacagtgacagctgccaacagcagcttcctgacagatggagccagcgccatgctgatcatggccgaggagaaggccctggccatgggctacaagcccaaggcctacctgcgggacttcatgtatgtgtcccaggaccccaaggaccagctgctgctgggccccacctacgccacccccaaggtgctggagaaggccggcctgaccatgaatgacattgatgcctttgagttccacgaggccttcagcggccagatcctggccaacttcaaggccatggacagcgactggtttgctgagaactacatgggcaggaagaccaaggtgggcctgccccccctggagaagttcaacaactggggcggcagcctgagcctgggccacccctttggagccaccggctgccgcctggtgatggccgccgccaaccggctgaggaaggagggcggccagtatggcctggtggccgcctgtgccgccggcggccagggccacgccatgattgtggaggcctaccccaagtag

SEQ ID NO: 155711 - DNA, 1359 bp, Artificial Sequence
  Description of Artificial Sequence: Synthetic coding sequence
atgaccctggtgtctggctggctgctgtatggctggatcatcgctgtgcagaccaagaccaagaagaccctggccaagcccaacatcagaaatgtggtggtggtggatggagtgaggacccccttcctgctgagcggcaccagctacaaggacctgatgcctcatgacctggcccgggccgccctgaccggcctgctgcacaggacctctgtgcccaaggaggtggtggactacatcatctttggaacagtcatccaggaggtgaagaccagcaatgtggcccgggaggccgccctgggcgccggcttcagtgacaagaccccagcccacacagtgaccatggcctgcatcagcgccaaccaggccatgaccactggagtgggcctcatcgccagcggccagtgtgatgtgattgtggccggcggcgtggagctgatgtctgatgtgcccatccgccacagcaggaagatgaggaagctgatgctggacctgaacaaggccaagtccatgggccagaggctgagcctcatcagcaagttccgcttcaacttcctggcccctgagctgcctgctgtgtctgagttcagcaccagcgagaccatgggccacagcgctgaccggctggccgccgcctttgctgtgtcccggctggagcaggatgaatatgccctgcggagccacagcctggccaagaaggcccaggatgagggcctgctgagtgatgtggtgcccttcaaggtgcctgggaaggacacagtgaccaaggacaatggcatccggcccagcagcctggagcagatggccaagctgaagccagccttcatcaagccctacggcaccgtgacagctgccaacagcagcttcctgacagatggagccagcgccatgctgatcatggccgaggagaaggccctggccatgggctacaagcccaaggcctacctgcgggacttcatgtatgtgtcccaggaccccaaggaccagctgctgctgggccccacctacgccacccccaaggtgctggagaaggccggcctgaccatgaatgacattgatgcctttgagttccacgaggccttcagcggccagatcctggccaacttcaaggccatggacagcgactggtttgctgagaactacatgggcaggaagaccaaggtgggcctgccccccctggagaagttcaacaactggggcggcagcctgagcctgggccacccctttggagccaccggctgccgcctggtgatggctgctgccaaccggctgaggaaggagggcggccagtatggcctggtggccgcctgtgccgccggcggccagggccacgccatgattgtggaggcctaccccaagtag

SEQ ID NO: 155712 - DNA, 783 bp, Artificial Sequence
  Description of Artificial Sequence: Synthetic coding sequence
atgaaggtggaggtgctgcctgccctgacagacaactacatgtacctggtgattgatgatgagaccaaggaggccgccatcgtggaccctgtgcagccccagaaggtggtggatgctgccaggaagcatggagtgaagctgaccaccgtgctgaccacccaccaccactgggaccacgccggcggcaatgagaagctggtgaagctggagagcggcctgaaggtgtatggaggagatgaccgcatcggggccctgacccacaagatcacccacctgagcaccctgcaggtgggcagcctgaatgtgaagtgcctggccaccccctgccacaccagcggccacatctgctactttgtgtccaagccaggcggcagcgagcccccagctgtgttcaccggggacaccctgtttgtggccggctgcggcaagttctatgagggcacagcagatgagatgtgcaaggccctgctggaggtgctgggccgcctgcccccagacaccagggtgtactgcggccacgagtacaccatcaacaacctgaagtttgcccggcacgtggagcctggaaatgctgccatccgggagaagctggcctgggccaaggagaagtacagcatcggggagcccaccgtgcccagcaccctggccgaggagttcacctacaaccccttcatgagggtgcgggagaagacagtgcagcagcacgccggggagacagatcctgtgaccaccatgagagctgtgagaagagagaaggaccagttcaagatgccccgggactag

SEQ ID NO: 155713 - DNA, 927 bp, Artificial Sequence
  Description of Artificial Sequence: Synthetic coding sequence
atggtggtgggccggggcctgctgggccgccgcagcctggccgccctgggcgccgcctgtgcccggcggggcctgggccctgccctgctgggcgtcttctgccacacagacctgaggaagaacctgactgtggatgagggcaccatgaaggtggaggtgctgcctgccctgacagacaactacatgtacctggtgattgatgatgagaccaaggaggccgccatcgtggaccctgtgcagccccagaaggtggtggatgctgccaggaagcatggagtgaagctgaccaccgtgctgaccacccaccaccactgggaccacgccggcggcaatgagaagctggtgaagctggagagcggcctgaaggtgtatggaggagatgaccgcatcggggccctgacccacaagatcacccacctgagcaccctgcaggtgggcagcctgaatgtgaagtgcctggccaccccctgccacaccagcggccacatctgctactttgtgtccaagccaggcggcagcgagcccccagctgtgttcaccggggacaccctgtttgtggccggctgcggcaagttctatgagggcacagcagatgagatgtgcaaggccctgctggaggtgctgggccgcctgcccccagacaccagggtgtactgcggccacgagtacaccatcaacaacctgaagtttgcccggcacgtggagcctggaaatgctgccatccgggagaagctggcctgggccaaggagaagtacagcatcggggagcccaccgtgcccagcaccctggccgaggagttcacctacaaccccttcatgagggtgcgggagaagacagtgcagcagcacgccggggagacagatcctgtgaccaccatgagagctgtgagaagagagaaggaccagttcaagatgccccgggactag

SEQ ID NO: 155714 - DNA, 711 bp, Artificial Sequence
  Description of Artificial Sequence: Synthetic coding sequence
atggtggtgggccggggcctgctgggccgccgcagcctggccgccctgggcgccgcctgtgcccggcggggcctgggccctgccctgctgggcgtcttctgccacacagacctgaggaagaacctgactgtggatgagggcaccatgaaggtggaggtgctgcctgccctgacagacaactacatgtacctggtgattgatgatgagaccaaggaggccgccatcgtggaccctgtgcagccccagaaggtggtggatgctgccaggaagcatggagtgaagctgaccaccgtgctgaccacccaccaccactgggaccacgccggcggcaatgagaagctggtgaagctggagagcggcctgaaggtgtatggaggagatgaccgcatcggggccctgacccacaagatcacccacctgagcaccctgcaggtgaccccctgcctgtggctggccgccggcagctccatgaagggcctgaggatgagatgtgtgaagctgtgctggaggtcctgggccggcagccccaggacccaggagagcacagtggccaccagcacccccagcaccaccagcagcctgcacgccacctggagccctgccatgcctccttctggccgctcctggccaggccccaggaggagcacagccagcggcagcccccagtgccaccccccctggcagaggagcctgcccaccacccccagctag

SEQ ID NO: 155715 - DNA, 1128 bp, Artificial Sequence
  Description of Artificial Sequence: Synthetic coding sequence
atggccatgacaggctggagctgcctggtgactggagctgggggcttcctgggccagaggatcatccggctgctggtgaaggagaaggagctgaaggagatccgggtgctggacaaggcctttggacctgagctgcgggaggagttcagcaagctgcagaacaagaccaagctgactgtgctggagggggacatcctggatgagcccttcctgaagagggcctgccaggatgtgtctgtcatcatccacacagcctgcatcattgatgtgtttggagtgacccaccgggagagcatcatgaatgtgaatgtgaagggcacccagctgctgctggaggcctgtgtgcaggcctctgtgcctgtgttcatctacaccagcagcattgaggtggccggccccaacagctacaaggagatcatccagaatggccacgaggaggagcccctggagaacacctggccagccccctacccccacagcaagaagctggccgagaaggctgtgctggccgccaacggctggaacctgaagaatggaggcaccctgtacacctgtgccctgcggcccatgtacatctatggagagggcagccgcttcctgagcgccagcatcaatgaggccctgaacaacaacggcatcctgagctctgtgggcaagttcagcacagtgaaccctgtgtatgtgggcaatgtggcctgggcccacatcctggccctgcgggccctgcaggaccccaagaaggcccccagcatccggggccagttctactacatcagtgatgacaccccccaccagagctatgacaacctgaactacaccctgagcaaggagtttggcctgcggctggacagccgctggagcttccccctgagcctgatgtactggattggcttcctgctggagatcgtgtccttcctgctgcggcccatctacacctacagaccacccttcaacagacacatcgtgaccctgagcaacagcgtcttcaccttctcctacaagaaggcccagagggacctggcctacaagcccctgtacagctgggaggaggccaagcagaagacagtggagtgggtgggcagcctggtggacagacacaaggagaccctgaagagcaagacccagtag

SEQ ID NO: 155716 - DNA, 1122 bp, Artificial Sequence
  Description of Artificial Sequence: Synthetic coding sequence
atgacaggctggagctgcctggtgactggagctgggggcttcctgggccagaggatcatccggctgctggtgaaggagaaggagctgaaggagatccgggtgctggacaaggcctttggacctgagctgcgggaggagttcagcaagctgcagaacaagaccaagctgactgtgctggagggggacatcctggatgagcccttcctgaagagggcctgccaggatgtgtctgtcatcatccacacagcctgcatcattgatgtgtttggagtgacccaccgggagagcatcatgaatgtgaatgtgaagggcacccagctgctgctggaggcctgtgtgcaggcctctgtgcctgtgttcatctacaccagcagcattgaggtggccggccccaacagctacaaggagatcatccagaatggccacgaggaggagcccctggagaacacctggccagccccctacccccacagcaagaagctggccgagaaggctgtgctggccgccaacggctggaacctgaagaatggaggcaccctgtacacctgtgccctgcggcccatgtacatctatggagagggcagccgcttcctgagcgccagcatcaatgaggccctgaacaacaacggcatcctgagctctgtgggcaagttcagcacagtgaaccctgtgtatgtgggcaatgtggcctgggcccacatcctggccctgcgggccctgcaggaccccaagaaggcccccagcatccggggccagttctactacatcagtgatgacaccccccaccagagctatgacaacctgaactacaccctgagcaaggagtttggcctgcggctggacagccgctggagcttccccctgagcctgatgtactggattggcttcctgctggagatcgtgtccttcctgctgcggcccatctacacctacagaccacccttcaacagacacatcgtgaccctgagcaacagcgtcttcaccttctcctacaagaaggcccagagggacctggcctacaagcccctgtacagctgggaggaggccaagcagaagacagtggagtgggtgggcagcctggtggacagacacaaggagaccctgaagagcaagacccagtag

SEQ ID NO: 155717 - DNA, 1122 bp, Artificial Sequence; identical to SEQ ID NO: 155716
  Description of Artificial Sequence: Synthetic coding sequence

SEQ ID NO: 155718 - DNA, 249 bp, Artificial Sequence
  Description of Artificial Sequence: Synthetic coding sequence
atgacaggctggagctgcctggtgactggagctgggggcttcctgggccagaggatcatccggctgctggtgaaggagaaggagctgaaggagatccgggtgctggacaaggcctttggacctgagctgcgggaggagttcagcaagctgcagaacaagaccaagctgactgtgctggagggggacatcctggatgagcccttcctgaagagggcctgccaggatgtgtctgtcatcatccacacctag

SEQ ID NO: 155719 - DNA, 1119 bp, Artificial Sequence
  Description of Artificial Sequence: Synthetic coding sequence
atgggctggagctgcctggtgactggagctgggggcctgctgggccagagaattgtgcggctgctggtggaggagaaggagctgaaggagatccgggccctggacaaggccttccggcctgagctgcgggaggagttcagcaagctgcagaacagaaccaagctgactgtgctggagggggacatcctggatgagcccttcctgaagagggcctgccaggatgtgtctgtggtgatccacacagcctgcatcattgatgtgtttggagtgacccaccgggagagcatcatgaatgtgaatgtgaagggcacccagctgctgctggaggcctgtgtgcaggcctctgtgcctgtgttcatctacaccagcagcattgaggtggccggccccaacagctacaaggagatcatccagaatggacatgaggaggagcccctggagaacacctggcccaccccctacccctacagcaagaagctggccgagaaggctgtgctggccgccaacggctggaacctgaagaatggagacaccctgtacacctgtgccctgcggcccacctacatctacggggagggcggccccttcctgagcgccagcatcaatgaggccctgaacaacaacggcatcctgagctctgtgggcaagttcagcacagtgaaccctgtgtatgtgggcaatgtggcctgggcccacatcctggccctgcgggccctgcgggaccccaagaaggcccccagcgtgcggggccagttctactacatcagtgatgacaccccccaccagagctatgacaacctgaactacatcctgagcaaggagtttggcctgcggctggacagccgctggagcctgcccctgaccctgatgtactggattggcttcctgctggaggtggtgtccttcctgctgagccccatctacagctaccagccccccttcaacagacacacagtgaccctgagcaacagcgtcttcaccttctcctacaagaaggcccagagggacctggcctacaagcccctgtacagctgggaggaggccaagcagaagacagtggagtgggtgggcagcctggtggacagacacaaggagaccctgaagagcaagacccagtag

SEQ ID NO: 155720 - DNA, 588 bp, Artificial Sequence
  Description of Artificial Sequence: Synthetic coding sequence
atgggctggagctgcctggtgactggagctgggggcctgctgggccagagaattgtgcggctgctggtggaggagaaggagctgaaggagatccgggccctggacaaggccttccggcctgagctgcgggaggagttcagcaagctgcagaacagaaccaagctgactgtgctggagggggacatcctggatgagcccttcctgaagagggcctgccaggatgtgtctgtggtgatccacacagcctgcatcattgatgtgtttggagtgacccaccgggagagcatcatgaatgtgaatgtgaagggcacccagctgctgctggaggcctgtgtgcaggcctctgtgcctgtgttcatctacaccagcagcattgaggtggccggccccaacagctacaaggagatcatccagaatggacatgaggaggagcccctggagaacacctggcccaccccctacccctacagcaagaagctggccgagaaggctgtgctggccgccaacggctggaacctgaagaatggagacaccctgtacacctgtgccctgcggcccacctacatctacggggagggcggcccctag

SEQ ID NO: 155721 - DNA, 1119 bp, Artificial Sequence; identical to SEQ ID NO: 155719
  Description of Artificial Sequence: Synthetic coding sequence

SEQ ID NO: 155722 - DNA, 591 bp, Artificial Sequence
  Description of Artificial Sequence: Synthetic coding sequence
atggctgacagcgcccaggcccagaagctggtgtacctggtgactggaggctgcggcttcctgggggagcacgtggtgaggatgctgctgcagcgggagccccggctgggggagctgcgggtgtttgaccagcacctgggcccctggctggaggagctgaagacaggccctgtgcgggtgacagccatccagggagatgtgacccaggcccacgaggtggccgctgctgtggccggggcccacgtggtgatccacacagctggcctggtggatgtgtttggccgggccagccccaagaccatccacgaggtgaatgtgcagggcaccagaaatgtgattgaggcctgtgtgcagacaggcacccgcttcctggtgtacaccagctccatggaggtggtgggccccaacaccaagggccaccccttctacagaggaaatgaagacaccccctatgaagctgtgcaccgccacccctacccctgcagcaaggccctggccgagtggctggtgctggaggccaacggcaggaaggccatgctgcccggctgcacctgctggcagcccggctcctggagcagcggccagccctag

SEQ ID NO: 155723 - DNA, 1110 bp, Artificial Sequence
  Description of Artificial Sequence: Synthetic coding sequence
atggctgacagcgcccaggcccagaagctggtgtacctggtgactggaggctgcggcttcctgggggagcacgtggtgaggatgctgctgcagcgggagccccggctgggggagctgcgggtgtttgaccagcacctgggcccctggctggaggagctgaagacaggccctgtgcgggtgacagccatccagggagatgtgacccaggcccacgaggtggccgctgctgtggccggggcccacgtggtgatccacacagctggcctggtggatgtgtttggccgggccagccccaagaccatccacgaggtgaatgtgcagggcaccagaaatgtgattgaggcctgtgtgcagacaggcacccgcttcctggtgtacaccagctccatggaggtggtgggccccaacaccaagggccaccccttctacagaggaaatgaagacaccccctatgaagctgtgcaccgccacccctacccctgcagcaaggccctggccgagtggctggtgctggaggccaacggcaggaaggtgcggggcggcctgcccctggtgacctgtgccctgcggcccaccggcatctatggagagggccaccagatcatgagggacttctaccggcagggcctgcggctgggcggctggctgttccgggccatcccagcctctgtggagcacggccgggtgtatgtgggcaatgtggcctggatgcacgtgctggccgcccgggagctggagcagagggccaccctgatgggcggccaggtgtacttctgctatgatggcagcccctaccgctcctatgaggacttcaacatggagttcctgggcccctgtggcctgcggctggtgggcgcccggcccctgctgccctactggctgctggtgttcctggccgccctgaatgccctgctgcagtggctgctgcggcccctggtgctgtatgcccccctgctgaacccctacaccctggccgtggccaacaccaccttcaccgtgtccacagacaaggcccagaggcacttcggctatgagcccctcttctcctgggaggacagcaggaccaggaccatcctgtgggtgcaggccgccactggaagtgcccagtag

SEQ ID NO: 155724 - DNA, 591 bp, Artificial Sequence; identical to SEQ ID NO: 155722
  Description of Artificial Sequence: Synthetic coding sequence

SEQ ID NO: 155725 - DNA, 1086 bp, Artificial Sequence
  Description of Artificial Sequence: Synthetic coding sequence
atgtctggaaatggaaatgctgctgccacagctgaggagaacagccccaagatgagggtcatccgggtgggcaccaggaagagccagctggcccgcatccagacagattctgtggtggccaccctgaaggccagctacccaggcctgcagtttgagatcatcgccatgagcaccactggagacaagatcctggacacagccctgagcaagattggagagaagagcctcttcaccaaggagctggagcacgccctggagaagaatgaggtggacctggtggtgcacagcctgaaggacctgcccaccgtgctgcccccaggcttcaccatcggggccatctgcaagcgggagaacccccatgatgctgtggtgttccaccccaagtttgtgggcaagaccctggagaccctgcctgagaagtctgtggtgggcaccagcagcctgcggcgggccgcccagctgcagaggaagttcccccacctggagttccgcagcatccggggcaacctgaacacccggctgaggaagctggatgagcagcaggagttcagcgccatcatcctggccacagctggcctgcagaggatgggctggcacaacagagtgggccagatcctgcaccctgaggagtgcatgtatgctgtgggccagggcgccctgggcgtggaggtgcgggccaaggaccaggacatcctggacctggtgggcgtgctgcatgaccctgagaccctgctgcgctgcatcgccgagcgggccttcctgcggcacctggagggcggctgcagcgtgcctgtggccgtgcacacagccatgaaggatggccagctgtacctgactggaggagtgtggagcctggatggcagtgacagcatccaggagaccatgcaggccaccatccacgtgcctgcccagcatgaagatggcccagaagatgacccccagctggtgggcatcacagccaggaacatcccccggggcccccagctggccgcccagaacctgggcatcagcctggccaacctgctgctgagcaaaggagccaagaacatcctggatgtggcccggcagctgaatgatgcccactag

SEQ ID NO: 155726 - DNA, 1035 bp, Artificial Sequence
  Description of Artificial Sequence: Synthetic coding sequence
atgagggtcatccgggtgggcaccaggaagagccagctggcccgcatccagacagacagcgtggtggccaccctgaaggccagctacccaggcctgcagtttgagatcatcgccatgagcaccaccggggacaagatcctggacacagccctgagcaagatcggggagaagagcctcttcaccaaggagctggagcacgccctggagaagaatgaggtggacctggtggtgcacagcctgaaggacctgcccaccgtgctgcccccaggcttcaccatcggggccatctgcaagcgggagaacccccatgatgctgtggtgttccaccccaagtttgtgggcaagaccctggagaccctgcctgagaagtctgtggtgggcaccagcagcctgcggcgggccgcccagctgcagaggaagttcccccacctggagttccgcagcatccggggcaacctgaacacccggctgaggaagctggatgagcagcaggagttcagcgccatcatcctggccacagctggcctgcagaggatgggctggcacaacagagtgggccagatcctgcaccctgaggagtgcatgtatgctgtgggccagggcgccctgggcgtggaggtgcgggccaaggaccaggacatcctggacctggtgggcgtgctgcatgaccctgagaccctgctgcgctgcatcgccgagcgggccttcctgcggcacctggagggcggctgcagcgtgcctgtggccgtgcacacagccatgaaggatggccagctgtacctgaccggcggcgtgtggagcctggatggcagtgacagcatccaggagaccatgcaggccaccatccacgtgcctgcccagcatgaagatggcccagaagatgacccccagctggtgggcatcacagccaggaacatcccccggggcccccagctggccgcccagaacctgggcatcagcctggccaacctgctgctgagcaagggggccaagaacatcctggatgtggcccggcagctgaatgatgcccactag

SEQ ID NO: 155727 - DNA, 1035 bp, Artificial Sequence; identical to SEQ ID NO: 155726
  Description of Artificial Sequence: Synthetic coding sequence

SEQ ID NO: 155728 - DNA, 564 bp, Artificial Sequence
  Description of Artificial Sequence: Synthetic coding sequence
atgagggtcatccgggtgggcaccaggaagagccagctggcccgcatccagacagacagcgtggtggccaccctgaaggccagctacccaggcctgcagtttgagatcatcgccatgagcaccaccggggacaagatcctggacacagccctgagcaagatcggggagaagagcctcttcaccaaggagctggagcacgccctggagaagaatgaggtggacctggtggtgcacagcctgaaggacctgcccaccgtgctgcccccaggcttcaccatcggggccatctgcaagcgggagaacccccatgatgctgtggtgttccaccccaagtttgtgggcaagaccctggagaccctgcctgagaagtctgtggtgggcaccagcagcctgcggcgggccgcccagctgcagaggaagttcccccacctggagttccgcagcatccggggcaacctgaacacccggctgaggaagctggatgagcagcaggagttcagcgccatcatcctggccacagctggcctgcagaggatgggctggcacaacagagtgggccagtag

SEQ ID NO: 155729 - DNA, 1035 bp, Artificial Sequence; identical to SEQ ID NO: 155726
  Description of Artificial Sequence: Synthetic coding sequence

SEQ ID NO: 155730 - DNA, 564 bp, Artificial Sequence; identical to SEQ ID NO: 155728
  Description of Artificial Sequence: Synthetic coding sequence

SEQ ID NO: 155731 - DNA, 915 bp, Artificial Sequence
  Description of Artificial Sequence: Synthetic coding sequence
atgagggtcatccgggtgggcaccaggaagagccagctggcccgcatccagacagacagcgtggtggccaccctgaaggccagctacccaggcctgcagtttgagatcatcgccatgagcaccaccggggacaagatcctggacacagccctgagcaagatcggggagaagagcctcttcaccaaggagctggagcacgccctggagaagaatgaggtggacctggtggtgcacagcctgaaggacctgcccaccgtgctgcccccaggcttcaccatcggggccatctgcaagcgggagaacccccatgatgctgtggtgttccaccccaagtttgtgggcaagaccctggagaccctgcctgagaagtctgtggtgggcaccagcagcctgcggcgggccgcccagctgcagaggaagttcccccacctggagttccgcagcatccggggcaacctgaacacccggctgaggaagctggatgagcagcaggagttcagcgccatcatcctggccacagctggcctgcagaggatgggctggcacaacagagtgggccagatcctgcaccctgaggagtgcatgtatgctgtgggccaggagggcggctgcagcgtgcctgtggccgtgcacacagccatgaaggatggccagctgtacctgaccggcggcgtgtggagcctggatggcagtgacagcatccaggagaccatgcaggccaccatccacgtgcctgcccagcatgaagatggcccagaagatgacccccagctggtgggcatcacagccaggaacatcccccggggcccccagctggccgcccagaacctgggcatcagcctggccaacctgctgctgagcaagggggccaagaacatcctggatgtggcccggcagctgaatgatgcccactag

SEQ ID NO: 155732 - DNA, 966 bp, Artificial Sequence
  Description of Artificial Sequence: Synthetic coding sequence
atgtctggaaatggaaatgctgctgccacagctgaggagaacagccccaagatgagggtcatccgggtgggcaccaggaagagccagctggcccgcatccagacagattctgtggtggccaccctgaaggccagctacccaggcctgcagtttgagatcatcgccatgagcaccactggagacaagatcctggacacagccctgagcaagattggagagaagagcctcttcaccaaggagctggagcacgccctggagaagaatgaggtggacctggtggtgcacagcctgaaggacctgcccaccgtgctgcccccaggcttcaccatcggggccatctgcaagcgggagaacccccatgatgctgtggtgttccaccccaagtttgtgggcaagaccctggagaccctgcctgagaagtctgtggtgggcaccagcagcctgcggcgggccgcccagctgcagaggaagttcccccacctggagttccgcagcatccggggcaacctgaacacccggctgaggaagctggatgagcagcaggagttcagcgccatcatcctggccacagctggcctgcagaggatgggctggcacaacagagtgggccagatcctgcaccctgaggagtgcatgtatgctgtgggccaggagggcggctgcagcgtgcctgtggccgtgcacacagccatgaaggatggccagctgtacctgactggaggagtgtggagcctggatggcagtgacagcatccaggagaccatgcaggccaccatccacgtgcctgcccagcatgaagatggcccagaagatgacccccagctggtgggcatcacagccaggaacatcccccggggcccccagctggccgcccagaacctgggcatcagcctggccaacctgctgctgagcaaaggagccaagaacatcctggatgtggcccggcagctgaatgatgcccactag

SEQ ID NO: 155733 - DNA, 879 bp, Artificial Sequence
  Description of Artificial Sequence: Synthetic coding sequence
atggccttcatgaagaagtacctgctgcccatcctgggcctcttcatggcctactactactacagcgccaatgaggagttccggcctgagatgctgcagggcaagaaggtgattgtgactggagccagcaagggcatcggccgggagatggcctaccacctggccaagatgggcgcccacgtggtggtgacagcccggagcaaggagaccctgcagaaggtggtgagccactgcctggagctgggcgccgccagcgcccactacatcgccggcaccatggaggacatgacctttgctgagcagtttgtggcccaggccggcaagctgatgggcggcctggacatgctgatcctgaaccacatcaccaacaccagcctgaacctcttccatgatgacatccaccacgtgaggaagtccatggaggtgaacttcctgtcctatgtggtgctgactgtggccgccctgcccatgctgaagcagagcaatggcagcatcgtggtggtgagcagcctggccggcaaggtggcctaccccatggtggccgcctacagcgccagcaagtttgccctggatggcttcttcagcagcatcaggaaggagtacagcgtgtcccgggtgaatgtgtccatcaccctgtgtgtgctgggcctgattgacacagaaacagccatgaaggctgtgtctggcatcgtgcacatgcaggccgcccccaaggaggagtgtgccctggagatcatcaagggcggggccctgcggcaggaggaggtgtactatgacagcagcctgtggaccaccctgctgatccggaacccctgcaggaagatcctggagttcctgtacagcaccagctacaacatggaccgcttcatcaacaagtag

SEQ ID NO: 155734 - DNA, 879 bp, Artificial Sequence; identical to SEQ ID NO: 155733
  Description of Artificial Sequence: Synthetic coding sequence

SEQ ID NO: 155735 - DNA, 879 bp, Artificial Sequence; identical to SEQ ID NO: 155733
  Description of Artificial Sequence: Synthetic coding sequence

SEQ ID NO: 155736 - DNA, 1218 bp, Artificial Sequence
  Description of Artificial Sequence: Synthetic coding sequence
atggagcgctggccctggcccagcggcggggcctggctgctggtggccgcccgggccctgctgcagctgctgcggagtgacctgcggctgggccggcccctgctggccgccctggccctgctggccgccctggactggctgtgccagaggctgctgcccccacctgctgccctggccgtgctggccgccgccggctggatcgccctgagccggctggcccggccccagaggctgcctgtggccaccagggctgtgctgatcaccggctgtgacagcggctttgggaaggagacagccaagaagctggacagcatgggcttcaccgtgctggccaccgtgctggagctgaacagccctggggccatcgagctgcggacctgctgcagcccccggctgcggctgctgcagatggacctgaccaagccaggggacatcagccgggtgctggagttcaccaaggcccacaccaccagcacaggcctgtggggcctggtgaacaatgccggccacaatgaggtggtggctgatgctgagctgagccctgtggccaccttccgcagctgcatggaggtgaacttcttcggggccctggagctgaccaagggcctgctgcccctgctgcggagcagccggggccgcatcgtgacagtgggcagccctgctggggacatgccctacccctgcctgggcgcctacggcaccagcaaggctgctgtggccctgctgatggacaccttcagctgtgagctgctgccctggggcgtgaaggtgtccatcatccagcccggctgcttcaagacagaatctgtgagaaatgtgggccagtgggagaagaggaagcagctgctgctggccaacctgccccaggagctgctgcaggcctacggcaaggactacatcgagcacctgcacggccagttcctgcacagcctgcggctggccatgtctgacctgacccctgtggtggatgccatcacagatgccctgctggccgcccggccccggcggcgctactacccaggccagggcctgggcctgatgtacttcatccactactacctgcctgagggcctgcggcggcgcttcctgcaggccttcttcatcagccactgcctgccccgggccctgcagcccggccagcccggcaccaccccaccccaggatgctgcccaggaccccaacctgagccctggccccagccctgctgtggccaggtag

SEQ ID NO: 155737 - DNA, 2232 bp, Artificial Sequence
  Description of Artificial Sequence: Synthetic coding sequence
atggaggccgtggccgtggccgctgctgtgggcgtgctgctgctggccggggccggcggcgctgctggagatgaggcccgggaggccgctgctgtgcgggccctggtggcccggctgctgggccctggccctgctgctgacttctctgtgtctgtggagcgggccctggccgccaagccaggcctggacacctacagcctgggcggcggcggggccgcccgggtgcgggtgcggggcagcactggagtggccgctgctgctggcctgcaccgctacctgcgggacttctgtggctgccacgtggcctggagcggcagccagctgcggctgccccggcccctgcctgctgtgcctggagagctgacagaggccacccccaaccgctaccgctactaccagaatgtgtgcacccagagctacagctttgtgtggtgggactgggcccgctgggagcgggagattgactggatggccctgaatggcatcaacctggccctggcctggagcggccaggaggccatctggcagagggtgtacctggccctgggcctgacccaggccgagatcaatgagttcttcaccggccctgccttcctggcctggggccgcatgggcaacctgcacacctgggatggccccctgcccccatcctggcacatcaagcagctgtacctgcagcaccgggtgctggaccagatgaggagctttggcatgacccctgtgctgcctgcctttgctggccacgtgcctgaggccgtgaccagggtcttcccccaggtgaatgtgaccaagatgggctcctggggccacttcaactgcagctacagctgcagcttcctgctggcccctgaggaccccatcttccccatcatcggcagcctcttcctgcgggagctgatcaaggagtttggaacagaccacatctatggagctgacaccttcaatgagatgcagccccccagcagcgagcccagctacctggccgccgccaccacagctgtgtatgaggccatgacagctgtggacacagaagctgtgtggctgctgcagggctggctgttccagcaccagccccagttctggggccctgcccagatccgggctgtgctgggcgctgtgccccggggccgcctgctggtgctggacctgtttgctgagagccagcctgtgtacaccaggacagccagcttccagggccagcccttcatctggtgcatgctgcacaactttggaggcaaccacggcctgtttggagccctggaggccgtgaatggaggccctgaggccgcccggctcttccccaacagcaccatggtgggcaccggcatggcccctgagggcatcagccagaatgaggtggtgtacagcctgatggccgagctgggctggaggaaggaccctgtgcctgacctggccgcctgggtgaccagctttgctgccaggagatatggagtgagccacccagatgctggggccgcctggaggctgctgctgcggtctgtgtacaactgcagcggggaggcctgccggggccacaacagaagccccctggtgagaagacccagcctgcagatgaacaccagcatctggtacaacagaagtgatgtgtttgaggcctggaggctgctgctgaccagcgcccccagcctggccaccagccctgccttccgctatgacctgctggacctgacccggcaggccgtgcaggagctggtgtccctgtactatgaggaggcccggagcgcctacctgagcaaggagctggccagcctgctgcgggccggcggcgtgctggcctatgagctgctgcctgccctggatgaggtgctggccagtgacagccgcttcctgctgggctcctggctggagcaggcccgggctgctgctgtgtctgaggccgaggccgacttctatgagcagaacagccgctaccagctgaccctgtggggccctgagggcaacatcctggactatgccaacaagcagctggccggcctggtggccaactactacaccccccgctggaggctcttcctggaggccctggtggacagcgtggcccagggcatccccttccagcagcaccagtttgacaagaatgtgttccagctggagcaggcctttgtgctgagcaagcagcgctaccccagccagcccaggggggacacagtggacctggccaagaagatcttcctgaagtactacccccgctgggtggccggctcctggtag

SEQ ID NO: 155738 - DNA, 450 bp, Artificial Sequence
  Description of Artificial Sequence: Synthetic coding sequence
atggccaggacagtggtgctgatcaccggctgcagcagcggcatcggcctgcacctggccgtgcggctggccagtgaccccagccagagcttcaaggtgtatgccaccctgcgggacctgaagacccagggccgcctgtgggaggccgcccgggccctggcctgccccccaggcagcctggagaccctgcagctggatgtgcgggacagcaagtctgtggccgccgcccgggagcgggtgacagagggccgggtggatgtgctggtgtgcaatgccggcctgggcctgctgggccccctggaggccctgggagaagatgctgtggcctctgtgctggatgtgaatgtggtgggcaccgtgaggatgctgcaggccttcctgcctgacatgaagaggcggggcagcggccgggtgctggtgactggatctgtgggcggcctgatggcctag

SEQ ID NO: 155739 - DNA, 987 bp, Artificial Sequence
  Description of Artificial Sequence: Synthetic coding sequence
atggccaggacagtggtgctgatcaccggctgcagcagcggcatcggcctgcacctggccgtgcggctggccagtgaccccagccagagcttcaaggtgtatgccaccctgcgggacctgaagacccagggccgcctgtgggaggccgcccgggccctggcctgccccccaggcagcctggagaccctgcagctggatgtgcgggacagcaagtctgtggccgccgcccgggagcgggtgacagagggccgggtggatgtgctggtgtgcaatgccggcctgggcctgctgggccccctggaggccctgggagaagatgctgtggcctctgtgctggatgtgaatgtggtgggcaccgtgaggatgctgcaggccttcctgcctgacatgaagaggcggggcagcggccgggtgctggtgactggatctgtgggcggcctgatgggcctgcccttcaatgatgtgtactgtgccagcaagtttgccctggagggcctgtgtgagagcctggccgtgctgctgctgccctttggagtgcacctgagcctgattgaatgtggccctgtgcacacagccttcatggagaaggtgctgggcagccctgaggaggtgctggacagaacagacatccacaccttccaccgcttctaccagtacctggcccacagcaagcaggtgttccgggaggccgcccagaaccctgaggaggtggccgaggtgttcctgacagccctgcgggcccccaagcccaccctgcgctacttcaccacagagcgcttcctgcccctgctgaggatgaggctggatgaccccagcggcagcaactacgtgacagccatgcaccgggaggtgtttggagatgtgcctgccaaggccgaggccggggctgaggccggcggcggggccggccctggagcagaagatgaggccggccgcggggctgtgggggaccctgagctgggggaccccccagctgccccccagtag

SEQ ID NO: 155740 - DNA, 447 bp, Artificial Sequence
  Description of Artificial Sequence: Synthetic coding sequence
atggcctgcaccgtggtgctgatcaccggctgcagcagcggcatcggcctgcacctggccatccacctggccctggaccccagccagagcttcaaggtgtatgccaccctgcgggacctgaagacccagggccgcctgtgggaggccgcccgggccctggcctgcccccagggcagcctggagcggctgcagctggatgtgaggaacagcagcagcctggccgccgcccgggagcgggtgacagagggccgggtggatgtgctggtgtgtgacaccggcctgggcctgctgggccccctgggggaggatgctgtggcctctgtgctggatgtgaatgtggtgggcaccgtgcgggtgctgcaggacttcctgcctgacatgaagaggcctggcagcggccgggtgctggtgacaggctccatgggcggcctgatgggagagtggtag

SEQ ID NO: 155741 - DNA, 786 bp, Artificial Sequence
  Description of Artificial Sequence: Synthetic coding sequence
atggctgctgcctgccgctctgtgaagggcctggtggccgtcatcaccggcggggccagcggcctgggcctggccacagctgagcggctggtgggccagggcgccagcgctgtgctgctggacctgcccaacagcggcggggaggcccaggccaagaagctgggcaacaactgtgtgtttgccccagcagatgtgaccagcgagaaggatgtgcagacagccctggccctggccaagggcaagtttggccgggtggatgtggccgtgaactgtgccggcattgctgtggccagcaagacctacaacctgaagaagggccagacccacaccctggaggacttccagagggtgctggatgtgaacctgatgggcaccttcaacgtcatccggctggtggccggggagatgggccagaatgaaccagaccagggcggccagaggggcgtcatcatcaacacagcctctgtggccgcctttgagggccaggtgggccaggccgcctacagcgccagcaagggcggcatcgtgggcatgaccctgcccatcgcccgggacctggcccccatcggcatccgggtgatgaccatcgcccctggcctgtttggcacccccctgctgaccagcctgcctgagaaggtgtgcaacttcctggccagccaggtgcccttccccagccggctgggggaccctgcagaatatgcccacctggtgcaggccatcatcgagaaccccttcctgaatggagaggtgatccggctggatggagccatccgcatgcagccctag

SEQ ID NO: 155742 - DNA, 510 bp, Artificial Sequence
  Description of Artificial Sequence: Synthetic coding sequence
atggctgctgcctgccgctctgtgaagggcctggtggccgtcatcaccggcggggccagcggcctgggcctggccacagctgagcggctggtgggccagggcgccagcgctgtgctgctggacctgcccaacagcggcggggaggcccaggccaagaagctgggcaacaactgtgtgtttgccccagcagatgtgaccagcgagaaggatgtgcagacagccctggccctggccaagggcaagtttggccgggtggatgtggccgtgaactgtgccggcattgctgtggccagcaagacctacaacctgaagaagggccagacccacaccctggaggacttccagagggtgctggatgtgaacctgatgggcaccttcaacgtcatccggctggtggccggggagatgggccagaatgaaccagaccagggcggccagaggggcgtcatcatcaacacagcctctgtggccgcctttgagggccaggtgtgcctggccccccactgctag

SEQ ID NO: 155743 - DNA, 759 bp, Artificial Sequence
  Description of Artificial Sequence: Synthetic coding sequence
atggctgctgcctgccgctctgtgaagggcctggtggccgtcatcaccggcggggccagcggcctgggcctggccacagctgagcggctggtgggccagggcgccagcgctgtgctgctggacctgcccaacagcggcggggaggcccaggccaagaagctgggcaacaactgtgtgtttgccccagcagatgtgaccagcgagaaggatgtgcagacagccctggccctggccaagggcaagtttggccgggtggatgtggccgtgaactgtgccggcattgctgtggccagcaagacctacaacctgaagaagggccagacccacaccctggaggacttccagagggtgctggatgtgaacctgatgggcaccttcaacgtcatccggctggtggccggggagatgggccagaatgaaccagaccagggcggccagaggggcgtcatcatcaacacagcctctgtggccgcctttgagggccaggtgggccaggccgcctacagcgccagcaagggcggcatcgtgggcatgaccctgcccatcgcccgggacctggcccccatcggcctgtttggcacccccctgctgaccagcctgcctgagaaggtgtgcaacttcctggccagccaggtgcccttccccagccggctgggggaccctgcagaatatgcccacctggtgcaggccatcatcgagaaccccttcctgaatggagaggtgatccggctggatggagccatccgcatgcagccctag

SEQ ID NO: 155744 - DNA, 903 bp, Artificial Sequence
  Description of Artificial Sequence: Synthetic coding sequence
atgaagttcctgctggacatcctgctgctgctgcccctgctgattgtgtgcagcctggagagctttgtgaagctgttcatccccaagaggaggaagtctgtgactggagagatcgtgctgatcaccggggccggccacggcatcggccgcctgacagcctatgaatttgccaagctgaagagcaagctggtgctgtgggacatcaacaagcacggcctggaggagacagctgccaagtgcaagggcctgggcgccaaggtgcacacctttgtggtggactgcagcaaccgggaggacatctacagcagcgccaagaaggtgaaggccgagattggagatgtgtccatcctggtgaacaatgccggcgtggtgtacaccagtgacctgtttgccacccaggacccccagatcgagaagacctttgaggtgaatgtgctggcccacttctggaccaccaaggccttcctgcctgccatgaccaagaacaaccacggccacatcgtgacagtggccagcgctgctggccacgtgtctgtgcccttcctgctggcctactgcagcagcaagtttgctgctgtgggcttccacaagaccctgacagatgagctggccgccctgcagatcactggagtgaagaccacctgcctgtgccccaactttgtgaacacaggcttcatcaagaaccccagcaccagcctgggccccaccctggagcctgaggaggtggtgaaccggctgatgcacggcatcctgacagagcagaagatgatcttcatccccagcagcatcgccttcctgaccaccctggagcgcatcctgcctgagcgcttcctggccgtgctgaagcagaagatctctgtgaagtttgatgctgtgattggctacaagatgaaggcccagtag

SEQ ID NO: 155745 - DNA, 795 bp, Artificial Sequence
  Description of Artificial Sequence: Synthetic coding sequence
atgaacatcatcctggagatcctgctgctgctgatcaccatcatctacagctacctggagagcctggtgaagttcttcatcccccagaggaggaagtctgtggccggggagatcgtgctgatcaccggggccggccacggcatcggccggcagaccacctatgaatttgccaagaggcagagcatcctggtgctgtgggacatcaacaaggtgaagaaggaggtgggagatgtgaccatcgtggtgaacaatgccggcaccgtgtacccagctgacctgctgagcaccaaggatgaggagatcaccaagacctttgaggtgaacatcctgggccacttctggatcaccaaggccctgctgcccagcatgatggagaggaaccacggccacatcgtgacagtggcctctgtgtgtggccacgagggcatcccctacctgatcccctactgcagcagcaagtttgctgctgtgggcttccaccggggcctgaccagcgagctgcaggccctgggcaagacaggcatcaagaccagctgcctgtgccctgtgtttgtgaacacaggcttcaccaagaaccccagcacccggctgtggcctgtgctggagacagatgaggtggtgcgcagcctgattgatggcatcctgaccaacaagaagatgatctttgtgcccagctacatcaacatcttcctgcggctgcagaagttcctgcctgagcgggccagcgccatcctgaacaggatgcagaacatccagtttgaagctgtggtgggccacaagatcaagatgaagtag

SEQ ID NO: 155746 - DNA, 903 bp, Artificial Sequence
  Description of Artificial Sequence: Synthetic coding sequence
atgaacatcatcctggagatcctgctgctgctgatcaccatcatctacagctacctggagagcctggtgaagttcttcatcccccagaggaggaagtctgtggccggggagatcgtgctgatcaccggggccggccacggcatcggccggcagaccacctatgaatttgccaagaggcagagcatcctggtgctgtgggacatcaacaagaggggcgtggaggagacagctgctgaatgtaggaagctgggcgtgacagcccacgcctacgtggtggactgcagcaaccgggaggagatctaccgcagcctgaaccaggtgaagaaggaggtgggagatgtgaccatcgtggtgaacaatgccggcaccgtgtacccagctgacctgctgagcaccaaggatgaggagatcaccaagacctttgaggtgaacatcctgggccacttctggatcaccaaggccctgctgcccagcatgatggagaggaaccacggccacatcgtgacagtggcctctgtgtgtggccacgagggcatcccctacctgatcccctactgcagcagcaagtttgctgctgtgggcttccaccggggcctgaccagcgagctgcaggccctgggcaagacaggcatcaagaccagctgcctgtgccctgtgtttgtgaacacaggcttcaccaagaaccccagcacccggctgtggcctgtgctggagacagatgaggtggtgcgcagcctgattgatggcatcctgaccaacaagaagatgatctttgtgcccagctacatcaacatcttcctgcggctgcagaagttcctgcctgagcgggccagcgccatcctgaacaggatgcagaacatccagtttgaagctgtggtgggccacaagatcaagatgaagtag

SEQ ID NO: 155747 - DNA, 813 bp, Artificial Sequence
  Description of Artificial Sequence: Synthetic coding sequence
atggccaccggcaccaggtatgctgggaaggtggtggtggtgactggaggcggccggggcattggagctggcatcgtgcgggcctttgtgaacagcggggcccgggtggtgatctgtgacaaggatgagagcggcggccgggccctggagcaggagctgcccggggctgtgttcatcctgtgtgatgtgacccaggaggatgatgtgaagaccctggtgtctgagaccatccgccgcttcggccgcctggactgtgtggtgaacaatgccggccaccaccccccaccccagaggcctgaggagaccagcgcccagggcttccggcagctgctggagctgaacctgctgggcacctacaccctgaccaagctggccctgccctacctgaggaagagccagggcaatgtcatcaacatcagcagcctggtgggcgccatcggccaggcccaggccgtgccctacgtggccaccaagggagctgtgacagccatgaccaaggccctggccctggatgagagcccctatggagtgcgggtgaactgcatcagccctggcaacatctggacccccctgtgggaggagctggccgccctgatgccagacccccgggccaccatccgggagggcatgctggcccagcccctgggccgcatgggccagcctgctgaggtgggcgctgctgctgtgttcctggccagcgaggccaacttctgcacaggaattgagctgctggtgactggaggagctgagctgggctacggctgcaaggccagccgcagcacccctgtggatgccccagacatccccagctag

SEQ ID NO: 155748 - DNA, 1164 bp, Artificial Sequence
  Description of Artificial Sequence: Synthetic coding sequence
atgagcaccttcttcagtgacacagcctggatctgcctggccgtgcccaccgtgctgtgtggcaccgtcttctgcaagtacaagaagagcagcggccagctgtggagctggatggtgtgcctggccggcctgtgtgctgtgtgcctgctgatcctgagccccttctggggcctcatcctcttctctgtgtcctgcttcctgatgtacacctacctgagcggccaggagctgctgcctgtggaccagaaggctgtgctggtgactggaggagactgtggcctgggccacgccctgtgcaagtacctggatgagctgggcttcaccgtgtttgctggggtgctgaatgaaaatggacctggagctgaggagctgcggaggacctgcagcccccggctgtctgtgctgcagatggacatcaccaagcctgtgcagatcaaggatgcctacagcaaggtggccgccatgctgcaggaccggggcctgtgggccgtcatcaacaatgctggggtgctgggcttccccacagatggagagctgctgctgatgacagactacaagcagtgcatggctgtgaacttcttcggcaccgtggaggtgaccaagaccttcctgcccctgctgaggaagagcaagggccgcctggtgaatgtgtcctccatgggcggcggggcccccatggagcggctggccagctatggcagcagcaaggctgctgtgaccatgttcagctctgtgatgaggctggagctgagcaagtggggcatcaaggtggccagcatccagcccggcggcttcctgaccaacattgctggcaccagtgacaagtgggagaagctggagaaggacatcctggaccacctgcctgctgaggtgcaggaggactatggccaggactacatcctggcccagaggaacttcctgctgctgatcaacagcctggccagcaaggacttcagccctgtgctgcgggacatccagcacgccatcctggccaagagcccctttgcctactacacccctgggaagggggcctacctgtggatctgcctggcccactacctgcccatcggcatctatgactactttgccaagaggcacttcggccaggacaagcccatgccccgggccctgaggatgcccaactacaagaagaaggccacctag

SEQ ID NO: 155749 - DNA, 783 bp, Artificial Sequence
  Description of Artificial Sequence: Synthetic coding sequence
atgggagatgtgctggagcagttcttcatcctgaccggcctgctggtgtgcctggcctgcctggccaagtgtgtgcgcttcagccgctgtgtgctgctgaactactggaaggtgctgcccaagagcttcctgcgctccatgggccagtgggccgtcatcaccggggctggagatggcatcggcaaggcctacagctttgagctggccaagaggggcctgaatgtggtgctgatcagcaggaccctggagaagctggaggccatcgccacagaaattgaaagaaccaccggccgctctgtgaagatcatccaggccgacttcaccaaggatgacatctatgagcacatcaaggagaagctggccggcctggagatcggcatcctggtgaacaacgtgggcatgctgcccaacctgctgcccagccacttcctgaatgccccagatgagatccagagcctcatccactgcaacatcacctctgtggtgaagatgacccagctgatcctgaagcacatggagagccggcagaagggcctcatcctgaacatcagcagcggcatcgccctcttcccctggcccctgtacagcatgtacagcgccagcaaggcctttgtgtgtgccttcagcaaggccctgcaggaggagtacaaggccaaggaggtgatcatccaggccggcttcctgagcctcatcccagcctgggccttctacagcggggccttccagaggctgctgctgacccactacgtggcctacctgaagctgaacaccaaggtgaggtag

SEQ ID NO: 155750 - DNA, 933 bp, Artificial Sequence
  Description of Artificial Sequence: Synthetic coding sequence
atgggagatgtgctggagcagttcttcatcctgaccggcctgctggtgtgcctggcctgcctggccaagtgtgtgcgcttcagccgctgtgtgctgctgaactactggaaggtgctgcccaagagcttcctgcgctccatgggccagtgggccgtcatcaccggggctggagatggcatcggcaaggcctacagctttgagctggccaagaggggcctgaatgtggtgctgatcagcaggaccctggagaagctggaggccatcgccacagaaattgaaagaaccaccggccgctctgtgaagatcatccaggccgacttcaccaaggatgacatctatgagcacatcaaggagaagctggccggcctggagatcggcatcctggtgaacaacgtgggcatgctgcccaacctgctgcccagccacttcctgaatgccccagatgagatccagagcctcatccactgcaacatcacctctgtggtgaagatgacccagctgatcctgaagcacatggagagccggcagaagggcctcatcctgaacatcagcagcggcatcgccctcttcccctggcccctgtacagcatgtacagcgccagcaaggcctttgtgtgtgccttcagcaaggccctgcaggaggagtacaaggccaaggaggtgatcatccaggtgctgaccccctatgctgtgtccacagccatgaccaagtacctgaacaccaacgtcatcaccaagacagcagatgaatttgtgaaggagagcctgaactacgtgaccatcggcggggagacctgtggctgcctggcccacgagatcctggccggcttcctgagcctcatcccagcctgggccttctacagcggggccttccagaggctgctgctgacccactacgtggcctacctgaagctgaacaccaaggtgaggtag

SEQ ID NO: 155751 - DNA, 2211 bp, Artificial Sequence
  Description of Artificial Sequence: Synthetic coding sequence
atgggcagccccctgcgctttgatggccgggtggtgctggtgactggagctggagctggcctgggccgggcctatgccctggcctttgctgagcggggggccctggtggtggtgaatgacctgggcggggacttcaagggcgtgggcaagggcagcctggccgctgacaaggtggtggaggagatcagaagaagaggaggcaaggctgtggccaactatgattctgtggaggagggggagaaggtggtgaagacagccctggatgccttcggcagaattgatgtggtggtgaacaatgccggcatcctgcgggacaggagctttgcccgcatcagtgatgaggactgggacatcatccaccgggtgcacctgcggggcagcttccaggtgaccagggctgcctgggagcacatgaagaagcagaagtatggccgcatcatcatgaccagcagcgccagcggcatctacggcaactttggccaggccaactacagcgctgccaagctgggcctgctgggcctggccaacagcctggccatcgagggcaggaagagcaacatccactgcaacaccatcgccccaaatgccggcagcaggatgacccagacagtgatgcctgaggacctggtggaggccctgaagccagaatatgtggcccccctggtgctgtggctgtgccacgagagctgtgaggagaatggaggcctgtttgaggtgggcgccggctggattggcaagctgcgctgggagaggaccctgggcgccatcgtgcggcagaagaaccaccccatgaccccagaggccgtgaaggccaactggaagaagatctgtgactttgaaaatgccagcaagccccagagcatccaggagagcacaggcagcatcatcgaggtgctgagcaagattgacagcgagggcggcgtgtctgccaaccacaccagccgggccaccagcacagccaccagcggctttgctggggccatcggccagaagctgccccccttctcctatgcctacacagagctggaggccatcatgtatgccctgggcgtgggcgccagcatcaaggaccccaaggacctgaagttcatctatgagggcagcagtgacttcagctgcctgcccacctttggagtcatcatcggccagaagtccatgatgggcggcggcctggccgagatccctggcctgagcatcaactttgccaaggtgctgcacggggagcagtacctggagctgtacaagcccctgccccgggccggcaagctgaagtgtgaggccgtggtggctgatgtgctggacaagggcagcggcgtggtgatcatcatggatgtgtacagctacagcgagaaggagctgatctgccacaaccagttcagcctcttcctggtgggcagcggcggctttggaggcaagaggaccagtgacaaggtgaaggtggccgtggccatccccaaccggcccccagatgctgtgctgacagacaccaccagcctgaaccaggccgccctgtaccgcctgagcggggactggaaccccctgcacatcgaccccaactttgccagcctggccggctttgacaagcccatcctgcacggcctgtgcaccttcggcttcagcgcccggcgggtgctgcagcagtttgctgacaatgatgtgagccgcttcaaggccatcaaggccaggtttgccaagcctgtgtacccaggccagaccctgcagacagagatgtggaaggagggcaaccgcatccacttccagaccaaggtgcaggagactggagacatcgtcatcagcaatgcctacgtggacctggcccccaccagcggcaccagcgccaagaccccatctgagggcggcaagctgcagagcacctttgtgtttgaggagattggaagaaggctgaaggacatcggccctgaggtggtgaagaaggtgaatgctgtgtttgagtggcacatcaccaagggcggcaacatcggggccaagtggaccatcgacctgaagagcggcagcggcaaggtgtaccagggccctgccaagggagctgctgacaccaccatcatcctgagtgatgaggacttcatggaggtggtgctgggcaagctggacccccagaaggccttcttcagcggccgcctgaaggcccggggcaacatcatgctgagccagaagctgcagatgatcctgaaggactatgccaagctgtag

SEQ ID NO: 155752 - DNA, 2286 bp, Artificial Sequence
  Description of Artificial Sequence: Synthetic coding sequence
atggtgatcctggaggccccccacctgctgcggaggaaggagcctgagaccccaggcctgagcagccgcatcggccccagcctgtgccccggcttctgcaggaagaggtctgtgtcctgctgcttccagaacctgtgcaacaaccccatggagaagatcatcagccagtgccgcttctttgtgtccatgaatgacctgggcggggacttcaagggcgtgggcaagggcagcctggccgctgacaaggtggtggaggagatcagaagaagaggaggcaaggctgtggccaactatgacagcgtggaggagggggagaaggtggtgaagacagccctggatgccttcggcagaattgatgtggtggtgaacaatgccggcatcctgcgggacaggagctttgcccgcatcagtgatgaggactgggacatcatccaccgggtgcacctgcggggcagcttccaggtgacccgggccgcctgggagcacatgaagaagcagaagtatggccgcatcatcatgaccagcagcgccagcggcatctacggcaactttggccaggccaactacagcgctgccaagctgggcctgctgggcctggccaacagcctggccatcgagggcaggaagagcaacatccactgcaacaccatcgccccaaatgccggcagcaggatgacccagacagtgatgcctgaggacctggtggaggccctgaagccagaatatgtggcccccctggtgctgtggctgtgccacgagagctgtgaagaaaatggaggcctgtttgaggtgggcgccggctggattggcaagctgcgctgggagaggaccctgggcgccatcgtgcggcagaagaaccaccccatgaccccagaggccgtgaaggccaactggaagaagatctgtgactttgaaaatgccagcaagccccagagcatccaggagagcacaggcagcatcatcgaggtgctgagcaagattgattctgagggcggcgtgtctgccaaccacaccagccgggccaccagcacagccaccagcggctttgctggggccatcggccagaagctgccccccttctcctatgcctacacagagctggaggccatcatgtatgccctgggcgtgggcgccagcatcaaggaccccaaggacctgaagttcatctatgagggcagcagtgacttcagctgcctgcccaccttcggggtcatcatcggccagaagtccatgatgggcggcggcctggccgagatccctggcctgagcatcaactttgccaaggtgctgcatggagagcagtacctggagctgtacaagcccctgcccagggctgggaagctgaagtgtgaggccgtggtggctgatgtgctggacaagggcagcggcgtggtgatcatcatggatgtgtacagctacagcgagaaggagctgatctgccacaaccagttcagcctcttcctggtgggcagcggcggctttggaggcaagaggaccagtgacaaggtgaaggtggccgtggccatccccaacagacctccagatgctgtgctgacagacaccaccagcctgaaccaggccgccctgtaccgcctgagcggggactggaaccccctgcacatcgaccccaactttgccagcctggccggctttgacaagcccatcctgcacggcctgtgcaccttcggcttcagcgccaggagagtgctgcagcagtttgctgacaatgatgtgagccgcttcaaggccatcaaggccaggtttgccaagcctgtgtacccaggccagaccctgcagacagagatgtggaaggagggcaaccgcatccacttccagaccaaggtgcaggagaccggggacatcgtcatcagcaatgcctacgtggacctggcccccaccagcggcaccagcgccaagacccccagcgagggcggcaagctgcagagcacctttgtgtttgaggagatcggccggcggctgaaggacatcggccctgaggtggtgaagaaggtgaatgctgtgtttgagtggcacatcaccaagggcggcaacattggagccaagtggaccatcgacctgaagagcggcagcggcaaggtgtaccagggccctgccaagggagctgctgacaccaccatcatcctgagtgatgaggacttcatggaggtggtgctgggcaagctggacccccagaaggccttcttcagcggccgcctgaaggcccggggcaacatcatgctgagccagaagctgcagatgatcctgaaggactatgccaagctgtag

SEQ ID NO: 155753 - DNA, 2139 bp, Artificial Sequence
  Description of Artificial Sequence: Synthetic coding sequence
atggagaagatcatcagccagtgccgcttctttgtgtccatgaatgacctgggcggggacttcaagggcgtgggcaagggcagcctggccgctgacaaggtggtggaggagatcagaagaagaggaggcaaggctgtggccaactatgattctgtggaggagggggagaaggtggtgaagacagccctggatgccttcggcagaattgatgtggtggtgaacaatgccggcatcctgcgggacaggagctttgcccgcatcagtgatgaggactgggacatcatccaccgggtgcacctgcggggcagcttccaggtgaccagggctgcctgggagcacatgaagaagcagaagtatggccgcatcatcatgaccagcagcgccagcggcatctacggcaactttggccaggccaactacagcgctgccaagctgggcctgctgggcctggccaacagcctggccatcgagggcaggaagagcaacatccactgcaacaccatcgccccaaatgccggcagcaggatgacccagacagtgatgcctgaggacctggtggaggccctgaagccagaatatgtggcccccctggtgctgtggctgtgccacgagagctgtgaggagaatggaggcctgtttgaggtgggcgccggctggattggcaagctgcgctgggagaggaccctgggcgccatcgtgcggcagaagaaccaccccatgaccccagaggccgtgaaggccaactggaagaagatctgtgactttgaaaatgccagcaagccccagagcatccaggagagcacaggcagcatcatcgaggtgctgagcaagattgacagcgagggcggcgtgtctgccaaccacaccagccgggccaccagcacagccaccagcggctttgctggggccatcggccagaagctgccccccttctcctatgcctacacagagctggaggccatcatgtatgccctgggcgtgggcgccagcatcaaggaccccaaggacctgaagttcatctatgagggcagcagtgacttcagctgcctgcccacctttggagtcatcatcggccagaagtccatgatgggcggcggcctggccgagatccctggcctgagcatcaactttgccaaggtgctgcacggggagcagtacctggagctgtacaagcccctgccccgggccggcaagctgaagtgtgaggccgtggtggctgatgtgctggacaagggcagcggcgtggtgatcatcatggatgtgtacagctacagcgagaaggagctgatctgccacaaccagttcagcctcttcctggtgggcagcggcggctttggaggcaagaggaccagtgacaaggtgaaggtggccgtggccatccccaaccggcccccagatgctgtgctgacagacaccaccagcctgaaccaggccgccctgtaccgcctgagcggggactggaaccccctgcacatcgaccccaactttgccagcctggccggctttgacaagcccatcctgcacggcctgtgcaccttcggcttcagcgcccggcgggtgctgcagcagtttgctgacaatgatgtgagccgcttcaaggccatcaaggccaggtttgccaagcctgtgtacccaggccagaccctgcagacagagatgtggaaggagggcaaccgcatccacttccagaccaaggtgcaggagactggagacatcgtcatcagcaatgcctacgtggacctggcccccaccagcggcaccagcgccaagaccccatctgagggcggcaagctgcagagcacctttgtgtttgaggagattggaagaaggctgaaggacatcggccctgaggtggtgaagaaggtgaatgctgtgtttgagtggcacatcaccaagggcggcaacatcggggccaagtggaccatcgacctgaagagcggcagcggcaaggtgtaccagggccctgccaagggagctgctgacaccaccatcatcctgagtgatgaggacttcatggaggtggtgctgggcaagctggacccccagaaggccttcttcagcggccgcctgaaggcccggggcaacatcatgctgagccagaagctgcagatgatcctgaaggactatgccaagctgtag

SEQ ID NO: 155754 - DNA, 1800 bp, Artificial Sequence
  Description of Artificial Sequence: Synthetic coding sequence
atgaagaagcagaagtatggccgcatcatcatgaccagcagcgccagcggcatctacggcaactttggccaggccaactacagcgctgccaagctgggcctgctgggcctggccaacagcctggccatcgagggcaggaagagcaacatccactgcaacaccatcgccccaaatgccggcagcaggatgacccagacagtgatgcctgaggacctggtggaggccctgaagccagaatatgtggcccccctggtgctgtggctgtgccacgagagctgtgaagaaaatggaggcctgtttgaggtgggcgccggctggattggcaagctgcgctgggagaggaccctgggcgccatcgtgcggcagaagaaccaccccatgaccccagaggccgtgaaggccaactggaagaagatctgtgactttgaaaatgccagcaagccccagagcatccaggagagcacaggcagcatcatcgaggtgctgagcaagattgattctgagggcggcgtgtctgccaaccacaccagccgggccaccagcacagccaccagcggctttgctggggccatcggccagaagctgccccccttctcctatgcctacacagagctggaggccatcatgtatgccctgggcgtgggcgccagcatcaaggaccccaaggacctgaagttcatctatgagggcagcagtgacttcagctgcctgcccaccttcggggtcatcatcggccagaagtccatgatgggcggcggcctggccgagatccctggcctgagcatcaactttgccaaggtgctgcatggagagcagtacctggagctgtacaagcccctgcccagggctgggaagctgaagtgtgaggccgtggtggctgatgtgctggacaagggcagcggcgtggtgatcatcatggatgtgtacagctacagcgagaaggagctgatctgccacaaccagttcagcctcttcctggtgggcagcggcggctttggaggcaagaggaccagtgacaaggtgaaggtggccgtggccatccccaacagacctccagatgctgtgctgacagacaccaccagcctgaaccaggccgccctgtaccgcctgagcggggactggaaccccctgcacatcgaccccaactttgccagcctggccggctttgacaagcccatcctgcacggcctgtgcaccttcggcttcagcgccaggagagtgctgcagcagtttgctgacaatgatgtgagccgcttcaaggccatcaaggccaggtttgccaagcctgtgtacccaggccagaccctgcagacagagatgtggaaggagggcaaccgcatccacttccagaccaaggtgcaggagaccggggacatcgtcatcagcaatgcctacgtggacctggcccccaccagcggcaccagcgccaagacccccagcgagggcggcaagctgcagagcacctttgtgtttgaggagatcggccggcggctgaaggacatcggccctgaggtggtgaagaaggtgaatgctgtgtttgagtggcacatcaccaagggcggcaacattggagccaagtggaccatcgacctgaagagcggcagcggcaaggtgtaccagggccctgccaagggagctgctgacaccaccatcatcctgagtgatgaggacttcatggaggtggtgctgggcaagctggacccccagaaggccttcttcagcggccgcctgaaggcccggggcaacatcatgctgagccagaagctgcagatgatcctgaaggactatgccaagctgtag

SEQ ID NO: 155755 - DNA, 2157 bp, Artificial Sequence
  Description of Artificial Sequence: Synthetic coding sequence
atgggcagccccctgcgctttgatggccgggtggtgctggtgactggagctggagctgtgaatgacctgggcggggacttcaagggcgtgggcaagggcagcctggccgctgacaaggtggtggaggagatcagaagaagaggaggcaaggctgtggccaactatgattctgtggaggagggggagaaggtggtgaagacagccctggatgccttcggcagaattgatgtggtggtgaacaatgccggcatcctgcgggacaggagctttgcccgcatcagtgatgaggactgggacatcatccaccgggtgcacctgcggggcagcttccaggtgaccagggctgcctgggagcacatgaagaagcagaagtatggccgcatcatcatgaccagcagcgccagcggcatctacggcaactttggccaggccaactacagcgctgccaagctgggcctgctgggcctggccaacagcctggccatcgagggcaggaagagcaacatccactgcaacaccatcgccccaaatgccggcagcaggatgacccagacagtgatgcctgaggacctggtggaggccctgaagccagaatatgtggcccccctggtgctgtggctgtgccacgagagctgtgaggagaatggaggcctgtttgaggtgggcgccggctggattggcaagctgcgctgggagaggaccctgggcgccatcgtgcggcagaagaaccaccccatgaccccagaggccgtgaaggccaactggaagaagatctgtgactttgaaaatgccagcaagccccagagcatccaggagagcacaggcagcatcatcgaggtgctgagcaagattgacagcgagggcggcgtgtctgccaaccacaccagccgggccaccagcacagccaccagcggctttgctggggccatcggccagaagctgccccccttctcctatgcctacacagagctggaggccatcatgtatgccctgggcgtgggcgccagcatcaaggaccccaaggacctgaagttcatctatgagggcagcagtgacttcagctgcctgcccacctttggagtcatcatcggccagaagtccatgatgggcggcggcctggccgagatccctggcctgagcatcaactttgccaaggtgctgcacggggagcagtacctggagctgtacaagcccctgccccgggccggcaagctgaagtgtgaggccgtggtggctgatgtgctggacaagggcagcggcgtggtgatcatcatggatgtgtacagctacagcgagaaggagctgatctgccacaaccagttcagcctcttcctggtgggcagcggcggctttggaggcaagaggaccagtgacaaggtgaaggtggccgtggccatccccaaccggcccccagatgctgtgctgacagacaccaccagcctgaaccaggccgccctgtaccgcctgagcggggactggaaccccctgcacatcgaccccaactttgccagcctggccggctttgacaagcccatcctgcacggcctgtgcaccttcggcttcagcgcccggcgggtgctgcagcagtttgctgacaatgatgtgagccgcttcaaggccatcaaggccaggtttgccaagcctgtgtacccaggccagaccctgcagacagagatgtggaaggagggcaaccgcatccacttccagaccaaggtgcaggagactggagacatcgtcatcagcaatgcctacgtggacctggcccccaccagcggcaccagcgccaagaccccatctgagggcggcaagctgcagagcacctttgtgtttgaggagattggaagaaggctgaaggacatcggccctgaggtggtgaagaaggtgaatgctgtgtttgagtggcacatcaccaagggcggcaacatcggggccaagtggaccatcgacctgaagagcggcagcggcaaggtgtaccagggccctgccaagggagctgctgacaccaccatcatcctgagtgatgaggacttcatggaggtggtgctgggcaagctggacccccagaaggccttcttcagcggccgcctgaaggcccggggcaacatcatgctgagccagaagctgcagatgatcctgaaggactatgccaagctgtag

SEQ ID NO: 155756 - DNA, 1026 bp, Artificial Sequence
  Description of Artificial Sequence: Synthetic coding sequence
atgaggaaggtggtgctgatcaccggggccagcagcggcatcggcctggccctgtgcaagaggctgctggctgaagatgatgagctgcacctgtgcctggcctgcaggaacatgagcaaggccgaggccgtgtgtgccgccctgctggccagccaccccacagctgaggtgaccatcgtgcaggtggatgtgagcaacctgcagagcgtcttccgggccagcaaggagctgaagcagcgcttccagaggctggactgcatctacctgaatgccggcatcatgcccaacccccagctgaacatcaaggccctcttcttcggcctcttcagcaggaaggtgatccacatgttcagcacagctgagggcctgctgacccagggcgacaagatcacagcagatggcctgcaggaggtgtttgagaccaacgtgtttggccacttcatcctgatccgggagctggagcccctgctgtgccacagcgacaaccccagccagctgatctggaccagcagccgcagcgccaggaagagcaacttcagcctggaggacttccagcacagcaagggcaaggagccctacagcagcagcaaatatgccacagacctgctgtctgtggccctgaacagaaacttcaaccagcagggcctgtacagcaatgtggcctgccctggaacagccctgaccaacctgacctacggcatcctgccccccttcatctggaccctgctgatgcctgccatcctgctgctgcgcttctttgccaatgccttcaccctgaccccctacaatggaacagaggccctggtgtggctgttccaccagaagccagagagcctgaaccccctcatcaagtacctgagcgccaccaccggcttcggcaggaactacatcatgacccagaagatggacctggatgaggacacagctgagaagttctaccagaagctgctggagctggagaagcacatccgggtgaccatccagaagacagacaaccaggcccggctgagcggcagctgcctgtag

SEQ ID NO: 155757 - DNA, 336 bp, Artificial Sequence
  Description of Artificial Sequence: Synthetic coding sequence
atgaggaaggtggtgctgatcaccggggccagcagcggcatcggcctggccctgtgcaagaggctgctggctgaagatgatgagctgcacctgtgcctggcctgcaggaacatgagcaaggccgaggccgtgtgtgccgccctgctggccagccaccccacagctgaggtgaccatcgtgcaggtggatgtgagcaacctgcagagcgtcttccgggccagcaaggagctgaagcagcgcttccagaggctggactgcatctacctgaatgccggcatcatgcccaacccccagctgaacatcaaggccctcttcttcggcctcttcagcagctag

SEQ ID NO: 155758 - DNA, 255 bp, Artificial Sequence
  Description of Artificial Sequence: Synthetic coding sequence
atgaggaaggtggtgctgatcaccggggccagcagcggcatcggcctggccctgtgcaagaggctgctggctgaagatgatgagctgcacctgtgcctggcctgcaggaacatgagcaaggccgaggccgtgtgtgccgccctgctggccagccaccccacagctgaggtgaccatcgtgcaggtggatgtgagcaacctgcagagcgtcttccgggccagcaaggagctgaagcagcgctacatcagctgctag

SEQ ID NO: 155759 - DNA, 921 bp, Artificial Sequence
  Description of Artificial Sequence: Synthetic coding sequence
atgaggaaggtggtgctgatcaccggggccagcagcggcatcggcctggccctgtgcaagaggctgctggctgaagatgatgagctgcacctgtgcctggcctgcaggaacatgagcaaggccgaggccgtgtgtgccgccctgctggccagccaccccacagctgaggtgaccatcgtgcaggtggatgtgagcaacctgcagagcgtcttccgggccagcaaggagctgaagcagcgcttccagaggctggactgcatctacctgaatgccggcatcatgcccaacccccagctgaacatcaaggccctcttcttcggcctcttcagcaggaaggtgatccacatgttcagcacagctgagggcctgctgacccagggcgacaagatcacagcagatggcctgcaggaggtgtttgagaccaacgtgtttggccacttcatcctgatccgggagctggagcccctgctgtgccacagcgacaaccccagccagctgatctggaccagcagccgcagcgccaggaagagcaacttcagcctggaggacttccagcacagcaagggcaaggagccctacagcagcagcaaatatgccacagacctgctgtctgtggccctgaacagaaacttcaaccagcagctgcgcttctttgccaatgccttcaccctgaccccctacaacggcacagaggccctggtgtggctgttccaccagaagccagagagcctgaaccccctcatcaagtacctgagcgccaccactggatttggaagaaactacatcatgacccagaagatggacctggatgaggacacagctgagaagttctaccagaagctgctggagctggagaagcacatccgggtgaccatccagaagacagacaaccaggcccggctgagcggcagctgcctgtag

SEQ ID NO: 155760 - DNA, 360 bp, Artificial Sequence
  Description of Artificial Sequence: Synthetic coding sequence
gtggtgatccgggagctggagcccctgctgtgccacagcgacaaccccagccagctgatctggaccagcagccgcagcgccaggaagagcaacttcagcctggaggacttccagcacagcaagggcaaggagccctacagcagcagcaaatatgccacagacctgctgtctgtggccctgaacagaaacttcaaccagcagctgcgcttctttgccaatgccttcaccctgaccccctacaatggaacagaggccctggtgtggctgttccaccagaagccagagagcctgaaccccctcatcaagtacctgagcgccaccaccggcttcggcaggaactacatcatgacccagaagtag

SEQ ID NO: 155761 - DNA, 966 bp, Artificial Sequence
  Description of Artificial Sequence: Synthetic coding sequence
atggagaggaagaaccagacagccatcacagagttcatcatcctgggcttcagcaacctgaatgagtggcagttcctgctcttcaccatcttcttcctgacctacttctgcaccctgggcggcaacatcctgatcatcctgaccaccgtgacagacccccacctgcacacccccatgtactacttcctgggcaacctggccttcatcgacatctgctacaccaccagcaatgtgccccagatgatggtgcacctgctgagcaagaagaagagcatctcctatgtgggctgtgtggtgcagctgtttgcctttgtgttctttgtgggctctgaatgtctgctgctggccgccatggcctatgaccgctacatcgccatctgcaaccccctgcgctacagcgtcatcctgagcaaggtgctgtgcaaccagctggccgccagctgctgggccgccggcttcctgaacagcgtggtgcacacagtgctgaccttctgcctgcccttctgtggcaacaaccagatcaactacttcttctgtgacatcccccccctgctgatcctgagctgtggcaacacctctgtgaatgagctggccctgctgagcactggagtcttcatcggctggacccccttcctgtgcatcgtgctgagctacatctgcatcatcagcaccatcctgcgcatccagagcagcgagggccgcaggaaggccttcagcacctgtgccagccacctggccatcgtgttcctgttctacggcagcgccatcttcacctacgtgcggcccatcagcacctacagcctgaagaaggaccggctggtgtctgtgctgtacagcgtggtgacccccatgctgaaccccatcatctacaccctgaggaacaaggacatcaaggaggccgtgaagaccatcggcagcaagtggcagccccccatcagcagcctggacagcaagctgacctactag

SEQ ID NO: 155762 - DNA, 786 bp, Artificial Sequence
  Description of Artificial Sequence: Synthetic coding sequence
atggccagccagctgcagaaccggctgcggagcgccctggccctggtgactggagctggcagcggcatcggccgggctgtgtctgtgcggctggccggggagggcgccaccgtggccgcctgtgacctggacagagctgctgcccaggagaccgtgcggctgctgggcggccctggcagcaaggagggccccccccggggcaaccacgccgccttccaggctgatgtgtctgaggcccgggccgcccgctgcctgctggagcaggtgcaggcctgcttcagccggccccccagcgtggtggtgtcctgtgccggcatcacccaggatgagttcctgctgcacatgtctgaagatgactgggacaaggtgattgctgtgaacctgaagggcaccttcctggtgacccaggccgccgcccaggccctggtgtccaatggctgccggggcagcatcatcaacatcagcagcatcgtgggcaaggtgggcaatgtgggccagaccaactatgctgccagcaaggccggcgtgattggcctgacccagacagctgcccgggagctgggccgccacggcatccgctgcaacagcgtgctgcccggcttcatcgccacccccatgacccagaaggtgccccagaaggtggtggacaagatcacagagatgatccccatgggccacctgggggaccctgaagatgtggctgatgtggtggccttcctggcctctgaagattctggctacatcaccggcacctctgtggaggtgactggaggcctcttcatgtag

SEQ ID NO: 155763 - DNA, 786 bp, Artificial Sequence; identical to SEQ ID NO: 155762
  Description of Artificial Sequence: Synthetic coding sequence

SEQ ID NO: 155764 - DNA, 786 bp, Artificial Sequence; identical to SEQ ID NO: 155762
  Description of Artificial Sequence: Synthetic coding sequence

SEQ ID NO: 155765 - DNA, 786 bp, Artificial Sequence; identical to SEQ ID NO: 155762
  Description of Artificial Sequence: Synthetic coding sequence

SEQ ID NO: 155766 - DNA, 786 bp, Artificial Sequence; identical to SEQ ID NO: 155762
  Description of Artificial Sequence: Synthetic coding sequence

SEQ ID NO: 155767 - DNA, 1848 bp, Artificial Sequence
  Description of Artificial Sequence: Synthetic coding sequence
atggtgtctggccccctggccctgcgctggtgtgcctgggccggccgcggggacatgggccctgacatggagctgcccagccacagcaagcagctgctgctgcagctgaaccagcagaggaccaagggcttcctgtgtgatgtgatcatcatggtggagaacagcatcttccgggcccacaagaatgtgctggccgccagcagcatctacttcaagagcctggtgctgcatgacaacctgatcaacctggacacagacatggtgagcagcacagtgttccagcagatcctggacttcatctacaccgggaagctgctgcccagcgaccagcctgctgagcccaacttcagcaccctgctgacagctgccagctacctgcagctgcctgagctggccgccctgtgcaggaggaagctgaagagagctgggaagcccttcggcagcggccgggccggcagcacaggcatgggccggcccccaagaagccagaggctgagcacagccagcgtcatccaggcccgctaccagggcctggtggatggcaggaaaggagcccacgccccccaggagctgccccaggccaagggcagtgatgatgagctgttcctgggcggcagcaaccaggacagcgtgcagggcctgggccgggctgtgtgcccagctggaggagaggccggcctgggcggctgcagcagcagcaccaacggcagcagcggcggctgtgagcaggagctgggcctggacctgagcaagaagagcccccccctgcccccagccaccccaggcccccacctgaccccagatgatgctgcccagctgagtgacagccagcacggcagccccccagctgccagcgcccctcctgtggccaacagcgccagctacagcgagctgggcggcaccccagatgagcccatggacctggagggcgctgaggacaaccacctgagcctgctggaggcccctgggggccagcccaggaagagcctgcggcacagcaccaggaagaaggagtggggcaagaaggagcctgtggccggcagcccctttgagcggcgggaggccggccccaagggcccctgccctggagaggagggggagggcgtgggggacagagtgcccaacggcatcctggccagcggggccggccccagcggcccctacggggagcccccctacccctgcaaggaggaggaggagaatggcaaggatgcctctgaagattctgcccagagcggcagcgagggcggcagcggccacgccagcgcccactacatgtaccggcaggagggctatgagaccgtgtcctatggagacaacctgtatgtgtgcatcccctgtgccaagggcttccccagcagcgagcagctgaatgcccacgtggagacccacacagaggaggagctgttcatcaaggaggagggcgcctatgaaacaggcagcggcggcgctgaggaggaggccgaggacctgagcgcccccagcgctgcctacacagctgagccccggcccttcaagtgcagcgtgtgtgagaagacctacaaggaccctgccaccctgcggcagcacgagaagacccactggctgacccggcccttcccctgcaacatctgtgggaagatgttcacccagaggggcaccatgaccaggcacatgaggagccacctgggcctgaagccctttgcctgtgatgaatgtggcatgaggttcacccggcagtaccgcctgacagagcacatgagggtgcacagcggggagaagccctatgagtgccagctgtgtggcggcaagttcacccagcagaggaacctgatcagccacctgaggatgcacaccagccccagctag

SEQ ID NO: 155768 - DNA, 1848 bp, Artificial Sequence; identical to SEQ ID NO: 155767
  Description of Artificial Sequence: Synthetic coding sequence

SEQ ID NO: 155769 - DNA, 1848 bp, Artificial Sequence; identical to SEQ ID NO: 155767
  Description of Artificial Sequence: Synthetic coding sequence

SEQ ID NO: 155770 - DNA, 2670 bp, Artificial Sequence
  Description of Artificial Sequence: Synthetic coding sequence
atggatgcccggggcggcggcggccggcctggagagagccctggggccaccccagcccctggccccccacctcctcctcctccagccccaccccagcagcagcccccacctcctcctcctccagcccctcctcctggccctggccctgccccaccccagcacccccccagggctgaggccctgcccccagaggccgcagatgaaggaggcccccggggccgcctgcggagccgggacagcagctgtggccggcccggcacccctggggccgccagcacagccaagggcagccccaatggagaatgtggccgcggggagccccagtgcagccctgctggccctgagggccctgcccggggccccaaggtgtccttcagctgccgcggggccgccagcggccctgcccctggccctggccctgctgaggaggccggcagcgaggaggccggccctgctggggagccccggggcagccaggccagcttcatgcagaggcagtttggagccctgctgcagcccggggtgaacaagttcagcctgaggatgtttggcagccagaaggctgtggagcgggagcaggagcgggtgaagtctgctggggcctggatcatccacccctacagcgacttccgcttctactgggacttcaccatgctgctcttcatggtgggcaacctgatcatcatccctgtgggcatcaccttcttcaaggatgagaccacagccccctggatcgtgttcaacgtggtgtctgacaccttcttcctgatggacctggtgctgaacttcagaactggaattgtgattgaggacaacacagagatcatcctggaccctgagaagatcaagaagaagtacctgcggacctggtttgtggtggactttgtgagcagcatccctgtggactacatcttcctgattgtggagaagggcatcgacagcgaggtgtacaagacagcccgggccctgagaattgtgcgcttcaccaagatcctgagcctgctgcggctgctgcggctgagccgcctcatccgctacatccaccagtgggaggagatcttccacatgacctatgacctggccagcgctgtgatgaggatctgcaacctgatctccatgatgctgctgctgtgccactgggatggctgcctgcagttcctggtgcccatgctgcaggacttccccaggaactgctgggtgtccatcaatggcatggtgaaccacagctggagcgagctgtacagctttgccctcttcaaggccatgagccacatgctgtgcatcggctacggccggcaggcccctgagagcatgacagacatctggctgaccatgctgtccatgattgtgggcgccacctgctacgccatgtttattggacatgccacagccctgatccagagcctggacagcagccggcggcagtaccaggagaagtacaagcaggtggagcagtacatgtccttccacaagctgcctgctgacttccggcagaagatccatgactactatgagcaccgctaccagggcaagatgtttgatgaagattccatcctgggggagctgaatggccccctgcgggaggagatcgtgaacttcaactgcaggaagctggtggcctccatgcccctgtttgccaatgctgaccccaactttgtgacagccatgctgaccaagctgaagtttgaggtgttccagcccggggactacatcatccgggagggcaccatcggcaagaagatgtacttcatccagcacggcgtggtgtctgtgctgaccaagggcaacaaggagatgaagctgagtgatggcagctactttggagagatctgcctgctgacccggggcagaagaacagcctctgtgcgggctgacacctactgccgcctgtacagcctgtctgtggacaacttcaatgaggtgctggaggagtaccccatgatgagaagagcctttgagaccgtggccatcgaccggctggacagaattggcaagaagaacagcatcctgctgcacaaggtgcagcacgacctgaacagcggggtcttcaacaaccaggagaatgccatcatccaggagatcgtgaagtatgaccgggagatggtgcagcaggccgagctgggccagagggtgggcctcttccccccacctcctcctccaccccaggtgaccagcgccatcgccaccctgcagcaggccgccgccatgtccttctgcccccaggtggcccggcccctggtgggccccctggccctgggcagcccccggctggtgagaagacctcctcctggccctgccccagctgctgccagccctggccccccacctccagccagccccccaggggccccagccagcccccgggcccccaggaccagcccctatggaggcctgcctgctgcccccctggccggccctgccctgcctgcccggcggctgagccgggccagccggcccctgagcgccagccagcccagcctgccccatggagcccctggccctgctgccagcaccaggcctgccagcagcagcaccccccggctgggccccaccccagctgcccgggctgctgcccccagcccagacagaagagacagcgccagccctggagctgctgggggcctggacccccaggacagcgcccggagccggctgagcagcaacctgtag

SEQ ID NO: 155771 - DNA, 2325 bp, Artificial Sequence
  Description of Artificial Sequence: Synthetic coding sequence
atggaggccgagcagaggcctgctgctggggccagcgagggcgccaccccaggcctggaggccgtgccccctgtggcccctcctccagccacagctgccagcggccccatccccaagagcggccctgagcccaagaggaggcacctgggcaccctgctgcagcccaccgtgaacaagttcagcctgcgggtgtttggcagccacaaggctgtggagattgagcaggagcgggtgaagtctgctggggcctggatcatccacccctacagcgacttccgcttctactgggacctgatcatgctgctgctgatggtgggcaacctgattgtgctgcctgtgggcatcaccttcttcaaggaggagaacagccccccctggatcgtgttcaacgtgctgagtgacaccttcttcctgctggacctggtgctgaacttcagaactggaattgtggtggaggagggcgctgagatcctgctggccccccgggccatccgcacccgctacctgcggacctggttcctggtggacctgatcagcagcatccctgtggactacatcttcctggtggtggagctggagccccggctggatgctgaggtgtacaagacagcccgggccctgagaattgtgcgcttcaccaagatcctgagcctgctgcggctgctgcggctgagccgcctcatccgctacatccaccagtgggaggagatcttccacatgacctatgacctggccagcgctgtggtgcgcatcttcaacctgattggcatgatgctgctgctgtgccactgggatggctgcctgcagttcctggtgcccatgctgcaggacttccccccagactgctgggtgtccatcaaccacatggtgaaccacagctggggccggcagtacagccacgccctcttcaaggccatgagccacatgctgtgcatcggctacggccagcaggcccctgtgggcatgccagatgtgtggctgaccatgctgtccatgattgtgggcgccacctgctacgccatgtttattggacatgccacagccctgatccagagcctggacagcagccggcggcagtaccaggagaagtacaagcaggtggagcagtacatgtccttccacaagctgcctgctgacacccggcagagaattcatgagtactatgagcaccgctaccagggcaagatgtttgatgaggagagcatcctgggggagctgtctgagcccctgcgggaggagatcatcaacttcacctgccggggcctggtggcccacatgcccctgtttgcccacgccgaccccagctttgtgacagctgtgctgaccaagctgcgctttgaggtgttccagcccggggacctggtggtgcgggagggctctgtgggcaggaagatgtacttcatccagcacggcctgctgtctgtgctggcccggggggcccgggacacccggctgacagatggcagctactttggagagatctgcctgctgacccggggcagaagaacagcctctgtgcgggctgacacctactgccgcctgtacagcctgtctgtggaccacttcaatgctgtgctggaggagttccccatgatgagaagagcctttgagaccgtggccatggaccggctgctgagaattggcaagaagaacagcatcctgcagaggaagaggtctgagcccagccctggcagcagcggcggcatcatggagcagcacctggtgcagcacgaccgggacatggcccggggcgtgcggggccgggcccccagcactggagcccagctgagcggcaagcctgtgctgtgggagcccctggtgcacgcccccctgcaggccgctgctgtgaccagcaatgtggccatcgccctgacccaccagaggggccccctgcccctgagcccagacagccctgccaccctgctggcccggagcgcctggaggtctgctggcagccctgccagccccctggtgcctgtgcgggccggcccctgggccagcaccagccggctgcctgcccccccagcccggaccctgcacgccagcctgagccgggccggccgcagccaggtgtccctgctgggccccccacctgggggcggcggccgccgcctgggcccccggggccggcccctgagcgccagccagcccagcctgccccagagggccactggagatggcagccctggcaggaagggcagcggcagcgagcggctgccccccagcggcctgctggccaagccacccaggacagcccagccccccaggcctcctgtgcctgagcccgccaccccccggggcctgcagctgagcgccaacatgtag

SEQ ID NO: 155772 - DNA, 3612 bp, Artificial Sequence
  Description of Artificial Sequence: Synthetic coding sequence
atggacaagctgcccccatccatgaggaagaggctgtacagcctgccccagcaggtgggcgccaaggcctggatcatggatgaggaggaggatgctgaggaggagggcgccggcggccggcaggaccccagcagaagaagcatccggctgcggcccctgcccagccccagccccagcgctgctgctgggggcacagagagccgcagcagcgccctgggcgctgctgacagcgagggccctgcccggggggccggcaagagcagcaccaacggggactgccgccgcttccggggcagcctggccagcctgggcagcagaggaggcggcagcggcggcactggaagtggcagcagccacggccacctgcatgattctgctgaggagcggcggctgattgctgaaggagatgccagccctggagaggacaggaccccacctggcctggccgctgagcctgagaggcctggggccagcgcccagcctgctgccagccccccaccaccccagcagcccccccagcctgccagcgccagctgtgagcagcccagcgtggacacagccatcaaggtggagggcggcgctgctgctggggaccagatcctgcctgaggccgaggtgcggctgggccaggccggcttcatgcagaggcagtttggagccatgctgcagcccggggtgaacaagttcagcctgaggatgtttggcagccagaaggctgtggagcgggagcaggagcgggtgaagtctgctggcttctggatcatccacccctacagcgacttccgcttctactgggacctgaccatgctgctgctgatggtgggcaacctgatcatcatccctgtgggcatcaccttcttcaaggatgagaacaccaccccctggatcgtgttcaacgtggtgtctgacaccttcttcctgattgacctggtgctgaacttcagaacaggcatcgtggtggaggacaacacagagatcatcctggacccccagaggatcaagatgaagtacctgaagtcctggttcatggtggacttcatcagcagcatccctgtggactacatcttcctgattgtggagaccagaattgattctgaggtgtacaagacagcccgggccctgcgcatcgtgcgcttcaccaagatcctgagcctgctgcggctgctgcggctgagccgcctcatccgctacatccaccagtgggaggagatcttccacatgacctatgacctggccagcgctgtggtgcgcatcgtgaacctgattggcatgatgctgctgctgtgccactgggatggctgcctgcagttcctggtgcccatgctgcaggacttcccagatgactgctgggtgtccatcaacaacatggtgaacaacagctggggcaagcagtacagctatgccctcttcaaggccatgagccacatgctgtgcatcggctacggccggcaggcccctgtgggcatgtctgatgtgtggctgaccatgctgtccatgattgtgggcgccacctgctacgccatgttcatcggccacgccacagccctgatccagagcctggacagcagccggcggcagtaccaggagaagtacaagcaggtggagcagtacatgtccttccacaagctgcccccagacacccggcagagaattcatgactactatgagcaccgctaccagggcaagatgtttgatgaggagagcatcctgggggagctgtctgagcccctgcgggaggagatcatcaacttcaactgcaggaagctggtggcctccatgcccctgtttgccaatgctgaccccaactttgtgacctccatgctgaccaagctgcgctttgaggtgttccagcccggggactacatcatccgggagggcaccatcggcaagaagatgtacttcatccagcacggcgtggtgtctgtgctgaccaagggcaacaaggagaccaagctggctgatggcagctactttggagagatctgcctgctgacccggggccgcaggacagcctctgtgcgggctgacacctactgccgcctgtacagcctgtctgtggacaacttcaatgaggtgctggaggagtaccccatgatgaggcgggcctttgaaacagtggccctggaccggctggaccgcatcggcaagaagaacagcatcctgctgcacaaggtgcagcacgacctgaacagcggggtcttcaactaccaggagaatgagatcatccagcagatcgtgcagcacgaccgggagatggcccactgtgcccaccgggtgcaggccgccgccagcgccacccccacccccacccctgtgatctggacccccctcatccaggcccccctgcaggccgccgccgccaccacctctgtggccatcgccctgacccaccacccccggctgcctgctgccatcttccggcccccacctggcagcggcctgggcaacctgggcgccggccagacccccaggcacctgaagaggctgcagagcctcatccccagcgccctgggcagcgccagccctgccagcagccccagccaggtggacacccccagcagcagcagcttccacatccagcagctggccggcttcagcgccccagctggcctgagccccctgctgcccagcagcagcagcagccccccacctggggcctgtggcagccccagcgcccccacccccagcgctggggtggccgccaccaccatcgccggcttcggccacttccacaaggccctgggcggcagcctgagcagcagtgacagccccctgctgacccccctgcagcccggggcccggagcccccaggccgcccagcccagccctgcccctcctggggcccggggcggcctgggcctgcctgagcacttcctgcccccaccacccagcagccgcagccccagcagcagccctggccagctgggccagcccccaggagagctgagcctgggcctggccaccggccccctgagcaccccagagaccccaccccggcagcctgagccccccagcctggtggccggggccagcggcggggccagccctgtgggcttcaccccccggggcggcctgagccccccaggccacagccctggcccccccaggaccttccccagcgccccaccccgggccagcggcagccacggcagcctgctgctgcccccagccagcagccccccaccaccccaggtgccccagaggcggggcaccccacccctgaccccaggccgcctgacccaggacctgaagctgatcagcgccagccagcctgccctgccccaggatggagcccagaccctgcggcgggccagcccccacagcagtggagagagcatggccgccttccccctcttcccccgggccggcggcggcagcggcggcagcggcagcagcggcggcctgggccccccaggccggccctacggggccatccctggccagcacgtgaccctgcccaggaagaccagcagcggcagcctgcccccacccctgagcctgtttggagcccgggccaccagcagcggcggcccccccctgacagctggcccccagcgggagcccggggcccggcctgagcctgtgcgcagcaagctgcccagcaacctgtag

SEQ ID NO: 155773 - DNA, 396 bp, Artificial Sequence
  Description of Artificial Sequence: Synthetic coding sequence
atgaacctgcccagcaccaaggtgtcctgggccgctgtgaccctgctgctgctgctgctgctgctgcccccagccctgctgagcagtggagctgctgcccagcccctgcctgactgctgccggcagaagacctgcagctgccgcctgtatgagctgctgcacggggccggcaaccacgccgccggcatcctgaccctgggcaagagaagaagtggccccccaggcctgcagggccgcctgcagaggctgctgcaggccagcggcaaccacgccgccggcatcctgaccatgggcagaagagctggagctgagcccgccccccggccctgcctgggccgccgctgcagcgccccagctgctgcctctgtggcccctgggggccagagcggcatctag

SEQ ID NO: 155774 - DNA, 1050 bp, Artificial Sequence
  Description of Artificial Sequence: Synthetic coding sequence
atggccgccacagctgctgaggccgtggccagcggcagcggggagccccgggaggaggccggggccctgggccctgcctgggatgagagccagctgcggagctacagcttccccacccggcccatcccccggctgagccagagcgaccccagggctgaggagctgattgaaaatgaggagcctgtggtgctgacagacaccaacctggtgtacccagccctgaagtgggacctggagtacctgcaggagaacattggaaatggagacttctctgtgtacagcgccagcacccacaagttcctgtactatgatgagaagaagatggccaacttccagaacttcaagcccaggagcaaccgggaggagatgaagttccacgagtttgtggagaagctgcaggacatccagcagagaggaggagaggagcggctgtacctgcagcagaccctgaatgacacagtgggcaggaagatcgtgatggacttcctgggcttcaactggaactggatcaacaagcagcagggcaagaggggctggggccagctgaccagcaacctgctgctgattggcatggagggcaatgtgaccccagcccactatgatgagcagcagaacttctttgcccagatcaagggctacaagcgctgcatcctcttccccccagaccagtttgaatgtctgtacccctaccctgtgcaccacccctgtgaccggcagagccaggtggactttgacaacccagactatgagcgcttccccaacttccagaatgtggtgggctatgaaacagtggtgggccctggagatgtgctgtacatccccatgtactggtggcaccacatcgagagcctgctgaatggaggcatcaccatcaccgtgaacttctggtacaagggggcccccacccccaagagaattgagtaccccctgaaggcccaccagaaggtggccatcatgaggaacatcgagaagatgctgggggaggccctgggcaacccccaggaggtgggccccctgctgaacaccatgatcaagggccgctacaactag

SEQ ID NO: 155775 - DNA, 1149 bp, Artificial Sequence
  Description of Artificial Sequence: Synthetic coding sequence
atggtgtctgtgggctgtgtggtgttcctgttcttcttcttcggcgtgaggaacagaagaagcttccgcttccgctggggccccagcctggccgctgagatggccgccacagctgctgaggccgtggccagcggcagcggggagccccgggaggaggccggggccctgggccctgcctgggatgagagccagctgcggagctacagcttccccacccggcccatcccccggctgagccagagcgaccccagggctgaggagctgattgaaaatgaggagcctgtggtgctgacagacaccaacctggtgtacccagccctgaagtgggacctggagtacctgcaggagaacattggaaatggagacttctctgtgtacagcgccagcacccacaagttcctgtactatgatgagaagaagatggccaacttccagaacttcaagcccaggagcaaccgggaggagatgaagttccatgaatttgtggagaagctgcaggacatccagcagaggggcggggaggagcggctgtacctgcagcagaccctgaatgacacagtgggcaggaagatcgtgatggacttcctgggcttcaactggaactggatcaacaagcagcagggcaagaggggctggggccagctgaccagcaacctgctgctgattggcatggagggcaatgtgaccccagcccactatgatgagcagcagaacttctttgcccagatcaagggctacaagcgctgcatcctcttccccccagaccagtttgagtgcctgtacccctaccctgtgcaccacccctgtgaccggcagagccaggtggactttgacaacccagactatgagcgcttccccaacttccagaatgtggtgggctatgagaccgtggtgggccctggagatgtgctgtacatccccatgtactggtggcaccacatcgagagcctgctgaatggaggcatcaccatcaccgtgaacttctggtacaagggggcccccacccccaagagaattgagtaccccctgaaggcccaccagaaggtggccatcatgagaaatattgagaagatgctgggggaggccctgggcaacccccaggaggtgggccccctgctgaacaccatgatcaagggccgctacaactag

SEQ ID NO: 155776 - DNA, 579 bp, Artificial Sequence
  Description of Artificial Sequence: Synthetic coding sequence
atggccaacttccagaacttcaagcccaggagcaaccgggaggagatgaagttccatgaatttgtggagaagctgcaggacatccagcagaggggcggggaggagcggctgtacctgcagcagaccctgaatgacacagtgggcaggaagatcgtgatggacttcctgggcttcaactggaactggatcaacaagcagcagggcaagaggggctggggccagctgaccagcaacctgctgctgattggcatggagggcaatgtgaccccagcccactatgatgagcagcagaacttctttgcccagatcaagggctacaagcgctgcatcctcttccccccagaccagtttgagtgcctgtacccctaccctgtgcaccacccctgtgaccggcagagccaggtggactttgacaacccagactatgagcgcttccccaacttccagaatgtggtgggctatgagaccgtggtgggccctggagatgtgctgtacatccccatgtactggtggcaccacatcgagagcctgctgaatggaggcatcaccatcaccgtgaacttctggtacaagggctag

SEQ ID NO: 155777 - DNA, 1803 bp, Artificial Sequence
  Description of Artificial Sequence: Synthetic coding sequence
atgaggcctgctgctggagctgcccggcggccccgctgctgcacctcctggctgacccgctgccccagccctgctgccagcgcccccacctggacccggcccctgagctgtgccagccccagcgccacctgtgcctgcacagccagcgccccccagctggagctgattggccacagcatctttgacttcatccacccctgtgaccaggaggagctgcaggatgccctgaccccccagcagaccctgagcaggaggaaggtggaggcccccacagagcgctgcttcagcctgaggatgaagagcaccctgaccagccggggccgcaccctgaacctgaaggccgccacctggaaggtgctgaactgcagcggccacatgagggcctacaagcccccagcccagaccagccctgctggcagcccagattctgagccccccctgcagtgcctggtgctgatctgtgaggccatcccccaccctggcagcctggagccccccctgggccgcggggccttcctgagccgccacagcctggacatgaagttcacctactgtgatgacagaattgctgaggtggccggctacagcccagatgacctgattggctgcagcgcctatgagtacatccacgccctggacagtgatgctgtgtccaagagcatccacaccctgctgagcaagggccaggccgtgacaggccagtaccgcttcctggcccggagcggcggctacctgtggacccagacccaggccaccgtggtgtctgggggccggggcccccagagcgagagcatcgtgtgtgtgcacttcctgatcagccaggtggaggagaccggggtggtgctgagcctggagcagacagagcagcacagccggcggcccatccagagaggagcccccagccagaaggacacccccaaccctggggacagcctggacaccccaggcccccgcatcctggccttcctgcacccccccagcctgtctgaggccgccctggccgctgacccccggcgcttctgcagcccagacctgcggcggctgctgggccccatcctggatggagcctctgtggccgccacccccagcacccccctggccaccaggcacccccagagccccctgtctgctgacctgcctgatgagctgcctgtgggcacagaaaatgtgcacaggctcttcaccagcggcaaggacacagaggccgtggagacagacctggacatcgcccaggatgctgatgccctggacctggagatgctggccccctacatctccatggatgatgacttccagctgaatgccagcgagcagctgccccgggcctaccaccggcccctgggcgctgtgccccggccccgggcccgctccttccacggcctgagccccccagccctggagcccagcctgctgccccgctggggcagtgacccccggctgagctgcagcagccccagcagaggagaccccagcgccagcagccccatggccggggccaggaagaggaccctggcccagagcagtgaagatgaagatgagggcgtggagctgctgggcgtgcggccccccaagaggagccccagccctgagcacgagaacttcctgctcttccccctgagcctgtccttcctgctgaccggcggccctgcccctggcagcctgcaggaccccagcacccccctgctgaacctgaatgagcccctgggcctgggccccagcctgctgagcccctacagtgatgaggacaccacccagcccggcggccccttccagccccgggccggcagcgcccaggccgactag

SEQ ID NO: 155778 - DNA, 1353 bp, Artificial Sequence
  Description of Artificial Sequence: Synthetic coding sequence
atgaggcctgctgctggagctgcccggcggccccgctgctgcacctcctggctgacccgctgccccagccctgctgccagcgcccccacctggacccggcccctgagctgtgccagccccagcgccacctgtgcctgcacagccagcgccccccagctggagctgattggccacagcatctttgacttcatccacccctgtgaccaggaggagctgcaggatgccctgaccccccagcagaccctgagcaggaggaaggtggaggcccccacagagcgctgcttcagcctgaggatgaagagcaccctgaccagccggggccgcaccctgaacctgaaggccgccacctggaaggtgctgaactgcagcggccacatgagggcctacaagcccccagcccagaccagccctgctggcagcccagattctgagccccccctgcagtgcctggtgctgatctgtgaggccatcccccaccctggcagcctggagccccccctgggccgcggggccttcctgagccgccacagcctggacatgaagttcacctactgtgatgacagaattgctgaggtggccggctacagcccagatgacctgattggctgcagcgcctatgagtacatccacgccctggacagtgatgctgtgtccaagagcatccacaccctgctgagcaagggccaggccgtgacaggccagtaccgcttcctggcccggagcggcggctacctgtggacccagacccaggccaccgtggtgtctgggggccggggcccccagagcgagagcatcgtgtgtgtgcacttcctgatcagccaggtggaggagaccggggtggtgctgagcctggagcagacagagcagcacagccggcggcccatccagagaggagcccccagccagaaggacacccccaaccctggggacagcctggacaccccaggcccccgcatcctggccttcctgcacccccccagcctgtctgaggccgccctggccgctgacccccggcgcttctgcagcccagacctgcggcggctgctgggccccatcctggatggagcctctgtggccgccacccccagcacccccctggccaccaggcacccccagagccccctgtctgctgacctgcctgatgagctgcctgtgggcacagaaaatgtgcacaggctcttcaccagcggcaaggacacagaggccgtggagacagacctggacatcgcccaggaccccagcacccccctgctgaacctgaatgagcccctgggcttccactttgtgacccagagcggcgtgcagtggcacaagcacagcagcccccagccccggcccccaggcctgaagtag

SEQ ID NO: 155779 - DNA, 1899 bp, Artificial Sequence
  Description of Artificial Sequence: Synthetic coding sequence
atggccctgggcctgcagagggcccggagcaccacagagctgaggaaggagaagagcagagatgctgcccggagccgccgcagccaggagacagaggtgctgtaccagctggcccacaccctgccctttgcccggggcgtgtctgcccacctggacaaggccagcatcatgaggctgaccatctcctacctgaggatgcaccggctgtgtgccgccggggagtggaaccaggtgggcgctggaggagagcccctggatgcctgctacctgaaggccctggagggctttgtgatggtgctgacagctgagggggacatggcctacctgtctgaaaatgtgtccaagcacctgggcctgagccagctggagctgattggccacagcatctttgacttcatccacccctgtgaccaggaggagctgcaggatgccctgaccccccagcagaccctgagcaggaggaaggtggaggcccccacagagcgctgcttcagcctgaggatgaagagcaccctgaccagccggggccgcaccctgaacctgaaggccgccacctggaaggtgctgaactgcagcggccacatgagggcctacaagcccccagcccagaccagccctgctggcagcccagacagcgagccccccctgcagtgcctggtgctgatctgtgaggccatcccccaccctggcagcctggagccccccctgggccgcggggccttcctgagccgccacagcctggacatgaagttcacctactgtgatgacagaattgctgaggtggccggctacagcccagatgacctgattggctgcagcgcctatgagtacatccacgccctggacagtgatgctgtgtccaagagcatccacaccctgctgagcaagggccaggccgtgacaggccagtaccgcttcctggcccggagcggcggctacctgtggacccagacccaggccaccgtggtgtctgggggccggggcccccagagcgagagcatcgtgtgtgtgcacttcctgatcagccaggtggaggagactggagtggtgctgagcctggagcagacagagcagcacagcagaagacccatccagagaggagcccccagccagaaggacacccccaaccctggggacagcctggacaccccaggcccccgcatcctggccttcctgcacccccccagcctgtctgaggccgccctggccgctgacccccggcgcttctgcagcccagacctgcggcggctgctgggccccatcctggatggagcctctgtggccgccacccccagcacccccctggccaccaggcacccccagagccccctgtctgctgacctgcctgatgagctgcctgtgggcacagaaaatgtgcacaggctcttcaccagcggcaaggacacagaagctgtggagacagacctggacatcgcccaggatgctgatgccctggacctggagatgctggccccctacatctccatggatgatgacttccagctgaatgccagcgagcagctgccccgggcctaccaccggcccctgggcgctgtgccccggccccgggcccggagcttccacggcctgagccccccagccctggagcccagcctgctgccccgctggggcagtgacccccggctgagctgcagcagccccagcagaggagaccccagcgccagcagccccatggccggggccaggaagaggaccctggcccagagcagtgaagatgaagatgaaggagtggagctgctgggcgtgcggccccccaagaggagccccagccctgagcacgagaacttcctgctcttccccctgagcctggtgtgctggggcatcaatggcatcctgtggcccagcctgcccagctggctgaagcccaccgtgctgtag

SEQ ID NO: 155780 - DNA, 1731 bp, Artificial Sequence
  Description of Artificial Sequence: Synthetic coding sequence
atgaggctgaccatctcctacctgaggatgcaccggctgtgtgccgccggggagtggaaccaggtgggcgctggaggagagcccctggatgcctgctacctgaaggccctggagggctttgtgatggtgctgacagctgagggggacatggcctacctgtctgaaaatgtgtccaagcacctgggcctgagccagctggagctgattggccacagcatctttgacttcatccacccctgtgaccaggaggagctgcaggatgccctgaccccccagcagaccctgagcaggaggaaggtggaggcccccacagagcgctgcttcagcctgaggatgaagagcaccctgaccagccggggccgcaccctgaacctgaaggccgccacctggaaggtgctgaactgcagcggccacatgagggcctacaagcccccagcccagaccagccctgctggcagcccagacagcgagccccccctgcagtgcctggtgctgatctgtgaggccatcccccaccctggcagcctggagccccccctgggccgcggggccttcctgagccgccacagcctggacatgaagttcacctactgtgatgacagaattgctgaggtggccggctacagcccagatgacctgattggctgcagcgcctatgagtacatccacgccctggacagtgatgctgtgtccaagagcatccacaccctgctgagcaagggccaggccgtgacaggccagtaccgcttcctggcccggagcggcggctacctgtggacccagacccaggccaccgtggtgtctgggggccggggcccccagagcgagagcatcgtgtgtgtgcacttcctgatcagccaggtggaggagactggagtggtgctgagcctggagcagacagagcagcacagcagaagacccatccagagaggagcccccagccagaaggacacccccaaccctggggacagcctggacaccccaggcccccgcatcctggccttcctgcacccccccagcctgtctgaggccgccctggccgctgacccccggcgcttctgcagcccagacctgcggcggctgctgggccccatcctggatggagcctctgtggccgccacccccagcacccccctggccaccaggcacccccagagccccctgtctgctgacctgcctgatgagctgcctgtgggcacagaaaatgtgcacaggctcttcaccagcggcaaggacacagaagctgtggagacagacctggacatcgcccaggatgctgatgccctggacctggagatgctggccccctacatctccatggatgatgacttccagctgaatgccagcgagcagctgccccgggcctaccaccggcccctgggcgctgtgccccggccccgggcccggagcttccacggcctgagccccccagccctggagcccagcctgctgccccgctggggcagtgacccccggctgagctgcagcagccccagcagaggagaccccagcgccagcagccccatggccggggccaggaagaggaccctggcccagagcagtgaagatgaagatgaaggagtggagctgctgggcgtgcggccccccaagaggagccccagccctgagcacgagaacttcctgctcttccccctgagcctggtgtgctggggcatcaatggcatcctgtggcccagcctgcccagctggctgaagcccaccgtgctgtag

SEQ ID NO: 155781 - DNA, 2004 bp, Artificial Sequence
  Description of Artificial Sequence: Synthetic coding sequence
atggactggcaggaccacaggagcaccacagagctgaggaaggagaagagcagagatgctgcccggagccgccgcagccaggagacagaggtgctgtaccagctggcccacaccctgccctttgcccggggcgtgtctgcccacctggacaaggccagcatcatgaggctgaccatctcctacctgaggatgcaccggctgtgtgccgccggggagtggaaccaggtgggcgctggaggagagcccctggatgcctgctacctgaaggccctggagggctttgtgatggtgctgacagctgagggggacatggcctacctgtctgaaaatgtgtccaagcacctgggcctgagccagctggagctgattggccacagcatctttgacttcatccacccctgtgaccaggaggagctgcaggatgccctgaccccccagcagaccctgagcaggaggaaggtggaggcccccacagagcgctgcttcagcctgaggatgaagagcaccctgaccagccggggccgcaccctgaacctgaaggccgccacctggaaggtgctgaactgcagcggccacatgagggcctacaagcccccagcccagaccagccctgctggcagcccagacagcgagccccccctgcagtgcctggtgctgatctgtgaggccatcccccaccctggcagcctggagccccccctgggccgcggggccttcctgagccgccacagcctggacatgaagttcacctactgtgatgacagaattgctgaggtggccggctacagcccagatgacctgattggctgcagcgcctatgagtacatccacgccctggacagtgatgctgtgtccaagagcatccacaccctgctgagcaagggccaggccgtgacaggccagtaccgcttcctggcccggagcggcggctacctgtggacccagacccaggccaccgtggtgtctgggggccggggcccccagagcgagagcatcgtgtgtgtgcacttcctgatcagccaggtggaggagactggagtggtgctgagcctggagcagacagagcagcacagcagaagacccatccagagaggagcccccagccagaaggacacccccaaccctggggacagcctggacaccccaggcccccgcatcctggccttcctgcacccccccagcctgtctgaggccgccctggccgctgacccccggcgcttctgcagcccagacctgcggcggctgctgggccccatcctggatggagcctctgtggccgccacccccagcacccccctggccaccaggcacccccagagccccctgtctgctgacctgcctgatgagctgcctgtgggcacagaaaatgtgcacaggctcttcaccagcggcaaggacacagaagctgtggagacagacctggacatcgcccaggatgctgatgccctggacctggagatgctggccccctacatctccatggatgatgacttccagctgaatgccagcgagcagctgccccgggcctaccaccggcccctgggcgctgtgccccggccccgggcccggagcttccacggcctgagccccccagccctggagcccagcctgctgccccgctggggcagtgacccccggctgagctgcagcagccccagcagaggagaccccagcgccagcagccccatggccggggccaggaagaggaccctggcccagagcagtgaagatgaagatgaaggagtggagctgctgggcgtgcggccccccaagaggagccccagccctgagcacgagaacttcctgctcttccccctgagcctgtccttcctgctgactggaggccctgcccctggcagcctgcaggaccccagcacccccctgctgaacctgaatgagcccctgggcctgggccccagcctgctgagcccctacagtgatgaggacaccacccagcccggcggccccttccagcccagggctggcagcgcccaggccgactag

SEQ ID NO: 155782 - DNA, 1842 bp, Artificial Sequence
  Description of Artificial Sequence: Synthetic coding sequence
atgaggctgaccatctcctacctgaggatgcaccggctgtgtgccgccggggagtggaaccaggtgggcgctggaggagagcccctggatgcctgctacctgaaggccctggagggctttgtgatggtgctgacagctgagggggacatggcctacctgtctgaaaatgtgtccaagcacctgggcctgagccagctggagctgattggccacagcatctttgacttcatccacccctgtgaccaggaggagctgcaggatgccctgaccccccagcagaccctgagcaggaggaaggtggaggcccccacagagcgctgcttcagcctgaggatgaagagcaccctgaccagccggggccgcaccctgaacctgaaggccgccacctggaaggtgctgaactgcagcggccacatgagggcctacaagcccccagcccagaccagccctgctggcagcccagacagcgagccccccctgcagtgcctggtgctgatctgtgaggccatcccccaccctggcagcctggagccccccctgggccgcggggccttcctgagccgccacagcctggacatgaagttcacctactgtgatgacagaattgctgaggtggccggctacagcccagatgacctgattggctgcagcgcctatgagtacatccacgccctggacagtgatgctgtgtccaagagcatccacaccctgctgagcaagggccaggccgtgacaggccagtaccgcttcctggcccggagcggcggctacctgtggacccagacccaggccaccgtggtgtctgggggccggggcccccagagcgagagcatcgtgtgtgtgcacttcctgatcagccaggtggaggagactggagtggtgctgagcctggagcagacagagcagcacagcagaagacccatccagagaggagcccccagccagaaggacacccccaaccctggggacagcctggacaccccaggcccccgcatcctggccttcctgcacccccccagcctgtctgaggccgccctggccgctgacccccggcgcttctgcagcccagacctgcggcggctgctgggccccatcctggatggagcctctgtggccgccacccccagcacccccctggccaccaggcacccccagagccccctgtctgctgacctgcctgatgagctgcctgtgggcacagaaaatgtgcacaggctcttcaccagcggcaaggacacagaagctgtggagacagacctggacatcgcccaggatgctgatgccctggacctggagatgctggccccctacatctccatggatgatgacttccagctgaatgccagcgagcagctgccccgggcctaccaccggcccctgggcgctgtgccccggccccgggcccggagcttccacggcctgagccccccagccctggagcccagcctgctgccccgctggggcagtgacccccggctgagctgcagcagccccagcagaggagaccccagcgccagcagccccatggccggggccaggaagaggaccctggcccagagcagtgaagatgaagatgaaggagtggagctgctgggcgtgcggccccccaagaggagccccagccctgagcacgagaacttcctgctcttccccctgagcctgtccttcctgctgactggaggccctgcccctggcagcctgcaggaccccagcacccccctgctgaacctgaatgagcccctgggcctgggccccagcctgctgagcccctacagtgatgaggacaccacccagcccggcggccccttccagcccagggctggcagcgcccaggccgactag

SEQ ID NO: 155783 - DNA, 2010 bp, Artificial Sequence
  Description of Artificial Sequence: Synthetic coding sequence
atggccctgggcctgcagagggcccggagcaccacagagctgaggaaggagaagagcagagatgctgcccggagccgccgcagccaggagacagaggtgctgtaccagctggcccacaccctgccctttgcccggggcgtgtctgcccacctggacaaggccagcatcatgaggctgaccatctcctacctgaggatgcaccggctgtgtgccgccggggagtggaaccaggtgggcgctggaggagagcccctggatgcctgctacctgaaggccctggagggctttgtgatggtgctgacagctgagggggacatggcctacctgtctgaaaatgtgtccaagcacctgggcctgagccagctggagctgattggccacagcatctttgacttcatccacccctgtgaccaggaggagctgcaggatgccctgaccccccagcagaccctgagcaggaggaaggtggaggcccccacagagcgctgcttcagcctgaggatgaagagcaccctgaccagccggggccgcaccctgaacctgaaggccgccacctggaaggtgctgaactgcagcggccacatgagggcctacaagcccccagcccagaccagccctgctggcagcccagacagcgagccccccctgcagtgcctggtgctgatctgtgaggccatcccccaccctggcagcctggagccccccctgggccgcggggccttcctgagccgccacagcctggacatgaagttcacctactgtgatgacagaattgctgaggtggccggctacagcccagatgacctgattggctgcagcgcctatgagtacatccacgccctggacagtgatgctgtgtccaagagcatccacaccctgctgagcaagggccaggccgtgacaggccagtaccgcttcctggcccggagcggcggctacctgtggacccagacccaggccaccgtggtgtctgggggccggggcccccagagcgagagcatcgtgtgtgtgcacttcctgatcagccaggtggaggagactggagtggtgctgagcctggagcagacagagcagcacagcagaagacccatccagagaggagcccccagccagaaggacacccccaaccctggggacagcctggacaccccaggcccccgcatcctggccttcctgcacccccccagcctgtctgaggccgccctggccgctgacccccggcgcttctgcagcccagacctgcggcggctgctgggccccatcctggatggagcctctgtggccgccacccccagcacccccctggccaccaggcacccccagagccccctgtctgctgacctgcctgatgagctgcctgtgggcacagaaaatgtgcacaggctcttcaccagcggcaaggacacagaagctgtggagacagacctggacatcgcccaggatgctgatgccctggacctggagatgctggccccctacatctccatggatgatgacttccagctgaatgccagcgagcagctgccccgggcctaccaccggcccctgggcgctgtgccccggccccgggcccggagcttccacggcctgagccccccagccctggagcccagcctgctgccccgctggggcagtgacccccggctgagctgcagcagccccagcagaggagaccccagcgccagcagccccatggccggggccaggaagaggaccctggcccagagcagtgaagatgaagatgaaggagtggagctgctgggcgtgcggccccccaagaggagccccagccctgagcacgagaacttcctgctcttccccctgagcctgtccttcctgctgactggaggccctgcccctggcagcctgcaggaccccagcacccccctgctgaacctgaatgagcccctgggcctgggccccagcctgctgagcccctacagtgatgaggacaccacccagcccggcggccccttccagcccagggctggcagcgcccaggccgactag

SEQ ID NO: 155784 - DNA, 1092 bp, Artificial Sequence
  Description of Artificial Sequence: Synthetic coding sequence
atggccctgggcctgcagagggcccggagcaccacagagctgaggaaggagaagagcagagatgctgcccggagccgccgcagccaggagacagaggtgctgtaccagctggcccacaccctgccctttgcccggggcgtgtctgcccacctggacaaggccagcatcatgaggctgaccatctcctacctgaggatgcaccggctgtgtgccgccggggagtggaaccaggtgggcgctggaggagagcccctggatgcctgctacctgaaggccctggagggctttgtgatggtgctgacagctgagggggacatggcctacctgtctgaaaatgtgtccaagcacctgggcctgagccagctggagctgattggccacagcatctttgacttcatccacccctgtgaccaggaggagctgcaggatgccctgaccccccagcagaccctgagcaggaggaaggtggaggcccccacagagcgctgcttcagcctgaggatgaagagcaccctgaccagccggggccgcaccctgaacctgaaggccgccacctggaaggtgctgaactgcagcggccacatgagggcctacaagcccccagcccagaccagccctgctggcagcccagacagcgagccccccctgcagtgcctggtgctgatctgtgaggccatcccccaccctggcagcctggagccccccctgggccgcggggccttcctgagccgccacagcctggacatgaagttcacctactgtgatgacagaattgctgaggtggccggctacagcccagatgacctgattggctgcagcgcctatgagtacatccacgccctggacagtgatgctgtgtccaagagcatccacacctgcatgtaccccatcagccctggggccaagccagctgccacctggcccccagctgacaccaggaccccccagctgcccatcccccaggatgccctgcccccccacctgaacaccagcagcctgctgcccaagccccagggcaccgtgtccttcctggcccccagctaccctgtgccccgctacttcagcccccacctgcccccctggtggccctag

SEQ ID NO: 155785 - DNA, 1839 bp, Artificial Sequence
  Description of Artificial Sequence: Synthetic coding sequence
atgctgcccatgcccagcggccggcccaggagctgtgccaggaagagccctggcatgaggcctgctgctggagctgcccggcggccccgctgctgcacctcctggctgacccgctgccccagccctgctgccagcgcccccacctggacccggcccctgagctgtgccagccccagcgccacctgtgcctgcacagccagcgccccccagctggagctgattggccacagcatctttgacttcatccacccctgtgaccaggaggagctgcaggatgccctgaccccccagcagaccctgagcaggaggaaggtggaggcccccacagagcgctgcttcagcctgaggatgaagagcaccctgaccagccggggccgcaccctgaacctgaaggccgccacctggaaggtgctgaactgcagcggccacatgagggcctacaagcccccagcccagaccagccctgctggcagcccagattctgagccccccctgcagtgcctggtgctgatctgtgaggccatcccccaccctggcagcctggagccccccctgggccgcggggccttcctgagccgccacagcctggacatgaagttcacctactgtgatgacagaattgctgaggtggccggctacagcccagatgacctgattggctgcagcgcctatgagtacatccacgccctggacagtgatgctgtgtccaagagcatccacaccctgctgagcaagggccaggccgtgacaggccagtaccgcttcctggcccggagcggcggctacctgtggacccagacccaggccaccgtggtgtctgggggccggggcccccagagcgagagcatcgtgtgtgtgcacttcctgatcagccaggtggaggagaccggggtggtgctgagcctggagcagacagagcagcacagccggcggcccatccagagaggagcccccagccagaaggacacccccaaccctggggacagcctggacaccccaggcccccgcatcctggccttcctgcacccccccagcctgtctgaggccgccctggccgctgacccccggcgcttctgcagcccagacctgcggcggctgctgggccccatcctggatggagcctctgtggccgccacccccagcacccccctggccaccaggcacccccagagccccctgtctgctgacctgcctgatgagctgcctgtgggcacagaaaatgtgcacaggctcttcaccagcggcaaggacacagaggccgtggagacagacctggacatcgcccaggatgctgatgccctggacctggagatgctggccccctacatctccatggatgatgacttccagctgaatgccagcgagcagctgccccgggcctaccaccggcccctgggcgctgtgccccggccccgggcccgctccttccacggcctgagccccccagccctggagcccagcctgctgccccgctggggcagtgacccccggctgagctgcagcagccccagcagaggagaccccagcgccagcagccccatggccggggccaggaagaggaccctggcccagagcagtgaagatgaagatgagggcgtggagctgctgggcgtgcggccccccaagaggagccccagccctgagcacgagaacttcctgctcttccccctgagcctgtccttcctgctgaccggcggccctgcccctggcagcctgcaggaccccagcacccccctgctgaacctgaatgagcccctgggcttccactttgtgacccagagcggcgtgcagtggcacaagcacagcagcccccagccccggcccccaggcctgaagtag

SEQ ID NO: 155786 - DNA, 600 bp, Artificial Sequence
  Description of Artificial Sequence: Synthetic coding sequence
atgaggcctgctgctggagctgcccggcggccccgctgctgcacctcctggctgacccgctgccccagccctgctgccagcgcccccacctggacccggcccctgagctgtgccagccccagcgccacctgtgcctgcacagccagcgccccccagctggagctgattggccacagcatctttgacttcatccacccctgtgaccaggaggagctgcaggatgccctgaccccccagcagaccctgagcaggaggaaggtggaggcccccacagagcgctgcttcagcctgaggatgaagagcaccctgaccagccggggccgcaccctgaacctgaaggccgccacctggaaggtgctgaactgcagcggccacatgagggcctacaagcccccagcccagaccagccctgctggcagcccagattctgagccccccctgcagtgcctggtgctgatctgtgaggccatcccccaccctggcagcctggagccccccctgggccgcggggccttcctgagccgccacagcctggacatgaagttcacctactgtgatgacagaattgctgaggtggccggctacagccccatgacctag

SEQ ID NO: 155787 - DNA, 714 bp, Artificial Sequence
  Description of Artificial Sequence: Synthetic coding sequence
atgaggcctgctgctggagctgcccggcggccccgctgctgcacctcctggctgacccgctgccccagccctgctgccagcgcccccacctggacccggcccctgagctgtgccagccccagcgccacctgtgcctgcacagccagcgccccccaggaggagctgcaggatgccctgaccccccagcagaccctgagcaggaggaaggtggaggcccccacagagcgctgcttcagcctgaggatgaagagcaccctgaccagccggggccgcaccctgaacctgaaggccgccacctggaaggtgctgaactgcagcggccacatgagggcctacaagcccccagcccagaccagccctgctggcagcccagacagcgagccccccctgcagtgcctggtgctgatctgtgaggccatcccccaccctggcagcctggagagatttgtgcctgtgagcagcgctgccaccagcctgtgcctgcccagcctgagccccagcaaggtggccggctacagcccagatgacctgattggctgcagcgcctatgagtacatccacgccctggacagtgatgccccccaggatgccctgcccccccacctgaacaccagcagcctgctgcccaagccccagggcaccgtgtccttcctggcccccagctaccctgtgccccgctacttcagcccccacctgcccccctggtggccctag

SEQ ID NO: 155788 - DNA, 1092 bp, Artificial Sequence; identical to SEQ ID NO: 155784
  Description of Artificial Sequence: Synthetic coding sequence

SEQ ID NO: 155789 - DNA, 2976 bp, Artificial Sequence
  Description of Artificial Sequence: Synthetic coding sequence
atggctgacaaggtgcggcggcagaggccccggcggcgggtgtgctgggccctggtggccgtgctgctggccgacctgctggccctgagtgacaccctggccgtgatgtctgtggacctgggcagcgagagcatgaaggtggccatcgtgctgaacaaggagagcaggaggaagacccctgtgattgtgaccctgaaggaaaatgaacgcttcttcggggacagcgctgcctccatggccatcaagaaccccaaggccaccctgcgctacttccagcacctgctgggcaagcaggccgacaacccccacgtggccctgtaccaggcccgcttccctgagcacgagctgacctttgacccccagaggcagacagtgcacttccagatcagcagccagctgcagttcagccctgaggaggtgctgggcatggtgctgaactacagccgcagcctggctgaagattttgctgagcagcccatcaaggatgctgtgatcaccgtgcctgtgttcttcaaccaggccgagcggcgggctgtgctgcaggccgccaggatggccggcctgaaggtgctgcagctgatcaatgacaacacagccacagccctgtcctatggagtcttccggaggaaggacatcaacaccacagcccagaacatcatgttttatgacatgggcagcggcagcacagtgtgcaccatcgtgacctaccagatggtgaagaccaaggaggccggcatgcagccccagctgcagatccggggcgtgggctttgacaggaccctgggcggcctggagatggagctgcggctgcgggagcggctggccggcctcttcaatgagcagaggaagggccagagggccaaggatgtgcgggagaacccccgggccatggccaagctgctgcgggaggccaaccggctgaagacagtgctgagcgccaatgctgaccacatggcccagatcgagggcctgatggatgatgtggacttcaaggccaaggtgaccagggtggagtttgaggagctgtgtgccgacctgtttgagcgggtgcccggccctgtgcagcaggccctgcagagcgctgagatgagcctggatgaaattgagcaggtgatcctggtgggcggggccaccagggtgccccgggtgcaggaggtgctgctgaaggctgtgggcaaggaggagctgggcaagaacatcaatgctgatgaagctgctgccatgggcgctgtgtaccaggccgccgccctgagcaaggccttcaaggtgaagccctttgtggtgagagatgctgtggtgtaccccatcctggtggagttcacccgggaggtggaggaggagcccggcatccacagcctgaagcacaacaagagggtgctcttcagcaggatgggcccctacccccagaggaaggtgatcaccttcaaccgctacagccatgacttcaacttccacatcaactacggggacctgggcttcctgggccctgaggacctgcgggtgtttggcagccagaacctgaccaccgtgaagctgaagggcgtgggggacagcttcaagaagtacccagactatgagagcaagggcatcaaggcccacttcaacctggatgaaagtggagtgctgagcctggacagagtggagagcgtgtttgagaccctggtggaggacagcgctgaggaggagagcaccctgaccaagctgggcaacaccatcagcagcctgtttggaggcggcaccaccccagatgccaaggaaaatggaacagacacagtgcaggaggaggaggagagccctgctgagggcagcaaggatgagcctggagagcaggtggagctgaaggaggaggccgaggcccctgtggaggatggcagccagcccccacctcctgagcccaagggagatgccaccccagagggggagaaggccacagagaaggaaaatggagacaagtctgaggcccagaagcccagcgagaaggccgaggccggccctgagggcgtggccccagcccctgagggggagaagaagcagaagccagccaggaagaggaggatggtggaggagattggagtggagctggtggtgctggacctgcctgacctgcctgaggacaagctggcccagagcgtgcagaagctgcaggacctgaccctgcgggacctggagaagcaggagcgggagaaggccgccaacagcctggaggccttcatctttgagacccaggacaagctgtaccagcctgagtaccaggaggtgtccacagaggagcagcgggaggagatcagcggcaagctgtctgctgccagcacctggctggaggatgaaggagtgggcgccaccaccgtgatgctgaaggagaagctggccgagctgaggaagctgtgccagggcctcttcttccgggtggaggagaggaagaagtggccagagcggctgagcgccctggacaacctgctgaaccacagctccatgttcctgaagggggcccggctcatccctgagatggaccagatcttcacagaggtggagatgaccaccctggagaaggtgatcaatgagacctgggcctggaagaatgccaccctggccgagcaggccaagctgcctgccacagagaagcctgtgctgctgagcaaggacatcgaggccaagatgatggccctggaccgggaggtgcagtacctgctgaacaaggccaagttcaccaagccccggccccggcccaaggacaagaatggcaccagggctgagccccccctgaatgccagcgccagtgaccagggcgagaaggtgatccccccagctggccagacagaagatgctgagcccatcagcgagcctgagaaggtggagacagctggcagcgagcccggggacacagagcccctggagctgggcggccctggagctgagcctgagcagaaggagcagagcacaggccagaagaggcccctgaagaatgatgagctgtag

SEQ ID NO: 155790 - DNA, 3000 bp, Artificial Sequence
  Description of Artificial Sequence: Synthetic coding sequence
atggctgacaaggtgcggcggcagaggccccggcggcgggtgtgctgggccctggtggccgtgctgctggccgacctgctggccctgagtgacaccctggccgtgatgtctgtggacctgggcagcgagagcatgaaggtggccatcgtgaagccaggagtgcccatggagatcgtgctgaacaaggagagcaggaggaagacccctgtgattgtgaccctgaaggaaaatgaacgcttctttggagacagcgctgcctccatggccatcaagaaccccaaggccaccctgcgctacttccagcacctgctgggcaagcaggccgacaacccccacgtggccctgtaccaggcccgcttccctgagcacgagctgacctttgacccccagaggcagacagtgcacttccagatcagcagccagctgcagttcagccctgaggaggtgctgggcatggtgctgaactacagccgcagcctggccgaggactttgctgagcagcccatcaaggatgctgtgatcaccgtgcctgtgttcttcaaccaggccgagaggagagctgtgctgcaggccgccaggatggccggcctgaaggtgctgcagctgatcaatgacaacacagccacagccctgtcctatggagtcttccggaggaaggacatcaacaccacagcccagaacatcatgttttatgacatgggcagcggcagcacagtgtgcaccatcgtgacctaccagatggtgaagaccaaggaggccggcatgcagccccagctgcagatccggggcgtgggctttgacaggaccctgggcggcctggagatggagctgcggctgcgggagcggctggccggcctcttcaatgagcagaggaagggccagagggccaaggatgtgcgggagaacccccgggccatggccaagctgctgcgggaggccaaccggctgaagacagtgctgagcgccaatgctgaccacatggcccagatcgagggcctgatggatgatgtggacttcaaggccaaggtgaccagggtggagtttgaggagctgtgtgccgacctgtttgagcgggtgcccggccctgtgcagcaggccctgcagagcgctgagatgagcctggatgaaattgagcaggtgatcctggtgggcggggccaccagggtgccccgggtgcaggaggtgctgctgaaggctgtgggcaaggaggagctgggcaagaacatcaatgctgatgaggccgccgccatgggcgctgtgtaccaggccgccgccctgagcaaggccttcaaggtgaagccctttgtggtgagagatgctgtggtgtaccccatcctggtggagttcacccgggaggtggaggaggagcccggcatccacagcctgaagcacaacaagagggtgctcttcagcaggatgggcccctacccccagaggaaggtgatcaccttcaaccgctacagccatgacttcaacttccacatcaactatggagacctgggcttcctgggccctgaggacctgcgggtgtttggcagccagaacctgaccaccgtgaagctgaagggcgtgggggacagcttcaagaagtacccagactatgagagcaagggcatcaaggcccacttcaacctggatgagagcggcgtgctgagcctggacagagtggagagcgtgtttgagaccctggtggaggacagcgctgaggaggagagcaccctgaccaagctgggcaacaccatcagcagcctgtttggaggcggcaccaccccagatgccaaggaaaatggaacagacacagtgcaggaggaggaggagagccctgctgagggcagcaaggatgagcccggggagcaggtggagctgaaggaggaggccgaggcccctgtggaggatggcagccagcccccacctcctgagcccaagggagatgccaccccagagggggagaaggccacagagaaggaaaatggagacaagtctgaggcccagaagcccagcgagaaggccgaggccggccctgagggcgtggccccagcccctgagggggagaagaagcagaagccagccaggaagaggaggatggtggaggagattggagtggagctggtggtgctggacctgcctgacctgcctgaggacaagctggcccagagcgtgcagaagctgcaggacctgaccctgcgggacctggagaagcaggagcgggagaaggccgccaacagcctggaggccttcatctttgagacccaggacaagctgtaccagcctgagtaccaggaggtgtccacagaggagcagcgggaggagatcagcggcaagctgtctgctgccagcacctggctggaggatgagggcgtgggcgccaccaccgtgatgctgaaggagaagctggccgagctgaggaagctgtgccagggcctcttcttccgggtggaggagaggaagaagtggccagagcggctgagcgccctggacaacctgctgaaccacagctccatgttcctgaagggggcccggctcatccctgagatggaccagatcttcacagaggtggagatgaccaccctggagaaggtgatcaatgagacctgggcctggaagaatgccaccctggccgagcaggccaagctgcctgccacagagaagcctgtgctgctgagcaaggacatcgaggccaagatgatggccctggaccgggaggtgcagtacctgctgaacaaggccaagttcaccaagccccggccccggcccaaggacaagaatggcaccagggctgagccccccctgaatgccagcgccagtgaccagggcgagaaggtgattcctcctgctggccagacagaagatgctgagcccatcagcgagcctgagaaggtggagaccggcagcgagcccggggacacagagcccctggagctgggcggccctggagctgagcctgagcagaaggagcagagcacaggccagaagaggcccctgaagaatgatgagctgtag

SEQ ID NO: 155791 - DNA, 2547 bp, Artificial Sequence
  Description of Artificial Sequence: Synthetic coding sequence
atggtgctgaactacagccgcagcctggctgaagattttgctgagcagcccatcaaggatgctgtgatcaccgtgcctgtgttcttcaaccaggccgagcggcgggctgtgctgcaggccgccaggatggccggcctgaaggtgctgcagctgatcaatgacaacacagccacagccctgtcctatggagtcttccggaggaaggacatcaacaccacagcccagaacatcatgttttatgacatgggcagcggcagcacagtgtgcaccatcgtgacctaccagatggtgaagaccaaggaggccggcatgcagccccagctgcagatccggggcgtgggctttgacaggaccctgggcggcctggagatggagctgcggctgcgggagcggctggccggcctcttcaatgagcagaggaagggccagagggccaaggatgtgcgggagaacccccgggccatggccaagctgctgcgggaggccaaccggctgaagacagtgctgagcgccaatgctgaccacatggcccagatcgagggcctgatggatgatgtggacttcaaggccaaggtgaccagggtggagtttgaggagctgtgtgccgacctgtttgagcgggtgcccggccctgtgcagcaggccctgcagagcgctgagatgagcctggatgaaattgagcaggtgatcctggtgggcggggccaccagggtgccccgggtgcaggaggtgctgctgaaggctgtgggcaaggaggagctgggcaagaacatcaatgctgatgaagctgctgccatgggcgctgtgtaccaggccgccgccctgagcaaggccttcaaggtgaagccctttgtggtgagagatgctgtggtgtaccccatcctggtggagttcacccgggaggtggaggaggagcccggcatccacagcctgaagcacaacaagagggtgctcttcagcaggatgggcccctacccccagaggaaggtgatcaccttcaaccgctacagccatgacttcaacttccacatcaactacggggacctgggcttcctgggccctgaggacctgcgggtgtttggcagccagaacctgaccaccgtgaagctgaagggcgtgggggacagcttcaagaagtacccagactatgagagcaagggcatcaaggcccacttcaacctggatgaaagtggagtgctgagcctggacagagtggagagcgtgtttgagaccctggtggaggacagcgctgaggaggagagcaccctgaccaagctgggcaacaccatcagcagcctgtttggaggcggcaccaccccagatgccaaggaaaatggaacagacacagtgcaggaggaggaggagagccctgctgagggcagcaaggatgagcctggagagcaggtggagctgaaggaggaggccgaggcccctgtggaggatggcagccagcccccacctcctgagcccaagggagatgccaccccagagggggagaaggccacagagaaggaaaatggagacaagtctgaggcccagaagcccagcgagaaggccgaggccggccctgagggcgtggccccagcccctgagggggagaagaagcagaagccagccaggaagaggaggatggtggaggagattggagtggagctggtggtgctggacctgcctgacctgcctgaggacaagctggcccagagcgtgcagaagctgcaggacctgaccctgcgggacctggagaagcaggagcgggagaaggccgccaacagcctggaggccttcatctttgagacccaggacaagctgtaccagcctgagtaccaggaggtgtccacagaggagcagcgggaggagatcagcggcaagctgtctgctgccagcacctggctggaggatgaaggagtgggcgccaccaccgtgatgctgaaggagaagctggccgagctgaggaagctgtgccagggcctcttcttccgggtggaggagaggaagaagtggccagagcggctgagcgccctggacaacctgctgaaccacagctccatgttcctgaagggggcccggctcatccctgagatggaccagatcttcacagaggtggagatgaccaccctggagaaggtgatcaatgagacctgggcctggaagaatgccaccctggccgagcaggccaagctgcctgccacagagaagcctgtgctgctgagcaaggacatcgaggccaagatgatggccctggaccgggaggtgcagtacctgctgaacaaggccaagttcaccaagccccggccccggcccaaggacaagaatggcaccagggctgagccccccctgaatgccagcgccagtgaccagggcgagaaggtgatccccccagctggccagacagaagatgctgagcccatcagcgagcctgagaaggtggagactggaagtgagcccggggacacagagcccctggagctgggcggccctggagctgagcctgagcagaaggagcagagcacaggccagaagaggcccctgaagaatgatgagctgtag

SEQ ID NO: 155792 - DNA, 2040 bp, Artificial Sequence
  Description of Artificial Sequence: Synthetic coding sequence
atggctgacaaggtgcggcggcagaggccccggcggcgggtgtgctgggccctggtggccgtgctgctggccgacctgctggccctgagtgacaccctggccgtgatgtctgtggacctgggcagcgagagcatgaaggtggccatcgtgaagccaggagtgcccatggagatcgtgctgaacaaggagagcaggaggaagacccctgtgattgtgaccctgaaggaaaatgaacgcttctttggagacagcgctgcctccatggccatcaagaaccccaaggccaccctgcgctacttccagcacctgctgggcaagcaggccgacaacccccacgtggccctgtaccaggcccgcttccctgagcacgagctgacctttgacccccagaggcagacagtgcacttccagatcagcagccagctgcagttcagccctgaggaggtgctgggcatggtgctgaactacagccgcagcctggccgaggactttgctgagcagcccatcaaggatgctgtgatcaccgtgcctgtgttcttcaaccaggccgagaggagagctgtgctgcaggccgccaggatggccggcctgaaggtgctgcagctgatcaatgacaacacagccacagccctgtcctatggagtcttccggaggaaggacatcaacaccacagcccagaacatcatgttttatgacatgggcagcggcagcacagtgtgcaccatcgtgacctaccagatggtgaagaccaaggaggccggcatgcagccccagctgcagatccggggcgtgggctttgacaggaccctgggcggcctggagatggagctgcggctgcgggagcggctggccggcctcttcaatgagcagaggaagggccagagggccaaggatgtgcgggagaacccccgggccatggccaagctgctgcgggaggccaaccggctgaagacagtgctgagcgccaatgctgaccacatggcccagatcgagggcctgatggatgatgtggacttcaaggccaaggtgaccagggtggagtttgaggagctgtgtgccgacctgtttgagcgggtgcccggccctgtgcagcaggccctgcagagcgctgagatgagcctggatgaaattgagcaggtgatcctggtgggcggggccaccagggtgccccgggtgcaggaggtgctgctgaaggctgtgggcaaggaggagctgggcaagaacatcaatgctgatgaggccgccgccatgggcgctgtgtaccaggccgccgccctgagcaaggccttcaaggtgaagccctttgtggtgagagatgctgtggtgtaccccatcctggtggagttcacccgggaggtggaggaggagcccggcatccacagcctgaagcacaacaagagggtgctcttcagcaggatgggcccctacccccagaggaaggtgatcaccttcaaccgctacagccatgacttcaacttccacatcaactatggagacctgggcttcctgggccctgaggacctgcgggtgtttggcagccagaacctgaccaccgtgaagctgaagggcgtgggggacagcttcaagaagtacccagactatgagagcaagggcatcaaggcccacttcaacctggatgagagcggcgtgctgagcctggacagagtggagagcgtgtttgagaccctggtggaggacagcgctgaggaggagagcaccctgaccaagctgggcaacaccatcagcagcctgtttggaggcggcaccaccccagatgccaaggaaaatggaacagacacagtgcaggaggaggaggagagccctgctgagggcagcaaggatgagcccggggagcaggtggagctgaaggaggaggccgaggcccctgtggaggatggcagccagcccccacctcctgagcccaagggagatgccaccccagagggggagaaggccacagagaaggaaaatggagacaagtctgaggcccagaagcccacctctgtgtgccgggcctctgtgaccaggtttggcttctag

SEQ ID NO: 155793 - DNA, 444 bp, Artificial Sequence
  Description of Artificial Sequence: Synthetic coding sequence
atggctgacaaggtgcggcggcagaggccccggcggcgggtgtgctgggccctggtggccgtgctgctggccgacctgctggccctgagtgacaccctggccgtgatgtctgtggacctgggcagcgagagcatgaaggtggccatcgtgaagccaggagtgcccatggagatcgtgctgaacaaggagagcaggaggaagacccctgtgattgtgaccctgaaggaaaatgaacgcttctttggagacagcgctgcctccatggccatcaagaaccccaaggccaccctgcgctacttccagcacctgctgggcaagcaggccgacaacccccacgtggccctgtaccaggcccgcttccctgagcacgagctgacctttgacccccagaggcagacagtgcacttccagatcagcagccagctgcagttcagccccctgtag

SEQ ID NO: 155794 - DNA, 1680 bp, Artificial Sequence
  Description of Artificial Sequence: Synthetic coding sequence
atggccatcaagaaccccaaggccaccctgcgctacttccagcacctgctgggcaagcaggccgacaacccccacgtggccctgtaccaggcccgcttccctgagcacgagctgacctttgacccccagaggcagacagtgcacttccagatcagcagccagctgcagttcagccctgaggaggtgctgggcatggtgctgaactacagccgcagcctggctgaagattttgctgagcagcccatcaaggatgctgtgatcaccgtgcctgtgttcttcaaccaggccgagcggcgggctgtgctgcaggccgccaggatggccggcctgaaggtgctgcagctgatcaatgacaacacagccacagccctgtcctatggagtcttccggaggaaggacatcaacaccacagcccagaacatcatgttttatgacatgggcagcggcagcacagtgtgcaccatcgtgacctaccagatggtgaagaccaaggaggccggcatgcagccccagctgcagatccggggcgtgggctttgacaggaccctgggcggcctggagatggagctgcggctgcgggagcggctggccggcctcttcaatgagcagaggaagggccagagggccaaggatgtgcgggagaacccccgggccatggccaagctgctgcgggaggccaaccggctgaagacagtgctgagcgccaatgctgaccacatggcccagatcgagggcctgatggatgatgtggacttcaaggccaaggtgaccagggtggagtttgaggagctgtgtgccgacctgtttgagcgggtgcccggccctgtgcagcaggccctgcagagcgctgagatgagcctggatgaaattgagcaggtgatcctggtgggcggggccaccagggtgccccgggtgcaggaggtgctgctgaaggctgtgggcaaggaggagctgggcaagaacatcaatgctgatgaagctgctgccatgggcgctgtgtaccaggccgccgccctgagcaaggccttcaaggtgaagccctttgtggtgagagatgctgtggtgtaccccatcctggtggagttcacccgggaggtggaggaggagcccggcatccacagcctgaagcacaacaagagggtgctcttcagcaggatgggcccctacccccagaggaaggtgatcaccttcaaccgctacagccatgacttcaacttccacatcaactacggggacctgggcttcctgggccctgaggacctgcgggtgtttggcagccagaacctgaccaccgtgaagctgaagggcgtgggggacagcttcaagaagtacccagactatgagagcaagggcatcaaggcccacttcaacctggatgaaagtggagtgctgagcctggacagagtggagagcgtgtttgagaccctggtggaggacagcgctgaggaggagagcaccctgaccaagctgggcaacaccatcagcagcctgtttggaggcggcaccaccccagatgccaaggaaaatggaacagacacagtgcagatgctgttcctgtgcccagcccggctgccccagagcaagcaggccatcgaccgcttccacacagctgtgacctgcatggagcccccctggggccgccgctgccgggcccggcctgcctggaggctgtgcagctag

SEQ ID NO: 155795 - DNA, 2943 bp, Artificial Sequence
  Description of Artificial Sequence: Synthetic coding sequence
atgtggcagagccggggccccatgctgttccacctgggcctgtgtgtgggcgctgctggcatgatccgggagtggtttgtgcccatccggcgggagaagggcagccgcctcatctgccctgggggcaccatggctgacaaggtgcggcggcagaggcccaggagaagagtgtgctgggccctggtggccgtgctgctggccgacctgctggccctgagtgacaccctggccgtgatgtctgtggacctgggcagcgagagcatgaaggtggccatcgtgaagccaggagtgcccatggagatcgtgctgaacaaggagagcaggaggaagacccctgtgattgtgaccctgaaggaaaatgaacgcttcttcggggacagcgctgcctccatggccatcaagaaccccaaggccaccctgcgctacttccagcacctgctgggcaagcaggccgacaacccccacgtggccctgtaccaggcccgcttccctgagcacgagctgacctttgacccccagaggcagacagtgcacttccagatcagcagccagctgcagttcagccctgaggaggtgctgggcatggtgctgaactacagccgcagcctggctgaagattttgctgagcagcccatcaaggatgctgtgatcaccgtgcctgtgttcttcaaccaggccgagcggcgggctgtgctgcaggccgccaggatggccggcctgaaggtgctgcagctgatcaatgacaacacagccacagccctgtcctatggagtcttccggaggaaggacatcaacaccacagcccagaacatcatgttttatgacatgggcagcggcagcacagtgtgcaccatcgtgacctaccagatggtgaagaccaaggaggccggcatgcagccccagctgcagatccggggcgtgggctttgacaggaccctgggcggcctggagatggagctgcggctgcgggagcggctggccggcctcttcaatgagcagaggaagggccagagggccaaggatgtgcgggagaacccccgggccatggccaagctgctgcgggaggccaaccggctgaagacagtgctgagcgccaatgctgaccacatggcccagatcgagggcctgatggatgatgtggacttcaaggccaaggtgaccagggtggagtttgaggagctgtgtgccgacctgtttgagcgggtgcccggccctgtgcagcaggccctgcagagcgctgagatgagcctggatgaaattgagcaggtgatcctggtgggcggggccaccagggtgccccgggtgcaggaggtgctgctgaaggctgtgggcaaggaggagctgggcaagaacatcaatgctgatgaagctgctgccatgggcgctgtgtaccaggccgccgccctgagcaaggccttcaaggtgaagccctttgtggtgagagatgctgtggtgtaccccatcctggtggagttcacccgggaggtggaggaggagcccggcatccacagcctgaagcacaacaagagggtgctcttcagcaggatgggcccctacccccagaggaaggtgatcaccttcaaccgctacagccatgacttcaacttccacatcaactacggggacctgggcttcctgggccctgaggacctgcgggtgtttggcagccagaacctgaccaccgtgaagctgaagggcgtgggggacagcttcaagaagtacccagactatgagagcaagggcatcaaggcccacttcaacctggatgaaagtggagtgctgagcctggacagagtggagagcgtgtttgagaccctggtggaggacagcgctgaggaggagagcaccctgaccaagctgggcaacaccatcagcagcctgtttggaggcggcaccaccccagatgccaaggaaaatggaacagacacagtgcagaagcccagcgagaaggccgaggccggccctgagggcgtggccccagcccctgagggggagaagaagcagaagccagccaggaagaggaggatggtggaggagattggagtggagctggtggtgctggacctgcctgacctgcctgaggacaagctggcccagagcgtgcagaagctgcaggacctgaccctgcgggacctggagaagcaggagcgggagaaggccgccaacagcctggaggccttcatctttgagacccaggacaagctgtaccagcctgagtaccaggaggtgtccacagaggagcagcgggaggagatcagcggcaagctgtctgctgccagcacctggctggaggatgaaggagtgggcgccaccaccgtgatgctgaaggagaagctggccgagctgaggaagctgtgccagggcctcttcttccgggtggaggagaggaagaagtggccagagcggctgagcgccctggacaacctgctgaaccacagctccatgttcctgaagggggcccggctcatccctgagatggaccagatcttcacagaggtggagatgaccaccctggagaaggtgatcaatgagacctgggcctggaagaatgccaccctggccgagcaggccaagctgcctgccacagagaagcctgtgctgctgagcaaggacatcgaggccaagatgatggccctggaccgggaggtgcagtacctgctgaacaaggccaagttcaccaagccccggccccggcccaaggacaagaatggcaccagggctgagccccccctgaatgccagcgccagtgaccagggcgagaaggtgatccccccagctggccagacagaagatgctgagcccatcagcgagcctgagaaggtggagactggaagtgagcccggggacacagagcccctggagctgggcggccctggagctgagcctgagcagaaggagcagagcacaggccagaagaggcccctgaagaatgatgagctgtag

SEQ ID NO: 155796 - DNA, 333 bp, Artificial Sequence
  Description of Artificial Sequence: Synthetic coding sequence
atggccccccggggctgcatcgtggccgtgtttgccatcttctgcatcagccggctgctgtgcagccatggagcccctgtggcccccatgaccccctacctgatgctgtgccagccccacaagagatgtggggacaagttctatgaccccctgcagcactgctgctatgatgatgctgtggtgcccctggcccggacccagacctgtggcaactgcaccttccgggtgtgctttgagcagtgctgcccctggaccttcatggtgaagctgatcaaccagaactgtgacagcgcccggaccagtgatgaccggctgtgccgctctgtgtcctag

SEQ ID NO: 155797 - DNA, 360 bp, Artificial Sequence
  Description of Artificial Sequence: Synthetic coding sequence
atggtgccccgcatctttgccccagcctacgtgtctgtgtgcctgctgctgctgtgcccccgggaggtgattgccccagctggcagcgagccctggctgtgccagcctgccccccgctgtggggacaagatctacaaccccctggagcagtgctgctacaatgatgccatcgtgtccctgtctgagacccggcagtgtggccccccctgcaccttctggccctgctttgagctgtgctgcctggacagctttggcctgaccaatgactttgtggtgaagctgaaggtgcagggcgtgaacagccagtgccacagcagccccatcagcagcaaatgtgagagcagaagacgcttcccctag

SEQ ID NO: 155798 - DNA, 393 bp, Artificial Sequence
  Description of Artificial Sequence: Synthetic coding sequence
atgaggttctctgtgtctggcatgaggacagactaccccaggtctgtgctggccccagcctacgtgtctgtgtgcctgctgctgctgtgcccccgggaggtgattgccccagctggcagcgagccctggctgtgccagcctgccccccgctgtggggacaagatctacaaccccctggagcagtgctgctacaatgatgccatcgtgtccctgtctgagacccggcagtgtggccccccctgcaccttctggccctgctttgagctgtgctgcctggacagctttggcctgaccaatgactttgtggtgaagctgaaggtgcagggcgtgaacagccagtgccacagcagccccatcagcagcaaatgtgagagcagaagacgcttcccctag

SEQ ID NO: 155799 - DNA, 378 bp, Artificial Sequence
  Description of Artificial Sequence: Synthetic coding sequence
atgaggccccgctgctgcatcctggccctggtgtgctggatcaccgtcttcctgctgcagtgcagcaagggcaccacagatgcccctgtgggcagcggcctgtggctgtgccagcccaccccccgctgtggcaacaagatctacaaccccagcgagcagtgctgctatgatgatgccatcctgagcctgaaggagacccggcgctgtggcagcacctgcaccttctggccctgctttgagctgtgctgcccagagagctttggcccccagcagaagttcctggtgaagctgcgggtgctgggcatgaagagccagtgccacctgagccccatcagccgcagctgcaccaggaacagaagacatgtgctgtacccctag

SEQ ID NO: 155800 - DNA, 375 bp, Artificial Sequence
  Description of Artificial Sequence: Synthetic coding sequence
atggtgccccgcatctctgctgccatcttcatctttgagctgctgggcagcaacagcgagggcgtgacagacctgcggctgtggctgtgccagcctgccccccgctgtggggagtggacctacaaccccctggagcagtgctgtgatgatggagtcatcctggacctgaaccagacccggctgtgtggcagcagctgcaccttctggccctgcttccagcactgctgcctggagagcctgggcagccagaaccagacagtggtgcgcttcaaggtgcccggcatgaagccagactgcaagagcagccccatcacccgcatctgtgcccaggagtaccaccccaagagccctgtgtccagaagtgacctgatctag

SEQ ID NO: 155801 - DNA, 1068 bp, Artificial Sequence
  Description of Artificial Sequence: Synthetic coding sequence
atgggccctggccgctgcctgctgacagccctgctgctgctggccctggcccctcctcctgaggccagccagtactgcggccgcctggagtactggaacccagacaacaagtgctgcagcagctgcctgcagcgcttcggccccccaccctgcccagactatgagttccgggagaactgtggcctgaatgaccatggagactttgtgaccccacccttcaggaagtgcagcagcggccagtgcaacccagatggagctgagctgtgcagcccctgtggcggcggcgctgtgacccccaccccagctgctgggggcggccgcaccccctggcgctgccgggagaggcctgtgcctgccaagggccactgccccctgaccccaggcaaccctggggcccccagcagccaggagaggagcagccctgccagcagcatcgcctggaggaccccagagcctgtgccccagcaggcctggcccaacttcctgcccctggtggtgctggtgctgctgctgaccctggccgtcatcgccatcctgctcttcatcctgctgtggcacctgtgctggcccaaggagaaggctgacccctacccctacccaggcctggtgtgtggggtgcccaacacccacacccccagcagcagccacctgagcagccctggggccctggagactggagacacctggaaggaggccagcctgctgcccctgctgagccgggagctgagcagcctggccagccagcccctgagccggctgctggatgagctggaggtgctggaggagctgattgtgctgctggaccctgagcccggccctgggggcggcatggcccacggcaccaccaggcacctggccgcccgctatggcctgcctgctgcctggagcacctttgcctacagcctgcggcccagccgcagccccctgcgggccctgattgagatggtggtggcccgggagcccagcgccagcctgggccagctgggcacccacctggcccagctgggccgggcagatgccctgcgggtgctgagcaagctgggcagcagcggcgtgtgctgggcctag

SEQ ID NO: 155802 - DNA, 504 bp, Artificial Sequence
  Description of Artificial Sequence: Synthetic coding sequence
atgggccctggccgctgcctgctgacagccctgctgctgctggccctggcccctcctcctgaggccagccagtactgcggccgcctggagtactggaacccagacaacaagtgctgcagcagctgcctgcagcgcttcggccccccaccctgcccagagctgagcagcctggccagccagcccctgagccggctgctggatgagctggaggtgctggaggagctgattgtgctgctggaccctgagcccggccctgggggcggcatggcccacggcaccaccaggcacctggccgcccgctatggcctgcctgctgcctggagcacctttgcctacagcctgcggcccagccgcagccccctgcgggccctgattgagatggtggtggcccgggagcccagcgccagcctgggccagctgggcacccacctggcccagctgggccgggcagatgccctgcgggtgctgagcaagctgggcagcagcggcgtgtgctgggcctag

SEQ ID NO: 155803 - DNA, 723 bp, Artificial Sequence
  Description of Artificial Sequence: Synthetic coding sequence
atgcctgagcgggacagcgagcccttcagcaaccccctggccccagatggccatgatgtggatgacccccacagcttccaccagagcaagctgaccaatgaagacttcaggaagctgctgatgacccccagggctgcccccaccagcgccccacccagcaagagccgccaccacgagatgccccgggagtacaatgaagatgaggaccctgctgcccggcggaggaagaagaagagctactatgccaagctgcggcagcaggagattgagcgggagcgggagctggccgagaagtacagagaccgggccaaggagaggagagatggagtgaacaaggactatgaggagacagagctgatcagcaccacagccaactacagagctgtgggccccacagctgaggccgacaagtctgctgctgagaagaggcggcagctgatccaggagagcaagttcctgggcggggacatggagcacacccacctggtgaagggcctggactttgccctgctgcagaaggtgcgggcagagatcgccagcaaggagaaggaggaggaggagctgatggagaagccccagaaggagaccaagaaggatgaggaccctgagaacaagattgagttcaagacccggctgggcagaaatgtgtacaggatgctgttcaagagcaaggcctatgaaagaaatgaactcttcctgcccggccgcatggccatgtggtag

SEQ ID NO: 155804 - DNA, 1674 bp, Artificial Sequence
  Description of Artificial Sequence: Synthetic coding sequence
atgcctgagcgggacagcgagcccttcagcaaccccctggccccagatggccatgatgtggatgacccccacagcttccaccagagcaagctgaccaatgaagacttcaggaagctgctgatgacccccagggctgcccccaccagcgccccacccagcaagagccgccaccacgagatgccccgggagtacaatgaagatgaggaccctgctgcccggcggaggaagaagaagagctactatgccaagctgcggcagcaggagattgagcgggagcgggagctggccgagaagtacagagaccgggccaaggagaggagagatggagtgaacaaggactatgaggagacagagctgatcagcaccacagccaactacagagctgtgggccccacagctgaggccgacaagtctgctgctgagaagaggcggcagctgatccaggagagcaagttcctgggcggggacatggagcacacccacctggtgaagggcctggactttgccctgctgcagaaggtgcgggcagagatcgccagcaaggagaaggaggaggaggagctgatggagaagccccagaaggagaccaagaaggatgaggaccctgagaacaagattgagttcaagacccggctgggcagaaatgtgtacaggatgctgttcaagagcaaggcctatgaaagaaatgaactcttcctgcccggccgcatggcctacgtggtggacctggatgatgaatatgctgacacagacatccccaccaccctcatccgcagcaaggctgactgccccaccatggaggcccagaccaccctgaccaccaatgacatcgtcatcagcaagctgacccagatcctgagctacctgcggcagggcaccaggaacaagaagctgaagaagaaggacaagggcaagctggaggagaagaagcccccagaggccgacatgaacatctttgaggacatcggggactatgtgcccagcaccaccaagaccccccgggacaaggagcgggagcgctaccgggagcgggagcgggaccgggagcgggaccgggaccgggaccgggagcgggagcgggagcgggaccgggagcgggagcgggagcgggaccgggagcgggaggaggagaagaagaggcacagctactttgagaagcccaaggtggatgatgagcccatggatgtggacaagggccctggcagcaccaaggagctgatcaagagcatcaatgagaagtttgctggcagcgctggctgggagggcacagagagcctgaagaagccagaggacaagaagcagctgggggacttcttcggcatgagcaacagctatgcagagtgctacccagccaccatggatgacatggctgtggacagtgatgaggaggtggactacagcaagatggaccagggcaacaagaagggccccctgggccgctgggactttgacacccaggaggagtacagcgagtacatgaacaacaaggaggccctgcccaaggccgccttccagtatggcatcaagatgtctgagggcaggaagacccggcgcttcaaggagaccaatgacaaggccgagctggaccggcagtggaagaagatcagcgccatcatcgagaagaggaagaagatggaggctgatggagtggaggtgaagaggcccaagtactag

SEQ ID NO: 155805 - DNA, 1560 bp, Artificial Sequence
  Description of Artificial Sequence: Synthetic coding sequence
atggatgctgatgagggccaggacatgagccaggtgtctgggaaggagagcccccctgtgtctgacaccccagatgaaggagatgagcccatgcccatccctgaggacctgagcaccaccagcggcggccagcagagcagcaagagtgacagagtggtggccagcaatgtgaaggtggagacccagagtgatgaggagaatggccgggcctgtgagatgaatggagaagaatgtgccgaggacctgaggatgctggatgccagcggggagaagatgaatggcagccaccgggaccagggcagcagcgccctgtctggagtgggcggcatccggctgcccaacgggaagctgaagtgtgacatctgtggcatcatctgcatcggccccaacgtgctgatggtgcacaagaggagccacactggagagcggcccttccagtgcaaccagtgtggggccagcttcacccagaagggcaacctgctgcggcacatcaagctgcacagcggggagaagcccttcaagtgccacctgtgcaactatgcctgcagaagaagagatgccctgaccggccacctgcggacccacagcgtgggcaagccccacaagtgtggctactgcggccgcagctacaagcagaggagcagcctggaggagcacaaggagcgctgccacaactacctggagagcatgggcctgcccggcaccctgtaccctgtgatcaaggaggagaccaaccacagcgagatggccgaggacctgtgcaagattggcagcgagaggagcctggtgctggaccggctggccagcaatgtggccaagaggaagagctccatgccccagaagttcctgggggacaagggcctgagtgacaccccctatgacagcagcgccagctatgagaaggaaaatgagatgatgaagagccacgtgatggaccaggccatcaacaatgccatcaactacctgggcgctgagagcctgcggcccctggtgcagaccccacctgggggcagcgaggtggtgcctgtgatcagccccatgtaccagctgcacaagcccctggccgagggcacccccaggagcaaccacagcgcccaggacagcgctgtggagaacctgctgctgctgagcaaggccaagctggtgcccagcgagcgggaggccagccccagcaacagctgccaggacagcacagacacagagagcaacaatgaggagcagaggagcggcctcatctacctgaccaaccacatcgcccctcatgccagaaatggcctgagcctgaaggaggagcaccgggcctatgacctgctgcgggccgccagcgagaacagccaggatgccctgcgggtggtgtccaccagcggggagcagatgaaggtgtacaagtgtgagcactgccgggtgctcttcctggaccacgtgatgtacaccatccacatgggctgccacggcttccgggacccctttgagtgcaacatgtgtggctaccacagccaggacagatatgagttcagcagccacatcaccagaggagagcaccgcttccacatgtcctag

SEQ ID NO: 155806 - DNA, 1299 bp, Artificial Sequence
  Description of Artificial Sequence: Synthetic coding sequence
atggatgctgatgagggccaggacatgagccaggtgtctgggaaggagagcccccctgtgtctgacaccccagatgaaggagatgagcccatgcccatccctgaggacctgagcaccaccagcggcggccagcagagcagcaagagtgacagagtggtgggggagcggcccttccagtgcaaccagtgtggggccagcttcacccagaagggcaacctgctgcggcacatcaagctgcacagcggggagaagcccttcaagtgccacctgtgcaactatgcctgcagaagaagagatgccctgaccggccacctgcggacccacagcgtgggcaagccccacaagtgtggctactgcggccgcagctacaagcagaggagcagcctggaggagcacaaggagcgctgccacaactacctggagagcatgggcctgcccggcaccctgtaccctgtgatcaaggaggagaccaaccacagcgagatggccgaggacctgtgcaagattggcagcgagaggagcctggtgctggaccggctggccagcaatgtggccaagaggaagagctccatgccccagaagttcctgggggacaagggcctgagtgacaccccctatgacagcagcgccagctatgagaaggaaaatgagatgatgaagagccacgtgatggaccaggccatcaacaatgccatcaactacctgggcgctgagagcctgcggcccctggtgcagaccccacctgggggcagcgaggtggtgcctgtgatcagccccatgtaccagctgcacaagcccctggccgagggcacccccaggagcaaccacagcgcccaggacagcgctgtggagaacctgctgctgctgagcaaggccaagctggtgcccagcgagcgggaggccagccccagcaacagctgccaggacagcacagacacagagagcaacaatgaggagcagaggagcggcctcatctacctgaccaaccacatcgccccccacgccagaaatggcctgagcctgaaggaggagcaccgggcctatgacctgctgcgggccgccagcgagaacagccaggatgccctgcgggtggtgtccaccagcggggagcagatgaaggtgtacaagtgtgagcactgccgggtgctcttcctggaccacgtgatgtacaccatccacatgggctgccacggcttccgggacccctttgagtgcaacatgtgtggctaccacagccaggacagatatgagttcagcagccacatcaccagaggagagcaccgcttccacatgtcctag

SEQ ID NO: 155807 - DNA, 870 bp, Artificial Sequence
  Description of Artificial Sequence: Synthetic coding sequence
atggatgctgatgagggccaggacatgagccaggtgtctgggaaggagagcccccctgtgtctgacaccccagatgaaggagatgagcccatgcccatccctgaggacctgagcaccaccagcggcggccagcagagcagcaagagtgacagagtggtgggggacaagggcctgagtgacaccccctatgacagcagcgccagctatgagaaggaaaatgagatgatgaagagccacgtgatggaccaggccatcaacaatgccatcaactacctgggcgctgagagcctgcggcccctggtgcagaccccacctgggggcagcgaggtggtgcctgtgatcagccccatgtaccagctgcacaagcccctggccgagggcacccccaggagcaaccacagcgcccaggacagcgctgtggagaacctgctgctgctgagcaaggccaagctggtgcccagcgagcgggaggccagccccagcaacagctgccaggacagcacagacacagagagcaacaatgaggagcagaggagcggcctcatctacctgaccaaccacatcgcccctcatgccagaaatggcctgagcctgaaggaggagcaccgggcctatgacctgctgcgggccgccagcgagaacagccaggatgccctgcgggtggtgtccaccagcggggagcagatgaaggtgtacaagtgtgagcactgccgggtgctcttcctggaccacgtgatgtacaccatccacatgggctgccacggcttccgggacccctttgagtgcaacatgtgtggctaccacagccaggacagatatgagttcagcagccacatcaccagaggagagcaccgcttccacatgtcctag

SEQ ID NO: 155808 - DNA, 1131 bp, Artificial Sequence
  Description of Artificial Sequence: Synthetic coding sequence
atggatgctgatgagggccaggacatgagccaggtgtctgggaaggagagcccccctgtgtctgacaccccagatgaaggagatgagcccatgcccatccctgaggacctgagcaccaccagcggcggccagcagagcagcaagagtgacagagtggtggccagcaatgtgaaggtggagacccagagtgatgaggagaatggccgggcctgtgagatgaatggagaagaatgtgccgaggacctgaggatgctggatgccagcggggagaagatgaatggcagccaccgggaccagggcagcagcgccctgtctggagtgggcggcatccggctgcccaacgggaagctgaagtgtgacatctgtggcatcatctgcatcggccccaacgtgctgatggtgcacaagaggagccacactggagacaagggcctgagtgacaccccctatgacagcagcgccagctatgagaaggaaaatgagatgatgaagagccacgtgatggaccaggccatcaacaatgccatcaactacctgggcgctgagagcctgcggcccctggtgcagaccccacctgggggcagcgaggtggtgcctgtgatcagccccatgtaccagctgcacaagcccctggccgagggcacccccaggagcaaccacagcgcccaggacagcgctgtggagaacctgctgctgctgagcaaggccaagctggtgcccagcgagcgggaggccagccccagcaacagctgccaggacagcacagacacagagagcaacaatgaggagcagaggagcggcctcatctacctgaccaaccacatcgccccccacgccagaaatggcctgagcctgaaggaggagcaccgggcctatgacctgctgcgggccgccagcgagaacagccaggatgccctgcgggtggtgtccaccagcggggagcagatgaaggtgtacaagtgtgagcactgccgggtgctcttcctggaccacgtgatgtacaccatccacatgggctgccacggcttccgggacccctttgagtgcaacatgtgtggctaccacagccaggacagatatgagttcagcagccacatcaccagaggagagcaccgcttccacatgtcctag

SEQ ID NO: 155809 - DNA, 1299 bp, Artificial Sequence
  Description of Artificial Sequence: Synthetic coding sequence
atggatgctgatgagggccaggacatgagccaggtgtctgggaaggagagcccccctgtgtctgacaccccagatgaaggagatgagcccatgcccatccctgaggacctgagcaccaccagcggcggccagcagagcagcaagagtgacagagtggtggccagcaatgtgaaggtggagacccagagtgatgaggagaatggccgggcctgtgagatgaatggagaagaatgtgccgaggacctgaggatgctggatgccagcggggagaagatgaatggcagccaccgggaccagggcagcagcgccctgtctggagtgggcggcatccggctgcccaacgggaagctgaagtgtgacatctgtggcatcatctgcatcggccccaacgtgctgatggtgcacaagaggagccacactggagagcggcccttccagtgcaaccagtgtggggccagcttcacccagaagggcaacctgctgcggcacatcaagctgcacagcggggagaagcccttcaagtgccacctgtgcaactatgcctgcagaagaagagatgccctgaccggccacctgcggacccacagcggggacaagggcctgagtgacaccccctatgacagcagcgccagctatgagaaggaaaatgagatgatgaagagccacgtgatggaccaggccatcaacaatgccatcaactacctgggcgctgagagcctgcggcccctggtgcagaccccacctgggggcagcgaggtggtgcctgtgatcagccccatgtaccagctgcacaagcccctggccgagggcacccccaggagcaaccacagcgcccaggacagcgctgtggagaacctgctgctgctgagcaaggccaagctggtgcccagcgagcgggaggccagccccagcaacagctgccaggacagcacagacacagagagcaacaatgaggagcagaggagcggcctcatctacctgaccaaccacatcgccccccacgccagaaatggcctgagcctgaaggaggagcaccgggcctatgacctgctgcgggccgccagcgagaacagccaggatgccctgcgggtggtgtccaccagcggggagcagatgaaggtgtacaagtgtgagcactgccgggtgctcttcctggaccacgtgatgtacaccatccacatgggctgccacggcttccgggacccctttgagtgcaacatgtgtggctaccacagccaggacagatatgagttcagcagccacatcaccagaggagagcaccgcttccacatgtcctag

SEQ ID NO: 155810 - DNA, 1434 bp, Artificial Sequence
  Description of Artificial Sequence: Synthetic coding sequence
atggatgctgatgagggccaggacatgagccaggtgtctgggaaggagagcccccctgtgtctgacaccccagatgaaggagatgagcccatgcccatccctgaggacctgagcaccaccagcggcggccagcagagcagcaagagtgacagagtggtggccagcaatgtgaaggtggagacccagagtgatgaggagaatggccgggcctgtgagatgaatggagaagaatgtgccgaggacctgaggatgctggatgccagcggggagaagatgaatggcagccaccgggaccagggcagcagcgccctgtctggagtgggcggcatccggctgcccaacgggaagctgaagtgtgacatctgtggcatcatctgcatcggccccaacgtgctgatggtgcacaagaggagccacactggagagcggcccttccagtgcaaccagtgtggggccagcttcacccagaagggcaacctgctgcggcacatcaagctgcacagcggggagaagcccttcaagtgccacctgtgcaactatgcctgcagaagaagagatgccctgaccggccacctgcggacccacagcgtcatcaaggaggagaccaaccacagcgagatggccgaggacctgtgcaagattggcagcgagaggagcctggtgctggaccggctggccagcaatgtggccaagaggaagagctccatgccccagaagttcctgggggacaagggcctgagtgacaccccctatgacagcagcgccagctatgagaaggaaaatgagatgatgaagagccacgtgatggaccaggccatcaacaatgccatcaactacctgggcgctgagagcctgcggcccctggtgcagaccccacctgggggcagcgaggtggtgcctgtgatcagccccatgtaccagctgcacaagcccctggccgagggcacccccaggagcaaccacagcgcccaggacagcgctgtggagaacctgctgctgctgagcaaggccaagctggtgcccagcgagcgggaggccagccccagcaacagctgccaggacagcacagacacagagagcaacaatgaggagcagaggagcggcctcatctacctgaccaaccacatcgcccctcatgccagaaatggcctgagcctgaaggaggagcaccgggcctatgacctgctgcgggccgccagcgagaacagccaggatgccctgcgggtggtgtccaccagcggggagcagatgaaggtgtacaagtgtgagcactgccgggtgctcttcctggaccacgtgatgtacaccatccacatgggctgccacggcttccgggacccctttgagtgcaacatgtgtggctaccacagccaggacagatatgagttcagcagccacatcaccagaggagagcaccgcttccacatgtcctag

SEQ ID NO: 155811 - DNA, 1299 bp, Artificial Sequence; identical to SEQ ID NO: 155806
  Description of Artificial Sequence: Synthetic coding sequence

SEQ ID NO: 155812 - DNA, 1434 bp, Artificial Sequence; identical to SEQ ID NO: 155810
  Description of Artificial Sequence: Synthetic coding sequence

SEQ ID NO: 155813 - DNA, 681 bp, Artificial Sequence
  Description of Artificial Sequence: Synthetic coding sequence
atggatgctgatgagggccaggacatgagccaggtgtctgggaaggagagcccccctgtgtctgacaccccagatgaaggagatgagcccatgcccatccctgaggacctgagcaccaccagcggcggccagcagagcagcaagagtgacagagtggtggccagcaatgtgaaggtggagacccagagtgatgaggagaatggccgggcctgtgagatgaatggagaagaatgtgccgaggacctgaggatgctggatgccagcggggagaagatgaatggcagccaccgggaccagggcagcagcgccctgtctggagtgggcggcatccggctgcccaacgggaagctgaagtgtgacatctgtggcatcatctgcatcggccccaacgtgctgatggtgcacaagaggagccacactggagagcggcccttccagtgcaaccagtgtggggccagcttcacccagaagggcaacctgctgcggcacatcaagctgcacagcggggagaagcccttcaagtgccacctgtgcaactatgcctgcagaagaagagatgccctgaccggccacctgcggacccacagcgtcatcaaggaggagaccaaccacagcgagatggccgaggacctgtgcaagattggcagcgagatcagcagagctggccagaccagcaagtag

SEQ ID NO: 155814 - DNA, 1758 bp, Artificial Sequence
  Description of Artificial Sequence: Synthetic coding sequence
atgcacaccccaccagccctgccccggcgcttccagggcggcggccgggtgaggaccccaggcagccaccggcagggcaaggacaacctggagcgggaccccagcggcggctgtgtgcctgacttcctgccccaggcccaggacagcaaccacttcatcatggagagcctcttctgtgagagcagcggggacagcagcctggagaaggagttcctgggcgcccctgtgggccccagcgtgtccacccccaacagccagcacagcagccccagccgcagcctgagcgccaacagcatcaaggtggagatgtacagtgatgaggagagcagccggctgctgggcccagatgagcggctgctggagaaggatgattctgtgattgtggaggacagcctgtctgagcccctgggctactgtgatggcagcggccctgagccccacagccctgggggcatccggctgcccaacgggaagctgaagtgtgatgtgtgtggcatggtgtgcatcggccccaacgtgctgatggtgcacaagaggagccacactggagagcggcccttccactgcaaccagtgtggggccagcttcacccagaagggcaacctgctgcggcacatcaagctgcacagcggggagaagcccttcaagtgccccttctgcaactatgcctgcagaagaagagatgccctgaccggccacctgcggacccacagcgtgagcagccccaccgtgggcaagccctacaagtgcaactactgcggccgcagctacaagcagcagagcaccctggaggagcacaaggagcgctgccacaactacctgcagagcctgagcacagaggcccaggccctggccggccagcctggagatgagatccgggacctggagatggtgcctgacagcatgctgcacagcagcagcgagcggcccaccttcatcgaccggctggccaacagcctgaccaagaggaagaggagcaccccccagaagtttgtgggggagaagcagatgaggttcagcctgagtgacctgccctatgatgtgaacagcggcggctatgagaaggatgtggagctggtggcccaccacagcctggagcccggcttcggcagcagcctggcctttgtgggcgctgagcacctgcggcccctgcggctgccccccaccaactgcatcagcgagctgacccctgtgatcagctctgtgtacacccagatgcagcccctgcccggccgcctggagctgcccggcagccgggaggccggggagggccctgaggacctggctgatggcggccccctgctgtaccggccccggggccccctgacagatcctggggccagccccagcaatggctgccaggacagcacagacacagagagcaaccacgaggacagagtggccggcgtggtgtccctgccccagggccccccaccccagcccccacccaccatcgtggtgggccgccacagccctgcctatgccaaggaggaccccaagccccaggagggcctgctgcggggcaccccaggccccagcaaggaggtgctgcgggtggtgggggagagcggggagcctgtgaaggccttcaagtgtgagcactgccgcatcctcttcctggaccacgtgatgttcaccatccacatgggctgccacggcttccgggacccctttgagtgcaacatctgtggctaccacagccaggacagatatgagttcagcagccacatcgtgcggggggagcacaaggtgggctag

SEQ ID NO: 155815 - DNA, 1452 bp, Artificial Sequence
  Description of Artificial Sequence: Synthetic coding sequence
atgtacagtgatgaggagagcagccggctgctgggcccagatgagcggctgctggagaaggatgattctgtgattgtggaggacagcctgtctgagcccctgggctactgtgatggcagcggccctgagccccacagccctgggggcatccggctgcccaacgggaagctgaagtgtgatgtgtgtggcatggtgtgcatcggccccaacgtgctgatggtgcacaagaggagccacactggagagcggcccttccactgcaaccagtgtggggccagcttcacccagaagggcaacctgctgcggcacatcaagctgcacagcggggagaagcccttcaagtgccccttctgcaactatgcctgcagaagaagagatgccctgaccggccacctgcggacccacagcgtgagcagccccaccgtgggcaagccctacaagtgcaactactgcggccgcagctacaagcagcagagcaccctggaggagcacaaggagcgctgccacaactacctgcagagcctgagcacagaggcccaggccctggccggccagcctggagatgagatccgggacctggagatggtgcctgacagcatgctgcacagcagcagcgagcggcccaccttcatcgaccggctggccaacagcctgaccaagaggaagaggagcaccccccagaagtttgtgggggagaagcagatgaggttcagcctgagtgacctgccctatgatgtgaacagcggcggctatgagaaggatgtggagctggtggcccaccacagcctggagcccggcttcggcagcagcctggcctttgtgggcgctgagcacctgcggcccctgcggctgccccccaccaactgcatcagcgagctgacccctgtgatcagctctgtgtacacccagatgcagcccctgcccggccgcctggagctgcccggcagccgggaggccggggagggccctgaggacctggctgatggcggccccctgctgtaccggccccggggccccctgacagatcctggggccagccccagcaatggctgccaggacagcacagacacagagagcaaccacgaggacagagtggccggcgtggtgtccctgccccagggccccccaccccagcccccacccaccatcgtggtgggccgccacagccctgcctatgccaaggaggaccccaagccccaggagggcctgctgcggggcaccccaggccccagcaaggaggtgctgcgggtggtgggggagagcggggagcctgtgaaggccttcaagtgtgagcactgccgcatcctcttcctggaccacgtgatgttcaccatccacatgggctgccacggcttccgggacccctttgagtgcaacatctgtggctaccacagccaggacagatatgagttcagcagccacatcgtgcggggggagcacaaggtgggctag

SEQ ID NO: 155816 - DNA, 1758 bp, Artificial Sequence; identical to SEQ ID NO: 155814
  Description of Artificial Sequence: Synthetic coding sequence

SEQ ID NO: 155817 - DNA, 33 bp, Artificial Sequence
  Description of Artificial Sequence: Synthetic coding sequence
atgcacaccccaccagccctgcccaggaggtag

SEQ ID NO: 155818 - DNA, 1863 bp, Artificial Sequence
  Description of Artificial Sequence: Synthetic coding sequence
atgaacaacttcatcctgctggaggagcagctgatcaagaagagccagcagaagaggaggaccagccccagcaacttcaaggtgcgcttctttgtgctgaccaaggccagcctggcctactttgaggacagacatggcaagaagaggaccctgaagggcagcattgagctgagccgcatcaagtgtgtggagatcgtgaagagtgacatcagcatcccctgccactacaagtaccccttccaggtggtgcatgacaactacctgctgtatgtgtttgccccagaccgggagagccggcagcgctgggtgctggccctgaaggaggagaccaggaacaacaacagcctggtgcccaagtaccaccccaacttctggatggatggcaagtggcgctgctgcagccagctggagaagctggccaccggctgtgcccagtatgaccccaccaagaatgccagcaagaagcccctgccccccaccccagaggacaacagaagacccctgtgggagcctgaggagaccgtggtgattgccctgtatgactaccagaccaatgacccccaggagctggccctgcggagaaatgaggagtactgcctgctggacagcagcgagatccactggtggagggtgcaggacagaaatggacatgagggctacgtgcccagcagctacctggtggagaagagccccaacaacctggagacctatgagtggtacaacaagagcatcagccgggacaaggccgagaagctgctgctggacaccgggaaggagggcgccttcatggtgcgggacagcaggacagctggcacctacacagtgtctgtgttcaccaaggctgtggtgtctgagaacaacccctgcatcaagcactaccacatcaaggagaccaatgacaaccccaagcgctactacgtggccgagaagtatgtgtttgacagcatccccctgctgatcaactaccaccagcacaacggcggcggcctggtgacccggctgcgctaccctgtgtgcttcggccggcagaaggcccctgtgacagctggcctgcgctatggcaagtgggtgattgaccccagcgagctgacctttgtgcaggagatcggcagcggccagtttggcctggtgcacctgggctactggctgaacaaggacaaggtggccatcaagaccatccgggagggcgccatgtctgaggaggacttcatcgaggaggccgaggtgatgatgaagctgagccaccccaagctggtgcagctgtatggagtgtgcctggagcaggcccccatctgcctggtgtttgagttcatggagcacggctgcctgagtgactacctgcggacccagaggggcctgtttgctgctgagaccctgctgggcatgtgcctggatgtgtgtgagggcatggcctacctggaggaggcctgtgtgatccaccgggacctggccgccaggaactgcctggtgggggagaaccaggtgatcaaggtgtctgactttggcatgaccaggtttgtgctggatgaccagtacaccagcagcacaggcaccaagtttcctgtgaagtgggccagccctgaggtgttctccttcagccgctacagcagcaagagtgatgtgtggagctttggagtgctgatgtgggaggtgttttctgagggcaagatcccctatgagaacagaagcaacagcgaggtggtggaggacatcagcacaggcttccggctgtacaagccccggctggccagcacccacgtgtaccagatcatgaaccactgctggaaggagaggcctgaggacaggcctgccttcagccggctgctgcggcagctggccgagattgctgagagcggcctgtag

SEQ ID NO: 155819 - DNA, 1899 bp, Artificial Sequence
  Description of Artificial Sequence: Synthetic coding sequence
atggagaccccagctgctgctgccccagctggcagcctcttccccagcttcctgctgctggcctgtggcaccctggtggccgccctgctgggcgccgcccaccggctgggcctcttctaccagctgctgcacaaggtggacaaggcctctgtgagacatggaggagaaaatgtggccgctgtgctgcgggcccatggagtgcgcttcatcttcaccctggtgggcggccacatcagccccctgctggtggcctgtgagaagctgggcatccgggtggtggacaccaggcatgaggtgacagctgtgtttgctgctgatgccatggcccggctgagcggcaccgtgggcgtggccgctgtgacagctggccctggcctgaccaacacagtgacagctgtgaagaatgcccagatggcccagagccccatcctgctgctgggcggggccgccagcaccctgctgcagaacagaggagccctgcaggccgtggaccagctgagcctcttccggcccctgtgcaagttctgtgtgtctgtgcggcgggtgcgggacatcgtgcccaccctgcgggccgccatggctgctgcccagagcggcaccccaggccctgtgtttgtggagctgcctgtggatgtgctgtacccctacttcatggtgcagaaggagatggtgcctgccaagccacccaagggcctggtgggccgggtggtgtcctggtacctggagaactacctggccaacctgtttgctggggcctgggagccccagcctgagggccccctgcccctggacatcccccaggccagcccccagcaggtgcagagatgtgtggagatcctgagccgggccaagaggcccctgatggtgctgggcagccaggccctgctgacccccaccagcgctgacaagctgcgggctgctgtggagaccctgggcgtgccctgcttcctgggcggcatggcccggggcctgctgggcaggaaccaccccctgcacatcagagaaaatagatctgctgccctgaagaaggcagatgtgattgtgctggccggcaccgtgtgtgacttccggctgtcctatggccgggtgctgagccacagcagcaagatcatcatcgtgaacagaaaccgggaggagatgctgctgaacagcgacatcttctggaagccccaggaggccgtgcagggagatgtgggcagctttgtgctgaagctggtggagggcctgcagggccagacctgggccccagactgggtggaggagctgcgggaggccgaccggcagaaggagcagaccttccgggagaaggccgccatgcctgtggcccagcacctgaaccctgtgcaggtgctgcagctggtggaggagaccctgcctgacaacagcatcctggtggtggatggaggagactttgtgggcacagctgcccacctggtgcagccccggggccccctgcgctggctggaccccggggccttcggcaccctgggcgtgggcgccggctttgccctgggcgccaagctgtgcaggccagatgctgaggtgtggtgcctgtttggagatggagccttcggctacagcctgattgaatttgacacctttgtgcgccacaagatccctgtgatggccctggtgggcaatgatgctggctggacccagatcagccgggagcaggtgcccagcctgggcagcaatgtggcctgtggcctggcctacacagactaccacaaggccgccatgggcctgggcgcccggggcctgctgctgagccgggagaatgaagaccaggtggtgaaggtgctgcatgatgcccagcagcagtgcagagatggccaccctgtggtggtgaacatcctgattggccgcacagacttcagagatggcagcattgctgtgtag

SEQ ID NO: 155820 - DNA, 678 bp, Artificial Sequence
  Description of Artificial Sequence: Synthetic coding sequence
atggagaccccagctgctgctgccccagctggcagcctcttccccagcttcctgctgctggcctgtggcaccctggtggccgccctgctgggcgccgcccaccggctgggcctcttctaccagctgctgcacaaggtggacaaggcctctgtgagacatggaggagaaaatgtggccgctgtgctgcgggcccatggagtgcgcttcatcttcaccctggtgggcggccacatcagccccctgctggtggcctgtgagaagctgggcatccgggtggtggacaccaggcatgaggtgacagctgtgtttgctgctgatgccatggcccggctgagcggcaccgtgggcgtggccgctgtgacagctggccctggcctgaccaacacagtgacagctgtgaagaatgcccagatggcccagagccccatcctgctgctgggcggggccgccagcaccctgctgcagaacagaggagccctgcaggccgtggaccagctgagcctcttccggcccccacctggctgcggccagcacccccactgggaggatggcctgccccgctggctgcactgctgcatcggcccctgtggcagcggccgcctggccgccttcctgcccctggactgtgtgcagctggtgtggagcctcatcatcgcctgccccggccccatcccctag

SEQ ID NO: 155821 - DNA, 789 bp, Artificial Sequence
  Description of Artificial Sequence: Synthetic coding sequence
atggagaccccagctgctgctgccccagctggcagcctcttccccagcttcctgctgctggcctgtggcaccctggtggccgccctgctgggcgccgcccaccggctgggcctcttctaccagctgctgcacaaggtggacaaggcctctgtgagacatggaggagaaaatgtggccgctgtgctgcgggcccatggagtgcgcttcatcttcaccctggtgggcggccacatcagccccctgctggtggcctgtgagaagctgggcatccgggtggtggacaccaggcatgaggtgacagctgtgtttgctgctgatgccatggcccggctgagcggcaccgtgggcgtggccgctgtgacagctggccctggcctgaccaacacagtgacagctgtgaagaatgcccagatggcccagagccccatcctgctgctgggcggggccgccagcaccctgctgcagaacagaggagccctgcaggccgtggaccagctgagcctcttccggcccctgtgcaagttctgtgtgtctgtgcggcgggtgcgggacatcgtgcccaccctgcgggccgccatggctgctgcccagagcggcaccccaggccctgtgtttgtggagctgcctgtggatgtgctgtacccctacttcatggtgcagaaggagatggtgcctgccaagccacccaagggcctggtgggccgggtggtgtcctggtacctggagaactacctggccaacctgtttgctggggcctgggagccccagcctgagggccccctgccctag

SEQ ID NO: 155822 - DNA, 501 bp, Artificial Sequence
  Description of Artificial Sequence: Synthetic coding sequence
atggagaccccagctgctgctgccccagctggcagcctcttccccagcttcctgctgctggcctgtggcaccctggtggccgccctgctgggcgccgcccaccggctgggcctcttctaccagctgctgcacaaggtggacaaggcctctgtgagacatggaggagaaaatgtggccgctgtgctgcgggcccatggagtgcgcttcatcttcaccctggtgggcggccacatcagccccctgctggtggcctgtgagaagctgggcatccgggtggtggacaccaggcatgaggtgacagctgtgtttgctgctgatgccatggcccggctgagcggcaccgtgggcgtggccgctgtgacagctggccctggcctgaccaacacagtgacagctgtgaagaatgcccagatggcccagagccccatcctgctgctgggcggggccgccagcaccctgctgcagaacagaggagccctgcaggccgtggaccagctgtag

SEQ ID NO: 155823 - DNA, 621 bp, Artificial Sequence
  Description of Artificial Sequence: Synthetic coding sequence
atggccgccacccgctgcctgcgctggggcctgagccgggccggcgtgtggctgctgcccccaccagcccgctgcccccggcgggccctgcacaagcagaaggatggaacagagttcaagagcatctacagcctggacaagctgtacccagagagccagggcagtgacacagcctggagggtgcccaatggagccaagcaggccgacagcgacatccccctggaccggctgaccatctcctactgccgcagcagcggccctgggggccagaatgtgaacaaggtgaacagcaaggccgaggtgcgcttccacctggccacagctgagtggattgctgagcctgtgcggcagaagatcgccatcacccacaagaacaagatcaaccggctgggggagctgatcctgaccagcgagagcagccgctaccagttcaggaacctggccgactgcctgcagaagatccgggacatgatcacagaggccagccagacccccaaggagcccaccaaggaggatgtgaagctgcaccgcatcagaattgagaacatgaaccgggagcggctgcggcagaagaggatccacagcgctgtgaagaccagcagaagagtggacatggactag

SEQ ID NO: 155824 - DNA, 471 bp, Artificial Sequence
  Description of Artificial Sequence: Synthetic coding sequence
atgtgccacagccgcagctgccaccccaccatgaccatcctgcaggcccccaccccagcccccagcaccatccctggcccccggcggggcagcggccctgagatcttcacctttgaccccctgcctgagcctgctgctgccccagctggccggcccagcgccagccggggccacaggaagaggagcagaagagtgctgtacccccgggtggtgcggcggcagctgcctgtggaggagcccaacccagccaagaggctgctcttcctgctgctgaccatcgtgttctgccagatcctgatggccgaggagggcgtgcctgcccccctgcccccagaagatgccccaaatgctgccagcctggcccccacccctgtgtctgctgtgctggagcccttcaacctgaccagcgagcccagcgactatgccctggacctgagcaccttcctgcagcagcaccctgctgccttctag

SEQ ID NO: 155825 - DNA, 417 bp, Artificial Sequence
  Description of Artificial Sequence: Synthetic coding sequence
atgtgccacagccgcagctgccaccccaccatgaccatcctgcaggcccccaccccagcccccagcaccatccctggcccccggcggggcagcggccctgagatcttcacctttgaccccctgcctgagcctgctgctgccccagctggccggcccagcgccagccggggccacaggaagaggagcagaagagtgctgtacccccgggtggtgtccattgctgaggtgggcatccggggcgtgcgctgccctggggtgactggagagaggccagacagccggggcctggacctgacctgcctgctcttctgcctgcccctgggccctgccccagctgccagccggggcacagagcccagccagaaggccagcctgtctgctgcccaccaccggctgctgcctgaccctgatggatag

SEQ ID NO: 155826 - DNA, 579 bp, Artificial Sequence
  Description of Artificial Sequence: Synthetic coding sequence
atgtgccacagccgcagctgccaccccaccatgaccatcctgcaggcccccaccccagcccccagcaccatccctggcccccggcggggcagcggccctgagatcttcacctttgaccccctgcctgagcctgctgctgccccagctggccggcccagcgccagccggggccacaggaagaggagcagaagagtgctgcccagcagtggagagtacagaagaagtggccacagcagaggagccctgccctggagccactggggcaccacccggctgcagggcctggacctgacctgcctgctcttctgcctgcccctggtgcggcggcagctgcctgtggaggagcccaacccagccaagaggctgctcttcctgctgctgaccatcgtgttctgccagatcctgatggccgaggagggcgtgcctgcccccctgcccccagaagatgccccaaatgctgccagcctggcccccacccctgtgtctgctgtgctggagcccttcaacctgaccagcgagcccagcgactatgccctggacctgagcaccttcctgcagcagcaccctgctgccttctag

SEQ ID NO: 155827 - DNA, 471 bp, Artificial Sequence
  Description of Artificial Sequence: Synthetic coding sequence
atgtgccacagccgcagctgccaccccaccatgaccatcctgcaggcccccaccccagcccccagcaccatccctggcccccggcggggcagcggccctgagatcttcacctttgaccccctgcctgagcctgctgctgccccagctggccggcccagcgccagccggggccacaggaagaggagcagaagagtgctgtacccccgggtggtgcggcggcagctgcctgtggaggagcccaacccagccaagaggctgctcttcctgctgctgaccatcgtgttctgccagatcctgatggccgaggagggcgtgcctgcccccctgcccccagaagatgccccaaatgctgccagcctggcccccacccctgtgtcccctgtgctggagcccttcaacctgaccagcgagcccagcgactatgccctggacctgagcaccttcctgcagcagcaccctgctgccttctag

SEQ ID NO: 155828 - DNA, 417 bp, Artificial Sequence; identical to SEQ ID NO: 155825
  Description of Artificial Sequence: Synthetic coding sequence

SEQ ID NO: 155829 - DNA, 417 bp, Artificial Sequence; identical to SEQ ID NO: 155825
  Description of Artificial Sequence: Synthetic coding sequence

SEQ ID NO: 155830 - DNA, 471 bp, Artificial Sequence; identical to SEQ ID NO: 155827
  Description of Artificial Sequence: Synthetic coding sequence

SEQ ID NO: 155831 - DNA, 417 bp, Artificial Sequence; identical to SEQ ID NO: 155825
  Description of Artificial Sequence: Synthetic coding sequence

SEQ ID NO: 155832 - DNA, 471 bp, Artificial Sequence; identical to SEQ ID NO: 155827
  Description of Artificial Sequence: Synthetic coding sequence

SEQ ID NO: 155833 - DNA, 417 bp, Artificial Sequence; identical to SEQ ID NO: 155825
  Description of Artificial Sequence: Synthetic coding sequence

SEQ ID NO: 155834 - DNA, 471 bp, Artificial Sequence; identical to SEQ ID NO: 155827
  Description of Artificial Sequence: Synthetic coding sequence

SEQ ID NO: 155835 - DNA, 417 bp, Artificial Sequence; identical to SEQ ID NO: 155825
  Description of Artificial Sequence: Synthetic coding sequence

SEQ ID NO: 155836 - DNA, 471 bp, Artificial Sequence; identical to SEQ ID NO: 155827
  Description of Artificial Sequence: Synthetic coding sequence

SEQ ID NO: 155837 - DNA, 249 bp, Artificial Sequence
  Description of Artificial Sequence: Synthetic coding sequence
atggccttcaccctgtacagcctgctgcaggccgccctgctgtgtgtgaatgccatcgctgtgctgcacgaggagcgcttcctgaagaacatcggctggggcacagaccagggcattggaggctttggagaggagcccggcatcaagagccagctgatgaacctgatccgctctgtgaggacagtgatgagggtgcccctcatcatcgtgaacagcatcgccatcgtgctgctgctgctgtttggatag

SEQ ID NO: 155838 - DNA, 984 bp, Artificial Sequence
  Description of Artificial Sequence: Synthetic coding sequence
atggagttcaagctggaggcccaccgcatcgtgtccatcagcctgggcaagatctacaacagccgggtgcagaggggcggcatcaagctgcacaagaacctgctggtgtccctggtgctgcggagcgcccggcaggtgtacctgagtgacccctgccccggcctgtacctggccggccctgctggcaccccagcccccccaccccagcagcagcccggggagcctgctgctggccccccagctggctggggcgagcccccacctcctgctgcccgggcctcctggccagagacagagccccagcctgagaggagctctgtgtctgatgccccccgggtgggagatgaggtgcctgtggccaccgtgactggagtgggagatgtgttccagggcggggaggctgatgccacagaagctgcctggagccgggtggagggcccccggcaggccgccgcccgggaggccgagggcacagctgggggctggggcgtcttccctgaggtgtccagagctgcccggcggccctgtggctgccccctgggcggagaagatcctcctggcaccccagctgccacccccagggctgcctgctgctgtgccccccagcctgcagaagatgagcccccagcccctcctgctgtgtgccccaggaagagatgtgccgccggcgtgggcggcggccctgctggctgcccagcccctggcagcacccccctgaagaagcccaggaggaacctggagcagcccccatctggaggagaagatgatgatgctgaggagatggagactggaaatgtggccaacctgatcagcatcttcggcagcagcttcagcggcctgctgaggaagagccctgggggcggccgggaggaggaggagggggaggagagcggccctgaggccgctgagcccggccagatctgctgtgacaagcctgtgctgcgggacatgaacccctggagcacagccatcgtggccttctag

SEQ ID NO: 155839 - DNA, 420 bp, Artificial Sequence
  Description of Artificial Sequence: Synthetic coding sequence
atggagttcaagctggaggcccaccgcatcgtgtccatcagcctgggcaagatctacaacagccgggtgcagaggggcggcatcaagctgcacaagaacctgctggtgtccctggtgctgcggagcgcccggcaggtgtacctgagtgacccctgccccggcctgtacctggccggccctgctggcaccccagcccccccaccccagcagcagcccggggagcctgctgctggccccccagctggctggggcgagcccccacctcctgctgcccgggcctcctggccagagacagagccccagcctgagaggagctctgtgtctgatgccccccgggtgggagatgaggtgcctgtggccaccgtgactggagtgggagatgtgttccagggccgctctgctgccatcagccgctgctag

SEQ ID NO: 155840 - DNA, 546 bp, Artificial Sequence
  Description of Artificial Sequence: Synthetic coding sequence
atggaggccatgaatgtggagaaggccagcgcagatggcaacctgcctgaggtgatcagcaacatcaaggagaccctgaagatcgtgtccaggacccctgtgaacatcaccatggccggggacagcggaaatggcatgagcaccttcatcagcgccctgaggaacacaggccacgagggcaaggccagccccccaacagagctggtgaaggccacccagagatgtgccagctacttcagcagccacttcagcaatgtggtgctgtgggacctgcccggcaccggcagcgccaccaccaccctggagaactacctgatggagatgcagttcaacagatatgacttcatcatggtggccagcgcccagttctccatgaaccacgtgatgctggccaagacagctgaggacatgggcaagaagttctacatcgtgtggaccaagctggacatggacctgagcactggagccctgcctgaggtgcagctgctgcagatcagagaaaatgtgctggagaacctgcagaaggagcgggtgtgtgagtactag

SEQ ID NO: 155841 - DNA, 1020 bp, Artificial Sequence
  Description of Artificial Sequence: Synthetic coding sequence
atggctgctgaagatgagctgcagctgccccggctgcctgagctgtttgagaccggccggcagctgctggatgaggtggaggtggccacagagcctgctggcagcagaattgtgcaggagaaggtgttcaagggcctggacctgctggagaaggctgctgagatgctgagccagctggacctcttcagcagaaatgaagacctggaggagatcgccagcacagacctgaagtacctgctggtgcctgccttccagggcgccctgaccatgaagcaggtgaaccccagcaagaggctggaccacctgcagagggcccgggagcacttcatcaactacctgacccagtgccactgctaccacgtggccgagtttgagctgcccaagaccatgaacaacagcgctgagaaccacacagccaacagctccatggcctaccccagcctggtggccatggccagccagaggcaggccaagatccagcgctacaagcagaagaaggagctggagcaccggctgagcgccatgaagtctgctgtggagagcggccaggctgatgatgagcgggtgcgggagtactacctgctgcacctgcagcgctggattgacatcagcctggaggagattgagagcattgaccaggagatcaagatcctgcgggagcgggacagcagccgggaggccagcaccagcaacagcagccggcaggagcggccccctgtgaagcccttcatcctgaccaggaacatggcccaggccaaggtgtttggagctggctaccccagcctgcccaccatgacagtgtctgactggtatgagcagcacaggaaatatggagccctgcctgaccagggcatcgccaaggccgcccctgaggagttcaggaaggccgcccagcagcaggaggagcaggaggagaaggaggaggaggatgatgagcagaccctgcaccgggcccgggagtgggatgactggaaggacacccacccccggggctacggcaaccggcagaacatgggctag

SEQ ID NO: 155842 - DNA, 1020 bp, Artificial Sequence; identical to SEQ ID NO: 155841
  Description of Artificial Sequence: Synthetic coding sequence

SEQ ID NO: 155843 - DNA, 480 bp, Artificial Sequence
  Description of Artificial Sequence: Synthetic coding sequence
atgaagaaccacctgctcttctggggcgtgctggccgtgttcatcaaggctgtgcacgtgaaggcccaggaggatgagcgcatcgtgctggtggacaacaagtgcaagtgtgcccgcatcaccagccgcatcatccgcagcagcgaggaccccaatgaagatattgtggagaggaacatccgcatcatcgtgcccctgaacaaccgggagaacatcagtgaccccaccagccccctgcggaccaggtttgtgtaccacctgagtgacctgtgcaagaagtgtgaccccacagaggtggagctggacaaccagatcgtgacagccacccagagcaacatctgtgatgaggacagcgccacagagacctgctacacctatgacaggaacaagtgctacacagctgtggtgcccctggtgtatggaggagagaccaagatggtggagacagccctgaccccagatgcctgctacccagactag

SEQ ID NO: 155844 - DNA, 213 bp, Artificial Sequence
  Description of Artificial Sequence: Synthetic coding sequence
atgaagaaccacctgctcttctggggcgtgctggccgtgttcatcaaggctgtgcacgtgaaggcccaggaggatgagcgcatcgtgctggtggacaacaagtgcaagtgtgcccgcatcaccagccgcatcatccgcagcagcgaggaccccaatgaagatattgtggagaggaacatccgcatcatcgtgcccctgaacaaccgggagtag

SEQ ID NO: 155845 - DNA, 480 bp, Artificial Sequence; identical to SEQ ID NO: 155843
  Description of Artificial Sequence: Synthetic coding sequence

SEQ ID NO: 155846 - DNA, 528 bp, Artificial Sequence
  Description of Artificial Sequence: Synthetic coding sequence
atgaagaaccacctgctcttctggggcgtgctggccgtgttcatcaaggctgtgcacgtgaagggcagccgggacagcagcgccagcgccagccgggtggccggcatcacagcccaggaggatgagcgcatcgtgctggtggacaacaagtgcaagtgtgcccgcatcaccagccgcatcatccgcagcagcgaggaccccaatgaagatattgtggagaggaacatccgcatcatcgtgcccctgaacaaccgggagaacatcagtgaccccaccagccccctgcggaccaggtttgtgtaccacctgagtgacctgtgcaagaagtgtgaccccacagaggtggagctggacaaccagatcgtgacagccacccagagcaacatctgtgatgaggacagcgccacagagacctgctacacctatgacaggaacaagtgctacacagctgtggtgcccctggtgtatggaggagagaccaagatggtggagacagccctgaccccagatgcctgctacccagactag

SEQ ID NO: 155847 - DNA, 642 bp, Artificial Sequence
  Description of Artificial Sequence: Synthetic coding sequence
atgaggcctggcaccggccagggcggcctggaggcccctggagagcccggccccaacctgcggcagcgctggcccctgctgctgctgggcctggccgtggtgacccacggcctgctgcggcccacagctgccagccagagccgggccctgggccctggggcccctgggggcagcagccgcagcagcctgcggagccgctggggccgcttcctgctgcagaggggctcctggacaggcccccgctgctggccccggggcttccagagcaagcacaacagcgtgacccacgtgtttggcagcggcacccagctgactgtgctgagccagcccaaggccaccccatctgtgaccctcttcccccccagcagcgaggagctgcaggccaacaaggccaccctggtgtgcctgatgaatgacttctacccaggcatcctgactgtgacctggaaggcagatggcacccccatcacccagggcgtggagatgaccacccccagcaagcagagcaacaacaagtatgctgccagcagctacctgagcctgaccccagagcagtggaggagcagaagaagctacagctgccaggtgatgcatgagggcagcacagtggagaagacagtggccccagcagaatgttcctag

SEQ ID NO: 155848 - DNA, 255 bp, Artificial Sequence
  Description of Artificial Sequence: Synthetic coding sequence
atgaggcctggcaccggccagggcggcctggaggcccctggagagcccggccccaacctgcggcagcgctggcccctgctgctgctgggcctggccgtggtgacccacggcctgctgcggcccacagctgccagccagagccgggccctgggccctggggcccctgggggcagcagccgcagcagcctgcggagccgctggggccgcagcgcccagggccaccccctgggccacagcgtgcctgctgtgctgtag

SEQ ID NO: 155849 - DNA, 2982 bp, Artificial Sequence
  Description of Artificial Sequence: Synthetic coding sequence
atggccagcgctgctgtggagagctttgtgaccaagcagctggacctgctggagctggagagagatgctgaggtggaggagcggcgctcctggcaggagaacatcagcctgaaggagctgcagagccggggcgtgtgcctgctgaagctgcaggtgagcagccagaggacaggcctgtatggccgcctgctggtgacctttgagccccggcgctatggcagcgctgctgccctgcccagcaacagcttcaccagcggggacatcgtgggcctgtatgatgctgccaatgaaggcagccagctggccaccggcatcctgaccagggtgacccagaagtctgtgacagtggcctttgatgagagccatgacttccagctgagcctggacagagaaaattcctaccgcctgctgaagctggccaatgatgtgacctaccgccgcctgaagaaggccctgattgccctgaagaagtaccacagcggccctgccagcagcctgattgaggtgctgtttggccgcagcgcccccagccctgccagcgagatccaccccctgaccttcttcaacacctgcctggacaccagccagaaggaggccgtgctgtttgccctgagccagaaggagctggccatcatccacggccccccaggcaccgggaagaccaccaccgtggtggagatcatcctgcaggccgtgaagcagggcctgaaggtgctgtgctgtgcccccagcaacattgctgtggacaacctggtggagcggctggccctgtgcaagcagaggatcctgcggctgggccacccagcccggctgctggagagcatccagcagcacagcctggatgctgtgctggcccggagtgacagcgcccagatcgtggccgacatcaggaaggacatcgaccaggtgtttgtgaagaacaagaagacccaggacaagcgggagaagagcaacttcagaaatgagatcaagctgctgaggaaggagctgaaggagcgggaggaggccgccatgctggagagcctgaccagcgccaacgtggtgctggccaccaacacaggagccagcgcagatggccccctgaagctgctgcctgagagctactttgatgtggtggtgattgatgaatgtgcccaggccctggaggccagctgctggatccccctgctgaaggccaggaagtgcatcctggccggggaccacaagcagctgccccccaccaccgtgagccacaaggccgccctggccggcctgagcctgagcctgatggagcggctggccgaggagtatggagcccgggtggtgaggaccctgactgtgcagtacaggatgcaccaggccatcatgcgctgggccagtgacaccatgtacctgggccagctgacagcccacagctctgtggcccggcacctgctgcgggacctgcccggggtggccgccacagaggagaccggggtgcccctgctgctggtggacacagctggctgcggcctgtttgagctggaggaggaggatgagcagagcaaaggaaatcctggagaggtgcggctggtgtccctgcacatccaggccctggtggatgctggggtgcctgcccgggacattgctgtggtgagcccctacaacctgcaggtggacctgctgcggcagagcctggtgcaccgccaccctgagctggagatcaagtctgtggatggcttccagggccgggagaaggaggccgtcatcctgagctttgtgcgcagcaacagaaaaggagaggtgggcttcctggctgaagatcggcgcatcaacgtggccgtgacccgggccaggagacatgtggccgtcatctgtgacagcaggacagtgaacaaccacgccttcctgaagaccctggtggagtacttcacccagcacggggaggtgaggacagcctttgagtacctggatgacatcgtgcctgagaactacagccatgagaacagccagggcagcagccacgccgccaccaagccccagggccctgccaccagcaccaggacaggcagccagaggcaggagggcggccaggaggccgccgccccagcccggcagggcaggaagaagccagctgggaagagcctggccagcgaggcccccagccagcccagcctgaatggaggcagccctgagggcgtggagagccaggatggagtggaccacttccgggccatgattgtggagttcatggccagcaagaagatgcagctggagttcccccccagcctgaacagccatgaccggctgcgggtgcaccagattgctgaggagcacggcctgcggcatgacagcagcggggagggcaagaggcgcttcatcaccgtgtccaagagggccccccggcccagggctgccctgggccccccagctggcactggaggccctgcccccctgcagcctgtgccccccaccccagcccagacagagcagcccccccgggagcagaggggccctgaccagcctgacctgcggaccctgcacctggagcggctgcagagggtgcgcagcgcccagggccagcctgccagcaaggagcagcaggccagcggccagcagaagctgcctgagaagaagaagaagaaggccaagggccacccagccacagacctgcccacagaagaagattttgaggccctggtgtctgctgctgtgaaggctgacaacacctgtggctttgccaagtgcacagctggggtgaccaccctgggccagttctgccagctgtgcagccgccgctactgcctgagccaccacctgcctgagatccacggctgtggggagcgggcccgggcccacgcccggcagaggatcagccgggagggcgtgctgtatgccggcagcggcaccaagaatggcagcctggaccctgccaagagggcccagctgcagaggcggctggacaagaagctgtctgagctgagcaaccagaggaccagcaggaggaaggagcggggcacctag

SEQ ID NO: 155850 - DNA, 1287 bp, Artificial Sequence
  Description of Artificial Sequence: Synthetic coding sequence
atgcaggagctgcacctgctgtggtgggccctgctgctgggcctggcccaggcctgcccagagccctgtgactgtggggagaagtatggcttccagattgctgactgtgcctacagagacctggagagcgtgcccccaggcttccctgccaacgtgaccaccctgagcctgagcgccaaccggctgcccggcctgcctgagggcgccttccgggaggtgcccctgctgcagagcctgtggctggcccacaatgagatcagaacagtggccgccggggccctggccagcctgagccacctgaagagcctggacctgagccacaacctgatcagtgactttgcctggagcgacctgcacaacctgagcgccctgcagctgctgaagatggacagcaatgagctgaccttcatccccagagatgccttccgcagcctgcgggccctgcggagcctgcagctgaaccacaaccggctgcacaccctggccgagggcaccttcacccccctgacagccctgagccacctgcagatcaatgaaaacccctttgactgcacctgtggcatcgtgtggctgaagacctgggccctgaccacagctgtgtccatccctgagcaggacaacatcgcctgcaccagcccccacgtgctgaagggcacccccctgagccggctgccccccctgccctgcagcgcccccagcgtgcagctgagctaccagcccagccaggatggagctgagctgcggcccggctttgtgctggccctgcactgtgatgtggatggccagcctgccccccagctgcactggcacatccagatccccagcggcatcgtggagatcaccagccccaacgtgggcacagatggccgggccctgcccggcacccctgtggccagcagccagccccgcttccaggcctttgccaacggcagcctgctgatcccagactttgggaagctggaggagggcacctacagctgcctggccaccaatgagctgggcagcgctgagagctctgtggatgtggccctggccaccccaggagagggcggggaggacaccctgggccgccgcttccacggcaaggctgtggagggcaagggctgctacacagtggacaatgaggtgcagcccagcggccctgaggacaacgtggtgatcatctacctgagcagagctggcaaccctgaggccgctgtggccgagggcgtgcccggccagctgcccccaggcctgctgctgctgggccagagcctgctgctcttcttcttcctgaccagcttctag

SEQ ID NO: 155851 - DNA, 1287 bp, Artificial Sequence; identical to SEQ ID NO: 155850
  Description of Artificial Sequence: Synthetic coding sequence

SEQ ID NO: 155852 - DNA, 444 bp, Artificial Sequence
  Description of Artificial Sequence: Synthetic coding sequence
atgcaggagctgcacctgctgtggtgggccctgctgctgggcctggcccaggcctgcccagagccctgtgactgtggggagaagtatggcttccagattgctgactgtgcctacagagacctggagagcgtgcccccaggcttccctgccaacgtgaccaccctgagcctgagcgccaaccggctgcccggcctgcctgagggcgccttccgggaggtgcccctgctgcagagcctgtggctggcccacaatgagatcagaacagtggccgccggggccctggccagcctgagccacctgaagagcctggacctgagccacaacctgatcagtgactttgcctggagcgacctgcacaacctgagcgccctgcagctgctgaagatggacagcaatgagctgaccttcatccccagagatgccttccgcagcctgcgggcctag

SEQ ID NO: 155853 - DNA, 552 bp, Artificial Sequence
  Description of Artificial Sequence: Synthetic coding sequence
atgcaggagctgcacctgctgtggtgggccctgctgctgggcctggcccaggcctgcccagagccctgtgactgtggggagaagtatggcttccagattgctgactgtgcctacagagacctggagagcgtgcccccaggcttccctgccaacgtgaccaccctgagcctgagcgccaaccggctgcccggcctgcctgagggcgccttccgggaggtgcccctgctgcagagcctgtggctggcccacaatgagatcagaacagtggccgccggggccctggccagcctgagccacctgaagagcctggacctgagccacaacctgatcagtgactttgcctggagcgacctgcacaacctgagcgccctgcagctgctgaagatggacagcaatgagctgaccttcatccccagagatgccttccgcagcctgcgggccctgcggagcctgcagctgaaccacaaccggctgcacaccctggccgagggcaccttcacccccctgacagccctgagccacctgcagatcaatgaaaacccctttgattag

SEQ ID NO: 155854 - DNA, 2238 bp, Artificial Sequence
  Description of Artificial Sequence: Synthetic coding sequence
atgttccccctgcgggccctgtggctggtgtgggccctgctgggcgtggccggcagctgcccagagccctgtgcctgtgtggacaagtatgcccaccagtttgctgactgtgcctacaaggagctgcgggaggtgcctgagggcctgcctgccaacgtgaccaccctgagcctgagcgccaacaagatcaccgtgctgcggcggggggcctttgctgatgtgacccaggtgaccagcctgtggctggcccacaatgaggtgaggacagtggagcccggggccctggccgtgctgagccagctgaagaacctggacctgagccacaacttcatcagcagcttcccctggagcgacctgaggaacctgagcgccctgcagctgctgaagatgaaccacaaccggctgggcagcctgcccagagatgccctgggcgccctgcctgacctgcggagcctgcgcatcaacaacaaccggctgcggaccctggcccctggcacctttgatgccctgagcgccctgagccacctgcagctgtaccacaaccccttccactgcggctgcggcctggtgtggctgcaggcctgggccgccagcaccagggtgtccctgcctgagccagacagcatcgcctgtgccagccccccagccctgcagggcgtgcctgtgtaccgcctgcctgccctgccctgtgccccacccagcgtgcacctgtctgctgagccccccctggaggcccctggcacccccctgcgggccggcctggcctttgtgctgcactgcatcgcagatggccaccccaccccccggctgcagtggcagctgcagatccctgggggcaccgtggtgctggagccccctgtgctgtctggagaagatgatggagtgggcgctgaggagggggagggggagggagatggagacctgctgacccagacccaggcccagacccccaccccagccccagcctggccagcccccccagccaccccccgcttcctggccctggccaacggcagcctgctggtgcccctgctgagcgccaaggaggccggcgtgtacacctgccgggcccacaatgagctgggcgccaacagcaccagcatccgggtggccgtggccgccactggaccacccaagcacgcccctggggccggcggggagccagatggccaggcccccaccagcgagaggaagagcacagccaagggccggggcaacagcgtgctgcccagcaagccagagggcaagatcaagggccagggcctggccaaggtgtccatcctgggggagacagaaacagagcctgaggaggacaccagcgagggggaggaggccgaggaccagatcctggccgaccctgctgaggagcagagatgtggaaatggagaccccagccgctacgtgagcaaccacgccttcaaccagagcgctgagctgaagccccacgtgtttgagctgggcgtgattgccctggatgtggccgagcgggaggcccgggtgcagctgacccccctggccgcccgctggggccctggccctggaggagctgggggcgccccccggcccggccggcggcccctgcggctgctgtacctgtgcccagctgggggcggcgctgctgtgcagtggagccgggtggaggagggcgtgaatgcctactggttccggggcctgcggcccggcaccaactacagcgtgtgcctggccctggccggggaggcctgccacgtgcaggtggtgttcagcaccaagaaggagctgcccagcctgctggtgattgtggccgtgtctgtgttcctgctggtgctggccaccgtgcccctgctgggcgccgcctgctgccacctgctggccaagcaccctgggaagccctaccgcctcatcctgcggccccaggccccagaccccatggagaagagaattgctgctgactttgacccccgggccagctacctggagagcgagaagagctacccagctggaggagaggccggcggggaggagccagaagatgtgcagggcgagggcctggatgaagatgctgagcagggcgaccccagcggggacctgcagcgggaggagagcctggccgcctgcagcctggtggagagccagagcaaggccaaccaggaggagtttgaagctggcagcgagtacagcgaccggctgcccctgggcgctgaggccgtgaacatcgcccaggagatcaatggaaactaccggcagacagctggatag

SEQ ID NO: 155855 - DNA, 1005 bp, Artificial Sequence
  Description of Artificial Sequence: Synthetic coding sequence
atgttccccctgcgggccctgtggctggtgtgggccctgctgggcgtggccggcagctgcccagagccctgtgcctgtgtggacaagtatgcccaccagtttgctgactgtgcctacaaggagctgcgggaggtgcctgagggcctgcctgccaacgtgaccaccctgagcctgagcgccaacaagatcaccgtgctgcggcggggggcctttgctgatgtgacccaggtgaccagcctgtggctggcccacaatgaggtgaggacagtggagcccggggccctggccgtgctgagccagctgaagaacctggacctgagccacaacttcatcagcagcttcccctggagcgacctgaggaacctgagcgccctgcagctgctgaagatgaaccacaaccggctgggcagcctgcccagagatgccctgggcgccctgcctgacctgcggagcctgcgcatcaacaacaaccggctggccggggaggcctgccacgtgcaggtggtgttcagcaccaagaaggagctgcccagcctgctggtgattgtggccgtgtctgtgttcctgctggtgctggccaccgtgcccctgctgggcgccgcctgctgccacctgctggccaagcaccctgggaagccctaccgcctcatcctgcggccccaggccccagaccccatggagaagagaattgctgctgactttgacccccgggccagctacctggagagcgagaagagctacccagctggaggagaggccggcggggaggagccagaagatgtgcagggcgagggcctggatgaagatgctgagcagggcgaccccagcggggacctgcagcgggaggagagcctggccgcctgcagcctggtggagagccagagcaaggccaaccaggaggagtttgaggccggcagcgagtacagcgaccggctgcccctgggcgctgaggccgtgaacatcgcccaggagatcaatggaaactaccggcagacagctggatag

SEQ ID NO: 155856 - DNA, 2238 bp, Artificial Sequence; identical to SEQ ID NO: 155854
  Description of Artificial Sequence: Synthetic coding sequence

SEQ ID NO: 155857 - DNA, 2238 bp, Artificial Sequence; identical to SEQ ID NO: 155854
  Description of Artificial Sequence: Synthetic coding sequence

SEQ ID NO: 155858 - DNA, 2238 bp, Artificial Sequence; identical to SEQ ID NO: 155854
  Description of Artificial Sequence: Synthetic coding sequence

SEQ ID NO: 155859 - DNA, 2238 bp, Artificial Sequence; identical to SEQ ID NO: 155854
  Description of Artificial Sequence: Synthetic coding sequence

SEQ ID NO: 155860 - DNA, 4011 bp, Artificial Sequence
  Description of Artificial Sequence: Synthetic coding sequence
atgaccctggacaggcctggagagggcgccaccatgctgaagaccttcaccgtgctgctcttctgcatccgcatgagcctgggcatgaccagcatcgtgatggacccccagcctgagctgtggattgagagcaactacccccaggccccctgggagaacatcaccctgtggtgccgcagccccagccgcatcagcagcaagttcctgctgctgaaggacaagacccagatgacctggatccggcccagccacaagaccttccaggtgtccttcctgattggagccctgacagagagcaatgccggcctgtaccgctgctgctactggaaggagaccggctggagcaagcccagcaaggtgctggagctggaggcccctggccagctgcccaagcccatcttctggatccaggccgagaccccagccctgcccggctgcaatgtgaacatcctgtgccacggctggctgcaggacctggtgttcatgctgttcaaggagggctatgcagagcctgtggactaccaggtgcccaccggcaccatggccatcttcagcattgacaacctgaccccagaagatgaaggagtgtacatctgcaggacccacatccagatgctgcccaccctgtggagcgagcccagcaaccccctgaagctggtggtggccggcctgtaccccaagcccaccctgacagcccaccctggccccatcatggcccctggagagagcctgaacctgcgctgccagggccccatctacggcatgacctttgccctgatgagggtggaggacctggagaagagcttctaccacaagaagaccatcaagaatgaggccaacttcttcttccagagcctgaagatccaggacaccggccactacctgtgcttctactatgatgccagctaccggggcagcctgctgagtgatgtgctgaagatctgggtgacagacaccttccccaagacctggctgctggcccggcccagcgctgtggtgcagatgggccagaatgtgtccctgcgctgccggggccctgtggatggagtgggcctggccctgtacaagaagggggaggacaagcccctgcagttcctggatgccaccagcattgatgacaacaccagcttcttcctgaacaacgtgacctacagcgacaccggcatctacagctgccactacctgctgacctggaagaccagcatccgcatgcccagccacaacacagtggagctgatggtggtggacaagccacccaagcccagcctgagcgcctggcccagcacagtgttcaagctgggcaaggccatcaccctgcagtgccgggtgagccaccctgtgctggagttcagcctggagtgggaggagcgggagaccttccagaagttctctgtgaatggagacttcatcatcagcaatgtggatggaaaaggaacaggcacctacagctgcagctacagagtggagacccaccccaacatctggagccacaggtctgagcccctgaagctgatgggccctgctggctacctgacctggaactacgtgctgaatgaggccatccggctgagcctcatcatgcagctggtggccctgctgctggtggtgctgtggatccgctggaagtgccggcggctgcgcatccgggaggcctggctgctgggcacagcccagggcgtgaccatgctgttcatcgtgacagccctgctgtgctgcggcctgtgcaatggagtgctgattgaggagacagaaattgtgatgcccacccccaagccagagctgtgggccgagaccaacttccccctggccccctggaagaacctgaccctgtggtgccgcagccccagcggcagcaccaaggagtttgtgctgctgaaggatggcaccggctggatcgccaccaggcctgccagcgagcaggtgcgggccgccttccccctgggcgccctgacccagagccacacaggcagctaccactgccacagctgggaggagatggctgtgtctgagcccagcgaggccctggagctggtgggcacagacatcctgcccaagcctgtgatcagcgccagccccaccatccggggccaggagctgcagctgcgctgcaagggctggctggccggcatgggctttgccctgtacaaggagggggagcaggagcctgtgcagcagctgggcgctgtgggccgggaggccttcttcaccatccagaggatggaggacaaggatgagggcaactacagctgcaggacccacacagagaagaggcccttcaagtggagcgagcccagcgagcccctggagctggtgatcaaggagatgtaccccaagcccttcttcaagacctgggccagccctgtggtgacccctggggcccgggtgaccttcaactgcagcaccccccaccagcacatgtccttcatcctgtacaaggatggcagcgagatcgccagcagtgaccgctcctgggccagccctggggccagcgctgcccacttcctgatcatctctgtgggcattggagatggcggcaactacagctgccgctactatgacttcagcatctggagcgagcccagcgaccctgtggagctggtggtgacagagttctaccccaagcccaccctgctggcccagcccggccctgtggtgtttcctgggaagagcgtcatcctgcgctgccagggcaccttccagggcatgagatttgccctgctgcaggagggcgcccacgtgcccctgcagttccgctctgtgtctggcaacagcgctgacttcctgctgcacacagtgggcgcagaagattctggcaactacagctgcatctactatgagaccaccatgagcaacagaggcagctacctgtccatgcccctgatgatctgggtgacagacaccttccccaagccctggctgtttgctgagcccagctctgtggtgcccatgggccagaatgtgaccctgtggtgccggggccctgtgcacggcgtgggctacatcctgcacaaggagggggaggccacctccatgcagctgtggggcagcaccagcaatgatggagccttccccatcaccaacatcagcggcacctccatgggccgctacagctgctgctaccacccagactggaccagcagcatcaagatccagcccagcaacaccctggagctgctggtgacaggcctgctgcccaagcccagcctgctggcccagcccggccccatggtggcccctggagagaacatgaccctgcagtgccagggcgagctgcctgacagcacctttgtgctgctgaaggagggcgcccaggagcccctggagcagcagaggccttctggctacagagctgacttctggatgcctgctgtgagaggagaagattctggcatctacagctgtgtgtactacctggacagcaccccatttgctgccagcaaccacagcgacagcctggagatctgggtgacagacaagccacccaagcccagcctgagcgcctggcccagcaccatgttcaagctgggcaaggacatcaccctgcagtgccggggccccctgcccggggtggagtttgtgctggagcatgatggagaggaggccccccagcagttctctgaagatggagactttgtgatcaacaacgtggagggcaaaggaattggcaactacagctgcagctaccgcctgcaggcctacccagacatctggagcgagcccagcgaccccctggagctggtgggcgccgccggccctgtggcccaggagtgcaccgtgggcaacatcgtgcgcagcagcctcatcgtggtggtggtggtggccctgggcgtggtgctggccatcgagtggaagaagtggccccggctgcggacccggggcagcgagacagatggccgggaccagaccatcgccctggaggagtgcaaccaggagggggagcccggcaccccagccaacagccccagcagcaccagccagaggatctctgtggagctgcctgtgcccatctag

SEQ ID NO: 155861 - DNA, 729 bp, Artificial Sequence
  Description of Artificial Sequence: Synthetic coding sequence
atgaccctggacaggcctggagagggcgccaccatgctgaagaccttcaccgtgctgctcttctgcatccgcatgagcctgggcatgaccagcatcgtgatggacccccagcctgagctgtggattgagagcaactacccccaggccccctgggagaacatcaccctgtggtgccgcagccccagccgcatcagcagcaagttcctgctgctgaaggacaagacccagatgacctggatccggcccagccacaagaccttccaggtgtccttcctgattggagccctgacagagagcaatgccggcctgtaccgctgctgctactggaaggagaccggctggagcaagcccagcaaggtgctggagctggaggcccctggccagctgcccaagcccatcttctggatccaggccgagaccccagccctgcccggctgcaatgtgaacatcctgtgccacggctggctgcaggacctggtgttcatgctgttcaaggagggctatgcagagcctgtggactaccaggtgcccaccggcaccatggccatcttcagcattgacaacctgaccccagaagatgaaggagtgtacatctgcaggacccacatccagatgctgcccaccctgtggagcgagcccagcaaccccctgaagctggtggtggccggcggctgcggctacggctgctggcacctggccatcgtggtgcccggcatcatggccggctag

SEQ ID NO: 155862 - DNA, 729 bp, Artificial Sequence; identical to SEQ ID NO: 155861
  Description of Artificial Sequence: Synthetic coding sequence

SEQ ID NO: 155863 - DNA, 4026 bp, Artificial Sequence
  Description of Artificial Sequence: Synthetic coding sequence
atgaccctggacaggcctggagagggcgccaccatgctgaagaccttcaccgtgctgctcttctgcatccgcatgagcctgggcatgaccagcatcgtgatggacccccagcctgagctgtggattgagagcaactacccccaggccccctgggagaacatcaccctgtggtgccgcagccccagccgcatcagcagcaagttcctgctgctgaaggacaagacccagatgacctggatccggcccagccacaagaccttccaggtgtccttcctgattggagccctgacagagagcaatgccggcctgtaccgctgctgctactggaaggagaccggctggagcaagcccagcaaggtgctggagctggaggcccctggccagctgcccaagcccatcttctggatccaggccgagaccccagccctgcccggctgcaatgtgaacatcctgtgccacggctggctgcaggacctggtgttcatgctgttcaaggagggctatgcagagcctgtggactaccaggtgcccaccggcaccatggccatcttcagcattgacaacctgaccccagaagatgaaggagtgtacatctgcaggacccacatccagatgctgcccaccctgtggagcgagcccagcaaccccctgaagctggtggtggccggcctgtaccccaagcccaccctgacagcccaccctggccccatcatggcccctggagagagcctgaacctgcgctgccagggccccatctacggcatgacctttgccctgatgagggtggaggacctggagaagagcttctaccacaagaagaccatcaagaatgaggccaacttcttcttccagagcctgaagatccaggacaccggccactacctgtgcttctactatgatgccagctaccggggcagcctgctgagtgatgtgctgaagatctgggtgacagacaccttccccaagacctggctgctggcccggcccagcgctgtggtgcagatgggccagaatgtgtccctgcgctgccggggccctgtggatggagtgggcctggccctgtacaagaagggggaggacaagcccctgcagttcctggatgccaccagcattgatgacaacaccagcttcttcctgaacaacgtgacctacagcgacaccggcatctacagctgccactacctgctgacctggaagaccagcatccgcatgcccagccacaacacagtggagctgatggtggtggacaagccacccaagcccagcctgagcgcctggcccagcacagtgttcaagctgggcaaggccatcaccctgcagtgccgggtgagccaccctgtgctggagttcagcctggagtgggaggagcgggagaccttccagaagttctctgtgaatggagacttcatcatcagcaatgtggatggaaaaggaacaggcacctacagctgcagctacagagtggagacccaccccaacatctggagccacaggtctgagcccctgaagctgatgggccctgctggctacctgacctggaactacgtgctgaatgaggccatccggctgagcctcatcatgcagctggtggccctgctgctggtggtgctgtggatccgctggaagtgccggcggctgcgcatccgggaggcctggctgctgggcacagcccagggcgtgaccatgctgttcatcgtgacagccctgctgtgctgtgccatcagctttgctggcctgtgcaatggagtgctgattgaggagacagagatcgtgatgcccacccccaagccagagctgtgggccgagaccaacttccccctggccccctggaagaacctgaccctgtggtgccgcagccccagcggcagcaccaaggagtttgtgctgctgaaggatggcaccggctggatcgccaccaggcctgccagcgagcaggtgcgggccgccttccccctgggcgccctgacccagagccacacaggcagctaccactgccacagctgggaggagatggctgtgtctgagcccagcgaggccctggagctggtgggcacagacatcctgcccaagcctgtgatcagcgccagccccaccatccggggccaggagctgcagctgcgctgcaagggctggctggccggcatgggctttgccctgtacaaggagggggagcaggagcctgtgcagcagctgggcgctgtgggccgggaggccttcttcaccatccagaggatggaggacaaggatgagggcaactacagctgcaggacccacacagagaagaggcccttcaagtggagcgagcccagcgagcccctggagctggtgatcaaggagatgtaccccaagcccttcttcaagacctgggccagccctgtggtgacccctggggcccgggtgaccttcaactgcagcaccccccaccagcacatgtccttcatcctgtacaaggatggcagcgagatcgccagcagtgaccgctcctgggccagccctggggccagcgctgcccacttcctgatcatctctgtgggcattggagatggcggcaactacagctgccgctactatgacttcagcatctggagcgagcccagcgaccctgtggagctggtggtgacagagttctaccccaagcccaccctgctggcccagcccggccctgtggtgtttcctgggaagagcgtcatcctgcgctgccagggcaccttccagggcatgagatttgccctgctgcaggagggcgcccacgtgcccctgcagttccgctctgtgtctggcaacagcgctgacttcctgctgcacacagtgggcgctgaggacagcggcaactacagctgcatctactatgagaccaccatgagcaacagaggcagctacctgtccatgcccctgatgatctgggtgacagacaccttccccaagccctggctgtttgctgagcccagctctgtggtgcccatgggccagaatgtgaccctgtggtgccggggccctgtgcatggagtgggctacatcctgcacaaggagggggaggccacctccatgcagctgtggggcagcaccagcaatgatggagccttccccatcaccaacatcagcggcacctccatgggccgctacagctgctgctaccacccagactggaccagcagcatcaagatccagcccagcaacaccctggagctgctggtgacaggcctgctgcccaagcccagcctgctggcccagcccggccccatggtggcccctggagagaacatgaccctgcagtgccagggcgagctgcctgacagcacctttgtgctgctgaaggagggcgcccaggagcccctggagcagcagaggcccagcggctacagagctgacttctggatgcctgctgtgcggggggaggacagcggcatctacagctgtgtgtactacctggacagcaccccatttgctgccagcaaccacagcgacagcctggagatctgggtgacagacaagccacccaagcccagcctgagcgcctggcccagcaccatgttcaagctgggcaaggacatcaccctgcagtgccggggccccctgcccggggtggagtttgtgctggagcatgatggagaggaggccccccagcagttctctgaagatggagactttgtgatcaacaacgtggagggcaagggcatcggcaactacagctgcagctaccgcctgcaggcctacccagacatctggagcgagcccagcgaccccctggagctggtgggcgctgctggccctgtggcccaggagtgcaccgtgggcaacatcgtgcgcagcagcctgattgtggtggtggtggtggccctgggcgtggtgctggccatcgagtggaagaagtggccccggctgcggacccggggcagcgagacagatggccgggaccagaccatcgccctggaggagtgcaaccaggagggggagcccggcaccccagccaacagccccagcagcaccagccagaggatctctgtggagctgcctgtgcccatctag

SEQ ID NO: 155864 - DNA, 3984 bp, Artificial Sequence
  Description of Artificial Sequence: Synthetic coding sequence
atgaccctggacaggcctggagagggcgccaccatgctgaagaccttcaccgtgctgctcttctgcatcctgatggacccccagcctgagctgtggattgagagcaactacccccaggccccctgggagaacatcaccctgtggtgccgcagccccagccgcatcagcagcaagttcctgctgctgaaggacaagacccagatgacctggatccggcccagccacaagaccttccaggtgtccttcctgattggagccctgacagagagcaatgccggcctgtaccgctgctgctactggaaggagaccggctggagcaagcccagcaaggtgctggagctggaggcccctggccagctgcccaagcccatcttctggatccaggccgagaccccagccctgcccggctgcaatgtgaacatcctgtgccacggctggctgcaggacctggtgttcatgctgttcaaggagggctacgccgagcctgtggactaccaggtgcccaccggcaccatggccatcttcagcattgacaacctgaccccagaagatgagggcgtgtacatctgcaggacccacatccagatgctgcccaccctgtggagcgagcccagcaaccccctgaagctggtggtggccggcctgtaccccaagcccaccctgacagcccaccctggccccatcatggcccctggagagagcctgaacctgcgctgccagggccccatctacggcatgacctttgccctgatgagggtggaggacctggagaagagcttctaccacaagaagaccatcaagaatgaggccaacttcttcttccagagcctgaagatccaggacaccggccactacctgtgcttctactatgatgccagctaccggggcagcctgctgagtgatgtgctgaagatctgggtgacagacaccttccccaagacctggctgctggcccggcccagcgctgtggtgcagatgggccagaatgtgtccctgcgctgccggggccctgtggatggagtgggcctggccctgtacaagaagggggaggacaagcccctgcagttcctggatgccaccagcattgatgacaacaccagcttcttcctgaacaacgtgacctacagcgacaccggcatctacagctgccactacctgctgacctggaagaccagcatccgcatgcccagccacaacacagtggagctgatggtggtggacaagccacccaagcccagcctgagcgcctggcccagcaccgtcttcaagctgggcaaggccatcaccctgcagtgccgggtgagccaccctgtgctggagttcagcctggagtgggaggagcgggagaccttccagaagttctctgtgaatggagacttcatcatcagcaatgtggatggcaagggcaccggcacctacagctgcagctacagagtggagacccaccccaacatctggagccacaggtctgagcccctgaagctgatgggccctgctggctacctgacctggaactacgtgctgaatgaggccatccggctgagcctcatcatgcagctggtggccctgctgctggtggtgctgtggatccgctggaagtgccggcggctgcgcatccgggaggcctggctgctgggcacagcccagggcgtgaccatgctgttcatcgtgacagccctgctgtgctgcggcctgtgcaatggagtgctgattgaggagacagagatcgtgatgcccacccccaagccagagctgtgggccgagaccaacttccccctggccccctggaagaacctgaccctgtggtgccgcagccccagcggcagcaccaaggagtttgtgctgctgaaggatggcaccggctggatcgccaccaggcctgccagcgagcaggtgcgggccgccttccccctgggcgccctgacccagagccacacaggcagctaccactgccacagctgggaggagatggctgtgtctgagcccagcgaggccctggagctggtgggcacagacatcctgcccaagcctgtgatcagcgccagccccaccatccggggccaggagctgcagctgcgctgcaagggctggctggccggcatgggctttgccctgtacaaggagggggagcaggagcctgtgcagcagctgggcgctgtgggccgggaggccttcttcaccatccagaggatggaggacaaggatgagggcaactacagctgcaggacccacacagagaagaggcccttcaagtggagcgagcccagcgagcccctggagctggtgatcaaggagatgtaccccaagcccttcttcaagacctgggccagccctgtggtgacccctggggcccgggtgaccttcaactgcagcaccccccaccagcacatgtccttcatcctgtacaaggatggcagcgagatcgccagcagtgaccgctcctgggccagccctggggccagcgctgcccacttcctgatcatctctgtgggcattggagatggcggcaactacagctgccgctactatgacttcagcatctggagcgagcccagcgaccctgtggagctggtggtgacagagttctaccccaagcccaccctgctggcccagcccggccctgtggtgtttcctgggaagagcgtcatcctgcgctgccagggcaccttccagggcatgagatttgccctgctgcaggagggcgcccacgtgcccctgcagttccgctctgtgtctggcaacagcgctgacttcctgctgcacacagtgggcgctgaggacagcggcaactacagctgcatctactatgagaccaccatgagcaacagaggcagctacctgtccatgcccctgatgatctgggtgacagacaccttccccaagccctggctgtttgctgagcccagctctgtggtgcccatgggccagaatgtgaccctgtggtgccggggccctgtgcatggagtgggctacatcctgcacaaggagggggaggccacctccatgcagctgtggggcagcaccagcaatgatggagccttccccatcaccaacatcagcggcacctccatgggccgctacagctgctgctaccacccagactggaccagcagcatcaagatccagcccagcaacaccctggagctgctggtgacaggcctgctgcccaagcccagcctgctggcccagcccggccccatggtggcccctggagagaacatgaccctgcagtgccagggcgagctgcctgacagcacctttgtgctgctgaaggagggcgcccaggagcccctggagcagcagaggcccagcggctacagagctgacttctggatgcctgctgtgcggggggaggacagcggcatctacagctgtgtgtactacctggacagcaccccatttgctgccagcaaccacagcgacagcctggagatctgggtgacagacaagccacccaagcccagcctgagcgcctggcccagcaccatgttcaagctgggcaaggacatcaccctgcagtgccggggccccctgcccggggtggagtttgtgctggagcatgatggagaggaggccccccagcagttctctgaagatggagactttgtgatcaacaacgtggagggcaagggcatcggcaactacagctgcagctaccgcctgcaggcctacccagacatctggagcgagcccagcgaccccctggagctggtgggcgctgctggccctgtggcccaggagtgcaccgtgggcaacatcgtgcgcagcagcctgattgtggtggtggtggtggccctgggcgtggtgctggccatcgagtggaagaagtggccccggctgcggacccggggcagcgagacagatggccgggaccagaccatcgccctggaggagtgcaaccaggagggggagcccggcaccccagccaacagccccagcagcaccagccagaggatctctgtggagctgcctgtgcccatctag

SEQ ID NO: 155865 - DNA, 3984 bp, Artificial Sequence; identical to SEQ ID NO: 155864
  Description of Artificial Sequence: Synthetic coding sequence

SEQ ID NO: 155866 - DNA, 3645 bp, Artificial Sequence
  Description of Artificial Sequence: Synthetic coding sequence
atgaagtgcttcttccctgtgctgagctgcctggccgtgctgggcgtggtgtctgcccagaggcaggtgacagtgcaggagggccccctgtacagaacagagggcagccacatcaccatctggtgcaatgtgtctggctaccagggccccagcgagcagaacttccagtggagcatctacctgcccagcagccctgagcgggaggtgcagatcgtgtccaccatggacagcagcttcccctatgccatctacacccagagggtgcggggcggcaagatcttcatcgagcgggtgcagggcaacagcaccctgctgcacatcacagacctgcaggccagagatgctggggagtatgagtgccacacccccagcacagacaagcagtacttcggcagctacagcgccaagatgaacctggtggtgatcccagacagcctgcagaccacagccatgccccagaccctgcaccgggtggagcaggaccccctggagctgacctgtgaggtggccagcgagaccatccagcacagccacctgtctgtggcctggctgcggcagaaggtgggggagaagcctgtggaggtgatcagcctgagccgggacttcatgctgcacagcagcagtgaatatgcccagaggcagagcctgggggaggtgcggctggacaagctgggccgcaccaccttccggctgaccatcttccacctgcagcccagcgaccagggcgagttctactgtgaggccgctgagtggatccaggaccctgatggctcctggtacgccatgaccaggaagaggtctgagggcgctgtggtgaatgtgcagcccacagacaaggagttcaccgtgcggctggagacagagaagaggctgcacacagtgggggagcctgtggagttccgctgcatcctggaggcccagaatgtgcctgaccgctactttgctgtgtcctgggccttcaacagcagcctgattgccaccatgggccccaatgctgtgcctgtgctgaacagcgagtttgcccaccgggaggcccggggccagctgaaggtggccaaggagagtgacagcgtgtttgtgctgaagatctaccacctgcggcaggaggacagcggcaagtacaactgccgggtgacagagcgggagaagacagtgactggagagttcatcgacaaggagagcaagaggcccaagaacatccccatcatcgtgctgcccctgacagacaactgggtggtgaaggtgccccagcaccaccagctgctgagccagggccacctggagagcagcatctctgtggaggtggccagcaatgccagcgtcatcctggagggggaggacctgcgcttcagctgcagcgtgaggacagctggccggccccagggccgcttcagcgtcatctggcagctggtggaccggcagaacagaagaagcaacatcatgtggctggacagagatggcaccgtgcagcccggcagcagctactgggagaggagcagctttggaggagtgcagatggagcaggtgcagcccaacagcttcagcctgggcatcttcaacagcaggaaggaggatgagggccagtatgagtgccacgtgacagagtgggtgcgggctgtggatggagagtggcagatcgtgggggagcggcgggccagcacccccatcagcatcacagccctggagatgggctttgctgtgacagccatcagcaggaccccaggagtgacctacagcgacagctttgacctgcagtgcatcatcaagccccactacccagcctgggtgcctgtgtctgtgacctggaggttccagcctgtgggcaccgtggagttccatgacctggtgaccttcaccagagatggaggagtgcagtggggagacaggagcagcagcttccgcaccaggacagccatcgagaaggccgagagcagcaacaacgtgcggctgagcatcagccgggccagtgacacagaggccggcaagtaccagtgtgtggccgagctgtggaggaagaactacaacaacacctggacccggctggccgagaggaccagcaacctgctggagatccgggtgctgcagcctgtgaccaagctgcaggtgtccaagagcaagaggaccctgaccctggtggagaacaagcccatccagctgaactgcagcgtgaagagccagaccagccagaacagccactttgctgtgctgtggtacgtgcacaagcccagtgatgctgatggcaagctgatcctgaagaccacccacaacagcgcctttgaatatggcacctatgcagaggaggagggcctgcgggcccggctgcagtttgaaagacatgtgtctgggggcctcttcagcctgactgtgcagagagctgaggtgtctgattctggcagctactactgccacgtggaggagtggctgctgagccccaactatgcctggtacaagctggccgaggaggtgtctggccgcacagaggtgacagtgaagcagcctgacagccggctgcggctgagccaggcccagggcaacctgtctgtgctggagacccggcaggtgcagctggagtgtgtggtgctgaacagaaccagcatcaccagccagctgatggtggagtggtttgtgtggaagcccaaccaccctgagcgggagaccgtggcccggctgagcagagatgccaccttccactacggggagcaggccgccaagaacaacctgaagggccgcctgcacctggagagccccagccctggggtgtaccgcctcttcatccagaatgtggccgtgcaggacagcggcacctacagctgccacgtggaggagtggctgcccagccccagcggcatgtggtacaagagagctgaggacacagctggccagacagccctgactgtgatgaggccagatgccagcctgcaggtggacacagtggtgcccaatgccaccgtgtctgagaaggccgccttccagctggactgcagcatcgtgagccgcagcagccaggacagcagatttgctgtggcctggtacagcctgcggaccaaggccggcggcaagaggagcagccctggcctggaggagcaggaggaggagcgggaggaggaggaggaggaggatgatgatgatgatgatgaccccacagagaggacagccctgctgtctgtgggcccagatgctgtgtttggacctgagggcagcccctgggagggccgcctgcgcttccagaggctgagccctgtgctgtaccgcctgactgtgctgcaggccagcccccaggacaccggcaactacagctgccacgtggaggagtggctgcccagcccccagaaggagtggtaccgcctgacagaggaggagagcgcccccatcggcatccgggtgctggacaccagccccaccctgcagagcatcatctgcagcaatgatgccctcttctactttgtgttcttctaccccttccccatcttcggcatcctgatcatcaccatcctgctggtgcgcttcaagagcaggaacagcagcaagaacagtgatggcaagaatggagtgcccctgctgtggatcaaggagccccacctgaactacagccccacctgcctggagccccctgtgctgagcatccaccctggggccattgattag

SEQ ID NO: 155867 - DNA, 3645 bp, Artificial Sequence; identical to SEQ ID NO: 155866
  Description of Artificial Sequence: Synthetic coding sequence

SEQ ID NO: 155868 - DNA, 3585 bp, Artificial Sequence
  Description of Artificial Sequence: Synthetic coding sequence
atgaagtgcttcttccctgtgctgagctgcctggccgtgctgggcgtggtgtctgcccagaggcaggtgacagtgcaggagggccccctgtacagaacagagggcagccacatcaccatctggtgcaatgtgtctggctaccagggccccagcgagcagaacttccagtggagcatctacctgcccagcagccctgagcgggaggtgcagatcgtgtccaccatggacagcagcttcccctatgccatctacacccagagggtgcggggcggcaagatcttcatcgagcgggtgcagggcaacagcaccctgctgcacatcacagacctgcaggccagagatgctggggagtatgagtgccacacccccagcacagacaagcagtacttcggcagctacagcgccaagatgaacctggtggtgatcccagacagcctgcagaccacagccatgccccagaccctgcaccgggtggagcaggaccccctggagctgacctgtgaggtggccagcgagaccatccagcacagccacctgtctgtggcctggctgcggcagaaggtgggggagaagcctgtggaggtgatcagcctgagccgggacttcatgctgcacagcagcagtgaatatgcccagaggcagagcctgggggaggtgcggctggacaagctgggccgcaccaccttccggctgaccatcttccacctgcagcccagcgaccagggcgagttctactgtgaggccgctgagtggatccaggaccctgatggctcctggtacgccatgaccaggaagaggtctgagggcgctgtggtgaatgtgcagcccacagacaaggagttcaccgtgcggctggagacagagaagaggctgcacacagtgggggagcctgtggagttccgctgcatcctggaggcccagaatgtgcctgaccgctactttgctgtgtcctgggccttcaacagcagcctgattgccaccatgggccccaatgctgtgcctgtgctgaacagcgagtttgcccaccgggaggcccggggccagctgaaggtggccaaggagagtgacagcgtgtttgtgctgaagatctaccacctgcggcaggaggacagcggcaagtacaactgccgggtgacagagcgggagaagacagtgactggagagttcatcgacaaggagagcaagaggcccaagaacatccccatcatcgtgctgcccctgaagagcagcatctctgtggaggtggccagcaatgccagcgtcatcctggagggggaggacctgcgcttcagctgcagcgtgaggacagctggccggccccagggccgcttcagcgtcatctggcagctggtggaccggcagaacagaagaagcaacatcatgtggctggacagagatggcaccgtgcagcccggcagcagctactgggagaggagcagctttggaggagtgcagatggagcaggtgcagcccaacagcttcagcctgggcatcttcaacagcaggaaggaggatgagggccagtatgagtgccacgtgacagagtgggtgcgggctgtggatggagagtggcagatcgtgggggagcggcgggccagcacccccatcagcatcacagccctggagatgggctttgctgtgacagccatcagcaggaccccaggagtgacctacagcgacagctttgacctgcagtgcatcatcaagccccactacccagcctgggtgcctgtgtctgtgacctggaggttccagcctgtgggcaccgtggagttccatgacctggtgaccttcaccagagatggaggagtgcagtggggagacaggagcagcagcttccgcaccaggacagccatcgagaaggccgagagcagcaacaacgtgcggctgagcatcagccgggccagtgacacagaggccggcaagtaccagtgtgtggccgagctgtggaggaagaactacaacaacacctggacccggctggccgagaggaccagcaacctgctggagatccgggtgctgcagcctgtgaccaagctgcaggtgtccaagagcaagaggaccctgaccctggtggagaacaagcccatccagctgaactgcagcgtgaagagccagaccagccagaacagccactttgctgtgctgtggtacgtgcacaagcccagtgatgctgatggcaagctgatcctgaagaccacccacaacagcgcctttgaatatggcacctatgcagaggaggagggcctgcgggcccggctgcagtttgaaagacatgtgtctgggggcctcttcagcctgactgtgcagagagctgaggtgtctgattctggcagctactactgccacgtggaggagtggctgctgagccccaactatgcctggtacaagctggccgaggaggtgtctggccgcacagaggtgacagtgaagcagcctgacagccggctgcggctgagccaggcccagggcaacctgtctgtgctggagacccggcaggtgcagctggagtgtgtggtgctgaacagaaccagcatcaccagccagctgatggtggagtggtttgtgtggaagcccaaccaccctgagcgggagaccgtggcccggctgagcagagatgccaccttccactacggggagcaggccgccaagaacaacctgaagggccgcctgcacctggagagccccagccctggggtgtaccgcctcttcatccagaatgtggccgtgcaggacagcggcacctacagctgccacgtggaggagtggctgcccagccccagcggcatgtggtacaagagagctgaggacacagctggccagacagccctgactgtgatgaggccagatgccagcctgcaggtggacacagtggtgcccaatgccaccgtgtctgagaaggccgccttccagctggactgcagcatcgtgagccgcagcagccaggacagcagatttgctgtggcctggtacagcctgcggaccaaggccggcggcaagaggagcagccctggcctggaggagcaggaggaggagcgggaggaggaggaggaggaggatgatgatgatgatgatgaccccacagagaggacagccctgctgtctgtgggcccagatgctgtgtttggacctgagggcagcccctgggagggccgcctgcgcttccagaggctgagccctgtgctgtaccgcctgactgtgctgcaggccagcccccaggacaccggcaactacagctgccacgtggaggagtggctgcccagcccccagaaggagtggtaccgcctgacagaggaggagagcgcccccatcggcatccgggtgctggacaccagccccaccctgcagagcatcatctgcagcaatgatgccctcttctactttgtgttcttctaccccttccccatcttcggcatcctgatcatcaccatcctgctggtgcgcttcaagagcaggaacagcagcaagaacagtgatggcaagaatggagtgcccctgctgtggatcaaggagccccacctgaactacagccccacctgcctggagccccctgtgctgagcatccaccctggggccattgattag

SEQ ID NO: 155869 - DNA, 726 bp, Artificial Sequence
  Description of Artificial Sequence: Synthetic coding sequence
atgggcacagccagccgcagcaacatcgcccggcacctgcagaccaacctgatcctcttctgtgtgggcgctgtgggcgcctgcaccctgtctgtgacccagccctggtacctggaggtggactacacccatgaggccgtgaccatcaagtgcaccttcagcgccaccggctgccccagcgagcagcccacctgcctgtggttccgctacggggcccaccagcctgagaacctgtgcctggatggctgcaagtctgaggccgacaagttcaccgtgcgggaggccctgaaggagaaccaggtgtccctgactgtgaacagagtgaccagcaatgattctgccatctacatctgtggcatcgccttccccagcgtgcctgaggcccgggccaagcagacaggaggcggcaccaccctggtggtgcgggagatcaagctgctgagcaaggagctgcgctccttcctgacagccctggtgtccctgctgtctgtgtatgtgactggagtgtgtgtggccttcatcctgctgagcaagagcaagagcaaccccctgaggaacaaggagatcaaggaggacagccagaagaagaagagcgcccggcgcatcttccaggagatcgcccaggagctgtaccacaagagacatgtggagaccaaccagcagagcgagaaggacaacaacacctatgagaacagaagagtgctgagcaactatgaaagaccctag

SEQ ID NO: 155870 - DNA, 1842 bp, Artificial Sequence
  Description of Artificial Sequence: Synthetic coding sequence
atgggcgccctgcggcccaccctgctgccccccagcctgcccctgctgctgctgctgatgctgggcatgggctgctgggcccgggaggtgctggtgcctgagggccccctgtacagagtggccggcacagctgtgtccatcagctgcaatgtgacaggctatgagggccctgcccagcagaactttgagtggttcctgtacagacctgaggccccagacacagccctgggcatcgtgtccaccaaggacacccagttctcctatgctgtgttcaagagccgggtggtggccggggaggtgcaggtgcagaggctgcagggagatgctgtggtgctgaagatcgcccggctgcaggcccaggatgctggcatctatgagtgccacacccccagcacagacacccgctacctgggcagctacagcggcaaggtggagctgcgggtgctgcctgatgtgctgcaggtgtctgctgcccctcctggcccccggggccggcaggcccccaccagcccccccaggatgacagtgcatgagggccaggagctggccctgggctgcctggcccggaccagcacccagaagcacacccacctggccgtgtcctttggccgctctgtgcctgaggcccctgtgggccgcagcaccctgcaggaggtggtgggcatccgcagtgacctggccgtggaggccggggccccctatgcagagcggctggccgccggggagctgcggctgggcaaggagggcacagaccgctacaggatggtggtgggcggggcccaggccggagatgctggcacctaccactgcacagctgctgagtggatccaggaccctgatggctcctgggcccagattgctgagaagagagctgtgctggcccacgtggatgtgcagaccctgagcagccagctggccgtgacagtgggccctggagagcggcgcatcggccctggagagcccctggagctgctgtgcaatgtgtctggggccctgcccccagctggaagacatgctgcctacagcgtgggctgggagatggccccagctggggcccctggccctggccgcctggtggcccagctggacacagagggcgtgggcagcctgggccctggctatgagggccgccacatcgccatggagaaggtggccagcaggacctaccgcctgcggctggaggccgcccggcctggagatgctggcacctaccgctgcctggccaaggcctacgtgcggggcagcggcacccggctgcgggaggccgccagcgcccggagccggcccctgcctgtgcacgtgcgggaggagggcgtggtgctggaggccgtggcctggctggccggcggcaccgtgtacagaggagaaacagccagcctgctgtgcaacatctctgtgcggggcggccccccaggcctgcggctggccgcctcctggtgggtggagaggccagaagatggagagctgagctctgtgcctgcccagctggtgggcggcgtgggccaggatggagtggccgagctgggcgtgcggcctgggggcggccctgtgtctgtggagctggtgggccccaggagccaccggctgcggctgcacagcctgggcccagaagatgagggcgtgtaccactgtgcccccagcgcctgggtgcagcacgccgactacagctggtaccaggccggcagcgcccggagcggccctgtgacagtgtacccctacatgcacgccctggacaccctgtttgtgcccctgctggtgggcaccggggtggccctggtgactggagccaccgtgctgggcaccatcacctgctgcttcatgaagaggctgaggaagaggtag

SEQ ID NO: 155871 - DNA, 1581 bp, Artificial Sequence
  Description of Artificial Sequence: Synthetic coding sequence
atgggcgccctgcggcccaccctgctgccccccagcctgcccctgctgctgctgctgatgctgggcatgggctgctgggcccgggaggtgctggtgcctgagggccccctgtacagagtggccggcacagctgtgtccatcagctgcaatgtgacaggctatgagggccctgcccagcagaactttgagtggttcctgtacagacctgaggccccagacacagccctgggcatcgtgtccaccaaggacacccagttctcctatgctgtgttcaagagccgggtggtggccggggaggtgcaggtgcagaggctgcagggagatgctgtggtgctgaagatcgcccggctgcaggcccaggatgctggcatctatgagtgccacacccccagcacagacacccgctacctgggcagctacagcggcaaggtggagctgcgggtgctgcctgatgtgctgcaggtgtctgctgcccctcctggcccccggggccggcaggcccccaccagcccccccaggatgacagtgcatgagggccaggagctggccctgggctgcctggcccggaccagcacccagaagcacacccacctggccgtgtcctttggccgctctgtgcctgaggcccctgtgggccgcagcaccctgcaggaggtggtgggcatccgcagtgacctggccgtggaggccggggccccctatgcagagcggctggccgccggggagctgcggctgggcaaggagggcacagaccgctacaggatggtggtgggcggggcccaggccggagatgctggcacctaccactgcacagctgctgagtggatccaggaccctgatggctcctgggcccagattgctgagaagagagctgtgctggcccacgtggatgtgcagaccctgagcagccagctggccgtgacagtgggccctggagagcggcgcatcggccctggagagcccctggagctgctgtgcaatgtgtctggggccctgcccccagctggaagacatgctgcctacagcgtgggctgggagatggccccagctggggcccctggccctggccgcctggtggcccagctggacacagagggcgtgggcagcctgggccctggctatgagggccgccacatcgccatggagaaggtggccagcaggacctaccgcctgcggctggaggccgcccggcctggagatgctggcacctaccgctgcctggccaaggcctacgtgcggggcagcggcacccggctgcgggaggccgccagcgcccggagccggcccctgcctgtgcacgtgcgggaggagggcgtggtgctggaggccgtggcctggctggccggcggcaccgtgtacagaggagaaacagccagcctgctgtgcaacatctctgtgcggggcggccccccaggcctgcggagcgcccggagcggccctgtgacagtgtacccctacatgcacgccctggacaccctgtttgtgcccctgctggtgggcactggagtggccctggtgactggagccaccgtgctgggcaccatcacctgctgcttcatgaagaggctgaggaagaggtag

SEQ ID NO: 155872 - DNA, 1842 bp, Artificial Sequence; identical to SEQ ID NO: 155870
  Description of Artificial Sequence: Synthetic coding sequence

SEQ ID NO: 155873 - DNA, 906 bp, Artificial Sequence
  Description of Artificial Sequence: Synthetic coding sequence
atgggcgccctgcggcccaccctgctgccccccagcctgcccctgctgctgctgctgatgctgggcatgggctgctgggcccgggaggtgctggtgcctgagggccccctgtacagagtggccggcacagctgtgtccatcagctgcaatgtgacaggctatgagggccctgcccagcagaactttgagtggttcctgtacagacctgaggccccagacacagccctgggcatcgtgtccaccaaggacacccagttctcctatgctgtgttcaagagccgggtggtggccggggaggtgcaggtgcagaggctgcagggagatgctgtggtgctgaagatcgcccggctgcaggcccaggatgctggcatctatgagtgccacacccccagcacagacacccgctacctgggcagctacagcggcaaggtggagctgcgggtgctgcctgatgtgctgcaggtgtctgctgcccctcctggcccccggggccggcaggcccccaccagcccccccaggatgacagtgcatgagggccaggagctggccctgggctgcctggcccggaccagcacccagaagcacacccacctggccgtgtcctttggccgctctgtgcctgaggcccctgtgggccgcagcaccctgcaggaggtggtgggcatccgcagtgacctggccgtggaggccggggccccctatgcagagcggctggccgccggggagctgcggctgggcaaggagggcacagaccgctacaggatggtggtgggcggggcccaggccggagatgctggcacctaccactgcacagctgctgagtggatccaggaccctgatggctcctgggcccagattgctgagaagagagctgtgctggcccacgtggatgtgcagaccctgtag

SEQ ID NO: 155874 - DNA, 2154 bp, Artificial Sequence
  Description of Artificial Sequence: Synthetic coding sequence
atggtgtggtgcctgggcctggccgtgctgagcctggtgatcagccagggcgcagatggccggggcaagccagaggtggtgtctgtggtgggccgggccggggagagcgtggtgctgggctgtgacctgctgcccccagctggccggccccccctgcacgtgattgagtggctgcgcttcggcttcctgctgcccatcttcatccagtttggcctgtacagccccagaattgatcctgactatgtgggccgggtgcggctgcagaagggggccagcctgcagatcgagggcctgcgggtggaggaccagggctggtatgaatgtagagtcttcttcctggaccagcacatcccagaagatgactttgccaacggctcctgggtgcacctgactgtgaacagccccccccagttccaggagaccccacctgctgtgctggaggtgcaggagctggagcctgtgaccctgcgctgtgtggcccggggcagccccctgccccacgtgacctggaagctgcggggcaaggacctgggccagggccagggccaggtgcaggtgcagaatggcaccctgcgcatccggcgggtggagcggggcagcagtggagtgtacacctgccaggccagcagcacagagggcagcgccacccacgccacccagctgctggtgctgggcccccctgtgattgtggtgccccccaagaacagcacagtgaatgccagccaggatgtgtccctggcctgccacgccgaggcctacccagccaacctgacctacagctggttccaggacaacatcaacgtgttccacatcagccggctgcagccccgggtgcgcatcctggtggatggcagcctgcggctgctggccacccagccagatgatgctggctgctacacctgtgtgcccagcaatggcctgctgcacccccccagcgccagcgcctacctgactgtgctgtacccagcccaggtgacagccatgcctcctgagacccccctgcccatcggcatgcctggggtcatccgctgccctgtgcgggccaacccccccctgctgtttgtgtcctggaccaaggatggcaaggccctgcagctggacaagtttcctggctggagccagggcacagagggcagcctcatcatcgccctgggcaatgaagatgccctgggggagtacagctgcaccccctacaacagcctgggcacagctggccccagccctgtgaccagggtgctgctgaaggcccccccagccttcatcgagcggcccaaggaggagtacttccaggaggtgggccgggagctgctgatcccctgcagcgcccagggcgaccccccacctgctgccccacccagccccctgcccggccctggccccctgctgcagtacctgagcctgcccttcttccgggagatgaatgtggatggagactggccacccctggaggagcccagccctgctgcccccccagactacatggacacccggcgctgccccaccagcagcttcctgcggagccctgagaccccacctgtgagcccccgggagagcctgcccggggctgtggtgggcgctggggccacagctgagcccccctacacagccctggccgactggaccctgcgggagcggctgctgcccggcctgctgcctgctgccccccggggcagcctgaccagccagagcagcggccggggcagcgccagcttcctgcggccccccagcacagcccccagcgctgggggcagctacctgagccctgcccctggggacaccagctcctgggccagcggccctgagcgctggccccggcgggagcacgtggtgacagtgtccaagagaagaaacacctctgtggatgagaactatgagtgggacagcgagttccctggggacatggagctgctggagaccctgcacctgggcctggccagcagccggctgcggcctgaggccgagcctgagctgggcgtgaagaccccagaggagggctgcctgctgaacacagcccacgtgacaggccctgaggcccgctgtgccgccctgcgggaggagttcctggccttcagaagaagaagagatgccacccgggcccggctgcctgcctaccggcagcctgtgccccaccctgagcaggccaccctgctgtag

SEQ ID NO: 155875 - DNA, 3492 bp, Artificial Sequence
  Description of Artificial Sequence: Synthetic coding sequence
atggtgtggtgcctgggcctggccgtgctgagcctggtgatcagccagggcgcagatggccggggcaagccagaggtggtgtctgtggtgggccgggccggggagagcgtggtgctgggctgtgacctgctgcccccagctggccggccccccctgcacgtgattgagtggctgcgcttcggcttcctgctgcccatcttcatccagtttggcctgtacagccccagaattgatcctgactatgtgggccgggtgcggctgcagaagggggccagcctgcagatcgagggcctgcgggtggaggaccagggctggtatgaatgtagagtcttcttcctggaccagcacatcccagaagatgactttgccaacggctcctgggtgcacctgactgtgaacagccccccccagttccaggagaccccacctgctgtgctggaggtgcaggagctggagcctgtgaccctgcgctgtgtggcccggggcagccccctgccccacgtgacctggaagctgcggggcaaggacctgggccagggccagggccaggtgcaggtgcagaatggcaccctgcgcatccggcgggtggagcggggcagcagtggagtgtacacctgccaggccagcagcacagagggcagcgccacccacgccacccagctgctggtgctgggcccccctgtgattgtggtgccccccaagaacagcacagtgaatgccagccaggatgtgtccctggcctgccacgccgaggcctacccagccaacctgacctacagctggttccaggacaacatcaacgtgttccacatcagccggctgcagccccgggtgcgcatcctggtggatggcagcctgcggctgctggccacccagccagatgatgctggctgctacacctgtgtgcccagcaatggcctgctgcacccccccagcgccagcgcctacctgactgtgctgtgcatgcctggggtcatccgctgccctgtgcgggccaacccccccctgctgtttgtgtcctggaccaaggatggcaaggccctgcagctggacaagtttcctggctggagccagggcacagagggcagcctcatcatcgccctgggcaatgaagatgccctgggggagtacagctgcaccccctacaacagcctgggcacagctggccccagccctgtgaccagggtgctgctgaaggcccccccagccttcatcgagcggcccaaggaggagtacttccaggaggtgggccgggagctgctgatcccctgcagcgcccagggcgaccccccacctgtggtgtcctggaccaaggtgggccggggcctgcagggccaggcccaggtggacagcaacagcagcctcatcctgcggcccctgaccaaggaggcccacggccactgggagtgcagcgccagcaatgctgtggcccgggtggccaccagcaccaacgtgtatgtgctgggcaccagcccccacgtggtgaccaacgtgtctgtggtggccctgcccaagggggccaacgtgtcctgggagcccggctttgatggcggctacctgcagcgcttctctgtgtggtacacccccctggccaagaggccagacaggatgcaccacgactgggtgtccctggccgtgcctgtgggcgccgcccacctgctggtgcccggcctgcagccccacacccagtaccagttctctgtgctggcccagaacaagctgggcagcggccccttcagcgagatcgtgctgagcgcccctgagggcctgcccaccaccccagctgcccctggcctgcccccaacagagatccccccacccctgagccccccccggggcctggtggccgtgaggaccccccggggcgtgctgctgcactgggaccccccagagctggtgcccaagaggctggatggctacgtgctggagggccggcagggcagccagggctgggaggtgctggaccctgctgtggccggcacagaaacagagctgctggtgcccggcctcatcaaggatgtgctgtatgagttccggctggtggcctttgctggcagctttgtgtctgaccccagcaacacagccaacgtgtccaccagcggcctggaggtgtaccccagcaggacccagctgcccggcctgctgccccagcctgtgctggccggcgtggtgggcggcgtgtgcttcctgggcgtggccgtgctggtgtccatcctggccggctgcctgctgaacagaagaagagctgccaggagaagaaggaagaggctgcggcaggaccccccactcatcttcagccccaccgggaagtctgctgcccccagcgccctgggcagcggcagcccagacagcgtggccaagctgaagctgcagggcagccctgtgcccagcctgcggcagagcctgctgtggggagaccctgctggcacccccagcccccacccagacccccccagcagccggggccccctgcccctggagcccatctgccggggcccagatggccgctttgtgatgggccccaccgtggccgccccccaggagaggagcggccgggagcaggccgagcccaggaccccagcccagaggctggcccggagctttgactgcagcagcagcagccccagcggggccccccagcccctgtgcatcgaggacatcagccctgtggcccctcctcctgctgccccacccagccccctgcccggccctggccccctgctgcagtacctgagcctgcccttcttccgggagatgaatgtggatggagactggccacccctggaggagcccagccctgctgcccccccagactacatggacacccggcgctgccccaccagcagcttcctgcggagccctgagaccccacctgtgagcccccgggagagcctgcccggggctgtggtgggcgctggggccacagctgagcccccctacacagccctggccgactggaccctgcgggagcggctgctgcccggcctgctgcctgctgccccccggggcagcctgaccagccagagcagcggccggggcagcgccagcttcctgcggccccccagcacagcccccagcgctgggggcagctacctgagccctgcccctggggacaccagctcctgggccagcggccctgagcgctggccccggcgggagcacgtggtgacagtgtccaagagaagaaacacctctgtggatgagaactatgagtgggacagcgagttccctggggacatggagctgctggagaccctgcacctgggcctggccagcagccggctgcggcctgaggccgagcctgagctgggcgtgaagaccccagaggagggctgcctgctgaacacagcccacgtgacaggccctgaggcccgctgtgccgccctgcgggaggagttcctggccttcagaagaagaagagatgccacccgggcccggctgcctgcctaccggcagcctgtgccccaccctgagcaggccaccctgctgtag

SEQ ID NO: 155876 - DNA, 3540 bp, Artificial Sequence
  Description of Artificial Sequence: Synthetic coding sequence
atggtgtggtgcctgggcctggccgtgctgagcctggtgatcagccagggcgcagatggccggggcaagccagaggtggtgtctgtggtgggccgggccggggagagcgtggtgctgggctgtgacctgctgcccccagctggccggccccccctgcacgtgattgagtggctgcgcttcggcttcctgctgcccatcttcatccagtttggcctgtacagccccagaattgatcctgactatgtgggccgggtgcggctgcagaagggggccagcctgcagatcgagggcctgcgggtggaggaccagggctggtatgaatgtagagtcttcttcctggaccagcacatcccagaagatgactttgccaacggctcctgggtgcacctgactgtgaacagccccccccagttccaggagaccccacctgctgtgctggaggtgcaggagctggagcctgtgaccctgcgctgtgtggcccggggcagccccctgccccacgtgacctggaagctgcggggcaaggacctgggccagggccagggccaggtgcaggtgcagaatggcaccctgcgcatccggcgggtggagcggggcagcagtggagtgtacacctgccaggccagcagcacagagggcagcgccacccacgccacccagctgctggtgctgggcccccctgtgattgtggtgccccccaagaacagcacagtgaatgccagccaggatgtgtccctggcctgccacgccgaggcctacccagccaacctgacctacagctggttccaggacaacatcaacgtgttccacatcagccggctgcagccccgggtgcgcatcctggtggatggcagcctgcggctgctggccacccagccagatgatgctggctgctacacctgtgtgcccagcaatggcctgctgcacccccccagcgccagcgcctacctgactgtgctgtacccagcccaggtgacagccatgcctcctgagacccccctgcccatcggcatgcctggggtcatccgctgccctgtgcgggccaacccccccctgctgtttgtgtcctggaccaaggatggcaaggccctgcagctggacaagtttcctggctggagccagggcacagagggcagcctcatcatcgccctgggcaatgaagatgccctgggggagtacagctgcaccccctacaacagcctgggcacagctggccccagccctgtgaccagggtgctgctgaaggcccccccagccttcatcgagcggcccaaggaggagtacttccaggaggtgggccgggagctgctgatcccctgcagcgcccagggcgaccccccacctgtggtgtcctggaccaaggtgggccggggcctgcagggccaggcccaggtggacagcaacagcagcctcatcctgcggcccctgaccaaggaggcccacggccactgggagtgcagcgccagcaatgctgtggcccgggtggccaccagcaccaacgtgtatgtgctgggcaccagcccccacgtggtgaccaacgtgtctgtggtggccctgcccaagggggccaacgtgtcctgggagcccggctttgatggcggctacctgcagcgcttctctgtgtggtacacccccctggccaagaggccagacaggatgcaccacgactgggtgtccctggccgtgcctgtgggcgccgcccacctgctggtgcccggcctgcagccccacacccagtaccagttctctgtgctggcccagaacaagctgggcagcggccccttcagcgagatcgtgctgagcgcccctgagggcctgcccaccaccccagctgcccctggcctgcccccaacagagatccccccacccctgagccccccccggggcctggtggccgtgaggaccccccggggcgtgctgctgcactgggaccccccagagctggtgcccaagaggctggatggctacgtgctggagggccggcagggcagccagggctgggaggtgctggaccctgctgtggccggcacagaaacagagctgctggtgcccggcctcatcaaggatgtgctgtatgagttccggctggtggcctttgctggcagctttgtgtctgaccccagcaacacagccaacgtgtccaccagcggcctggaggtgtaccccagcaggacccagctgcccggcctgctgccccagcctgtgctggccggcgtggtgggcggcgtgtgcttcctgggcgtggccgtgctggtgtccatcctggccggctgcctgctgaacagaagaagagctgccaggagaagaaggaagaggctgcggcaggaccccccactcatcttcagccccaccgggaagtctgctgcccccagcgccctgggcagcggcagcccagacagcgtggccaagctgaagctgcagggcagccctgtgcccagcctgcggcagagcctgctgtggggagaccctgctggcacccccagcccccacccagacccccccagcagccggggccccctgcccctggagcccatctgccggggcccagatggccgctttgtgatgggccccaccgtggccgccccccaggagaggagcggccgggagcaggccgagcccaggaccccagcccagaggctggcccggagctttgactgcagcagcagcagccccagcggggccccccagcccctgtgcatcgaggacatcagccctgtggcccctcctcctgctgccccacccagccccctgcccggccctggccccctgctgcagtacctgagcctgcccttcttccgggagatgaatgtggatggagactggccacccctggaggagcccagccctgctgcccccccagactacatggacacccggcgctgccccaccagcagcttcctgcggagccctgagaccccacctgtgagcccccgggagagcctgcccggggctgtggtgggcgctggggccacagctgagcccccctacacagccctggccgactggaccctgcgggagcggctgctgcccggcctgctgcctgctgccccccggggcagcctgaccagccagagcagcggccggggcagcgccagcttcctgcggccccccagcacagcccccagcgctgggggcagctacctgagccctgcccctggggacaccagctcctgggccagcggccctgagcgctggccccggcgggagcacgtggtgacagtgtccaagagaagaaacacctctgtggatgagaactatgagtgggacagcgagttccctggggacatggagctgctggagaccctgcacctgggcctggccagcagccggctgcggcctgaggccgagcctgagctgggcgtgaagaccccagaggagggctgcctgctgaacacagcccacgtgacaggccctgaggcccgctgtgccgccctgcgggaggagttcctggccttcagaagaagaagagatgccacccgggcccggctgcctgcctaccggcagcctgtgccccaccctgagcaggccaccctgctgtag

SEQ ID NO: 155877 - DNA, 4050 bp, Artificial Sequence
  Description of Artificial Sequence: Synthetic coding sequence
atgatctggtacgtggccaccttcatcgcctctgtgattggcacccggggcctggccgctgagggcgcccacggcctgcgggaggagcctgagtttgtgacagcccgggccggggagagcgtggtgctgcgctgtgatgtgatccaccctgtgacaggccagcccccaccctacgtggtggagtggttcaagtttggagtgcccatccccatcttcatcaagtttggctactacccacctcatgtggaccctgaatatgccggccgggccagcctgcatgacaaggccagcctgcggctggagcaggtgcgctctgaggaccagggctggtatgagtgcaaggtgctgatgctggaccagcagtatgacaccttccacaacggctcctgggtgcacctgaccatcaatgccccacccaccttcacagagaccccaccccagtacatcgaggccaaggagggcggcagcatcaccatgacctgcacagccttcggcaaccccaagcccatcgtgacctggctgaaggagggcaccctgctgggcgccagcggcaagtaccaggtgtctgatggcagcctgactgtgacctctgtgtccagagaagatagaggagcctacacctgccgggcctacagcatccagggcgaggccgtgcacaccacccacctgctggtgcagggcccccccttcatcgtgagccccccagagaacatcaccgtgaacatcagccaggatgccctgctgacctgcagagctgaggcctacccaggcaacctgacctacacctggtactggcaggatgaaaatgtgtacttccagaatgacctgaagctgcgggtgcgcatcctgattgatggcaccctcatcatcttccgggtgaagccagaggacagcggcaagtacacctgtgtgcccagcaacagcctgggccgcagccccagcgccagcgcctacctgactgtgcagtacccagcccgggtgctgaacatgcctcctgtgatctacgtgcctgtgggcatccacggctacatccgctgccctgtggatgctgagcccccagccaccgtggtgaagtggaacaaggatggccggcccctgcaggtggagaagaacctgggctggaccctgatggaggatggcagcatccgcatcgaggaggccacagaggaggccctgggcacctacacctgtgtgccctacaacaccctgggcaccatgggccagagcgccccagcccggctggtgctgaaggaccccccctacttcaccgtgctgcccggctgggagtaccggcaggaggccggccgggagctgctgatcccctgtgccgctgctggggaccccttccctgtgatcacctggaggaaggtgggcaagcccagccgcagcaagcacagcgccctgcccagcggcagcctgcagttccgggccctgagcaaagaagatcatggagagtgggagtgtgtggccaccaacgtggtgaccagcatcacagccagcacccacctgaccgtcatcggcaccagcccccacgcccctggctctgtgcgggtgcaggtgtccatgaccacagccaacgtgtcctgggagcccggctatgatggcggctatgagcagaccttctctgtgtggatgaagagggcccagtttggcccccatgactggctgagcctgcctgtgcccccaggccccagctggctgctggtggacaccctggagcctgagacagcctaccagttctctgtgctggcccagaacaagctgggcaccagcgccttcagcgaggtggtgacagtgaacaccctggccttccccatcaccaccccagagcccctggtgctggtgaccccaccccgctgcctgattgccaacagaacccagcagggcgtgctgctgtcctggctgcccccagccaaccacagcttccccatcgaccgctacatcatggagttccgggtggccgagcgctgggagctgctggatgatggcatccctggaacagaaggagagttctttgccaaggacctgagccaggacacctggtatgagttccgggtgctggccgtgatgcaggacctgatcagcgagcccagcaacattgctggggtgagcagcacagacatcttcccccagcctgacctgacagaagatggcctggcccggcctgtgctggccggcatcgtggccaccatctgcttcctggccgccgccatcctcttcagcaccctggccgcctgctttgtgaacaagcagaggaagaggaagctgaagaggaagaaggacccccccctgagcatcacccactgcaggaagagcctggagagccccctgagcagcggcaaggtgtccccagagagcatccgcaccctgcgggcccccagcgagagcagtgatgaccagggccagcctgctgccaagaggatgctgagccccacccgggagaaggagctgagcctgtacaagaagaccaagagggccatcagcagcaagaagtacagcgtggccaaggccgaggccgaggccgaggccaccacccccatcgagctgatcagccggggcccagatggccgctttgtgatggaccctgctgagatggagcccagcctgaagagccgccgcatcgagggcttcccctttgctgaggagacagacatgtacccagagttccggcagagtgatgaagaaaatgaagaccccctggtgcccacctctgtggccgccctgaagagccagctgacccccctgagcagcagccaggagagctacctgcccccaccagcctacagcccccgcttccagccccggggcctggagggccctgggggcctggagggccgcctgcaggccaccggccaggcccggcccccagccccccggcccttccaccacggccagtactacggctacctgagcagcagcagccctggagaggtggagcccccacccttctacgtgcctgaggtgggcagccccctgagctctgtgatgagcagcccccccctgcccacagagggccccttcggccaccccaccatcccagaagaaaatggagaaaatgccagcaacagcaccctgcccctgacccagacccccaccggcggccgcagccctgagccctggggccggcctgagttcccctttggaggcctggagaccccagccatgatgttcccccaccagctgcccccctgtgatgtgcctgagagcctgcagcccaaggccggcctgccccggggcctgccccccaccagcctgcaggtgcctgctgcctacccaggcatcctgagcctggaggcccccaagggctgggccggcaagagccctggccggggccctgtgcctgcccccccagctgccaagtggcaggaccggcccatgcagcccctggtgtcccagggccagctgcggcacaccagccagggcatgggcatccctgtgctgccctacccagagcctgctgagcccggggcccacggcggccccagcaccttcggcctggacacccgctggtatgagccccagccccggccccggcccagcccccggcaggccaggagagctgagcccagcctgcaccaggtggtgctgcagcccagccggctgagccccctgacccagagccccctgagcagcaggacaggcagccctgagctggccgcccgggcccggccccggcccggcctgctgcagcaggccgagatgtctgagatcaccctgcagcccccagctgctgtgtccttcagcaggaagagcacccccagcacaggcagccccagccagagcagccgcagcggcagccccagctacagacctgccatgggcttcaccaccctggccaccggctaccccagccccccacctggccctgccccagctggccctggggacagcctggatgtgtttggccagacccccagccccaggagaactggagaggagctgctgcggcctgagaccccaccacccaccctgcccaccagcggcaagctgcagagggacaggcctgccccagccaccagccccccagagcgggccctgagcaagctgtag

SEQ ID NO: 155878 - DNA, 1509 bp, Artificial Sequence
  Description of Artificial Sequence: Synthetic coding sequence
atggcctggcccaagctgcctgccccctggctgctgctgtgcacctggctgcctgctggctgcctgagcctgctggtgacagtgcagcacacagagcgctacgtgaccctgtttgccagcatcatcctgaagtgtgactacaccaccagcgcccagctgcaggatgtggtggtgacctggaggttcaagagcttctgcaaggaccccatctttgactactacagcgccagctaccaggccgccctgagcctgggccaggaccccagcaatgactgcaatgacaaccagcgggaggtgagaattgtggcccagaggcggggccagaatgaacctgtgctgggcgtggactaccggcagaggaagatcaccatccagaacagagctgacctggtgatcaatgaggtgatgtggtgggaccacggcgtgtactactgcaccatcgaggcccctggggacaccagcggggaccctgacaaggaggtgaagctgattgtgctgcactggctgaccgtcatcttcatcatcctgggcgccctgctgctgctgctgctgattggagtgtgctggtgccagtgctgcccccagtactgctgctgctacatccgctgcccctgctgcccagcccactgctgctgcccagaggaggacctgagcctgcccagcagcctgccccagatgcccatgacccagaccaccaaccagccccccatcgccaatggagtgctggagtacctggagaaggagctgaggaacctgaacctggcccagcccctgcccccagacctgaagggccgcttcggccacccctgcagcatgctgagcagcctgggcagcgaggtggtggagcggcgcatcatccacctgcccccactcatccgggacctgagcagcagcaggaggaccagtgacagcctgcaccagcagtggctgacccccatccccagccggccctgggacctgcgggagggccgcagccaccaccactacccagacttccaccaggagctgcaggaccggggccccaagtcctgggccctggagcggcgggagctggaccccagctggagcggccgccacaggagcagccggctgaatggcagccccatccactggagcgaccgggacagcctgagtgatgtgcccagcagcagcgaggcccgctggaggcccagccacccccccttccgcagccgctgccaggagcggccccggcggcccagcccccgggagagcacccagagacatggaagaagaagaagacacaggagctacagcccccccctgcccagcggcctgagctcctggagcagcgaggaggacaaggagcggcagccccagagctggagggcccaccggcggggcagccacagcccccactggccagaggagaagcccccatcctaccgcagcctggacatcaccccaggcaagaacagcaggaagaagggctctgtggagaggagaagtgagaaggacagcagccacagcggccgctctgtggtgatctag

SEQ ID NO: 155879 - DNA, 1641 bp, Artificial Sequence
  Description of Artificial Sequence: Synthetic coding sequence
atggcctggcccaagctgcctgccccctggctgctgctgtgcacctggctgcctgctggctgcctgagcctgctggtgacagtgcagcacacagagcgctacgtgaccctgtttgccagcatcatcctgaagtgtgactacaccaccagcgcccagctgcaggatgtggtggtgacctggaggttcaagagcttctgcaaggaccccatctttgactactacagcgccagctaccaggccgccctgagcctgggccaggaccccagcaatgactgcaatgacaaccagcgggaggtgagaattgtggcccagaggcggggccagaatgaacctgtgctgggcgtggactaccggcagaggaagatcaccatccagaacagagctgacctggtgatcaatgaggtgatgtggtgggaccacggcgtgtactactgcaccatcgaggcccctggggacaccagcggggaccctgacaaggaggtgaagctgattgtgctgcactggctgaccgtcatcttcatcatcctgggcgccctgctgctgctgctgctgattggagtgtgctggtgccagtgctgcccccagtactgctgctgctacatccgctgcccctgctgcccagcccactgctgctgcccagaggaggccctggcccggcaccgctacatgaagcaggcccaggccctgggcccccagatgatgggcaagcccctgtactggggcgctgacaggagcagccaggtgagcagctaccccatgcaccccctgctgcagagggacctgagcctgcccagcagcctgccccagatgcccatgacccagaccaccaaccagccccccatcgccaatggagtgctggagtacctggagaaggagctgaggaacctgaacctggcccagcccctgcccccagacctgaagggccgcttcggccacccctgcagcatgctgagcagcctgggcagcgaggtggtggagcggcgcatcatccacctgcccccactcatccgggacctgagcagcagcaggaggaccagtgacagcctgcaccagcagtggctgacccccatccccagccggccctgggacctgcgggagggccgcagccaccaccactacccagacttccaccaggagctgcaggaccggggccccaagtcctgggccctggagcggcgggagctggaccccagctggagcggccgccacaggagcagccggctgaatggcagccccatccactggagcgaccgggacagcctgagtgatgtgcccagcagcagcgaggcccgctggaggcccagccacccccccttccgcagccgctgccaggagcggccccggcggcccagcccccgggagagcacccagagacatggaagaagaagaagacacaggagctacagcccccccctgcccagcggcctgagctcctggagcagcgaggaggacaaggagcggcagccccagagctggagggcccaccggcggggcagccacagcccccactggccagaggagaagcccccatcctaccgcagcctggacatcaccccaggcaagaacagcaggaagaagggctctgtggagaggagaagtgagaaggacagcagccacagcggccgctctgtggtgatctag

SEQ ID NO: 155880 - DNA, 639 bp, Artificial Sequence
  Description of Artificial Sequence: Synthetic coding sequence
atggcctggcccaagctgcctgccccctggctgctgctgtgcacctggctgcctgctggctgcctgagcctgctggtgacagtgcagcacacagagcgctacgtgaccctgtttgccagcatcatcctgaagtgtgactacaccaccagcgcccagctgcaggatgtggtggtgacctggaggttcaagagcttctgcaaggaccccatctttgactactacagcgccagctaccaggccgccctgagcctgggccaggaccccagcaatgactgctgctgctgcccagaggaggccctggcccggcaccgctacatgaagcaggcccaggccctgggcccccagatgatgggcaagcccctgtactggggcgctgacaggagcagccaggtgtcctcctaccccatgcaccccctgctgcagagggacctgagcctgcccagcagcctgccccagatgcccatgacccagaccaccaaccagccccccatcgccaacggggtgctggagtacctggagaaggagctgaggaacctgaacctggcccagcccctgcccccagacctgaagggccgcttcggccacccctgcagcatgctgagcagcctgggcagcgagaaccagatcgaggagttctag

SEQ ID NO: 155881 - DNA, 1374 bp, Artificial Sequence
  Description of Artificial Sequence: Synthetic coding sequence
atggcctggcccaagctgcctgccccctggctgctgctgtgcacctggctgcctgctggctgcctgagcctgctggtgacagtgcagcacacagagcgctacgtgaccctgtttgccagcatcatcctgaagtgtgactacaccaccagcgcccagctgcaggatgtggtggtgacctggaggttcaagagcttctgcaaggaccccatctttgactactacagcgccagctaccaggccgccctgagcctgggccaggaccccagcaatgactgcaatgacaaccagcgggaggtgagaattgtggcccagaggcggggccagaatgaacctgtgctgggcgtggactaccggcagaggaagatcaccatccagaaccccctggcccggcaccgctacatgaagcaggcccaggccctgggcccccagatgatgggcaagcccctgtactggggcgctgacaggagcagccaggtgtcctcctaccccatgcaccccctgctgcagagggacctgagcctgcccagcagcctgccccagatgcccatgacccagaccaccaaccagccccccatcgccaacggggtgctggagtacctggagaaggagctgaggaacctgaacctggcccagcccctgcccccagacctgaagggccgcttcggccacccctgcagcatgctgagcagcctgggcagcgaggtggtggagcggcgcatcatccacctgcccccactcatccgggacctgagcagcagcaggaggaccagtgacagcctgcaccagcagtggctgacccccatccccagccggccctgggacctgcgggagggccgcagccaccaccactacccagacttccaccaggagctgcaggaccggggccccaagtcctgggccctggagcggcgggagctggaccccagctggagcggccgccacaggagcagccggctgaatggcagccccatccactggagcgaccgggacagcctgagtgatgtgcccagcagcagcgaggcccgctggaggcccagccacccccccttccgcagccgctgccaggagcggccccggcggcccagcccccgggagagcacccagagacatggaagaagaagaagacacaggagctacagcccccccctgcccagcggcctgagctcctggagcagcgaggaggacaaggagcggcagccccagagctggagggcccacagaagaggcagccacagcccccactggccagaggagaagccacccagctaccgcagcctggacatcacccctgggaagaacagcaggaagaagggctctgtggagcggcgctctgagaaggacagcagccacagcggccgctctgtggtgatctag

SEQ ID NO: 155882 - DNA, 1545 bp, Artificial Sequence
  Description of Artificial Sequence: Synthetic coding sequence
atggccggcaacatcttctgcccctttgccctcttcttcctgcccatgagccgggtgggccacctgcagcacttcctgctgctgctggccctgggctgcctgagcctgctggtgacagtgcagcacacagagcgctacgtgaccctgtttgccagcatcatcctgaagtgtgactacaccaccagcgcccagctgcaggatgtggtggtgacctggaggttcaagagcttctgcaaggaccccatctttgactactacagcgccagctaccaggccgccctgagcctgggccaggaccccagcaatgactgcaatgacaaccagcgggaggtgagaattgtggcccagaggcggggccagaatgaacctgtgctgggcgtggactaccggcagaggaagatcaccatccagaacagagctgacctggtgatcaatgaggtgatgtggtgggaccacggcgtgtactactgcaccatcgaggcccctggggacaccagcggggaccctgacaaggaggtgaagctgattgtgctgcactggctgaccgtcatcttcatcatcctgggcgccctgctgctgctgctgctgattggagtgtgctggtgccagtgctgcccccagtactgctgctgctacatccgctgcccctgctgcccagcccactgctgctgcccagaggaggacctgagcctgcccagcagcctgccccagatgcccatgacccagaccaccaaccagccccccatcgccaatggagtgctggagtacctggagaaggagctgaggaacctgaacctggcccagcccctgcccccagacctgaagggccgcttcggccacccctgcagcatgctgagcagcctgggcagcgaggtggtggagcggcgcatcatccacctgcccccactcatccgggacctgagcagcagcaggaggaccagtgacagcctgcaccagcagtggctgacccccatccccagccggccctgggacctgcgggagggccgcagccaccaccactacccagacttccaccaggagctgcaggaccggggccccaagtcctgggccctggagcggcgggagctggaccccagctggagcggccgccacaggagcagccggctgaatggcagccccatccactggagcgaccgggacagcctgagtgatgtgcccagcagcagcgaggcccgctggaggcccagccacccccccttccgcagccgctgccaggagcggccccggcggcccagcccccgggagagcacccagagacatggaagaagaagaagacacaggagctacagcccccccctgcccagcggcctgagctcctggagcagcgaggaggacaaggagcggcagccccagagctggagggcccaccggcggggcagccacagcccccactggccagaggagaagcccccatcctaccgcagcctggacatcaccccaggcaagaacagcaggaagaagggctctgtggagaggagaagtgagaaggacagcagccacagcggccgctctgtggtgatctag

SEQ ID NO: 155883 - DNA, 1800 bp, Artificial Sequence
  Description of Artificial Sequence: Synthetic coding sequence
atggagggccccctgaccccaccacccctgcagggcggcggcgctgctgctgtgcctgagcccggggcccggcagcaccctggccatgaaacagctgcccagcgctacagcgcccggctgctgcaggccggctatgagcctgagagcccccggctggacctggccacccaccccaccacccccaggtctgagctgagctctgtggtgctgctggccggcgtgggcgtgcagatggaccggctgcggcgggcctccatggctgactacctgatcagcggcggcaccggctacgtgcctgaagatggcctgacagcccagcagctgtttgccagcgcagatggcctgacctacaatgacttcctgatcctgcccggcttcatcgacttcatcgcagatgaggtggacctgaccagcgccctgaccaggaagatcaccctgaagacccccctcatcagcagccccatggacacagtgacagaagctgacatggccatcgccatggccctgatgggcggcatcggcttcatccaccacaactgcaccccagagttccaggccaatgaggtgaggaaggtgaagaagtttgagcagggcttcatcacagatcctgtggtgctgagccccagccacacagtgggagatgtgctggaggccaagatgagacatggcttcagcggcatccccatcacagagaccggcaccatgggcagcaagctggtgggcatcgtgaccagccgggacatcgacttcctggccgagaaggaccacaccaccctgctgtctgaggtgatgaccccccgcatcgagctggtggtggccccagctggggtgaccctgaaggaggccaatgagatcctgcagaggagcaagaagggcaagctgcccatcgtgaatgactgtgatgagctggtggccatcatcgccaggacagacctgaagaagaacagagactaccccctggccagcaaggacagccagaagcagctgctgtgtggggctgctgtgggcaccagagaagatgacaagtaccgcctggacctgctgacccaggccggcgtggatgtgattgtgctggacagcagccagggcaacagcgtgtaccagatcgccatggtgcactacatcaagcagaagtacccccacctgcaggtgattggaggaaatgtggtgacagctgcccaggccaagaacctgattgatgctggggtggatggcctgcgggtgggcatgggctgcggcagcatctgcatcacccaggaggtgatggcctgtggccggccccagggcacagctgtgtacaaggtggccgagtatgcccggcgcttcggcgtgcccatcatcgcagatggcggcatccagacagtgggccacgtggtgaaggccctggccctgggcgccagcacagtgatgatgggcagcctgctggccgccaccacagaggcccctggagagtacttcttcagtgatggagtgcggctgaagaagtaccggggcatgggcagcctggatgccatggagaagagcagcagcagccagaagcgctacttcagcgagggggacaaggtgaagatcgcccagggcgtgtctggcagcatccaggacaagggcagcatccagaagtttgtgccctacctgattgctggcatccagcacggctgccaggacatcggggcccggagcctgtctgtgctgcgctccatgatgtacagcggggagctgaagtttgagaagaggaccatgtctgcccagatcgagggcggcgtgcacggcctgcacagctatgagaagaggctgtactag

SEQ ID NO: 155884 - DNA, 1470 bp, Artificial Sequence
  Description of Artificial Sequence: Synthetic coding sequence
atggctgactacctgatcagcggcggcaccggctacgtgcctgaagatggcctgacagcccagcagctgtttgccagcgcagatggcctgacctacaatgacttcctgatcctgcccggcttcatcgacttcatcgcagatgaggtggacctgaccagcgccctgaccaggaagatcaccctgaagacccccctcatcagcagccccatggacacagtgacagaggccgacatggccatcgccatggccaagtttgagcagggcttcatcacagatcctgtggtgctgagccccagccacacagtgggagatgtgctggaggccaagatgagacatggcttcagcggcatccccatcacagagaccggcaccatgggcagcaagctggtgggcatcgtgaccagccgggacatcgacttcctggccgagaaggaccacaccaccctgctgtctgaggtgatgaccccccgcatcgagctggtggtggccccagctggggtgaccctgaaggaggccaatgagatcctgcagaggagcaagaagggcaagctgcccatcgtgaatgactgtgatgagctggtggccatcatcgccaggacagacctgaagaagaacagagactaccccctggccagcaaggacagccagaagcagctgctgtgtggggctgctgtgggcaccagagaagatgacaagtaccgcctggacctgctgacccaggccggcgtggatgtgattgtgctggacagcagccagggcaacagcgtgtaccagatcgccatggtgcactacatcaagcagaagtacccccacctgcaggtgattggaggaaatgtggtgacagctgcccaggccaagaacctgattgatgctggggtggatggcctgcgggtgggcatgggctgcggcagcatctgcatcacccaggaggtgatggcctgtggccggccccagggcacagctgtgtacaaggtggccgagtatgcccggcgcttcggcgtgcccatcatcgcagatggcggcatccagacagtgggccacgtggtgaaggccctggccctgggcgccagcacagtgatgatgggcagcctgctggccgccaccacagaggcccctggagagtacttcttcagtgatggagtgcggctgaagaagtaccggggcatgggcagcctggatgccatggagaagagcagcagcagccagaagcgctacttcagcgagggggacaaggtgaagatcgcccagggcgtgtctggcagcatccaggacaagggcagcatccagaagtttgtgccctacctgattgctggcatccagcacggctgccaggacatcggggcccggagcctgtctgtgctgcgctccatgatgtacagcggggagctgaagtttgagaagaggaccatgtctgcccagatcgagggcggcgtgcacggcctgcacagctatgagaagaggctgtactag

SEQ ID NO: 155885 - DNA, 1692 bp, Artificial Sequence
  Description of Artificial Sequence: Synthetic coding sequence
atggagggccccctgaccccaccacccctgcagggcggcggcgctgctgctgtgcctgagcccggggcccggcagcaccctggccatgaaacagctgcccagcgctacagcgcccggctgctgcaggccggctatgagcctgagagcatggctgactacctgatcagcggcggcaccggctacgtgcctgaagatggcctgacagcccagcagctgtttgccagcgcagatggcctgacctacaatgacttcctgatcctgcccggcttcatcgacttcatcgcagatgaggtggacctgaccagcgccctgaccaggaagatcaccctgaagacccccctcatcagcagccccatggacacagtgacagaagctgacatggccatcgccatggccctgatgggcggcatcggcttcatccaccacaactgcaccccagagttccaggccaatgaggtgaggaaggtgaagaagtttgagcagggcttcatcacagatcctgtggtgctgagccccagccacacagtgggagatgtgctggaggccaagatgagacatggcttcagcggcatccccatcacagagaccggcaccatgggcagcaagctggtgggcatcgtgaccagccgggacatcgacttcctggccgagaaggaccacaccaccctgctgtctgaggtgatgaccccccgcatcgagctggtggtggccccagctggggtgaccctgaaggaggccaatgagatcctgcagaggagcaagaagggcaagctgcccatcgtgaatgactgtgatgagctggtggccatcatcgccaggacagacctgaagaagaacagagactaccccctggccagcaaggacagccagaagcagctgctgtgtggggctgctgtgggcaccagagaagatgacaagtaccgcctggacctgctgacccaggccggcgtggatgtgattgtgctggacagcagccagggcaacagcgtgtaccagatcgccatggtgcactacatcaagcagaagtacccccacctgcaggtgattggaggaaatgtggtgacagctgcccaggccaagaacctgattgatgctggggtggatggcctgcgggtgggcatgggctgcggcagcatctgcatcacccaggaggtgatggcctgtggccggccccagggcacagctgtgtacaaggtggccgagtatgcccggcgcttcggcgtgcccatcatcgcagatggcggcatccagacagtgggccacgtggtgaaggccctggccctgggcgccagcacagtgatgatgggcagcctgctggccgccaccacagaggcccctggagagtacttcttcagtgatggagtgcggctgaagaagtaccggggcatgggcagcctggatgccatggagaagagcagcagcagccagaagcgctacttcagcgagggggacaaggtgaagatcgcccagggcgtgtctggcagcatccaggacaagggcagcatccagaagtttgtgccctacctgattgctggcatccagcacggctgccaggacatcggggcccggagcctgtctgtgctgcgctccatgatgtacagcggggagctgaagtttgagaagaggaccatgtctgcccagatcgagggcggcgtgcacggcctgcacagctatgagaagaggctgtactag

SEQ ID NO: 155886 - DNA, 1770 bp, Artificial Sequence
  Description of Artificial Sequence: Synthetic coding sequence
atggagggccccctgaccccaccacccctgcagggcggcggcgctgctgctgtgcctgagcccggggcccggcagcaccctggccatgaaacagctgcccagcgctacagcgcccggctgctgcaggccggctatgagcctgagagctgcttcctgctggagctgagctctgtggtgctgctggccggcgtgggcgtgcagatggaccggctgcggcgggcctccatggctgactacctgatcagcggcggcaccggctacgtgcctgaagatggcctgacagcccagcagctgtttgccagcgcagatggcctgacctacaatgacttcctgatcctgcccggcttcatcgacttcatcgcagatgaggtggacctgaccagcgccctgaccaggaagatcaccctgaagacccccctcatcagcagccccatggacacagtgacagaagctgacatggccatcgccatggccctgatgggcggcatcggcttcatccaccacaactgcaccccagagttccaggccaatgaggtgaggaaggtgaagaagtttgagcagggcttcatcacagatcctgtggtgctgagccccagccacacagtgggagatgtgctggaggccaagatgagacatggcttcagcggcatccccatcacagagaccggcaccatgggcagcaagctggtgggcatcgtgaccagccgggacatcgacttcctggccgagaaggaccacaccaccctgctgtctgaggtgatgaccccccgcatcgagctggtggtggccccagctggggtgaccctgaaggaggccaatgagatcctgcagaggagcaagaagggcaagctgcccatcgtgaatgactgtgatgagctggtggccatcatcgccaggacagacctgaagaagaacagagactaccccctggccagcaaggacagccagaagcagctgctgtgtggggctgctgtgggcaccagagaagatgacaagtaccgcctggacctgctgacccaggccggcgtggatgtgattgtgctggacagcagccagggcaacagcgtgtaccagatcgccatggtgcactacatcaagcagaagtacccccacctgcaggtgattggaggaaatgtggtgacagctgcccaggccaagaacctgattgatgctggggtggatggcctgcgggtgggcatgggctgcggcagcatctgcatcacccaggaggtgatggcctgtggccggccccagggcacagctgtgtacaaggtggccgagtatgcccggcgcttcggcgtgcccatcatcgcagatggcggcatccagacagtgggccacgtggtgaaggccctggccctgggcgccagcacagtgatgatgggcagcctgctggccgccaccacagaggcccctggagagtacttcttcagtgatggagtgcggctgaagaagtaccggggcatgggcagcctggatgccatggagaagagcagcagcagccagaagcgctacttcagcgagggggacaaggtgaagatcgcccagggcgtgtctggcagcatccaggacaagggcagcatccagaagtttgtgccctacctgattgctggcatccagcacggctgccaggacatcggggcccggagcctgtctgtgctgcgctccatgatgtacagcggggagctgaagtttgagaagaggaccatgtctgcccagatcgagggcggcgtgcacggcctgcacagctatgagaagaggctgtactag

SEQ ID NO: 155887 - DNA, 1593 bp, Artificial Sequence
  Description of Artificial Sequence: Synthetic coding sequence
atggagggccccctgaccccaccacccctgcagggcggcggcgctgctgctgtgcctgagcccggggcccggcagcaccctggccatgaaacagctgcccagcgctacagcgcccggctgctgcaggccggctatgagcctgagagtgacttcctgatcctgcccggcttcatcgacttcatcgcagatgaggtggacctgaccagcgccctgaccaggaagatcaccctgaagacccccctcatcagcagccccatggacacagtgacagaggccgacatggccatcgccatggccctgatgggcggcatcggcttcatccaccacaactgcaccccagagttccaggccaatgaggtgaggaaggtgaagaagtttgagcagggcttcatcacagatcctgtggtgctgagccccagccacacagtgggagatgtgctggaggccaagatgagacatggcttcagcggcatccccatcacagaaacaggcaccatgggcagcaagctggtgggcatcgtgaccagccgggacatcgacttcctggccgagaaggaccacaccaccctgctgtctgaggtgatgaccccaagaattgagctggtggtggccccagctggggtgaccctgaaggaggccaatgagatcctgcagaggagcaagaagggcaagctgcccatcgtgaatgactgtgatgagctggtggccatcatcgccaggacagacctgaagaagaacagagactaccccctggccagcaaggacagccagaagcagctgctgtgtggggctgctgtgggcacccgggaggatgacaagtaccgcctggacctgctgacccaggccggcgtggatgtgattgtgctggacagcagccagggcaacagcgtgtaccagatcgccatggtgcactacatcaagcagaagtacccccacctgcaggtgattggaggaaatgtggtgacagctgcccaggccaagaacctgattgatgctggggtggatggcctgcgggtgggcatgggctgcggcagcatctgcatcacccaggaggtgatggcctgtggccggccccagggcacagctgtgtacaaggtggccgagtatgccaggagatttggagtgcccatcatcgcagatggcggcatccagacagtgggccacgtggtgaaggccctggccctgggcgccagcacagtgatgatgggcagcctgctggccgccaccacagaggcccctggagagtacttcttcagtgatggagtgcggctgaagaagtaccggggcatgggcagcctggatgccatggagaagagcagcagcagccagaagcgctacttcagcgagggggacaaggtgaagatcgcccagggcgtgtctggcagcatccaggacaagggcagcatccagaagtttgtgccctacctgattgctggcatccagcacggctgccaggacattggagcccggagcctgtctgtgctgcgctccatgatgtacagcggggagctgaagtttgagaagaggaccatgtctgcccagattgaaggaggagtgcacggcctgcacagctatgagaagaggctgtactag

SEQ ID NO: 155888 - DNA, 1701 bp, Artificial Sequence
  Description of Artificial Sequence: Synthetic coding sequence
atggagggccccctgaccccaccacccctgcagggcggcggcgctgctgctgtgcctgagcccggggcccggcagcaccctggccatgaaacagctgcccagcgctacagcgcccggctgctgcaggccggctatgagcctgagagcccccggctggacctggccacccaccccaccacccccaggtctgagctgagctctgtggtgctgctggccggcgtgggcgtgcagatggaccggctgcggcgggccagtgacttcctgatcctgcccggcttcatcgacttcatcgcagatgaggtggacctgaccagcgccctgaccaggaagatcaccctgaagacccccctcatcagcagccccatggacacagtgacagaggccgacatggccatcgccatggccctgatgggcggcatcggcttcatccaccacaactgcaccccagagttccaggccaatgaggtgaggaaggtgaagaagtttgagcagggcttcatcacagatcctgtggtgctgagccccagccacacagtgggagatgtgctggaggccaagatgagacatggcttcagcggcatccccatcacagaaacaggcaccatgggcagcaagctggtgggcatcgtgaccagccgggacatcgacttcctggccgagaaggaccacaccaccctgctgtctgaggtgatgaccccaagaattgagctggtggtggccccagctggggtgaccctgaaggaggccaatgagatcctgcagaggagcaagaagggcaagctgcccatcgtgaatgactgtgatgagctggtggccatcatcgccaggacagacctgaagaagaacagagactaccccctggccagcaaggacagccagaagcagctgctgtgtggggctgctgtgggcacccgggaggatgacaagtaccgcctggacctgctgacccaggccggcgtggatgtgattgtgctggacagcagccagggcaacagcgtgtaccagatcgccatggtgcactacatcaagcagaagtacccccacctgcaggtgattggaggaaatgtggtgacagctgcccaggccaagaacctgattgatgctggggtggatggcctgcgggtgggcatgggctgcggcagcatctgcatcacccaggaggtgatggcctgtggccggccccagggcacagctgtgtacaaggtggccgagtatgccaggagatttggagtgcccatcatcgcagatggcggcatccagacagtgggccacgtggtgaaggccctggccctgggcgccagcacagtgatgatgggcagcctgctggccgccaccacagaggcccctggagagtacttcttcagtgatggagtgcggctgaagaagtaccggggcatgggcagcctggatgccatggagaagagcagcagcagccagaagcgctacttcagcgagggggacaaggtgaagatcgcccagggcgtgtctggcagcatccaggacaagggcagcatccagaagtttgtgccctacctgattgctggcatccagcacggctgccaggacattggagcccggagcctgtctgtgctgcgctccatgatgtacagcggggagctgaagtttgagaagaggaccatgtctgcccagattgaaggaggagtgcacggcctgcacagctatgagaagaggctgtactag

SEQ ID NO: 155889 - DNA, 1530 bp, Artificial Sequence
  Description of Artificial Sequence: Synthetic coding sequence
atggctgactacctgatcagcggcggcaccggctacgtgcctgaagatggcctgacagcccagcagctgtttgccagcgcagatggcctgacctacaatgacttcctgatcctgcccggcttcatcgacttcatcgcagatgaggtggacctgaccagcgccctgaccaggaagatcaccctgaagacccccctcatcagcagccccatggacacagtgacagaggccgacatggccatcgccatggccctgatgggcggcatcggcttcatccaccacaactgcaccccagagttccaggccaatgagaagtttgagcagggcttcatcacagatcctgtggtgctgagccccagccacacagtgggagatgtgctggaggccaagatgagacatggcttcagcggcatccccatcacagagaccggcaccatgggcagcaagctggtgggcatcgtgaccagccgggacatcgacttcctggccgagaaggaccacaccaccctgctgtctgaggtgatgaccccccgcatcgagctggtggtggccccagctggggtgaccctgaaggaggccaatgagatcctgcagaggagcaagaagggcaagctgcccatcgtgaatgactgtgatgagctggtggccatcatcgccaggacagacctgaagaagaacagagactaccccctggccagcaaggacagccagaagcagctgctgtgtggggctgctgtgggcaccagagaagatgacaagtaccgcctggacctgctgacccaggccggcgtggatgtgattgtgctggacagcagccagggcaacagcgtgtaccagatcgccatggtgcactacatcaagcagaagtacccccacctgcaggtgattggaggaaatgtggtgacagctgcccaggccaagaacctgattgatgctggggtggatggcctgcgggtgggcatgggctgcggcagcatctgcatcacccaggaggtgatggcctgtggccggccccagggcacagctgtgtacaaggtggccgagtatgcccggcgcttcggcgtgcccatcatcgcagatggcggcatccagacagtgggccacgtggtgaaggccctggccctgggcgccagcacagtgatgatgggcagcctgctggccgccaccacagaggcccctggagagtacttcttcagtgatggagtgcggctgaagaagtaccggggcatgggcagcctggatgccatggagaagagcagcagcagccagaagcgctacttcagcgagggggacaaggtgaagatcgcccagggcgtgtctggcagcatccaggacaagggcagcatccagaagtttgtgccctacctgattgctggcatccagcacggctgccaggacatcggggcccggagcctgtctgtgctgcgctccatgatgtacagcggggagctgaagtttgagaagaggaccatgtctgcccagatcgagggcggcgtgcacggcctgcacagctatgagaagaggctgtactag

SEQ ID NO: 155890 - DNA, 1470 bp, Artificial Sequence; identical to SEQ ID NO: 155884
  Description of Artificial Sequence: Synthetic coding sequence

SEQ ID NO: 155891 - DNA, 1545 bp, Artificial Sequence
  Description of Artificial Sequence: Synthetic coding sequence
atggctgactacctgatcagcggcggcaccagctatgtgcctgatgatggcctgacagcccagcagctgttcaactgtggagatggcctgacctacaatgacttcctgatcctgcccggctacatcgacttcaccgctgaccaggtggacctgaccagcgccctgaccaagaagatcaccctgaagacccccctggtgagcagccccatggacacagtgacagaggccggcatggccatcgccatggccctgactggaggcatcggcttcatccaccacaactgcaccccagagttccaggccaatgaggtgaggaaggtgaagaagtatgagcagggcttcatcacagatcctgtggtgctgagccccaaggacagagtgagagatgtgtttgaggccaaggcccggcacggcttctgtggcatccccatcacagacaccggccgcatgggcagccggctggtgggcatcatcagcagccgggacatcgacttcctgaaggaggaggagcatgactgcttcctggaggagatcatgaccaagcgggaggacctggtggtggccccagctggcatcaccctgaaggaggccaatgagatcctgcagaggagcaagaagggcaagctgcccatcgtgaatgaagatgatgagctggtggccatcatcgccaggacagacctgaagaagaacagagactaccccctggccagcaaggatgccaagaagcagctgctgtgtggggccgccatcggcacccatgaagatgacaagtaccgcctggacctgctggcccaggccggcgtggatgtggtggtgctggacagcagccagggcaacagcatcttccagatcaacatgatcaagtacatcaaggacaagtaccccaacctgcaggtgattggaggaaatgtggtgacagctgcccaggccaagaacctgattgatgctggggtggatgccctgcgggtgggcatgggcagcggcagcatctgcatcacccaggaggtgctggcctgtggccggccccaggccacagctgtgtacaaggtgtctgaatatgccaggagatttggagtgcctgtgattgctgatggcggcatccagaatgtgggccacatcgccaaggccctggccctgggcgccagcacagtgatgatgggcagcctgctggccgccaccacagaggcccctggagagtacttcttcagtgatggcatccggctgaagaagtaccggggcatgggcagcctggatgccatggacaagcacctgagcagccagaaccgctacttcagcgaggccgacaagatcaaggtggcccagggcgtgtctggagctgtgcaggacaagggcagcatccacaagtttgtgccctacctgattgctggcatccagcacagctgccaggacattggagccaagagcctgacccaggtgcgggccatgatgtacagcggggagctgaagtttgagaagaggaccagcagcgcccaggtggagggcggcgtgcacagcctgcacagctatgagaagaggctcttctag

SEQ ID NO: 155892 - DNA, 1074 bp, Artificial Sequence
  Description of Artificial Sequence: Synthetic coding sequence
atggctgactacctgatcagcggcggcaccagctatgtgcctgatgatggcctgacagcccagcagctgttcaactgtggagatggcctgacctacaatgacttcctgatcctgcccggctacatcgacttcaccgctgaccaggtggacctgaccagcgccctgaccaagaagatcaccctgaagacccccctggtgagcagccccatggacacagtgacagaggccggcatggccatcgccatggccctgactggaggcatcggcttcatccaccacaactgcaccccagagttccaggccaatgaggtgaggaaggtgaagaagtatgagcagggcttcatcacagatcctgtggtgctgagccccaaggacagagtgagagatgtgtttgaggccaaggcccggcacggcttctgtggcatccccatcacagacaccggccgcatgggcagccggctggtgggcatcatcagcagccgggacatcgacttcctgaaggaggaggagcatgactgcttcctggaggagatcatgaccaagcgggaggacctggtggtggccccagctggcatcaccctgaaggaggccaatgagatcctgcagaggagcaagaagggcaagctgcccatcgtgaatgaagatgatgagctggtggccatcatcgccaggacagacctgaagaagaacagagactaccccctggccagcaaggatgccaagaagcagctgctgtgtggggccgccatcggcacccatgaagatgacaagtaccgcctggacctgctggcccaggccggcgtggatgtggtggtgctggacagcagccagggcaacagcatcttccagatcaacatgatcaagtacatcaaggacaagtaccccaacctgcaggtgattggaggaaatgtggtgacagctgcccaggccaagaacctgattgatgctggggtggatgccctgcgggtgggcatgggcagcggcagcatctgcatcacccaggaggtgctggcctgtggccggccccaggccacagctgtgtgcacccagaagcagcacccccacttccagtag

SEQ ID NO: 155893 - DNA, 501 bp, Artificial Sequence
  Description of Artificial Sequence: Synthetic coding sequence
atgctgcggggcgtgctgggcaagaccttccggctggtgggctacaccatccagtatggctgcatcgcccactgtgcctttgaatatgtgggcggcgtggtgatgtgcagcggccccagcatggagcccaccatccagaacagcgacatcgtgtttgctgagaacctgagccgccacttctacggcatccagagaggagacatcgtcatcgccaagagccccagcgaccccaagagcaacatctgcaagagggtcatcggcctggagggggacaagatcctgaccaccagccccagcgacttcttcaagagccacagctatgtgcccatgggccacgtgtggctggagggggacaacctgcagaacagcacagacagccgctgctacggccccatcccctacggcctcatccggggccgcatcttcttcaagatctggcccctgagtgactttggcttcctgcgggccagccccaacggccaccgcttcagtgatgactag

SEQ ID NO: 155894 - DNA, 324 bp, Artificial Sequence
  Description of Artificial Sequence: Synthetic coding sequence
atgctgcggggcgtgctgggcaagaccttccggctggtgggctacaccatccagtatggctgcatcgcccactgtgcctttgaatatgtgggcggcgtggtgatgtgcagcggccccagcatggagcccaccatccagaacagcgacatcgtgtttgctgagaacctgagccgccacttctacggcatccagagaggagacatcgtcatcgccaagagccccagcgaccccaagagcaacatctgcaagagggtcatcggcctggagggggacaagatcctgaccaccagccccagcgacttcttcaagagccacagctactag

SEQ ID NO: 155895 - DNA, 291 bp, Artificial Sequence
  Description of Artificial Sequence: Synthetic coding sequence
atgctgcggggcgtgctgggcaagaccttccggctggtgggctacaccatccagtatggctgcatcgcccactgtgcctttgaatatgtgggcggcgtggtgatgtgcagcggccccagcatggagcccaccatccagaacagcgacatcgtgtttgctgagaacctgagccgccacttctacggcatccagagaggagacatcgtcatcgccaagagccccagcgaccccaagagcaacatctgcaagagggtcatcggcctggagggggacaagatcctgaccacctag

SEQ ID NO: 155896 - DNA, 501 bp, Artificial Sequence; identical to SEQ ID NO: 155893
  Description of Artificial Sequence: Synthetic coding sequence

SEQ ID NO: 155897 - DNA, 528 bp, Artificial Sequence
  Description of Artificial Sequence: Synthetic coding sequence
atggcccagagccagggctgggtgaagcgctacatcaaggccttctgcaagggcttctttgtggccgtgcctgtggccgtgaccttcctggacagagtggcctgtgtggcccgggtggagggcgcctccatgcagcccagcctgaaccctgggggcagccagagcagtgatgtggtgctgctgaaccactggaaggtgaggaactttgaggtgcacagaggagacatcgtgtccctggtgagccccaagaaccctgagcagaagatcatcaagagggtcatcgccctggagggggacatcgtgaggaccatcggccacaagaaccgctacgtgaaggtgccccggggccacatctgggtggagggggaccaccacggccacagctttgacagcaacagctttggacctgtgtccctgggcctgctgcacgcccacgccacccacatcctgtggcccccagagcgctggcagaagctggagagcgtgctgcccccagagcggctgcctgtgcagcgggaggaggagtag

SEQ ID NO: 155898 - DNA, 528 bp, Artificial Sequence; identical to SEQ ID NO: 155897
  Description of Artificial Sequence: Synthetic coding sequence

SEQ ID NO: 155899 - DNA, 528 bp, Artificial Sequence; identical to SEQ ID NO: 155897
  Description of Artificial Sequence: Synthetic coding sequence

SEQ ID NO: 155900 - DNA, 333 bp, Artificial Sequence
  Description of Artificial Sequence: Synthetic coding sequence
atggcccagagccagggctgggtgaagcgctacatcaaggccttctgcaagggcttctttgtggccgtgcctgtggccgtgaccttcctggacagagtggcctgtgtggcccgggtggagggcgcctccatgcagcccagcctgaaccctgggggcagccagagcagtgatgtggtgctgctgaaccactggaaggtgaggaactttgaggtgcacagaggagacatcgtgtccctggtgagccccaagaaccctgagcagaagatcatcaagagggtcatcgccctggagggggacatcgtgagagatggcaggaagctgaagaggatctag

SEQ ID NO: 155901 - DNA, 240 bp, Artificial Sequence
  Description of Artificial Sequence: Synthetic coding sequence
atggcccagagccagggctgggtgaagcgctacatcaaggccttctgcaagggcttctttgtggccgtgcctgtggccgtgaccttcctggacagagtggcctgtgtggcccgggtggagggcgcctccatgcagcccagcctgaaccctgggggcagccagagcagtgatgtggtgctgctgaaccactggaaggtgaggaactttgaggtgcacagaggagacatcgtgtccctgtag

SEQ ID NO: 155902 - DNA, 528 bp, Artificial Sequence; identical to SEQ ID NO: 155897
  Description of Artificial Sequence: Synthetic coding sequence

SEQ ID NO: 155903 - DNA, 555 bp, Artificial Sequence
  Description of Artificial Sequence: Synthetic coding sequence
atggtgaggaagctgaagttccacgagcagaagctgctgaagcaggtggacttcctgaactgggaggtgacagaccacaacctgcacgagctgcgggtgctgcggcgctaccgcctgcagaggcgggaggactacacccgctacaaccagctgagcagagctgtgcgggagctggcccggcggctgcgggacctgcctgagcgggaccagttccgggtgcgggccagcgctgccctgctggacaagctgtatgccctgggcctggtgcccacccggggcagcctggagctgtgtgactttgtgacagccagcagcttctgcagaagaaggctgcccaccgtgctgctgaagctgaggatggcccagcacctgcaggccgctgtggcctttgtggagcagggccacgtgcgggtgggcccagatgtggtgacagatcctgccttcctggtgaccaggtccatggaggactttgtgacctgggtggacagcagcaagatcaagagacatgtgctggagtacaatgaggagagagatgactttgacctggaggcctag

SEQ ID NO: 155904 - DNA, 555 bp, Artificial Sequence; identical to SEQ ID NO: 155903
  Description of Artificial Sequence: Synthetic coding sequence

SEQ ID NO: 155905 - DNA, 96 bp, Artificial Sequence
  Description of Artificial Sequence: Synthetic coding sequence
atggaggactttgtgacctgggtggacagcagcaagatcaagagacatgtgctggagtacaatgaggagagagatgactttgacctggaggcctag

SEQ ID NO: 155906 - DNA, 876 bp, Artificial Sequence
  Description of Artificial Sequence: Synthetic coding sequence
atgctgcggcgggaggcccggctgcggcgggagtacctgtacaggaaggcccgggaggaggcccagaggtctgcccaggagaggaaggagcggctgcggcgggccctggaggagaacagactcatccccacagagctgcggcgggaggccctggccctgcagggcagcctggagtttgatgatgctggaggagagggcgtgaccagccacgtggatgatgagtaccgctgggccggcgtggaggaccccaaggtgatgatcaccaccagccgggaccccagcagccggctgaagatgtttgccaaggagctgaagctggtgtttcctggggcccagaggatgaacagaggaagacatgaggtgggcgccctggtgcgggcctgcaaggccaatggagtgacagacctgctggtggtgcatgagcaccggggcacccctgtgggcctcatcgtgagccacctgcccttcggccccacagcctacttcaccctgtgcaatgtggtgatgagacatgacatcccagacctgggcaccatgtctgaggccaagccccacctgatcacccacggcttcagcagccggctgggcaagagggtgtctgacatcctgcgctacctgtttcctgtgcccaaggatgacagccacagggtcatcacctttgccaaccaggatgactacatctccttccgccaccacgtgtacaagaagacagaccacagaaatgtggagctgacagaggtgggccccaggtttgagctgaagctgtacatgatccggctgggcaccctggagcaggaggccacagcagatgtggagtggcgctggcacccctacaccaacacagccaggaagagggtcttcctgagcacagaatag

SEQ ID NO: 155907 - DNA, 2928 bp, Artificial Sequence
  Description of Artificial Sequence: Synthetic coding sequence
atggacctgaacagcgccagcacagtggtgctgcaggtgctgacccaggccaccagccaggacacagctgtgctgaagccagctgaggagcagctgaagcagtgggagacccagcccggcttctacagcgtgctgctgaacatcttcaccaaccacaccctggacatcaacgtgcgctggctggccgtgctgtacttcaagcacggcatcgaccgctactggaggagagtggccccccacgccctgtctgaggaggagaagaccaccctgcgggccggcctcatcaccaacttcaatgagcccatcaaccagatcgccacccagattgctgtgctgattgccaaggtggcccggctggactgcccccggcagtggccagagctgatccccaccctgattgaatctgtgaaggtgcaggatgacctgcggcagcaccgggccctgctgaccttctaccacgtgaccaagaccctggccagcaagaggctggccgctgacaggaagctgttctatgacctggccagcggcatctacaactttgcctgcagcctgtggaaccaccacacagacaccttcctgcaggaggtgtcctctggaaatgaggccgccatcctgagcagcctggagaggaccctgctgagcctgaaggtgctgaggaagctgactgtgaatggatttgtggagccccacaagaacatggaggtgatgggcttcctgcacggcatctttgagcggctgaagcagttcctggagtgcagccgcagcatcggcacagacaacgtgtgccgggaccggctggagaagaccatcatcctcttcaccaaggtgctgctggacttcctggaccagcaccccttctccttcacccccctcatccagaggagcctggagttctctgtgtcctatgtgttcacagaggtgggggagggcgtgacctttgagcgcttcatcgtgcagtgcatgaacctgatcaagatgattgtgaagaactatgcctacaagcccagcaagaactttgaggacagcagccctgagaccctggaggcccacaagatcaagatggccttcttcacctaccccaccctgacagagatctgccggcggctggtgagccactacttcctgctgacagaggaggagctgaccatgtgggaggaggaccctgagggcttcaccgtggaggagaccggcggggacagctggaagtacagcctgcggccctgcacagaggtgctcttcatcgacatcttccacgagtacaaccagaccctgacccctgtgctgctggagatgatgcagaccctgcagggccccaccaacgtggaggacatgaatgccctgctgatcaaggatgctgtgtacaatgctgtgggcctggccgcctatgagctgtttgattctgtggactttgaccagtggttcaagaaccagctgctgcctgagctgcaggtgatccacaaccgctacaagcccctgcggcggcgggtcatctggctgattggccagtggatctctgtgaagttcaagagtgacctgcggcccatgctgtatgaggccatctgcaacctgctgcaggaccaggacctggtggtgagaattgaaacagccaccaccctgaagctgactgtggatgactttgagttcagaacagaccagttcctgccctacctggagaccatgttcaccctgctcttccagctgctgcagcaggtgacagaatgtgacaccaagatgcacgtgctgcacgtgctgagctgtgtgattgaaagagtgaacatgcagatccggccctacgtgggctgcctggtgcagtacctgcccctgctgtggaagcagagcgaggagcacaacatgctgcgctgtgccatcctgaccaccctcatccacctggtgcagggcctgggcgctgacagcaagaacctgtaccccttcctgctgcctgtgatccagctgagcacagatgtgtcccagcccccccacgtgtacctgctggaggatggcctggagctgtggctggtgaccctggagaacagcccctgcatcaccccagagctgctgcgcatcttccagaacatgagccccctgctggagctgagcagcgagaacctgcggacctgcttcaagatcatcaatggctacatcttcctgagcagcacagagttcctgcagacctatgctgtgggcctgtgccagagcttctgtgagctgctgaaggagatcaccacagagggccaggtgcaggtgctgaaggtggtggagaatgccctgaaggtgaaccccatcctgggcccccagatgttccagcccatcctgccctacgtgttcaagggcatcattgaaggagagcgctaccctgtggtgatgagcacctacctgggcgtgatgggccgggtgctgctgcagaacaccagcttcttcagcagcctgctgaatgagatggcccacaagttcaaccaggagatggaccagctgctgggcaacatgattgagatgtgggtggacaggatggacaacatcacccagcctgagaggaggaagctgagcgccctggccctgctgagcctgctgcccagcgacaacagcgtcatccaggacaagttctgtggcatcatcaacatctctgtggagggcctgcatgatgtgatgacagaggaccctgagaccggcacctacaaggactgcatgctgatgagccacctggaggagcccaaggtgacagaagatgaggagcccccaacagagcaggacaagaggaagaagatgctggccctgaaggaccctgtgcacacagtgtccctgcagcagttcatctatgagaagctgaaggcccagcaggagatgctgggggagcagggcttccagagcctgatggagaccgtggacacagagatcgtgacccagctgcaggagttcctgcagggcttctag

SEQ ID NO: 155908 - DNA, 3048 bp, Artificial Sequence
  Description of Artificial Sequence: Synthetic coding sequence
atggtgcagcccatcatccacctgggctacgtggtgtacagcctgctgtacctgggctacaagcctgtgcagcacgtgacagccctgaacacagtgagcagctgccacaagatggtgtccatggacctgaacagcgccagcacagtggtgctgcaggtgctgacccaggccaccagccaggacacagctgtgctgaagccagctgaggagcagctgaagcagtgggagacccagcccggcttctacagcgtgctgctgaacatcttcaccaaccacaccctggacatcaacgtgcgctggctggccgtgctgtacttcaagcacggcatcgaccgctactggaggagagtggccccccacgccctgtctgaggaggagaagaccaccctgcgggccggcctcatcaccaacttcaatgagcccatcaaccagatcgccacccagattgctgtgctgattgccaaggtggcccggctggactgcccccggcagtggccagagctgatccccaccctgattgaatctgtgaaggtgcaggatgacctgcggcagcaccgggccctgctgaccttctaccacgtgaccaagaccctggccagcaagaggctggccgctgacaggaagctgttctatgacctggccagcggcatctacaactttgcctgcagcctgtggaaccaccacacagacaccttcctgcaggaggtgtcctctggaaatgaggccgccatcctgagcagcctggagaggaccctgctgagcctgaaggtgctgaggaagctgactgtgaatggatttgtggagccccacaagaacatggaggtgatgggcttcctgcacggcatctttgagcggctgaagcagttcctggagtgcagccgcagcatcggcacagacaacgtgtgccgggaccggctggagaagaccatcatcctcttcaccaaggtgctgctggacttcctggaccagcaccccttctccttcacccccctcatccagaggagcctggagttctctgtgtcctatgtgttcacagaggtgggggagggcgtgacctttgagcgcttcatcgtgcagtgcatgaacctgatcaagatgattgtgaagaactatgcctacaagcccagcaagaactttgaggacagcagccctgagaccctggaggcccacaagatcaagatggccttcttcacctaccccaccctgacagagatctgccggcggctggtgagccactacttcctgctgacagaggaggagctgaccatgtgggaggaggaccctgagggcttcaccgtggaggagaccggcggggacagctggaagtacagcctgcggccctgcacagaggtgctcttcatcgacatcttccacgagtacaaccagaccctgacccctgtgctgctggagatgatgcagaccctgcagggccccaccaacgtggaggacatgaatgccctgctgatcaaggatgctgtgtacaatgctgtgggcctggccgcctatgagctgtttgattctgtggactttgaccagtggttcaagaaccagctgctgcctgagctgcaggtgatccacaaccgctacaagcccctgcggcggcgggtcatctggctgattggccagtggatctctgtgaagttcaagagtgacctgcggcccatgctgtatgaggccatctgcaacctgctgcaggaccaggacctggtggtgagaattgaaacagccaccaccctgaagctgactgtggatgactttgagttcagaacagaccagttcctgccctacctggagaccatgttcaccctgctcttccagctgctgcagcaggtgacagaatgtgacaccaagatgcacgtgctgcacgtgctgagctgtgtgattgaaagagtgaacatgcagatccggccctacgtgggctgcctggtgcagtacctgcccctgctgtggaagcagagcgaggagcacaacatgctgcgctgtgccatcctgaccaccctcatccacctggtgcagggcctgggcgctgacagcaagaacctgtaccccttcctgctgcctgtgatccagctgagcacagatgtgtcccagcccccccacgtgtacctgctggaggatggcctggagctgtggctggtgaccctggagaacagcccctgcatcaccccagagctgctgcgcatcttccagaacatgagccccctgctggagctgagcagcgagaacctgcggacctgcttcaagatcatcaatggctacatcttcctgagcagcacagagttcctgcagacctatgctgtgggcctgtgccagagcttctgtgagctgctgaaggagatcaccacagagggccaggtgcaggtgctgaaggtggtggagaatgccctgaaggtgaaccccatcctgggcccccagatgttccagcccatcctgccctacgtgttcaagggcatcattgaaggagagcgctaccctgtggtgatgagcacctacctgggcgtgatgggccgggtgctgctgcagaacaccagcttcttcagcagcctgctgaatgagatggcccacaagttcaaccaggagatggaccagctgctgggcaacatgattgagatgtgggtggacaggatggacaacatcacccagcctgagaggaggaagctgagcgccctggccctgctgagcctgctgcccagcgacaacagcgtcatccaggacaagttctgtggcatcatcaacatctctgtggagggcctgcatgatgtgatgacagaggaccctgagaccggcacctacaaggactgcatgctgatgagccacctggaggagcccaaggtgacagaagatgaggagcccccaacagagcaggacaagaggaagaagatgctggccctgaaggaccctgtgcacacagtgtccctgcagcagttcatctatgagaagctgaaggcccagcaggagatgctgggggagcagggcttccagagcctgatggagaccgtggacacagagatcgtgacccagctgcaggagttcctgcagggcttctag

SEQ ID NO: 155909 - DNA, 195 bp, Artificial Sequence
  Description of Artificial Sequence: Synthetic coding sequence
atggacctgaacagcgccagcacagtggtgctgcaggtgctgacccaggccaccagccaggacacagctgtgctgaagccagctgaggagcagctgaagcagtgggagacccagcccggcttctacagcgtgctgctgaacatcttcaccaaccacaccctggacatcaacgtgcgctggctggccgtgctgtag

SEQ ID NO: 155910 - DNA, 489 bp, Artificial Sequence
  Description of Artificial Sequence: Synthetic coding sequence
atggacctgaacagcgccagcacagtggtgctgcaggtgctgacccaggccaccagccaggacacagctgtgctgaagccagctgaggagcagctgaagcagtgggagacccagcccggcttctacagcgtgctgctgaacatcttcaccaaccacaccctggacatcaacgtgcgctggctggccgtgctgtacttcaagcacggcatcgaccgctactggaggagagtggccccccacgccctgtctgaggaggagaagaccaccctgcgggccggcctcatcaccaacttcaatgagcccatcaaccagatcgccacccagattgctgtgctgattgccaaggtggcccggctggactgcccccggcagtggccagagctgatccccaccctgattgaatctgtgaaggtgcaggatgacctgcggcagcaccgggccctgctgaccttctaccacgtgaccaagaccctggccagcaagaggtag

SEQ ID NO: 155911 - DNA, 450 bp, Artificial Sequence
  Description of Artificial Sequence: Synthetic coding sequence
atggacctgaacagcgccagcacagtggtgctgcaggtgctgacccaggccaccagccaggacacagctgtgctgaagccagctgaggagcagctgaagcagtgggagacccagcccggcttctacagcgtgctgctgaacatcttcaccaaccacaccctggacatcaacgtgcgctggctggccgtgctgtacttcaagcacggcatcgaccgctactggaggagagtggccccccacgccctgtctgaggaggagaagaccaccctgcgggccggcctcatcaccaacttcaatgagcccatcaaccagatcgccacccagattgctgtgctgattgccaaggtggcccggctggactgcccccggcagtggccagagctgatccccaccctgattgaatctgtgaaggtgcaggatgacctgcggcagcaccgggccctgctgtag

SEQ ID NO: 155912 - DNA, 1425 bp, Artificial Sequence
  Description of Artificial Sequence: Synthetic coding sequence
atgatgcagaccctgcagggccccaccaacgtggaggacatgaatgccctgctgatcaaggatgctgtgtacaatgctgtgggcctggccgcctatgagctgtttgattctgtggactttgaccagtggttcaagaaccagctgctgcctgagctgcaggtgatccacaaccgctacaagcccctgcggcggcgggtcatctggctgattggccagtggatctctgtgaagttcaagagtgacctgcggcccatgctgtatgaggccatctgcaacctgctgcaggaccaggacctggtggtgagaattgaaacagccaccaccctgaagctgactgtggatgactttgagttcagaacagaccagttcctgccctacctggagaccatgttcaccctgctcttccagctgctgcagcaggtgacagaatgtgacaccaagatgcacgtgctgcacgtgctgagctgtgtgattgaaagagtgaacatgcagatccggccctacgtgggctgcctggtgcagtacctgcccctgctgtggaagcagagcgaggagcacaacatgctgcgctgtgccatcctgaccaccctcatccacctggtgcagggcctgggcgctgacagcaagaacctgtaccccttcctgctgcctgtgatccagctgagcacagatgtgtcccagcccccccacgtgtacctgctggaggatggcctggagctgtggctggtgaccctggagaacagcccctgcatcaccccagagctgctgcgcatcttccagaacatgagccccctgctggagctgagcagcgagaacctgcggacctgcttcaagatcatcaatggctacatcttcctgagcagcacagagttcctgcagacctatgctgtgggcctgtgccagagcttctgtgagctgctgaaggagatcaccacagagggccaggtgcaggtgctgaaggtggtggagaatgccctgaaggtgaaccccatcctgggcccccagatgttccagcccatcctgccctacgtgttcaagggcatcattgaaggagagcgctaccctgtggtgatgagcacctacctgggcgtgatgggccgggtgctgctgcagaacaccagcttcttcagcagcctgctgaatgagatggcccacaagttcaaccaggagatggaccagctgctgggcaacatgattgagatgtgggtggacaggatggacaacatcacccagcctgagaggaggaagctgagcgccctggccctgctgagcctgctgcccagcgacaacagcgtcatccaggacaagttctgtggcatcatcaacatctctgtggagggcctgcatgatgtgatgacagaggaccctgagaccggcacctacaaggactgcatgctgatgagccacctggaggagcccaagtag

SEQ ID NO: 155913 - DNA, 3117 bp, Artificial Sequence
  Description of Artificial Sequence: Synthetic coding sequence
atggaccccaacaccatcatcgaggccctgcggggcaccatggaccctgccctgcgggaggccgctgagcggcagctgaatgaggcccacaagagcctgaactttgtgtccaccctgctgcagatcaccatgtctgagcagctggacctgcctgtgcggcaggccggggtcatctacctgaagaacatgatcacccagtactggccagaccgggagacagcccctggggacatcagcccctacaccatccctgaggaggacagacactgcatcagagaaaatattgtggaggccatcatccacagccctgagctgatccgggtgcagctgaccacctgcatccaccacatcatcaagcatgactaccccagccgctggacagccatcgtggacaagattggcttctacctgcagagcgacaacagcgcctgctggctgggcatcctgctgtgcctgtaccagctggtgaagaactatgagtacaagaagccagaggagaggagccccctggtggccgccatgcagcacttcctgcctgtgctgaaggaccgcttcatccagctgctgagtgaccagagcgaccagagcgtgctgatccagaagcagatcttcaagatcttctacgccctggtgcagtacaccctgcccctggagctgatcaaccagcagaacctgacagagtggattgagatcctgaagacagtggtgaacagagatgtgcccaatgagaccctgcaggtggaggaggatgacaggcctgagctgccctggtggaagtgcaagaagtgggccctgcacatcctggcccggctgtttgaaagatatggcagccctggaaatgtgtccaaggagtacaatgaatttgctgaggtgttcctgaaggcctttgctgtgggcgtgcagcaggtgctgctgaaggtgctgtaccagtacaaggagaagcagtacatggccccccgggtgctgcagcagaccctgaactacatcaaccagggcgtgtcccatgccctgacctggaagaacctgaagccccacatccagggcatcatccaggacgtcatcttccccctgatgtgctacacagatgctgatgaggagctgtggcaggaggacccctatgagtacatccgcatgaagtttgatgtgtttgaggacttcatcagccccaccacagctgcccagaccctgctcttcaccgcctgcagcaagaggaaggaggtgctgcagaagaccatgggcttctgctaccagatcctgacagagcccaatgctgaccccaggaagaaggatggagccctgcacatgattggcagcctggccgagatcctgctgaagaagaagatctacaaggaccagatggagtacatgctgcagaaccacgtgttccccctcttcagcagcgagctgggctacatgagggcccgggcctgctgggtgctgcactacttctgtgaggtgaagttcaagagtgaccagaacctgcagacagccctggagctgacccggcgctgcctgattgatgaccgggagatgcctgtgaaggtggaggccgccatcgccctgcaggtgctgatcagcaaccaggagaaggccaaggagtacatcacccccttcatccggcctgtgatgcaggccctgctgcacatcatccgggagacagaaaatgatgacctgaccaacgtcatccagaagatgatctgtgagtacagcgaggaggtgacccccatcgctgtggagatgacccagcacctggccatgaccttcaaccaggtgatccagacaggcccagatgaggagggcagtgatgacaaggctgtgacagccatgggcatcctgaacaccatcgacaccctgctgtctgtggtggaggaccacaaggagatcacccagcagctggagggcatctgcctgcaggtgattggcaccgtgctgcagcagcacgtgctggagttctatgaggagatcttcagcctggcccacagcctgacctgccagcaggtgagcccccagatgtggcagctgctgcccctggtgtttgaggtgttccagcaggacggctttgactacttcacagacatgatgcccctgctgcacaactacgtgacagtggacacagacaccctgctgagtgacaccaagtacctggagatgatctacagcatgtgcaagaaggtgctgactggagtggccggggaggatgctgaatgtcatgctgccaagctgctggaggtgatcatcctgcagtgcaagggccggggcatcgaccagtgcatccccctgtttgtggaggccgccctggagcggctgacccgggaggtgaagaccagcgagctgcggaccatgtgcctgcaggtggccatcgccgccctgtactacaacccccacctgctgctgaacaccctggagaacctgcgcttccccaacaacgtggagcctgtgaccaaccacttcatcacccagtggctgaatgatgtggactgcttcctgggcctgcatgacaggaagatgtgtgtgctgggcctgtgtgccctgattgacatggagcagatcccccaggtgctgaaccaggtgtctggccagatcctgcctgccttcatcctgctcttcaacggcctgaagagggcctatgcctgccacgccgagcatgaaaatgacagtgatgatgatgatgaagcagaagatgatgatgaaacagaggagctgggcagtgatgaagatgacattgatgaagatggccaggagtacctggagatcctggccaagcaggccggagaagatggagatgatgaggactgggaggaggatgatgctgaggagacagccctggagggctacagcaccatcattgatgatgaggacaaccctgtggatgagtaccagatcttcaaggccatcttccagaccatccagaacagaaatcctgtgtggtaccaggccctgacccacggcctgaatgaggagcagaggaagcagctgcaggacatcgccaccctggccgaccagaggcgggccgcccacgagagcaagatgattgagaagcacggcggctacaagttcagcgcccctgtggtgcccagcagcttcaactttggaggccctgcccctggcatgaactag

SEQ ID NO: 155914 - DNA, 3114 bp, Artificial Sequence
  Description of Artificial Sequence: Synthetic coding sequence
atggacctgaaccgcatcatccaggccctgaagggcaccatcgaccccaagctgagaattgctgctgaaaatgagctgaaccagagctacaagatcatcaactttgcccccagcctgctgcgcatcatcgtgtctgaccacgtggagttccctgtgcggcaggccgccgccatctacctgaagaacatggtgacccagtactggccagaccgggagcccccacctggagaggccatcttccccttcaacatccatgaaaatgaccggcagcagatccgggacaacatcgtggagggcatcatccgcagcccagacctggtgcgggtgcagctgaccatgtgcctgcgggccatcatcaagcatgacttccctggccactggccaggagtggtggacaagattgactactacctgcagagccagagcagcgcctcctggctgggcagcctgctgtgcctgtaccagctggtgaagacctatgagtacaagaaggccgaggagcgggagcccctcatcatcgccatgcagatcttcctgccccgcatccagcagcagatcgtgcagctgctgcctgacagcagctactacagcgtgctgctgcagaagcagatcctgaagatcttctacgccctggtgcagtatgccctgcccctgcagctggtgaacaaccagaccatgaccacctggatggagatcttccgcaccatcatcgacagaacagtgcccccagagaccctgcacattgatgaagatgacaggcctgagctggtgtggtggaagtgcaagaagtgggccctgcacatcgtggcccggctgtttgaaagatatggcagccctggaaatgtgaccaaggagtactttgagttcagcgagttcttcctgaagacctatgctgtgggcatccagcaggtgctgctgaagatcctggaccagtaccggcagaaggagtatgtggccccccgggtgctgcagcaggccttcaactacctgaaccagggcgtggtgcacagcatcacctggaagcagatgaagccccacatccagaacatcagtgaagatgtgatcttctctgtgatgtgctacaaggatgaagatgaggagctgtggcaggaggacccctatgagtacatccgcatgaagtttgacatctttgaagattatgccagccccaccacagctgcccagaccctgctgtacacagctgccaagaagaggaaggaggtgctgcccaagatgatggccttctgctaccagatcctgacagaccccaactttgaccccaggaagaaggatggagccctgcacgtgattggcagcctggccgagatcctgctgaagaagagcctcttcaaggaccagatggagctgttcctgcagaaccacgtgttccccctgctgctgagcaacctgggctacctgcgggcccggagctgctgggtgctgcacgccttcagcagcctgaagttccacaatgagctgaacctgagaaatgctgtggagctggccaagaagagcctgattgaggacaaggagatgcctgtgaaggtggaggccgccctggccctgcagagcctcatcagcaaccagatccaggccaaggagtacatgaagccccacgtgcggcccatcatgcaggagctgctgcacatcgtgcgggagacagaaaatgatgatgtgaccaacgtcatccagaagatgatctgtgagtacagccaggaggtggccagcattgctgtggacatgacccagcacctggccgagatctttgggaaggtgctgcagagtgatgaatatgaggaggtggaggacaagacagtgatggccatgggcatcctgcacaccatcgacaccatcctgactgtggtggaggaccacaaggagatcacccagcagctggagaacatctgcctgcgcatcatcgacctggtgctgcagaagcacgtgattgagttctatgaggagatcctgagcctggcctacagcctgacctgccacagcatcagcccccagatgtggcagctgctgggcatcctgtatgaggtgttccagcaggactgctttgagtacttcacagacatgatgcccctgctgcacaactacgtgaccatcgacacagacaccctgctgagcaatgccaagcacctggagatcctcttcaccatgtgcaggaaggtgctgtgtggagatgctggggaggatgctgaatgtcatgctgccaagctgctggaggtgatcatcctgcagtgcaagggccggggcatcgaccagtgcatccccctgtttgtgcagctggtgctggagcggctgacccggggcgtgaagaccagcgagctgcggaccatgtgcctgcaggtggccatcgccgccctgtactacaacccagacctgctgctgcacaccctggagcgcatccagctgccccacaaccctggccccatcaccgtgcagttcatcaaccagtggatgaatgacacagactgcttcctgggccaccacgacaggaagatgtgcatcatcggcctgagcatcctgctggagctgcagaacagacctcctgctgtggatgctgtggtgggccagatcgtgcccagcatcctcttcctgttcctgggcctgaagcaggtgtgtgccacccggcagctggtgaacagagaagatagaagcaaggccgagaaggctgacatggaggagaatgaggagatcagcagtgatgaggaggagaccaacgtgacagcccaggccatgcagagcaacaacggcagaggagaagatgaggaggaggaggatgatgactgggatgaggaggtgctggaggagacagccctggagggcttcagcacccccctggacctggacaacagcgtggatgagtaccagttcttcacccaggccctgatcaccgtgcagagcagagatgctgcctggtaccagctgctgatggcccccctgtctgaggaccagaggacagccctgcaggaggtgtacaccctggccgagcacagaagaacagtggccgaggccaagaagaagattgagcagcagggcggcttcacctttgagaacaagggcgtgctgagcgccttcaactttggcaccgtgcccagcaacaactag

SEQ ID NO: 155915 - DNA, 2499 bp, Artificial Sequence
  Description of Artificial Sequence: Synthetic coding sequence
atggagagcctgaccctgaagggctacgccctgcccctgcagctggtgaacaaccagaccatgaccacctggatggagatcttccgcaccatcatcgacagaacagtgcccccagagaccctgcacattgatgaagatgacaggcctgagctggtgtggtggaagtgcaagaagtgggccctgcacatcgtggcccggctgtttgaaagatatggcagccctggaaatgtgaccaaggagtactttgagttcagcgagttcttcctgaagacctatgctgtgggcatccagcaggtgctgctgaagatcctggaccagtaccggcagaaggagtatgtggccccccgggtgctgcagcaggccttcaactacctgaaccagggcgtggtgcacagcatcacctggaagcagatgaagccccacatccagaacatcagtgaagatgtgatcttctctgtgatgtgctacaaggatgaagatgaggagctgtggcaggaggacccctatgagtacatccgcatgaagtttgacatctttgaggactatgccagccccaccacagctgcccagaccctgctgtacacagctgccaagaagaggaaggaggtgctgcccaagatgatggccttctgctaccagatcctgacagaccccaactttgaccccaggaagaaggatggagccctgcacgtgattggcagcctggccgagatcctgctgaagaagagcctcttcaaggaccagatggagctgttcctgcagaaccacgtgttccccctgctgctgagcaacctgggctacctgcgggcccggagctgctgggtgctgcacgccttcagcagcctgaagttccacaatgagctgaacctgagaaatgctgtggagctggccaagaagagcctgattgaggacaaggagatgcctgtgaaggtggaggccgccctggccctgcagagcctcatcagcaaccagatccaggccaaggagtacatgaagccccacgtgcggcccatcatgcaggagctgctgcacatcgtgcgggagacagaaaatgatgatgtgaccaacgtcatccagaagatgatctgtgagtacagccaggaggtggccagcattgctgtggacatgacccagcacctggccgagatctttgggaaggtgctgcagagtgatgaatatgaggaggtggaggacaagacagtgatggccatgggcatcctgcacaccatcgacaccatcctgactgtggtggaggaccacaaggagatcacccagcagctggagaacatctgcctgcgcatcatcgacctggtgctgcagaagcacgtgattgagttctatgaggagatcctgagcctggcctacagcctgacctgccacagcatcagcccccagatgtggcagctgctgggcatcctgtatgaggtgttccagcaggactgctttgagtacttcacagacatgatgcccctgctgcacaactacgtgaccatcgacacagacaccctgctgagcaatgccaagcacctggagatcctcttcaccatgtgcaggaaggtgctgtgtggagatgctggagaagatgctgagtgccacgccgccaagctgctggaggtgatcatcctgcagtgcaagggccggggcatcgaccagtgcatccccctgtttgtgcagctggtgctggagcggctgacccggggcgtgaagaccagcgagctgcggaccatgtgcctgcaggtggccatcgccgccctgtactacaacccagacctgctgctgcacaccctggagcgcatccagctgccccacaaccctggccccatcaccgtgcagttcatcaaccagtggatgaatgacacagactgcttcctgggccaccacgacaggaagatgtgcatcatcggcctgagcatcctgctggagctgcagaaccggcccccagctgtggatgctgtggtgggccagatcgtgcccagcatcctcttcctgttcctgggcctgaagcaggtgtgtgccacccggcagctggtgaaccgggaggacaggagcaaggccgagaaggctgacatggaggagaatgaggagatcagcagtgatgaggaggagaccaacgtgacagcccaggccatgcagagcaacaacggccgcggggaggatgaggaggaggaggatgatgactgggatgaggaggtgctggaggagacagccctggagggcttcagcacccccctggacctggacaacagcgtggatgagtaccagttcttcacccaggccctgatcaccgtgcagagcagagatgctgcctggtaccagctgctgatggcccccctgtctgaggaccagaggacagccctgcaggaggtgtacaccctggccgagcacagaagaacagtggccgaggccaagaagaagattgagcagcagggcggcttcacctttgaaaataaaggagtgctgagcgccttcaactttggaacagtgcccagcaacaactag

SEQ ID NO: 155916 - DNA, 1542 bp, Artificial Sequence
  Description of Artificial Sequence: Synthetic coding sequence
ctgagcagcggccacgagctggccaaggagtacatgaagccccacgtgcggcccatcatgcaggagctgctgcacatcgtgcgggagacagaaaatgatgatgtgaccaacgtcatccagaagatgatctgtgagtacagccaggaggtggccagcattgctgtggacatgacccagcacctggccgagatctttgggaaggtgctgcagagtgatgaatatgaggaggtggaggacaagacagtgatggccatgggcatcctgcacaccatcgacaccatcctgactgtggtggaggaccacaaggagatcacccagcagctggagaacatctgcctgcgcatcatcgacctggtgctgcagaagcacgtgattgagttctatgaggagatcctgagcctggcctacagcctgacctgccacagcatcagcccccagatgtggcagctgctgggcatcctgtatgaggtgttccagcaggactgctttgagtacttcacagacatgatgcccctgctgcacaactacgtgaccatcgacacagacaccctgctgagcaatgccaagcacctggagatcctcttcaccatgtgcaggaaggtgctgtgtggagatgctggggaggatgctgaatgtcatgctgccaagctgctggaggtgatcatcctgcagtgcaagggccggggcatcgaccagtgcatccccctgtttgtgcagctggtgctggagcggctgacccggggcgtgaagaccagcgagctgcggaccatgtgcctgcaggtggccatcgccgccctgtactacaacccagacctgctgctgcacaccctggagcgcatccagctgccccacaaccctggccccatcaccgtgcagttcatcaaccagtggatgaatgacacagactgcttcctgggccaccacgacaggaagatgtgcatcatcggcctgagcatcctgctggagctgcagaacagacctcctgctgtggatgctgtggtgggccagatcgtgcccagcatcctcttcctgttcctgggcctgaagcaggtgtgtgccacccggcagctggtgaacagagaagatagaagcaaggccgagaaggctgacatggaggagaatgaggagatcagcagtgatgaggaggagaccaacgtgacagcccaggccatgcagagcaacaacggcagaggagaagatgaggaggaggaggatgatgactgggatgaggaggtgctggaggagacagccctggagggcttcagcacccccctggacctggacaacagcgtggatgagtaccagttcttcacccaggccctgatcaccgtgcagagcagagatgctgcctggtaccagctgctgatggcccccctgtctgaggaccagaggacagccctgcaggaggtgtacaccctggccgagcacagaagaacagtggccgaggccaagaagaagattgagcagcagggcggcttcacctttgagaacaagggcgtgctgagcgccttcaactttggcaccgtgcccagcaacaactag

SEQ ID NO: 155917 - DNA, 3546 bp, Artificial Sequence
  Description of Artificial Sequence: Synthetic coding sequence
atgccagaaaatcctgccacagacaagctgcaggtgctgcaggtgctggaccggctgaagatgaagctgcaggagaagggggacaccagccagaatgagaagctgtccatgttttatgagaccctgaagagccccctcttcaaccagatcctgaccctgcagcagagcatcaagcagctgaagggccagctgaaccacatccccagcgactgcagcgccaactttgacttcagcaggaagggcctgctggtgttcacagatggcagcatcaccaatggaaatgtgcaccggcccagcaacaacagcacagtgtctggcctcttcccctggacccccaagctgggcaatgaagacttcaacagcgtcatccagcagatggcccagggccggcagatcgagtacattgatattgagcggcccagcactggaggcctgggcttctctgtggtggccctgcggagccagaacctgggcaaggtggacatctttgtgaaggatgtgcagcccggctctgtggccgaccgggaccagaggctgaaggaaaatgaccagatcctggccatcaaccacacccccctggaccagaacatcagccaccagcaggccatcgccctgctgcagcagaccaccggcagcctgcggctcatcgtggcccgggagcctgtgcacaccaagagcagcaccagcagcagcctgaatgacaccaccctgcctgagaccgtgtgctggggccacgtggaggaggtggagctgatcaatgatggcagcggcctgggcttcggcatcgtgggcggcaagaccagcggcgtggtggtgaggaccatcgtgcctgggggcctggccgacagagatggccgcctgcagacaggagaccacatcctgaagattggaggcaccaacgtgcagggcatgaccagcgagcaggtggcccaggtgctgaggaactgtggcaacagcgtgaggatgctggtggcccgggaccctgctggggacatctctgtgaccccaccagccccagctgccctgcctgtggccctgcccaccgtggccagcaagggccctggcagtgacagcagcctgtttgagacctacaacgtggagctggtgaggaaggatggccagagcctgggcatccgcatcgtgggctacgtgggcaccagccacactggagaggccagcggcatctacgtgaagagcatcatccctggcagcgctgcctaccacaacggccacatccaggtgaatgacaagatcgtggccgtggatggagtgaacatccagggctttgccaaccatgatgtggtggaggtgctgagaaatgccggccaggtggtgcacctgaccctggtgcggaggaagaccagcagcagcaccagccccctggagcccccaagtgaccggggcaccgtggtggagcccctgaagcccccagccctcttcctgaccggggctgtggagacagagaccaacgtggatggagaagatgaggagatcaaggagagaattgacaccctgaagaatgacaacatccaggccctggagaagctggagaaggtgcctgacagcccagaaaatgagctgaagagccgctgggagaacctgctgggccctgactatgaggtgatggtggccaccctggacacccagattgctgatgatgctgagctgcagaagtacagcaagctgctgcccatccacaccctgcggctgggcgtggaggtggacagctttgatggccaccactacatcagcagcatcgtgtctgggggccctgtggacaccctgggcctgctgcagccagaagatgagctgctggaggtgaatggcatgcagctgtatggcaagagcagaagagaggccgtgtccttcctgaaggaggtgcccccacccttcaccctggtgtgctgcagaagactctttgatgatgaggcctctgtggatgagcccaggagaacagagaccagcctgcctgagacagaggtggaccacaacatggatgtgaacacagaagaagatgatgatggagagctggccctgtggagccctgaggtgaagatcgtggagctggtgaaggactgcaagggcctgggcttcagcatcctggactaccaggaccccctggaccccaccaggagcgtcatcgtcatccgcagcctggtggctgatggagtggccgagaggtctgggggcctgctgcccggggaccggctggtgtctgtgaatgagtactgcctggacaacaccagcctggccgaggccgtggagatcctgaaggctgtgcccccaggcctggtgcacctgggcatctgcaagcccctggtggaggacaatgaggaggagagctgctacatcctgcacagcagcagcaatgaagacaagacagagttcagcggcaccatccatgacatcaacagcagcctcatcctggaggcccccaagggcttcagagatgagccctacttcaaggaggagctggtggatgagcccttcctggacctgggcaagagcttccacagccagcagaaggagattgagcagagcaaggaggcctgggagatgcatgagttcctgaccccccggctgcaggagatggatgaggagcgggagatcctggtggatgaggagtatgagctgtaccaggaccccagccccagcatggagctgtaccccctgagccacatccaggaggccacccctgtgcccagcgtgaatgagctgcacttcggcacccagtggctgcatgacaatgagcccagcgagagccaggaggccaggacaggccgcacagtgtacagccaggaggcccagccctacggctactgcccagaaaatgtgatgaaggagaactttgtgatggagagcctgcccagcgtgcccagcacagagggcaacagccagcagggccgctttgatgacctggagaacctgaacagcctggccaagaccagcctggacctgggcatgatccccaatgatgtgcagggccccagcctgctgattgacctgcctgtggtggcccagaggcgggagcaggaggacctgcccctgtaccagcaccaggccaccagggtcatcagcaaggccagcgcctacacaggcatgctgagcagccgctatgccacagacacctgtgagctgcctgagcgggaggagggggagggggaggagacccccaacttcagccactggggccccccacgcatcgtggagatcttccgggagcccaacgtgtccctgggcatcagcatcgtgggcggccagaccgtcatcaagaggctgaagaatggagaggagctgaagggcatcttcatcaagcaggtgctggaggacagccctgctgggaagaccaatgccctgaagacaggagacaagatcctggaggtgtctggagtggacctgcagaatgccagccacagcgaggccgtggaggccatcaagaatgccggcaaccctgtggtgttcatcgtgcagagcctgagcagcaccccagcctgggtgacagagcaggacagcgtgtccaagaagaagaagaaccacgagggctag

SEQ ID NO: 155918 - DNA, 600 bp, Artificial Sequence
  Description of Artificial Sequence: Synthetic coding sequence
atggtgcagggcggcttccctgagaagatccggcagagatatgctgacctgcccggggagctgcacatcatcgagctggagaaggacaagaatggcctgggcctgagcctggccggcaacaaggacaggagcaggatgagcatctttgtggtgggcatcaaccctgagggccctgctgctgctgatggccgcatgagaattggagatgagctgctggagatcaacaaccagatcctgtatggccgcagccaccagaatgccagcgccatcatcaagacagcccccagcaaggtgaagctggtgttcatcagaaatgaagatgctgtgaaccagatggctgtgacccccttccctgtgcccagcagcagccccagcagcattgaggaccagagcggcacagagcccatcagcagcgaggaggatggctctgtggaggtgggcatcaagcagctgcctgagagcgagagcttcaagctggccgtgtcccagatgaagcagcagaagtaccccaccaaggtgtccttcagcagccaggagatccccctggccccagccagcagctaccacagcacagatgctgacttcaccggctacggctag

SEQ ID NO: 155919 - DNA, 4746 bp, Artificial Sequence
  Description of Artificial Sequence: Synthetic coding sequence
atgccagaaaatcctgccacagacaagctgcaggtgctgcaggtgctggaccggctgaagatgaagctgcaggagaagggggacaccagccagaatgagaagctgtccatgttttatgagaccctgaagagccccctcttcaaccagatcctgaccctgcagcagagcatcaagcagctgaagggccagctgaaccacatccccagcgactgcagcgccaactttgacttcagcaggaagggcctgctggtgttcacagatggcagcatcaccaatggaaatgtgcaccggcccagcaacaacagcacagtgtctggcctcttcccctggacccccaagctgggcaatgaagacttcaacagcgtcatccagcagatggcccagggccggcagatcgagtacattgatattgagcggcccagcactggaggcctgggcttctctgtggtggccctgcggagccagaacctgggcaaggtggacatctttgtgaaggatgtgcagcccggctctgtggccgaccgggaccagaggctgaaggaaaatgaccagatcctggccatcaaccacacccccctggaccagaacatcagccaccagcaggccatcgccctgctgcagcagaccaccggcagcctgcggctcatcgtggcccgggagcctgtgcacaccaagagcagcaccagcagcagcctgaatgacaccaccctgcctgagaccgtgtgctggggccacgtggaggaggtggagctgatcaatgatggcagcggcctgggcttcggcatcgtgggcggcaagaccagcggcgtggtggtgaggaccatcgtgcctgggggcctggccgacagagatggccgcctgcagacaggagaccacatcctgaagattggaggcaccaacgtgcagggcatgaccagcgagcaggtggcccaggtgctgaggaactgtggcaacagcgtgaggatgctggtggcccgggaccctgctggggacatctctgtgaccccaccagccccagctgccctgcctgtggccctgcccaccgtggccagcaagggccctggcagtgacagcagcctgtttgagacctacaacgtggagctggtgaggaaggatggccagagcctgggcatccgcatcgtgggctacgtgggcaccagccacactggagaggccagcggcatctacgtgaagagcatcatccctggcagcgctgcctaccacaacggccacatccaggtgaatgacaagatcgtggccgtggatggagtgaacatccagggctttgccaaccatgatgtggtggaggtgctgagaaatgccggccaggtggtgcacctgaccctggtgcggaggaagaccagcagcagcaccagccccctggagcccccaagtgaccggggcaccgtggtggagcccctgaagcccccagccctcttcctgaccggggctgtggagacagagaccaacgtggatggagaagatgaggagatcaaggagagaattgacaccctgaagaatgacaacatccaggccctggagaagctggagaaggtgcctgacagcccagaaaatgagctgaagagccgctgggagaacctgctgggccctgactatgaggtgatggtggccaccctggacacccagattgctgatgatgctgagctgcagaagtacagcaagctgctgcccatccacaccctgcggctgggcgtggaggtggacagctttgatggccaccactacatcagcagcatcgtgtctgggggccctgtggacaccctgggcctgctgcagccagaagatgagctgctggaggtgaatggcatgcagctgtatggcaagagcagaagagaggccgtgtccttcctgaaggaggtgcccccacccttcaccctggtgtgctgcagaagactctttgatgatgaggcctctgtggatgagcccaggagaacagagaccagcctgcctgagacagaggtggaccacaacatggatgtgaacacagaagaagatgatgatggagagctggccctgtggagccctgaggtgaagatcgtggagctggtgaaggactgcaagggcctgggcttcagcatcctggactaccaggaccccctggaccccaccaggagcgtcatcgtcatccgcagcctggtggctgatggagtggccgagaggtctgggggcctgctgcccggggaccggctggtgtctgtgaatgagtactgcctggacaacaccagcctggccgaggccgtggagatcctgaaggctgtgcccccaggcctggtgcacctgggcatctgcaagcccctggtggaggacaatgaggaggagagctgctacatcctgcacagcagcagcaatgaagacaagacagagttcagcggcaccatccatgacatcaacagcagcctcatcctggaggcccccaagggcttcagagatgagccctacttcaaggaggagctggtggatgagcccttcctggacctgggcaagagcttccacagccagcagaaggagattgagcagagcaaggaggcctgggagatgcatgagttcctgaccccccggctgcaggagatggatgaggagcgggagatcctggtggatgaggagtatgagctgtaccaggaccccagccccagcatggagctgtaccccctgagccacatccaggaggccacccctgtgcccagcgtgaatgagctgcacttcggcacccagtggctgcatgacaatgagcccagcgagagccaggaggccaggacaggccgcacagtgtacagccaggaggcccagccctacggctactgcccagaaaatgtgatgaaggagaactttgtgatggagagcctgcccagcgtgcccagcacagagggcaacagccagcagggccgctttgatgacctggagaacctgaacagcctggccaagaccagcctggacctgggcatgatccccaatgatgtgcagggccccagcctgctgattgacctgcctgtggtggcccagaggcgggagcaggaggacctgcccctgtaccagcaccaggccaccagggtcatcagcaaggccagcgcctacacaggcatgctgagcagccgctatgccacagacacctgtgagctgcctgagcgggaggagggggagggggaggagacccccaacttcagccactggggccccccacgcatcgtggagatcttccgggagcccaacgtgtccctgggcatcagcatcgtgggcggccagaccgtcatcaagaggctgaagaatggagaggagctgaagggcatcttcatcaagcaggtgctggaggacagccctgctgggaagaccaatgccctgaagacaggagacaagatcctggaggtgtctggagtggacctgcagaatgccagccacagcgaggccgtggaggccatcaagaatgccggcaaccctgtggtgttcatcgtgcagagcctgagcagcacccccagggtcatccccaacgtgcacaacaaggccaacaagatcactggaaaccagaaccaggacacccaggagaagaaggagaagaggcagggcacagcccccccacccatgaagctgcccccaccctacaaggccctgacagatgacagtgatgaaaatgaggaggaggatgccttcacagaccagaagatccggcagagatatgctgacctgcccggggagctgcacatcatcgagctggagaaggacaagaatggcctgggcctgagcctggccggcaacaaggacaggagcaggatgagcatctttgtggtgggcatcaaccctgagggccctgctgctgctgatggccgcatgagaattggagatgagctgctggagatcaacaaccagatcctgtatggccgcagccaccagaatgccagcgccatcatcaagacagcccccagcaaggtgaagctggtgttcatcagaaatgaagatgctgtgaaccagatggctgtgacccccttccctgtgcccagcagcagccccagcagcattgaggaccagagcggcacagagcccatcagcagcgaggaggatggctctgtggaggtgggcatcaagcagctgcctgagagcgagagcttcaagctggccgtgtcccagatgaagcagcagaagtaccccaccaaggtgtccttcagcagccaggagatccccctggccccagccagcagctaccacagcacagatgctgacttcaccggctacggcggcttccaggcccccctgtctgtggaccctgccacctgccccatcgtgcccggccaggagatgatcatcgagatcagcaagggccgcagcggcctgggcctgagcatcgtgggcggcaaggacacccccctcttctggaggctgggcagcccccgggcctggagccagcacctggtgcgggccttcatgctgcaccaccctgtgacagaggtggagggccagaatgccatcgtcatccacgaggtgtatgaggagggcgctgctgccagagatggccgcctgtgggccggggaccagatcctggaggtgaatggagtggacctgaggaacagcagccatgaggaggccatcacagccctgcggcagaccccccagaaggtgcggctggtggtgtacagagatgaggcccactacagagatgaggagaacctggagatcttccctgtggacctgcagaagaaggccggccggggcctgggcctgagcatcgtgggcaagtag

SEQ ID NO: 155920 - DNA, 5406 bp, Artificial Sequence
  Description of Artificial Sequence: Synthetic coding sequence
atgccagaaaatcctgccacagacaagctgcaggtgctgcaggtgctggaccggctgaagatgaagctgcaggagaagggggacaccagccagaatgagaagctgtccatgttttatgagaccctgaagagccccctcttcaaccagatcctgaccctgcagcagagcatcaagcagctgaagggccagctgaaccacatccccagcgactgcagcgccaactttgacttcagcaggaagggcctgctggtgttcacagatggcagcatcaccaatggaaatgtgcaccggcccagcaacaacagcacagtgtctggcctcttcccctggacccccaagctgggcaatgaagacttcaacagcgtcatccagcagatggcccagggccggcagatcgagtacattgatattgagcggcccagcactggaggcctgggcttctctgtggtggccctgcggagccagaacctgggcaaggtggacatctttgtgaaggatgtgcagcccggctctgtggccgaccgggaccagaggctgaaggaaaatgaccagatcctggccatcaaccacacccccctggaccagaacatcagccaccagcaggccatcgccctgctgcagcagaccaccggcagcctgcggctcatcgtggcccgggagcctgtgcacaccaagagcagcaccagcagcagcctgaatgacaccaccctgcctgagaccgtgtgctggggccacgtggaggaggtggagctgatcaatgatggcagcggcctgggcttcggcatcgtgggcggcaagaccagcggcgtggtggtgaggaccatcgtgcctgggggcctggccgacagagatggccgcctgcagacaggagaccacatcctgaagattggaggcaccaacgtgcagggcatgaccagcgagcaggtggcccaggtgctgaggaactgtggcaacagcgtgaggatgctggtggcccgggaccctgctggggacatctctgtgaccccaccagccccagctgccctgcctgtggccctgcccaccgtggccagcaagggccctggcagtgacagcagcctgtttgagacctacaacgtggagctggtgaggaaggatggccagagcctgggcatccgcatcgtgggctacgtgggcaccagccacactggagaggccagcggcatctacgtgaagagcatcatccctggcagcgctgcctaccacaacggccacatccaggtgaatgacaagatcgtggccgtggatggagtgaacatccagggctttgccaaccatgatgtggtggaggtgctgagaaatgccggccaggtggtgcacctgaccctggtgcggaggaagaccagcagcagcaccagccccctggagcccccaagtgaccggggcaccgtggtggagcccctgaagcccccagccctcttcctgaccggggctgtggagacagagaccaacgtggatggagaagatgaggagatcaaggagagaattgacaccctgaagaatgacaacatccaggccctggagaagctggagaaggtgcctgacagcccagaaaatgagctgaagagccgctgggagaacctgctgggccctgactatgaggtgatggtggccaccctggacacccagattgctgatgatgctgagctgcagaagtacagcaagctgctgcccatccacaccctgcggctgggcgtggaggtggacagctttgatggccaccactacatcagcagcatcgtgtctgggggccctgtggacaccctgggcctgctgcagccagaagatgagctgctggaggtgaatggcatgcagctgtatggcaagagcagaagagaggccgtgtccttcctgaaggaggtgcccccacccttcaccctggtgtgctgcagaagactctttgatgatgaggcctctgtggatgagcccaggagaacagagaccagcctgcctgagacagaggtggaccacaacatggatgtgaacacagaagaagatgatgatggagagctggccctgtggagccctgaggtgaagatcgtggagctggtgaaggactgcaagggcctgggcttcagcatcctggactaccaggaccccctggaccccaccaggagcgtcatcgtcatccgcagcctggtggctgatggagtggccgagaggtctgggggcctgctgcccggggaccggctggtgtctgtgaatgagtactgcctggacaacaccagcctggccgaggccgtggagatcctgaaggctgtgcccccaggcctggtgcacctgggcatctgcaagcccctggtggaggacaatgaggaggagagctgctacatcctgcacagcagcagcaatgaagacaagacagagttcagcggcaccatccatgacatcaacagcagcctcatcctggaggcccccaagggcttcagagatgagccctacttcaaggaggagctggtggatgagcccttcctggacctgggcaagagcttccacagccagcagaaggagattgagcagagcaaggaggcctgggagatgcatgagttcctgaccccccggctgcaggagatggatgaggagcgggagatcctggtggatgaggagtatgagctgtaccaggaccccagccccagcatggagctgtaccccctgagccacatccaggaggccacccctgtgcccagcgtgaatgagctgcacttcggcacccagtggctgcatgacaatgagcccagcgagagccaggaggccaggacaggccgcacagtgtacagccaggaggcccagccctacggctactgcccagaaaatgtgatgaaggagaactttgtgatggagagcctgcccagcgtgcccagcacagagggcaacagccagcagggccgctttgatgacctggagaacctgaacagcctggccaagaccagcctggacctgggcatgatccccaatgatgtgcagggccccagcctgctgattgacctgcctgtggtggcccagaggcgggagcaggaggacctgcccctgtaccagcaccaggccaccagggtcatcagcaaggccagcgcctacacaggcatgctgagcagccgctatgccacagacacctgtgagctgcctgagcgggaggagggggagggggaggagacccccaacttcagccactggggccccccacgcatcgtggagatcttccgggagcccaacgtgtccctgggcatcagcatcgtgggcggccagaccgtcatcaagaggctgaagaatggagaggagctgaagggcatcttcatcaagcaggtgctggaggacagccctgctgggaagaccaatgccctgaagacaggagacaagatcctggaggtgtctggagtggacctgcagaatgccagccacagcgaggccgtggaggccatcaagaatgccggcaaccctgtggtgttcatcgtgcagagcctgagcagcacccccagggtcatccccaacgtgcacaacaaggccaacaagatcactggaaaccagaaccaggacacccaggagaagaaggagaagaggcagggcacagcccccccacccatgaagctgcccccaccctacaaggccctgacagatgacagtgatgaaaatgaggaggaggatgccttcacagaccagaagatccggcagagatatgctgacctgcccggggagctgcacatcatcgagctggagaaggacaagaatggcctgggcctgagcctggccggcaacaaggacaggagcaggatgagcatctttgtggtgggcatcaaccctgagggccctgctgctgctgatggccgcatgagaattggagatgagctgctggagatcaacaaccagatcctgtatggccgcagccaccagaatgccagcgccatcatcaagacagcccccagcaaggtgaagctggtgttcatcagaaatgaagatgctgtgaaccagatggctgtgacccccttccctgtgcccagcagcagccccagcagcattgaggaccagagcggcacagagcccatcagcagcgaggaggatggctctgtggaggtgggcatcaagcagctgcctgagagcgagagcttcaagctggccgtgtcccagatgaagcagcagaagtaccccaccaaggtgtccttcagcagccaggagatccccctggccccagccagcagctaccacagcacagatgctgacttcaccggctacggcggcttccaggcccccctgtctgtggaccctgccacctgccccatcgtgcccggccaggagatgatcatcgagatcagcaagggccgcagcggcctgggcctgagcatcgtgggcggcaaggacacccccctgaatgccatcgtcatccacgaggtgtatgaggagggcgctgctgccagagatggccgcctgtgggccggggaccagatcctggaggtgaatggagtggacctgaggaacagcagccatgaggaggccatcacagccctgcggcagaccccccagaaggtgcggctggtggtgtacagagatgaggcccactacagagatgaggagaacctggagatcttccctgtggacctgcagaagaaggccggccggggcctgggcctgagcatcgtgggcaagagaaatggaagtggagtcttcatcagtgacatcgtgaagggcggcgctgctgacctggatggccgcctcatccagggcgaccagatcctgtctgtgaatggagaggacatgagaaatgccagccaggagaccgtggccaccatcctgaagtgtgcccagggcctggtgcagctggagatcggccgcctgcgggccggctcctggaccagcgcccggaccaccagccagaacagccagggcagccagcagagcgcccacagcagctgccaccccagctttgcccctgtgatcaccggcctgcagaacctggtgggcaccaagagggtgtctgaccccagccagaagaacagcggcacagacatggagcccaggacagtggagatcaaccgggagctgagtgatgccctgggcatcagcattgctgggggccggggcagccccctgggggacatccctgtgttcatcgccatgatccaggccagcggcgtggccgcccggacccagaagctgaaggtgggggacagaattgtgtccatcaatggccagcccctggatggcctgagccatgctgatgtggtgaacctgctgaagaatgcctacggccgcatcatcctgcaggtggtggccgacaccaacatcagcgccatcgccgcccagctggagaacatgagcacaggctaccacctgggcagccccacagctgagcaccaccctgaggacacagaggagcagctgcagatgacagctgactag

SEQ ID NO: 155921 - DNA, 4572 bp, Artificial Sequence
  Description of Artificial Sequence: Synthetic coding sequence
atgccagaaaatcctgccacagacaagctgcaggtgctgcaggtgctggaccggctgaagatgaagctgcaggagaagggggacaccagccagaatgagaagctgtccatgttttatgagaccctgaagagccccctcttcaaccagatcctgaccctgcagcagagcatcaagcagctgaagggccagctgaaccacatccccagcgactgcagcgccaactttgacttcagcaggaagggcctgctggtgttcacagatggcagcatcaccaatggaaatgtgcaccggcccagcaacaacagcacagtgtctggcctcttcccctggacccccaagctgggcaatgaagacttcaacagcgtcatccagcagatggcccagggccggcagatcgagtacattgatattgagcggcccagcactggaggcctgggcttctctgtggtggccctgcggagccagaacctgggcaaggtggacatctttgtgaaggatgtgcagcccggctctgtggccgaccgggaccagaggctgaaggaaaatgaccagatcctggccatcaaccacacccccctggaccagaacatcagccaccagcaggccatcgccctgctgcagcagaccaccggcagcctgcggctcatcgtggcccgggagcctgtgcacaccaagagcagcaccagcagcagcctgaatgacaccaccctgcctgagaccgtgtgctggggccacgtggaggaggtggagctgatcaatgatggcagcggcctgggcttcggcatcgtgggcggcaagaccagcggcgtggtggtgaggaccatcgtgcctgggggcctggccgacagagatggccgcctgcagacaggagaccacatcctgaagattggaggcaccaacgtgcagggcatgaccagcgagcaggtggcccaggtgctgaggaactgtggcaacagcgtgaggatgctggtggcccgggaccctgctggggacatctctgtgaccccaccagccccagctgccctgcctgtggccctgcccaccgtggccagcaagggccctggcagtgacagcagcctgtttgagacctacaacgtggagctggtgaggaaggatggccagagcctgggcatccgcatcgtgggctacgtgggcaccagccacactggagaggccagcggcatctacgtgaagagcatcatccctggcagcgctgcctaccacaacggccacatccaggtgaatgacaagatcgtggccgtggatggagtgaacatccagggctttgccaaccatgatgtggtggaggtgctgagaaatgccggccaggtggtgcacctgaccctggtgcggaggaagaccagcagcagcaccagccccctggagcccccaagtgaccggggcaccgtggtggagcccctgaagcccccagccctcttcctgaccggggctgtggagacagagaccaacgtggatggagaagatgaggagatcaaggagagaattgacaccctgaagaatgacaacatccaggccctggagaagctggagaaggtgcctgacagcccagaaaatgagctgaagagccgctgggagaacctgctgggccctgactatgaggtgatggtggccaccctggacacccagattgctgatgatgctgagctgcagaagtacagcaagctgctgcccatccacaccctgcggctgggcgtggaggtggacagctttgatggccaccactacatcagcagcatcgtgtctgggggccctgtggacaccctgggcctgctgcagccagaagatgagctgctggaggtgaatggcatgcagctgtatggcaagagcagaagagaggccgtgtccttcctgaaggaggtgcccccacccttcaccctggtgtgctgcagaagactctttgatgatgaggcctctgtggatgagcccaggagaacagagaccagcctgcctgagacagaggtggaccacaacatggatgtgaacacagaagaagatgatgatggagagctggccctgtggagccctgaggtgaagatcgtggagctggtgaaggactgcaagggcctgggcttcagcatcctggactaccaggaccccctggaccccaccaggagcgtcatcgtcatccgcagcctggtggctgatggagtggccgagaggtctgggggcctgctgcccggggaccggctggtgtctgtgaatgagtactgcctggacaacaccagcctggccgaggccgtggagatcctgaaggctgtgcccccaggcctggtgcacctgggcatctgcaagcccctggtggaggacaatgaggaggagagctgctacatcctgcacagcagcagcaatgaagacaagacagagttcagcggcaccatccatgacatcaacagcagcctcatcctggaggcccccaagggcttcagagatgagccctacttcaaggaggagctggtggatgagcccttcctggacctgggcaagagcttccacagccagcagaaggagattgagcagagcaaggaggcctgggagatgcatgagttcctgaccccccggctgcaggagatggatgaggagcgggagatcctggtggatgaggagtatgagctgtaccaggaccccagccccagcatggagctgtaccccctgagccacatccaggaggccacccctgtgcccagcgtgaatgagctgcacttcggcacccagtggctgcatgacaatgagcccagcgagagccaggaggccaggacaggccgcacagtgtacagccaggaggcccagccctacggctactgcccagaaaatgtgatgaaggagaactttgtgatggagagcctgcccagcgtgcccagcacagagggcaacagccagcagggccgctttgatgacctggagaacctgaacagcctggccaagaccagcctggacctgggcatgatccccaatgatgtgcagggccccagcctgctgattgacctgcctgtggtggcccagaggcgggagcaggaggacctgcccctgtaccagcaccaggccaccagggtcatcagcaaggccagcgcctacacaggcatgctgagcagccgctatgccacagacacctgtgagctgcctgagcgggaggagggggagggggaggagacccccaacttcagccactggggccccccacgcatcgtggagatcttccgggagcccaacgtgtccctgggcatcagcatcgtgggcggccagaccgtcatcaagaggctgaagaatggagaggagctgaagggcatcttcatcaagcaggtgctggaggacagccctgctgggaagaccaatgccctgaagacaggagacaagatcctggaggtgtctggagtggacctgcagaatgccagccacagcgaggccgtggaggccatcaagaatgccggcaaccctgtggtgttcatcgtgcagagcctgagcagcacccccagggtcatccccaacgtgcacaacaaggccaacaagatcactggaaaccagaaccaggacacccaggagaagaaggagaagaggcagggcacagcccccccacccatgaagctgcccccaccctacaaggccctgacagatgacagtgatgaaaatgaggaggaggatgccttcacagaccagaagatccggcagagatatgctgacctgcccggggagctgcacatcatcgagctggagaaggacaagaatggcctgggcctgagcctggccggcaacaaggacaggagcaggatgagcatctttgtggtgggcatcaaccctgagggccctgctgctgctgatggccgcatgagaattggagatgagctgctggagatcaacaaccagatcctgtatggccgcagccaccagaatgccagcgccatcatcaagacagcccccagcaaggtgaagctggtgttcatcagaaatgaagatgctgtgaaccagatggctgtgacccccttccctgtgcccagcagcagccccagcagcattgaggaccagagcggcacagagcccatcagcagcgaggaggatggctctgtggaggtgggcatcaagcagctgcctgagagcgagagcttcaagctggccgtgtcccagatgaagcagcagaagtaccccaccaaggtgtccttcagcagccaggagatccccctggccccagccagcagctaccacagcacagatgctgacttcaccggctacggcggcttccaggcccccctgtctgtggaccctgccacctgccccatcgtgcccggccaggagatgatcatcgagatcagcaagggccgcagcggcctgggcctgagcatcgtgggcggcaaggacacccccctggtgaatggagtggacctgaggaacagcagccatgaggaggccatcacagccctgcggcagaccccccagaaggtgcggctggtggtgtacagagatgaggcccactacagagatgaggagaacctggagatcttccctgtggacctgcagaagaaggccggccggggcctgggcctgagcatcgtgggcaagtag

SEQ ID NO: 155922 - DNA, 1359 bp, Artificial Sequence
  Description of Artificial Sequence: Synthetic coding sequence
atggtgcagggcggcttccctgagaagatccggcagagatatgctgacctgcccggggagctgcacatcatcgagctggagaaggacaagaatggcctgggcctgagcctggccggcaacaaggacaggagcaggatgagcatctttgtggtgggcatcaaccctgagggccctgctgctgctgatggccgcatgagaattggagatgagctgctggagatcaacaaccagatcctgtatggccgcagccaccagaatgccagcgccatcatcaagacagcccccagcaaggtgaagctggtgttcatcagaaatgaagatgctgtgaaccagatggctgtgacccccttccctgtgcccagcagcagccccagcagcattgaggaccagagcggcacagagcccatcagcagcgaggaggatggctctgtggaggtgggcatcaagcagctgcctgagagcgagagcttcaagctggccgtgtcccagatgaagcagcagaagtaccccaccaaggtgtccttcagcagccaggagatccccctggccccagccagcagctaccacagcacagatgctgacttcaccggctacggcggcttccaggcccccctgtctgtggaccctgccacctgccccatcgtgcccggccaggagatgatcatcgagatcagcaagggccgcagcggcctgggcctgagcatcgtgggcggcaaggacacccccctcttctggaggctgggcagcccccgggcctggagccagcacctggtgcgggccttcatgctgcaccaccctgtgacagaggtggagggccagaatgccatcgtcatccacgaggtgtatgaggagggcgctgctgccagagatggccgcctgtgggccggggaccagatcctggaggtgaatggagtggacctgaggaacagcagccatgaggaggccatcacagccctgcggcagaccccccagaaggtgcggctggtggtgtacagagatgaggcccactacagagatgaggagaacctggagatcttccctgtggacctgcagaagaaggccggccggggcctgggcctgagcatcgtgggcaagagaaatggaagtggagtcttcatcagtgacatcgtgaagggcggcgctgctgacctggatggccgcctcatccagggcgaccagatcctgtctgtgaatggagaggacatgagaaatgccagccaggagaccgtggccaccatcctgaagtgtgcccagggcctggtgcagctggagatcggccgcctgcgggccggctcctggaccagcgcccggaccaccagccagaacagccaggtggtggatggcttcagcagtgactag

SEQ ID NO: 155923 - DNA, 594 bp, Artificial Sequence
  Description of Artificial Sequence: Synthetic coding sequence
atggctgtgacccccttccctgtgcccagcagcagccccagcagcattgaggaccagagcggcacagagcccatcagcagtgaagaagatggctctgtggaggtgggcatcaagcagctgcctgagagcgagagcttcaagctggccgtgtcccagatgaagcagcagaagtaccccaccaaggtgtccttcagcagccaggagatccccctggccccagccagcagctaccacagcacagatgctgacttcaccggctatggaggcttccaggcccccctgtctgtggaccctgccacctgccccatcgtgcccggccaggagatgatcatcgagatcagcaagggccgcagcggcctgggcctgagcatcgtgggcggcaaggacacccccctggtgaatggagtggacctgaggaacagcagccatgaggaggccatcacagccctgcggcagaccccccagaaggtgcggctggtggtgtacagagatgaggcccactacagagatgaggagaacctggagatcttccctgtggacctgcagaagaaggccggccggggcctgggcctgagcatcgtgggcaagaggtag

SEQ ID NO: 155924 - DNA, 1236 bp, Artificial Sequence
  Description of Artificial Sequence: Synthetic coding sequence
atgagccctgcccggctgcggccccggctgcacttctgcctggtgctgctgctgctgctggtggtgcctgctgcctggggctgcggccctggccgggtggtgggcagcagaagaagaccacccaggaagctggtgcccctggcctacaagcagttcagccccaacgtgcctgagaagaccctgggcgccagcggccgctatgagggcaagatcgcccggagcagcgagcgcttcaaggagctgacccccaactacaacccagacatcatcttcaaggatgaagaaaatactggagctgaccggctgatgacccagcgctgcaaggaccggctgaacagcctggccatctctgtgatgaaccagtggccaggagtgaagctgcgggtgacagagggctgggatgaagatggccaccacagcgaggagagcctgcactatgagggccgggctgtggacatcaccaccagtgaccgggacaggaacaagtatggcctgctggcccggctggccgtggaggccggctttgactgggtgtactatgagagcaaggcccacgtgcactgcagcgtgaagtctgagcacagcgctgctgccaagacaggaggctgcttccctgctggggcccaggtgcggctggagagcggggcccgggtggccctgtctgctgtgcggcctggggacagagtgctggccatgggagaagatggcagccccaccttcagtgatgtgctgatcttcctggaccgggagccccaccggctgcgggccttccaggtgattgagacccaggaccccccccggcggctggccctgaccccagcccacctgctcttcaccgctgacaaccacacagagcctgctgcccgcttccgggccacctttgccagccacgtgcagcccggccagtatgtgctggtggccggcgtgcccggcctgcagcctgcccgggtggccgctgtgtccacccacgtggccctgggcgcctatgcccccctgaccaagcacggcaccctggtggtggaggatgtggtggccagctgctttgctgctgtggccgaccaccacctggcccagctggccttctggcccctgcggctcttccacagcctggcctggggctcctggaccccaggagagggcgtgcactggtacccccagctgctgtaccgcctgggccgcctgctgctggaggagggcagcttccaccccctgggcatgtctggagctggcagctag

SEQ ID NO: 155925 - DNA, 1212 bp, Artificial Sequence
  Description of Artificial Sequence: Synthetic coding sequence
atggcccacgccatggagaacagctggaccatcagcaaggagtaccacattgatgaggaggtgggctttgccctgcccaacccccaggagaacctgcctgacttctacaatgactggatgttcatcgccaagcacctgcctgacctgattgagagcggccagctgcgggagcgggtggagaagctgaacatgctgagcattgaccacctgacagaccacaagagccagaggctggcccggctggtgctgggctgcatcaccatggcctacgtgtggggcaagggccatggagatgtgaggaaggtgctgcccagaaatattgctgtgccctactgccagctgagcaagaagctggagctgccccccatcctggtgtatgctgactgtgtgctggccaactggaagaagaaggaccccaacaagcccctgacctatgagaacatggatgtgctcttctccttcagagatggagactgcagcaagggcttcttcctggtgtccctgctggtggagattgctgctgccagcgccatcaaggtgatccccaccgtcttcaaggccatgcagatgcaggagcgggacaccctgctgaaggccctgctggagatcgccagctgcctggagaaggccctgcaggtgttccaccagatccatgaccacgtgaaccccaaggccttcttctctgtgctgcgcatctacctgagcggctggaagggcaacccccagctgagtgatggcctggtgtatgagggcttctgggaggaccccaaggagtttgctgggggcagcgctggccagagcagcgtcttccagtgctttgatgtgctgctgggcatccagcagacagctgggggcggccacgccgcccagttcctgcaggacatgaggcgctacatgcccccagcccacaggaacttcctgtgcagcctggagagcaaccccagcgtgcgggagtttgtgctgagcaaaggagatgctggcctgcgggaggcctatgatgcctgtgtgaaggccctggtgtccctgcggagctaccacctgcagatcgtgaccaagtacatcctgatcccagccagccagcagcccaaggagaacaagaccagcgaggaccccagcaagctggaggccaagggcactggaggaacagacctgatgaacttcctgaagacagtgcgcagcaccacagagaagagcctgctgaaggagggctag

SEQ ID NO: 155926 - DNA, 237 bp, Artificial Sequence
  Description of Artificial Sequence: Synthetic coding sequence
atggcccacgccatggagaacagctggaccatcagcaaggagtaccacattgatgaggaggtgggctttgccctgcccaacccccaggagaacctgcctgacttctacaatgactggatgttcatcgccaagcacctgcctgacctgattgagagcggccagctgcgggagcgggtggagaagctgaacatgctgagcattgaccacctgacagaccacaagagccagaggctgtag

SEQ ID NO: 155927 - DNA, 543 bp, Artificial Sequence
  Description of Artificial Sequence: Synthetic coding sequence
atggcccacgccatggagaacagctggaccatcagcaaggagtaccacattgatgaggaggtgggctttgccctgcccaacccccaggagaacctgcctgacttctacaatgactggatgttcatcgccaagcacctgcctgacctgattgagagcggccagctgcgggagcgggtggagaagctgaacatgctgagcattgaccacctgacagaccacaagagccagaggctggcccggctggtgctgggctgcatcaccatggcctacgtgtggggcaagggccatggagatgtgaggaaggtgctgcccagaaatattgctgtgccctactgccagctgagcaagaagctggagctgccccccatcctggtgtatgctgactgtgtgctggccaactggaagaagaaggaccccaacaagcccctgacctatgagaacatggatgtgctcttctccttcagagatggagactgcagcaagggcttcttcctggtgtccctgctggtggagattgctgctgccagcgccatcaaggtgtag

SEQ ID NO: 155928 - DNA, 1212 bp, Artificial Sequence; identical to SEQ ID NO: 155925
  Description of Artificial Sequence: Synthetic coding sequence

SEQ ID NO: 155929 - DNA, 144 bp, Artificial Sequence
  Description of Artificial Sequence: Synthetic coding sequence
atggcccacgccatggagaacagctggaccatcagcaaggagtaccacattgatgaggaggtgggctttgccctgcccaacccccaggagaacctgcctgacttctacaatgactggatgttcatcgccaagcacctgccctag

SEQ ID NO: 155930 - DNA, 1224 bp, Artificial Sequence
  Description of Artificial Sequence: Synthetic coding sequence
atggagccccaccggcccaacgtgaagacagctgtgcccctgagcctggagagctaccacatcagcgaggagtatggcttcctgctgcctgacagcctgaaggagctgcctgaccactaccggccctggatggagatcgccaacaagctgccccagctgattgatgcccaccagctgcaggcccacgtggacaagatgcccctgctgagctgccagttcctgaagggccaccgggagcagaggctggcccacctggtgctgtccttcctgaccatgggctacgtgtggcaggagggggaggcccagcctgctgaggtgctgcccaggaacctggccctgccctttgtggaggtgtccaggaacctgggcctgccccccatcctggtgcacagcgacctggtgctgaccaactggaccaagaaggaccctgatggcttcctggagatcggcaacctggagaccatcatctccttccctggaggagagagcctgcacggcttcatcctggtgacagccctggtggagaaggaggccgtgcccggcatcaaggccctggtgcaggccaccaatgccatcctgcagcccaaccaggaggccctgctgcaggccctgcagaggctgcggctgagcatccaggacatcaccaagaccctgggccagatgcatgactatgtggaccctgacatcttctacgccggcatccgcatcttcctgagcggctggaaggacaacccagccatgcctgctggcctgatgtatgaaggagtgtcccaggagcccctgaagtacagcggcggcagcgctgcccagagcacagtgctgcacgcctttgatgagttcctgggcatccgccacagcaaggagagcggggacttcctgtacaggatgagggactacatgccacccagccacaaggccttcatcgaggacatccacagcgcccccagcctgcgggactacatcctgagcagcggccaggaccacctgctgacagcctacaaccagtgtgtgcaggccctggccgagctgcggagctaccacatcaccatggtgaccaagtacctgatcacagctgctgccaaggccaagcacggcaagcccaaccacctgcccggccccccccaggccctgaaggaccggggcaccggcggcacagctgtgatgtccttcctgaagtctgtgcgggacaagaccctggagagcatcctgcacccccggggctag

SEQ ID NO: 155931 - DNA, 1263 bp, Artificial Sequence
  Description of Artificial Sequence: Synthetic coding sequence
atgctgcacttccactactatgacaccagcaacaagatcatggagccccaccggcccaacgtgaagacagctgtgcccctgagcctggagagctaccacatcagcgaggagtatggcttcctgctgcctgacagcctgaaggagctgcctgaccactaccggccctggatggagatcgccaacaagctgccccagctgattgatgcccaccagctgcaggcccacgtggacaagatgcccctgctgagctgccagttcctgaagggccaccgggagcagaggctggcccacctggtgctgtccttcctgaccatgggctacgtgtggcaggagggggaggcccagcctgctgaggtgctgcccaggaacctggccctgccctttgtggaggtgtccaggaacctgggcctgccccccatcctggtgcacagcgacctggtgctgaccaactggaccaagaaggaccctgatggcttcctggagatcggcaacctggagaccatcatctccttccctggaggagagagcctgcacggcttcatcctggtgacagccctggtggagaaggaggccgtgcccggcatcaaggccctggtgcaggccaccaatgccatcctgcagcccaaccaggaggccctgctgcaggccctgcagaggctgcggctgagcatccaggacatcaccaagaccctgggccagatgcatgactatgtggaccctgacatcttctacgccggcatccgcatcttcctgagcggctggaaggacaacccagccatgcctgctggcctgatgtatgagggcgtgtcccaggagcccctgaagtacagcggcggcagcgctgcccagagcacagtgctgcacgcctttgatgagttcctgggcatccgccacagcaaggagagcggggacttcctgtacaggatgagggactacatgccacccagccacaaggccttcatcgaggacatccacagcgcccccagcctgcgggactacatcctgagcagcggccaggaccacctgctgacagcctacaaccagtgtgtgcaggccctggccgagctgcggagctaccacatcaccatggtgaccaagtacctgatcacagctgctgccaaggccaagcacggcaagcccaaccacctgcccggccccccccaggccctgaaggaccggggcactggaggaacagctgtgatgtccttcctgaagtctgtgcgggacaagaccctggagagcatcctgcacccccggggctag

SEQ ID NO: 155932 - DNA, 792 bp, Artificial Sequence
  Description of Artificial Sequence: Synthetic coding sequence
atgaagggcggcttcaccggaggagatgagtaccagaagcacttcctgccccgggactacctggccacctactacagctttgatggcagccccagccctgaggccgagatgctgaagttcaacctggagtgcctgcacaagacctttggacctgggggcctgcagggcgacaccctgattgacatcggcagcggccccaccatctaccaggtgctggccgcctgtgacagcttccaggacatcaccctgagtgacttcacagacaggaaccgggaggagctggagaagtggctgaagaaggagcccggggcctatgactggaccccagctgtgaagtttgcctgtgagctggagggcaacagcggccgctgggaggagaaggaggagaagctgcgggctgctgtgaagagggtgctgaagtgtgatgtgcacctgggcaaccccctggccccagctgtgctgcccctggccgactgtgtgctgaccctgctggccatggagtgtgcctgctgcagcctggatgcctaccgggccgccctgtgcaacctggccagcctgctgaagccaggcggccacctggtgaccaccgtgaccctgcggctgcccagctacatggtgggcaagcgggagttcagctgtgtggccctggagaaggaggaggtggagcaggccgtgctggatgctggctttgacatcgagcagctgctgcacagcccccagagctacagcgtgaccaatgctgccaacaacggggtgtgcttcatcgtggccaggaagaagccaggcccctag

SEQ ID NO: 155933 - DNA, 789 bp, Artificial Sequence
  Description of Artificial Sequence: Synthetic coding sequence
atgaagggcggcttcaccggaggagatgagtaccagaagcacttcctgccccgggactacctggccacctactacagctttgatggcagccccagccctgaggccgagatgctgaagttcaacctggagtgcctgcacaagacctttggacctggcctgcagggcgacaccctgattgatattggcagcggccccaccatctaccaggtgctggccgcctgtgacagcttccaggacatcaccctgagtgacttcacagacaggaaccgggaggagctggagaagtggctgaagaaggagcccggggcctatgactggaccccagctgtgaagtttgcctgtgagctggagggcaacagcggccgctgggaggagaaggaggagaagctgcgggctgctgtgaagagggtgctgaagtgtgatgtgcacctgggcaaccccctggccccagctgtgctgcccctggccgactgtgtgctgaccctgctggccatggagtgtgcctgctgcagcctggatgcctacagagctgccctgtgcaacctggccagcctgctgaagccaggcggccacctggtgaccaccgtgaccctgcggctgcccagctacatggtgggcaagcgggagttcagctgtgtggccctggagaaggaggaggtggagcaggccgtgctggatgctggctttgatattgagcagctgctgcacagcccccagagctacagcgtgaccaatgctgccaacaatggagtgtgcttcatcgtggccaggaagaagccaggcccctag

SEQ ID NO: 155934 - DNA, 600 bp, Artificial Sequence
  Description of Artificial Sequence: Synthetic coding sequence
atgaagagcggcctgtggtacttcttcctgttctgcctgcgcatcaaggtgctgactggagagatcaatggaagtgccaactatgagatgttcatcttccacaatggaggagtgcagatcctgtgcaagtacccagacatcgtgcagcagttcaagatgcagctgctgaagggcggccagatcctgtgtgacctgaccaagaccaagggcagcggcaacacagtgtccatcaagagcctgaagttctgccacagccagctgagcaacaacagcgtgtccttcttcctgtacaacctggaccacagccacgccaactactacttctgcaacctgagcatctttgaccccccacccttcaaggtgaccctgaccggcggctacctgcacatctatgagagccagctgtgctgccagctgaagttctggctgcccatcggctgtgccgcctttgtggtggtgtgcatcctgggctgcatcctgatctgctggctgaccaagaagaagtacagcagctctgtgcatgaccccaatggagagtacatgttcatgagagctgtgaacacagccaagaagagccggctgacagatgtgaccctgtag

SEQ ID NO: 155935 - DNA, 507 bp, Artificial Sequence
  Description of Artificial Sequence: Synthetic coding sequence
atgaagagcggcctgtggtacttcttcctgttctgcctgcgcatcaaggtgctgactggagagatcaatggaagtgccaactatgagatgttcatcttccacaatggaggagtgcagatcctgtgcaagtacccagacatcgtgcagcagttcaagatgcagctgctgaagggcggccagatcctgtgtgacctgaccaagaccaagggcagcggcaacacagtgtccatcaagagcctgaagttctgccacagccagctgagcaacaacagcgtgtccttcttcctgtacaacctggaccacagccacgccaactactacttctgcaacctgagcatctttgaccccccacccttcaaggtgaccctgaccggcggctacctgcacatctatgagagccagctgtgctgccagctgaagttctggctgcccatcggctgtgccgcctttgtggtggtgtgcatcctgggctgcatcctgatctgctggctgaccaagaagatgtag

SEQ ID NO: 155936 - DNA, 930 bp, Artificial Sequence
  Description of Artificial Sequence: Synthetic coding sequence
atgaggctgggcagccctggcctgctcttcctgctcttcagcagcctgcgggctgacacccaggagaaggaggtgcgggccatggtgggcagtgatgtggagctgagctgtgcctgcccagagggcagcagatttgacctgaatgatgtgtatgtgtactggcagaccagcgagagcaagacagtggtgacctaccacatcccccagaacagcagcctggagaatgtggacagccgctacagaaacagagccctgatgagccctgctggcatgctgcggggggacttcagcctgcggctcttcaacgtgaccccccaggatgagcagaagttccactgcctggtgctgagccagagcctgggcttccaggaggtgctgtctgtggaggtgaccctgcacgtggccgccaacttctctgtgcctgtggtgtctgccccccacagccccagccaggatgagctgaccttcacctgcaccagcatcaatggctacccccggcccaacgtgtactggatcaacaagacagacaacagcctgctggaccaggccctgcagaatgacaccgtcttcctgaacatgaggggcctgtatgatgtggtgtctgtgctgagaattgcccggacccccagcgtgaacatcggctgctgcattgaaaatgtgctgctgcagcagaacctgactgtgggcagccagacaggaaatgacatcggggagcgggacaagatcacagagaaccctgtgtccactggagagaagaatgctgccacctggagcatcctggccgtgctgtgcctgctggtggtggtggccgtggccatcggctgggtgtgccgggaccgctgcctgcagcacagctatgctggggcctgggccgtgtccccagagacagagctgacagagagctggaacctgctgctgctgctgtcctag

SEQ ID NO: 155937 - DNA, 558 bp, Artificial Sequence
  Description of Artificial Sequence: Synthetic coding sequence
atgaggctgggcagccctggcctgctcttcctgctcttcagcagcctgcgggccgccaacttctctgtgcctgtggtgtctgccccccacagccccagccaggatgagctgaccttcacctgcaccagcatcaatggctacccccggcccaacgtgtactggatcaacaagacagacaacagcctgctggaccaggccctgcagaatgacacagtgttcctgaacatgaggggcctgtatgatgtggtgtctgtgctgcgcatcgcccggaccccatctgtgaacatcggctgctgcattgaaaatgtgctgctgcagcagaacctgactgtgggcagccagacaggaaatgacattggagagcgggacaagatcacagaaaatcctgtgtccactggagagaagaatgctgccacctggagcatcctggccgtgctgtgcctgctggtggtggtggccgtggccatcggctgggtgtgccgggaccgctgcctgcagcacagctatgctggggcctgggccgtgtccccagagacagagctgaccggccacgtgtag

SEQ ID NO: 155938 - DNA, 909 bp, Artificial Sequence
  Description of Artificial Sequence: Synthetic coding sequence
atgaggctgggcagccctggcctgctcttcctgctcttcagcagcctgcgggctgacacccaggagaaggaggtgcgggccatggtgggcagtgatgtggagctgagctgtgcctgcccagagggcagcagatttgacctgaatgatgtgtatgtgtactggcagaccagcgagagcaagacagtggtgacctaccacatcccccagaacagcagcctggagaatgtggacagccgctacagaaacagagccctgatgagccctgctggcatgctgcggggggacttcagcctgcggctcttcaacgtgaccccccaggatgagcagaagttccactgcctggtgctgagccagagcctgggcttccaggaggtgctgtctgtggaggtgaccctgcacgtggccgccaacttctctgtgcctgtggtgtctgccccccacagccccagccaggatgagctgaccttcacctgcaccagcatcaatggctacccccggcccaacgtgtactggatcaacaagacagacaacagcctgctggaccaggccctgcagaatgacaccgtcttcctgaacatgaggggcctgtatgatgtggtgtctgtgctgagaattgcccggacccccagcgtgaacatcggctgctgcattgaaaatgtgctgctgcagcagaacctgactgtgggcagccagacaggaaatgacatcggggagcgggacaagatcacagagaaccctgtgtccactggagagaagaatgctgccacctggagcatcctggccgtgctgtgcctgctggtggtggtggccgtggccatcggctgggtgtgccgggaccgctgcctgcagcacagctatgctggggcctgggccgtgtccccagagacagagctgactggacatgtgtag

SEQ ID NO: 155939 - DNA, 1101 bp, Artificial Sequence
  Description of Artificial Sequence: Synthetic coding sequence
atggtgctgcacctgctgctcttcctgctgctgaccccccagggcggccacagctgccagggcctggagctggcccgggagctggtgctggccaaggtgcgggccctcttcctggatgccctgggccccccagctgtgacccgggagggcggggaccccggggtgcggcggctgcccaggagacatgccctgggcggcttcacccaccggggcagcgagcctgaggaggaggaggatgtgtcccaggccatcctcttccctgccacagatgccagctgtgaggacaagtctgctgcccggggcctggcccaggaggccgaggagggcctcttccgctacatgttccggcccagccagcacaccaggagccggcaggtgaccagcgcccagctgtggttccacacaggcctggaccggcagggcacagctgccagcaacagcagcgagcccctgctgggcctgctggccctgagccctgggggccctgtggccgtgcccatgagcctgggccacgccccaccccactgggccgtgctgcacctggccaccagcgccctgagcctgctgacccaccctgtgctggtgctgctgctgcgctgccccctgtgcacctgcagcgcccggcctgaggccacccccttcctggtggcccacaccaggaccaggcctccttctggaggagagcgggcccggcgcagcacccccctgatgtcctggccctggagccccagcgccctgcggctgctgcagaggcctcctgaggagcctgctgcccacgccaactgccaccgggtggccctgaacatctccttccaggagctgggctgggagcgctggatcgtgtacccacccagcttcatcttccactactgccacggcggctgcggcctgcacatcccccccaacctgagcctgcctgtgcctggggccccacccaccccagcccagccctacagcctgctgcccggggcccagccctgctgtgccgccctgcccggcaccatgaggcccctgcacgtgaggaccaccagtgatggcggctacagcttcaagtatgagaccgtgcccaacctgctgacccagcactgtgcctgcatctag

SEQ ID NO: 155940 - DNA, 1281 bp, Artificial Sequence
  Description of Artificial Sequence: Synthetic coding sequence
atgcccctgctgtggctgcggggcttcctgctggccagctgctggatcatcgtgcgcagcagccccaccccaggcagcgagggccacagcgctgccccagactgccccagctgtgccctggccgccctgcccaaggatgtgcccaacagccagcctgagatggtggaggccgtgaagaagcacatcctgaacatgctgcacctgaagaagaggccagatgtgacccagcctgtgcccaaggccgccctgctgaatgccatcaggaagctgcacgtgggcaaggtgggagaaaatggctacgtggagattgaagatgacattggaagaagagctgagatgaatgagctgatggagcagaccagcgagatcatcacctttgctgagagcggcacagccaggaagaccctgcactttgagatcagcaaggagggcagtgacctgtctgtggtggagagagctgaggtgtggctgttcctgaaggtgcccaaggccaacagaaccaggaccaaggtgaccatccgcctcttccagcagcagaagcacccccagggcagcctggacaccggggaggaggccgaggaggtgggcctgaagggggagaggtctgagctgctgctgtctgagaaggtggtggatgccaggaagagcacctggcacgtgtttcctgtgagcagcagcatccagaggctgctggaccagggcaagagcagcctggatgtgcgcatcgcctgtgagcagtgccaggagagcggggccagcctggtgctgctgggcaagaagaagaagaaggaggaggagggggagggcaagaagaagggcggcggggagggcggggccggggctgatgaggagaaggagcagagccaccggcccttcctgatgctgcaggcccggcagagcgaggaccacccccacagaagaagaagaagaggcctggagtgtgatggcaaggtgaacatctgctgcaagaagcagttctttgtgtccttcaaggacatcggctggaatgactggatcatcgcccccagcggctaccacgccaactactgtgaaggagaatgtcccagccacatcgccggcaccagcggcagcagcctgtccttccacagcaccgtcatcaaccactacaggatgaggggccacagcccctttgccaacctgaagagctgctgcgtgcccaccaagctgcggcccatgtccatgctgtactatgatgatggccagaacatcatcaagaaggacatccagaacatgattgtggaggagtgtggctgcagctag

SEQ ID NO: 155941 - DNA, 1281 bp, Artificial Sequence; identical to SEQ ID NO: 155940
  Description of Artificial Sequence: Synthetic coding sequence

SEQ ID NO: 155942 - DNA, 1224 bp, Artificial Sequence
  Description of Artificial Sequence: Synthetic coding sequence
atggatggcctgcccggccgggccctgggcgccgcctgcctgctgctgctggccgccggctggctgggccctgaggcctggggcagccccaccccaccacccaccccagctgcccctcctcctcctcctcctcctggcagccctgggggcagccaggacacctgcaccagctgtggcggcttccggcggcctgaggagctgggccgggtggatggagacttcctggaggccgtgaagaggcacatcctgagccggctgcagatgaggggccggcccaacatcacccatgctgtgcccaaggccgccatggtgacagccctgaggaagctgcacgccggcaaggtgagagaagatggccgggtggagatcccccacctggatggccacgccagccctggagcagatggccaggagcgggtgtctgagatcatcagctttgctgagacagatggcctggccagcagccgggtgcggctgtacttcttcatcagcaatgaaggcaaccagaacctgtttgtggtgcaggccagcctgtggctgtacctgaagctgctgccctacgtgctggagaagggcagcaggaggaaggtgcgggtgaaggtgtacttccaggagcagggccacggggaccgctggaacatggtggagaagagggtggacctgaagaggagcggctggcacaccttccccctgacagaggccatccaggccctgtttgagcggggggagcggcggctgaacctggatgtgcagtgtgacagctgccaggagctggccgtggtgcctgtgtttgtggaccctggagaggagagccaccggccctttgtggtggtgcaggcccggctgggggacagccgccaccgcatcaggaagaggggcctggagtgtgatggccgcaccaacctgtgctgccggcagcagttcttcatcgacttccggctgattggctggaatgactggatcatcgcccccaccggctactacggcaactactgtgagggcagctgcccagcctacctggccggcgtgcccggcagcgccagcagcttccacacagctgtggtgaaccagtacaggatgaggggcctgaaccctggcaccgtgaacagctgctgcatccccaccaagctgagcaccatgtccatgctgtactttgatgatgagtacaacatcgtgaagagagatgtgcccaacatgattgtggaggagtgtggctgtgcctag

SEQ ID NO: 155943 - DNA, 1059 bp, Artificial Sequence
  Description of Artificial Sequence: Synthetic coding sequence
atgaccagcagcctgctgctggccttcctgctgctggcccccaccaccgtggccaccccccgggccggcggccagtgcccagcctgtggcggccccaccctggagctggagagccagcgggagctgctgctggacctggccaagaggagcatcctggacaagctgcacctgacccagaggcccaccctgaacagacctgtgtcccgggccgccctgaggacagccctgcagcacctgcacggcgtgccccagggcgccctgctggaggacaaccgggagcaggagtgtgagatcatcagctttgctgagaccggcctgagcaccatcaaccagacccggctggacttccacttcagcagtgacagaacagctggggaccgggaggtgcagcaggccagcctgatgttctttgtgcagctgcccagcaacaccacctggaccctgaaggtgcgggtgctggtgctgggcccccacaacaccaacctgaccctggccacccagtacctgctggaggtggatgccagcggctggcaccagctgcccctgggccctgaggcccaggccgcctgcagccagggccacctgaccctggagctggtgctggagggccaggtggcccagagcagcgtcatcctgggcggggccgcccaccggccctttgtggccgcccgggtgcgggtgggcggcaagcaccagatccacagaagaggcatcgactgccagggcggcagcaggatgtgctgccggcaggagttctttgtggacttccgggagatcggctggcatgactggatcatccagcctgagggctacgccatgaacttctgcatcggccagtgccccctgcacatcgccggcatgcctggcattgctgccagcttccacacagctgtgctgaacctgctgaaggccaacacagctgctggcaccactggaggcggcagctgctgcgtgcccacagcccggcggcccctgagcctgctgtactatgaccgggacagcaacatcgtgaagacagacatcccagacatggtggtggaggcctgtggctgcagctag

SEQ ID NO: 155944 - DNA, 1053 bp, Artificial Sequence
  Description of Artificial Sequence: Synthetic coding sequence
atgaggctgcctgatgtgcagctgtggctggtgctgctgtgggccctggtgcgggcccagggcaccggctctgtgtgccccagctgtggcggcagcaagctggccccccaggccgagcgggccctggtgctggagctggccaagcagcagatcctggatggcctgcacctgaccagccggccccgcatcacccaccccccaccccaggccgccctgacccgggccctgcggcggctgcagcccggctctgtggcccctggaaatggagaggaggtgatcagctttgccaccgtgacagacagcaccagcgcctacagcagcctgctgaccttccacctgagcacccccaggagccaccacctgtaccacgcccggctgtggctgcacgtgctgcccaccctgcccggcaccctgtgcctgcgcatcttccgctggggccccaggagaagacggcagggcagcaggaccctgctggccgagcaccacatcaccaacctgggctggcacaccctgaccctgcccagcagcggcctgcggggggagaagtctggagtgctgaagctgcagctggactgccggcccctggagggcaacagcacagtgacaggccagccccggcggctgctggacacagctggccaccagcagcccttcctggagctgaagatccgggccaatgagcccggggccggccgggcccggcggaggacccccacctgtgagcccgccacccccctgtgctgcagaagagaccactacgtggacttccaggagctgggctggagggactggatcctgcagcctgagggctaccagctgaactactgcagcggccagtgccccccccacctggccggcagccctggcattgctgccagcttccacagcgctgtgttcagcctgctgaaggccaacaacccctggccagccagcaccagctgctgcgtgcccacagcccggcggcccctgagcctgctgtacctggaccacaatggaaatgtggtgaagacagatgtgcctgacatggtggtggaggcctgtggctgcagctag

SEQ ID NO: 155945 - DNA, 4062 bp, Artificial Sequence
  Description of Artificial Sequence: Synthetic coding sequence
atgagcagccccatgccagactgcaccagcaaatgtcgcagcctgaagcacgccctggatgtgctgtctgtggtgaccaagggcagcgagaaccagatcaaggccttcctgagcagccactgctacaatgctgccaccatcaaggatgtgtttggaagaaatgccctgcacctggtgagcagctgtgggaagaagggcgtgctggactggctgatccagaagggcgtggacctgctggtgaaggacaaggagagcggctggacagccctgcacaggagcatcttctacggccacatcgactgtgtgtggagcctgctgaagcacggcgtgtccctgtacatccaggacaaggagggcctgagcgccctggacctggtgatgaaggaccggcccacccacgtggtgttcaagaacacagaccccacagatgtgtacacctggggagacaacaccaacttcaccctgggccacggcagccagaacagcaagcaccaccctgagctggtggacctcttcagccgcagcggcatctacatcaagcaggtggtgctgtgcaagttccacagcgtcttcctgagccagaagggccaggtgtacacctgtggccacggccctgggggccgcctgggccatggagatgagcagacctgcctggtgccccggctggtggagggcctgaatggccacaactgcagccaggtggccgccgccaaggaccacacagtggtgctgacagaagatggctgtgtgtacaccttcggcctgaacatcttccaccagctgggcatcatccccccacccagcagctgcaatgtgccccggcagatccaggccaagtacctgaagggccgcaccatcattggagtggccgccggccgcttccacacagtgctgtggacccgggaggccgtgtacaccatgggcctgaatggaggccagctgggctgcctgctggaccccaatggagagaagtgtgtgacagccccccggcaggtgtctgccctgcaccacaaggacatcgccctgagcctggtggccgccagtgatggagccaccgtgtgtgtgaccaccaggggggacatctacctgctggccgactaccagtgcaagaagatggccagcaagcagctgaacctgaagaaggtgctggtgtctgggggccacatggagtacaaggtggaccctgagcacctgaaggaaaatggaggccagaagatctgcatcctggccatggatggagctggccgggtcttctgctggaggtctgtgaacagcagcctgaagcagtgccgctgggcctacccccggcaggtgttcatcagtgacatcgccctgaacagaaatgagatcctgtttgtgacccaggatggagagggcttccggggccgctggtttgaggagaagaggaagagcagcgagaagaaggagatcctgagcaacctgcacaacagcagcagtgatgtgtcctatgtgtctgacatcaacagcgtgtatgaaagaatccggctggagaagctgacctttgcccacagagctgtgtctgtgtccacagaccccagcggctgcaactttgccatcctgcagagcgaccccaagaccagcctgtatgagatcccagctgtgagcagcagcagcttctttgaggagtttgggaagctgctgcgggaggctgatgagatggacagcatccatgatgtgaccttccaggtgggcaacagactcttccctgcccacaagtacatcctggccgtgcacagcgacttcttccagaagctgttcctgagtgatggcaacaccagcgagttcacagacatctaccagaaggatgaggacagcgctggctgccacctgtttgtggtggagaaggtgcacccagacatgtttgagtacctgctgcagttcatctacacagacacctgtgacttcctgacccacggcttcaagccccgcatccacctgaacaagaaccctgaggagtaccagggcaccctgaacagccacctgaacaaggtgaacttccatgaagatgacaaccagaagagcgcctttgaggtgtacaagagcaaccaggcccagacagtgtctgagcggcagaagagcaagcccaagagctgcaagaagggcaagaacatcagagaagatgatcctgtgaggatgctgcagacagtggccaagaagtttgacttcagcaacctgagcagccggctggatggagtgcgctttgaaaatgagaagatcaacgtgattgccaagaacacaggcaacaagctgaagctgagccagaagaagtgcagcttcctgtgtgatgtgaccatgaagtctgtggatggcaaggagttcccctgccacaagtgtgtgctgtgtgcccggctggagtacttccacagcatgctgagcagctcctggattgaggccagcagctgtgccgccctggagatgcccatccacagcgacatcctgaaggtgatcctggactacctgtacacagatgaggccgtggtgatcaaggagagccagaatgtggacttcatctgcagcgtgctggtggtggccgaccagctgctgatcacccggctgaaggagatctgtgaggtggccctgacagagaagctgaccctgaagaatgctgccatgctgctggagtttgctgccatgtacagcgccaagcagctgaagctgagctgcctgcagttcatcggcctgaacatggccgccctgctggaggcccggagcctggatgtgctgagtgatggagtgctgaaggacctgtctgagttctacaggaagatgatcccagccatggaccggcgggtcatcaccccctaccaggacggccctgacatctcctacctggaggtggaggatggagacatcttcctgaaggaggagatcaacatggagcagaaccacagcgagaccatgttcaagaaggccaagaccaaggccaagaagaagcccaggaagagaagtgacagcagcggcggctacaacctgagtgacatcatccagagccccagcagcacaggcctgctgaagagcggcaagaccaacagcgtggagagcctgcctgagctgctgaccagtgacagcgagggcagctatgccggcgtgggcagcccccgggacctgcagagcccagacttcaccaccggcttccacagcgacaagattgaggccaaggtgaagccctacgtgaatggcaccagccctgtgtacagccgggaggacctgaagccctgggagaagagccccatcctgaagatcagcgccccccagcccatccccagcaacagaattgacaccaccagcagcgcctcctgggtggccggcagcttcagccctgtgtccccacctgtggtggacctgcggaccatcatggagattgaggagagccggcagaagtgtggggccacccccaagagccacctgggcaagacagtgtcccatggagtgaagctgagccagaagcagaggaagatgattgccctgaccaccaaggagaacaacagcggcatgaacagcatggagaccgtgctcttcacccccagcaaggcccccaagcctgtgaatgcctgggccagcagcctgcacagcgtgagcagcaagagcttccgggacttcctgctggaggagaagaagtctgtgaccagccacagcagcggggaccacgtgaagaaggtgtccttcaagggcatcgagaacagccaggcccccaagatcgtgcgctgcagcacccacggcaccccaggccctgagggcaaccacatcagtgacctgcccctgctggacagccccaacccctggctgagcagctctgtgacagcccccagcatggtggcccctgtgacctttgccagcatcgtggaggaggagctgcagcaggaggccgccctgatccgcagccgggagaagcccctggccctgatccagatcgaggagcacgccatccaggacctgctggtgttctatgaggccttcggcaaccctgaggagtttgtgattgtggagaggaccccccagggccccctggccgtgcccatgtggaacaagcacggctgctag

SEQ ID NO: 155946 - DNA, 1386 bp, Artificial Sequence
  Description of Artificial Sequence: Synthetic coding sequence
atgtggcagctgaccagcctgctgctgtttgtggccacctggggcatcagcggcaccccagcccccctggacagcgtcttcagcagcagcgagcgggcccaccaggtgctgcgcatcaggaagagggccaacagcttcctggaggagctgcggcacagcagcctggagcgggagtgcatcgaggagatctgtgactttgaggaggccaaggagatcttccagaatgtggatgacaccctggccttctggagcaagcacgtggatggagaccagtgcctggtgctgcccctggagcacccctgtgccagcctgtgctgcggccacggcacctgcattgatggcatcggcagcttcagctgtgactgccgcagcggctgggagggccgcttctgccagcgggaggtgtccttcctgaactgcagcctggacaatggaggctgcacccactactgcctggaggaggtgggctggaggcgctgcagctgtgcccctggctacaagctgggagatgacctgctgcagtgccaccctgctgtgaagttcccctgtggccggccctggaagaggatggagaagaagaggagccacctgaagagggacacagaggaccaggaggaccaggtggacccccggctgattgatggcaagatgaccaggagaggagacagcccctggcaggtggtgctgctggacagcaagaagaagctggcctgtggggctgtgctgatccaccccagctgggtgctgacagctgcccactgcatggatgagagcaagaagctgctggtgcggctgggggagtatgacctgcggcgctgggagaagtgggagctggacctggacatcaaggaggtgtttgtgcaccccaactacagcaagagcaccacagacaatgacatcgccctgctgcacctggcccagcctgccaccctgagccagaccatcgtgcccatctgcctgcctgattctggcctggccgagcgggagctgaaccaggccggccaggagaccctggtgacaggctggggctaccacagcagccgggagaaggaggccaagaggaacagaacatttgtgctgaacttcatcaagatccctgtggtgccccacaatgaatgttctgaggtgatgagcaacatggtgtctgagaacatgctgtgtgccggcatcctgggggaccggcaggatgcctgtgagggggacagcggcggccccatggtggccagcttccacggcacctggttcctggtgggcctggtgtcctggggcgagggctgcggcctgctgcacaactacggcgtgtacaccaaggtgagccgctacctggactggatccacggccacatccgggacaaggaggccccccagaagtcctgggccccctag

SEQ ID NO: 155947 - DNA, 405 bp, Artificial Sequence
  Description of Artificial Sequence: Synthetic coding sequence
atgaaggccttcagccctgtgcgctctgtgaggaagaacagcctgagtgaccacagcctgggcatcagccgcagcaagacccctgtggatgaccccatgagcctgctgtacaacatgaatgactgctacagcaagctgaaggagctggtgcccagcatcccccagaacaagaaggtgtccaagatggagatcctgcagcacgtgattgactacatcctggacctgcagatcgccctggacagccaccccaccatcgtgtccctgcaccaccagaggcctggccagaaccaggccagcaggacccccctgaccaccctgaacacagacatcagcatcctgagcctgcaggccagcgagttccccagcgagctgatgagcaatgacagcaaggccctgtgtggctag

SEQ ID NO: 155948 - DNA, 405 bp, Artificial Sequence; identical to SEQ ID NO: 155947
  Description of Artificial Sequence: Synthetic coding sequence

SEQ ID NO: 155949 - DNA, 360 bp, Artificial Sequence
  Description of Artificial Sequence: Synthetic coding sequence
atgaaggccctgagccctgtgcggggctgctatgaagctgtgtgctgcctgtctgagaggagcctggccatcgcccggggccggggcaagggccctgctgctgaggagcccctgagcctgctggatgacatgaaccactgctacagccggctgcgggagctggtgcctggggtgccccggggcacccagctgagccaggtggagatcctgcagagggtcatcgactacatcctggacctgcaggtggtgctggccgagcccgcccctggccccccagatggcccccacctgcccatccagacagctgagctgaccccagagctggtgatcagcaatgacaagaggagcttctgccactag

SEQ ID NO: 155950 - DNA, 486 bp, Artificial Sequence
  Description of Artificial Sequence: Synthetic coding sequence
atgaaggctgtgtcccctgtgcggcccagcggcaggaaggcccccagcggctgcggcggcggggagctggccctgcgctgcctggccgagcacggccacagcctgggcggcagcgctgctgctgctgctgctgctgctgctgcccgctgcaaggctgctgaggccgctgctgatgagcccgccctgtgcctgcagtgtgacatgaatgactgctacagccggctgcggcggctggtgcccaccatcccccccaacaagaaggtgtccaaggtggagatcctgcagcacgtgattgactacatcctggacctgcagctggccctggagacccacccagccctgctgcggcagcccccacctccagccccaccccaccaccctgctggcacctgcccagctgccccacccaggacccccctgacagccctgaacacagatcctgctggagctgtgaacaagcagggcgacagcatcctgtgcaggtag

SEQ ID NO: 155951 - DNA, 843 bp, Artificial Sequence
  Description of Artificial Sequence: Synthetic coding sequence
atgctgggccagcagcagcagcagctgtacagcagcgctgccctgctgactggagagaggagccggctgctgacctgctacgtgcaggactacctggagtgtgtggagagcctgccccatgacatgcagagaaatgtgtctgtgctgcgggagctggacaacaagtaccaggagaccctgaaggagattgatgatgtgtatgagaagtacaagaaggaggatgacctgaaccagaagaagaggctgcagcagctgctgcagagggccctgatcaacagccaggagctgggagatgagaagatccagatcgtgacccagatgctggagctggtggagaacagagcccggcagatggagctgcacagccagtgcttccaggaccctgctgagagcgagcgggccagtgacaaggccaagatggacagcagccagcctgagaggagcagccggcggccccggcggcagaggaccagcgagagccgggacctgtgccacatggccaacggcatcgaggactgtgatgaccagccccccaaggagaagaagagcaagagcgccaagaagaagaagaggagcaaggccaagcaggagcgggaggccagccctgtggagtttgccatcgaccccaatgagcccacctactgcctgtgcaaccaggtgtcctatggagagatgattggctgtgacaatgagcagtgccccatcgagtggttccacttcagctgtgtgtccctgacctacaagcccaagggcaagtggtactgccccaagtgccgcggggacaatgagaagaccatggacaagagcacagagaagaccaagaaggacagaagaagcaggtag

SEQ ID NO: 155952 - DNA, 723 bp, Artificial Sequence
  Description of Artificial Sequence: Synthetic coding sequence
atggaccaggatggagaccagcagctgggccccagccgcatcctggccccccagaccctgaaggagattgatgatgtgtatgagaagtacaagaaggaggatgacctgaaccagaagaagaggctgcagcagctgctgcagagggccctgatcaacagccaggagctgggagatgagaagatccagatcgtgacccagatgctggagctggtggagaacagagcccggcagatggagctgcacagccagtgcttccaggaccctgctgagagcgagcgggccagtgacaaggccaagatggacagcagccagcctgagaggagcagccggcggccccggcggcagaggaccagcgagagccgggacctgtgccacatggccaacggcatcgaggactgtgatgaccagccccccaaggagaagaagagcaagagcgccaagaagaagaagaggagcaaggccaagcaggagcgggaggccagccctgtggagtttgccatcgaccccaatgagcccacctactgcctgtgcaaccaggtgtcctatggagagatgattggctgtgacaatgagcagtgccccatcgagtggttccacttcagctgtgtgtccctgacctacaagcccaagggcaagtggtactgccccaagtgccgcggggacaatgagaagaccatggacaagagcacagagaagaccaagaaggacagaagaagcaggtag

SEQ ID NO: 155953 - DNA, 1257 bp, Artificial Sequence
  Description of Artificial Sequence: Synthetic coding sequence
atgctgtacctggaggactacctggagatgattgagcagctgcccatggacctgcgggaccgcttcacagagatgagggagatggacctgcaggtgcagaatgccatggaccagctggagcagagggtgtctgagttcttcatgaatgccaagaagaacaagccagagtggagggaggagcagatggccagcatcaagaaggactactacaaggccctggaggatgctgatgagaaggtgcagctggccaaccagatctatgacctggtggacagacacctgaggaagctggaccaggagctggccaagttcaagatggagctggaggccgacaatgccggcatcacagagatcctggagaggaggagcctggagctggacacccccagccagcctgtgaacaaccaccacgcccacagccacacccctgtggagaagaggaagtacaaccccaccagccaccacaccaccacagaccacatccctgagaagaagttcaagtctgaggccctgctgagcaccctgaccagtgatgccagcaaggagaacaccctgggctgcaggaacaacaacagcacagccagcagcaacaatgcctacaacgtgaacagcagccagcccctgggcagctacaacatcggcagcctgagcagcggcaccggggccggggccatcaccatggctgctgcccaggccgtgcaggccacagcccagatgaaggagggccgccgcaccagcagcctgaaggccagctatgaggccttcaagaacaatgacttccagctgggcaaggagttctccatggcccgggagaccgtgggctacagcagcagcagcgccctgatgaccaccctgacccagaatgccagcagcagcgctgctgacagccgcagcggcaggaagagcaagaacaacaacaagagcagcagccagcagagcagcagcagcagcagcagcagcagcctgagcagctgcagcagcagcagcacagtggtgcaggagatcagccagcagaccaccgtggtgcctgagagtgacagcaacagccaggtggactggacctatgaccccaatgagccccgctactgcatctgcaaccaggtgtcctatggagagatggtgggctgtgacaaccaggactgccccatcgagtggttccactacggctgtgtgggcctgacagaggcccccaagggcaagtggtactgcccccagtgcacagctgccatgaagaggcggggcagccgccacaagtag

SEQ ID NO: 155954 - DNA, 279 bp, Artificial Sequence
  Description of Artificial Sequence: Synthetic coding sequence
atgctgtacctggaggactacctggagatgattgagcagctgcccatggacctgcgggaccgcttcacagagatgagggagatggacctgcaggtgcagaatgccatggaccagctggagcagagggtgtctgagttcttcatgaatgccaagaagaacaagccagagtggagggaggagcagatggccagcatcaagaaggactactacaaggccctggaggatgctgatgagaaggtgcagctggccaaccagatctatgacctgcagcacttctag

SEQ ID NO: 155955 - DNA, 723 bp, Artificial Sequence
  Description of Artificial Sequence: Synthetic coding sequence
atggccacagccatgtacctggagcactacctggacagcattgagaacctgccctgtgagctgcagaggaacttccagctgatgagggagctggaccagaggacagaggacaagaaggccgagattgacatcctggccgctgagtacatcagcacagtgaagaccctgagcccagaccagagggtggagcggctgcagaagatccagaatgcctacagcaagtgcaaggagtacagtgatgacaaggtgcagctggccatgcagacctatgagatggtggacaagcacatccggcggctggatgctgacctggccaggtttgaagctgacctgaaggacaagatggagggcagtgactttgagagcagcggcggccggggcctgaagaagggccggggccagaaggagaagaggggcagccggggccggggccgccgcaccagcgaggaggacacccccaagaagaagaagcacaagggcggcagcgagttcacagacaccatcctgtctgtgcaccccagtgatgtgctggacatgcctgtggaccccaatgagcccacctactgcctgtgccaccaggtgtcctatggagagatgattggctgtgacaacccagactgccccatcgagtggttccactttgcctgtgtggacctgaccaccaagcccaagggcaagtggttctgcccccgctgtgtgcaggagaagaggaagaagaagtag

SEQ ID NO: 155956 - DNA, 681 bp, Artificial Sequence
  Description of Artificial Sequence: Synthetic coding sequence
atggccacagccatgtacctggagcactacctggacagcattgagaacctgccctgtgagctgcagaggaacttccagctgatgagggagctggaccagaggacagaggacaagaaggccgagattgacatcctggccgctgagtacatcagcacagtgaagaccctgagcccagaccagagggtggagcggctgcagaagatccagaatgcctacagcaagtgcaaggagtacagtgatgacaaggtgcagctggccatgcagacctatgagatggtggacaagcacatccggcggctggatgctgacctggccaggtttgaagctgacctgaaggacaagatggagggcagtgactttgagagcagcggcggccggggcctgaagaagggccggggccagaaggagaagaggggcagccggggccggggccgccgcaccagcgaggaggacacccccaagaagaagaagcacaagggcggcagcgagttcacagacaccatcctgtctgtgcaccccagtgatgtgctggacatgcctgtggaccccaatgagcccacctactgcctgtgccaccaggtgtcctatggagagatgattggctgtgacaacccagactgccccatcgagtggttccactttgcctgtgtggacctgaccaccaagcccaagggcaagtag

SEQ ID NO: 155957 - DNA, 2265 bp, Artificial Sequence
  Description of Artificial Sequence: Synthetic coding sequence
atgttttctgggggctgccacagccctggcttcggccggcccagccctgccttccctgcccctggcagccccccaccagccccccggccctgccggcaggagactggagagcagatcgccatcaagcagtgccggcaggagctgagccccaggaaccgggagcgctggtgcctggagatccagatcatgaggcggctgacccaccccaacgtggtggccgccagagatgtgcctgagggcatgcagaacctggccccaaatgacctgcccctgctggccatggagtactgccagggcggggacctgaggaagtacctgaaccagtttgagaactgctgcggcctgcgggagggcgccatcctgaccctgctgagtgacatcgccagcgccctgcgctacctgcacgagaaccgcatcatccaccgggacctgaagccagaaaatattgtgctgcagcagggcgagcagaggctcatccacaagatcatcgacctgggctacgccaaggagctggaccagggcagcctgtgcaccagctttgtgggcaccctgcagtacctggcccctgagctgctggagcagcagaagtacacagtgacagtggactactggagctttggcaccctggcctttgagtgcatcaccggcttccggcccttcctgcccaactggcagcctgtgcagtggcacagcaaggtgcggcagaagtctgaggtggacatcgtggtgtctgaggacctgaatggcaccgtgaagttcagcagcagcctgccctaccccaacaacctgaacagcgtgctggccgagcggctggagaagtggctgcagctgatgctgatgtggcacccccggcagaggggcacagaccccacctacggccccaacggctgcttcaaggccctggatgacatcctgaacctgaagctggtgcacatcctgaacatggtgacaggcaccatccacacctaccctgtgacagaagatgagagcctgcagagcctgaaggcccgcatccagcaggacaccggcatccctgaggaggaccaggagctgctgcaggaggccggcctggccctgatcccagacaagccagccacccagtgcatcagtgatggcaagctgaatgaaggccacaccctggacatggacctggtgttcctgtttgacaacagcaagatcacctatgagacccagatcagcccccggccccagcctgagagcgtgtcctgcatcctgcaggagcccaagaggaacctggccttcttccagctgaggaaggtgtggggccaggtgtggcacagcatccagaccctgaaggaggactgcaaccggctgcagcagggccagagagctgccatgatgaacctgctgaggaacaacagctgcctgagcaagatgaagaacagcatggcctccatgagccagcagctgaaggccaagctggacttcttcaagaccagcatccagattgacctggagaagtacagcgagcagacagaatttggcatcaccagtgacaagctgctgctggcctggagggagatggagcaggccgtggagctgtgtggcagagaaaatgaggtgaagctgctggtggagaggatgatggccctgcagacagacatcgtggacctgcagaggagccccatgggcaggaagcagggcggcaccctggatgacctggaggagcaggcccgggagctgtaccgccgcctgcgggagaagccccgggaccagaggacagaaggagacagccaggagatggtgcggctgctgctgcaggccatccagagctttgagaagaaggtgcgggtcatctacacccagctgagcaagacagtggtgtgcaagcagaaggccctggagctgctgcccaaggtggaggaggtggtgtccctgatgaatgaagatgagaagacagtggtgcggctgcaggagaagaggcagaaggagctgtggaacctgctgaagatcgcctgcagcaaggtgcggggccctgtgtctggcagcccagacagcatgaatgccagccggctgagccagcccggccagctgatgagccagcccagcacagccagcaacagcctgcctgagcccgccaagaagtctgaggagctggtggccgaggcccacaacctgtgcaccctgctggagaatgccatccaggacacagtgcgggagcaggaccagagcttcaccgccctggactggagctggctgcagacagaggaggaggagcacagctgcctggagcaggccagctag

SEQ ID NO: 155958 - DNA, 963 bp, Artificial Sequence
  Description of Artificial Sequence: Synthetic coding sequence
atgaacagacacctgtggaagagccagctgtgtgagatggtgcagcccagcggcggccctgctgctgaccaggatgtgctgggggaggagagccccctgggcaagccagccatgctgcacctgcccagcgagcagggcgcccctgagaccctgcagcgctgcctggaggagaaccaggagctgagagatgccatccggcagagcaaccagatcctgcgggagcgctgtgaggagctgctgcacttccaggccagccagcgggaggagaaggagttcctgatgtgcaagttccaggaggccaggaagctggtggagcggctgggcctggagaagctggacctgaagaggcagaaggagcaggccctgcgggaggtggagcacctgaagcgctgccagcagcagatggccgaggacaaggcctctgtgaaggcccaggtgaccagcctgctgggggagctgcaggagagccagagccggctggaggccgccaccaaggagtgccaggccctggagggccgcaggaagctggcccagctgcaggtggcctaccaccagctgttccaggagtatgacaaccacatcaagagctctgtggtgggcagcgagaggaagagagctgacatctacaaggctgacttccaggccgagcggcaggcccgggagaagctggccgagaagaaggagctgctgcaggagcagctggagcagctgcagcgggagtacagcaagctgaaggccagctgccaggagagcgccagaattgaggacatgaggaagagacatgtggaggtgtcccaggcccccctgcccccagccccagcctacctgagcagccccctggccctgcccagccagaggaggagccccccagaggagcccccagacttctgctgccccaagtgccagtaccaggccccagacatggacaccctgcagatccacgtgatggagtgcattgaatag

SEQ ID NO: 155959 - DNA, 1602 bp, Artificial Sequence
  Description of Artificial Sequence: Synthetic coding sequence
atgagcagtgatggcaccatccgccacagcaaggtgcggcagaagtctgaggtggacatcgtggtgtctgaggacctgaatggaacagtgaagttcagcagcagcctgccctaccccaacaacctgaacagcgtgctggccgagcggctggagaagtggctgcagctgatgctgatgtggcacccccggcagaggggcacagaccccacctacggccccaacggctgcttcaaggccctggatgacatcctgaacctgaagctggtgcacatcctgaacatggtgacaggcaccatccacacctaccctgtgacagaagatgagagcctgcagagcctgaaggcccgcatccagcaggacaccggcatccctgaggaggaccaggagctgctgcaggaggccggcctggccctgatcccagacaagccagccacccagtgcatcagtgatggcaagctgaatgaaggccacaccctggacatggacctggtgttcctgtttgacaacagcaagatcacctatgagacccagatcagcccccggccccagcctgagagcgtgtcctgcatcctgcaggagcccaagaggaacctggccttcttccagctgaggaaggtgtggggccaggtgtggcacagcatccagaccctgaaggaggactgcaaccggctgcagcagggccagagagctgccatgatgaacctgctgaggaacaacagctgcctgagcaagatgaagaacagcatggcctccatgagccagcagctgaaggccaagctggacttcttcaagaccagcatccagattgacctggagaagtacagcgagcagacagaatttggcatcaccagtgacaagctgctgctggcctggagggagatggagcaggccgtggagctgtgtggccgggagaatgaggtgaagctgctggtggagaggatgatggccctgcagacagacatcgtggacctgcagaggagccccatgggcaggaagcagggcggcaccctggatgacctggaggagcaggcccgggagctgtacagaaggctgcgggagaagccccgggaccagaggacagaaggagacagccaggagatggtgcggctgctgctgcaggccatccagagctttgagaagaaggtgcgggtcatctacacccagctgagcaagacagtggtgtgcaagcagaaggccctggagctgctgcccaaggtggaggaggtggtgtccctgatgaatgaagatgagaagacagtggtgcggctgcaggagaagaggcagaaggagctgtggaacctgctgaagatcgcctgcagcaaggtgcggggccctgtgtctggcagcccagacagcatgaatgccagccggctgagccagcccggccagctgatgagccagcccagcacagccagcaacagcctgcctgagcccgccaagaagtctgaggagctggtggccgaggcccacaacctgtgcaccctgctggagaatgccatccaggacacagtgcgggagcaggaccagagcttcaccgccctggactggagctggctgcagacagaggaggaggagcacagctgcctggagcaggccagctag

SEQ ID NO: 155960 - DNA, 2094 bp, Artificial Sequence
  Description of Artificial Sequence: Synthetic coding sequence
atgagcagtgatggcaccatccggctgacccaccccaacgtggtggccgccagagatgtgcctgagggcatgcagaacctggccccaaatgacctgcccctgctggccatggagtactgccagggcggggacctgaggaagtacctgaaccagtttgagaactgctgcggcctgcgggagggcgccatcctgaccctgctgagtgacatcgccagcgccctgcgctacctgcatgaaaatcgcatcatccaccgggacctgaagccagagaacatcgtgctgcagcagggcgagcagaggctcatccacaagatcatcgacctgggctacgccaaggagctggaccagggcagcctgtgcaccagctttgtgggcaccctgcagtacctggcccctgagctgctggagcagcagaagtacacagtgacagtggactactggagctttggcaccctggcctttgagtgcatcaccggcttccggcccttcctgcccaactggcagcctgtgcagtggcacagcaaggtgcggcagaagtctgaggtggacatcgtggtgtctgaggacctgaatggaacagtgaagttcagcagcagcctgccctaccccaacaacctgaacagcgtgctggccgagcggctggagaagtggctgcagctgatgctgatgtggcacccccggcagaggggcacagaccccacctacggccccaacggctgcttcaaggccctggatgacatcctgaacctgaagctggtgcacatcctgaacatggtgacaggcaccatccacacctaccctgtgacagaagatgagagcctgcagagcctgaaggcccgcatccagcaggacaccggcatccctgaggaggaccaggagctgctgcaggaggccggcctggccctgatcccagacaagccagccacccagtgcatcagtgatggcaagctgaatgaaggccacaccctggacatggacctggtgttcctgtttgacaacagcaagatcacctatgagacccagatcagcccccggccccagcctgagagcgtgtcctgcatcctgcaggagcccaagaggaacctggccttcttccagctgaggaaggtgtggggccaggtgtggcacagcatccagaccctgaaggaggactgcaaccggctgcagcagggccagagagctgccatgatgaacctgctgaggaacaacagctgcctgagcaagatgaagaacagcatggcctccatgagccagcagctgaaggccaagctggacttcttcaagaccagcatccagattgacctggagaagtacagcgagcagacagaatttggcatcaccagtgacaagctgctgctggcctggagggagatggagcaggccgtggagctgtgtggccgggagaatgaggtgaagctgctggtggagaggatgatggccctgcagacagacatcgtggacctgcagaggagccccatgggcaggaagcagggcggcaccctggatgacctggaggagcaggcccgggagctgtacagaaggctgcgggagaagccccgggaccagaggacagaaggagacagccaggagatggtgcggctgctgctgcaggccatccagagctttgagaagaaggtgcgggtcatctacacccagctgagcaagacagtggtgtgcaagcagaaggccctggagctgctgcccaaggtggaggaggtggtgtccctgatgaatgaagatgagaagacagtggtgcggctgcaggagaagaggcagaaggagctgtggaacctgctgaagatcgcctgcagcaaggtgcggggccctgtgtctggcagcccagacagcatgaatgccagccggctgagccagcccggccagctgatgagccagcccagcacagccagcaacagcctgcctgagcccgccaagaagtctgaggagctggtggccgaggcccacaacctgtgcaccctgctggagaatgccatccaggacacagtgcgggagcaggaccagagcttcaccgccctggactggagctggctgcagacagaggaggaggagcacagctgcctggagcaggccagctag

SEQ ID NO: 155961 - DNA, 2271 bp, Artificial Sequence
  Description of Artificial Sequence: Synthetic coding sequence
atgtcctggagccccagcctgaccacccagacctgtggggcctgggagatgaaggagcggctgggcactggaggctttggaaatgtcatccgctggcacaaccaggagactggagagcagatcgccatcaagcagtgccggcaggagctgagccccaggaaccgggagcgctggtgcctggagatccagatcatgaggcggctgacccaccccaacgtggtggccgccagagatgtgcctgagggcatgcagaacctggccccaaatgacctgcccctgctggccatggagtactgccagggcggggacctgaggaagtacctgaaccagtttgagaactgctgcggcctgcgggagggcgccatcctgaccctgctgagtgacatcgccagcgccctgcgctacctgcacgagaaccgcatcatccaccgggacctgaagccagaaaatattgtgctgcagcagggcgagcagaggctcatccacaagatcatcgacctgggctacgccaaggagctggaccagggcagcctgtgcaccagctttgtgggcaccctgcagtacctggcccctgagctgctggagcagcagaagtacacagtgacagtggactactggagctttggcaccctggcctttgagtgcatcaccggcttccggcccttcctgcccaactggcagcctgtgcagtggcacagcaaggtgcggcagaagtctgaggtggacatcgtggtgtctgaggacctgaatggcaccgtgaagttcagcagcagcctgccctaccccaacaacctgaacagcgtgctggccgagcggctggagaagtggctgcagctgatgctgatgtggcacccccggcagaggggcacagaccccacctacggccccaacggctgcttcaaggccctggatgacatcctgaacctgaagctggtgcacatcctgaacatggtgacaggcaccatccacacctaccctgtgacagaagatgagagcctgcagagcctgaaggcccgcatccagcaggacaccggcatccctgaggaggaccaggagctgctgcaggaggccggcctggccctgatcccagacaagccagccacccagtgcatcagtgatggcaagctgaatgaaggccacaccctggacatggacctggtgttcctgtttgacaacagcaagatcacctatgagacccagatcagcccccggccccagcctgagagcgtgtcctgcatcctgcaggagcccaagaggaacctggccttcttccagctgaggaaggtgtggggccaggtgtggcacagcatccagaccctgaaggaggactgcaaccggctgcagcagggccagagagctgccatgatgaacctgctgaggaacaacagctgcctgagcaagatgaagaacagcatggcctccatgagccagcagctgaaggccaagctggacttcttcaagaccagcatccagattgacctggagaagtacagcgagcagacagaatttggcatcaccagtgacaagctgctgctggcctggagggagatggagcaggccgtggagctgtgtggcagagaaaatgaggtgaagctgctggtggagaggatgatggccctgcagacagacatcgtggacctgcagaggagccccatgggcaggaagcagggcggcaccctggatgacctggaggagcaggcccgggagctgtaccgccgcctgcgggagaagccccgggaccagaggacagaaggagacagccaggagatggtgcggctgctgctgcaggccatccagagctttgagaagaaggtgcgggtcatctacacccagctgagcaagacagtggtgtgcaagcagaaggccctggagctgctgcccaaggtggaggaggtggtgtccctgatgaatgaagatgagaagacagtggtgcggctgcaggagaagaggcagaaggagctgtggaacctgctgaagatcgcctgcagcaaggtgcggggccctgtgtctggcagcccagacagcatgaatgccagccggctgagccagcccggccagctgatgagccagcccagcacagccagcaacagcctgcctgagcccgccaagaagtctgaggagctggtggccgaggcccacaacctgtgcaccctgctggagaatgccatccaggacacagtgcgggagcaggaccagagcttcaccgccctggactggagctggctgcagacagaggaggaggagcacagctgcctggagcaggccagctag

SEQ ID NO: 155962 - DNA, 3999 bp, Artificial Sequence
  Description of Artificial Sequence: Synthetic coding sequence
atgaggaacctgaagctgttccgcaccctggagttccgggacatccagggccctggcaacccccagtgcttcagcctgaggacagagcagggcaccgtgctgattggcagcgagcacggcctcatcgaggtggaccctgtgtcccgggaggtgaagaatgaggtgtccctggtggccgagggcttcctgcctgaagatggcagcggcagaattgtgggcgtgcaggacctgctggaccaggagagcgtgtgtgtggccacagccagcggagatgtgatcctgtgcagcctgagcacccagcagctggagtgtgtgggctctgtggccagcggcatctctgtgatgtcctggagcccagaccaggagctggtgctgctggccaccggccagcagaccctcatcatgatgaccaaggactttgagcccatcctggagcagcagatccaccaggatgactttggagagagcaagttcatcaccgtgggctggggcaggaaggagacccagttccacggcagcgagggccggcaggccgccttccagatgcagatgcatgaaagtgccctgccctgggatgaccaccggccccaggtgacctggagaggagatggccagttctttgctgtgtctgtggtgtgcccagagaccggggccaggaaggtgcgggtgtggaaccgggagtttgccctgcagagcaccagcgagcctgtggccggcctgggccctgccctggcctggaagcccagcggcagcctgattgccagcacccaggacaagcccaaccagcaggacatcgtgttctttgagaagaatggcctgctgcacggccacttcaccctgcccttcctgaaggatgaggtgaaggtgaatgacctgctgtggaatgctgacagctctgtgctggccgtgtggctggaggacctgcagcgggaggagagcagcatccccaagacctgtgtgcagctgtggacagtgggcaactaccactggtacctgaagcagagcctgtccttcagcacctgtgggaagagcaagatcgtgtccctgatgtgggaccctgtgaccccctaccgcctgcacgtgctgtgccagggctggcactacctggcctatgactggcactggaccacagacagatctgtgggggacaacagcagtgacctgagcaatgtggccgtgattgatggcaacagagtgctggtgaccgtcttccggcagacagtggtgcccccacccatgtgcacctaccagctgctcttcccccaccctgtgaaccaggtgaccttcctggcccacccccagaagagcaatgacctggccgtgctggatgccagcaaccagatctctgtgtacaagtgtggggactgccccagcgctgaccccaccgtgaagctgggcgctgtgggcggcagcggcttcaaggtgtgcctgcggaccccccacctggagaagcgctacaagatccagtttgaaaataatgaagaccaggatgtgaaccccctgaagctgggcctgctgacctggattgaagaagatgtgttcctggccgtgagccacagcgagttcagccccaggagcgtcatccaccacctgacagctgccagcagcgagatggatgaggagcacggccagctgaatgtgagcagcagcgctgctgtggatggagtcatcatcagcctgtgctgcaacagcaagaccaagtctgtggtgctgcagctggctgatggccagatcttcaagtacctgtgggagagccccagcctggccatcaagccctggaagaacagcggcggcttccctgtgcgcttcccctacccctgcacccagacagagctggccatgattggagaggaggagtgtgtgctgggcctgacagaccgctgccgcttcttcatcaatgacatcgaggtggccagcaacatcaccagctttgctgtgtatgatgagttcctgctgctgaccacccacagccacacctgccagtgcttctgcctgagagatgccagcttcaagaccctgcaggccggcctgagcagcaaccacgtgagccacggggaggtgctgaggaaggtggagcggggcagcagaattgtgacagtggtgccccaggacaccaagctggtgctgcagatgccccggggcaacctggaggtggtgcaccaccgggccctggtgctggcccagatcaggaagtggctggacaagctgatgttcaaggaggcctttgagtgcatgaggaagctgcgcatcaacctgaacctgatctatgaccacaaccccaaggtgttcctgggcaatgtggagaccttcatcaagcagattgacagcgtgaaccacatcaacctcttcttcacagagctgaaggaggaggatgtgaccaagaccatgtacccagcccctgtgaccagctctgtgtacctgagccgggaccctgatggcaacaagattgacctggtgtgtgatgccatgagagctgtgatggagagcatcaacccccacaagtactgcctgagcatcctgaccagccacgtgaagaagaccaccccagagctggagatcgtgctgcagaaggtgcatgagctgcagggcaatgcccccagcgaccctgatgctgtgtctgctgaggaggccctgaagtacctgctgcacctggtggatgtgaatgagctgtatgaccacagcctgggcacctatgactttgacctggtgctgatggtggccgagaagagccagaaggaccccaaggagtacctgcccttcctgaacaccctgaagaagatggagaccaactaccagcgcttcaccatcgacaagtacctgaagagatatgagaaggccatcggccacctgagcaaatgtggccctgagtacttccctgagtgcctgaacctgatcaaggacaagaacctgtacaatgaggccctgaagctgtacagccccagcagccagcagtaccaggacatcagcatcgcctacggggagcacctgatgcaggagcacatgtatgagcctgctggcctgatgtttgcccgctgtggggcccacgagaaggccctgagcgccttcctgacctgtggcaactggaagcaggccctgtgtgtggccgcccagctgaacttcaccaaggaccagctggtgggcctgggccgcaccctggccggcaagctggtggagcagaggaagcacattgatgctgccatggtgctggaggagtgtgcccaggactatgaggaggccgtgctgctgctgctggagggcgccgcctgggaggaggccctgcggctggtgtacaagtacaaccggctggacatcatcgagaccaacgtgaagcccagcatcctggaggcccagaagaactacatggccttcctggacagccagacagccaccttcagccgccacaagaagaggctgctggtggtgcgggagctgaaggagcaggcccagcaggccggcctggatgatgaggtgccccacggccaggagagtgacctcttcagcgagaccagctctgtggtgtctggcagcgagatgtctgggaagtacagccacagcaacagccgcatcagcgcccggagcagcaagaacagaaggaaggccgagaggaagaagcacagcctgaaggagggcagccccctggaggacctggccctgctggaggccctgtctgaggtggtgcagaacacagagaacctgaaggatgaggtgtaccacatcctgaaggtgctcttcctgtttgaatttgatgagcagggccgggagctgcagaaggcctttgaggacaccctgcagctgatggagaggagcctgcctgagatctggaccctgacctaccagcagaacagcgccacccctgtgctgggccccaacagcacagccaacagcatcatggccagctaccagcagcagaagacctctgtgcctgtgctggatgctgagctgttcatcccccccaagatcaacagaaggacccagtggaagctgagcctgctggactag

SEQ ID NO: 155963 - DNA, 2952 bp, Artificial Sequence
  Description of Artificial Sequence: Synthetic coding sequence
atgtgggaccctgtgaccccctaccgcctgcacgtgctgtgccagggctggcactacctggcctatgactggcactggaccacagacagatctgtgggggacaacagcagtgacctgagcaatgtggccgtgattgatggcaacagagtgctggtgacagtgttccggcagacagtggtgcccccacccatgtgcacctaccagctgctcttcccccaccctgtgaaccaggtgaccttcctggcccacccccagaagagcaatgacctggccgtgctggatgccagcaaccagatctctgtgtacaagtgtggggactgccccagcgctgaccccaccgtgaagctgggcgctgtgggcggcagcggcttcaaggtgtgcctgcggaccccccacctggagaagcgctacaagatccagtttgagaacaatgaagaccaggatgtgaaccccctgaagctgggcctgctgacctggattgaggaggatgtgttcctggccgtgagccacagcgagttcagccccaggagcgtcatccaccacctgacagctgccagcagcgagatggatgaggagcacggccagctgaatgtgagcagcagcgctgctgtggatggagtcatcatcagcctgtgctgcaacagcaagaccaagtctgtggtgctgcagctggctgatggccagatcttcaagtacctgtgggagagccccagcctggccatcaagccctggaagaacagcggcggcttccctgtgcgcttcccctacccctgcacccagacagagctggccatgattggagaggaggagtgtgtgctgggcctgacagaccgctgccgcttcttcatcaatgacatcgaggtggccagcaacatcaccagctttgctgtgtatgatgagttcctgctgctgaccacccacagccacacctgccagtgcttctgcctgagagatgccagcttcaagaccctgcaggccggcctgagcagcaaccacgtgtcccatggagaggtgctgaggaaggtggagcggggcagccgcatcgtgacagtggtgccccaggacaccaagctggtgctgcagatgccccggggcaacctggaggtggtgcaccaccgggccctggtgctggcccagatcaggaagtggctggacaagctgatgttcaaggaggcctttgagtgcatgaggaagctgcgcatcaacctgaacctgatctatgaccacaaccccaaggtgttcctgggcaatgtggagaccttcatcaagcagattgattctgtgaaccacatcaacctcttcttcacagagctgaaggaggaggatgtgaccaagaccatgtacccagcccctgtgaccagctctgtgtacctgagccgggaccctgatggcaacaagattgacctggtgtgtgatgccatgagagctgtgatggagagcatcaacccccacaagtactgcctgagcatcctgaccagccacgtgaagaagaccaccccagagctggagatcgtgctgcagaaggtgcatgagctgcagggcaatgcccccagcgaccctgatgctgtgtctgctgaggaggccctgaagtacctgctgcacctggtggatgtgaatgagctgtatgaccacagcctgggcacctatgactttgacctggtgctgatggtggccgagaagagccagaaggaccccaaggagtacctgcccttcctgaacaccctgaagaagatggagaccaactaccagcgcttcaccatcgacaagtacctgaagagatatgagaaggccatcggccacctgagcaaatgtggccctgagtacttcccagaatgtctgaacctgatcaaggacaagaacctgtacaatgaggccctgaagctgtacagccccagcagccagcagtaccaggacatcagcatcgcctatggagagcacctgatgcaggagcacatgtatgagcccgccggcctgatgtttgcccgctgtggggcccacgagaaggccctgagcgccttcctgacctgtggcaactggaagcaggccctgtgtgtggccgcccagctgaacttcaccaaggaccagctggtgggcctgggccgcaccctggccggcaagctggtggagcagaggaagcacattgatgctgccatggtgctggaggagtgtgcccaggactatgaggaggccgtgctgctgctgctggagggcgccgcctgggaggaggccctgcggctggtgtacaagtacaaccggctggacatcatcgagaccaacgtgaagcccagcatcctggaggcccagaagaactacatggccttcctggacagccagacagccaccttcagccgccacaagaagaggctgctggtggtgcgggagctgaaggagcaggcccagcaggccggcctggatgatgaggtgccccacggccaggagagtgacctcttcagcgagaccagctctgtggtgtctggcagcgagatgtctgggaagtacagccacagcaacagccgcatcagcgcccggagcagcaagaacagaaggaaggccgagaggaagaagcacagcctgaaggagggcagccccctggaggacctggccctgctggaggccctgtctgaggtggtgcagaacacagagaacctgaaggatgaggtgtaccacatcctgaaggtgctcttcctgtttgaatttgatgagcagggccgggagctgcagaaggcctttgaggacaccctgcagctgatggagaggagcctgcctgagatctggaccctgacctaccagcagaacagcgccacccctgtgctgggccccaacagcacagccaacagcatcatggccagctaccagcagcagaagacctctgtgcctgtgctggatgctgagctgttcatcccccccaagatcaacagaaggacccagtggaagctgagcctgctggactag

SEQ ID NO: 155964 - DNA, 2151 bp, Artificial Sequence
  Description of Artificial Sequence: Synthetic coding sequence
atgcagagcacagccaactacctgtggcacacagatgacctgctgggccagggcgccacagcctctgtgtacaaggccaggaacaagaagtctggagagctggtggccgtgaaggtgttcaacaccaccagctacctgcggccccgggaggtgcaggtgcgggagtttgaggtgctgaggaagctgaaccaccagaacatcgtgaagctgtttgctgtggaggagaccggcggcagccggcagaaggtgctggtgatggagtactgcagcagcggcagcctgctgtctgtgctggagagcccagaaaatgccttcggcctgcctgaagatgagttcctggtggtgctgcgctgtgtggtggccggcatgaaccacctgcgggagaatggaattgtgcaccgggacatcaagccaggcaacatcatgaggctggtgggggaggagggccagagcatctacaagctgacagactttggagctgcccgggagctggatgatgatgagaagtttgtgtctgtgtatggaacagaggagtacctgcacccagacatgtatgaaagagctgtgctgaggaagccccagcagaaggccttcggcgtgacagtggacctgtggagcattggagtgaccctgtaccacgccgccaccggcagcctgcccttcatcccctttggaggccccaggaggaacaaggagatcatgtaccgcatcaccacagagaagccagctggggccatcgccggggcccagaggagagaaaatggccccctggagtggagctacaccctgcccatcacctgccagctgagcctgggcctgcagagccagctggtgcccatcctggccaacatcctggaggtggagcaggccaagtgctggggctttgaccagttctttgctgagaccagtgacatcctgcagagggtggtggtgcacgtgttcagcctgagccaggccgtgctgcaccacatctacatccacgcccacaacaccatcgccatcttccaggaggccgtgcacaagcagacctctgtggcccccaggcaccaggagtacctgtttgagggccacctgtgtgtgctggagcccagcgtgtctgcccagcacatcgcccacaccacagccagcagccccctgaccctcttcagcacagccatccccaagggcctggccttccgggaccctgccctggatgtgcccaagtttgtgcccaaggtggacctgcaggccgactacaacacagccaagggcgtgctgggcgccggctaccaggccctgcggctggcccgggccctgctggatggccaggagctgatgttccggggcctgcactgggtgatggaggtgctgcaggccacctgcaggaggaccctggaggtggcccggaccagcctgctgtacctgagcagcagcctgggcacagagcgcttcagctctgtggccggcaccccagagatccaggagctgaaggctgctgctgagctgcggagccggctgcggaccctggccgaggtgctgagccgctgcagccagaacatcacagagacccaggagagcctgagcagcctgaaccgggagctggtgaagagccgggaccaggtgcatgaggacaggagcatccagcagatccagtgctgcctggacaagatgaacttcatctacaagcagttcaagaagagcaggatgaggcctggcctgggctacaatgaggagcagatccacaagctggacaaggtgaacttcagccacctggccaagaggctgctgcaggtgttccaggaggagtgtgtgcagaagtaccaggccagcctggtgacccacggcaagaggatgagggtggtgcatgagaccaggaaccacctgcggctggtgggctgcagcgtggccgcctgcaacacagaggcccagggcgtgcaggagagcctgagcaagctgctggaggagctgagccaccagctgctgcaggaccgggccaagggggcccaggccagccccccacccatcgccccctaccccagccccaccaggaaggacctgctgctgcacatgcaggagctgtgtgagggcatgaagctgctggccagtgacctgctggacaacaaccgcatcatcgagcggctgaacagagtgcctgcccccccagatgtgtag

SEQ ID NO: 155965 - DNA, 1896 bp, Artificial Sequence
  Description of Artificial Sequence: Synthetic coding sequence
atggagtactgcagcagcggcagcctgctgtctgtgctggagagcccagaaaatgccttcggcctgcctgaagatgagttcctggtggtgctgcgctgtgtggtggccggcatgaaccacctgagagaaaatggcatcgtgcaccgggacatcaagccaggcaacatcatgaggctggtgggggaggagggccagagcatctacaagctgacagactttggagctgcccgggagctggatgatgatgagaagtttgtgtctgtgtatggaacagaggagtacctgcacccagacatgtatgaaagagctgtgctgaggaagccccagcagaaggcctttggagtgacagtggacctgtggagcattggagtgaccctgtaccacgccgccaccggcagcctgcccttcatcccctttggaggccccaggaggaacaaggagatcatgtaccgcatcaccacagagaagccagctggggccatcgccggggcccagaggcgggagaatggccccctggagtggagctacaccctgcccatcacctgccagctgagcctgggcctgcagagccagctggtgcccatcctggccaacatcctggaggtggagcaggccaagtgctggggctttgaccagttctttgctgagaccagtgacatcctgcagagggtggtggtgcacgtgttcagcctgagccaggccgtgctgcaccacatctacatccacgcccacaacaccatcgccatcttccaggaggccgtgcacaagcagacctctgtggcccccaggcaccaggagtacctgtttgagggccacctgtgtgtgctggagcccagcgtgtctgcccagcacatcgcccacaccacagccagcagccccctgaccctcttcagcacagccatccccaagggcctggccttccgggaccctgccctggatgtgcccaagtttgtgcccaaggtggacctgcaggccgactacaacacagccaagggcgtgctgggcgccggctaccaggccctgcggctggcccgggccctgctggatggccaggagctgatgttccggggcctgcactgggtgatggaggtgctgcaggccacctgcaggaggaccctggaggtggcccggaccagcctgctgtacctgagcagcagcctgggcacagagcgcttcagctctgtggccggcaccccagagatccaggagctgaaggctgctgctgagctgcggagccggctgcggaccctggccgaggtgctgagccgctgcagccagaacatcacagagacccaggagagcctgagcagcctgaaccgggagctggtgaagagccgggaccaggtgcatgaagatagaagcatccagcagatccagtgctgcctggacaagatgaacttcatctacaagcagttcaagaagagcaggatgaggcctggcctgggctacaatgaggagcagatccacaagctggacaaggtgaacttcagccacctggccaagaggctgctgcaggtgttccaggaggagtgtgtgcagaagtaccaggccagcctggtgacccacggcaagaggatgagggtggtgcatgagaccaggaaccacctgcggctggtgggctgcagcgtggccgcctgcaacacagaggcccagggcgtgcaggagagcctgagcaagctgctggaggagctgagccaccagctgctgcaggaccgggccaagggggcccaggccagccccccacccatcgccccctaccccagccccaccaggaaggacctgctgctgcacatgcaggagctgtgtgagggcatgaagctgctggccagtgacctgctggacaacaaccgcatcatcgagcggctgaacagagtgcctgcccccccagatgtgtag

SEQ ID NO: 155966 - DNA, 1107 bp, Artificial Sequence
  Description of Artificial Sequence: Synthetic coding sequence
atgaacagacacctgtggaagagccagctgtgtgagatggtgcagcccagcggcggccctgctgctgaccaggatgtgctgggggaggagagccccctgggcaagccagccatgctgcacctgcccagcgagcagggcgcccctgagaccctgcagcgctgcctggaggagaaccaggagctgagagatgccatccggcagagcaaccagatcctgcgggagcgctgtgaggagctgctgcacttccaggccagccagcgggaggagaaggagttcctgatgtgcaagttccaggaggccaggaagctggtggagcggctgggcctggagaagctggacctgaagaggcagaaggagcaggccctgcgggaggtggagcacctgaagcgctgccagcagcagatggccgaggacaaggcctctgtgaaggcccaggtgaccagcctgctgggggagctgcaggagagccagagccggctggaggccgccaccaaggagtgccaggccctggagggccgcaggaagctggcccagctgcaggtggcctaccaccagctgttccaggagtatgacaaccacatcaagagctctgtggtgggcagcgagaggaagaggggcatgcagctggaggacctgaagcagcagctgcagcaggccgaggaggccctggtggccaagcaggaggtgattgacaagctgaaggaggaggccgagcagcacaagatcgtgatggagaccgtgcctgtgctgaaggcccaggccgacatctacaaggctgacttccaggccgagcggcaggcccgggagaagctggccgagaagaaggagctgctgcaggagcagctggagcagctgcagcgggagtacagcaagctgaaggccagctgccaggagagcgccagaattgaggacatgaggaagagacatgtggaggtgtcccaggcccccctgcccccagccccagcctacctgagcagccccctggccctgcccagccagaggaggagccccccagaggagcccccagacttctgctgccccaagtgccagtaccaggccccagacatggacaccctgcagatccacgtgatggagtgcattgaatag

SEQ ID NO: 155967 - DNA, 1260 bp, Artificial Sequence
  Description of Artificial Sequence: Synthetic coding sequence
atgaacagacacctgtggaagagccagctgtgtgagatggtgcagcccagcggcggccctgctgctgaccaggatgtgctgggggaggagagccccctgggcaagccagccatgctgcacctgcccagcgagcagggcgcccctgagaccctgcagcgctgcctggaggagaaccaggagctgagagatgccatccggcagagcaaccagatcctgcgggagcgctgtgaggagctgctgcacttccaggccagccagcgggaggagaaggagttcctgatgtgcaagttccaggaggccaggaagctggtggagcggctgggcctggagaagctggacctgaagaggcagaaggagcaggccctgcgggaggtggagcacctgaagcgctgccagcagcagatggccgaggacaaggcctctgtgaaggcccaggtgaccagcctgctgggggagctgcaggagagccagagccggctggaggccgccaccaaggagtgccaggccctggagggccgggcccgggccgccagcgagcaggcccggcagctggagagcgagcgggaggccctgcagcagcagcacagcgtgcaggtggaccagctgaggatgcagggccagagcgtggaggccgccctgaggatggagcggcaggccgccagcgaggagaagaggaagctggcccagctgcaggtggcctaccaccagctgttccaggagtatgacaaccacatcaagagctctgtggtgggcagcgagaggaagaggggcatgcagctggaggacctgaagcagcagctgcagcaggccgaggaggccctggtggccaagcaggaggtgattgacaagctgaaggaggaggccgagcagcacaagatcgtgatggagaccgtgcctgtgctgaaggcccaggccgacatctacaaggctgacttccaggccgagcggcaggcccgggagaagctggccgagaagaaggagctgctgcaggagcagctggagcagctgcagcgggagtacagcaagctgaaggccagctgccaggagagcgccagaattgaggacatgaggaagagacatgtggaggtgtcccaggcccccctgcccccagccccagcctacctgagcagccccctggccctgcccagccagaggaggagccccccagaggagcccccagacttctgctgccccaagtgccagtaccaggccccagacatggacaccctgcagatccacgtgatggagtgcatcgagtag

SEQ ID NO: 155968 - DNA, 1260 bp, Artificial Sequence; identical to SEQ ID NO: 155967
  Description of Artificial Sequence: Synthetic coding sequence

SEQ ID NO: 155969 - DNA, 1260 bp, Artificial Sequence; identical to SEQ ID NO: 155967
  Description of Artificial Sequence: Synthetic coding sequence

SEQ ID NO: 155970 - DNA, 1464 bp, Artificial Sequence
  Description of Artificial Sequence: Synthetic coding sequence
atggccctggtgatccaggtgggcaagctgcggccccgggaggtgaggaccccccagaccatcaaccccagcctcttccccagcctgcctgtgaagctgagcagcatcatcgaggtgcccagcggcggggagcgctgctgcagcaggaggaccctggtgtacaaggcccgggccttctggaagggggcccccctgccctgctggatgaacagacacctgtggaagagccagctgtgtgagatggtgcagcccagcggcggccctgctgctgaccaggatgtgctgggggaggagagccccctgggcaagccagccatgctgcacctgcccagcgagcagggcgcccctgagaccctgcagcgctgcctggaggagaaccaggagctgagagatgccatccggcagagcaaccagatcctgcgggagcgctgtgaggagctgctgcacttccaggccagccagcgggaggagaaggagttcctgatgtgcaagttccaggaggccaggaagctggtggagcggctgggcctggagaagctggacctgaagaggcagaaggagcaggccctgcgggaggtggagcacctgaagcgctgccagcagcagatggccgaggacaaggcctctgtgaaggcccaggtgaccagcctgctgggggagctgcaggagagccagagccggctggaggccgccaccaaggagtgccaggccctggagggccgggcccgggccgccagcgagcaggcccggcagctggagagcgagcgggaggccctgcagcagcagcacagcgtgcaggtggaccagctgaggatgcagggccagagcgtggaggccgccctgaggatggagcggcaggccgccagcgaggagaagaggaagctggcccagctgcaggtggcctaccaccagctgttccaggagtatgacaaccacatcaagagctctgtggtgggcagcgagaggaagaggggcatgcagctggaggacctgaagcagcagctgcagcaggccgaggaggccctggtggccaagcaggaggtgattgacaagctgaaggaggaggccgagcagcacaagatcgtgatggagaccgtgcctgtgctgaaggcccaggccgacatctacaaggctgacttccaggccgagcggcaggcccgggagaagctggccgagaagaaggagctgctgcaggagcagctggagcagctgcagcgggagtacagcaagctgaaggccagctgccaggagagcgccagaattgaggacatgaggaagagacatgtggaggtgtcccaggcccccctgcccccagccccagcctacctgagcagccccctggccctgcccagccagaggaggagccccccagaggagcccccagacttctgctgccccaagtgccagtaccaggccccagacatggacaccctgcagatccacgtgatggagtgcatcgagtag

SEQ ID NO: 155971 - DNA, 621 bp, Artificial Sequence
  Description of Artificial Sequence: Synthetic coding sequence
atgaacagacacctgtggaagagccagctgtgtgagatggtgcagcccagcggcggccctgctgctgaccaggatgtgctgggggaggagagccccctgggcaagccagccatgctgcacctgcccagcgagcagggcgcccctgagaccctgcagcgctgcctggaggagaaccaggagctgagagatgccatccggcagagcaaccagatcctgcgggagcgctgtgaggagctgctgcacttccaggccagccagcgggaggagaaggagttcctgatgtgcaagttccaggaggccaggaagctggtggagcggctgggcctggagaagctggacctgaagaggcagaaggagcaggccctgcgggaggtggagcacctgaagcgctgccagcagcagatggccgaggacaaggcctctgtgaaggcccaggtgaccagcctgctgggggagctgcaggagagccagagccggctggaggccgccaccaaggagtgccaggccctggagggccgggcccgggccgccagcgagcaggcccggcagctggagagcgagcgggaggccctgcagcagcagcacagcgtgcaggtggaccagctgaggatgcagggctag

SEQ ID NO: 155972 - DNA, 756 bp, Artificial Sequence
  Description of Artificial Sequence: Synthetic coding sequence
atgaacagacacctgtggaagagccagctgtgtgagatggtgcagcccagcggcggccctgctgctgaccaggatgtgctgggggaggagagccccctgggcaagccagccatgctgcacctgcccagcgagcagggcgcccctgagaccctgcagcgctgcctggaggagaaccaggagctgagagatgccatccggcagagcaaccagatcctgcgggagcgctgtgaggagctgctgcacttccaggccagccagcgggaggagaaggagttcctgatgtgcaagttccaggaggccaggaagctggtggagcggctgggcctggagaagctggacctgaagaggcagaaggagcaggccctgcgggaggtggagcacctgaagcgctgccagcagcagatggccgaggacaaggcctctgtgaaggcccaggtgaccagcctgctgggggagctgcaggagagccagagccggctggaggccgccaccaaggagtgccaggccctggagggccgggcccgggccgccagcgagcaggcccggcagctggagagcgagcgggaggccctgcagcagcagcacagcgtgcaggtggaccagctgaggatgcagggccagagcgtggaggccgccctgaggatggagcggcaggccgccagcgaggagaagaggaagctggcccagctgcaggtggcctaccaccagctgttccaggagtatgacaaccacatcaagagctctgtggtgggctag

SEQ ID NO: 155973 - DNA, 417 bp, Artificial Sequence
  Description of Artificial Sequence: Synthetic coding sequence
atgaacagacacctgtggaagagccagctgtgtgagatggtgcagcccagcggcggccctgctgctgaccaggatgtgctgggggaggagagccccctgggcaagccagccatgctgcacctgcccagcgagcagggcgcccctgagaccctgcagcgctgcctggaggagaaccaggagctgagagatgccatccggcagagcaaccagatcctgcgggagcgctgtgaggagctgctgcacttccaggccagccagcgggaggagaaggagttcctgatgtgcaagttccaggaggccaggaagctggtggagcggctgggcctggagaagctggacctgaagaggcagaaggagcaggccctgcgggaggtggagcacctgaagcgctgccagcagcagatggctgaagattag

SEQ ID NO: 155974 - DNA, 1257 bp, Artificial Sequence
  Description of Artificial Sequence: Synthetic coding sequence
atgaacagacacctgtggaagagccagctgtgtgagatggtgcagcccagcggcggccctgctgctgaccaggatgtgctgggggaggagagccccctgggcaagccagccatgctgcacctgcccagcgagcagggcgcccctgagaccctgcagcgctgcctggaggagaaccaggagctgagagatgccatccggcagagcaaccagatcctgcgggagcgctgtgaggagctgctgcacttccaggccagccagcgggaggagaaggagttcctgatgtgcaagttccaggaggccaggaagctggtggagcggctgggcctggagaagctggacctgaagaggcagaaggagcaggccctgcgggaggtggagcacctgaagcgctgccagcagatggccgaggacaaggcctctgtgaaggcccaggtgaccagcctgctgggggagctgcaggagagccagagccggctggaggccgccaccaaggagtgccaggccctggagggccgggcccgggccgccagcgagcaggcccggcagctggagagcgagcgggaggccctgcagcagcagcacagcgtgcaggtggaccagctgaggatgcagggccagagcgtggaggccgccctgaggatggagcggcaggccgccagcgaggagaagaggaagctggcccagctgcaggtggcctaccaccagctgttccaggagtatgacaaccacatcaagagctctgtggtgggcagcgagaggaagaggggcatgcagctggaggacctgaagcagcagctgcagcaggccgaggaggccctggtggccaagcaggaggtgattgacaagctgaaggaggaggccgagcagcacaagatcgtgatggagaccgtgcctgtgctgaaggcccaggccgacatctacaaggctgacttccaggccgagcggcaggcccgggagaagctggccgagaagaaggagctgctgcaggagcagctggagcagctgcagcgggagtacagcaagctgaaggccagctgccaggagagcgccagaattgaggacatgaggaagagacatgtggaggtgtcccaggcccccctgcccccagccccagcctacctgagcagccccctggccctgcccagccagaggaggagccccccagaggagcccccagacttctgctgccccaagtgccagtaccaggccccagacatggacaccctgcagatccacgtgatggagtgcattgaatag

SEQ ID NO: 155975 - DNA, 2181 bp, Artificial Sequence
  Description of Artificial Sequence: Synthetic coding sequence
atgctgcgggcctgccagctgagcggcgtgacagctgctgcccagagctgcctgtgtgggaagtttgtgctgcggcccctgcggccctgccgccgctacagcaccagcggcagcagcggcctgaccaccgggaagattgctggagctggcctgctgtttgtgggcggcggcatcggcggcaccatcctgtatgccaagtgggacagccacttccgggagagcgtggagaagaccatcccctacagcgacaagctgtttgagatggtgctgggccctgctgcctacaacgtgcccctgcccaagaagagcatccagagcggccccctgaagatcagctctgtgtctgaggtgatgaaggagagcaagcagcctgccagccagctgcagaagcagaagggggacaccccagccagcgccacagcccccacagaagctgcccagatcatctctgctgctggggacaccctgtctgtgcctgccccagctgtgcagcctgaggagagcctgaagacagaccaccctgagatcggggagggcaagcccaccccagccctgagcgccctggccaagagcctggaggatgccctgcggcagacagcctctgtgaccctgcaggccatcgccgcccagaatgctgctgtgcaggccgtgaatgcccacagcaacatcctgaaggccgccatggacaacagcgagattgctggggagaagaagagcgcccagtggaggacagtggagggcgccctgaaggagaggaggaaggctgtggatgaagctgctgatgccctgctgaaggccaaggaggagctggagaagatgaagtctgtgattgaaaatgccaagaagaaggaggtggccggggccaagccccacatcacagctgctgagggcaagctgcacaacatgattgtggacctggacaacgtggtgaagaaggtgcaggccgcccagagcgaggccaaggtggtgtcccagtaccacgagctggtggtgcaggccagagatgacttcaagcgggagctggacagcatcaccccagaggtgctgcccggctggaagggcatgtctgagtacaacctggccgacaagctgagcacagatgacctgaacagcctgattgcccacgcccacagaagaattgaccagctgaaccgggagctggccgagcagaaggccacagagaagcagcacatcaccctggccctggagaagcagaagctggaggagaagagggcctttgattctgctgtggccaaggccctggagcaccacaggtctgagatccaggccgagcaggacaggaagattgaggaggtgagagatgccatggagaatgagatgaggacccagctgcggcggcaggccgccgcccacacagaccacctgagagatgtgctgcgggtgcaggagcaggagctgaagtcagaatttgagcagaacctgtctgagaagctgtctgagcaggagctgcagttccggcggctgagccaggagcaggtggacaacttcaccctggacatcaacacagcctatgcccggctgcggggcatcgagcaggccgtgcagagccatgctgtggccgaggaggaggccaggaaggcccaccagctgtggctgtctgtggaggccctgaagtacagcatgaagaccagcagcgctgagacccccaccatccccctgggcagcgctgtggaggccatcaaggccaactgcagcgacaatgagttcacccaggccctgacagctgccatccccccagagagcctgacccggggcgtgtacagcgaggagaccctgcgggcccgcttctatgctgtgcagaagctggccaggagagtggccatgattgatgagaccaggaacagcctgtaccagtacttcctgagctacctgcagagcctgctgctcttccccccccagcagctgaagcccccacctgagctgtgcccagaggacatcaacaccttcaagctgctgtcctatgccagctactgcatcgagcacggggacctggagctggccgccaagtttgtgaaccagctgaagggggagagccggcgggtggcccaggactggctgaaggaggccaggatgaccctggagaccaagcagatcgtggagatcctgacagcctatgccagcgctgtgggcatcggcaccacccaggtgcagcctgagtag

SEQ ID NO: 155976 - DNA, 1119 bp, Artificial Sequence
  Description of Artificial Sequence: Synthetic coding sequence
atgctgcgggcctgccagctgagcggcgtgacagctgctgcccagagctgcctgtgtgggaagtttgtgctgcggcccctgcggccctgccgccgctacagcaccagcggcagcagcggcctgaccaccgggaagattgctggagctggcctgctgtttgtgggcggcggcatcggcggcaccatcctgtatgccaagtgggacagccacttccgggagagcgtggagaagaccatcccctacagcgacaagctgtttgagatggtgctgggccctgctgcctacaacgtgcccctgcccaagaagagcatccagagcggccccctgaagatcagctctgtgtctgaggtgatgaaggagagcaagcagcctgccagccagctgcagaagcagaagggggacaccccagccagcgccacagctggggacaccctgtctgtgcctgccccagctgtgcagcctgaggagagcctgaagacagaccaccctgagattggagagggcaagcccaccccagccctgtctgaggccagcagcagcagcatccgggagcggcccccagaggaggtggccgcccggctggcccagcaggagaagcaggagcaggtgaagattgagagcctggccaagagcctggaggatgccctgcggcagacagcctctgtgaccctgcaggccatcgccgccatccccccagagagcctgacccggggcgtgtacagcgaggagaccctgcgggcccgcttctatgctgtgcagaagctggccaggagagtggccatgattgatgagaccaggaacagcctgtaccagtacttcctgagctacctgcagagcctgctgctcttccccccccagcagctgaagcccccacctgagctgtgcccagaggacatcaacaccttcaagctgctgtcctatgccagctactgcatcgagcacggggacctggagctggccgccaagtttgtgaaccagctgaagggggagagccggcgggtggcccaggactggctgaaggaggccaggatgaccctggagaccaagcagatcgtggagatcctgacagcctatgccagcgctgtgggcatcggcaccacccaggtgcagcctgagtag

SEQ ID NO: 155977 - DNA, 1980 bp, Artificial Sequence
  Description of Artificial Sequence: Synthetic coding sequence
atgctgcgggcctgccagctgagcggcgtgacagctgctgcccagagctgcctgtgtgggaagtttgtgctgcggcccctgcggccctgccgccgctacagcaccagcggcagcagcggcctgaccaccgggaagattgctggagctggcctgctgtttgtgggcggcggcatcggcggcaccatcctgtatgccaagtgggacagccacttccgggagagcgtggagaagaccatcccctacagcgacaagctgtttgagatggtgctgggccctgctgcctacaacgtgcccctgcccaagaagagcatccagagcggccccctgaagatcagctctgtgtctgaggtgatgaaggagagcaagcagcctgccagccagctgcagaagcagaagggggacaccccagccagcgccacagccctggccaagagcctggaggatgccctgcggcagacagcctctgtgaccctgcaggccatcgccgcccagaatgctgctgtgcaggccgtgaatgcccacagcaacatcctgaaggccgccatggacaacagcgagattgctggggagaagaagagcgcccagtggaggacagtggagggcgccctgaaggagaggaggaaggctgtggatgaagctgctgatgccctgctgaaggccaaggaggagctggagaagatgaagtctgtgattgaaaatgccaagaagaaggaggtggccggggccaagccccacatcacagctgctgagggcaagctgcacaacatgattgtggacctggacaacgtggtgcaggccagagatgacttcaagcgggagctggacagcatcaccccagaggtgctgcccggctggaagggcatgtctgtgtctgacctggccgacaagctgagcacagatgacctgaacagcctcatcgcccacgcccacagaagaattgaccagctgaaccgggagctggccgagcagaaggccacagagaagcagcacatcaccctggccctggagaagcagaagctggaggagaagagggcctttgacagcgctgtggccaaggccctggagcaccacaggtctgagatccaggccgagcaggacaggaagattgaggaggtgagagatgccatggagaatgagatgaggacccagctgcggcggcaggccgccgcccacacagaccacctgagagatgtgctgcgggtgcaggagcaggagctgaagtcagaatttgagcagaacctgtctgagaagctgtctgagcaggagctgcagttccggcggctgagccaggagcaggtggacaacttcaccctggacatcaacacagcctatgcccggctgcggggcatcgagcaggccgtgcagagccatgctgtggccgaggaggaggccaggaaggcccaccagctgtggctgtctgtggaggccctgaagtacagcatgaagaccagcagcgctgagacccccaccatccccctgggcagcgctgtggaggccatcaaggccaactgcagcgacaatgagttcacccaggccctgacagctgccatccccccagagagcctgacccggggcgtgtacagcgaggagaccctgcgggcccgcttctatgctgtgcagaagctggcccggcgggtggccatgattgatgagaccaggaacagcctgtaccagtacttcctgagctacctgcagagcctgctgctcttccccccccagcagctgaagcccccacctgagctgtgcccagaggacatcaacaccttcaagctgctgtcctatgccagctactgcattgaacatggagacctggagctggccgccaagtttgtgaaccagctgaagggggagagcagaagagtggcccaggactggctgaaggaggccaggatgaccctggagaccaagcagatcgtggagatcctgacagcctatgccagcgctgtgggcatcggcaccacccaggtgcagcctgagtag

SEQ ID NO: 155978 - DNA, 2277 bp, Artificial Sequence
  Description of Artificial Sequence: Synthetic coding sequence
atgctgcgggcctgccagctgagcggcgtgacagctgctgcccagagctgcctgtgtgggaagtttgtgctgcggcccctgcggccctgccgccgctacagcaccagcggcagcagcggcctgaccaccgggaagattgctggagctggcctgctgtttgtgggcggcggcatcggcggcaccatcctgtatgccaagtgggacagccacttccgggagagcgtggagaagaccatcccctacagcgacaagctgtttgagatggtgctgggccctgctgcctacaacgtgcccctgcccaagaagagcatccagagcggccccctgaagatcagctctgtgtctgaggtgatgaaggagagcaagcagcctgccagccagctgcagaagcagaagggggacaccccagccagcgccacagcccccacagaagctgcccagatcatctctgctgctggggacaccctgtctgtgcctgccccagctgtgcagcctgaggagagcctgaagacagaccaccctgagatcggggagggcaagcccaccccagccctgtctgaggaggccagcagcagcagcatccgggagcggcccccagaggaggtggccgcccggctggcccagcaggagaagcaggagcaggtgaagattgagagcctggccaagagcctggaggatgccctgcggcagacagcctctgtgaccctgcaggccatcgccgcccagaatgctgctgtgcaggccgtgaatgcccacagcaacatcctgaaggccgccatggacaacagcgagattgctggggagaagaagagcgcccagtggaggacagtggagggcgccctgaaggagaggaggaaggctgtggatgaagctgctgatgccctgctgaaggccaaggaggagctggagaagatgaagtctgtgattgaaaatgccaagaagaaggaggtggccggggccaagccccacatcacagctgctgagggcaagctgcacaacatgattgtggacctggacaacgtggtgaagaaggtgcaggccgcccagagcgaggccaaggtggtgtcccagtaccacgagctggtggtgcaggccagagatgacttcaagcgggagctggacagcatcaccccagaggtgctgcccggctggaagggcatgtctgtgtctgacctggccgacaagctgagcacagatgacctgaacagcctgattgcccacgcccacagaagaattgaccagctgaaccgggagctggccgagcagaaggccacagagaagcagcacatcaccctggccctggagaagcagaagctggaggagaagagggcctttgattctgctgtggccaaggccctggagcaccacaggtctgagatccaggccgagcaggacaggaagattgaggaggtgagagatgccatggagaatgagatgaggacccagctgcggcggcaggccgccgcccacacagaccacctgagagatgtgctgcgggtgcaggagcaggagctgaagtcagaatttgagcagaacctgtctgagaagctgtctgagcaggagctgcagttccggcggctgagccaggagcaggtggacaacttcaccctggacatcaacacagcctatgcccggctgcggggcatcgagcaggccgtgcagagccatgctgtggccgaggaggaggccaggaaggcccaccagctgtggctgtctgtggaggccctgaagtacagcatgaagaccagcagcgctgagacccccaccatccccctgggcagcgctgtggaggccatcaaggccaactgcagcgacaatgagttcacccaggccctgacagctgccatccccccagagagcctgacccggggcgtgtacagcgaggagaccctgcgggcccgcttctatgctgtgcagaagctggccaggagagtggccatgattgatgagaccaggaacagcctgtaccagtacttcctgagctacctgcagagcctgctgctcttccccccccagcagctgaagcccccacctgagctgtgcccagaggacatcaacaccttcaagctgctgtcctatgccagctactgcatcgagcacggggacctggagctggccgccaagtttgtgaaccagctgaagggggagagccggcgggtggcccaggactggctgaaggaggccaggatgaccctggagaccaagcagatcgtggagatcctgacagcctatgccagcgctgtgggcatcggcaccacccaggtgcagcctgagtag

SEQ ID NO: 155979 - DNA, 2274 bp, Artificial Sequence
  Description of Artificial Sequence: Synthetic coding sequence
atgctgcgggcctgccagctgagcggcgtgacagctgctgcccagagctgcctgtgtgggaagtttgtgctgcggcccctgcggccctgccgccgctacagcaccagcggcagcagcggcctgaccaccgggaagattgctggagctggcctgctgtttgtgggcggcggcatcggcggcaccatcctgtatgccaagtgggacagccacttccgggagagcgtggagaagaccatcccctacagcgacaagctgtttgagatggtgctgggccctgctgcctacaacgtgcccctgcccaagaagagcatccagagcggccccctgaagatcagctctgtgtctgaggtgatgaaggagagcaagcagcctgccagccagctgcagaagcagaagggggacaccccagccagcgccacagcccccacagaagctgcccagatcatctctgctgctggggacaccctgtctgtgcctgccccagctgtgcagcctgaggagagcctgaagacagaccaccctgagatcggggagggcaagcccaccccagccctgtctgaggccagcagcagcagcatccgggagaggcctcctgaggaggtggccgcccggctggcccagcaggagaagcaggagcaggtgaagattgagagcctggccaagagcctggaggatgccctgcggcagacagcctctgtgaccctgcaggccatcgccgcccagaatgctgctgtgcaggccgtgaatgcccacagcaacatcctgaaggccgccatggacaacagcgagattgctggggagaagaagagcgcccagtggaggacagtggagggcgccctgaaggagaggaggaaggctgtggatgaggccgcagatgccctgctgaaggccaaggaggagctggagaagatgaagtctgtgattgaaaatgccaagaagaaggaggtggccggggccaagccccacatcacagctgctgagggcaagctgcacaacatgattgtggacctggacaacgtggtgaagaaggtgcaggccgcccagagcgaggccaaggtggtgtcccagtaccacgagctggtggtgcaggccagagatgacttcaagcgggagctggacagcatcaccccagaggtgctgcccggctggaagggcatgtctgtgtctgacctggccgacaagctgagcacagatgacctgaacagcctcatcgcccacgcccacagaagaattgaccagctgaaccgggagctggccgagcagaaggccacagagaagcagcacatcaccctggccctggagaagcagaagctggaggagaagagggcctttgacagcgctgtggccaaggccctggagcaccacaggtctgagatccaggccgagcaggacaggaagattgaggaggtgagagatgccatggagaatgagatgaggacccagctgcggcggcaggccgccgcccacacagaccacctgagagatgtgctgcgggtgcaggagcaggagctgaagtcagaatttgagcagaacctgtctgagaagctgtctgagcaggagctgcagttccggcggctgagccaggagcaggtggacaacttcaccctggacatcaacacagcctatgcccggctgcggggcatcgagcaggccgtgcagagccatgctgtggccgaggaggaggccaggaaggcccaccagctgtggctgtctgtggaggccctgaagtacagcatgaagaccagcagcgctgagacccccaccatccccctgggcagcgctgtggaggccatcaaggccaactgcagcgacaatgagttcacccaggccctgacagctgccatccccccagagagcctgacccggggcgtgtacagcgaggagaccctgcgggcccgcttctatgctgtgcagaagctggcccggcgggtggccatgattgatgagaccaggaacagcctgtaccagtacttcctgagctacctgcagagcctgctgctcttccccccccagcagctgaagcccccacctgagctgtgcccagaggacatcaacaccttcaagctgctgtcctatgccagctactgcattgaacatggagacctggagctggccgccaagtttgtgaaccagctgaagggggagagcagaagagtggcccaggactggctgaaggaggccaggatgaccctggagaccaagcagatcgtggagatcctgacagcctatgccagcgctgtgggcatcggcaccacccaggtgcagcctgagtag

SEQ ID NO: 155980 - DNA, 2244 bp, Artificial Sequence
  Description of Artificial Sequence: Synthetic coding sequence
atgctgcgggcctgccagctgagcggcgtgacagctgctgcccagagctgcctgtgtgggaagtttgtgctgcggcccctgcggccctgccgccgctacagcaccagcggcagcagcggcctgaccaccgggaagattgctggagctggcctgctgtttgtgggcggcggcatcggcggcaccatcctgtatgccaagtgggacagccacttccgggagagcgtggagaagaccatcccctacagcgacaagctgtttgagatggtgctgggccctgctgcctacaacgtgcccctgcccaagaagagcatccagagcggccccctgaagatcagctctgtgtctgaggtgatgaaggagagcaagcagcctgccagccagctgcagaagcagaagggggacaccccagccagcgccacagctggggacaccctgtctgtgcctgccccagctgtgcagcctgaggagagcctgaagacagaccaccctgagattggagagggcaagcccaccccagccctgtctgaggaggccagcagcagcagcatccgggagaggcctcctgaggaggtggccgcccggctggcccagcaggagaagcaggagcaggtgaagattgagagcctggccaagagcctggaggatgccctgcggcagacagcctctgtgaccctgcaggccatcgccgcccagaatgctgctgtgcaggccgtgaatgcccacagcaacatcctgaaggccgccatggacaacagcgagattgctggggagaagaagagcgcccagtggaggacagtggagggcgccctgaaggagaggaggaaggctgtggatgaggccgcagatgccctgctgaaggccaaggaggagctggagaagatgaagtctgtgattgaaaatgccaagaagaaggaggtggccggggccaagccccacatcacagctgctgagggcaagctgcacaacatgattgtggacctggacaacgtggtgaagaaggtgcaggccgcccagagcgaggccaaggtggtgtcccagtaccacgagctggtggtgcaggccagagatgacttcaagcgggagctggacagcatcaccccagaggtgctgcccggctggaagggcatgtctgtgtctgacctggccgacaagctgagcacagatgacctgaacagcctcatcgcccacgcccacagaagaattgaccagctgaaccgggagctggccgagcagaaggccacagagaagcagcacatcaccctggccctggagaagcagaagctggaggagaagagggcctttgacagcgctgtggccaaggccctggagcaccacaggtctgagatccaggccgagcaggacaggaagattgaggaggtgagagatgccatggagaatgagatgaggacccagctgcggcggcaggccgccgcccacacagaccacctgagagatgtgctgcgggtgcaggagcaggagctgaagtcagaatttgagcagaacctgtctgagaagctgtctgagcaggagctgcagttccggcggctgagccaggagcaggtggacaacttcaccctggacatcaacacagcctatgcccggctgcggggcatcgagcaggccgtgcagagccatgctgtggccgaggaggaggccaggaaggcccaccagctgtggctgtctgtggaggccctgaagtacagcatgaagaccagcagcgctgagacccccaccatccccctgggcagcgctgtggaggccatcaaggccaactgcagcgacaatgagttcacccaggccctgacagctgccatccccccagagagcctgacccggggcgtgtacagcgaggagaccctgcgggcccgcttctatgctgtgcagaagctggcccggcgggtggccatgattgatgagaccaggaacagcctgtaccagtacttcctgagctacctgcagagcctgctgctcttccccccccagcagctgaagcccccacctgagctgtgcccagaggacatcaacaccttcaagctgctgtcctatgccagctactgcattgaacatggagacctggagctggccgccaagtttgtgaaccagctgaagggggagagcagaagagtggcccaggactggctgaaggaggccaggatgaccctggagaccaagcagatcgtggagatcctgacagcctatgccagcgctgtgggcatcggcaccacccaggtgcagcctgagtag

SEQ ID NO: 155981 - DNA, 2244 bp, Artificial Sequence
  Description of Artificial Sequence: Synthetic coding sequence
atgctgcgggcctgccagctgagcggcgtgacagctgctgcccagagctgcctgtgtgggaagtttgtgctgcggcccctgcggccctgccgccgctacagcaccagcggcagcagcggcctgaccaccgggaagattgctggagctggcctgctgtttgtgggcggcggcatcggcggcaccatcctgtatgccaagtgggacagccacttccgggagagcgtggagaagaccatcccctacagcgacaagctgtttgagatggtgctgggccctgctgcctacaacgtgcccctgcccaagaagagcatccagagcggccccctgaagatcagctctgtgtctgaggtgatgaaggagagcaagcagcctgccagccagctgcagaagcagaagggggacaccccagccagcgccacagctggggacaccctgtctgtgcctgccccagctgtgcagcctgaggagagcctgaagacagaccaccctgagattggagagggcaagcccaccccagccctgtctgaggaggccagcagcagcagcatccgggagaggcctcctgaggaggtggccgcccggctggcccagcaggagaagcaggagcaggtgaagattgagagcctggccaagagcctggaggatgccctgcggcagacagcctctgtgaccctgcaggccatcgccgcccagaatgctgctgtgcaggccgtgaatgcccacagcaacatcctgaaggccgccatggacaacagcgagattgctggggagaagaagagcgcccagtggaggacagtggagggcgccctgaaggagaggaggaaggctgtggatgaggccgcagatgccctgctgaaggccaaggaggagctggagaagatgaagtctgtgattgaaaatgccaagaagaaggaggtggccggggccaagccccacatcacagctgctgagggcaagctgcacaacatgattgtggacctggacaacgtggtgaagaaggtgcaggccgcccagagcgaggccaaggtggtgtcccagtaccacgagctggtggtgcaggccagagatgacttcaagcgggagctggacagcatcaccccagaggtgctgcccggctggaagggcatgtctgagtacaacctggccgacaagctgagcacagatgacctgaacagcctcatcgcccacgcccacagaagaattgaccagctgaaccgggagctggccgagcagaaggccacagagaagcagcacatcaccctggccctggagaagcagaagctggaggagaagagggcctttgacagcgctgtggccaaggccctggagcaccacaggtctgagatccaggccgagcaggacaggaagattgaggaggtgagagatgccatggagaatgagatgaggacccagctgcggcggcaggccgccgcccacacagaccacctgagagatgtgctgcgggtgcaggagcaggagctgaagtcagaatttgagcagaacctgtctgagaagctgtctgagcaggagctgcagttccggcggctgagccaggagcaggtggacaacttcaccctggacatcaacacagcctatgcccggctgcggggcatcgagcaggccgtgcagagccatgctgtggccgaggaggaggccaggaaggcccaccagctgtggctgtctgtggaggccctgaagtacagcatgaagaccagcagcgctgagacccccaccatccccctgggcagcgctgtggaggccatcaaggccaactgcagcgacaatgagttcacccaggccctgacagctgccatccccccagagagcctgacccggggcgtgtacagcgaggagaccctgcgggcccgcttctatgctgtgcagaagctggcccggcgggtggccatgattgatgagaccaggaacagcctgtaccagtacttcctgagctacctgcagagcctgctgctcttccccccccagcagctgaagcccccacctgagctgtgcccagaggacatcaacaccttcaagctgctgtcctatgccagctactgcattgaacatggagacctggagctggccgccaagtttgtgaaccagctgaagggggagagcagaagagtggcccaggactggctgaaggaggccaggatgaccctggagaccaagcagatcgtggagatcctgacagcctatgccagcgctgtgggcatcggcaccacccaggtgcagcctgagtag

SEQ ID NO: 155982 - DNA, 579 bp, Artificial Sequence
  Description of Artificial Sequence: Synthetic coding sequence
atggaccgggcccaccggctgggccagaccaagcaggtgacagtgtaccgcctcatctgcaagggcaccatcgaggagcgcatcctgcagagggccaaggagaagtctgagatccagaggatggtgatcagcggcggcaacttcaagccagacaccctgaagcccaaggaggtggtgtccctgctgctggatgatgaggagctggagaagaagctgcggctgcggcaggaggagaagaggcagcaggaggagaccaacagagtgaaggagaggaagaggaagcgggagaagtatgcagagaagaagaagaaggaggatgagctggatggcaagaggaggaaggagggcgtgaacctggtgatcccctttgtgcccagcgctgacaacagcaacctgtctgcagatggagatgacagcttcatctctgtggacagcgccatgcccagccccttcagcgagatcagcatcagcagcgagctgcacacaggcagcatccccctggatgagagcagcagcctggccccagacagcctggtgaggaagcagggcaagggcaccaaccccagcggcggccgctag

SEQ ID NO: 155983 - DNA, 4671 bp, Artificial Sequence
  Description of Artificial Sequence: Synthetic coding sequence
atggccagcgagctgggcgccagagatgatggcggctgcacagagctggccaagcccctgtacctgcagtacctggagcgggccctgcggctggaccacttcctgcggcagaccagcgccatcttcaacagaaacatcagcagtgatgattctgaagatggcctggatgacagcaaccccctgctgccccagagcggggaccccctcatccaggtgaaggaggagccccccaacagcctgctgggggagaccagcggggccggcagcagcggcatgctgaacacctacagcctgaatggagtgctgcagagcgagagcaaatgtgacaagggcaacctgtacaacttcagcaagctgaagaagagcaggaagtggctgaagagcatcctgctgagtgatgagagcagcgaggccgacagccagagtgaagatgatgatgaggaggagctgaacctgagccgggaggagctgcacaacatgctgcggctgcacaagtacaagaagctgcaccagaacaagtacagcaaggacaaggagctgcagcagtaccagtactacagcgctggcctgctgagcacctatgaccccttctatgagcagcagaggcacctgctgggccccaagaagaagaagttcaaggaggagaagaagctgaaggccaagctgaagaaggtgaagaagaagagaagaagagatgaggagctgagcagcgaggagagcccccggcggcaccaccaccagaccaaggtgtttgccaagttcagccatgatgcccctcctcctggcaccaagaagaagcacctgagcattgagcagctgaatgcccggcggaggaaggtgtggctgagcatcgtgaagaaggagctgcccaaggccaacaagcagaaggccagcgccaggaacctcttcctgaccaacagcaggaagctggcccaccagtgcatgaaggaggtgagaagagctgccctgcaggcccagaagaactgcaaggagaccctgccccgggcccggcggctgaccaaggagatgctgctgtactggaagaagtatgagaaggtggagaaggagcacaggaagagagctgagaaggaggccctggagcagaggaagctggatgaggagatgagggaggccaagaggcagcagaggaagctgaacttcctgatcacccagacagagctgtatgcccacttcatgagcaggaagagggacatgggccatgatggcatccaggaggagatcctgaggaagctggaggacagcagcacccagaggcagattgatattggaggcggcgtggtggtgaacatcacccaggaggactatgacagcaaccacttcaaggcccaggccctgaagaatgcagaaaatgcctaccacatccaccaggcccggaccaggagctttgatgaagatgccaaggagagcagagctgctgccctgcgggccgccaacaagtctggaactggatttggagagagctacagcctggccaaccccagcatccgggccggggaggacatcccccagcccaccatcttcaacgggaagctgaagggctaccagctgaagggcatgaactggctggccaacctgtatgagcagggcatcaatggcatcctggctgatgagatgggcctgggcaagacagtgcagagcatcgccctgctggcccacctggccgagcgggagaacatctggggccccttcctgatcatcagccctgccagcaccctgaacaactggcaccaggagttcaccaggtttgtgcccaagttcaaggtgctgccctactggggcaacccccatgacaggaaggtgatccgccgcttctggagccagaagaccctgtacacccaggatgcccccttccacgtggtgatcaccagctaccagctggtggtgcaggatgtgaagtacttccagagggtgaagtggcagtacatggtgctggatgaggcccaggccctgaagagcagcagctctgtgcgctggaagatcctgctgcagttccagtgcaggaaccggctgctgctgaccggcacccccatccagaacaccatggccgagctgtgggccctgctgcacttcatcatgcccaccctgtttgacagccatgaggagttcaatgagtggttcagcaaggacatcgagagccatgctgagaacaagagcgccattgatgagaaccagctgagccggctgcacatgatcctgaagcccttcatgctgcggcgcatcaagaaggatgtggagaatgagctgagtgacaagattgagatcctgatgtactgccagctgaccagccggcagaagctgctgtaccaggccctgaagaacaagatcagcattgaggacctgctgcagagctccatgggcagcacccagcaggcccagaacaccaccagcagcctgatgaacctggtgatgcagttcaggaaggtgtgcaaccaccctgagctgtttgagcggcaggagacctggagccccttccacatcagcctgaagccctaccacatcagcaagttcatctacagacatggccagatccgggtcttcaaccacagccgggaccgctggctgcgggtgctgagcccctttgccccagactacatccagaggagcctcttccacaggaagggcatcaatgaggagagctgcttctccttcctgcgcttcatcgacatcagccctgctgagatggccaacctgatgctgcagggcctgctggcccgctggctggccctcttcctgagcctgaaggccagctaccgcctgcaccagctgcgctcctggggcgcccctgagggggagagccaccagcgctacctgaggaacaaggacttcctgctgggcgtgaacttccccctgtccttccccaacctgtgcagctgccccctgctgaagagcctggtgttcagcagccactgcaaggctgtgtctggctacagcgaccaggtggtgcaccagaggagaagtgccaccagcagcctgcggcgctgcctgctgacagagctgcccagcttcctgtgtgtggccagcccccgggtgacagctgtgcccctggacagctactgcaatgacagatctgcagaatatgaaagaagagtgctgaaggagggcggcagcctggccgccaagcagtgcctgctgaatggagcccctgagctggccgctgactggctgaacagaagaagccagttcttccctgagcctgctgggggcctgtggagcatccggccccagaatggctggagcttcatccgcatccctgggaaggagagcctcatcacagacagcggcaagctgtatgccctggatgtgctgctgacccggctgaagagccagggccaccgggtgctgatctacagccagatgaccaggatgattgacctgctggaggagtacatggtgtacaggaagcacacctacatgaggctggatggcagcagcaagatcagcgagcggcgggacatggtggccgacttccagaacagaaatgacatctttgtgttcctgctgagcacccgggccggcggcctgggcatcaacctgacagctgctgacaccgtcatcttctatgacagcgactggaaccccaccgtggaccagcaggccatggaccgggcccaccggctgggccagaccaagcaggtgacagtgtaccgcctcatctgcaagggcaccatcgaggagcgcatcctgcagagggccaaggagaagtctgagatccagaggatggtgatcagcggcggcaacttcaagccagacaccctgaagcccaaggaggtggtgtccctgctgctggatgatgaggagctggagaagaagctgcggctgcggcaggaggagaagaggcagcaggaggagaccaacagagtgaaggagaggaagaggaagcgggagaagtatgcagagaagaagaagaaggaggatgagctggatggcaagaggaggaaggagggcgtgaacctggtgatcccctttgtgcccagcgctgacaacagcaacctgtctgcagatggagatgacagcttcatctctgtggacagcgccatgcccagccccttcagcgagatcagcatcagcagcgagctgcacacaggcagcatccccctggatgagagcagcagtgacatgctggtgattgtggatgatcctgccagcagcgccccccagagccgggccaccaacagccctgccagcatcaccggctctgtgtctgacacagtgaatggcatcagcatccaggagatgcctgctgctggccggggccacagcgcccggagccggggccggcccaagggcagcggcagcacagccaagggggccggcaagggccgcagcaggaagagcacagctggcagcgctgctgccatggccggggccaaggccggggctgctgctgccagcgctgctgcctatgctgcctacggctacaacgtgtccaagggcatcagcgccagcagccccctgcagaccagcctggtgcggcctgctggcctggccgactttggccccagcagcgccagcagccccctgagcagccccctgagcaagggcaacaacgtgcccggcaaccccaagaacctgcacatgaccagcagcctggccccagacagcctggtgaggaagcagggcaagggcaccaaccccagcggcggccgctag

SEQ ID NO: 155984 - DNA, 4671 bp, Artificial Sequence; identical to SEQ ID NO: 155983
  Description of Artificial Sequence: Synthetic coding sequence

SEQ ID NO: 155985 - DNA, 585 bp, Artificial Sequence
  Description of Artificial Sequence: Synthetic coding sequence
atggccgccagcctggtgggcaagaagatcgtgtttgtgactggaaatgccaagaagctggaggaggtggtgcagatcctgggggacaagttcccctgcaccctggtggcccagaagattgacctgcctgagtaccagggcgagccagatgagatcagcatccagaagtgccaggaggccgtgcggcaggtgcagggccctgtgctggtggaggacacctgcctgtgcttcaatgccctgggcggcctgcccggcccctacatcaagtggttcctggagaagctgaagccagagggcctgcaccagctgctggccggctttgaggacaagagcgcctatgccctgtgcacctttgccctgagcactggagaccccagccagcctgtgcggctcttccggggccgcaccagcggccgcatcgtggccccccggggctgccaggactttggctgggacccctgcttccagccagatggctatgagcagacctatgcagagatgcccaaggccgagaagaatgctgtgagccaccgcttccgggccctgctggagctgcaggagtacttcggcagcctggccgcctag

SEQ ID NO: 155986 - DNA, 462 bp, Artificial Sequence
  Description of Artificial Sequence: Synthetic coding sequence
atggccgccagcctggtgggcaagaagatcgtgtttgtgactggaaatgccaagaagctggaggaggtgcagggccctgtgctggtggaggacacctgcctgtgcttcaatgccctgggcggcctgcccggcccctacatcaagtggttcctggagaagctgaagccagagggcctgcaccagctgctggccggctttgaggacaagagcgcctatgccctgtgcacctttgccctgagcactggagaccccagccagcctgtgcggctcttccggggccgcaccagcggcagaattgtggccccccggggctgccaggactttggctgggacccctgcttccagccagatggctatgagcagacctacgccgagatgcccaaggccgagaagaatgctgtgagccaccgcttccgggccctgctggagctgcaggagtacttcggcagcctggccgcctag

SEQ ID NO: 155987 - DNA, 534 bp, Artificial Sequence
  Description of Artificial Sequence: Synthetic coding sequence
atggccgccagcctggtggtgcagatcctgggggacaagttcccctgcaccctggtggcccagaagattgacctgcctgagtaccagggcgagccagatgagatcagcatccagaagtgccaggaggccgtgcggcaggtgcagggccctgtgctggtggaggacacctgcctgtgcttcaatgccctgggcggcctgcccggcccctacatcaagtggttcctggagaagctgaagccagagggcctgcaccagctgctggccggctttgaggacaagagcgcctatgccctgtgcacctttgccctgagcactggagaccccagccagcctgtgcggctcttccggggccgcaccagcggcagaattgtggccccccggggctgccaggactttggctgggacccctgcttccagccagatggctatgagcagacctacgccgagatgcccaaggccgagaagaatgctgtgagccaccgcttccgggccctgctggagctgcaggagtacttcggcagcctggccgcctag

SEQ ID NO: 155988 - DNA, 8232 bp, Artificial Sequence
  Description of Artificial Sequence: Synthetic coding sequence
atgtctgacaagatgagcagcttcctgcacatcggggacatctgcagcctgtatgcagagggcagcaccaacggcttcatcagcaccctgggcctggtggatgacagatgtgtggtgcagcctgagactggagacctgaacaacccccccaagaagttccgggactgcctcttcaagctgtgccccatgaaccgctacagcgcccagaagcagttctggaaggccgccaagccaggggccaacagcaccacagatgctgtgctgctgaacaagctgcaccacgccgctgacctggagaagaagcagaatgaaacagagaacaggaagctgctgggcaccgtcatccagtatggaaatgtcatccagctgctgcacctgaagagcaacaagtacctgactgtgaacaagaggctgcctgccctgctggagaagaatgccatgagggtgaccctggatgaggccggaaatgaaggctcctggttctacatccagcccttctacaagctgcggagcatcggggacagcgtggtgattggagacaaggtggtgctgaaccctgtgaatgccggccagcccctgcacgccagcagccaccagctggtggacaaccctggctgcaatgaggtgaacagcgtgaactgcaacacctcctggaagatcgtgctcttcatgaagtggagcgacaacaaggatgacatcctgaagggaggagatgtggtgcggctcttccacgccgagcaggagaagttcctgacctgtgatgagcacaggaagaagcagcacgtgttcctgcggaccaccggccggcagagcgccaccagcgccaccagcagcaaggccctgtgggaggtggaggtggtgcagcacgacccctgccggggcggggccggctactggaacagcctcttccgcttcaagcacctggccaccggccactacctggccgctgaggtggaccctgaccaggatgccagccgcagccggctgagaaatgcccaggagaagatggtgtacagcctggtgtctgtgcctgagggcaatgacatcagcagcatctttgagctggaccccaccaccctgcggggcggggacagcctggtgcccagaaattcctatgtgcggctgcggcacctgtgcaccaacacctgggtgcacagcaccaacatccccatcgacaaggaggaggagaagcctgtgatgctgaagattggcaccagccctgtgaaggaggacaaggaggcctttgccatcgtgcctgtgtccccagctgaggtgcgggacctggactttgccaatgatgccagcaaggtgctgggcagcattgctgggaagctggagaagggcaccatcacccagaatgaaagaagatctgtgaccaagctgctggaggacctggtgtactttgtgactggaggcaccaacagcggccaggatgtgctggaggtggtgttcagcaagcccaaccgggagcggcagaagctgatgagggagcagaacatcctgaagcagatcttcaagctgctgcaggcccccttcacagactgtggagatggccccatgctgcggctggaggagctgggggaccagagacatgcccccttccgccacatctgccgcctgtgctacagagtgctgcggcacagccagcaggactacaggaagaaccaggagtacatcgccaagcagtttggcttcatgcagaagcagatcggctatgatgtgctggccgaggacaccatcacagccctgctgcacaacaacaggaagctgctggagaagcacatcacagctgctgagattgacacctttgtgtccctggtgaggaagaaccgggagccccgcttcctggactacctgagtgacctgtgtgtgtccatgaacaagagcatccctgtgacccaggagctgatctgcaaggctgtgctgaaccccaccaatgctgacatcctgattgagaccaagctggtgctgagcagatttgaatttgagggcgtgagcagcactggagaaaatgccctggaggccggagaagatgaggaggaggtgtggctgttctggagggacagcaacaaggagatccgcagcaagtctgtgcgggagctggcccaggatgccaaggagggccagaaggaggacagagatgtgctgagctactaccgctaccagctgaacctgtttgccaggatgtgcctggaccggcagtacctggccatcaatgagatcagcggccagctggatgtggacctgatcctgcgctgcatgtctgatgagaacctgccctatgacctgcgggccagcttctgccgcctgatgctgcacatgcacgtggaccgggacccccaggagcaggtgacccctgtgaagtatgcccggctgtggagcgagatccccagcgagatcgccattgatgattatgacagcagcggggccagcaaggatgagatcaaggagagatttgcccagaccatggagtttgtggaggagtacctgagagatgtggtgtgccagcgcttccccttcagtgacaaggagaagaacaagctgacctttgaggtggtgaacctggccaggaacctgatctacttcggcttctacaacttcagtgacctgctgcggctgaccaagatcctgctggccatcctggactgtgtgcacgtgaccaccatcttccccatcagcaagatggccaagggggaggagaacaagggcaacaatgatgtggagaagctgaagagcagcaatgtgatgaggagcatccacggcgtgggggagctgatgacccaggtggtgctgcggggcggcggcttcctgcccatgacccccatggccgccgcccctgagggcaatgtgaagcaggccgagcctgagaaggaggacatcatggtgatggacaccaagctgaagatcatcgagatcctgcagttcatcctgaatgtgcggctggactaccgcatcagctgcctgctgtgcatcttcaagcgggagtttgatgagagcaacagccagaccagcgagaccagcagcggcaacagcagccaggagggccccagcaatgtgcctggggccctggactttgagcacatcgaggagcaggccgagggcatctttggaggcagcgaggagaacacccccctggacctggatgaccacggcggccgcaccttcctgcgggtgctgctgcacctgaccatgcatgactacccacccctggtgtctggggccctgcagctgctcttccgccacttcagccagaggcaggaggtgctgcaggccttcaagcaggtgcagctgctggtgaccagccaggatgtggacaactacaagcagatcaagcaggacctggaccagctgcggagcatcgtggagaagtctgagctgtgggtgtacaagggccagggcccagatgagaccatggatggagccagcggggagaatgagcacaagaagacagaggagggcaacaacaagccccagaagcatgagagcaccagcagctacaactacagagtggtgaaggagatcctgatccggctgagcaagctgtgtgtgcaggagagcgcctctgtgaggaagagcaggaagcagcagcagaggctgctgaggaacatgggcgcccatgctgtggtgctggagctgctgcagatcccctatgagaaggccgaggacaccaagatgcaggagatcatgaggctggcccacgagttcctgcagaacttctgtgccggcaaccagcagaaccaggccctgctgcacaagcacatcaacctcttcctgaaccctggcatcctggaggccgtgaccatgcagcacatcttcatgaacaacttccagctgtgcagcgagatcaatgaaagagtggtgcagcactttgtgcactgcatcgagacccatggaagaaatgtgcagtacatcaagttcctgcagaccatcgtgaaggccgagggcaagttcatcaagaagtgccaggacatggtgatggccgagctggtgaacagcggggaggatgtgctggtgttctacaatgaccgggccagcttccagaccctcatccagatgatgaggtctgagcgggacaggatggatgagaacagccccctgatgtaccacatccacctggtggagctgctggccgtgtgcacagagggcaagaatgtgtacacagagatcaagtgcaacagcctgctgcccctggatgacatcgtgcgggtggtgacccatgaggactgcatccctgaggtgaagatcgcctacatcaacttcctgaaccactgctacgtggacacagaggtggagatgaaggagatctacaccagcaaccacatgtggaagctgtttgagaacttcctggtggacatctgccgggcctgcaacaacaccagtgacaggaagcatgctgacagcatcctggagaagtatgtgacagagatcgtgatgagcatcgtgaccaccttcttcagcagccccttcagtgaccagagcaccaccctgcagacccggcagcctgtgtttgtgcagctgctgcagggcgtcttccgggtgtaccactgcaactggctgatgcccagccagaaggcctctgtggagagctgcatccgggtgctgagtgatgtggccaagagccgggccatcgccatccctgtggacctggacagccaggtgaacaacctcttcctgaagagccacagcatcgtgcagaagacagccatgaactggaggctgagcgccagaaatgctgcccggcgggacagcgtgctggccgccagccgggactacagaaacatcatcgagcggctgcaggacatcgtgtctgccctggaggaccggctgcggcccctggtgcaggccgagctgtctgtgctggtggatgtgctgcacaggcctgagctgctcttcccagaaaatacagatgcccggaggaaatgtgagagcggcggcttcatctgcaagctgatcaagcacaccaagcagctgctggaggagaatgaggagaagctgtgcatcaaggtgctgcagaccctgcgggagatgatgaccaaggaccggggctatggagagaagctgatcagcattgatgagctggacaatgctgagctgcccccagccccagacagtgaaaatgccacagaggagctggagcccagcccccccctgcggcagctggaggaccacaagagaggagaggccctgcggcaggtgctggtgaaccgctactatggaaatgtgcggcccagcggccggcgggagagcctgaccagctttggaaatggccccctgtctgctgggggccctgggaagccaggcggcggcggcggcggcagcggcagcagctccatgagcagaggagagatgagcctggccgaggtgcagtgccacctggacaaggagggcgccagcaacctggtgattgacctgatcatgaatgccagcagtgacagagtcttccacgagagcatcctgctggccatcgccctgctggagggcggcaacaccaccatccagcacagcttcttctgccgcctgacagaggacaagaagtctgagaagttcttcaaggtgttctatgacaggatgaaggtggcccagcaggagatcaaggccaccgtgacagtgaacaccagtgacctgggcaacaagaagaaggatgatgaggtggacagagatgcccccagcaggaagaaggccaaggagcccaccacccagatcacagaggaggtgcgggaccagctgctggaggccagcgctgccaccaggaaggccttcaccaccttccggcgggaggccgaccctgatgaccactaccagcctggagagggcacccaggccacagctgacaaggccaaggatgacctggagatgtctgctgtgatcaccatcatgcagcccatcctgcgcttcctgcagctgctgtgtgagaaccacaacagagacctgcagaacttcctgcgctgccagaacaacaagaccaactacaacctggtgtgtgagaccctgcagttcctggactgcatctgtggcagcaccaccggcggcctgggcctgctgggcctgtacatcaatgagaagaatgtggccctgatcaaccagaccctggagagcctgacagagtactgccagggcccctgccacgagaaccagaactgcatcgccacccatgagagcaatggcatcgacatcatcacagccctgatcctgaatgacatcaaccccctgggcaagaagaggatggacctggtgctggagctgaagaacaatgccagcaagctgctgctggccatcatggagagcagacatgattctgaaaatgctgagcgcatcctgtacaacatgaggcccaaggagctggtggaggtgatcaagaaggcctacatgcagggcgaggtggagtttgaagatggagaaaatggagaagatggagctgccagccccagaaatgtgggccacaacatctacatcctggcccaccagctggcccggcacaacaaggagctgcagagcatgctgaagccaggcggccaggtggatggagatgaggccctggagttctacgccaagcacacagcccagattgaaattgtgcggctggacaggaccatggagcagatcgtgtttcctgtgcccagcatctgtgagttcctgaccaaggagagcaagctgcgcatctactacaccacagaaagagatgagcagggcagcaagatcaatgacttcttcctgcggagtgaagatctcttcaatgagatgaactggcagaagaagctgcgggcccagcctgtgctgtactggtgtgccaggaacatgtccttctggagcagcatctccttcaacctggccgtgctgatgaacctgctggtggccttcttctaccccttcaagggcgtgcggggcggcaccctggagccccactggagcggcctgctgtggacagccatgctgatcagcctggccatcgtcatcgccctgcccaagccccacggcatccgggccctgattgccagcaccatcctgcggctcatcttctctgtgggcctgcagcccaccctcttcctgctgggcgccttcaacgtgtgcaacaagatcatcttcctgatgagctttgtgggcaactgtggcaccttcacccggggctaccgggccatggtgctggatgtggagttcctgtaccacctgctgtacctggtgatctgtgccatgggcctgtttgtgcatgagttcttctacagcctgctgctgtttgacctggtgtaccgggaggagaccctgctgaatgtcatcaagtctgtgaccagaaatggccgcagcatcatcctgacagctgtgctggccctgatcctggtgtacctgttcagcatcgtgggctacctgttcttcaaggatgacttcatcctggaggtggaccggctgcccaatgaaacagctgtgcctgagaccggggagagcctggccagcgagttcctgttcagtgatgtgtgccgggtggagagcggggagaactgcagcagccctgccccccgggaggagctggtgcctgctgaggagacagagcaggacaaggagcacacctgtgagaccctgctgatgtgcatcgtgacagtgctgagccacggcctgcggagcggcggcggcgtgggagatgtgctgaggaagcccagcaaggaggagcccctgtttgctgcccgggtcatctatgacctgctcttcttcttcatggtgatcatcatcgtgctgaacctgatctttggagtcatcatcgacacctttgctgacctgcggtctgagaagcagaagaaggaggagatcctgaagaccacctgcttcatctgtggcctggagcgggacaagtttgacaacaagacagtgacctttgaggagcacatcaaggaggagcacaacatgtggcactacctgtgcttcatcgtgctggtgaaggtgaaggacagcacagagtacacaggccctgagagctatgtggccgagatgatcaaggagaggaacctggactggttccccaggatgagggccatgagcctggtgtccagtgacagcgagggggagcagaatgagctgaggaacctgcaggagaagctggagagcaccatgaagctggtgaccaacctgagcggccagctgtctgagctgaaggaccagatgacagagcagaggaagcagaagcagagaattggcctgctgggccaccccccccacatgaatgtgaacccccagcagcctgcctag

SEQ ID NO: 155989 - DNA, 8232 bp, Artificial Sequence
  Description of Artificial Sequence: Synthetic coding sequence
atgtctgacaagatgagcagcttcctgcacatcggggacatctgcagcctgtatgcagagggcagcaccaacggcttcatcagcaccctgggcctggtggatgacagatgtgtggtgcagcctgagactggagacctgaacaacccccccaagaagttccgggactgcctcttcaagctgtgccccatgaaccgctacagcgcccagaagcagttctggaaggccgccaagccaggggccaacagcaccacagatgctgtgctgctgaacaagctgcaccacgccgctgacctggagaagaagcagaatgaaacagagaacaggaagctgctgggcaccgtcatccagtatggaaatgtcatccagctgctgcacctgaagagcaacaagtacctgactgtgaacaagaggctgcctgccctgctggagaagaatgccatgagggtgaccctggatgaggccggaaatgaaggctcctggttctacatccagcccttctacaagctgcggagcatcggggacagcgtggtgattggagacaaggtggtgctgaaccctgtgaatgccggccagcccctgcacgccagcagccaccagctggtggacaaccctggctgcaatgaggtgaacagcgtgaactgcaacacctcctggaagatcgtgctcttcatgaagtggagcgacaacaaggatgacatcctgaagggaggagatgtggtgcggctcttccacgccgagcaggagaagttcctgacctgtgatgagcacaggaagaagcagcacgtgttcctgcggaccaccggccggcagagcgccaccagcgccaccagcagcaaggccctgtgggaggtggaggtggtgcagcacgacccctgccggggcggggccggctactggaacagcctcttccgcttcaagcacctggccaccggccactacctggccgctgaggtggaccctgactttgaggaggagtgcctggagttccagcccagcgtggaccctgaccaggatgccagccgcagccggctgagaaatgcccaggagaagatggtgtacagcctggtgtctgtgcctgagggcaatgacatcagcagcatctttgagctggaccccaccaccctgcggggcggggacagcctggtgcccaggaacagctatgtgcggctgcggcacctgtgcaccaacacctgggtgcacagcaccaacatccccatcgacaaggaggaggagaagcctgtgatgctgaagattggcaccagccctgtgaaggaggacaaggaggcctttgccatcgtgcctgtgtccccagctgaggtgcgggacctggactttgccaatgatgccagcaaggtgctgggcagcattgctgggaagctggagaagggcaccatcacccagaatgaaagaagatctgtgaccaagctgctggaggacctggtgtactttgtgactggaggcaccaacagcggccaggatgtgctggaggtggtgttcagcaagcccaaccgggagcggcagaagctgatgagggagcagaacatcctgaagcagatcttcaagctgctgcaggcccccttcacagactgtggagatggccccatgctgcggctggaggagctgggggaccagagacatgcccccttccgccacatctgccgcctgtgctacagagtgctgcggcacagccagcaggactacaggaagaaccaggagtacatcgccaagcagtttggcttcatgcagaagcagatcggctatgatgtgctggccgaggacaccatcacagccctgctgcacaacaacaggaagctgctggagaagcacatcacagctgctgagattgacacctttgtgtccctggtgaggaagaaccgggagccccgcttcctggactacctgagtgacctgtgtgtgtccatgaacaagagcatccctgtgacccaggagctgatctgcaaggctgtgctgaaccccaccaatgctgacatcctgattgagaccaagctggtgctgagcagatttgaatttgaaggagtgagcagcactggagaaaatgccctggaggccggggaggatgaggaggaggtgtggctgttctggagggacagcaacaaggagatccgcagcaagtctgtgcgggagctggcccaggatgccaaggagggccagaaggaggacagagatgtgctgagctactaccgctaccagctgaacctgtttgccaggatgtgcctggaccggcagtacctggccatcaatgagatcagcggccagctggatgtggacctgatcctgcgctgcatgtctgatgagaacctgccctatgacctgcgggccagcttctgccgcctgatgctgcacatgcacgtggaccgggacccccaggagcaggtgacccctgtgaagtatgcccggctgtggagcgagatccccagcgagatcgccattgatgattatgacagcagcggggccagcaaggatgagatcaaggagagatttgcccagaccatggagtttgtggaggagtacctgagagatgtggtgtgccagcgcttccccttcagtgacaaggagaagaacaagctgacctttgaggtggtgaacctggccaggaacctgatctacttcggcttctacaacttcagtgacctgctgcggctgaccaagatcctgctggccatcctggactgtgtgcacgtgaccaccatcttccccatcagcaagatggccaagggggaggagaacaagggcaacaatgatgtggagaagctgaagagcagcaatgtgatgaggagcatccatggagtgggggagctgatgacccaggtggtgctgcggggcggcggcttcctgcccatgacccccatggctgctgcccctgagggcaatgtgaagcaggccgagcctgagaaggaggacatcatggtgatggacaccaagctgaagatcatcgagatcctgcagttcatcctgaatgtgcggctggactaccgcatcagctgcctgctgtgcatcttcaagcgggagtttgatgagagcaacagccagaccagcgagaccagcagcggcaacagcagccaggagggccccagcaatgtgcctggggccctggactttgagcacatcgaggagcaggccgagggcatctttggaggcagcgaggagaacacccccctggacctggatgaccatggaggccgcaccttcctgcgggtgctgctgcacctgaccatgcatgactacccacccctggtgtctggggccctgcagctgctcttccgccacttcagccagaggcaggaggtgctgcaggccttcaagcaggtgcagctgctggtgaccagccaggatgtggacaactacaagcagatcaagcaggacctggaccagctgcggagcatcgtggagaagtctgagctgtgggtgtacaagggccagggcccagatgagaccatggatggagccagcggagaaaatgagcacaagaagacagaggagggcaacaacaagccccagaagcatgagagcaccagcagctacaactacagagtggtgaaggagatcctgatccggctgagcaagctgtgtgtgcaggagagcgcctctgtgaggaagagcaggaagcagcagcagaggctgctgaggaacatgggcgcccatgctgtggtgctggagctgctgcagatcccctatgagaaggccgaggacaccaagatgcaggagatcatgaggctggcccacgagttcctgcagaacttctgtgccggcaaccagcagaaccaggccctgctgcacaagcacatcaacctcttcctgaaccctggcatcctggaggccgtgaccatgcagcacatcttcatgaacaacttccagctgtgcagcgagatcaatgaaagagtggtgcagcactttgtgcactgcatcgagacccacggcagaaatgtgcagtacatcaagttcctgcagaccatcgtgaaggccgagggcaagttcatcaagaagtgccaggacatggtgatggccgagctggtgaacagcggagaagatgtgctggtgttctacaatgaccgggccagcttccagaccctcatccagatgatgaggtctgagcgggacaggatggatgagaacagccccctgatgtaccacatccacctggtggagctgctggccgtgtgcacagagggcaagaatgtgtacacagagatcaagtgcaacagcctgctgcccctggatgacatcgtgcgggtggtgacccatgaggactgcatccctgaggtgaagatcgcctacatcaacttcctgaaccactgctacgtggacacagaggtggagatgaaggagatctacaccagcaaccacatgtggaagctgtttgagaacttcctggtggacatctgccgggcctgcaacaacaccagtgacaggaagcacgccgacagcatcctggagaagtatgtgacagaaattgtgatgagcatcgtgaccaccttcttcagcagccccttcagtgaccagagcaccaccctgcagacccggcagcctgtgtttgtgcagctgctgcagggcgtcttccgggtgtaccactgcaactggctgatgcccagccagaaggcctctgtggagagctgcatccgggtgctgagtgatgtggccaagagccgggccatcgccatccctgtggacctggacagccaggtgaacaacctcttcctgaagagccacagcatcgtgcagaagacagccatgaactggaggctgagcgccagaaatgctgcccggcgggacagcgtgctggccgccagccgggactacagaaacatcatcgagcggctgcaggacatcgtgtctgccctggaggaccggctgcggcccctggtgcaggccgagctgtctgtgctggtggatgtgctgcacaggcctgagctgctcttccctgagaacacagatgcccggaggaaatgtgagagcggcggcttcatctgcaagctgatcaagcacaccaagcagctgctggaggagaatgaggagaagctgtgcatcaaggtgctgcagaccctgcgggagatgatgaccaaggaccggggctacggggagaagctgatcagcattgatgagctggacaatgctgagctgcccccagccccagattctgaaaatgccacagagaagggggaggccctgcggcaggtgctggtgaaccgctactatggaaatgtgcggcccagcggccggcgggagagcctgaccagctttggaaatggccccctgtctgctgggggccctgggaagccaggcggcggcggcggcggcagcggcagcagctccatgagcagaggagagatgagcctggccgaggtgcagtgccacctggacaaggagggcgccagcaacctggtgattgacctgatcatgaatgccagcagtgacagagtcttccacgagagcatcctgctggccatcgccctgctggagggcggcaacaccaccatccagcacagcttcttctgccgcctgacagaggacaagaagtctgagaagttcttcaaggtgttctatgacaggatgaaggtggcccagcaggagatcaaggccaccgtgacagtgaacaccagtgacctgggcaacaagaagaaggatgatgaggtggacagagatgcccccagcaggaagaaggccaaggagcccaccacccagatcacagaggaggtgcgggaccagctgctggaggccagcgctgccaccaggaaggccttcaccaccttccggcgggaggccgaccctgatgaccactaccagcctggagagggcacccaggccacagctgacaaggccaaggatgacctggagatgtctgctgtgatcaccatcatgcagcccatcctgcgcttcctgcagctgctgtgtgagaaccacaacagagacctgcagaacttcctgcgctgccagaacaacaagaccaactacaacctggtgtgtgagaccctgcagttcctggactgcatctgtggcagcaccaccggcggcctgggcctgctgggcctgtacatcaatgagaagaatgtggccctgatcaaccagaccctggagagcctgacagagtactgccagggcccctgccacgagaaccagaactgcatcgccacccatgagagcaatggcatcgacatcatcacagccctgatcctgaatgacatcaaccccctgggcaagaagaggatggacctggtgctggagctgaagaacaatgccagcaagctgctgctggccatcatggagagcagacatgattctgaaaatgctgagcgcatcctgtacaacatgaggcccaaggagctggtggaggtgatcaagaaggcctacatgcagggcgaggtggagtttgaagatggagaaaatggagaagatggagctgccagccccagaaatgtgggccacaacatctacatcctggcccaccagctggcccggcacaacaaggagctgcagagcatgctgaagccaggcggccaggtggatggagatgaggccctggagttctacgccaagcacacagcccagattgaaattgtgcggctggacaggaccatggagcagatcgtgtttcctgtgcccagcatctgtgagttcctgaccaaggagagcaagctgcgcatctactacaccacagaaagagatgagcagggcagcaagatcaatgacttcttcctgcggagtgaagatctcttcaatgagatgaactggcagaagaagctgcgggcccagcctgtgctgtactggtgtgccaggaacatgtccttctggagcagcatctccttcaacctggccgtgctgatgaacctgctggtggccttcttctaccccttcaagggcgtgcggggcggcaccctggagccccactggagcggcctgctgtggacagccatgctgatcagcctggccatcgtcatcgccctgcccaagccccacggcatccgggccctgattgccagcaccatcctgcggctcatcttctctgtgggcctgcagcccaccctcttcctgctgggcgccttcaacgtgtgcaacaagatcatcttcctgatgagctttgtgggcaactgtggcaccttcacccggggctaccgggccatggtgctggatgtggagttcctgtaccacctgctgtacctggtgatctgtgccatgggcctgtttgtgcatgagttcttctacagcctgctgctgtttgacctggtgtaccgggaggagaccctgctgaatgtcatcaagtctgtgaccagaaatggccgcagcatcatcctgacagctgtgctggccctgatcctggtgtacctgttcagcatcgtgggctacctgttcttcaaggatgacttcatcctggaggtggaccggctgcccaatgaaacagctgtgcctgagaccggggagagcctggccagcgagttcctgttcagtgatgtgtgccgggtggagagcggggagaactgcagcagccctgccccccgggaggagctggtgcctgctgaggagacagagcaggacaaggagcacacctgtgagaccctgctgatgtgcatcgtgacagtgctgagccacggcctgcggagcggcggcggcgtgggagatgtgctgaggaagcccagcaaggaggagcccctgtttgctgcccgggtcatctatgacctgctcttcttcttcatggtgatcatcatcgtgctgaacctgatctttggagtcatcatcgacacctttgctgacctgcggtctgagaagcagaagaaggaggagatcctgaagaccacctgcttcatctgtggcctggagcgggacaagtttgacaacaagacagtgacctttgaggagcacatcaaggaggagcacaacatgtggcactacctgtgcttcatcgtgctggtgaaggtgaaggacagcacagagtacacaggccctgagagctatgtggccgagatgatcaaggagaggaacctggactggttccccaggatgagggccatgagcctggtgtccagtgacagcgagggggagcagaatgagctgaggaacctgcaggagaagctggagagcaccatgaagctggtgaccaacctgagcggccagctgtctgagctgaaggaccagatgacagagcagaggaagcagaagcagagaattggcctgctgggccaccccccccacatgaatgtgaacccccagcagcctgcctag

SEQ ID NO: 155990 - DNA, 8277 bp, Artificial Sequence
  Description of Artificial Sequence: Synthetic coding sequence
atgtctgacaagatgagcagcttcctgcacatcggggacatctgcagcctgtatgcagagggcagcaccaacggcttcatcagcaccctgggcctggtggatgacagatgtgtggtgcagcctgagactggagacctgaacaacccccccaagaagttccgggactgcctcttcaagctgtgccccatgaaccgctacagcgcccagaagcagttctggaaggccgccaagccaggggccaacagcaccacagatgctgtgctgctgaacaagctgcaccacgccgctgacctggagaagaagcagaatgaaacagagaacaggaagctgctgggcaccgtcatccagtatggaaatgtcatccagctgctgcacctgaagagcaacaagtacctgactgtgaacaagaggctgcctgccctgctggagaagaatgccatgagggtgaccctggatgaggccggaaatgaaggctcctggttctacatccagcccttctacaagctgcggagcatcggggacagcgtggtgattggagacaaggtggtgctgaaccctgtgaatgccggccagcccctgcacgccagcagccaccagctggtggacaaccctggctgcaatgaggtgaacagcgtgaactgcaacacctcctggaagatcgtgctcttcatgaagtggagcgacaacaaggatgacatcctgaagggaggagatgtggtgcggctcttccacgccgagcaggagaagttcctgacctgtgatgagcacaggaagaagcagcacgtgttcctgcggaccaccggccggcagagcgccaccagcgccaccagcagcaaggccctgtgggaggtggaggtggtgcagcacgacccctgccggggcggggccggctactggaacagcctcttccgcttcaagcacctggccaccggccactacctggccgctgaggtggaccctgactttgaggaggagtgcctggagttccagcccagcgtggaccctgaccaggatgccagccgcagccggctgagaaatgcccaggagaagatggtgtacagcctggtgtctgtgcctgagggcaatgacatcagcagcatctttgagctggaccccaccaccctgcggggcggggacagcctggtgcccaggaacagctatgtgcggctgcggcacctgtgcaccaacacctgggtgcacagcaccaacatccccatcgacaaggaggaggagaagcctgtgatgctgaagattggcaccagccctgtgaaggaggacaaggaggcctttgccatcgtgcctgtgtccccagctgaggtgcgggacctggactttgccaatgatgccagcaaggtgctgggcagcattgctgggaagctggagaagggcaccatcacccagaatgaaagaagatctgtgaccaagctgctggaggacctggtgtactttgtgactggaggcaccaacagcggccaggatgtgctggaggtggtgttcagcaagcccaaccgggagcggcagaagctgatgagggagcagaacatcctgaagcagatcttcaagctgctgcaggcccccttcacagactgtggagatggccccatgctgcggctggaggagctgggggaccagagacatgcccccttccgccacatctgccgcctgtgctacagagtgctgcggcacagccagcaggactacaggaagaaccaggagtacatcgccaagcagtttggcttcatgcagaagcagatcggctatgatgtgctggccgaggacaccatcacagccctgctgcacaacaacaggaagctgctggagaagcacatcacagctgctgagattgacacctttgtgtccctggtgaggaagaaccgggagccccgcttcctggactacctgagtgacctgtgtgtgtccatgaacaagagcatccctgtgacccaggagctgatctgcaaggctgtgctgaaccccaccaatgctgacatcctgattgagaccaagctggtgctgagcagatttgaatttgaaggagtgagcagcactggagaaaatgccctggaggccggggaggatgaggaggaggtgtggctgttctggagggacagcaacaaggagatccgcagcaagtctgtgcgggagctggcccaggatgccaaggagggccagaaggaggacagagatgtgctgagctactaccgctaccagctgaacctgtttgccaggatgtgcctggaccggcagtacctggccatcaatgagatcagcggccagctggatgtggacctgatcctgcgctgcatgtctgatgagaacctgccctatgacctgcgggccagcttctgccgcctgatgctgcacatgcacgtggaccgggacccccaggagcaggtgacccctgtgaagtatgcccggctgtggagcgagatccccagcgagatcgccattgatgattatgacagcagcggggccagcaaggatgagatcaaggagagatttgcccagaccatggagtttgtggaggagtacctgagagatgtggtgtgccagcgcttccccttcagtgacaaggagaagaacaagctgacctttgaggtggtgaacctggccaggaacctgatctacttcggcttctacaacttcagtgacctgctgcggctgaccaagatcctgctggccatcctggactgtgtgcacgtgaccaccatcttccccatcagcaagatggccaagggggaggagaacaagggcaacaatgatgtggagaagctgaagagcagcaatgtgatgaggagcatccatggagtgggggagctgatgacccaggtggtgctgcggggcggcggcttcctgcccatgacccccatggctgctgcccctgagggcaatgtgaagcaggccgagcctgagaaggaggacatcatggtgatggacaccaagctgaagatcatcgagatcctgcagttcatcctgaatgtgcggctggactaccgcatcagctgcctgctgtgcatcttcaagcgggagtttgatgagagcaacagccagaccagcgagaccagcagcggcaacagcagccaggagggccccagcaatgtgcctggggccctggactttgagcacatcgaggagcaggccgagggcatctttggaggcagcgaggagaacacccccctggacctggatgaccatggaggccgcaccttcctgcgggtgctgctgcacctgaccatgcatgactacccacccctggtgtctggggccctgcagctgctcttccgccacttcagccagaggcaggaggtgctgcaggccttcaagcaggtgcagctgctggtgaccagccaggatgtggacaactacaagcagatcaagcaggacctggaccagctgcggagcatcgtggagaagtctgagctgtgggtgtacaagggccagggcccagatgagaccatggatggagccagcggagaaaatgagcacaagaagacagaggagggcaacaacaagccccagaagcatgagagcaccagcagctacaactacagagtggtgaaggagatcctgatccggctgagcaagctgtgtgtgcaggagagcgcctctgtgaggaagagcaggaagcagcagcagaggctgctgaggaacatgggcgcccatgctgtggtgctggagctgctgcagatcccctatgagaaggccgaggacaccaagatgcaggagatcatgaggctggcccacgagttcctgcagaacttctgtgccggcaaccagcagaaccaggccctgctgcacaagcacatcaacctcttcctgaaccctggcatcctggaggccgtgaccatgcagcacatcttcatgaacaacttccagctgtgcagcgagatcaatgaaagagtggtgcagcactttgtgcactgcatcgagacccacggcagaaatgtgcagtacatcaagttcctgcagaccatcgtgaaggccgagggcaagttcatcaagaagtgccaggacatggtgatggccgagctggtgaacagcggagaagatgtgctggtgttctacaatgaccgggccagcttccagaccctcatccagatgatgaggtctgagcgggacaggatggatgagaacagccccctgatgtaccacatccacctggtggagctgctggccgtgtgcacagagggcaagaatgtgtacacagagatcaagtgcaacagcctgctgcccctggatgacatcgtgcgggtggtgacccatgaggactgcatccctgaggtgaagatcgcctacatcaacttcctgaaccactgctacgtggacacagaggtggagatgaaggagatctacaccagcaaccacatgtggaagctgtttgagaacttcctggtggacatctgccgggcctgcaacaacaccagtgacaggaagcacgccgacagcatcctggagaagtatgtgacagaaattgtgatgagcatcgtgaccaccttcttcagcagccccttcagtgaccagagcaccaccctgcagacccggcagcctgtgtttgtgcagctgctgcagggcgtcttccgggtgtaccactgcaactggctgatgcccagccagaaggcctctgtggagagctgcatccgggtgctgagtgatgtggccaagagccgggccatcgccatccctgtggacctggacagccaggtgaacaacctcttcctgaagagccacagcatcgtgcagaagacagccatgaactggaggctgagcgccagaaatgctgcccggcgggacagcgtgctggccgccagccgggactacagaaacatcatcgagcggctgcaggacatcgtgtctgccctggaggaccggctgcggcccctggtgcaggccgagctgtctgtgctggtggatgtgctgcacaggcctgagctgctcttccctgagaacacagatgcccggaggaaatgtgagagcggcggcttcatctgcaagctgatcaagcacaccaagcagctgctggaggagaatgaggagaagctgtgcatcaaggtgctgcagaccctgcgggagatgatgaccaaggaccggggctacggggagaagctgatcagcattgatgagctggacaatgctgagctgcccccagccccagattctgaaaatgccacagaggagctggagcccagcccccccctgcggcagctggaggaccacaagagaggagaggccctgcggcaggtgctggtgaaccgctactatggaaatgtgcggcccagcggcagaagagagagcctgaccagctttggaaatggccccctgtctgctgggggccctgggaagccaggcggcggcggcggcggcagcggcagcagctccatgagcagaggagagatgagcctggccgaggtgcagtgccacctggacaaggagggcgccagcaacctggtgattgacctgatcatgaatgccagcagtgacagagtcttccacgagagcatcctgctggccatcgccctgctggagggcggcaacaccaccatccagcacagcttcttctgccgcctgacagaggacaagaagtctgagaagttcttcaaggtgttctatgacaggatgaaggtggcccagcaggagatcaaggccaccgtgacagtgaacaccagtgacctgggcaacaagaagaaggatgatgaggtggacagagatgcccccagcaggaagaaggccaaggagcccaccacccagatcacagaggaggtgcgggaccagctgctggaggccagcgctgccaccaggaaggccttcaccaccttcagaagagaggccgaccctgatgaccactaccagcccggggagggcacccaggccacagctgacaaggccaaggatgacctggagatgtctgctgtgatcaccatcatgcagcccatcctgcgcttcctgcagctgctgtgtgagaaccacaacagagacctgcagaacttcctgcgctgccagaacaacaagaccaactacaacctggtgtgtgagaccctgcagttcctggactgcatctgtggcagcaccactggaggcctgggcctgctgggcctgtacatcaatgagaagaatgtggccctgatcaaccagaccctggagagcctgacagagtactgccagggcccctgccacgagaaccagaactgcatcgccacccatgagagcaatggaattgacatcatcacagccctgatcctgaatgacatcaaccccctgggcaagaagaggatggacctggtgctggagctgaagaacaatgccagcaagctgctgctggccatcatggagagcagacatgacagtgaaaatgctgagcgcatcctgtacaacatgaggcccaaggagctggtggaggtgatcaagaaggcctacatgcagggcgaggtggagtttgaagatggagaaaatggagaagatggagctgccagccccagaaatgtgggccacaacatctacatcctggcccaccagctggcccggcacaacaaggagctgcagagcatgctgaagccaggcggccaggtggatggagatgaggccctggagttctacgccaagcacacagcccagatcgagatcgtgcggctggacaggaccatggagcagatcgtgtttcctgtgcccagcatctgtgagttcctgaccaaggagagcaagctgcgcatctactacaccacagaaagagatgagcagggcagcaagatcaatgacttcttcctgcggtctgaggacctcttcaatgagatgaactggcagaagaagctgcgggcccagcctgtgctgtactggtgtgccaggaacatgtccttctggagcagcatctccttcaacctggccgtgctgatgaacctgctggtggccttcttctaccccttcaagggcgtgcggggcggcaccctggagccccactggagcggcctgctgtggacagccatgctgatcagcctggccatcgtgattgccctgcccaagccccacggcatccgggccctgattgccagcaccatcctgcggctcatcttctctgtgggcctgcagcccaccctcttcctgctgggcgccttcaacgtgtgcaacaagatcatcttcctgatgagctttgtgggcaactgtggcaccttcacccggggctaccgggccatggtgctggatgtggagttcctgtaccacctgctgtacctggtgatctgtgccatgggcctgtttgtgcatgagttcttctacagcctgctgctgtttgacctggtgtaccgggaggagaccctgctgaatgtcatcaagtctgtgaccagaaatggccgcagcatcatcctgacagctgtgctggccctgatcctggtgtacctgttcagcatcgtgggctacctgttcttcaaggatgacttcatcctggaggtggaccggctgcccaatgaaacagctgtgcctgagactggagagagcctggccagcgagttcctgttcagtgatgtgtgccgggtggagagcggggagaactgcagcagccctgccccccgggaggagctggtgcctgctgaggagacagagcaggacaaggagcacacctgtgagaccctgctgatgtgcatcgtgacagtgctgagccacggcctgcggagcggcggcggcgtgggagatgtgctgaggaagcccagcaaggaggagcccctgtttgctgcccgggtcatctatgacctgctcttcttcttcatggtgatcatcatcgtgctgaacctgatctttggagtcatcatcgacacctttgctgacctgcggtctgagaagcagaagaaggaggagatcctgaagaccacctgcttcatctgtggcctggagcgggacaagtttgacaacaagacagtgacctttgaggagcacatcaaggaggagcacaacatgtggcactacctgtgcttcatcgtgctggtgaaggtgaaggacagcacagagtacacaggccctgagagctatgtggccgagatgatcaaggagaggaacctggactggttccccaggatgagggccatgagcctggtgtccagtgacagcgagggggagcagaatgagctgaggaacctgcaggagaagctggagagcaccatgaagctggtgaccaacctgagcggccagctgtctgagctgaaggaccagatgacagagcagaggaagcagaagcagagaattggcctgctgggccaccccccccacatgaatgtgaacccccagcagcctgcctag

SEQ ID NO: 155991 - DNA, 8133 bp, Artificial Sequence
  Description of Artificial Sequence: Synthetic coding sequence
atgtctgacaagatgagcagcttcctgcacatcggggacatctgcagcctgtatgcagagggcagcaccaacggcttcatcagcaccctgggcctggtggatgacagatgtgtggtgcagcctgagactggagacctgaacaacccccccaagaagttccgggactgcctcttcaagctgtgccccatgaaccgctacagcgcccagaagcagttctggaaggccgccaagccaggggccaacagcaccacagatgctgtgctgctgaacaagctgcaccacgccgctgacctggagaagaagcagaatgaaacagagaacaggaagctgctgggcaccgtcatccagtatggaaatgtcatccagctgctgcacctgaagagcaacaagtacctgactgtgaacaagaggctgcctgccctgctggagaagaatgccatgagggtgaccctggatgaggccggaaatgaaggctcctggttctacatccagcccttctacaagctgcggagcatcggggacagcgtggtgattggagacaaggtggtgctgaaccctgtgaatgccggccagcccctgcacgccagcagccaccagctggtggacaaccctggctgcaatgaggtgaacagcgtgaactgcaacacctcctggaagatcgtgctcttcatgaagtggagcgacaacaaggatgacatcctgaagggaggagatgtggtgcggctcttccacgccgagcaggagaagttcctgacctgtgatgagcacaggaagaagcagcacgtgttcctgcggaccaccggccggcagagcgccaccagcgccaccagcagcaaggccctgtgggaggtggaggtggtgcagcacgacccctgccggggcggggccggctactggaacagcctcttccgcttcaagcacctggccaccggccactacctggccgctgaggtggaccctgactttgaggaggagtgcctggagttccagcccagcgtggaccctgaccaggatgccagccgcagccggctgagaaatgcccaggagaagatggtgtacagcctggtgtctgtgcctgagggcaatgacatcagcagcatctttgagctggaccccaccaccctgcggggcggggacagcctggtgcccaggaacagctatgtgcggctgcggcacctgtgcaccaacacctgggtgcacagcaccaacatccccatcgacaaggaggaggagaagcctgtgatgctgaagattggcaccagccctgtgaaggaggacaaggaggcctttgccatcgtgcctgtgtccccagctgaggtgcgggacctggactttgccaatgatgccagcaaggtgctgggcagcattgctgggaagctggagaagggcaccatcacccagaatgaaagaagatctgtgaccaagctgctggaggacctggtgtactttgtgactggaggcaccaacagcggccaggatgtgctggaggtggtgttcagcaagcccaaccgggagcggcagaagctgatgagggagcagaacatcctgaagcagatcttcaagctgctgcaggcccccttcacagactgtggagatggccccatgctgcggctggaggagctgggggaccagagacatgcccccttccgccacatctgccgcctgtgctacagagtgctgcggcacagccagcaggactacaggaagaaccaggagtacatcgccaagcagtttggcttcatgcagaagcagatcggctatgatgtgctggccgaggacaccatcacagccctgctgcacaacaacaggaagctgctggagaagcacatcacagctgctgagattgacacctttgtgtccctggtgaggaagaaccgggagccccgcttcctggactacctgagtgacctgtgtgtgtccatgaacaagagcatccctgtgacccaggagctgatctgcaaggctgtgctgaaccccaccaatgctgacatcctgattgagaccaagctggtgctgagcagatttgaatttgaaggagtgagcagcactggagaaaatgccctggaggccggggaggatgaggaggaggtgtggctgttctggagggacagcaacaaggagatccgcagcaagtctgtgcgggagctggcccaggatgccaaggagggccagaaggaggacagagatgtgctgagctactaccgctaccagctgaacctgtttgccaggatgtgcctggaccggcagtacctggccatcaatgagatcagcggccagctggatgtggacctgatcctgcgctgcatgtctgatgagaacctgccctatgacctgcgggccagcttctgccgcctgatgctgcacatgcacgtggaccgggacccccaggagcaggtgacccctgtgaagtatgcccggctgtggagcgagatccccagcgagatcgccattgatgattatgacagcagcggggccagcaaggatgagatcaaggagagatttgcccagaccatggagtttgtggaggagtacctgagagatgtggtgtgccagcgcttccccttcagtgacaaggagaagaacaagctgacctttgaggtggtgaacctggccaggaacctgatctacttcggcttctacaacttcagtgacctgctgcggctgaccaagatcctgctggccatcctggactgtgtgcacgtgaccaccatcttccccatcagcaagatggccaagggggaggagaacaagggcagcaatgtgatgaggagcatccacggcgtgggggagctgatgacccaggtggtgctgcggggcggcggcttcctgcccatgacccccatggccgccgcccctgagggcaatgtgaagcaggccgagcctgagaaggaggacatcatggtgatggacaccaagctgaagatcatcgagatcctgcagttcatcctgaatgtgcggctggactaccgcatcagctgcctgctgtgcatcttcaagcgggagtttgatgagagcaacagccagaccagcgagaccagcagcggcaacagcagccaggagggccccagcaatgtgcctggggccctggactttgagcacatcgaggagcaggccgagggcatctttggaggcagcgaggagaacacccccctggacctggatgaccacggcggccgcaccttcctgcgggtgctgctgcacctgaccatgcatgactacccacccctggtgtctggggccctgcagctgctcttccgccacttcagccagaggcaggaggtgctgcaggccttcaagcaggtgcagctgctggtgaccagccaggatgtggacaactacaagcagatcaagcaggacctggaccagctgcggagcatcgtggagaagtctgagctgtgggtgtacaagggccagggcccagatgagaccatggatggagccagcggggagaatgagcacaagaagacagaggagggcaacaacaagccccagaagcatgagagcaccagcagctacaactacagagtggtgaaggagatcctgatccggctgagcaagctgtgtgtgcaggagagcgcctctgtgaggaagagcaggaagcagcagcagaggctgctgaggaacatgggcgcccatgctgtggtgctggagctgctgcagatcccctatgagaaggccgaggacaccaagatgcaggagatcatgaggctggcccacgagttcctgcagaacttctgtgccggcaaccagcagaaccaggccctgctgcacaagcacatcaacctcttcctgaaccctggcatcctggaggccgtgaccatgcagcacatcttcatgaacaacttccagctgtgcagcgagatcaatgaaagagtggtgcagcactttgtgcactgcatcgagacccatggaagaaatgtgcagtacatcaagttcctgcagaccatcgtgaaggccgagggcaagttcatcaagaagtgccaggacatggtgatggccgagctggtgaacagcggggaggatgtgctggtgttctacaatgaccgggccagcttccagaccctcatccagatgatgaggtctgagcgggacaggatggatgagaacagccccctgatgtaccacatccacctggtggagctgctggccgtgtgcacagagggcaagaatgtgtacacagagatcaagtgcaacagcctgctgcccctggatgacatcgtgcgggtggtgacccatgaggactgcatccctgaggtgaagatcgcctacatcaacttcctgaaccactgctacgtggacacagaggtggagatgaaggagatctacaccagcaaccacatgtggaagctgtttgagaacttcctggtggacatctgccgggcctgcaacaacaccagtgacaggaagcatgctgacagcatcctggagaagtatgtgacagagatcgtgatgagcatcgtgaccaccttcttcagcagccccttcagtgaccagagcaccaccctgcagacccggcagcctgtgtttgtgcagctgctgcagggcgtcttccgggtgtaccactgcaactggctgatgcccagccagaaggcctctgtggagagctgcatccgggtgctgagtgatgtggccaagagccgggccatcgccatccctgtggacctggacagccaggtgaacaacctcttcctgaagagccacagcatcgtgcagaagacagccatgaactggaggctgagcgccagaaatgctgcccggcgggacagcgtgctggccgccagccgggactacagaaacatcatcgagcggctgcaggacatcgtgtctgccctggaggaccggctgcggcccctggtgcaggccgagctgtctgtgctggtggatgtgctgcacaggcctgagctgctcttcccagaaaatacagatgcccggaggaaatgtgagagcggcggcttcatctgcaagctgatcaagcacaccaagcagctgctggaggagaatgaggagaagctgtgcatcaaggtgctgcagaccctgcgggagatgatgaccaaggaccggggctatggagagaagggggaggccctgcggcaggtgctggtgaaccgctactatggaaatgtgcggcccagcggcagaagagagagcctgaccagctttggaaatggccccctgtctgctgggggccctgggaagccaggcggcggcggcggcggcagcggcagcagctccatgagcagaggagagatgagcctggccgaggtgcagtgccacctggacaaggagggcgccagcaacctggtgattgacctgatcatgaatgccagcagtgacagagtcttccacgagagcatcctgctggccatcgccctgctggagggcggcaacaccaccatccagcacagcttcttctgccgcctgacagaggacaagaagtctgagaagttcttcaaggtgttctatgacaggatgaaggtggcccagcaggagatcaaggccaccgtgacagtgaacaccagtgacctgggcaacaagaagaaggatgatgaggtggacagagatgcccccagcaggaagaaggccaaggagcccaccacccagatcacagaggaggtgcgggaccagctgctggaggccagcgctgccaccaggaaggccttcaccaccttcagaagagaggccgaccctgatgaccactaccagcccggggagggcacccaggccacagctgacaaggccaaggatgacctggagatgtctgctgtgatcaccatcatgcagcccatcctgcgcttcctgcagctgctgtgtgagaaccacaacagagacctgcagaacttcctgcgctgccagaacaacaagaccaactacaacctggtgtgtgagaccctgcagttcctggactgcatctgtggcagcaccactggaggcctgggcctgctgggcctgtacatcaatgagaagaatgtggccctgatcaaccagaccctggagagcctgacagagtactgccagggcccctgccacgagaaccagaactgcatcgccacccatgagagcaatggaattgacatcatcacagccctgatcctgaatgacatcaaccccctgggcaagaagaggatggacctggtgctggagctgaagaacaatgccagcaagctgctgctggccatcatggagagcagacatgacagtgaaaatgctgagcgcatcctgtacaacatgaggcccaaggagctggtggaggtgatcaagaaggcctacatgcagggcgaggtggagtttgaagatggagaaaatggagaagatggagctgccagccccagaaatgtgggccacaacatctacatcctggcccaccagctggcccggcacaacaaggagctgcagagcatgctgaagccaggcggccaggtggatggagatgaggccctggagttctacgccaagcacacagcccagatcgagatcgtgcggctggacaggaccatggagcagatcgtgtttcctgtgcccagcatctgtgagttcctgaccaaggagagcaagctgcgcatctactacaccacagaaagagatgagcagggcagcaagatcaatgacttcttcctgcggtctgaggacctcttcaatgagatgaactggcagaagaagctgcgggcccagcctgtgctgtactggtgtgccaggaacatgtccttctggagcagcatctccttcaacctggccgtgctgatgaacctgctggtggccttcttctaccccttcaagggcgtgcggggcggcaccctggagccccactggagcggcctgctgtggacagccatgctgatcagcctggccatcgtgattgccctgcccaagccccacggcatccgggccctgattgccagcaccatcctgcggctcatcttctctgtgggcctgcagcccaccctcttcctgctgggcgccttcaacgtgtgcaacaagatcatcttcctgatgagctttgtgggcaactgtggcaccttcacccggggctaccgggccatggtgctggatgtggagttcctgtaccacctgctgtacctggtgatctgtgccatgggcctgtttgtgcatgagttcttctacagcctgctgctgtttgacctggtgtaccgggaggagaccctgctgaatgtcatcaagtctgtgaccagaaatggccgcagcatcatcctgacagctgtgctggccctgatcctggtgtacctgttcagcatcgtgggctacctgttcttcaaggatgacttcatcctggaggtggaccggctgcccaatgaaacagctgtgcctgagactggagagagcctggccagcgagttcctgttcagtgatgtgtgccgggtggagagcggggagaactgcagcagccctgccccccgggaggagctggtgcctgctgaggagacagagcaggacaaggagcacacctgtgagaccctgctgatgtgcatcgtgacagtgctgagccacggcctgcggagcggcggcggcgtgggagatgtgctgaggaagcccagcaaggaggagcccctgtttgctgcccgggtcatctatgacctgctcttcttcttcatggtgatcatcatcgtgctgaacctgatctttggagtcatcatcgacacctttgctgacctgcggtctgagaagcagaagaaggaggagatcctgaagaccacctgcttcatctgtggcctggagcgggacaagtttgacaacaagacagtgacctttgaggagcacatcaaggaggagcacaacatgtggcactacctgtgcttcatcgtgctggtgaaggtgaaggacagcacagagtacacaggccctgagagctatgtggccgagatgatcaaggagaggaacctggactggttccccaggatgagggccatgagcctggtgtccagtgacagcgagggggagcagaatgagctgaggaacctgcaggagaagctggagagcaccatgaagctggtgaccaacctgagcggccagctgtctgagctgaaggaccagatgacagagcagaggaagcagaagcagagaattggcctgctgggccaccccccccacatgaatgtgaacccccagcagcctgcctag

SEQ ID NO: 155992 - DNA, 8133 bp, Artificial Sequence
  Description of Artificial Sequence: Synthetic coding sequence
atgtctgacaagatgagcagcttcctgcacatcggggacatctgcagcctgtatgcagagggcagcaccaacggcttcatcagcaccctgggcctggtggatgacagatgtgtggtgcagcctgagactggagacctgaacaacccccccaagaagttccgggactgcctcttcaagctgtgccccatgaaccgctacagcgcccagaagcagttctggaaggccgccaagccaggggccaacagcaccacagatgctgtgctgctgaacaagctgcaccacgccgctgacctggagaagaagcagaatgaaacagagaacaggaagctgctgggcaccgtcatccagtatggaaatgtcatccagctgctgcacctgaagagcaacaagtacctgactgtgaacaagaggctgcctgccctgctggagaagaatgccatgagggtgaccctggatgaggccggaaatgaaggctcctggttctacatccagcccttctacaagctgcggagcatcggggacagcgtggtgattggagacaaggtggtgctgaaccctgtgaatgccggccagcccctgcacgccagcagccaccagctggtggacaaccctggctgcaatgaggtgaacagcgtgaactgcaacacctcctggaagatcgtgctcttcatgaagtggagcgacaacaaggatgacatcctgaagggaggagatgtggtgcggctcttccacgccgagcaggagaagttcctgacctgtgatgagcacaggaagaagcagcacgtgttcctgcggaccaccggccggcagagcgccaccagcgccaccagcagcaaggccctgtgggaggtggaggtggtgcagcacgacccctgccggggcggggccggctactggaacagcctcttccgcttcaagcacctggccaccggccactacctggccgctgaggtggaccctgactttgaggaggagtgcctggagttccagcccagcgtggaccctgaccaggatgccagccgcagccggctgagaaatgcccaggagaagatggtgtacagcctggtgtctgtgcctgagggcaatgacatcagcagcatctttgagctggaccccaccaccctgcggggcggggacagcctggtgcccaggaacagctatgtgcggctgcggcacctgtgcaccaacacctgggtgcacagcaccaacatccccatcgacaaggaggaggagaagcctgtgatgctgaagattggcaccagccctgtgaaggaggacaaggaggcctttgccatcgtgcctgtgtccccagctgaggtgcgggacctggactttgccaatgatgccagcaaggtgctgggcagcattgctgggaagctggagaagggcaccatcacccagaatgaaagaagatctgtgaccaagctgctggaggacctggtgtactttgtgactggaggcaccaacagcggccaggatgtgctggaggtggtgttcagcaagcccaaccgggagcggcagaagctgatgagggagcagaacatcctgaagcagatcttcaagctgctgcaggcccccttcacagactgtggagatggccccatgctgcggctggaggagctgggggaccagagacatgcccccttccgccacatctgccgcctgtgctacagagtgctgcggcacagccagcaggactacaggaagaaccaggagtacatcgccaagcagtttggcttcatgcagaagcagatcggctatgatgtgctggccgaggacaccatcacagccctgctgcacaacaacaggaagctgctggagaagcacatcacagctgctgagattgacacctttgtgtccctggtgaggaagaaccgggagccccgcttcctggactacctgagtgacctgtgtgtgtccatgaacaagagcatccctgtgacccaggagctgatctgcaaggctgtgctgaaccccaccaatgctgacatcctgattgagaccaagctggtgctgagcagatttgaatttgaaggagtgagcagcactggagaaaatgccctggaggccggggaggatgaggaggaggtgtggctgttctggagggacagcaacaaggagatccgcagcaagtctgtgcgggagctggcccaggatgccaaggagggccagaaggaggacagagatgtgctgagctactaccgctaccagctgaacctgtttgccaggatgtgcctggaccggcagtacctggccatcaatgagatcagcggccagctggatgtggacctgatcctgcgctgcatgtctgatgagaacctgccctatgacctgcgggccagcttctgccgcctgatgctgcacatgcacgtggaccgggacccccaggagcaggtgacccctgtgaagtatgcccggctgtggagcgagatccccagcgagatcgccattgatgattatgacagcagcggggccagcaaggatgagatcaaggagagatttgcccagaccatggagtttgtggaggagtacctgagagatgtggtgtgccagcgcttccccttcagtgacaaggagaagaacaagctgacctttgaggtggtgaacctggccaggaacctgatctacttcggcttctacaacttcagtgacctgctgcggctgaccaagatcctgctggccatcctggactgtgtgcacgtgaccaccatcttccccatcagcaagatggccaagggggaggagaacaagggcagcaatgtgatgaggagcatccacggcgtgggggagctgatgacccaggtggtgctgcggggcggcggcttcctgcccatgacccccatggccgccgcccctgagggcaatgtgaagcaggccgagcctgagaaggaggacatcatggtgatggacaccaagctgaagatcatcgagatcctgcagttcatcctgaatgtgcggctggactaccgcatcagctgcctgctgtgcatcttcaagcgggagtttgatgagagcaacagccagaccagcgagaccagcagcggcaacagcagccaggagggccccagcaatgtgcctggggccctggactttgagcacatcgaggagcaggccgagggcatctttggaggcaggaaagaaaacacccccctggacctggatgaccacggcggccgcaccttcctgcgggtgctgctgcacctgaccatgcatgactacccacccctggtgtctggggccctgcagctgctcttccgccacttcagccagaggcaggaggtgctgcaggccttcaagcaggtgcagctgctggtgaccagccaggatgtggacaactacaagcagatcaagcaggacctggaccagctgcggagcatcgtggagaagtctgagctgtgggtgtacaagggccagggcccagatgagaccatggatggagccagcggggagaatgagcacaagaagacagaggagggcaacaacaagccccagaagcatgagagcaccagcagctacaactacagagtggtgaaggagatcctgatccggctgagcaagctgtgtgtgcaggagagcgcctctgtgaggaagagcaggaagcagcagcagaggctgctgaggaacatgggcgcccatgctgtggtgctggagctgctgcagatcccctatgagaaggccgaggacaccaagatgcaggagatcatgaggctggcccacgagttcctgcagaacttctgtgccggcaaccagcagaaccaggccctgctgcacaagcacatcaacctcttcctgaaccctggcatcctggaggccgtgaccatgcagcacatcttcatgaacaacttccagctgtgcagcgagatcaatgaaagagtggtgcagcactttgtgcactgcatcgagacccatggaagaaatgtgcagtacatcaagttcctgcagaccatcgtgaaggccgagggcaagttcatcaagaagtgccaggacatggtgatggccgagctggtgaacagcggggaggatgtgctggtgttctacaatgaccgggccagcttccagaccctcatccagatgatgaggtctgagcgggacaggatggatgagaacagccccctgatgtaccacatccacctggtggagctgctggccgtgtgcacagagggcaagaatgtgtacacagagatcaagtgcaacagcctgctgcccctggatgacatcgtgcgggtggtgacccatgaggactgcatccctgaggtgaagatcgcctacatcaacttcctgaaccactgctacgtggacacagaggtggagatgaaggagatctacaccagcaaccacatgtggaagctgtttgagaacttcctggtggacatctgccgggcctgcaacaacaccagtgacaggaagcatgctgacagcatcctggagaagtatgtgacagagatcgtgatgagcatcgtgaccaccttcttcagcagccccttcagtgaccagagcaccaccctgcagacccggcagcctgtgtttgtgcagctgctgcagggcgtcttccgggtgtaccactgcaactggctgatgcccagccagaaggcctctgtggagagctgcatccgggtgctgagtgatgtggccaagagccgggccatcgccatccctgtggacctggacagccaggtgaacaacctcttcctgaagagccacagcatcgtgcagaagacagccatgaactggaggctgagcgccagaaatgctgcccggcgggacagcgtgctggccgccagccgggactacagaaacatcatcgagcggctgcaggacatcgtgtctgccctggaggaccggctgcggcccctggtgcaggccgagctgtctgtgctggtggatgtgctgcacaggcctgagctgctcttcccagaaaatacagatgcccggaggaaatgtgagagcggcggcttcatctgcaagctgatcaagcacaccaagcagctgctggaggagaatgaggagaagctgtgcatcaaggtgctgcagaccctgcgggagatgatgaccaaggaccggggctatggagagaagggggaggccctgcggcaggtgctggtgaaccgctactatggaaatgtgcggcccagcggcagaagagagagcctgaccagctttggaaatggccccctgtctgctgggggccctgggaagccaggcggcggcggcggcggcagcggcagcagctccatgagcagaggagagatgagcctggccgaggtgcagtgccacctggacaaggagggcgccagcaacctggtgattgacctgatcatgaatgccagcagtgacagagtcttccacgagagcatcctgctggccatcgccctgctggagggcggcaacaccaccatccagcacagcttcttctgccgcctgacagaggacaagaagtctgagaagttcttcaaggtgttctatgacaggatgaaggtggcccagcaggagatcaaggccaccgtgacagtgaacaccagtgacctgggcaacaagaagaaggatgatgaggtggacagagatgcccccagcaggaagaaggccaaggagcccaccacccagatcacagaggaggtgcgggaccagctgctggaggccagcgctgccaccaggaaggccttcaccaccttcagaagagaggccgaccctgatgaccactaccagcccggggagggcacccaggccacagctgacaaggccaaggatgacctggagatgtctgctgtgatcaccatcatgcagcccatcctgcgcttcctgcagctgctgtgtgagaaccacaacagagacctgcagaacttcctgcgctgccagaacaacaagaccaactacaacctggtgtgtgagaccctgcagttcctggactgcatctgtggcagcaccactggaggcctgggcctgctgggcctgtacatcaatgagaagaatgtggccctgatcaaccagaccctggagagcctgacagagtactgccagggcccctgccacgagaaccagaactgcatcgccacccatgagagcaatggaattgacatcatcacagccctgatcctgaatgacatcaaccccctgggcaagaagaggatggacctggtgctggagctgaagaacaatgccagcaagctgctgctggccatcatggagagcagacatgacagtgaaaatgctgagcgcatcctgtacaacatgaggcccaaggagctggtggaggtgatcaagaaggcctacatgcagggcgaggtggagtttgaagatggagaaaatggagaagatggagctgccagccccagaaatgtgggccacaacatctacatcctggcccaccagctggcccggcacaacaaggagctgcagagcatgctgaagccaggcggccaggtggatggagatgaggccctggagttctacgccaagcacacagcccagatcgagatcgtgcggctggacaggaccatggagcagatcgtgtttcctgtgcccagcatctgtgagttcctgaccaaggagagcaagctgcgcatctactacaccacagaaagagatgagcagggcagcaagatcaatgacttcttcctgcggtctgaggacctcttcaatgagatgaactggcagaagaagctgcgggcccagcctgtgctgtactggtgtgccaggaacatgtccttctggagcagcatctccttcaacctggccgtgctgatgaacctgctggtggccttcttctaccccttcaagggcgtgcggggcggcaccctggagccccactggagcggcctgctgtggacagccatgctgatcagcctggccatcgtgattgccctgcccaagccccacggcatccgggccctgattgccagcaccatcctgcggctcatcttctctgtgggcctgcagcccaccctcttcctgctgggcgccttcaacgtgtgcaacaagatcatcttcctgatgagctttgtgggcaactgtggcaccttcacccggggctaccgggccatggtgctggatgtggagttcctgtaccacctgctgtacctggtgatctgtgccatgggcctgtttgtgcatgagttcttctacagcctgctgctgtttgacctggtgtaccgggaggagaccctgctgaatgtcatcaagtctgtgaccagaaatggccgcagcatcatcctgacagctgtgctggccctgatcctggtgtacctgttcagcatcgtgggctacctgttcttcaaggatgacttcatcctggaggtggaccggctgcccaatgaaacagctgtgcctgagactggagagagcctggccagcgagttcctgttcagtgatgtgtgccgggtggagagcggggagaactgcagcagccctgccccccgggaggagctggtgcctgctgaggagacagagcaggacaaggagcacacctgtgagaccctgctgatgtgcatcgtgacagtgctgagccacggcctgcggagcggcggcggcgtgggagatgtgctgaggaagcccagcaaggaggagcccctgtttgctgcccgggtcatctatgacctgctcttcttcttcatggtgatcatcatcgtgctgaacctgatctttggagtcatcatcgacacctttgctgacctgcggtctgagaagcagaagaaggaggagatcctgaagaccacctgcttcatctgtggcctggagcgggacaagtttgacaacaagacagtgacctttgaggagcacatcaaggaggagcacaacatgtggcactacctgtgcttcatcgtgctggtgaaggtgaaggacagcacagagtacacaggccctgagagctatgtggccgagatgatcaaggagaggaacctggactggttccccaggatgagggccatgagcctggtgtccagtgacagcgagggggagcagaatgagctgaggaacctgcaggagaagctggagagcaccatgaagctggtgaccaacctgagcggccagctgtctgagctgaaggaccagatgacagagcagaggaagcagaagcagagaattggcctgctgggccaccccccccacatgaatgtgaacccccagcagcctgcctag

SEQ ID NO: 155993 - DNA, 3615 bp, Artificial Sequence
  Description of Artificial Sequence: Synthetic coding sequence
caggagcccggccactgccacagccggggccctggccagcccagccagcagcccctgagccaggtgccccagcactgtgccgaggccatgaactggaggctgagcgccagaaatgctgcccggcgggacagcgtgctggccgccagccgggactacagaaacatcatcgagcggctgcaggacatcgtgtctgccctggaggaccggctgcggcccctggtgcaggccgagctgtctgtgctggtggatgtgctgcacaggcctgagctgctcttccctgagaacacagatgcccggaggaaatgtgagagcggcggcttcatctgcaagctgatcaagcacaccaagcagctgctggaggagaatgaggagaagctgtgcatcaaggtgctgcagaccctgcgggagatgatgaccaaggaccggggctacggggagaagctgatcagcattgatgagctggacaatgctgagctgcccccagccccagattctgaaaatgccacagaggagctggagcccagcccccccctgcggcagctggaggaccacaagagaggagaggccctgcggcaggtgctggtgaaccgctactatggaaatgtgcggcccagcggcagaagagagagcctgaccagctttggaaatggccccctgtctgctgggggccctgggaagccaggcggcggcggcggcggcagcggcagcagctccatgagcagaggagagatgagcctggccgaggtgcagtgccacctggacaaggagggcgccagcaacctggtgattgacctgatcatgaatgccagcagtgacagagtcttccacgagagcatcctgctggccatcgccctgctggagggcggcaacaccaccatccagcacagcttcttctgccgcctgacagaggacaagaagtctgagaagttcttcaaggtgttctatgacaggatgaaggtggcccagcaggagatcaaggccaccgtgacagtgaacaccagtgacctgggcaacaagaagaaggatgatgaggtggacagagatgcccccagcaggaagaaggccaaggagcccaccacccagatcacagaggaggtgcgggaccagctgctggaggccagcgctgccaccaggaaggccttcaccaccttcagaagagaggccgaccctgatgaccactaccagcccggggagggcacccaggccacagctgacaaggccaaggatgacctggagatgtctgctgtgatcaccatcatgcagcccatcctgcgcttcctgcagctgctgtgtgagaaccacaacagagacctgcagaacttcctgcgctgccagaacaacaagaccaactacaacctggtgtgtgagaccctgcagttcctggactgcatctgtggcagcaccactggaggcctgggcctgctgggcctgtacatcaatgagaagaatgtggccctgatcaaccagaccctggagagcctgacagagtactgccagggcccctgccacgagaaccagaactgcatcgccacccatgagagcaatggaattgacatcatcacagccctgatcctgaatgacatcaaccccctgggcaagaagaggatggacctggtgctggagctgaagaacaatgccagcaagctgctgctggccatcatggagagcagacatgacagtgaaaatgctgagcgcatcctgtacaacatgaggcccaaggagctggtggaggtgatcaagaaggcctacatgcagggcgaggtggagtttgaagatggagaaaatggagaagatggagctgccagccccagaaatgtgggccacaacatctacatcctggcccaccagctggcccggcacaacaaggagctgcagagcatgctgaagccaggcggccaggtggatggagatgaggccctggagttctacgccaagcacacagcccagatcgagatcgtgcggctggacaggaccatggagcagatcgtgtttcctgtgcccagcatctgtgagttcctgaccaaggagagcaagctgcgcatctactacaccacagaaagagatgagcagggcagcaagatcaatgacttcttcctgcggtctgaggacctcttcaatgagatgaactggcagaagaagctgcgggcccagcctgtgctgtactggtgtgccaggaacatgtccttctggagcagcatctccttcaacctggccgtgctgatgaacctgctggtggccttcttctaccccttcaagggcgtgcggggcggcaccctggagccccactggagcggcctgctgtggacagccatgctgatcagcctggccatcgtgattgccctgcccaagccccacggcatccgggccctgattgccagcaccatcctgcggctcatcttctctgtgggcctgcagcccaccctcttcctgctgggcgccttcaacgtgtgcaacaagatcatcttcctgatgagctttgtgggcaactgtggcaccttcacccggggctaccgggccatggtgctggatgtggagttcctgtaccacctgctgtacctggtgatctgtgccatgggcctgtttgtgcatgagttcttctacagcctgctgctgtttgacctggtgtaccgggaggagaccctgctgaatgtcatcaagtctgtgaccagaaatggccgcagcatcatcctgacagctgtgctggccctgatcctggtgtacctgttcagcatcgtgggctacctgttcttcaaggatgacttcatcctggaggtggaccggctgcccaatgaaacagctgtgcctgagactggagagagcctggccagcgagttcctgttcagtgatgtgtgccgggtggagagcggggagaactgcagcagccctgccccccgggaggagctggtgcctgctgaggagacagagcaggacaaggagcacacctgtgagaccctgctgatgtgcatcgtgacagtgctgagccacggcctgcggagcggcggcggcgtgggagatgtgctgaggaagcccagcaaggaggagcccctgtttgctgcccgggtcatctatgacctgctcttcttcttcatggtgatcatcatcgtgctgaacctgatctttggagtcatcatcgacacctttgctgacctgcggtctgagaagcagaagaaggaggagatcctgaagaccacctgcttcatctgtggcctggagcgggacaagtttgacaacaagacagtgacctttgaggagcacatcaaggaggagcacaacatgtggcactacctgtgcttcatcgtgctggtgaaggtgaaggacagcacagagtacacaggccctgagagctatgtggccgagatgatcaaggagaggaacctggactggttccccaggatgagggccatgagcctggtgtccagtgacagcgagggggagcagaatgagctgaggaacctgcaggagaagctggagagcaccatgaagctggtgaccaacctgagcggccagctgtctgagctgaaggaccagatgacagagcagaggaagcagaagcagagaattggcctgctgggccaccccccccacatgaatgtgaacccccagcagcctgcctag

SEQ ID NO: 155994 - DNA, 8232 bp, Artificial Sequence; identical to SEQ ID NO: 155988
  Description of Artificial Sequence: Synthetic coding sequence

SEQ ID NO: 155995 - DNA, 8088 bp, Artificial Sequence
  Description of Artificial Sequence: Synthetic coding sequence
atgtctgacaagatgagcagcttcctgcacatcggggacatctgcagcctgtatgcagagggcagcaccaacggcttcatcagcaccctgggcctggtggatgacagatgtgtggtgcagcctgagactggagacctgaacaacccccccaagaagttccgggactgcctcttcaagctgtgccccatgaaccgctacagcgcccagaagcagttctggaaggccgccaagccaggggccaacagcaccacagatgctgtgctgctgaacaagctgcaccacgccgctgacctggagaagaagcagaatgaaacagagaacaggaagctgctgggcaccgtcatccagtatggaaatgtcatccagctgctgcacctgaagagcaacaagtacctgactgtgaacaagaggctgcctgccctgctggagaagaatgccatgagggtgaccctggatgaggccggaaatgaaggctcctggttctacatccagcccttctacaagctgcggagcatcggggacagcgtggtgattggagacaaggtggtgctgaaccctgtgaatgccggccagcccctgcacgccagcagccaccagctggtggacaaccctggctgcaatgaggtgaacagcgtgaactgcaacacctcctggaagatcgtgctcttcatgaagtggagcgacaacaaggatgacatcctgaagggaggagatgtggtgcggctcttccacgccgagcaggagaagttcctgacctgtgatgagcacaggaagaagcagcacgtgttcctgcggaccaccggccggcagagcgccaccagcgccaccagcagcaaggccctgtgggaggtggaggtggtgcagcacgacccctgccggggcggggccggctactggaacagcctcttccgcttcaagcacctggccaccggccactacctggccgctgaggtggaccctgaccaggatgccagccgcagccggctgagaaatgcccaggagaagatggtgtacagcctggtgtctgtgcctgagggcaatgacatcagcagcatctttgagctggaccccaccaccctgcggggcggggacagcctggtgcccagaaattcctatgtgcggctgcggcacctgtgcaccaacacctgggtgcacagcaccaacatccccatcgacaaggaggaggagaagcctgtgatgctgaagattggcaccagccctgtgaaggaggacaaggaggcctttgccatcgtgcctgtgtccccagctgaggtgcgggacctggactttgccaatgatgccagcaaggtgctgggcagcattgctgggaagctggagaagggcaccatcacccagaatgaaagaagatctgtgaccaagctgctggaggacctggtgtactttgtgactggaggcaccaacagcggccaggatgtgctggaggtggtgttcagcaagcccaaccgggagcggcagaagctgatgagggagcagaacatcctgaagcagatcttcaagctgctgcaggcccccttcacagactgtggagatggccccatgctgcggctggaggagctgggggaccagagacatgcccccttccgccacatctgccgcctgtgctacagagtgctgcggcacagccagcaggactacaggaagaaccaggagtacatcgccaagcagtttggcttcatgcagaagcagatcggctatgatgtgctggccgaggacaccatcacagccctgctgcacaacaacaggaagctgctggagaagcacatcacagctgctgagattgacacctttgtgtccctggtgaggaagaaccgggagccccgcttcctggactacctgagtgacctgtgtgtgtccatgaacaagagcatccctgtgacccaggagctgatctgcaaggctgtgctgaaccccaccaatgctgacatcctgattgagaccaagctggtgctgagcagatttgaatttgagggcgtgagcagcactggagaaaatgccctggaggccggagaagatgaggaggaggtgtggctgttctggagggacagcaacaaggagatccgcagcaagtctgtgcgggagctggcccaggatgccaaggagggccagaaggaggacagagatgtgctgagctactaccgctaccagctgaacctgtttgccaggatgtgcctggaccggcagtacctggccatcaatgagatcagcggccagctggatgtggacctgatcctgcgctgcatgtctgatgagaacctgccctatgacctgcgggccagcttctgccgcctgatgctgcacatgcacgtggaccgggacccccaggagcaggtgacccctgtgaagtatgcccggctgtggagcgagatccccagcgagatcgccattgatgattatgacagcagcggggccagcaaggatgagatcaaggagagatttgcccagaccatggagtttgtggaggagtacctgagagatgtggtgtgccagcgcttccccttcagtgacaaggagaagaacaagctgacctttgaggtggtgaacctggccaggaacctgatctacttcggcttctacaacttcagtgacctgctgcggctgaccaagatcctgctggccatcctggactgtgtgcacgtgaccaccatcttccccatcagcaagatggccaagggggaggagaacaagggcagcaatgtgatgaggagcatccatggagtgggggagctgatgacccaggtggtgctgcggggcggcggcttcctgcccatgacccccatggctgctgcccctgagggcaatgtgaagcaggccgagcctgagaaggaggacatcatggtgatggacaccaagctgaagatcatcgagatcctgcagttcatcctgaatgtgcggctggactaccgcatcagctgcctgctgtgcatcttcaagcgggagtttgatgagagcaacagccagaccagcgagaccagcagcggcaacagcagccaggagggccccagcaatgtgcctggggccctggactttgagcacatcgaggagcaggccgagggcatctttggaggcagcgaggagaacacccccctggacctggatgaccatggaggccgcaccttcctgcgggtgctgctgcacctgaccatgcatgactacccacccctggtgtctggggccctgcagctgctcttccgccacttcagccagaggcaggaggtgctgcaggccttcaagcaggtgcagctgctggtgaccagccaggatgtggacaactacaagcagatcaagcaggacctggaccagctgcggagcatcgtggagaagtctgagctgtgggtgtacaagggccagggcccagatgagaccatggatggagccagcggagaaaatgagcacaagaagacagaggagggcaacaacaagccccagaagcatgagagcaccagcagctacaactacagagtggtgaaggagatcctgatccggctgagcaagctgtgtgtgcaggagagcgcctctgtgaggaagagcaggaagcagcagcagaggctgctgaggaacatgggcgcccatgctgtggtgctggagctgctgcagatcccctatgagaaggccgaggacaccaagatgcaggagatcatgaggctggcccacgagttcctgcagaacttctgtgccggcaaccagcagaaccaggccctgctgcacaagcacatcaacctcttcctgaaccctggcatcctggaggccgtgaccatgcagcacatcttcatgaacaacttccagctgtgcagcgagatcaatgaaagagtggtgcagcactttgtgcactgcatcgagacccacggcagaaatgtgcagtacatcaagttcctgcagaccatcgtgaaggccgagggcaagttcatcaagaagtgccaggacatggtgatggccgagctggtgaacagcggagaagatgtgctggtgttctacaatgaccgggccagcttccagaccctcatccagatgatgaggtctgagcgggacaggatggatgagaacagccccctgatgtaccacatccacctggtggagctgctggccgtgtgcacagagggcaagaatgtgtacacagagatcaagtgcaacagcctgctgcccctggatgacatcgtgcgggtggtgacccatgaggactgcatccctgaggtgaagatcgcctacatcaacttcctgaaccactgctacgtggacacagaggtggagatgaaggagatctacaccagcaaccacatgtggaagctgtttgagaacttcctggtggacatctgccgggcctgcaacaacaccagtgacaggaagcacgccgacagcatcctggagaagtatgtgacagaaattgtgatgagcatcgtgaccaccttcttcagcagccccttcagtgaccagagcaccaccctgcagacccggcagcctgtgtttgtgcagctgctgcagggcgtcttccgggtgtaccactgcaactggctgatgcccagccagaaggcctctgtggagagctgcatccgggtgctgagtgatgtggccaagagccgggccatcgccatccctgtggacctggacagccaggtgaacaacctcttcctgaagagccacagcatcgtgcagaagacagccatgaactggaggctgagcgccagaaatgctgcccggcgggacagcgtgctggccgccagccgggactacagaaacatcatcgagcggctgcaggacatcgtgtctgccctggaggaccggctgcggcccctggtgcaggccgagctgtctgtgctggtggatgtgctgcacaggcctgagctgctcttccctgagaacacagatgcccggaggaaatgtgagagcggcggcttcatctgcaagctgatcaagcacaccaagcagctgctggaggagaatgaggagaagctgtgcatcaaggtgctgcagaccctgcgggagatgatgaccaaggaccggggctacggggagaagggggaggccctgcggcaggtgctggtgaaccgctactatggaaatgtgcggcccagcggccggcgggagagcctgaccagctttggaaatggccccctgtctgctgggggccctgggaagccaggcggcggcggcggcggcagcggcagcagctccatgagcagaggagagatgagcctggccgaggtgcagtgccacctggacaaggagggcgccagcaacctggtgattgacctgatcatgaatgccagcagtgacagagtcttccacgagagcatcctgctggccatcgccctgctggagggcggcaacaccaccatccagcacagcttcttctgccgcctgacagaggacaagaagtctgagaagttcttcaaggtgttctatgacaggatgaaggtggcccagcaggagatcaaggccaccgtgacagtgaacaccagtgacctgggcaacaagaagaaggatgatgaggtggacagagatgcccccagcaggaagaaggccaaggagcccaccacccagatcacagaggaggtgcgggaccagctgctggaggccagcgctgccaccaggaaggccttcaccaccttccggcgggaggccgaccctgatgaccactaccagcctggagagggcacccaggccacagctgacaaggccaaggatgacctggagatgtctgctgtgatcaccatcatgcagcccatcctgcgcttcctgcagctgctgtgtgagaaccacaacagagacctgcagaacttcctgcgctgccagaacaacaagaccaactacaacctggtgtgtgagaccctgcagttcctggactgcatctgtggcagcaccaccggcggcctgggcctgctgggcctgtacatcaatgagaagaatgtggccctgatcaaccagaccctggagagcctgacagagtactgccagggcccctgccacgagaaccagaactgcatcgccacccatgagagcaatggcatcgacatcatcacagccctgatcctgaatgacatcaaccccctgggcaagaagaggatggacctggtgctggagctgaagaacaatgccagcaagctgctgctggccatcatggagagcagacatgattctgaaaatgctgagcgcatcctgtacaacatgaggcccaaggagctggtggaggtgatcaagaaggcctacatgcagggcgaggtggagtttgaagatggagaaaatggagaagatggagctgccagccccagaaatgtgggccacaacatctacatcctggcccaccagctggcccggcacaacaaggagctgcagagcatgctgaagccaggcggccaggtggatggagatgaggccctggagttctacgccaagcacacagcccagattgaaattgtgcggctggacaggaccatggagcagatcgtgtttcctgtgcccagcatctgtgagttcctgaccaaggagagcaagctgcgcatctactacaccacagaaagagatgagcagggcagcaagatcaatgacttcttcctgcggagtgaagatctcttcaatgagatgaactggcagaagaagctgcgggcccagcctgtgctgtactggtgtgccaggaacatgtccttctggagcagcatctccttcaacctggccgtgctgatgaacctgctggtggccttcttctaccccttcaagggcgtgcggggcggcaccctggagccccactggagcggcctgctgtggacagccatgctgatcagcctggccatcgtcatcgccctgcccaagccccacggcatccgggccctgattgccagcaccatcctgcggctcatcttctctgtgggcctgcagcccaccctcttcctgctgggcgccttcaacgtgtgcaacaagatcatcttcctgatgagctttgtgggcaactgtggcaccttcacccggggctaccgggccatggtgctggatgtggagttcctgtaccacctgctgtacctggtgatctgtgccatgggcctgtttgtgcatgagttcttctacagcctgctgctgtttgacctggtgtaccgggaggagaccctgctgaatgtcatcaagtctgtgaccagaaatggccgcagcatcatcctgacagctgtgctggccctgatcctggtgtacctgttcagcatcgtgggctacctgttcttcaaggatgacttcatcctggaggtggaccggctgcccaatgaaacagctgtgcctgagaccggggagagcctggccagcgagttcctgttcagtgatgtgtgccgggtggagagcggggagaactgcagcagccctgccccccgggaggagctggtgcctgctgaggagacagagcaggacaaggagcacacctgtgagaccctgctgatgtgcatcgtgacagtgctgagccacggcctgcggagcggcggcggcgtgggagatgtgctgaggaagcccagcaaggaggagcccctgtttgctgcccgggtcatctatgacctgctcttcttcttcatggtgatcatcatcgtgctgaacctgatctttggagtcatcatcgacacctttgctgacctgcggtctgagaagcagaagaaggaggagatcctgaagaccacctgcttcatctgtggcctggagcgggacaagtttgacaacaagacagtgacctttgaggagcacatcaaggaggagcacaacatgtggcactacctgtgcttcatcgtgctggtgaaggtgaaggacagcacagagtacacaggccctgagagctatgtggccgagatgatcaaggagaggaacctggactggttccccaggatgagggccatgagcctggtgtccagtgacagcgagggggagcagaatgagctgaggaacctgcaggagaagctggagagcaccatgaagctggtgaccaacctgagcggccagctgtctgagctgaaggaccagatgacagagcagaggaagcagaagcagagaattggcctgctgggccaccccccccacatgaatgtgaacccccagcagcctgcctag

SEQ ID NO: 155996 - DNA, 2166 bp, Artificial Sequence
  Description of Artificial Sequence: Synthetic coding sequence
atgtctgacaagatgagcagcttcctgcacatcggggacatctgcagcctgtatgcagagggcagcaccaacggcttcatcagcaccctgggcctggtggatgacagatgtgtggtgcagcctgagactggagacctgaacaacccccccaagaagttccgggactgcctcttcaagctgtgccccatgaaccgctacagcgcccagaagcagttctggaaggccgccaagccaggggccaacagcaccacagatgctgtgctgctgaacaagctgcaccacgccgctgacctggagaagaagcagaatgaaacagagaacaggaagctgctgggcaccgtcatccagtatggaaatgtcatccagctgctgcacctgaagagcaacaagtacctgactgtgaacaagaggctgcctgccctgctggagaagaatgccatgagggtgaccctggatgaggccggaaatgaaggctcctggttctacatccagcccttctacaagctgcggagcatcggggacagcgtggtgattggagacaaggtggtgctgaaccctgtgaatgccggccagcccctgcacgccagcagccaccagctggtggacaaccctggctgcaatgaggtgaacagcgtgaactgcaacacctcctggaagatcgtgctcttcatgaagtggagcgacaacaaggatgacatcctgaagggaggagatgtggtgcggctcttccacgccgagcaggagaagttcctgacctgtgatgagcacaggaagaagcagcacgtgttcctgcggaccaccggccggcagagcgccaccagcgccaccagcagcaaggccctgtgggaggtggaggtggtgcagcacgacccctgccggggcggggccggctactggaacagcctcttccgcttcaagcacctggccaccggccactacctggccgctgaggtggaccctgactttgaggaggagtgcctggagttccagcccagcgtgtgcaacaagatcatcttcctgatgagctttgtgggcaactgtggcaccttcacccggggctaccgggccatggtgctggatgtggagttcctgtaccacctgctgtacctggtgatctgtgccatgggcctgtttgtgcatgagttcttctacagcctgctgctgtttgacctggtgtaccgggaggagaccctgctgaatgtcatcaagtctgtgaccagaaatggccgcagcatcatcctgacagctgtgctggccctgatcctggtgtacctgttcagcatcgtgggctacctgttcttcaaggatgacttcatcctggaggtggaccggctgcccaatgaaacagctgtgcctgagaccggggagagcctggccagcgagttcctgttcagtgatgtgtgccgggtggagagcggggagaactgcagcagccctgccccccgggaggagctggtgcctgctgaggagacagagcaggacaaggagcacacctgtgagaccctgctgatgtgcatcgtgacagtgctgagccacggcctgcggagcggcggcggcgtgggagatgtgctgaggaagcccagcaaggaggagcccctgtttgctgcccgggtcatctatgacctgctcttcttcttcatggtgatcatcatcgtgctgaacctgatctttggagtcatcatcgacacctttgctgacctgcggtctgagaagcagaagaaggaggagatcctgaagaccacctgcttcatctgtggcctggagcgggacaagtttgacaacaagacagtgacctttgaggagcacatcaaggaggagcacaacatgtggcactacctgtgcttcatcgtgctggtgaaggtgaaggacagcacagagtacacaggccctgagagctatgtggccgagatgatcaaggagaggaacctggactggttccccaggatgagggccatgagcctggtgtccagtgacagcgagggggagcagaatgagctgaggaacctgcaggagaagctggagagcaccatgaagctggtgaccaacctgagcggccagctgtctgagctgaaggaccagatgacagagcagaggaagcagaagcagagaattggcctgctgggccaccccccccacatgaatgtgaacccccagcagcctgcctag

SEQ ID NO: 155997 - DNA, 546 bp, Artificial Sequence
  Description of Artificial Sequence: Synthetic coding sequence
atgacagagaagatgagcagcttcctgtacatcggggacatcgtgtccctgtatgcagagggctctgtgaatggcttcatcagcaccctgggcctggtggatgacagatgtgtggtgcaccctgaggccggggacctggccaacccccccaagaagttccgggactgcctcttcaaggtgtgccccatgaaccgctacagcgcccagaagcagtactggaaggccaagcaggccaagcagggcaaccacacagaggccgccctgctgaagaagctgcagcacgccgctgagctggagcagaagcagaatgaaagtgagaacaagaagctgctgggggagatcgtgaagtacagcaatgtcatccagctgctgcacatcaagagcaacaagtacctgactgtgaacaagaggctgcctgccctgctggagaagaatgccatgagggtgtccctggatgctgctggaaatgaaggctcctggttctacatccaccccttctggaagctgcggtctgagggggacaatgatgccagcttctggatctag

SEQ ID NO: 155998 - DNA, 8106 bp, Artificial Sequence
  Description of Artificial Sequence: Synthetic coding sequence
atgacagagaagatgagcagcttcctgtacatcggggacatcgtgtccctgtatgcagagggctctgtgaatggcttcatcagcaccctgggcctggtggatgacagatgtgtggtgcaccctgaggccggggacctggccaacccccccaagaagttccgggactgcctcttcaaggtgtgccccatgaaccgctacagcgcccagaagcagtactggaaggccaagcaggccaagcagggcaaccacacagaggccgccctgctgaagaagctgcagcacgccgctgagctggagcagaagcagaatgaaagtgagaacaagaagctgctgggggagatcgtgaagtacagcaatgtcatccagctgctgcacatcaagagcaacaagtacctgactgtgaacaagaggctgcctgccctgctggagaagaatgccatgagggtgtccctggatgctgctggaaatgaaggctcctggttctacatccaccccttctggaagctgcggtctgagggggacaacatcgtggtgggggacaaggtggtgctgatgcctgtgaatgccggccagcccctgcacgccagcaacatcgagctgctggacaaccctggctgcaaggaggtgaatgctgtgaactgcaacacctcctggaagatcaccctcttcatgaagtacagcagctacagagaagatgtgctgaagggaggagatgtggtgcggctcttccacgccgagcaggagaagttcctgacctgtgatgaatatgagaagaagcagcacatcttcctgcggaccaccctgcggcagagcgccaccagcgccaccagcagcaaggccctgtgggagattgaggtggtgcaccacgacccctgccggggcggggccggccagtggaacagcctcttccgcttcaagcacctggccaccggcaactacctggccgctgagctgaacccagactacagagatgcccagaatgaaggcaagaatgtgagagatggagtgccccccaccagcaagaagaagaggcaggccggggagaagatcatgtacaccctggtgtctgtgccccatggaaatgacatcgccagcctgtttgagctggatgccaccaccctgcagagagctgactgcctggtgcccagaaattcctatgtgcggctgcggcacctgtgcaccaacacctgggtgaccagcaccagcatccccatcgacacagatgaggagaggcctgtgatgctgaagattggcacctgccagaccaaggaggacaaggaggcctttgccatcgtgtctgtgcccctgtctgaggtgcgggacctggactttgccaatgatgccaacaaggtgctggccaccaccgtgaagaagctggagaatggcaccatcacccagaatgaaagaagatttgtgaccaagctgctggaggacctgatcttctttgtggctgatgtgcccaacaacggccaggaggtgctggatgtggtgatcaccaagcccaaccgggagcggcagaagctgatgagggagcagaacatcctggcccaggtgtttggcatcctgaaggcccccttcaaggagaaggccggggagggctccatgctgcggctggaggacctgggggaccagagatatgccccctacaagtacatgctgcggctgtgctacagagtgctgcggcacagccagcaggactacaggaagaaccaggagtacatcgccaagaacttctgtgtgatgcagagccagatcggctatgacatcctggccgaggacaccatcacagccctgctgcacaacaacaggaagctgctggagaagcacatcacagccaaggagattgagacctttgtgtccctgctgcggaggaaccgggagccccgcttcctggactacctgagtgacctgtgtgtgagcaacaccacagccatccctgtgacccaggagctgatctgcaagttcatgctgagccctggaaatgctgacatcctgatccagaccaaggtggtgtccatgcaggccgacaaccccatggagagcagcatcctgagtgatgacattgatgatgaggaggtgtggctgtactggattgacagcaacaaggagccccacggcaaggccatccgccacctggcccaggaggccaaggagggcaccaaggctgacctggaggtgctgacctactaccgctaccagctgaacctgtttgccaggatgtgcctggaccggcagtacctggccatcaaccagatcagcacccagctgtctgtggacctgatcctgcgctgtgtgtctgatgagagcctgccctttgacctgcgggccagcttctgccgcctgatgctgcacatgcacgtggaccgggacccccaggagagcgtggtgcctgtgcgctatgcccggctgtggacagagatccccaccaagatcaccatccacgagtatgacagcatcacagacagcagcagaaatgacatgaagaggaagtttgccctgaccatggagtttgtggaggagtacctgaaggaggtggtgaaccagcccttcccctttggagacaaggagaagaacaagctgacctttgaggtggtgcacctggccaggaacctgatctacttcggcttctacagcttcagcgagctgctgcggctgaccaggaccctgctggccatcctggacatcgtgcaggcccccatgagcagctactttgagcggctgagcaagttccaggacggcggcaacaacgtgatgaggaccatccacggcgtgggggagatgatgacccagatggtgctgagccggggcagcatcttccccatgtctgtgcctgatgtgcccccatccatccaccccagcaagcagggcagccccacagaacatgaagatgtgacagtgatggacaccaagctgaagatcatcgagatcctgcagttcatcctgtctgtgcggctggactaccgcatctcctacatgctgagcatctacaagaaggagtttggagaggacaatgacaatgctgagaccagcgccagcggcagcccagacaccctgctgcccagcgccatcgtgcctgacattgatgaaattgctgcccaggccgagaccatgtttgctggcaggaaggagaagaaccctgtgcagctggatgatgaaggaggccgcaccttcctgcgggtgctgatccacctgatcatgcatgactacccacccctgctgagcggggccctgcagctgctcttcaagcacttcagccagagagctgaggtgctgcaggccttcaagcaggtgcagctgctggtgagcaaccaggatgtggacaactacaagcagatcaaggctgacctggaccagctgcggctgactgtggagaagtctgagctgtgggtggagaagagcagcaactatgaaaatggagaaattggagagagccaggtgaagggcggggaggagcccatcgaggagagcaacatcctgagccctgtgcaggacggcaccaagaagccccagattgacagcaacaagagcaacaactacagaattgtgaaggagatcctgatccggctgagcaagctgtgtgtgcagaacaagaagtgcaggaaccagcaccagaggctgctgaagaacatgggcgcccacagcgtggtgctggacctgctgcagatcccctatgagaagaatgatgagaagatgaatgaggtgatgaacctggcccacaccttcctgcagaacttctgccggggcaacccccagaaccaggtgctgctgcacaagcacctgaacctcttcctgaccccaggcctgctggaggccgagaccatgaggcacatcttcatgaacaactaccacctgtgcaatgagatcagcgagcgggtggtgcagcactttgtgcactgcatcgagacccacggccgccacgtggagtacctgcgcttcctgcagaccatcgtgaaggcagatggcaagtatgtgaagaagtgccaggacatggtgatgacagagctgatcaatggaggagaagatgtgctgatcttctacaatgaccgggccagcttccccatcctgctgcacatgatgtgcagcgagcgggacagaggagatgaaagtggccccctggcctaccacatcaccctggtggagctgctggccgcctgcacagagggcaagaatgtgtacacagagatcaagtgcaacagcctgctgcccctggatgacatcgtgcgggtggtgacccatgatgactgcatccctgaggtgaagatcgcctacgtgaactttgtgaaccactgctacgtggacacagaggtggagatgaaggagatctacaccagcaaccacatctggaagctgtttgagaacttcctggtggacatggcccgggtgtgcaacaccaccacagacaggaagcatgctgacatcttcctggagaagtgtgtgacagagagcatcatgaacatcgtgtctggcttcttcaacagccccttcagtgacaacagcaccagcctgcagacccaccagcctgtgttcatccagctgctgcagagcgccttccgcatctacaactgcacctggcccaacccagcccagaaggcctctgtggagagctgcatccgcaccctggccgaggtggccaagaacagaggaattgccatccctgtggacctggacagccaggtgaacaccctcttcatgaagagccacagcaacatggtgcagagagctgccatgggctggaggctgagcgcccggagcggcccccgcttcaaggaggccctgggcggccctgcctgggactacagaaacatcatcgagaagctgcaggatgtggtggccagcctggagcaccagttcagccccatgatgcaggccgagttctctgtgctggtggatgtgctgtacagccctgagctgctcttccctgagggcagtgatgcccgcatccgctgtggggccttcatgagcaagctgatcaaccacaccaagaagctgatggagaaggaggagaagctgtgcatcaagatcctgcagaccctgcgggagatgctggagaagaaggacagctttgtggaggagggcaacaccctgaggaagatcctgctgaaccgctacttcaagggggactacagcattggagtgaatggccacctgagcggggcctacagcaagacagcccaggtgggcggcagcttcagcggccaggacagcgacaagatgggcatctccatgtctgacatccagtgcctgctggacaaggagggcgccagcgagctggtgattgatgtgattgtgaacaccaagaatgaccgcatcttcagcgagggcatcttcctgggcatcgccctgctggagggcggcaacacccagacccagtacagcttctaccagcagctgcacgagcagaagaagtctgagaagttcttcaaggtgctgtatgacaggatgaaggccgcccagaaggagatccgcagcacagtgacagtgaacaccatcgacctgggcaacaagaagagagatgatgacaatgagctgatgaccagcggccccaggatgagggtgcgggacagcaccctgcacctgaaggagggcatgaagggccagctgacagaggccagcagcgccaccagcaaggcctactgtgtgtaccgccgggagatggaccctgagattgacatcatgtgcaccggccctgaggccggcaacacagaggagaagtctgctgaggaggtgaccatgagccctgccatcgccatcatgcagcccatcctgcgcttcctgcagctgctgtgtgagaaccacaaccgggagctgcagaacttcctgaggaaccagaacaacaagaccaactacaacctggtgtgtgagaccctgcagttcctggactgcatctgtggcagcaccactggaggcctgggcctgctgggcctgtacatcaatgagaagaatgtggccctggtgaaccagaacctggagagcctgacagagtactgccagggcccctgccacgagaaccagacctgcatcgccacccatgagagcaatggaattgacatcatcatcgccctgatcctgaatgacatcaaccccctgggcaagtacaggatggacctggtgctgcagctgaagaacaatgccagcaagctgctgctggccatcatggagagcagacatgacagtgaaaatgctgagcgcatcctcttcaacatgaggccccgggagctggtggatgtgatgaagaatgcctacaaccagggcctggagtgtgaccatggagatgatgagggcggagatgatggagtgagccccaaggatgtgggccacaacatctacatcctggcccaccagctggcccggcacaacaagctgctgcagcagatgctgaagccaggcagtgaccctgatgaaggagatgaggccctgaagtactatgccaaccacacagcccagattgaaattgtgagacatgacaggaccatggagcagatcgtgtttcctgtgcccaacatctgtgagtacctgacccgggagagcaaatgtagagtcttcaacaccacagaaagagatgagcagggcagcaaggtgaatgacttcttccagcagacagaagatctctacaatgagatgaagtggcagaagaagatccggaacaacccagccctcttctggttcagccgccacatcagcctgtggggcagcatctccttcaacctggccgtgttcatcaacctggccgtggccctcttctacccctttggagatgatggagatgagggcaccctgagccccctcttctctgtgctgctgtggattgctgtggccatctgcacctccatgctgttcttcttcagcaagcctgtgggcatccggcccttcctggtgtccatcatgctgcggagcatctacaccatcggcctgggccccaccctcatcctgctgggcgccgccaacctgtgcaacaagatcgtgttcctggtgtcctttgtgggcaacagaggcaccttcacccggggctacagagctgtgatcctggacatggccttcctgtaccacgtggcctacgtgctggtgtgcatgctgggcctgtttgtgcatgagttcttctacagcttcctgctgtttgacctggtgtaccgggaggagaccctgctgaatgtcatcaagtctgtgaccagaaatggccgcagcatcatcctgacagctgtgctggccctgatcctggtgtacctgttcagcatcatcggcttcctgttcctgaaggatgacttcaccatggaggtggaccggctgaagaacagaacacctgtgacaggcagccaccaggtgcccaccatgaccctgaccaccatgatggaggcctgtgccaaggagaactgcagccccaccatcccagccagcaacacagcagatgaggagtatgaagatggcattgaaagaacctgtgacaccctgctgatgtgcatcgtgacagtgctgaaccagggcctgagaaatggaggaggagtgggagatgtgctgcggcggcccagcaaggatgagcccctgtttgctgcccgggtggtgtatgacctgctcttctacttcatcgtcatcatcatcgtgctgaacctgatctttggagtcatcatcgacacctttgctgacctgcggtctgagaagcagaagaaggaggagatcctgaagaccacctgcttcatctgtggcctggagcgggacaagtttgacaacaagacagtgtcctttgaggagcacatcaagtctgagcacaacatgtggcactacctgtacttcatcgtgctggtgaaggtgaaggaccccacagagtacacaggccctgagagctatgtggcccagatgattgtggagaagaacctggactggttccccaggatgagggccatgagcctggtgtccaatgaaggagacagcgagcagaatgagatccgcagcctgcaggagaagctggagagcaccatgagcctggtgaagcagctgagcggccagctggccgagctgaaggagcagatgacagagcagaggaagaacaagcagaggctgggcttcctgggcagcaacacccctcatgtgaaccaccacatgccaccccactag

SEQ ID NO: 155999 - DNA, 8016 bp, Artificial Sequence
  Description of Artificial Sequence: Synthetic coding sequence
atgtctgagatgagcagcttcctgcacatcggggacatcgtgtccctgtatgcagagggctctgtgaatggcttcatcagcaccctgggcctggtggatgacagatgtgtggtggagcctgctgctggggacctggacaacccccccaagaagttccgggactgcctcttcaaggtgtgccccatgaaccgctacagcgcccagaagcagtactggaaggccaagcagaccaagcaggacaaggagaagattgctgatgtggtgctgctgcagaagctgcagcacgccgcccagatggagcagaagcagaatgacacagagaacaagaaggtgcatggagatgtggtgaagtatggcagcgtcatccagctgctgcacatgaagagcaacaagtacctgactgtgaacaagaggctgcctgccctgctggagaagaatgccatgagggtgaccctggatgccactggaaatgaaggctcctggctgttcatccagcccttctggaagctgcggagcaatggagacaacgtggtggtgggggacaaggtgatcctgaaccctgtgaatgccggccagcccctgcacgccagcaactatgagctgagtgacaatgccggctgcaaggaggtgaacagcgtgaactgcaacacctcctggaagatcaacctcttcatgcagttccgggaccacctggaggaggtgctgaagggaggagatgtggtgcggctcttccacgccgagcaggagaagttcctgacctgtgatgagtacaagggcaagctgcaggtgttcctgcggaccaccctgcggcagagcgccaccagcgccaccagcagcaatgccctgtgggaggtggaggtggtgcaccacgacccctgccggggcggggccggccactggaatggcctgtaccgcttcaagcacctggccactggaaactacctggccgctgaggagaaccccagctacaagggagatgccagtgaccccaaggctgctggcatgggcgcccagggccgcactggaagaagaaatgctggggagaagatcaagtactgcctggtggccgtgccccatggaaatgacatcgccagcctgtttgagctggaccccaccaccctgcagaagacagacagctttgtgcccagaaattcctatgtgcggctgcggcacctgtgcaccaacacctggatccagagcaccaacgtgcccattgatattgaggaggagcggcccatccggctgatgctgggcacctgccccaccaaggaggacaaggaggcctttgccatcgtgtctgtgcctgtgtctgagatccgggacctggactttgccaatgatgccagctccatgctggccagcgctgtggagaagctgaatgaaggcttcatcagccagaatgacagaagatttgtgatccagctgctggaggacctggtgttctttgtgtctgatgtgcccaacaacggccagaatgtgctggacatcatggtgaccaagcccaaccgggagcggcagaagctgatgagggagcagaacatcctgaagcaggtgtttggcatcctgaaggcccccttccgggagaagggcggggagggccccctggtgcggctggaggagctgagtgaccagaagaatgccccctaccagcacatgttccggctgtgctacagagtgctgcggcacagccaggaggactacaggaagaaccaggagcacatcgccaagcagtttggcatgatgcagagccagatcggctatgacatcctggccgaggacaccatcacagccctgctgcacaacaacaggaagctgctggagaagcacatcaccaagacagaggtggagacctttgtgtccctggtgaggaagaaccgggagccccgcttcctggactacctgagtgacctgtgtgtgagcaaccacatcgccatccctgtgacccaggagctgatctgcaagtgtgtgctggaccccaagaacagcgacatcctgatcagaacagagctgcggcctgtgaaggagatggcccagagccatgagtacctgagcattgagtacagcgaggaggaggtgtggctgacctggacagacaagaacaatgagcaccacgagaagtctgtgcggcagctggcccaggaggcccgggctggaaatgcccatgatgaaaatgtgctgagctactaccgctaccagctgaagctgtttgccaggatgtgcctggaccggcagtacctggccattgatgagatcagccagcagctgggcgtggacctgatcttcctgtgcatggctgatgagatgctgccctttgacctgcgggccagcttctgccacctgatgctgcacgtgcacgtggaccgggacccccaggagctggtgacccctgtgaagtttgcccggctgtggacagagatccccacagccatcaccatcaaggactatgacagcaacctgaatgccagcagagatgacaagaagaacaagtttgccaacaccatggagtttgtggaggactacctgaacaacgtggtgtctgaggccgtgccctttgccaatgaggagaagaacaagctgacctttgaggtggtgtccctggcccacaacctgatctacttcggcttctacagcttcagcgagctgctgcggctgaccaggaccctgctgggcatcatcgactgtgtgcagggccccccagccatgctgcaggcctatgaggaccccggcggcaagaatgtgcggcgcagcatccagggcgtgggccacatgatgagcaccatggtgctgagcaggaagcagagcgtcttcagcgcccccagcctgtctgctggggccagcgctgctgagcccctggacaggagcaagtttgaggagaatgaagacatcgtggtgatggagaccaagctgaagatcctggagatcctgcagttcatcctgaatgtgcggctggactaccgcatctcctacctgctgagcgtcttcaagaaggagtttgtggaggtgttccccatgcaggacagcggggctgatggaacagccccagcctttgacagcaccacagccaacatgaacctggaccgcatcggggagcaggccgaggccatgtttggagtgggcaagaccagctccatgctggaggtggatgatgaaggaggccgcatgttcctgcgggtgctgatccacctgaccatgcatgactatgcccccctggtgtctggggccctgcagctgctcttcaagcacttcagccagaggcaggaggccatgcacaccttcaagcaggtgcagctgctgatcagcgcccaggatgtggagaactacaaggtgatcaagtctgagctggaccggctgcggaccatggtggagaagtctgagctgtgggtggacaagaagggcagcgggaaaggagaggaggtggaggccggggccgccaaggacaagaaggagcggcccacagatgaggagggcttcctgcaccccccaggagagaagagcagcgagaactaccagatcgtgaagggcatcctggagcggctgaacaagatgtgtggggtgggggagcagatgaggaagaagcagcagaggctgctgaagaacatggatgcccacaaggtgatgctggacctgctgcagatcccctatgacaagggagatgccaagatgatggagatcctgcgctacacccaccagttcctgcagaagttctgtgccggcaaccctggcaaccaggccctgctgcacaagcacctgcacctgttcctgaccccaggcctgctggaggccgagaccatgcagcacatcttcctgaacaactaccagctgtgcagcgagatcagcgagcctgtgctgcagcactttgtgcacctgctggccacccacggccgccacgtgcagtacctggacttcctgcacacagtcatcaaggccgagggcaagtatgtgaagaagtgccaggacatgatcatgacagagctgaccaatgctggagatgatgtggtggtgttctacaatgacaaggccagcctggcccacctgctggacatgatgaaggccgccagagatggagtggaggaccacagccccctgatgtaccacatcagcctggtggacctgctggccgcctgtgccgagggcaagaatgtgtacacagagatcaagtgcaccagcctgctgcccctggaggatgtggtgtctgtggtgacccatgaggactgcatcacagaggtgaagatggcctacgtgaactttgtgaaccactgctacgtggacacagaggtggagatgaaggagatctacaccagcaaccacatctggaccctgtttgagaacttcaccctggacatggcccgggtgtgcagcaagcgggagaagagggtggccgaccccaccctggagaagtatgtgctgtctgtggtgctggacaccatcaatgccttcttcagcagccccttcagcgagaacagcaccagcctgcagacccaccagaccatcgtggtgcagctgctgcagagcaccacccggctgctggagtgcccctggctgcagcagcagcacaagggctctgtggaggcctgcatccgcaccctggccatggtggccaagggccgggccatcctgctgcccatggacctggatgcccacatcagctccatgctgagcagcggggccagctgtgccgctgctgcccagagaaatgccagcagctacaaggccaccacccgggccttcccccgggtgacccccacagccaaccagtgggactacaagaacatcatcgagaagctgcaggacatcatcacagccctggaggagcggctgaagcccctggtgcaggccgagctgtctgtgctggtggatgtgctgcactggccagagctgctcttcctggagggcagcgaggcctaccagagatgtgagagcggcggcttcctgagcaagctgatccagcacaccaaggacctgatggagagcgaggagaagctgtgcatcaaggtgctgcggaccctgcagcagatgctgctgaagaagaccaagtatggagaccggggcaaccagctgaggaagatgctgctgcagaactacctgcagaacaggaagagcaccagcagaggagacctgcctgaccccatcggcaccggcctggaccctgactggagcgccatcgccgccacccagtgccgcctggacaaggagggcgccaccaagctggtgtgtgacctgatcaccagcaccaagaatgagaagatcttccaggagagcatcggcctggccatccacctgctggatggcggcaacacagagatccagaagagcttccacaacctgatgatgtctgacaagaagtctgagcgcttcttcaaggtgctgcatgacaggatgaagagggcccagcaggagaccaagagcacagtggccgtgaacatgaatgacctgggcagccagccccatgaagatcgggagcctgtggaccccaccaccaagggccgggtggccagcttcagcatccctggcagcagcagccgctacagcctgggccccagcctgcggcggggccacgaggtgtctgagcgggtgcagagcagcgagatgggcacctctgtgctgatcatgcagcccatcctgcgcttcctgcagctgctgtgtgagaaccacaacagagacctgcagaacttcctgcgctgccagaacaacaagaccaactacaacctggtgtgtgagaccctgcagttcctggacatcatgtgtggcagcaccactggaggcctgggcctgctgggcctgtacatcaatgaagataatgtgggcctggtgatccagaccctggagaccctgacagagtactgccagggcccctgccacgagaaccagacctgcatcgtgacccatgagagcaatggaattgacatcatcacagccctgatcctgaatgacatcagccccctgtgcaagtacaggatggacctggtgctgcagctgaaggacaatgccagcaagctgctgctggccctgatggagagcagacatgacagtgaaaatgctgagcgcatcctgatcagcctgcggccccaggagctggtggatgtgatcaagaaggcctacctgcaggaggaggagcgggagaacagcgaggtgagcccccgggaggtgggccacaacatctacatcctggccctgcagctgagccgccacaacaagcagctgcagcacctgctgaagcctgtgaagaggatccaggaggaggaggccgagggcatcagctccatgctgagcctgaacaacaagcagctgagccagatgctgaagagcagcgccccagcccaggaggaggaggaggaccccctggcctactatgagaaccacaccagccagatcgagatcgtgcggcaggaccgctccatggagcagatcgtgtttcctgtgcccggcatctgccagttcctgacagaggagaccaagcacaggctcttcaccaccacagagcaggatgagcagggcagcaaggtgtctgacttctttgaccagagcagcttcctgcacaatgagatggagtggcagaggaagctgcgctccatgcccctcatctactggttcagcaggaggatgaccctgtggggcagcatctccttcaacctggccgtgttcatcaacatcatcatcgccttcttctacccctacatggagggcgccagcactggagtgctggacagccccctcatcagcctgctcttctggatcctgatctgcttcagcattgctgccctcttcaccaagcgctacagcatccggcccctgattgtggccctgatcctgcggagcatctactacctgggcatcggccccaccctgaacatcctgggcgccctgaacctgaccaacaagatcgtgtttgtggtgtcctttgtgggcaacagaggcaccttcatccggggctacaaggccatggtgatggacatggagttcctgtaccacgtgggctacatcctgacctctgtgctgggcctgtttgcccacgagctgttctacagcatcctgctgtttgacctgatctaccgggaggagaccctcttcaacgtcatcaagtctgtgaccagaaatggccgcagcatcctgctgacagccctgctggccctgatcctggtgtacctgttcagcatcgtgggcttcctgttcctgaaggatgacttcatcctggaggtggaccggctgcccaacaaccacagcacagccagccccctgggcatgccccacggggctgctgcctttgtggacacctgcagcggggacaagatggactgtgtgtctggcctgtctgtgcctgaggtgctggaggaggaccgggagctggacagcacagagcgggcctgtgacaccctgctgatgtgcatcgtgacagtgatgaaccacggcctgagaaatggaggaggagtgggggacatcctgaggaagcccagcaaggatgagagcctcttccctgcccgggtggtgtatgacctgctcttcttcttcatcgtcatcatcatcgtgctgaacctgatctttggagtcatcatcgacacctttgctgacctgcggtctgagaagcagaagaaggaggagatcctgaagaccacctgcttcatctgtggcctggagcgggacaagtttgacaacaagacagtgtcctttgaggagcacatcaagctggagcacaacatgtggaactacctgtacttcatcgtgctggtgcgggtgaagaacaagacagactacacaggccctgagagctatgtggcccagatgatcaagaacaagaacctggactggttccccaggatgagggccatgagcctggtgtccaatgaaggagagggggagcagaatgagatccgcatcctgcaggacaagctgaacagcaccatgaagctggtgagccacctgacagcccagctgaatgagctgaaggagcagatgacagagcagaggaagaggcggcagaggctgggctttgtggatgtgcagaactgcatcagcaggtag

SEQ ID NO: 156000 - DNA, 1326 bp, Artificial Sequence
  Description of Artificial Sequence: Synthetic coding sequence
atgtgtgtgtgccagaccatggaggtgggccagtatggcaagaatgccagcagagctggggacagaggagtgctgctggagcccttcatccaccaggtgggcggccacagctccatgatgagatatgatgaccacacagtgtgcaagcccctcatcagccgggagcagcgcttctatgagagcctgcccccagagatgaaggagttcaccccagagtacaagggcgtggtgtctgtgtgctttgaaggagacagtgatggctacatcaacctggtggcctacccctacgtggagagcgagaccgtggagcaggatgacaccacagagcgggagcagcccaggaggaagcacagcagaagaagcctgcacaggagcggcagcggcagtgaccacaaggaggagaaggccagcctgagcctggagaccagcgagagcagccaggaggccaagagccccaaggtggagctgcacagccacagcgaggtgcccttccagatgctggatggcaacagcggcctgagcagcgagaagatcagccacaacccctggagcctgcgctgccacaagcagcagctgagcaggatgaggtctgagagcaaggacaggaagctgtacaagttcctgctgctggagaatgtggtgcaccacttcaagtacccctgtgtgctggacctgaagatgggcacccggcagcacggagatgatgccagcgctgagaaggccgcccggcagatgaggaaatgtgagcagagcaccagcgccaccctgggcgtgcgggtgtgtggcatgcaggtgtaccagctggacaccggccactacctgtgcaggaacaagtactacggccggggcctgagcattgagggcttcagaaatgccctgtaccagtacctgcacaacggcctggacctgcggcgggacctgtttgagcccatcctgagcaagctgcggggcctgaaggctgtgctggagcggcaggccagctaccgcttctacagcagcagcctgctggtgatctatgatggcaaggaatgtagagctgagagctgcctggaccggcgctctgagatgaggctgaagcacctggacatggtgctgcctgaggtggccagcagctgtggccccagcaccagccccagcaacaccagccctgaggccggccccagcagccagcccaaggtggatgtgaggatgattgactttgcccacagcaccttcaagggcttcagagatgaccccaccgtgcatgatggccctgaccggggctacgtgtttggcctggagaacctgatcagcatcatggagcagatgagagatgagaaccagtag

SEQ ID NO: 156001 - DNA, 831 bp, Artificial Sequence
  Description of Artificial Sequence: Synthetic coding sequence
atgctggatggcaacagcggcctgagcagcgagaagatcagccacaacccctggagcctgcgctgccacaagcagcagctgagcaggatgaggtctgagagcaaggacaggaagctgtacaagttcctgctgctggagaatgtggtgcaccacttcaagtacccctgtgtgctggacctgaagatgggcacccggcagcacggagatgatgccagcgctgagaaggccgcccggcagatgaggaaatgtgagcagagcaccagcgccaccctgggcgtgcgggtgtgtggcatgcaggtgtaccagctggacaccggccactacctgtgcaggaacaagtactacggccggggcctgagcattgagggcttcagaaatgccctgtaccagtacctgcacaacggcctggacctgcggcgggacctgtttgagcccatcctgagcaagctgcggggcctgaaggctgtgctggagcggcaggccagctaccgcttctacagcagcagcctgctggtgatctatgatggcaaggagtgcagagctgagagctgcctggacagaagaagtgagatgaggctgaagcacctggacatggtgctgcctgaggtggccagcagctgtggccccagcaccagccccagcaacaccagccctgaggccggccccagcagccagcccaaggtggatgtgaggatgattgactttgcccacagcaccttcaagggcttcagagatgaccccaccgtgcatgatggccctgaccggggctacgtgtttggcctggagaacctgatcagcatcatggagcagatgagagatgagaaccagtag

SEQ ID NO: 156002 - DNA, 831 bp, Artificial Sequence; identical to SEQ ID NO: 156001
  Description of Artificial Sequence: Synthetic coding sequence

SEQ ID NO: 156003 - DNA, 1281 bp, Artificial Sequence
  Description of Artificial Sequence: Synthetic coding sequence
atgagccctgccttccgggccatggatgtggagccccgggccaagggcgtgctgctggagccctttgtgcaccaggtgggcggccacagctgtgtgctgcgcttcaatgagaccaccctgtgcaagcccctggtgccccgggagcaccagttctatgagaccctgcctgctgagatgaggaagttcaccccccagtacaagggcgtggtgtctgtgcgctttgaggaggatgaggacaggaacctgtgcctgattgcctaccccctgaagggggaccatggaattgtggacatcgtggacaacagcgactgtgagcccaagagcaagctgctgcgctggaccaccaacaagaagcaccacgtgctggagacagagaagacccccaaggactgggtgcggcagcacaggaaggaggagaagatgaagagccacaagctggaggaggagtttgagtggctgaagaagtctgaggtgctgtactacacagtggagaagaagggcaacatcagcagccagctgaagcactacaacccctggagcatgaagtgccaccagcagcagctgcagaggatgaaggaaaatgccaagcacaggaaccagtacaagttcatcctgctggagaacctgaccagccgctatgaggtgccctgtgtgctggacctgaagatgggcacccggcagcacggagatgatgccagcgaggagaaggccgccaaccagatcaggaagtgccagcagagcaccagcgctgtgattggagtgcgggtgtgtggcatgcaggtgtaccaggccggcagcggccagctgatgttcatgaacaagtaccacggcaggaagctgtctgtgcagggcttcaaggaggccctcttccagttcttccacaacggccgctacctgcggcgggagctgctgggccctgtgctgaagaagctgacagagctgaaggctgtgctggagcggcaggagagctaccgcttctacagcagcagcctgctggtgatctatgatggcaaggagaggcctgaggtggtgctggacagtgatgctgaggacctggaggacctgtctgaggagagcgcagatgaatctgctggggcctatgcctacaagcccatcggggccagctctgtggatgtgaggatgattgactttgcccacaccacctgccgcctgtatggagaggacacagtggtgcatgagggccaggatgctggctacatcttcggcctgcagagcctgattgacatcgtgacagagatcagcgaggagagcggggagtag

SEQ ID NO: 156004 - DNA, 294 bp, Artificial Sequence
  Description of Artificial Sequence: Synthetic coding sequence
atgagccctgccttccgggccatggatgtggagccccgggccaagggcgtgctgctggagccctttgtgcaccaggtgggcggccacagctgtgtgctgcgcttcaatgagaccaccctgtgcaagcccctggtgccccgggagcaccagttctatgagaccctgcctgctgagatgaggaagttcaccccccagtacaagggccagagccagaggcccctggtgtcctggcccagcctgccccacttcttcccctggagcttccccctgtggccccagggctctgtggcctag

SEQ ID NO: 156005 - DNA, 294 bp, Artificial Sequence; identical to SEQ ID NO: 156004
  Description of Artificial Sequence: Synthetic coding sequence

SEQ ID NO: 156006 - DNA, 558 bp, Artificial Sequence
  Description of Artificial Sequence: Synthetic coding sequence
atgagcctgaacctgcctgaggccagcctgctgagccgggcctcctggccagagcaggccaaggagccccggcgggagggccacacagacaagcagcagacagaagatgtgctggccgccggcctgcgctgcctgccccacctgcctgccatctgtgcccggaggatgagccctgccttccgggccatggatgtggagccccgggccaagggcgtgctgctggagccctttgtgcaccaggtgggcggccacagctgtgtgctgcgcttcaatgagaccaccctgtgcaagcccctggtgccccgggagcaccagttctatgagaccctgcctgctgagatgaggaagttcaccccccagtacaagggcaagagccagctgctggagggcctgccccactggagaggagatgtgcgggaccggggccacggccggccctggcagcccagcctggagcccagcctgccccccaccctgtgcttccccagcctgagcagcttcagcagctcctggcccagcgcccagcacctgacccccagcgtcttcaacccctggtag

SEQ ID NO: 156007 - DNA, 264 bp, Artificial Sequence
  Description of Artificial Sequence: Synthetic coding sequence
atgagccctgccttccgggccatggatgtggagccccgggccaagggcgtgctgctggagccctttgtgcaccaggtgggcggccacagctgtgtgctgcgcttcaatgagaccaccctgtgcaagcccctggtgccccgggagcaccagttctatgagaccctgcctgctgagatgaggaagttcaccccccagtacaagggggacatcagcagccaccagcacggcggcgtgtttgtgggggagtggggcagcctgctgtag

SEQ ID NO: 156008 - DNA, 567 bp, Artificial Sequence
  Description of Artificial Sequence: Synthetic coding sequence
atgaacctgtgccagagccccttccaggagggctgccagagcctgctggcctcctggccagagcaggccaaggagccccggcgggagggccacacagacaagcagcagacagaagatgtgctggccgccggcctgcgctgcctgccccacctgcctgccatctgtgcccggaggatgagccctgccttccgggccatggatgtggagccccgggccaagggcgtgctgctggagccctttgtgcaccaggtgggcggccacagctgtgtgctgcgcttcaatgagaccaccctgtgcaagcccctggtgccccgggagcaccagttctatgagaccctgcctgctgagatgaggaagttcaccccccagtacaagggcaagagccagctgctggagggcctgccccactggagaggagatgtgcgggaccggggccacggccggccctggcagcccagcctggagcccagcctgccccccaccctgtgcttccccagcctgagcagcttcagcagctcctggcccagcgcccagcacctgaccccatctgtgttcaacccctggtag

SEQ ID NO: 156009 - DNA, 1233 bp, Artificial Sequence
  Description of Artificial Sequence: Synthetic coding sequence
atggtggtgcagaacagcgcagatgctggggacatgagagctggggtgcagctggagcccttcctgcaccaggtgggcggccacatgtctgtgatgaagtatgatgagcacacagtgtgcaagcccctggtgtcccgggagcagcgcttctatgagagcctgcccctggccatgaagcgcttcaccccccagtacaagggcaccgtgacagtgcacctgtggaaggacagcacaggccacctgagcctggtggccaaccctgtgaaggagagccaggagcccttcaaggtgtccacagaatctgctgctgtggccatctggcagaccctgcagcagaccaccggcagcaatggaagtgactgcaccctggcccagtggccccacgcccagctggcccggagccccaaggagagccctgccaaggccctgctgcggtctgagccccacctgaacaccccagccttcagcctggtggaggacaccaacggcaaccaggtggagaggaagagcttcaacccctggggcctgcagtgccaccaggcccacctgacccggctgtgcagcgagtacccagagaacaagaggcaccgcttcctgctgctggagaatgtggtgtcccagtacacccacccctgtgtgctggacctgaagatgggcacccggcagcacggagatgatgccagcgaggagaagaaggcccggcacatgaggaaatgtgcccagagcaccagcgcctgcctgggcgtgcgcatctgtggcatgcaggtgtaccagacagacaagaagtacttcctgtgcaaggacaagtactacggcaggaagctgtctgtggagggcttccggcaggccctgtaccagttcctgcacaacggcagccacctgcggcgggagctgctggagcccatcctgcaccagctgcgggccctgctgagcgtcatccgcagccagagcagctaccgcttctacagcagcagcctgctggtgatctatgatggccaggagcccccagagcgggcccctggcagcccccacccccatgaggccccccaggccgcccacggcagcagccctgggggcctgaccaaggtggacatccgcatgattgactttgcccacaccacctacaagggctactggaatgagcacaccacctatgatggccctgaccccggctacatcttcggcctggagaacctgatccgcatcctgcaggacatccaggagggggagtag

SEQ ID NO: 156010 - DNA, 1233 bp, Artificial Sequence; identical to SEQ ID NO: 156009
  Description of Artificial Sequence: Synthetic coding sequence

SEQ ID NO: 156011 - DNA, 1080 bp, Artificial Sequence
  Description of Artificial Sequence: Synthetic coding sequence
atggcccccatgggcatccggctgagccccctgggcgtggccgtgttctgcctgctgggcctgggcgtgctgtaccacctgtacagcggcttcctggccggccgcttcagcctgtttggcctgggcggggagcccggcggcggggccgccggccctgctgctgctgctgatggcggcaccgtggacctgcgggagatgctggccgtgtctgtgctggccgctgtgagaggaggagatgaggtgcggcgggtgcgggagagcaatgtgctgcacgagaagagcaagggcaagacccgggagggcgctgaggacaagatgaccagcggagatgtgctgagcaacaggaagatgttctacctgctgaagacagccttccccagcgtgcagatcaacacagaggagcacgtggatgctgctgaccaggaggtgatcctgtgggaccacaagatccctgaggacatcctgaaggaggtgaccacccccaaggaggtgcctgctgagagcgtgacagtgtggattgaccccctggatgccacccaggagtacacagaggacctgaggaaatatgtgaccaccatggtgtgtgtggccgtgaatggcaagcccatgctgggcgtcatccacaagcccttcagcgagtacacagcctgggccatggtggatggcggcagcaatgtgaaggcccggagcagctacaatgagaagaccccaagaattgtggtgagccgcagccacagcggcatggtgaagcaggtggccctgcagacctttggaaaccagaccaccatcatcccagctgggggcgccggctacaaggtgctggccctgctggatgtgcctgacaagagccaggagaaggctgacctgtacatccacgtgacctacatcaagaagtgggacatctgtgctggaaatgccatcctgaaggccctgggcggccacatgaccaccctgtctggagaggagatctcctacacaggcagtgatggcattgaaggaggcctgctggccagcatccgcatgaaccaccaggccctggtgaggaagctgcctgacctggagaagacaggccacaagtag

SEQ ID NO: 156012 - DNA, 1251 bp, Artificial Sequence
  Description of Artificial Sequence: Synthetic coding sequence
atggccacagagccccccagccccctgcgggtggaggcccctggccccccagagatgaggaccagccctgccatcgagagcaccccagagggcaccccccagcctgctgggggccgcctgcgcttcctgaatggctgtgtgcccctgagccaccaggtggccggccacatgtatggcaaggacaaggtgggcatcctgcagcacccagatggcaccgtgctgaagcagctgcagcccccaccccggggcccccgggagctggagttctacaacatggtgtatgctgctgactgctttgatggagtgctgctggagctgaggaagtacctgcccaagtactacggcatctggagccccccaacagccccaaatgacctgtacctgaagctggaggatgtgacccacaagttcaacaagccctgcatcatggatgtgaagattggccagaagagctatgacccctttgccagcagcgagaagatccagcagcaggtgtccaagtaccccctgatggaggagatcggcttcctggtgctgggcatgagggtgtaccacgtgcacagcgacagctatgaaacagagaaccagcactacggccgcagcctgaccaaggagaccatcaaggatggagtgagccgcttcttccacaacggctactgcctgaggaaggatgctgtggccgccagcatccagaagattgagaagatcctgcagtggtttgagaaccagaagcagctgaacttctacgccagcagcctgctgtttgtgtatgagggcagcagccagcccaccaccaccaagctgaatgacaggaccctggccgagaagttcctgagcaagggccagctgagtgacacagaggtgctggagtacaacaacaacttccacgtgctgagcagcacagccaacgggaagattgagagctctgtgggcaagagcctgagcaagatgtatgcccggcacaggaagatctacaccaagaagcaccacagccagaccagcctgaaggtggagaacctggagcaggacaatggctggaagtccatgagccaggagcacctgaatggaaatgtgctgagccagctggagaaggtgttctaccacctgcccaccggctgccaggagattgctgaggtggaggtgaggatgattgactttgcccacgtgttccccagcaacaccattgatgagggctacgtgtatggcctgaagcacctgatctctgtgctgcggagcatcctggacaactag

SEQ ID NO: 156013 - DNA, 3777 bp, Artificial Sequence
  Description of Artificial Sequence: Synthetic coding sequence
atggccagcgcctgtggggcccctggccctgggggcgccctgggcagccaggcccccagctggtaccaccgggacctgagcagagctgctgctgaggagctgctggcccgggccggcagagatggcagcttcctggtgcgggacagcgagagcgtggccggggcctttgccctgtgtgtgctgtaccagaagcacgtgcacacctaccgcatcctgcctgatggagaggacttcctggccgtgcagaccagccagggcgtgcctgtgcggcgcttccagaccctgggggagctgattggcctgtatgcccagcccaaccagggcctggtgtgtgccctgctgctgcctgtggagggggagcgggagccagaccccccagatgacagagatgccagtgatggagaagatgagaagccacccctgccccccaggagcggcagcaccagcatcagcgcccccaccggccccagcagccccctgcctgcccctgagacccccacagccccagctgctgagagcgcccccaacggcctgagcacagtgtcccatgactacctgaagggcagctatggcctggacctggaggccgtgcggggcggggccagccacctgccccacctgaccaggaccctggccaccagctgccggcggctgcacagcgaggtggacaaggtgctgagcggcctggagatcctgagcaaggtgtttgaccagcagagcagccccatggtgacccggctgctgcagcagcagaacctgccccagacaggagagcaggagctggagagcctggtgctgaagctgtctgtgctgaaggacttcctgagcggcatccagaagaaggccctgaaggccctgcaggacatgagcagcacagcccccccagccccccagcccagcaccaggaaggccaagaccatccctgtgcaggcctttgaggtgaagctggatgtgaccctgggggacctgaccaagattggcaagagccagaagttcaccctgtctgtggatgtggagggcggccgcctggtgctgctgcggcggcagagggacagccaggaggactggaccaccttcacccatgaccgcatccggcagctgatcaagagccagagggtgcagaacaagctgggcgtggtgtttgagaaggagaaggacaggacccagaggaaggacttcatctttgtgtctgccaggaagcgggaggccttctgccagctgctgcagctgatgaagaacaagcacagcaagcaggatgagccagacatgatctctgtgttcatcggcacctggaacatgggctctgtgcccccacccaagaatgtgacctcctggttcaccagcaagggcctgggcaagaccctggatgaggtgacagtgaccatcccccatgacatctacgtgtttggcacccaggagaacagcgtgggggaccgggagtggctggacctgctgcggggcggcctgaaggagctgacagacctggactaccggcccatcgccatgcagagcctgtggaacatcaaggtggccgtgctggtgaagccagagcatgaaaatcgcatcagccacgtgtccaccagctctgtgaagacaggcatcgccaacaccctgggcaacaagggagctgtgggcgtgtccttcatgtttaatggcaccagctttggatttgtgaactgccacctgaccagcggaaatgagaagacagcccggaggaaccagaactacctggacatcctgcggctgctgagcctgggggaccggcagctgaatgcctttgacatcagcctgcgcttcacccacctgttctggtttggagacctgaactaccgcctggacatggacatccaggagatcctgaactacatcagcaggaaggagtttgagcccctgctgcgggtggaccagctgaacctggagcgggagaagcacaaggtgttcctgcgcttcagcgaggaggagatctccttcccccccacctaccgctatgagcggggcagccgggacacctacgcctggcacaagcagaagcccactggagtgaggaccaacgtgcccagctggtgtgaccgcatcctgtggaagagctacccagagacccacatcatctgcaacagctatggctgcacagatgacatcgtgaccagtgaccacagccctgtgtttggcacctttgaggtgggcgtgaccagccagttcatcagcaagaagggcctgagcaagaccagtgaccaggcctacatcgagtttgagagcattgaggccatcgtgaagacagccagcaggaccaagttcttcatcgagttctacagcacctgcctggaggagtacaagaagagctttgaaaatgatgcccagagcagtgacaacatcaacttcctgaaggtgcagtggagcagccggcagctgcccaccctgaagcccatcctggccgacatcgagtacctgcaggaccagcacctgctgctgactgtgaagtccatggatggctatgagagctatggagaatgtgtggtggccctgaagtccatgattggcagcacagcccagcagttcctgaccttcctgagccacagaggagaggagactggaaacatccggggctccatgaaggtgcgggtgcccacagagcggctgggcacccgggagcggctgtatgagtggatcagcattgacaaggatgaggccggggccaagagcaaggcccccagcgtgtcccggggcagccaggagcccaggagcggcagcaggaagccagccttcacagaggccagctgccccctgagccggctgtttgaggagcctgagaagcccccacccaccggccggcccccagccccaccccgggccgccccccgggaggagcccctgaccccccggctgaagccagagggcgcccctgagcctgagggcgtggccgcccccccacccaagaacagcttcaacaacccagcctactacgtgctggagggcgtgccccaccagctgctgcccccagagccccccagccctgcccgggcccctgtgcccagcgccaccaagaacaaggtggccatcaccgtgcctgccccccagctgggccaccaccgccacccccgggtgggggagggcagcagcagtgatgaggagagcggcggcaccctgcccccaccagacttccccccaccacccctgcctgattctgccatcttcctgccccccagcctggaccccctgcccggccctgtggtgcggggccggggcggcgctgaggcccggggccccccaccacccaaggcccaccccaggcctcccctgcccccaggccccagccctgccagcaccttcctgggggaggtggccagcggagatgacaggagctgcagcgtgctgcagatggccaagaccctgtctgaggtggactatgccccagctggccctgcccggagcgccctgctgcccggccccctggagctgcagcccccccggggcctgcccagcgactatggccggcccctgtccttccccccaccccgcatccgggagagcatccaggaggacctggccgaggaggccccctgcctgcagggcggccgggccagcggcctgggggaggccggcatgtctgcctggctgcgggccatcggcctggagagatatgaggagggcctggtgcacaacggctgggatgacctggagttcctgagtgacatcacagaggaggacctggaggaggccggcgtgcaggaccctgcccacaagaggctgctgctggacaccctgcagctgagcaagtag

SEQ ID NO: 156014 - DNA, 105 bp, Artificial Sequence
  Description of Artificial Sequence: Synthetic coding sequence
atggtgacccggctgctgcagcagcagaacctgccccagacaggagagcaggagctggagagcctggtgctgaagctgtctgtgctgaaggacttcctgtcctag

SEQ ID NO: 156015 - DNA, 3051 bp, Artificial Sequence
  Description of Artificial Sequence: Synthetic coding sequence
atggtgacccggctgctgcagcagcagaacctgccccagacaggagagcaggagctggagagcctggtgctgaagctgtctgtgctgaaggacttcctgagcggcatccagaagaaggccctgaaggccctgcaggacatgagcagcacagcccccccagccccccagcccagcaccaggaaggccaagaccatccctgtgcaggcctttgaggtgaagctggatgtgaccctgggggacctgaccaagattggcaagagccagaagttcaccctgtctgtggatgtggagggcggccgcctggtgctgctgcggcggcagagggacagccaggaggactggaccaccttcacccatgaccgcatccggcagctgatcaagagccagagggtgcagaacaagctgggcgtggtgtttgagaaggagaaggacaggacccagaggaaggacttcatctttgtgtctgccaggaagcgggaggccttctgccagctgctgcagctgatgaagaacaagcacagcaagcaggatgagccagacatgatctctgtgttcatcggcacctggaacatgggctctgtgcccccacccaagaatgtgacctcctggttcaccagcaagggcctgggcaagaccctggatgaggtgacagtgaccatcccccatgacatctacgtgtttggcacccaggagaacagcgtgggggaccgggagtggctggacctgctgcggggcggcctgaaggagctgacagacctggactaccggcccatcgccatgcagagcctgtggaacatcaaggtggccgtgctggtgaagccagagcatgaaaatcgcatcagccacgtgtccaccagctctgtgaagacaggcatcgccaacaccctgggcaacaagggagctgtgggcgtgtccttcatgtttaatggcaccagctttggatttgtgaactgccacctgaccagcggaaatgagaagacagcccggaggaaccagaactacctggacatcctgcggctgctgagcctgggggaccggcagctgaatgcctttgacatcagcctgcgcttcacccacctgttctggtttggagacctgaactaccgcctggacatggacatccaggagatcctgaactacatcagcaggaaggagtttgagcccctgctgcgggtggaccagctgaacctggagcgggagaagcacaaggtgttcctgcgcttcagcgaggaggagatctccttcccccccacctaccgctatgagcggggcagccgggacacctacgcctggcacaagcagaagcccactggagtgaggaccaacgtgcccagctggtgtgaccgcatcctgtggaagagctacccagagacccacatcatctgcaacagctatggctgcacagatgacatcgtgaccagtgaccacagccctgtgtttggcacctttgaggtgggcgtgaccagccagttcatcagcaagaagggcctgagcaagaccagtgaccaggcctacatcgagtttgagagcattgaggccatcgtgaagacagccagcaggaccaagttcttcatcgagttctacagcacctgcctggaggagtacaagaagagctttgaaaatgatgcccagagcagtgacaacatcaacttcctgaaggtgcagtggagcagccggcagctgcccaccctgaagcccatcctggccgacatcgagtacctgcaggaccagcacctgctgctgactgtgaagtccatggatggctatgagagctatggagaatgtgtggtggccctgaagtccatgattggcagcacagcccagcagttcctgaccttcctgagccacagaggagaggagactggaaacatccggggctccatgaaggtgcgggtgcccacagagcggctgggcacccgggagcggctgtatgagtggatcagcattgacaaggatgaggccggggccaagagcaaggcccccagcgtgtcccggggcagccaggagcccaggagcggcagcaggaagccagccttcacagaggccagctgccccctgagccggctgtttgaggagcctgagaagcccccacccaccggccggcccccagccccaccccgggccgccccccgggaggagcccctgaccccccggctgaagccagagggcgcccctgagcctgagggcgtggccgcccccccacccaagaacagcttcaacaacccagcctactacgtgctggagggcgtgccccaccagctgctgcccccagagccccccagccctgcccgggcccctgtgcccagcgccaccaagaacaaggtggccatcaccgtgcctgccccccagctgggccaccaccgccacccccgggtgggggagggcagcagcagtgatgaggagagcggcggcaccctgcccccaccagacttccccccaccacccctgcctgattctgccatcttcctgccccccagcctggaccccctgcccggccctgtggtgcggggccggggcggcgctgaggcccggggccccccaccacccaaggcccaccccaggcctcccctgcccccaggccccagccctgccagcaccttcctgggggaggtggccagcggagatgacaggagctgcagcgtgctgcagatggccaagaccctgtctgaggtggactatgccccagctggccctgcccggagcgccctgctgcccggccccctggagctgcagcccccccggggcctgcccagcgactatggccggcccctgtccttccccccaccccgcatccgggagagcatccaggaggacctggccgaggaggccccctgcctgcagggcggccgggccagcggcctgggggaggccggcatgtctgcctggctgcgggccatcggcctggagagatatgaggagggcctggtgcacaacggctgggatgacctggagttcctgagtgacatcacagaggaggacctggaggaggccggcgtgcaggaccctgcccacaagaggctgctgctggacaccctgcagctgagcaagtag

SEQ ID NO: 156016 - DNA, 69 bp, Artificial Sequence
  Description of Artificial Sequence: Synthetic coding sequence
atggccagcgcctgtggggcccctggccctgggggcgccctgggcagccaggcccccagctggtactag

SEQ ID NO: 156017 - DNA, 3051 bp, Artificial Sequence; identical to SEQ ID NO: 156015
  Description of Artificial Sequence: Synthetic coding sequence

SEQ ID NO: 156018 - DNA, 57 bp, Artificial Sequence
  Description of Artificial Sequence: Synthetic coding sequence
atggccagcgcctgtggggcccctggccctgggggcgccctgggcagccaggcctag

SEQ ID NO: 156019 - DNA, 474 bp, Artificial Sequence
  Description of Artificial Sequence: Synthetic coding sequence
atggtgacccggctgctgcagcagcagaacctgccccagacaggagagcaggagctggagagcctggtgctgaagctgtctgtgctgaaggacttcctgagcggcatccagaagaaggccctgaaggccctgcaggacatgagcagcacagcccccccagccccccagcccagcaccaggaaggccaagaccatccctgtgcaggcctttgaggtgaagctggatgtgaccctgggggacctgaccaagattggcaagagccagaagttcaccctgtctgtggatgtggagggcggccgcctggtgctgctgcggcggcagagggacagccaggaggactggaccaccttcacccatgaccgcatccggcagctgatcaagagccagagggtgcagaacaagctgggcgtggtgtttgagaaggagaaggacaggacccagaggaaggacttcatctttgtgtctgccaggtag

SEQ ID NO: 156020 - DNA, 1200 bp, Artificial Sequence
  Description of Artificial Sequence: Synthetic coding sequence
atgtctgacatcctgcgggagctgctgtgtgtgtctgagaaggccgccaacatcgcccgggcctgccggcagcaggaggccctcttccagctgctgattgaggagaagaaggagggggagaagaacaagaagtttgctgtggacttcaagaccctggctgatgtgctggtgcaggaggtgatcaagcagaacatggagaacaagtttcctggcctggagaagaacatctttggagaggagagcaatgagttcaccaatgactggggcgagaagatcaccctgcggctgtgcagcacagaggaggagacagctgagctgctgagcaaggtgctgaatggaaacaaggtggccagcgaggccctggcccgggtggtgcaccaggatgtggccttcacagaccccaccctggacagcacagagatcaacgtgccccaggacatcctgggcatctgggtggaccccatcgacagcacctaccagtacatcaagggcagcgctgacatcaagagcaaccagggcatcttcccctgtggcctgcagtgtgtgaccatcctgattggagtgtatgacatccagacaggagtgcccctgatgggcgtcatcaaccagccctttgtgtcccgggaccccaacaccctgcgctggaagggccagtgctactggggcctgagctacatgggcaccaacatgcacagcctgcagctgaccatcagcagaagaaatggaagtgagacccacactggaaacacaggcagcgaggccgccttcagccccagcttctctgctgtgatcagcaccagcgagaaggagaccatcaaggccgccctgagccgggtgtgtggggaccgcatctttggagctgctggggccggctacaagagcctgtgtgtggtgcagggcctggtggacatctacatcttcagcgaggacaccaccttcaagtgggacagctgtgccgcccacgccatcctgcgggccatgggcggcggcatcgtggacctgaaggagtgcctggagaggaaccctgagaccggcctggacctgccccagctggtgtaccacgtggagaatgaaggagctgctggggtggaccgctgggccaacaagggcggcctgattgcctaccgcagcaggaagaggctggagaccttcctgagcctgctggtgcagaacctggccccagctgagacccacacctag

SEQ ID NO: 156021 - DNA, 1200 bp, Artificial Sequence; identical to SEQ ID NO: 156020
  Description of Artificial Sequence: Synthetic coding sequence

SEQ ID NO: 156022 - DNA, 468 bp, Artificial Sequence
  Description of Artificial Sequence: Synthetic coding sequence
atgtctgacatcctgcgggagctgctgtgtgtgtctgagaaggccgccaacatcgcccgggcctgccggcagcaggaggccctcttccagctgctgattgaggagaagaaggagggggagaagaacaagaagtttgctgtggacttcaagaccctggctgatgtgctggtgcaggaggtgatcaagcagaacatggagaacaagtttcctggcctggagaagaacatctttggagaggagagcaatgagttcaccaatgactggggcgagaagatcaccctgcggctgtgcagcacagaggaggagacagctgagctgctgagcaaggtgctgaatggaaacaaggtggccagcgaggccctggcccgggtggtgcaccaggatgtggccttcacagaccccaccctggacagcacagagatcaacgtgccccaggacatcctgggcatctgggtggaccccatctag

SEQ ID NO: 156023 - DNA, 267 bp, Artificial Sequence
  Description of Artificial Sequence: Synthetic coding sequence
atgtctgacatcctgcgggagctgctgtgtgtgtctgagaaggccgccaacatcgcccgggcctgccggcagcaggaggccctcttccagctgctgattgaggagaagaaggagggggagaagaacaagaagtttgctgtggacttcaagaccctggctgatgtgctggtgcaggaggtgatcaagcagaacatggagaacaagtttcctggcctggagaagaacatctttggagaggagagcaatgagttcaccaatgactggtag

SEQ ID NO: 156024 - DNA, 639 bp, Artificial Sequence
  Description of Artificial Sequence: Synthetic coding sequence
atgtctgacatcctgcgggagctgctgtgtgtgtctgagaaggccgccaacatcgcccgggcctgccggcagcaggaggccctcttccagctgctgattgaggagaagaaggagggggagaagaacaagaagtttgctgtggacttcaagaccctggctgatgtgctggtgcaggaggtgatcaagcagaacatggagaacaagtttcctggcctggagaagaacatctttggagaggagagcaatgagttcaccaatgactggggcgagaagatcaccctgcggctgtgcagcacagaggaggagacagctgagctgctgagcaaggtgctgaatggaaacaaggtggccagcgaggccctggcccgggtggtgcaccaggatgtggccttcacagaccccaccctggacagcacagagatcaacgtgccccaggacatcctgggcatctgggtggaccccatcgacagcacctaccagtacatcaagggcagcgctgacatcaagagcaaccagggcatcttcccctgtggcctgcagtgtgtgaccatcctgattggagtgtatgacatccagacaggagtgcccctgatgggcgtcatcaaccagccctttgtgtcccgggaccccaacacctag

SEQ ID NO: 156025 - DNA, 30 bp, Artificial Sequence
  Description of Artificial Sequence: Synthetic coding sequence
atgtctgacatcctgcgggagctgctgtag

SEQ ID NO: 156026 - DNA, 642 bp, Artificial Sequence
  Description of Artificial Sequence: Synthetic coding sequence
atgtctgacatcctgcgggagctgctgtgtgtgtctgagaaggccgccaacatcgcccgggcctgccggcagcaggaggccctcttccagctgctgattgaggagaagaaggagggggagaagaacaagaagtttgctgtggacttcaagaccctggctgatgtgctggtgcaggaggtgatcaagcagaacatggagaacaagtttcctggcctggagaagaacatctttggagaggagagcaatgagttcaccaatgactggggcgagaagatcaccctgcggctgtgcagcacagaggaggagacagctgagctgctgagcaaggtgctgaatggaaacaaggtggccagcgaggccctggcccgggtggtgcaccaggatgtggccttcacagaccccaccctggacagcacagagatcaacgtgccccaggacatcctgggcatctgggtggaccccatcgacagcacctaccagtacatcaagggcagcgctgacatcaagagcaaccagggcatcttcccctgtggcctgcagtgtgtgaccatcctgattggagtgtatgacatccagacaggagtgcccctgatgggcgtcatcaaccagccctttgtgtcccgggaccccaacaccctgtag

SEQ ID NO: 156027 - DNA, 573 bp, Artificial Sequence
  Description of Artificial Sequence: Synthetic coding sequence
atgtctgacatcctgcgggagctgctgtgtgtgtctgagaaggccgccaacatcgcccgggcctgccggcagcaggaggccctcttccagctgctgattgaggagaagaaggagggggagaagaacaagaagtttgctgtggacttcaagaccctggctgatgtgctggtgcaggaggtgatcaagcagaacatggagaacaagtttcctggcctggagaagaacatctttggagaggagagcaatgagttcaccaatgactggggcgagaagatcaccctgcggctgtgcagcacagaggaggagacagctgagctgctgagcaaggtgctgaatggaaacaaggtggccagcgaggccctggcccgggtggtgcaccaggatgtggccttcacagaccccaccctggacagcacagagatcaacgtgccccaggacatcctgggcatctgggtggaccccatcgacagcacctaccagtacatcaagggcagcgctgacatcaagagcaaccagggcatcttcccctgtggcctgcagtgtgtgaccatcctgattggagtgtatgactag

SEQ ID NO: 156028 - DNA, 93 bp, Artificial Sequence
  Description of Artificial Sequence: Synthetic coding sequence
atgtctgacatcctgcgggagctgctgtgtgtgtctgagaaggccgccaacatcgcccgggcctgccggcagcaggaggccctcttccagtag

SEQ ID NO: 156029 - DNA, 207 bp, Artificial Sequence
  Description of Artificial Sequence: Synthetic coding sequence
atgtctgacatcctgcgggagctgctgtgtgtgtctgagaaggccgccaacatcgcccgggcctgccggcagcaggaggccctcttccagctgctgattgaggagaagaaggagggggagaagaacaagaagtttgctgtggacttcaagaccctggctgatgtgctggtgcaggaggtgatcaagcagaacatggagaacaagtag

SEQ ID NO: 156030 - DNA, 432 bp, Artificial Sequence
  Description of Artificial Sequence: Synthetic coding sequence
atgtctgacatcctgcgggagctgctgtgtgtgtctgagaaggccgccaacatcgcccgggcctgccggcagcaggaggccctcttccagctgctgattgaggagaagaaggagggggagaagaacaagaagtttgctgtggacttcaagaccctggctgatgtgctggtgcaggaggtgatcaagcagaacatggagaacaagtttcctggcctggagaagaacatctttggagaggagagcaatgagttcaccaatgactggggcgagaagatcaccctgcggctgtgcagcacagaggaggagacagctgagctgctgagcaaggtgctgaatggaaacaaggtggccagcgaggccctggcccgggtggtgcaccaggatgtggccttcacagaccccaccctggacagcacagagatcaacgtgtag

SEQ ID NO: 156031 - DNA, 1200 bp, Artificial Sequence; identical to SEQ ID NO: 156020
  Description of Artificial Sequence: Synthetic coding sequence

SEQ ID NO: 156032 - DNA, 2934 bp, Artificial Sequence
  Description of Artificial Sequence: Synthetic coding sequence
atgacagcccgggagcacagccccaggcatggagcccgggcccgggccatgcagagggccagcaccattgatgtggccgctgacatgctgggcctgagcctggccggcaacatccaggaccctgatgagcccatcctggagttcagcctggcctgcagcgagctgcacacccccagcctggacaggaagcccaacagctttgtggccgtgtctgtgaccaccccaccccaggccttctggaccaagcacgcccagacagagatcatcgagggcaccaacaaccccatcttcctgagcagcatcgccttcttccaggacagcctcatcaaccagatgacccaggtgaagctgtctgtgtatgatgtgaaggacaggagccagggcaccatgtacctgctgggcagcggcaccttcatcgtgaaggacctgctgcaggacagacaccaccggctgcacctgaccctgcggtctgctgagagtgacagagtgggcaacatcaccgtgattggctggcagatggaggagaagagtgaccagaggcctcctgtgaccaggtctgtggacacagtgaatggaaggatggtgctgcctgtggatgagagcctgacagaggccctgggcatccgcagcaaatatgccagcctgaggaaggacaccctgctgaagtctgtgtttggaggagccatctgcaggatgtaccgcttccccaccacagatggcaaccacctgcgcatcctggagcagatggccgagagcgtgctgagcctgcacgtgccccggcagtttgtgaagctgctgctggaggaggatgctgcccgggtgtgtgagctggaggagctgggggagctgagcccctgctgggagagcctgcggcggcagatcgtgacccagtaccagaccatcatcctgacctaccaggagaacctgacagacctgcaccagtaccggggccccagcttcaaggccagcagcctgaaggctgacaagaagctggagtttgtgcccaccaacctgcacatccagaggatgagggtgcaggatgatggcggcagtgaccagaactatgacatcgtgaccatcggggccccagctgcccactgccagggcttcaagagcggcggcctgaggaagaagctgcacaagtttgaggagaccaagaagcactttgaggagtgctgcaccagcagcggctgccagagcatcatctacatcccccaggatgtggtgcgggccaaggagatcatcgcccagatcaacaccctgaagacccaggtgtcctactatgcagagcggctgagcagagctgccaaggacagaagtgccaccggcctggagaggaccctggccatcctggccgacaagacccggcagctggtgacagtgtgtgactgcaagctgctggccaacagcatccacggcctgaatgctgcccggccagactacatcgccagcaaggccagccccaccagcacagaggaggagcaggtgatgctgagaaatgaccaggacaccctgatggcccgctggacaggcaggaacagccgcagcagcctgcaggtggactggcatgaggaggagtgggagaaggtgtggctgaatgtggacaagagcctggagtgcatcatccagagggtggacaagctgctgcagaaggagcggctgcatggagagggctgtgaagatgtgttcccctgtgccggcagctgcaccagcaagaagggcaacccagacagccacgcctactggatccggcctgaggaccccttctgtgatgtgcccagcagcccctgccccagcaccatgcccagcacagcctgccacccccacctgaccacccactgcagccccccacctgaggagagcagccctggagagtggagcgaggccctgtaccccctgctgaccaccctgacagactgtgtggccatgatgtctgacaaggccaagaaggccatggtgttcctgctgatgcaggacagcgcccccaccatcgccacctacctgagcctgcagtacagaagagatgtggtgttctgccagaccctgacagccctgatctgtggcttcatcatcaagctgaggaactgcctgcatgatgatggcttcctgcggcagctgtacaccatcggcctgctggcccagtttgagagcctgctgagcacctacggggaggagctggccatgctggaggacatgagcctgggcatcatggacctgagaaatgtgaccttcaaggtgacccaggccaccagcagcgccagcgctgacatgctgcctgtgatcaccggcaacagagatggcttcaacgtgcgggtgcccctgcccggccccctgtttgatgccctgccccgggagatccagagcggcatgctgctgcgggtgcagcctgtgctcttcaacgtgggcatcaatgagcagcagaccctggccgagagatttggagacaccagcctgcaggaggtgatcaacgtggagagcctggtgcggctgaacagctactttgagcagttcaaggaggtgctgcctgaggactgcctgcccaggagccgcagccagacctgcctgcctgagctgctgcgcttcctgggccagaatgtgcacgccaggaagaacaagaatgtggacatcctgtggcaggccgctgagatctgccggcggctgaatggagtgcgcttcaccagctgcaagagcgccaaggacagaacagccatgtctgtgaccctggagcagtgcctgatcctgcagcacgagcacggcatggccccccaggtgttcacccaggccctggagtgcatgaggtctgagggctgccggcgggagaacaccatgaagaatgtgggcagcaggaaatatgccttcaacagcctgcagctgaaggccttccccaagcactacagacctcctgagggcacctacggcaaggtggagacctag

SEQ ID NO: 156033 - DNA, 2817 bp, Artificial Sequence
  Description of Artificial Sequence: Synthetic coding sequence
atgacagcccgggagcacagccccaggcatggagcccgggcccgggccatgcagagggccagcaccattgatgtggccgctgacatgctgggcctgagcctggccggcaacatccaggaccctgatgagcccatcctggagttcagcctggcctgcagcgagctgcacacccccagcctggacaggaagcccaacagctttgtggccgtgtctgtgaccaccccaccccaggccttctggaccaagcacgcccagacagagatcatcgagggcaccaacaaccccatcttcctgagcagcatcgccttcttccaggacagcctcatcaaccagatgacccaggtgaagctgtctgtgtatgatgtgaaggacaggagccagggcaccatgtacctgctgggcagcggcaccttcatcgtgaaggacctgctgcaggacagacaccaccggctgcacctgaccctgcggtctgctgagagtgacagagtgggcaacatcaccgtgattggctggcagatggaggagaagagtgaccagaggcctcctgtgaccaggtctgtggacacagtgaatggaaggatggtgctgcctgtggatgagagcctgacagaggccctgggcatccgcagcaaatatgccagcctgaggaaggacaccctgctgaagtctgtgtttggaggagccatctgcaggatgtaccgcttccccaccacagatggcaaccacctgcgcatcctggagcagatggccgagagcgtgctgagcctgcacgtgccccggcagtttgtgaagctgctgctggaggaggatgctgcccgggtgtgtgagctggaggagctgggggagctgagcccctgctgggagagcctgcggcggcagatcgtgacccagtaccagaccatcatcctgacctaccaggagaacctgacagacctgcaccagtaccggggccccagcttcaaggccagcagcctgaaggctgacaagaagctggagtttgtgcccaccaacctgcacatccagaggatgagggtgcaggatgatggcggcagtgaccagaactatgacatcgtgaccatcggggccccagctgcccactgccagggcttcaagagcggcggcctgaggaagaagctgcacaagtttgaggagaccaagaagcactttgaggagtgctgcaccagcagcggctgccagagcatcatctacatcccccaggatgtggtgcgggccaaggagatcatcgcccagatcaacaccctgaagacccaggtgtcctactatgcagagcggctgagcagagctgccaaggacagaagtgccaccggcctggagaggaccctggccatcctggccgacaagacccggcagctggtgacagtgtgtgactgcaagctgctggccaacagcatccacggcctgaatgctgcccggccagactacatcgccagcaaggccagccccaccagcacagaggaggagcaggtgatgctgagaaatgaccaggacaccctgatggcccgctggacaggcaggaacagccgcagcagcctgcaggtggactggcatgaggaggagtgggagaaggtgtggctgaatgtggacaagagcctggagtgcatcatccagagggtggacaagctgctgcagaaggagcggctgcatggagagggctgtgaagatgtgttcccctgtgccggcagctgcaccagcaagaaggactgcagccccccacctgaggagagcagccctggagagtggagcgaggccctgtaccccctgctgaccaccctgacagactgtgtggccatgatgtctgacaaggccaagaaggccatggtgttcctgctgatgcaggacagcgcccccaccatcgccacctacctgagcctgcagtacagaagagatgtggtgttctgccagaccctgacagccctgatctgtggcttcatcatcaagctgaggaactgcctgcatgatgatggcttcctgcggcagctgtacaccatcggcctgctggcccagtttgagagcctgctgagcacctatggagaggagctggccatgctggaggacatgagcctgggcatcatggacctgagaaatgtgaccttcaaggtgacccaggccaccagcagcgccagcgctgacatgctgcccgtcatcactggaaacagagatggcttcaacgtgcgggtgcccctgcccggccccctgtttgatgccctgccccgggagatccagagcggcatgctgctgcgggtgcagcctgtgctcttcaacgtgggcatcaatgagcagcagaccctggccgagagatttggagacaccagcctgcaggaggtgatcaacgtggagagcctggtgcggctgaacagctactttgagcagttcaaggaggtgctgcctgaggactgcctgcccaggagccgcagccagacctgcctgcctgagctgctgcgcttcctgggccagaatgtgcacgccaggaagaacaagaatgtggacatcctgtggcaggccgctgagatctgccggcggctgaatggagtgcgcttcaccagctgcaagagcgccaaggacagaacagccatgtctgtgaccctggagcagtgcctgatcctgcagcatgaacatggcatggccccccaggtgttcacccaggccctggagtgcatgaggtctgagggctgcagaagagagaacaccatgaagaatgtgggcagcaggaaatatgccttcaacagcctgcagctgaaggccttccccaagcactaccggcccccagagggcacctacggcaaggtggagacctag

SEQ ID NO: 156034 - DNA, 2865 bp, Artificial Sequence
  Description of Artificial Sequence: Synthetic coding sequence
atgacagcccgggagcacagccccaggcatggagcccgggcccgggccatgcagagggccagcaccattgatgtggccgctgacatgctgggcctgagcctggccggcaacatccaggaccctgatgagcccatcctggagttcagcctggcctgcagcgagctgcacacccccagcctggacaggaagcccaacagctttgtggccgtgtctgtgaccaccccaccccaggccttctggaccaagcacgcccagacagagatcatcgagggcaccaacaaccccatcttcctgagcagcatcgccttcttccaggacagcctcatcaaccagatgacccaggtgaagctgtctgtgtatgatgtgaaggacaggagccagggcaccatgtacctgctgggcagcggcaccttcatcgtgaaggacctgctgcaggacagacaccaccggctgcacctgaccctgcggtctgctgagagtgacagagtgggcaacatcaccgtgattggctggcagatggaggagaagagtgaccagaggcctcctgtgaccaggtctgtggacacagtgaatggaaggatggtgctgcctgtggatgagagcctgacagaggccctgggcatccgcagcaaatatgccagcctgaggaaggacaccctgctgaagtctgtgtttggaggagccatctgcaggatgtaccgcttccccaccacagatggcaaccacctgcgcatcctggagcagatggccgagagcgtgctgagcctgcacgtgccccggcagtttgtgaagctgctgctggaggaggatgctgcccgggtgtgtgagctggaggagctgggggagctgagcccctgctgggagagcctgcggcggcagatcgtgacccagtaccagaccatcatcctgacctaccaggagaacctgacagacctgcaccagtaccggggccccagcttcaaggccagcagcctgaaggctgacaagaagctggagtttgtgcccaccaacctgcacatccagaggatgagggtgcaggatgatggcggcagtgaccagaactatgacatcgtgaccatcggggccccagctgcccactgccagggcttcaagagcggcggcctgaggaagaagctgcacaagtttgaggagaccaagaagcactttgaggagtgctgcaccagcagcggctgccagagcatcatctacatcccccaggatgtggtgcgggccaaggagatcatcgcccagatcaacaccctgaagacccaggtgtcctactatgcagagcggctgagcagagctgccaaggacagaagtgccaccggcctggagaggaccctggccatcctggccgacaagacccggcagctggtgacagtgtgtgactgcaagctgctggccaacagcatccacggcctgaatgctgcccggccagactacatcgccagcaaggccagccccaccagcacagaggaggagcaggtgatgctgagaaatgaccaggacaccctgatggcccgctggacaggcaggaacagccgcagcagcctgcaggtggactggcatgaggaggagtgggagaaggtgtggctgaatgtggacaagagcctggagtgcatcatccagagggtggacaagctgctgcagaaggagcggctgcatggagagggctgtgaagatgtgttcccctgtgccggcagctgcaccagcaagaaggactgcagccccccacctgaggagagcagccctggagagtggagcgaggccctgtaccccctgctgaccaccctgacagactgtgtggccatgatgtctgacaaggccaagaaggccatggtgttcctgctgatgcaggacagcgcccccaccatcgccacctacctgagcctgcagtacagaagagatgtggtgttctgccagaccctgacagccctgatctgtggcttcatcatcaagctgaggaactgcctgcatgatgatggcttcctgcggcagctgtacaccatcggcctgctggcccagtttgagagcctgctgagcacctatggagaggagctggccatgctggaggacatgagcctgggcatcatggacctgagaaatgtgaccttcaaggtgacccaggccaccagcagcgccagcgctgacatgctgcccgtcatcactggaaacagagatggcttcaacgtgcgggtgcccctgcccggccccctgtttgatgccctgccccgggagatccagagcggcatgctgctgcgggtgcagcctgtgctcttcaacgtgggcatcaatgagcagcagaccctggccgagagatttggagacaccagcctgcaggaggtgatcaacgtggagagcctggtgcggctgaacagctactttgagcagttcaaggaggtgctgcctgaggactgcctgcccaggagccgcagccagacctgcctgcctgagctgctgcgcttcctgggccagaatgtgcacgccaggaagaacaagaatgtggacatcctgtggcaggccgctgagatctgccggcggctgaatggagtgcgcttcaccagctgcaagagcgccaaggacagaacagccatgtctgtgaccctggagcagtgcctgatcctgcagcatgaacatggcatggccccccaggtgttcacccaggccctggagtgcatgaggagcatcggcacccgggaggtggtgacccagaagaacctgagcggcctggtgcccatccgggacctgcggctggaccccagcctgctgtgcagcatccccctgctggccctgagccccaacctgctgattgtgtggctgttcctgagcatcgcctacctggtgaccaagctgcgctgcaagtag

SEQ ID NO: 156035 - DNA, 2919 bp, Artificial Sequence
  Description of Artificial Sequence: Synthetic coding sequence
atgacagcccgggagcacagccccaggcatggagcccgggcccgggccatgcagagggccagcaccattgatgtggccgctgacatgctgggcctgagcctggccggcaacatccaggaccctgatgagcccatcctggagttcagcctggcctgcagcgagctgcacacccccagcctggacaggaagcccaacagctttgtggccgtgtctgtgaccaccccaccccaggccttctggaccaagcacgcccagacagagatcatcgagggcaccaacaaccccatcttcctgagcagcatcgccttcttccaggacagcctcatcaaccagatgacccaggtgaagctgtctgtgtatgatgtgaaggacaggagccagggcaccatgtacctgctgggcagcggcaccttcatcgtgaaggacctgctgcaggacagacaccaccggctgcacctgaccctgcggtctgctgagagtgacagagtgggcaacatcaccgtgattggctggcagatggaggagaagagtgaccagaggcctcctgtgaccaggtctgtggacacagtgaatggaaggatggtgctgcctgtggatgagagcctgacagaggccctgggcatccgcagcaaatatgccagcctgaggaaggacaccctgctgaagtctgtgtttggaggagccatctgcaggatgtaccgcttccccaccacagatggcaaccacctgcgcatcctggagcagatggccgagagcgtgctgagcctgcacgtgccccggcagtttgtgaagctgctgctggaggaggatgctgcccgggtgtgtgagctggaggagctgggggagctgagcccctgctgggagagcctgcggcggcagatcgtgacccagtaccagaccatcatcctgacctaccaggagaacctgacagacctgcaccagtaccggggccccagcttcaaggccagcagcctgaaggctgacaagaagctggagtttgtgcccaccaacctgcacatccagaggatgagggtgcaggatgatggcggcagtgaccagaactatgacatcgtgaccatcggggccccagctgcccactgccagggcttcaagagcggcggcctgaggaagaagctgcacaagtttgaggagaccaagaagcacaccagcagcggctgccagagcatcatctacatcccccaggatgtggtgcgggccaaggagatcatcgcccagatcaacaccctgaagacccaggtgtcctactatgcagagcggctgagccgggccgccaaggacagaagtgccaccggcctggagaggaccctggccatcctggccgacaagacccggcagctggtgacagtgtgtgactgcaagctgctggccaacagcatccacggcctgaatgctgcccggccagactacatcgccagcaaggccagccccaccagcacagaggaggagcaggtgatgctgagaaatgaccaggacaccctgatggcccgctggacaggaagaaacagccgcagcagcctgcaggtggactggcatgaggaggagtgggagaaggtgtggctgaatgtggacaagagcctggagtgcatcatccagagggtggacaagctgctgcagaaggagcggctgcacggggagggctgtgaagatgtgttcccctgtgccggcagctgcaccagcaagaagggcaacccagacagccacgcctactggatccggcctgaggaccccttctgtgatgtgcccagcagcccctgccccagcaccatgcccagcacagcctgccacccccacctgaccacccactgcagccccccacctgaggagagcagccctggagagtggagcgaggccctgtaccccctgctgaccaccctgacagactgtgtggccatgatgtctgacaaggccaagaaggccatggtgttcctgctgatgcaggacagcgcccccaccatcgccacctacctgagcctgcagtacagaagagatgtggtgttctgccagaccctgacagccctgatctgtggcttcatcatcaagctgaggaactgcctgcatgatgatggcttcctgcggcagctgtacaccatcggcctgctggcccagtttgagagcctgctgagcacctatggagaggagctggccatgctggaggacatgagcctgggcatcatggacctgagaaatgtgaccttcaaggtgacccaggccaccagcagcgccagcgctgacatgctgcccgtcatcactggaaacagagatggcttcaacgtgcgggtgcccctgcccggccccctgtttgatgccctgccccgggagatccagagcggcatgctgctgcgggtgcagcctgtgctcttcaacgtgggcatcaatgagcagcagaccctggccgagagatttggagacaccagcctgcaggaggtgatcaacgtggagagcctggtgcggctgaacagctactttgagcagttcaaggaggtgctgcctgaggactgcctgcccaggagccgcagccagacctgcctgcctgagctgctgcgcttcctgggccagaatgtgcacgccaggaagaacaagaatgtggacatcctgtggcaggccgctgagatctgccggcggctgaatggagtgcgcttcaccagctgcaagagcgccaaggacagaacagccatgtctgtgaccctggagcagtgcctgatcctgcagcatgaacatggcatggccccccaggtgttcacccaggccctggagtgcatgaggtctgagggctgcagaagagagaacaccatgaagaatgtgggcagcaggaaatatgccttcaacagcctgcagctgaaggccttccccaagcactaccggcccccagagggcacctacggcaaggtggagacctag

SEQ ID NO: 156036 - DNA, 2934 bp, Artificial Sequence; identical to SEQ ID NO: 156032
  Description of Artificial Sequence: Synthetic coding sequence

SEQ ID NO: 156037 - DNA, 2817 bp, Artificial Sequence
  Description of Artificial Sequence: Synthetic coding sequence
atgacagcccgggagcacagccccaggcatggagcccgggcccgggccatgcagagggccagcaccattgatgtggccgctgacatgctgggcctgagcctggccggcaacatccaggaccctgatgagcccatcctggagttcagcctggcctgcagcgagctgcacacccccagcctggacaggaagcccaacagctttgtggccgtgtctgtgaccaccccaccccaggccttctggaccaagcacgcccagacagagatcatcgagggcaccaacaaccccatcttcctgagcagcatcgccttcttccaggacagcctcatcaaccagatgacccaggtgaagctgtctgtgtatgatgtgaaggacaggagccagggcaccatgtacctgctgggcagcggcaccttcatcgtgaaggacctgctgcaggacagacaccaccggctgcacctgaccctgcggtctgctgagagtgacagagtgggcaacatcaccgtgattggctggcagatggaggagaagagtgaccagaggcctcctgtgaccaggtctgtggacacagtgaatggaaggatggtgctgcctgtggatgagagcctgacagaggccctgggcatccgcagcaaatatgccagcctgaggaaggacaccctgctgaagtctgtgtttggaggagccatctgcaggatgtaccgcttccccaccacagatggcaaccacctgcgcatcctggagcagatggccgagagcgtgctgagcctgcacgtgccccggcagtttgtgaagctgctgctggaggaggatgctgcccgggtgtgtgagctggaggagctgggggagctgagcccctgctgggagagcctgcggcggcagatcgtgacccagtaccagaccatcatcctgacctaccaggagaacctgacagacctgcaccagtaccggggccccagcttcaaggccagcagcctgaaggctgacaagaagctggagtttgtgcccaccaacctgcacatccagaggatgagggtgcaggatgatggcggcagtgaccagaactatgacatcgtgaccatcggggccccagctgcccactgccagggcttcaagagcggcggcctgaggaagaagctgcacaagtttgaggagaccaagaagcagcaggaggagagcaggaccagcagcggctgccagagcatcatctacatcccccaggatgtggtgcgggccaaggagatcatcgcccagatcaacaccctgaagacccaggtgtcctactatgcagagcggctgagcagagctgccaaggacagaagtgccaccggcctggagaggaccctggccatcctggccgacaagacccggcagctggtgacagtgtgtgactgcaagctgctggccaacagcatccacggcctgaatgctgcccggccagactacatcgccagcaaggccagccccaccagcacagaggaggagcaggtgatgctgagaaatgaccaggacaccctgatggcccgctggacaggcaggaacagccgcagcagcctgcaggtggactggcatgaggaggagtgggagaaggtgtggctgaatgtggacaagagcctggagtgcatcatccagagggtggacaagctgctgcagaaggagcggctgcatggagagggctgtgaagatgtgttcccctgtgccggcagctgcaccagcaagaaggactgcagccccccacctgaggagagcagccctggagagtggagcgaggccctgtaccccctgctgaccaccctgacagactgtgtggccatgatgtctgacaaggccaagaaggccatggtgttcctgctgatgcaggacagcgcccccaccatcgccacctacctgagcctgcagtacagaagagatgtggtgttctgccagaccctgacagccctgatctgtggcttcatcatcaagctgaggaactgcctgcatgatgatggcttcctgcggcagctgtacaccatcggcctgctggcccagtttgagagcctgctgagcacctatggagaggagctggccatgctggaggacatgagcctgggcatcatggacctgagaaatgtgaccttcaaggtgacccaggccaccagcagcgccagcgctgacatgctgcccgtcatcactggaaacagagatggcttcaacgtgcgggtgcccctgcccggccccctgtttgatgccctgccccgggagatccagagcggcatgctgctgcgggtgcagcctgtgctcttcaacgtgggcatcaatgagcagcagaccctggccgagagatttggagacaccagcctgcaggaggtgatcaacgtggagagcctggtgcggctgaacagctactttgagcagttcaaggaggtgctgcctgaggactgcctgcccaggagccgcagccagacctgcctgcctgagctgctgcgcttcctgggccagaatgtgcacgccaggaagaacaagaatgtggacatcctgtggcaggccgctgagatctgccggcggctgaatggagtgcgcttcaccagctgcaagagcgccaaggacagaacagccatgtctgtgaccctggagcagtgcctgatcctgcagcatgaacatggcatggccccccaggtgttcacccaggccctggagtgcatgaggtctgagggctgcagaagagagaacaccatgaagaatgtgggcagcaggaaatatgccttcaacagcctgcagctgaaggccttccccaagcactaccggcccccagagggcacctacggcaaggtggagacctag

SEQ ID NO: 156038 - DNA, 3021 bp, Artificial Sequence
  Description of Artificial Sequence: Synthetic coding sequence
atggagggccagagcagccggggcagccggcggcccggcacccgggccggcctgggcagcctgcccatgccccagggcgtggcccagacaggagcccccagcaaggtggacagcagcttccagctgcctgccaagaagaatgctgccctgggccccagcgagccccggctggccctggcccctgtgggcccccgggccgccatgtctgccagcagcgagggcccccggctggccctggccagcccccggcccatcctggcccccctgtgcaccccagagggccagaagacagccacagcccacaggagcagcagcctggcccccacctctgtgggccagctggtgatgtctgccagcgctggccccaagcccccaccagccaccactggatctgtgctggcccccaccagcctgggcctggtgatgcctgccagcgctggccccaggagcccccctgtgaccctgggccccaacctggcccccaccagccgggaccagaagcaggagcccccagcctctgtgggccccaagcccaccctggccgccagcggcctgagcctggccctggccagcgaggagcagcccccagagctgcccagcacccccagccctgtgcccagccctgtgctgagccccacccaggagcaggccctggccccagccagcacagccagcggggccgcctctgtgggccagaccagcgccaggaagagagatgccccagccccccggcccctgcctgccagcgagggccacctgcagcccccagcccagaccagcggccccaccggcagccccccctgcatccagaccagcccagacccccggctgagccccagcttccgggcccggcctgaggccctgcacagcagcccagaagatcctgtgctgccccggcccccccagaccctgcccctggatgtgggccagggccccagcgagcccggcacccacagccctggcctgctgagccccaccttccggcctggggcccccagcggccagacagtgcccccacccctgcccaagccacccaggagccccagccgcagccccagccacagccccaacagaagcccctgtgtgcccccagccccagacatggccctgccccggctgggcacccagagcacaggccctggccgctgcctgagccccaacctgcaggcccaggaggccccagcccctgtgaccaccagcagcagcaccagcaccctgagcagcagcccctggagcgcccagcccacctggaagagtgaccccggcttccgcatcaccgtggtgacctggaatgtgggcacagccatgcccccagatgatgtgaccagcctgctgcacctgggcggcggagatgacagtgatggagctgacatgattgccatcggcctgcaggaggtgaacagcatgctgaacaagaggctgaaggatgccctcttcacagaccagtggagcgagctgttcatggatgccctgggccccttcaactttgtgctggtgtcctctgtgaggatgcagggcgtcatcctgctgctgtttgccaagtactaccacctgcccttcctgagagatgtgcagacagactgcaccaggacaggcctgggcggctactggggcaacaagggcggcgtgtctgtgcggctggccgccttcggccacatgctgtgcttcctgaactgccacctgcctgcccacatggacaaggccgagcagaggaaggacaacttccagaccatcctgagcctgcagcagttccagggccctggggcccagggcatcctggaccatgacctggtgttctggtttggagacctgaacttccgcatcgagagctatgacctgcactttgtgaagtttgccatcgacagcgaccagctgcaccagctgtgggagaaggaccagctgaacatggccaagaacacctggcccatcctgaagggcttccaggagggccccctgaactttgcccccaccttcaagtttgatgtgggcaccaacaagtatgacaccagcgccaagaagaggaagccagcctggacagaccgcatcctgtggaaggtgaaggcccctgggggcggccccagccccagcggcaggaagagccaccggctgcaggtgacccagcacagctaccgcagccacatggagtacacagtgtctgaccacaagcctgtggccgcccagttcctgctgcagtttgccttcagagatgacatgcccctggtgcggctggaggtggctgatgagtgggtgcggcctgagcaggccgtggtgcgctacaggatggagaccgtgtttgcccggagctcctgggactggattggcctgtacagagtgggcttccgccactgcaaggactatgtggcctacgtgtgggccaagcatgaagatgtggatggcaacacctaccaggtgaccttcagcgaggagagcctgcccaagggccatggagacttcatcctgggctactacagccacaaccacagcatcctgattggcatcacagagcccttccagatcagcctgcccagcagcgagctggccagcagcagcacagacagcagcggcaccagcagtgaaggagaagatgacagcaccctggagctgctggcccccaagagccgcagccccagccctgggaagagcaagaggcacaggagccgcagccctggcctggcccgcttccctggcctggccctgcggcccagcagccgggagcggcggggggccagccgcagccccagcccccagagccggcggctgagccgggtggccccagacaggagcagcaatggcagcagccggggcagcagcgaggagggccccagcggcctgcccggcccctgggccttccccccagctgtgcccaggagcctgggcctgctgcctgccctgcggctggagaccgtggaccccggcggcggcggctcctggggccctgaccgggaggccctggcccccaacagcctgagccccagcccccagggccaccggggcctggaggagggcggcctgggcccctag

SEQ ID NO: 156039 - DNA, 1920 bp, Artificial Sequence
  Description of Artificial Sequence: Synthetic coding sequence
atggccctgccccggctgggcacccagagcactggacctggccgctgcctgagccccaacctgcaggcccaggaggccccagcccctgtgaccaccagcagcagcaccagcaccctgagcagcagcccctggagcgcccagcccacctggaagagtgaccccggcttccgcatcaccgtggtgacctggaatgtgggcacagccatgcccccagatgatgtgaccagcctgctgcacctgggcggcggagatgacagtgatggagctgacatgattgccatcggcctgcaggaggtgaacagcatgctgaacaagaggctgaaggatgccctcttcacagaccagtggagcgagctgttcatggatgccctgggccccttcaactttgtgctggtgtcctctgtgaggatgcagggcgtcatcctgctgctgtttgccaagtactaccacctgcccttcctgagagatgtgcagacagactgcaccaggacaggcctgggcggctactggggcaacaagggcggcgtgtctgtgcggctggccgccttcggccacatgctgtgcttcctgaactgccacctgcctgcccacatggacaaggccgagcagaggaaggacaacttccagaccatcctgagcctgcagcagttccagggccctggggcccagggcatcctggaccatgacctggtgttctggtttggagacctgaacttcagaattgagagctatgacctgcactttgtgaagtttgccatcgacagcgaccagctgcaccagctgtgggagaaggaccagctgaacatggccaagaacacctggcccatcctgaagggcttccaggagggccccctgaactttgcccccaccttcaagtttgatgtgggcaccaacaagtatgacaccagcgccaagaagaggaagccagcctggacagaccgcatcctgtggaaggtgaaggcccctgggggcggccccagccccagcggcaggaagagccaccggctgcaggtgacccagcacagctaccgcagccacatggagtacacagtgtctgaccacaagcctgtggccgcccagttcctgctgcagtttgccttcagagatgacatgcccctggtgcggctggaggtggctgatgagtgggtgcggcctgagcaggccgtggtgcgctacaggatggagaccgtgtttgcccggagctcctgggactggattggcctgtacagagtgggcttccgccactgcaaggactatgtggcctacgtgtgggccaagcatgaagatgtggatggcaacacctaccaggtgaccttcagcgaggagagcctgcccaagggccacggggacttcatcctgggctactacagccacaaccacagcatcctgattggcatcacagagcccttccagatcagcctgcccagcagcgagctggccagcagcagcacagacagcagcggcaccagcagcgagggggaggatgacagcaccctggagctgctggcccccaagagccgcagccccagccctgggaagagcaagaggcacaggagccgcagccctggcctggcccgcttccctggcctggccctgcggcccagcagccgggagaggagaggagccagccgcagccccagcccccagagccggcggctgagccgggtggccccagacaggagcagcaatggcagcagccggggcagcagcgaggagggccccagcggcctgcccggcccctgggccttccccccagctgtgcccaggagcctgggcctgctgcctgccctgcggctggagaccgtggaccccggcggcggcggctcctggggccctgaccgggaggccctggcccccaacagcctgagccccagcccccagggccaccggggcctggaggagggcggcctgggcccctag

SEQ ID NO: 156040 - DNA, 1917 bp, Artificial Sequence
  Description of Artificial Sequence: Synthetic coding sequence
atggagggccagagcagccggggcagccggcggcccggcacccgggccggcctgggcagcctgcccatgccccagggcgtggcccagacaggagcccccagcaaggtggacagcagcttccagctgcctgccaagaagaatgctgccctgggccccagcgagccccgcatcaccgtggtgacctggaatgtgggcacagccatgcccccagatgatgtgaccagcctgctgcacctgggcggcggagatgacagtgatggagctgacatgattgccatcggcctgcaggaggtgaacagcatgctgaacaagaggctgaaggatgccctcttcacagaccagtggagcgagctgttcatggatgccctgggccccttcaactttgtgctggtgtcctctgtgaggatgcagggcgtcatcctgctgctgtttgccaagtactaccacctgcccttcctgagagatgtgcagacagactgcaccaggacaggcctgggcggctactggggcaacaagggcggcgtgtctgtgcggctggccgccttcggccacatgctgtgcttcctgaactgccacctgcctgcccacatggacaaggccgagcagaggaaggacaacttccagaccatcctgagcctgcagcagttccagggccctggggcccagggcatcctggaccatgacctggtgttctggtttggagacctgaacttccgcatcgagagctatgacctgcactttgtgaagtttgccatcgacagcgaccagctgcaccagctgtgggagaaggaccagctgaacatggccaagaacacctggcccatcctgaagggcttccaggagggccccctgaactttgcccccaccttcaagtttgatgtgggcaccaacaagtatgacaccagcgccaagaagaggaagccagcctggacagaccgcatcctgtggaaggtgaaggcccctgggggcggccccagccccagcggcaggaagagccaccggctgcaggtgacccagcacagctaccgcagccacatggagtacacagtgtctgaccacaagcctgtggccgcccagttcctgctgcagtttgccttcagagatgacatgcccctggtgcggctggaggtggctgatgagtgggtgcggcctgagcaggccgtggtgcgctacaggatggagaccgtgtttgcccggagctcctgggactggattggcctgtacagagtgggcttccgccactgcaaggactatgtggcctacgtgtgggccaagcatgaagatgtggatggcaacacctaccaggtgaccttcagcgaggagagcctgcccaagggccatggagacttcatcctgggctactacagccacaaccacagcatcctgattggcatcacagagcccttccagatcagcctgcccagcagcgagctggccagcagcagcacagacagcagcggcaccagcagtgaaggagaagatgacagcaccctggagctgctggcccccaagagccgcagccccagccctgggaagagcaagaggcacaggagccgcagccctggcctggcccgcttccctggcctggccctgcggcccagcagccgggagcggcggggggccagccgcagccccagcccccagagccggcggctgagccgggtggccccagacaggagcagcaatggcagcagccggggcagcagcgaggagggccccagcggcctgcccggcccctgggccttccccccagctgtgcccaggagcctgggcctgctgcctgccctgcggctggagaccgtggaccccggcggcggcggctcctggggccctgaccgggaggccctggcccccaacagcctgagccccagcccccagggccaccggggcctggaggagggcggcctgggcccctag

SEQ ID NO: 156041 - DNA, 1920 bp, Artificial Sequence; identical to SEQ ID NO: 156039
  Description of Artificial Sequence: Synthetic coding sequence

SEQ ID NO: 156042 - DNA, 2820 bp, Artificial Sequence
  Description of Artificial Sequence: Synthetic coding sequence
atgtctgccagcagcgagggcccccggctggccctggccagcccccggcccatcctggcccccctgtgcaccccagagggccagaagacagccacagcccacaggagcagcagcctggcccccacctctgtgggccagctggtgatgtctgccagcgctggccccaagcccccaccagccaccaccggctctgtgctggcccccaccagcctgggcctggtgatgcctgccagcgctggccccaggagcccccctgtgaccctgggccccaacctggcccccaccagccgggaccagaagcaggagcccccagcctctgtgggccccaagcccaccctggccgccagcggcctgagcctggccctggccagcgaggagcagcccccagagctgcccagcacccccagccctgtgcccagccctgtgctgagccccacccaggagcaggccctggccccagccagcacagccagcggggccgcctctgtgggccagaccagcgccaggaagagagatgccccagccccccggcccctgcctgccagcgagggccacctgcagcccccagcccagaccagcggccccaccggcagccccccctgcatccagaccagcccagacccccggctgagccccagcttccgggcccggcctgaggccctgcacagcagccctgaggaccctgtgctgcccaggcctccccagaccctgcccctggatgtgggccagggccccagcgagcccggcacccacagccctggcctgctgagccccaccttccggcctggggcccccagcggccagacagtgcccccacccctgcccaagcccccaagaagccccagccgcagccccagccacagccccaacagaagcccctgtgtgcccccagccccagacatggccctgccccggctgggcacccagagcactggacctggccgctgcctgagccccaacctgcaggcccaggaggccccagcccctgtgaccaccagcagcagcaccagcaccctgagcagcagcccctggagcgcccagcccacctggaagagtgaccccggcttccgcatcaccgtggtgacctggaatgtgggcacagccatgcccccagatgatgtgaccagcctgctgcacctgggcggcggagatgacagtgatggagctgacatgattgccatcggcctgcaggaggtgaacagcatgctgaacaagaggctgaaggatgccctcttcacagaccagtggagcgagctgttcatggatgccctgggccccttcaactttgtgctggtgtcctctgtgaggatgcagggcgtcatcctgctgctgtttgccaagtactaccacctgcccttcctgagagatgtgcagacagactgcaccaggacaggcctgggcggctactggggcaacaagggcggcgtgtctgtgcggctggccgccttcggccacatgctgtgcttcctgaactgccacctgcctgcccacatggacaaggccgagcagaggaaggacaacttccagaccatcctgagcctgcagcagttccagggccctggggcccagggcatcctggaccatgacctggtgttctggtttggagacctgaacttcagaattgagagctatgacctgcactttgtgaagtttgccatcgacagcgaccagctgcaccagctgtgggagaaggaccagctgaacatggccaagaacacctggcccatcctgaagggcttccaggagggccccctgaactttgcccccaccttcaagtttgatgtgggcaccaacaagtatgacaccagcgccaagaagaggaagccagcctggacagaccgcatcctgtggaaggtgaaggcccctgggggcggccccagccccagcggcaggaagagccaccggctgcaggtgacccagcacagctaccgcagccacatggagtacacagtgtctgaccacaagcctgtggccgcccagttcctgctgcagtttgccttcagagatgacatgcccctggtgcggctggaggtggctgatgagtgggtgcggcctgagcaggccgtggtgcgctacaggatggagaccgtgtttgcccggagctcctgggactggattggcctgtacagagtgggcttccgccactgcaaggactatgtggcctacgtgtgggccaagcatgaagatgtggatggcaacacctaccaggtgaccttcagcgaggagagcctgcccaagggccacggggacttcatcctgggctactacagccacaaccacagcatcctgattggcatcacagagcccttccagatcagcctgcccagcagcgagctggccagcagcagcacagacagcagcggcaccagcagcgagggggaggatgacagcaccctggagctgctggcccccaagagccgcagccccagccctgggaagagcaagaggcacaggagccgcagccctggcctggcccgcttccctggcctggccctgcggcccagcagccgggagaggagaggagccagccgcagccccagcccccagagccggcggctgagccgggtggccccagacaggagcagcaatggcagcagccggggcagcagcgaggagggccccagcggcctgcccggcccctgggccttccccccagctgtgcccaggagcctgggcctgctgcctgccctgcggctggagaccgtggaccccggcggcggcggctcctggggccctgaccgggaggccctggcccccaacagcctgagccccagcccccagggccaccggggcctggaggagggcggcctgggcccctag

SEQ ID NO: 156043 - DNA, 3534 bp, Artificial Sequence
  Description of Artificial Sequence: Synthetic coding sequence
atggtgccctgctggaaccacggcaacatcaccaggagcaaggccgaggagctgctgagcaggacaggcaaggatggcagcttcctggtgcgggccagcgagagcatcagccgggcctatgccctgtgtgtgctgtacagaaactgtgtgtacacctaccgcatcctgcccaatgaagatgacaagttcaccgtgcaggccagcgagggcgtgtccatgaggttcttcaccaagctggaccagctgattgagttctacaagaaggagaacatgggcctggtgacccacctgcagtaccctgtgcccctggaggaggaggacacaggagatgatcctgaggaggacacagtggagagcgtggtgtccccacctgagctgcccccaagaaacatccccctgacagccagcagctgtgaggccaaggaggtgcccttcagcaatgaaaacccccgggccacagagaccagccggcccagcctgtctgagaccctcttccagaggctgcagagcatggacaccagcggcctgcctgaggagcacctgaaggccatccaggactacctgagcacccagctggcccaggacagcgagtttgtgaagacaggcagcagcagcctgccccacctgaagaagctgaccaccctgctgtgcaaggagctgtatggccagatgctgaggacagtgcccggcatcggcaaggtgaaggaggaggaccacgtgcctggagaggccaaccccatcaacatggtgtccaagctgagccagctgaccagcctgctgagcagcattgaggacaaggtgaaggccctgctgcacgagggccctgagagcccccaccggcccagcctcatcccccctgtgacctttgaggtgaaggccgagagcctgggcatcccccagaagatgcagctgaaggtggatgtggagagcggcaagctgatcatcaagaagagcaaggatggcagcgaggacaagttctacagccacaagaagatcctgcagctgatcaagagccagaagttcctgaacaagctggtgatcctggtggagacagagaaggagaagatcctgaggaaggagtatgtgtttgctgacagcaagaagcgggagggcttctgccagctgctgcagcagatgaagaacaagcacagcgagcagcctgagccagacatgatcaccatcttcatcggcacctggaacatgggaaatgcccccccacccaagaagatcacctcctggttcctgagcaagggccagggcaagaccagagatgacagcgctgactacatcccccatgacatctacgtgattggcacccaggaggaccccctgtctgagaaggagtggctggagatcctgaagcacagcctgcaggagatcacctctgtgaccttcaagacagtggccatccacaccctgtggaacatccgcatcgtggtgctggccaagccagagcatgaaaatcgcatcagccacatctgcacagacaacgtgaagacaggcatcgccaacaccctgggcaacaagggagctgtgggcgtgtccttcatgtttaatggcaccagcctgggctttgtgaacagccacctgaccagcggcagcgagaagaagctgcggaggaaccagaactacatgaacatcctgcgcttcctggccctgggggacaagaagctgagccccttcaacatcacccaccgcttcacccacctgttctggtttggagacctgaactacagagtggacctgcccacctgggaggccgagaccatcatccagaagatcaagcagcagcagtatgctgacctgctgagccatgaccagctgctgacagagcggcgggagcagaaggtgttcctgcactttgaggaggaggagatcacctttgcccccacctacagatttgagcggctgacccgggacaagtatgcctacaccaagcagaaggccaccggcatgaagtacaacctgcccagctggtgtgacagagtgctgtggaagagctaccccctggtgcacgtggtgtgccagagctatggcagcaccagtgacatcatgaccagtgaccacagccctgtgtttgccacctttgaggccggcgtgaccagccagtttgtgtccaagaatggacctggcaccgtggacagccagggccagatcgagttcctgcgctgctacgccaccctgaagaccaagagccagaccaagttctacctggagttccacagcagctgcctggagagctttgtgaagagccaggagggagaaaatgaggagggcagcgagggggagctggtggtgaagtttggagagaccctgcccaagctgaagcccatcatcagtgaccctgagtacctgctggaccagcacatcctgatcagcatcaagagcagtgacagtgatgagagctatggagagggctgcatcgccctgcggctggaggccacagagacccagctgcccatctacacccccctgacccaccacggggagctgaccggccacttccagggcgagatcaagctgcagaccagccagggcaagacccgggagaagctgtatgactttgtgaagacagaaagagatgagagcagcggccccaagaccctgaagagcctgaccagccatgaccccatgaagcagtgggaggtgaccagccgggccccaccctgcagcggcagcagcatcacagagatcatcaaccccaactacatgggcgtgggcccctttggaccacccatgcccctgcacgtgaagcagaccctgagcccagaccagcagcccacagcctggagctatgaccagccccccaaggacagccccctgggcccctgccgcggggagagcccccccaccccacctggccagccccccatcagccccaagaagttcctgcccagcacagccaacagaggcctgccccccaggacccaggagagccggcccagcgacctgggcaagaatgctggggacaccctgccccaggaggacctgcccctgaccaagccagagatgtttgagaaccccctgtatggcagcctgagcagcttccccaagccagcccccaggaaggaccaggagagccccaagatgcccaggaaggagcccccaccctgcccagagcccggcatcctgagccccagcatcgtgctgaccaaggcccaggaggccgacagaggagagggccctgggaagcaggtgcctgccccccggctgcgctccttcacctgcagcagcagcgctgagggccgggctgctggaggagacaagagccagggcaagcccaagacccctgtgagcagccaggcccctgtgcctgccaagaggcccatcaagcccagccgctctgagatcaaccagcagaccccacccacccccacccccaggcctcccctgcctgtgaagagccctgctgtgctgcacctgcagcacagcaagggccgggactacagagacaacacagagctgccccaccacggcaagcacaggcctgaggagggccccccaggccccctgggccgcacagccatgcagtag

SEQ ID NO: 156044 - DNA, 2433 bp, Artificial Sequence
  Description of Artificial Sequence: Synthetic coding sequence
aagcgggagggcttctgccagctgctgcagcagatgaagaacaagcacagcgagcagcctgagccagacatgatcaccatcttcatcggcacctggaacatgggaaatgcccccccacccaagaagatcacctcctggttcctgagcaagggccagggcaagaccagagatgattctgctgactacatcccccatgacatctacgtgattggcacccaggaggaccccctgtctgagaaggagtggctggagatcctgaagcacagcctgcaggagatcacctctgtgaccttcaagacagtggccatccacaccctgtggaacatcagaattgtggtgctggccaagccagagcacgagaaccgcatcagccacatctgcacagacaacgtgaagacaggaattgccaacaccctgggcaacaagggagctgtgggcgtgtccttcatgttcaacggcaccagcctgggctttgtgaacagccacctgaccagcggcagcgagaagaagctgcggaggaaccagaactacatgaacatcctgcgcttcctggccctgggggacaagaagctgagccccttcaacatcacccaccgcttcacccacctgttctggtttggagacctgaactacagagtggacctgcccacctgggaggccgagaccatcatccagaagatcaagcagcagcagtatgctgacctgctgagccatgaccagctgctgacagaaagaagagagcagaaggtgttcctgcactttgaggaggaggagatcacctttgcccccacctacagatttgagcggctgacccgggacaagtatgcctacaccaagcagaaggccaccggcatgaagtacaacctgcccagctggtgtgacagagtgctgtggaagagctaccccctggtgcacgtggtgtgccagagctatggcagcaccagtgacatcatgaccagtgaccacagccctgtgtttgccacctttgaagctggggtgaccagccagtttgtgtccaagaatggacctggcaccgtggacagccagggccagatcgagttcctgcgctgctacgccaccctgaagaccaagagccagaccaagttctacctggagttccacagcagctgcctggagagctttgtgaagagccaggagggggagaatgaggagggcagcgagggggagctggtggtgaagtttggagagaccctgcccaagctgaagcccatcatcagtgaccctgagtacctgctggaccagcacatcctgatcagcatcaagagcagtgacagtgatgagagctatggagagggctgcatcgccctgcggctggaggccacagagacccagctgcccatctacacccccctgacccaccacggggagctgaccggccacttccagggcgagatcaagctgcagaccagccagggcaagacccgggagaagctgtatgactttgtgaagacagaaagagatgagagcagcggccccaagaccctgaagagcctgaccagccatgaccccatgaagcagtgggaggtgaccagccgggccccaccctgcagcggcagcagcatcacagagatcatcaaccccaactacatgggcgtgggccccttcggcccccccatgcccctgcacgtgaagcagaccctgagcccagaccagcagcccacagcctggagctatgaccagccccccaaggacagccccctgggcccctgccgcggggagagcccccccaccccacctggccagccccccatcagccccaagaagttcctgcccagcacagccaacagaggcctgccccccaggacccaggagagccggcccagcgacctgggcaagaatgctggggacaccctgccccaggaggacctgcccctgaccaagccagagatgtttgagaaccccctgtatggcagcctgagcagcttccccaagccagcccccaggaaggaccaggagagccccaagatgcccaggaaggagcccccaccctgcccagagcccggcatcctgagccccagcatcgtgctgaccaaggcccaggaggccgacagaggagagggccctgggaagcaggtgcctgccccccggctgcggagcttcacctgcagcagcagcgctgagggccgggccgccggcggggacaagagccagggcaagcccaagacccctgtgagcagccaggcccctgtgcctgccaagaggcccatcaagcccagccgctctgagatcaaccagcagaccccacccacccccaccccccggccccccctgcctgtgaagagccctgctgtgctgcacctgcagcacagcaagggccgggactacagagacaacacagagctgccccaccacggcaagcacaggcctgaggagggccccccaggccccctgggccgcacagccatgcagtag

SEQ ID NO: 156045 - DNA, 666 bp, Artificial Sequence
  Description of Artificial Sequence: Synthetic coding sequence
atggtgccctgctggaaccacggcaacatcaccaggagcaaggccgaggagctgctgagcaggacaggcaaggatggcagcttcctggtgcgggccagcgagagcatcagccgggcctatgccctgtgtgtgctgtacagaaactgtgtgtacacctaccgcatcctgcccaatgaagatgacaagttcaccgtgcaggccagcgagggcgtgtccatgaggttcttcaccaagctggaccagctgattgagttctacaagaaggagaacatgggcctggtgacccacctgcagtaccctgtgcccctggaggaggaggacacaggagatgatcctgaggaggacacagagagcgtggtgagccccccagagctgccccccaggaacatccccctgacagccagcagctgtgaggccaaggaggtgcccttcagcaatgaaaacccccgggccacagagaccagccggcccagcctgtctgagaccctcttccagaggctgcagagcatggacaccagcggcctgcctgaggagcacctgaaggccatccaggactacctgagcacccagctggcccaggacagcgagtttgtgaagacaggcagcagcagcctgccccacctgaagaagctgaccaccctgctgtgcaaggagctgtatggatag

SEQ ID NO: 156046 - DNA, 2433 bp, Artificial Sequence; identical to SEQ ID NO: 156044
  Description of Artificial Sequence: Synthetic coding sequence

SEQ ID NO: 156047 - DNA, 2433 bp, Artificial Sequence; identical to SEQ ID NO: 156044
  Description of Artificial Sequence: Synthetic coding sequence

SEQ ID NO: 156048 - DNA, 2826 bp, Artificial Sequence
  Description of Artificial Sequence: Synthetic coding sequence
cggccccaggtgcctggagaggccaaccccatcaacatggtgtccaagctgagccagctgaccagcctgctgagcagcattgaggacaaggtgaaggccctgctgcacgagggccctgagagcccccaccggcccagcctcatcccccctgtgacctttgaggtgaaggccgagagcctgggcatcccccagaagatgcagctgaaggtggatgtggagagcggcaagctgatcatcaagaagagcaaggatggcagcgaggacaagttctacagccacaagaagatcctgcagctgatcaagagccagaagttcctgaacaagctggtgatcctggtggagacagagaaggagaagatcctgaggaaggagtatgtgtttgctgacagcaagaagcgggagggcttctgccagctgctgcagcagatgaagaacaagcacagcgagcagcctgagccagacatgatcaccatcttcatcggcacctggaacatgggaaatgcccccccacccaagaagatcacctcctggttcctgagcaagggccagggcaagaccagagatgacagcgctgactacatcccccatgacatctacgtgattggcacccaggaggaccccctgtctgagaaggagtggctggagatcctgaagcacagcctgcaggagatcacctctgtgaccttcaagacagtggccatccacaccctgtggaacatccgcatcgtggtgctggccaagccagagcatgaaaatcgcatcagccacatctgcacagacaacgtgaagacaggcatcgccaacaccctgggcaacaagggagctgtgggcgtgtccttcatgtttaatggcaccagcctgggctttgtgaacagccacctgaccagcggcagcgagaagaagctgcggaggaaccagaactacatgaacatcctgcgcttcctggccctgggggacaagaagctgagccccttcaacatcacccaccgcttcacccacctgttctggtttggagacctgaactacagagtggacctgcccacctgggaggccgagaccatcatccagaagatcaagcagcagcagtatgctgacctgctgagccatgaccagctgctgacagagcggcgggagcagaaggtgttcctgcactttgaggaggaggagatcacctttgcccccacctacagatttgagcggctgacccgggacaagtatgcctacaccaagcagaaggccaccggcatgaagtacaacctgcccagctggtgtgacagagtgctgtggaagagctaccccctggtgcacgtggtgtgccagagctatggcagcaccagtgacatcatgaccagtgaccacagccctgtgtttgccacctttgaggccggcgtgaccagccagtttgtgtccaagaatggacctggcaccgtggacagccagggccagatcgagttcctgcgctgctacgccaccctgaagaccaagagccagaccaagttctacctggagttccacagcagctgcctggagagctttgtgaagagccaggagggagaaaatgaggagggcagcgagggggagctggtggtgaagtttggagagaccctgcccaagctgaagcccatcatcagtgaccctgagtacctgctggaccagcacatcctgatcagcatcaagagcagtgacagtgatgagagctatggagagggctgcatcgccctgcggctggaggccacagagacccagctgcccatctacacccccctgacccaccacggggagctgaccggccacttccagggcgagatcaagctgcagaccagccagggcaagacccgggagaagctgtatgactttgtgaagacagaaagagatgagagcagcggccccaagaccctgaagagcctgaccagccatgaccccatgaagcagtgggaggtgaccagccgggccccaccctgcagcggcagcagcatcacagagatcatcaaccccaactacatgggcgtgggcccctttggaccacccatgcccctgcacgtgaagcagaccctgagcccagaccagcagcccacagcctggagctatgaccagccccccaaggacagccccctgggcccctgccgcggggagagcccccccaccccacctggccagccccccatcagccccaagaagttcctgcccagcacagccaacagaggcctgccccccaggacccaggagagccggcccagcgacctgggcaagaatgctggggacaccctgccccaggaggacctgcccctgaccaagccagagatgtttgagaaccccctgtatggcagcctgagcagcttccccaagccagcccccaggaaggaccaggagagccccaagatgcccaggaaggagcccccaccctgcccagagcccggcatcctgagccccagcatcgtgctgaccaaggcccaggaggccgacagaggagagggccctgggaagcaggtgcctgccccccggctgcgctccttcacctgcagcagcagcgctgagggccgggctgctggaggagacaagagccagggcaagcccaagacccctgtgagcagccaggcccctgtgcctgccaagaggcccatcaagcccagccgctctgagatcaaccagcagaccccacccacccccacccccaggcctcccctgcctgtgaagagccctgctgtgctgcacctgcagcacagcaagggccgggactacagagacaacacagagctgccccaccacggcaagcacaggcctgaggagggccccccaggccccctgggccgcacagccatgcagtag

SEQ ID NO: 156049 - DNA, 669 bp, Artificial Sequence
  Description of Artificial Sequence: Synthetic coding sequence
atggtgccctgctggaaccacggcaacatcaccaggagcaaggccgaggagctgctgagcaggacaggcaaggatggcagcttcctggtgcgggccagcgagagcatcagccgggcctatgccctgtgtgtgctgtacagaaactgtgtgtacacctaccgcatcctgcccaatgaagatgacaagttcaccgtgcaggccagcgagggcgtgtccatgaggttcttcaccaagctggaccagctgattgagttctacaagaaggagaacatgggcctggtgacccacctgcagtaccctgtgcccctggaggaggaggacacaggagatgatcctgaggaggacacagtggagagcgtggtgtccccacctgagctgcccccaagaaacatccccctgacagccagcagctgtgaggccaaggaggtgcccttcagcaatgaaaacccccgggccacagagaccagccggcccagcctgtctgagaccctcttccagaggctgcagagcatggacaccagcggcctgcctgaggagcacctgaaggccatccaggactacctgagcacccagctggcccaggacagcgagtttgtgaagacaggcagcagcagcctgccccacctgaagaagctgaccaccctgctgtgcaaggagctgtatggatag

SEQ ID NO: 156050 - DNA, 2826 bp, Artificial Sequence
  Description of Artificial Sequence: Synthetic coding sequence
cctccccaggtgcctggagaggccaaccccatcaacatggtgtccaagctgagccagctgaccagcctgctgagcagcattgaggacaaggtgaaggccctgctgcacgagggccctgagagcccccaccggcccagcctcatcccccctgtgacctttgaggtgaaggccgagagcctgggcatcccccagaagatgcagctgaaggtggatgtggagagcggcaagctgatcatcaagaagagcaaggatggcagcgaggacaagttctacagccacaagaagatcctgcagctgatcaagagccagaagttcctgaacaagctggtgatcctggtggagacagagaaggagaagatcctgaggaaggagtatgtgtttgctgacagcaagaagcgggagggcttctgccagctgctgcagcagatgaagaacaagcacagcgagcagcctgagccagacatgatcaccatcttcatcggcacctggaacatgggaaatgcccccccacccaagaagatcacctcctggttcctgagcaagggccagggcaagaccagagatgacagcgctgactacatcccccatgacatctacgtgattggcacccaggaggaccccctgtctgagaaggagtggctggagatcctgaagcacagcctgcaggagatcacctctgtgaccttcaagacagtggccatccacaccctgtggaacatccgcatcgtggtgctggccaagccagagcatgaaaatcgcatcagccacatctgcacagacaacgtgaagacaggcatcgccaacaccctgggcaacaagggagctgtgggcgtgtccttcatgtttaatggcaccagcctgggctttgtgaacagccacctgaccagcggcagcgagaagaagctgcggaggaaccagaactacatgaacatcctgcgcttcctggccctgggggacaagaagctgagccccttcaacatcacccaccgcttcacccacctgttctggtttggagacctgaactacagagtggacctgcccacctgggaggccgagaccatcatccagaagatcaagcagcagcagtatgctgacctgctgagccatgaccagctgctgacagagcggcgggagcagaaggtgttcctgcactttgaggaggaggagatcacctttgcccccacctacagatttgagcggctgacccgggacaagtatgcctacaccaagcagaaggccaccggcatgaagtacaacctgcccagctggtgtgacagagtgctgtggaagagctaccccctggtgcacgtggtgtgccagagctatggcagcaccagtgacatcatgaccagtgaccacagccctgtgtttgccacctttgaggccggcgtgaccagccagtttgtgtccaagaatggacctggcaccgtggacagccagggccagatcgagttcctgcgctgctacgccaccctgaagaccaagagccagaccaagttctacctggagttccacagcagctgcctggagagctttgtgaagagccaggagggagaaaatgaggagggcagcgagggggagctggtggtgaagtttggagagaccctgcccaagctgaagcccatcatcagtgaccctgagtacctgctggaccagcacatcctgatcagcatcaagagcagtgacagtgatgagagctatggagagggctgcatcgccctgcggctggaggccacagagacccagctgcccatctacacccccctgacccaccacggggagctgaccggccacttccagggcgagatcaagctgcagaccagccagggcaagacccgggagaagctgtatgactttgtgaagacagaaagagatgagagcagcggccccaagaccctgaagagcctgaccagccatgaccccatgaagcagtgggaggtgaccagccgggccccaccctgcagcggcagcagcatcacagagatcatcaaccccaactacatgggcgtgggcccctttggaccacccatgcccctgcacgtgaagcagaccctgagcccagaccagcagcccacagcctggagctatgaccagccccccaaggacagccccctgggcccctgccgcggggagagcccccccaccccacctggccagccccccatcagccccaagaagttcctgcccagcacagccaacagaggcctgccccccaggacccaggagagccggcccagcgacctgggcaagaatgctggggacaccctgccccaggaggacctgcccctgaccaagccagagatgtttgagaaccccctgtatggcagcctgagcagcttccccaagccagcccccaggaaggaccaggagagccccaagatgcccaggaaggagcccccaccctgcccagagcccggcatcctgagccccagcatcgtgctgaccaaggcccaggaggccgacagaggagagggccctgggaagcaggtgcctgccccccggctgcgctccttcacctgcagcagcagcgctgagggccgggctgctggaggagacaagagccagggcaagcccaagacccctgtgagcagccaggcccctgtgcctgccaagaggcccatcaagcccagccgctctgagatcaaccagcagaccccacccacccccacccccaggcctcccctgcctgtgaagagccctgctgtgctgcacctgcagcacagcaagggccgggactacagagacaacacagagctgccccaccacggcaagcacaggcctgaggagggccccccaggccccctgggccgcacagccatgcagtag

SEQ ID NO: 156051 - DNA, 1791 bp, Artificial Sequence
  Description of Artificial Sequence: Synthetic coding sequence
atggtgccctgctggaaccacggcaacatcaccaggagcaaggccgaggagctgctgagcaggacaggcaaggatggcagcttcctggtgcgggccagcgagagcatcagccgggcctatgccctgtgtgtgctgtacagaaactgtgtgtacacctaccgcatcctgcccaatgaagatgacaagttcaccgtgcaggccagcgagggcgtgtccatgaggttcttcaccaagctggaccagctgattgagttctacaagaaggagaacatgggcctggtgacccacctgcagtaccctgtgcccctggaggaggaggacacaggagatgatcctgaggaggacacagtggagagcgtggtgtccccacctgagctgcccccaagaaacatccccctgacagccagcagctgtgaggccaaggaggtgcccttcagcaatgaaaacccccgggccacagagaccagccggcccagcctgtctgagaccctcttccagaggctgcagagcatggacaccagcggcctgcctgaggagcacctgaaggccatccaggactacctgagcacccagctggcccaggacagcgagtttgtgaagacaggcagcagcagcctgccccacctgaagaagctgaccaccctgctgtgcaaggagctgtatggctactgcctggaggtgctgctgagctaccccctgagcctgctgagccaggtgcctggagaggccaaccccatcaacatggtgtccaagctgagccagctgaccagcctgctgagcagcattgaggacaaggtgaaggccctgctgcacgagggccctgagagcccccaccggcccagcctcatcccccctgtgacctttgaggtgaaggccgagagcctgggcatcccccagaagatgcagctgaaggtggatgtggagagcggcaagctgatcatcaagaagagcaaggatggcagcgaggacaagttctacagccacaagaagatcctgcagctgatcaagagccagaagttcctgaacaagctggtgatcctggtggagacagagaaggagaagatcctgaggaaggagtatgtgtttgctgacagcaagaagcgggagggcttctgccagctgctgcagcagatgaagaacaagcacagcgagcagcctgagccagacatgatcaccatcttcatcggcacctggaacatgggaaatgcccccccacccaagaagatcacctcctggttcctgagcaagggccagggcaagaccagagatgattctgctgactacatcccccatgacatctacgtgattggcacccaggaggaccccctgtctgagaaggagtggctggagatcctgaagcacagcctgcaggagatcacctctgtgaccttcaagacagtggccatccacaccctgtggaacatcagaattgtggtgctggccaagccagagcacgagaaccgcatcagccacatctgcacagacaacgtgaagacaggaattgccaacaccctgggcaacaagggagctgtgggcgtgtccttcatgttcaacggcaccagcctgggctttgtgaacagccacctgaccagcggcagcgagaagaagctgcggaggaaccagaactacatgaacatcctgcgcttcctggccctgggggacaagaagctgagccccttcaacatcacccaccgcttcacccacctgttctggtttggagacctgaactacagagtggacctgcccacctgggaggccgagaccatcatccagaagatcaagcagcagtag

SEQ ID NO: 156052 - DNA, 837 bp, Artificial Sequence
  Description of Artificial Sequence: Synthetic coding sequence
tgacagaagaactggctgcgggagttctaccaggtggtgcacacccacaagccccacttcatggccctgcactgccaggagtttggaggcaagaactatgaggcctccatgagccacgtggacaagtttgtgaaggagctgctgagcagtgatgccatgaaggagtacaacagagcccgggtgtacctggatgagaactacaagagccaggagcacttcaccgccctgggcagcttctacttcctgcacgagagcctgaagaacatctaccagtttgacttcaaggccaagaagtacaggaaggtggccggcaaggagatctacagcgacaccctggagagcacccccatgctggagaaggagaagttcccccaggactacttccctgagtgcaagtggagcaggaagggcttcatccgcacccgctggtgcatcgctgactgtgcctttgacctggtgaacatccacctgttccatgatgccagcaacctggtggcctgggagaccagccccagcgtgtacagcggcatccgccacaaggccctgggctacgtgctggaccgcatcatcgaccagagatttgagaaggtgtcctactttgtgtttggagacttcaacttccggctggacagcaagtctgtggtggagctgctggagtttgacaaggagctgtctgtgttcaaggaccggctgtatgagctggacatctccttccccccatcctacccctacagtgaagatgcccggcagggcgagcagtacatgaacacccgctgcccagcctggtgtgaccgcatcctgatgagccccagcgccaaggagctggtgctgaggtag

SEQ ID NO: 156053 - DNA, 1164 bp, Artificial Sequence
  Description of Artificial Sequence: Synthetic coding sequence
atggccggcaaggccgccgcccctggaacagctgtgctgctggtgacagccaacgtgggcagcctgtttgatgatcctgagaacctgcagaagaactggctgcgggagttctaccaggtggtgcacacccacaagccccacttcatggccctgcactgccaggagtttggaggcaagaactatgaggcctccatgagccacgtggacaagtttgtgaaggagctgctgagcagtgatgccatgaaggagtacaacagagcccgggtgtacctggatgagaactacaagagccaggagcacttcaccgccctgggcagcttctacttcctgcacgagagcctgaagaacatctaccagtttgacttcaaggccaagaagtacaggaaggtggccggcaaggagatctacagcgacaccctggagagcacccccatgctggagaaggagaagttcccccaggactacttccctgagtgcaagtggagcaggaagggcttcatccgcacccgctggtgcatcgctgactgtgcctttgacctggtgaacatccacctgttccatgatgccagcaacctggtggcctgggagaccagccccagcgtgtacagcggcatccgccacaaggccctgggctacgtgctggaccgcatcatcgaccagagatttgagaaggtgtcctactttgtgtttggagacttcaacttccggctggacagcaagtctgtggtggagaccctgtgcaccaaggccaccatgcagacagtgcgggctgctgacaccaatgaggtggtgaagctgatcttccgggagagtgacaatgacaggaaggtgatgctgcagctggagaagaagctgtttgactacttcaaccaggaggtgttccgggacaacaacggcacagccctgctggagtttgacaaggagctgagcgtcttcaaggaccggctgtatgagctggacatctccttcccccccagctacccctacagtgaagatgcccggcagggcgagcagtacatgaacacccgctgcccagcctggtgtgaccgcatcctgatgagccccagcgccaaggagctggtgctgcgggtgtctgtgtgctgccccagccctggccaccggggcatgtggagcgctggcagcggcctggcccagccctggtag

SEQ ID NO: 156054 - DNA, 1239 bp, Artificial Sequence
  Description of Artificial Sequence: Synthetic coding sequence
atggccggcaaggccgccgcccctggaacagctgtgctgctggtgacagccaacgtgggcagcctgtttgatgatcctgagaacctgcagaagaactggctgcgggagttctaccaggtggtgcacacccacaagccccacttcatggccctgcactgccaggagtttggaggcaagaactatgaggcctccatgagccacgtggacaagtttgtgaaggagctgctgagcagtgatgccatgaaggagtacaacagagcccgggtgtacctggatgagaactacaagagccaggagcacttcaccgccctgggcagcttctacttcctgcacgagagcctgaagaacatctaccagtttgacttcaaggccaagaagtacaggaaggtggccggcaaggagatctacagcgacaccctggagagcacccccatgctggagaaggagaagttcccccaggactacttccctgagtgcaagtggagcaggaagggcttcatccgcacccgctggtgcatcgctgactgtgcctttgacctggtgaacatccacctgttccatgatgccagcaacctggtggcctgggagaccagccccagcgtgtacagcggcatccgccacaaggccctgggctacgtgctggaccgcatcatcgaccagagatttgagaaggtgtcctactttgtgtttggagacttcaacttccggctggacagcaagtctgtggtggagaccctgtgcaccaaggccaccatgcagacagtgcgggctgctgacaccaatgaggtggtgaagctgatcttccgggagagtgacaatgacaggaaggtgatgctgcagctggagaagaagctgtttgactacttcaaccaggaggtgttccgggacaacaacggcacagccctgctggagtttgacaaggagctgagcgtcttcaaggaccggctgtatgagctggacatctccttcccccccagctacccctacagtgaagatgcccggcagggcgagcagtacatgaacacccgctgcccagcctggtgtgaccgcatcctgatgagccccagcgccaaggagctggtgctgcggtctgagagcgaggagaaggtggtgacctatgaccacatcggccccaacgtgtgcatgggagaccacaagcctgtgttcctggccttccgcatcatgcctggggccggcaagccccacgcccacgtgcacaagtgctgcgtggtgcagtag

SEQ ID NO: 156055 - DNA, 558 bp, Artificial Sequence
  Description of Artificial Sequence: Synthetic coding sequence
atggccggcaaggccgccgcccctggaacagctgtgctgctggtgacagccaacgtgggcagcctgtttgatgatcctgagaacctgcagaagaactggctgcgggagttctaccaggtggtgcacacccacaagccccacttcatggccctgcactgccaggagtttggaggcaagaactatgaggcctccatgagccacgtggacaagtttgtgaaggagctgctgagcagtgatgccatgaaggagtacaacagagcccgggtgtacctggatgagaactacaagagccaggagcacttcaccgccctgggcagcttctacttcctgcacgagagcctgaagaacatctaccagtttgacttcaaggccaagaagtacaggaaggtggccggcaaggagatctacagcgacaccctggagagcacccccatgctggagaaggagaagttcccccaggactacttccctgagcggcacgtgccccacaccagcctggaggccctgctgatcctgcacgaggacccccagctgcctgacccccacctgcccctgtag

SEQ ID NO: 156056 - DNA, 1068 bp, Artificial Sequence
  Description of Artificial Sequence: Synthetic coding sequence
atggccggcaaggccgccgcccctggaacagctgtgctgctggtgacagccaacgtgggcagcctgtttgatgatcctgagaacctgcagaagaactggctgcgggagttctaccaggtggtgcacacccacaagccccacttcatggccctgcactgccaggagtttggaggcaagaactatgaggcctccatgagccacgtggacaagtttgtgaaggagctgctgagcagtgatgccatgaaggagtacaacagagcccgggtgtacctggatgagaactacaagagccaggagcacttcaccgccctgggcagcttctacttcctgcacgagagcctgaagaacatctaccagtttgacttcaaggccaagaagtacaggaaggtggccggcaaggagatctacagcgacaccctggagagcacccccatgctggagaaggagaagttcccccaggactacttccctgagtgcaagtggagcaggaagggcttcatccgcacccgctggtgcatcgctgactgtgcctttgacctggtgaacatccacctgttccatgatgccagcaacctggtggcctgggagaccagccccagcgtgtacagcggcatccgccacaaggccctgggctacgtgctggaccgcatcatcgaccagagatttgagaaggtgtcctactttgtgtttggagacttcaacttccggctggacagcaagtctgtggtggagctgctggagtttgacaaggagctgtctgtgttcaaggaccggctgtatgagctggacatctccttccccccatcctacccctacagtgaagatgcccggcagggcgagcagtacatgaacacccgctgcccagcctggtgtgaccgcatcctgatgagccccagcgccaaggagctggtgctgcggtctgagagcgaggagaaggtggtgacctatgaccacatcggccccaacgtgtgcatgggagaccacaagcctgtgttcctggccttccgcatcatgcctggagctgggaagccccacgcccacgtgcacaagtgctgcgtggtgcagtag

SEQ ID NO: 156057 - DNA, 417 bp, Artificial Sequence
  Description of Artificial Sequence: Synthetic coding sequence
gtcacagccaacgtgggcagcctgtttgatgatcctgagaacctgcagaagaactggctgcgggagttctaccaggccctgggcagcttctacttcctgcacgagagcctgaagaacatctaccagtttgacttcaaggccaagaagtacaggaaggtggccggcaaggagatctacagcgacaccctggagagcacccccatgctggagaaggagaagttcccccaggactacttccctgagtgcaagtggagcaggaagggcttcatccgcacccgctggtgcatcgctgactgtgcctttgacctggtgaacatccacctgttccatgatgccagcaacctggtggcctgggagaccagccccagcgtgtacagcggcatccgccacaaggccctgggctacgtgctggactag

SEQ ID NO: 156058 - DNA, 990 bp, Artificial Sequence
  Description of Artificial Sequence: Synthetic coding sequence
atgaaggagtacaacagagcccgggtgtacctggatgagaactacaagagccaggagcacttcaccgccctgggcagcttctacttcctgcacgagagcctgaagaacatctaccagtttgacttcaaggccaagaagtacaggaaggtggccggcaaggagatctacagcgacaccctggagagcacccccatgctggagaaggagaagttccccctgctgccccgggtgcagatggtgaagaagaggctgcacccagatgaggtgattgctgactgtgcctttgacctggtgaacatccacctgttccatgatgccagcaacctggtggcctgggagaccagccccagcgtgtacagcggcatccgccacaaggccctgggctacgtgctggaccgcatcatcgaccagagatttgagaaggtgtcctactttgtgtttggagacttcaacttccggctggacagcaagtctgtggtggagaccctgtgcaccaaggccaccatgcagacagtgcgggctgctgacaccaatgaggtggtgaagctgatcttccgggagagtgacaatgacaggaaggtgatgctgcagctggagaagaagctgtttgactacttcaaccaggaggtgttccgggacaacaatggaacagccctgctggagtttgacaaggagctgtctgtgttcaaggaccggctgtatgagctggacatctccttccccccatcctacccctacagtgaagatgcccggcagggcgagcagtacatgaacacccgctgcccagcctggtgtgaccgcatcctgatgagccccagcgccaaggagctggtgctgcggtctgagagcgaggagaaggtggtgacctatgaccacatcggccccaacgtgtgcatgggagaccacaagcctgtgttcctggccttccgcatcatgcctggagctgggaagccccacgcccacgtgcacaagtgctgcgtggtgcagtag

SEQ ID NO: 156059 - DNA, 315 bp, Artificial Sequence
  Description of Artificial Sequence: Synthetic coding sequence
ctggacatctccttcccccccagctacccctacagtgaagatgcccggcagggcgagcagtacatgaacacccgctgcccagcctggtgtgaccgcatcctgatgagccccagcgccaaggagctggtgctgcggtctgagagcgaggagaaggtggtgacctatgaccacatcggccccaacgtgtgcatgggagaccacaagcctgtgttcctggccttccgcatcatgcctggggccggcaagcgctgccagagacatgagaggaccctgcgggagcccccctgcagccggggccccaacacccacagctag

SEQ ID NO: 156060 - DNA, 546 bp, Artificial Sequence
  Description of Artificial Sequence: Synthetic coding sequence
gctgctgcccctggaacagctgtgctgctggtgacagccaacgtgggcagcctgtttgatgatcctgagaacctgcagaagaactggctgcgggagttctaccaggtggtgcacacccacaagccccacttcatggccctgcactgccaggagtttggaggcaagaactatgaggcctccatgagccacgtggacaagtttgtgaaggagctgctgagcagtgatgccatgaaggagtacaacagagcccgggtgtacctggatgagaactacaagagccaggagcacttcaccgccctgggcagcttctacttcctgcacgagagcctgaagaacatctaccagtttgacttcaaggccaagaagtacaggaaggtggccggcaaggagatctacagcgacaccctggagagcacccccatgctggagaaggagaagttcccccaggactacttccctgagcggcacgtgccccacaccagcctggaggccctgctgatcctgcacgaggacccccagctgcctgacccccacctgcccctgtag

SEQ ID NO: 156061 - DNA, 459 bp, Artificial Sequence
  Description of Artificial Sequence: Synthetic coding sequence
atggccggcaaggccgccgcccctggaacagctgtgctgctggtgacagccaacgtgggcagcctgtttgatgatcctgagaacctgcagaagaactggctgcgggagttctaccaggccctgggcagcttctacttcctgcacgagagcctgaagaacatctaccagtttgacttcaaggccaagaagtacaggaaggtggccggcaaggagatctacagcgacaccctggagagcacccccatgctggagaaggagaagttcccccaggactacttccctgagtgcaagtggagcaggaagggcttcatccgcacccgctggtgcatcgctgactgtgcctttgacctggtgaacatccacctgttccatgatgccagcaacctggtggcctgggagaccagccccagcgtgtacagcggcatccgccacaaggccctgggctacgtgctggactag

SEQ ID NO: 156062 - DNA, 1935 bp, Artificial Sequence
  Description of Artificial Sequence: Synthetic coding sequence
atgcccagcaaggccgagaacctgcggcccagcgagcccgccccccagcccccagagggccgcaccctgcagggccagctgcccggggcccccccagcccagagagctggcagccccccagatgcccctggcagcgagagccctgccctggcctgcagcaccccagccaccccatctggagaagatcctccagcccgggccgcccccatcgccccccggcccccagcccggccccggctggagcgggccctgagcctggatgacaagggctggaggagaagacgcttccggggcagccaggaggacctggaggccagaaatggcaccagccccagccggggctctgtgcagagcgagggccctggggccccagcccacagctgcagccccccctgcctgagcaccagcctgcaggagatccccaagagcagaggagtgctgagcagcgagcggggcagccccagcagcggcggcaaccccctgagcggcgtggccagcagcagccccaacctgccccacagagatgctgctgtggccggcagcagcccccggctgcccagcctgctgccccccaggcctcctccagccctgagcctggacatcgccagtgacagcctgaggacagccaacaaggtggacagcgacctggccgactacaagctgcgggcccagcccctgctggtgcgggcccacagcagcctgggccctggccggcccaggagccccctggcctgtgatgactgcagcctgcggagcgccaagagcagcttcagcctgctggcccccatccgcagcaaggatgtgcgcagccgcagctacctggagggcagcctgctggccagcggggccctgctgggcgcagatgagctggcccgctacttcccagacagaaatgtggccctgtttgtggccacctggaacatgcagggccagaaggagctgccccccagcctggatgagttcctgctgcctgctgaggccgactatgcccaggacctgtatgtgattggagtgcaggagggctgcagcgacagaagagagtgggagacccggctgcaggagaccctgggcccccactacgtgctgctgagcagcgctgcccacggcgtgctgtacatgagcctcttcatccggcgggacctgatctggttctgcagcgaggtggagtgcagcacagtgaccaccagaattgtgtcccagatcaagaccaagggggccctgggcatctccttcaccttcttcggcaccagcttcctgttcatcaccagccacttcaccagcggagatggcaaggtggccgagcggctgctggactacaccaggacagtgcaggccctggtgctgcccagaaatgtgcctgacaccaacccctaccgcagcagcgctgctgatgtgaccaccaggtttgatgaggtgttctggtttggagacttcaacttccggctgagcggcggccgcacagtggtggatgccctgctgtgccagggcctggtggtggatgtgcctgccctgctgcagcacgaccagctgatccgggagatgaggaagggcagcatcttcaagggcttccaggagccagacatccacttcctgcccagctacaagtttgacatcggcaaggacacctatgacagcaccagcaagcagaggacccccagctacacagacagagtgctgtaccgcagccgccacaagggggacatctgccctgtgtcctacagcagctgccccggcatcaagaccagtgaccacaggcctgtgtatggcctcttccgggtgaaggtgcggcccggccgggacaacatccccctggccgccggcaagtttgaccgggagctgtacctgctgggcatcaagaggcgcatcagcaaggagatccagaggcagcaggccctgcagagccagaacagcagcaccatctgcagcgtgtcctag

SEQ ID NO: 156063 - DNA, 960 bp, Artificial Sequence
  Description of Artificial Sequence: Synthetic coding sequence
atggaccagagcgtggccatccaggagaccctggccgagggggagtactgtgtgattgctgtgcagggcgtgctgtgtgagggggacagccggcagagccggctgctgggcctggtgcgctaccgcctggagcacggcggccaggagcacgccctcttcctgtacacccacaggaggatggccatcactggagatgatgtgtccctggaccagatcgtgcctgtgtcccgggacttcaccctggaggaggtgtccccagatggagagctgtacatcctgggcagtgatgtgacagtgcagctggacacagctgagctgagcctggtgttccagctgcccttcggcagccagaccaggatgttcctgcacgaggtggcccgggcctgccccggctttgacagcgccacccgggaccctgagttcctgtggctgagccgctaccgctgtgccgagctggagctggagatgcccaccccccggggctgcaacagcgccctggtgacctggccaggctacgccaccatcggcggcggccgctaccccagcaggaagaagcgctggggcctggaggaggcccggccccagggcgccggctctgtgctcttctggggcggggccatggagaagacaggcttccggctgatggagcgggcccatggaggcggctttgtgtggggccgcagcgccagagatggaagaagagatgaggagctggaggaggccggccgggagatgtctgctgctgctggcagccgggagaggaacacagctggcagcgctgggggcggcaagctgggctggggcgccggccctggagctgctgtgcggcctgccctgggctgggccggcagcgctgtgtggcctgtggatgcccggggggaggaccagagccctgggggccccctggaggccggcaccctgggccagaagttctgtgatgtgctgctgcggcgggcctag

SEQ ID NO: 156064 - DNA, 2982 bp, Artificial Sequence
  Description of Artificial Sequence: Synthetic coding sequence
atggaccagagcgtggccatccaggagaccctggccgagggggagtactgtgtgattgctgtgcagggcgtgctgtgtgagggggacagccggcagagccggctgctgggcctggtgcgctaccgcctggagcacggcggccaggagcacgccctcttcctgtacacccacaggaggatggccatcactggagatgatgtgtccctggaccagatcgtgcctgtgtcccgggacttcaccctggaggaggtgtccccagatggagagctgtacatcctgggcagtgatgtgacagtgcagctggacacagctgagctgagcctggtgttccagctgcccttcggcagccagaccaggatgttcctgcacgaggtggcccgggcctgccccggctttgacagcgccacccgggaccctgagttcctgtggctgagccgctaccgctgtgccgagctggagctggagatgcccaccccccggggctgcaacagcgccctggtgacctggccaggctacgccaccatcggcggcggccgctaccccagcaggaagaagcgctggggcctggaggaggcccggccccagggcgccggctctgtgctcttctggggcggggccatggagaagacaggcttccggctgatggagcgggcccatggaggcggctttgtgtggggccgcagcgccagagatggaagaagagatgaggagctggaggaggccggccgggagatgtctgctgctgctggcagccgggagaggaacacagctgggggcagcaactttgatggcctgcggcccaacgggaagggcgtgcccatggaccagagcagccggggccaggacaagccagagagcctgcagccccggcagaacaagagcaagtctgagatcacagacatggtgcgcagcagcaccatcaccgtgtctgacaaggcccacatcctgtccatgcagaagtttggcctgcgggacaccatcgtgaagagccacctgctgcagaaggaggaggactacacctacatccagaacttccgcttctttgctggcacctacaacgtgaatggccagagccccaaggaatgtctgcggctgtggctgagcaatggcatccaggccccagatgtgtactgtgtgggcttccaggagctggacctgagcaaggaggccttcttcttccatgacacccccaaggaggaggagtggttcaaggctgtgtctgagggcctgcacccagatgccaagtatgccaaggtgaagctgatccggctggtgggcatcatgctgctgctgtatgtgaagcaggagcacgccgcctacatcagcgaggtggaggccgagaccgtgggcaccggcatcatgggccgcatgggcaacaagggcggcgtggccatccgcttccagttccacaacaccagcatctgtgtggtgaacagccacctggccgcccacatcgaggagtatgaaagaagaaaccaggactacaaggacatctgcagcaggatgcagttctgccagcctgaccccagcctgccccccctgaccatcagcaaccatgatgtgatcctgtggctgggggacctgaactaccgcatcgaggagctggatgtggagaaggtgaagaagctgattgaggagaaggacttccagatgctgtatgcctatgaccagctgaagatccaggtggccgccaagacagtgtttgagggcttcacagaaggagagctgaccttccagcccacctacaagtatgacaccggcagtgatgactgggacaccagcgagaagtgccgggccccagcctggtgtgaccgcatcctgtggaagggcaagaacatcacccagctgagctaccagagccacatggccctgaagaccagtgaccacaagcctgtgtcctctgtgtttgacatcggcgtgcgggtggtgaatgatgagctgtacaggaagaccctggaggagatcgtgcgcagcctggacaagatggagaatgccaacatccccagcgtgtccctgagcaagcgggagttctgcttccagaatgtgaagtacatgcagctgaaggtggagagcttcaccatccacaacggccaggtgccctgccactttgagttcatcaacaagccagatgaggagagctactgcaagcagtggctgaatgccaaccccagccggggcttcctgctgcctgacagtgatgtggagattgacctggagctgtttgtgaacaagatgacagccaccaagctgaacagcggggaggacaagattgaggacatcctggtgctgcacctggaccggggcaaggactacttcctgtctgtgtctggcaactacctgcccagctgcttcggcagccccatccacaccctgtgctacatgagggagcccatcctggacctgcccctggagaccatcagcgagctgaccctgatgcctgtgtggacaggagatgatggcagccagctggacagccccatggagatccccaaggagctgtggatgatggtggactacctgtacagaaatgctgtgcagcaggaggacctcttccagcagcccggcctgcggagtgaatttgagcacatccgggactgcctggacaccggcatgattgacaacctgagcgccagcaaccacagcgtggccgaggccctgctgctcttcctggagagcctgcctgagcccgtcatctgctacagcacctaccacaactgcctggagtgcagcggcaactacacagccagcaagcaggtgatcagcaccctgcccatcttccacaagaatgtgttccactacctgatggccttcctgcgggagctgctgaagaacagcgccaagaaccacctggatgagaacatcctggccagcatcttcggcagcctgctgctgagaaatcctgctggccaccagaagctggacatgacagagaagaagaaggcccaggagttcatccaccagttcctgtgcaaccccctgtag

SEQ ID NO: 156065 - DNA, 2742 bp, Artificial Sequence
  Description of Artificial Sequence: Synthetic coding sequence
atggaccagagcgtggccatccaggagaccctggccgagggggagtactgtgtgattgctgtgcagggcgtgctgtgtgagggggacagccggcagagccggctgctgggcctggtgcgctaccgcctggagcacggcggccaggagcacgccctcttcctgtacacccacaggaggatggccatcactggagatgatgtgtccctggaccagatcgtgcctgtgtcccgggacttcaccctggaggaggtgtccccagatggagagctgtacatcctgggcagtgatgtgacagtgcagctggacacagctgagctgagcctggtgttccagctgcccttcggcagccagaccaggatgttcctgcacgaggtggcccgggcctgccccggctttgacagcgccacccgggaccctgagttcctgtggctgagccgctaccgctgtgccgagctggagctggagatgcccaccccccggggctgcaacagcgccctggtgacctggccaggctacgccaccatcggcggcggcggcagcaactttgatggcctgcggcccaacgggaagggcgtgcccatggaccagagcagccggggccaggacaagccagagagcctgcagccccggcagaacaagagcaagtctgagatcacagacatggtgcgcagcagcaccatcaccgtgtctgacaaggcccacatcctgtccatgcagaagtttggcctgcgggacaccatcgtgaagagccacctgctgcagaaggaggaggactacacctacatccagaacttccgcttctttgctggcacctacaacgtgaatggccagagccccaaggaatgtctgcggctgtggctgagcaatggcatccaggccccagatgtgtactgtgtgggcttccaggagctggacctgagcaaggaggccttcttcttccatgacacccccaaggaggaggagtggttcaaggctgtgtctgagggcctgcacccagatgccaagtatgccaaggtgaagctgatccggctggtgggcatcatgctgctgctgtatgtgaagcaggagcacgccgcctacatcagcgaggtggaggccgagaccgtgggcaccggcatcatgggccgcatgggcaacaagggcggcgtggccatccgcttccagttccacaacaccagcatctgtgtggtgaacagccacctggccgcccacatcgaggagtatgaaagaagaaaccaggactacaaggacatctgcagcaggatgcagttctgccagcctgaccccagcctgccccccctgaccatcagcaaccatgatgtgatcctgtggctgggggacctgaactaccgcatcgaggagctggatgtggagaaggtgaagaagctgattgaggagaaggacttccagatgctgtatgcctatgaccagctgaagatccaggtggccgccaagacagtgtttgagggcttcacagaaggagagctgaccttccagcccacctacaagtatgacaccggcagtgatgactgggacaccagcgagaagtgccgggccccagcctggtgtgaccgcatcctgtggaagggcaagaacatcacccagctgagctaccagagccacatggccctgaagaccagtgaccacaagcctgtgtcctctgtgtttgacatcggcgtgcgggtggtgaatgatgagctgtacaggaagaccctggaggagatcgtgcgcagcctggacaagatggagaatgccaacatccccagcgtgtccctgagcaagcgggagttctgcttccagaatgtgaagtacatgcagctgaaggtggagagcttcaccatccacaacggccaggtgccctgccactttgagttcatcaacaagccagatgaggagagctactgcaagcagtggctgaatgccaaccccagccggggcttcctgctgcctgacagtgatgtggagattgacctggagctgtttgtgaacaagatgacagccaccaagctgaacagcggggaggacaagattgaggacatcctggtgctgcacctggaccggggcaaggactacttcctgtctgtgtctggcaactacctgcccagctgcttcggcagccccatccacaccctgtgctacatgagggagcccatcctggacctgcccctggagaccatcagcgagctgaccctgatgcctgtgtggacaggagatgatggcagccagctggacagccccatggagatccccaaggagctgtggatgatggtggactacctgtacagaaatgctgtgcagcaggaggacctcttccagcagcccggcctgcggagtgaatttgagcacatccgggactgcctggacaccggcatgattgacaacctgagcgccagcaaccacagcgtggccgaggccctgctgctcttcctggagagcctgcctgagcccgtcatctgctacagcacctaccacaactgcctggagtgcagcggcaactacacagccagcaagcaggtgatcagcaccctgcccatcttccacaagaatgtgttccactacctgatggccttcctgcgggagctgctgaagaacagcgccaagaaccacctggatgagaacatcctggccagcatcttcggcagcctgctgctgagaaatcctgctggccaccagaagctggacatgacagagaagaagaaggcccaggagttcatccaccagttcctgtgcaaccccctgtag

SEQ ID NO: 156066 - DNA, 2982 bp, Artificial Sequence; identical to SEQ ID NO: 156064
  Description of Artificial Sequence: Synthetic coding sequence

SEQ ID NO: 156067 - DNA, 2250 bp, Artificial Sequence
  Description of Artificial Sequence: Synthetic coding sequence
atgtctgctgctgctggcagccgggagaggaacacagctgggggcagcaactttgatggcctgcggcccaacgggaagggcgtgcccatggaccagagcagccggggccaggacaagccagagagcctgcagccccggcagaacaagagcaagtctgagatcacagacatggtgcgcagcagcaccatcaccgtgtctgacaaggcccacatcctgtccatgcagaagtttggcctgcgggacaccatcgtgaagagccacctgctgcagaaggaggaggactacacctacatccagaacttccgcttctttgctggcacctacaacgtgaatggccagagccccaaggaatgtctgcggctgtggctgagcaatggcatccaggccccagatgtgtactgtgtgggcttccaggagctggacctgagcaaggaggccttcttcttccatgacacccccaaggaggaggagtggttcaaggctgtgtctgagggcctgcacccagatgccaagtatgccaaggtgaagctgatccggctggtgggcatcatgctgctgctgtatgtgaagcaggagcacgccgcctacatcagcgaggtggaggccgagaccgtgggcaccggcatcatgggccgcatgggcaacaagggcggcgtggccatccgcttccagttccacaacaccagcatctgtgtggtgaacagccacctggccgcccacatcgaggagtatgaaagaagaaaccaggactacaaggacatctgcagcaggatgcagttctgccagcctgaccccagcctgccccccctgaccatcagcaaccatgatgtgatcctgtggctgggggacctgaactaccgcatcgaggagctggatgtggagaaggtgaagaagctgattgaggagaaggacttccagatgctgtatgcctatgaccagctgaagatccaggtggccgccaagacagtgtttgagggcttcacagaaggagagctgaccttccagcccacctacaagtatgacaccggcagtgatgactgggacaccagcgagaagtgccgggccccagcctggtgtgaccgcatcctgtggaagggcaagaacatcacccagctgagctaccagagccacatggccctgaagaccagtgaccacaagcctgtgtcctctgtgtttgacatcggcgtgcgggtggtgaatgatgagctgtacaggaagaccctggaggagatcgtgcgcagcctggacaagatggagaatgccaacatccccagcgtgtccctgagcaagcgggagttctgcttccagaatgtgaagtacatgcagctgaaggtggagagcttcaccatccacaacggccaggtgccctgccactttgagttcatcaacaagccagatgaggagagctactgcaagcagtggctgaatgccaaccccagccggggcttcctgctgcctgacagtgatgtggagattgacctggagctgtttgtgaacaagatgacagccaccaagctgaacagcggggaggacaagattgaggacatcctggtgctgcacctggaccggggcaaggactacttcctgtctgtgtctggcaactacctgcccagctgcttcggcagccccatccacaccctgtgctacatgagggagcccatcctggacctgcccctggagaccatcagcgagctgaccctgatgcctgtgtggacaggagatgatggcagccagctggacagccccatggagatccccaaggagctgtggatgatggtggactacctgtacagaaatgctgtgcagcaggaggacctcttccagcagcccggcctgcggagtgaatttgagcacatccgggactgcctggacaccggcatgattgacaacctgagcgccagcaaccacagcgtggccgaggccctgctgctcttcctggagagcctgcctgagcccgtcatctgctacagcacctaccacaactgcctggagtgcagcggcaactacacagccagcaagcaggtgatcagcaccctgcccatcttccacaagaatgtgttccactacctgatggccttcctgcgggagctgctgaagaacagcgccaagaaccacctggatgagaacatcctggccagcatcttcggcagcctgctgctgagaaatcctgctggccaccagaagctggacatgacagagaagaagaaggcccaggagttcatccaccagttcctgtgcaaccccctgtag

SEQ ID NO: 156068 - DNA, 2487 bp, Artificial Sequence
  Description of Artificial Sequence: Synthetic coding sequence
atggaccagagcgtggccatccaggagaccctggccgagggggagtactgtgtgattgctgtgcagggcgtgctgtgtgagggggacagccggcagagccggctgctgggcctggtgcgctaccgcctggagcacggcggccaggagcacgccctcttcctgtacacccacaggaggatggccatcactggagatgatgtgtccctggaccagatcgtgcctgtgtcccgggacttcaccctggaggaggtgtccccagatggagagctgtacatcctgggcagtgatgtgacagtgcagctggacacagctgagctgagcctggtgttccagctgcccttcggcagccagaccaggatgttcctgcacgaggtggcccgggcctgccccggctttgacagcgccacccgggaccctgagttcctgtggctgagccgctaccgctgtgccgagctggagctggagatgcccaccccccggggctgcaacagcgccctggtgacctggccaggctacgccaccatcggcggcggccgctaccccagcaggaagaagcgctggggcctggaggaggcccggccccagggcgccggctctgtgctcttctggggcggggccatggagaagacaggcttccggctgatggagcgggcccatggaggcggctttgtgtggggccgcagcgccagagatggaagaagagatgaggagctggaggaggccggccgggagatgtctgctgctgctggcagccgggagaggaacacagctgggggcagcaactttgatggcctgcggcccaacgggaagggcgtgcccatggaccagagcagccggggccaggacaagccagagagcctgcagccccggcagaacaagagcaagtctgagatcacagacatggtgcgcagcagcaccatcaccgtgtctgacaaggcccacatcctgtccatgcagaagtttggcctgcgggacaccatcgtgaagagccacctgctgcagaaggaggaggactacacctacatccagaacttccgcttctttgctggcacctacaacgtgaatggccagagccccaaggaatgtctgcggctgtggctgagcaatggcatccaggccccagatgtgtactgtgtgggcttccaggagctggacctgagcaaggaggccttcttcttccatgacacccccaaggaggaggagtggttcaaggctgtgtctgagggcctgcacccagatgccaagtatgccaaggtgaagctgatccggctggtgggcatcatgctgctgctgtatgtgaagcaggagcacgccgcctacatcagcgaggtggaggccgagaccgtgggcaccggcatcatgggccgcatgggcaacaagggcggcgtggccatccgcttccagttccacaacaccagcatctgtgtggtgaacagccacctggccgcccacatcgaggagtatgaaagaagaaaccaggactacaaggacatctgcagcaggatgcagttctgccagcctgaccccagcctgccccccctgaccatcagcaaccatgatgtgatcctgtggctgggggacctgaactaccgcatcgaggagctggatgtggagaaggtgaagaagctgattgaggagaaggacttccagatgctgtatgcctatgaccagctgaagatccaggtggccgccaagacagtgtttgagggcttcacagaaggagagctgaccttccagcccacctacaagtatgacaccggcagtgatgactgggacaccagcgagaagtgccgggccccagcctggtgtgaccgcatcctgtggaagggcaagaacatcacccagctgagctaccagagccacatggccctgaagaccagtgaccacaagcctgtgtcctctgtgtttgacatcggcgtgcgggtggtgaatgatgagctgtacaggaagaccctggaggagatcgtgcgcagcctggacaagatggagaatgccaacatccccagcgtgtccctgagcaagcgggagttctgcttccagaatgtgaagtacatgcagctgaaggtggagagcttcaccatccacaacggccaggtgccctgccactttgagttcatcaacaagccagatgaggagagctactgcaagcagtggctgaatgccaaccccagccggggcttcctgctgcctgacagtgatgtggagattgacctggagctgtttgtgaacaagatgacagccaccaagctgaacagcggggaggacaagattgaggacatcctggtgctgcacctggaccggggcaaggactacttcctgtctgtgtctggcaactacctgcccagctgcttcggcagccccatccacaccctgtgctacatgagggagcccatcctggacctgcccctggagaccatcagcgagctgctggcctacctggccgcctactgctttgagacccagctggtgaccaagagcctcatctag

SEQ ID NO: 156069 - DNA, 528 bp, Artificial Sequence
  Description of Artificial Sequence: Synthetic coding sequence
atgcagaagtttggcctgcgggacaccatcgtgaagagccacctgctgcagaaggaggaggactacacctacatccagaacttccgcttctttgctggcacctacaacgtgaatggccagagccccaaggagtgcctgcggctgtggctgagcaatggcatccaggccccagatgtgtactgtgtgggcttccaggagctggacctgagcaaggaggccttcttcttccatgacacccccaaggaggaggagtggttcaaggctgtgtctgagggcctgcacccagatgccaagtatgccaaggtgaagctgatccggctggtgggcatcatgctgctgctgtatgtgaagcaggagcacgccgcctacatcagcgaggtggaggccgagaccgtgggcaccggcatcatgggccgcatgtgtgacctggtggccggcggcccccagctgcaggacagaagagctggctgcggcaagtctgagaaggcccacagaagagagggcctgagcaatgctgtgtgcatctag

SEQ ID NO: 156070 - DNA, 834 bp, Artificial Sequence
  Description of Artificial Sequence: Synthetic coding sequence
atggctgacccctggcaggagtgcatggactatgctgtgaccctggcccggcaggccggggaggtggtgtgtgaggccatcaagaatgagatgaatgtgatgctgaagagcagccctgtggacctggtgacagccacagaccagaaggtggagaagatgctgatcagcagcatcaaggagaagtaccccagccacagcttcatcggggaggagagcgtggccgccggggagaagagcatcctgacagacaaccccacctggatcatcgaccccattgatggcaccaccaactttgtgcaccgcttcccctttgtggccgtgtccattggatttgctgtgaacaagaagattgaatttggagtggtgtacagctgtgtggagggcaagatgtacacagccaggaaaggaaaaggagccttctgcaatggccagaagctgcaggtgtcccagcaggaggacatcaccaagagcctgctggtgacagagctgggcagcagcaggaccccagagaccgtgaggatggtgctgagcaacatggagaagctgttctgcatccctgtgcacggcatccgctctgtgggcacagctgctgtgaacatgtgcctggtggccactggaggagcagatgcctactatgagatgggcatccactgctgggatgtggccggggccggcatcatcgtgacagaagctggaggagtgctgatggatgtgactggaggcccctttgacctgatgagccggcgggtgattgctgccaacaaccgcatcctggccgagcgcatcgccaaggagatccaggtgatccccctgcagagagatgatgaggactag

SEQ ID NO: 156071 - DNA, 597 bp, Artificial Sequence
  Description of Artificial Sequence: Synthetic coding sequence
atggctgacccctggcaggagtgcatggactatgctgtgaccctggcccggcaggccggggaggtggtgtgtgaggccatcaagaatgagatgaatgtgatgctgaagagcagccctgtggacctggtgacagccacagaccagaaggtggagaagatgctgatcagcagcatcaaggagaagtaccccagccacagcttcatcggggaggagagcgtggccgccggggagaagagcatcctgacagacaaccccacctggatcatcgaccccattgatggcaccaccaactttgtgcaccgcttcccctttgtggccgtgtccattggatttgctgtgaacaagaagattgaatttggagtggtgtacagctgtgtggagggcaagatgtacacagccaggaaaggaaaaggagccttctgcaatggccagaagctgcaggtgtcccagcaggagggcagcggcgtgctggagcagcagctgctgatctgtgccctgtggcagctggccgagcagatgcacatcatgaagtgggagttcaccgctggcatgctgcaggagctggccctgctgctgctgaagctggtggcctgctag

SEQ ID NO: 156072 - DNA, 1011 bp, Artificial Sequence
  Description of Artificial Sequence: Synthetic coding sequence
atgggccagaggcctggccctgtgctgcctgctgtggccgtgctgggccaggtggccaagaggaaggtggcctggctgctgcgctggaaggctgtgaccaggacagaaacagctggcaacagcagcggcgtgtatggctttgggaagatgaagatctttgtgaagtacttccagaagatggctgacccctggcaggagtgcatggactatgctgtgaccctggcccggcaggccggggaggtggtgtgtgaggccatcaagaatgagatgaatgtgatgctgaagagcagccctgtggacctggtgacagccacagaccagaaggtggagaagatgctgatcagcagcatcaaggagaagtaccccagccacagcttcatcggggaggagagcgtggccgccggggagaagagcatcctgacagacaaccccacctggatcatcgaccccattgatggcaccaccaactttgtgcaccgcttcccctttgtggccgtgtccatcggctttgctgtgaacaagaagattgaatttggagtggtgtacagctgtgtggagggcaagatgtacacagccaggaagggcaagggggccttctgcaatggccagaagctgcaggtgtcccagcaggaggacatcaccaagagcctgctggtgacagagctgggcagcagcaggaccccagagaccgtgaggatggtgctgagcaacatggagaagctgttctgcatccctgtgcacggcatccgctctgtgggcacagctgctgtgaacatgtgcctggtggccaccggcggcgcagatgcctactatgagatgggcatccactgctgggatgtggccggggccggcatcatcgtgacagaggccggcggcgtgctgatggatgtgactggaggcccctttgacctgatgagcagaagagtgattgctgccaacaaccgcatcctggccgagagaattgccaaggagatccaggtgatccccctgcagagagatgatgaagattag

SEQ ID NO: 156073 - DNA, 462 bp, Artificial Sequence
  Description of Artificial Sequence: Synthetic coding sequence
atggctgacccctggcaggagtgcatggactatgctgtgaccctggcccggcaggccggggaggtggtgtgtgaggccatcaagaatgagatgaatgtgatgctgaagagcagccctgtggacctggtgacagccacagaccagaaggtggagaagatgctgatcagcagcatcaaggagaagtaccccagccaccgcttcccctttgtggccgtgtccatcggctttgctgtgaacaagaagattgaatttggagtggtgtacagctgtgtggagggcaagatgtacacagccaggaagggcaagggggccttctgcaatggccagaagctgcaggtgtcccagcaggaggacatcaccaagagcctgctggtgacagagctgggcagcagcaggaccccagagaccgtgaggatggtgctgagcaacatggagaagctgttctgcatccctgtgcactag

SEQ ID NO: 156074 - DNA, 636 bp, Artificial Sequence
  Description of Artificial Sequence: Synthetic coding sequence
atgggccagaggcctggccctgtgctgcctgctgtggccgtgctgggccaggtggccaagaggaaggtggcctggctgctgcgctggaaggctgtgaccaggacagaaacagctggcaacagcagcggcgtgtatggctttgggaagatgaagatctttgtgaagtacttccagaagatggctgacccctggcaggagtgcatggactatgctgtgaccctggcccggcaggccggggaggtggtgtgtgaggccatcaagaatgagatgaatgtgatgctgaagagcagccctgtggacctggtgacagccacagaccagaaggtggagaagatgctgatcagcagcatcaaggagaagtaccccagccacagcttcatcggggaggagagcgtggccgccggggagaagagcatcctgacagacaaccccacctggatcatcgaccccattgatggcaccaccaactttgtgcaccgcttcccctttgtggccgtgtccatcggctttgctgtgaacaagaagattgaatttggagtggtgtacagctgtgtggagggcaagatgtacacagccaggaagggcaagggggccttctgcaatggccagaagctgcaggtgtcccagcaggagtag

SEQ ID NO: 156075 - DNA, 867 bp, Artificial Sequence
  Description of Artificial Sequence: Synthetic coding sequence
atgaagcccagcggggaggaccaggccgccctggccgccggcccctgggaggagtgcttccaggccgctgtgcagctggccctgcgggccggccagatcatcaggaaggccctgacagaggagaagagggtgtccaccaagaccagcgctgctgacctggtgacagaaacagaccacctggtggaggacctgatcatcagcgagctgcgggagcgcttccccagccaccgcttcatcgccgaggaggccgccgccagcggggccaagtgtgtgctgacccacagccccacctggatcatcgaccccattgatggcacctgcaactttgtgcaccgcttccccaccgtggccgtgtccatcggctttgctgtgcggcaggagctggagtttggagtcatctaccactgcacagaggagcggctgtacacaggaagaagaggccgcggggccttctgcaatggccagaggctgcgggtgtctggagaaacagacctgagcaaggccctggtgctgacagagatcggccccaagagggaccctgccaccctgaagctgttcctgagcaacatggagcggctgctgcacgccaaggcccatggagtgcgggtcatcggcagcagcaccctggccctgtgccacctggccagcggggctgctgatgcctactaccagtttggcctgcactgctgggacctggccgccgccaccgtcatcatccgggaggccggcggcatcgtgattgacaccagcggcggccccctggacctgatggcctgccgggtggtggccgccagcacccgggagatggccatgctgattgcccaggccctgcagaccatcaactacggcagagatgatgagaagtag

SEQ ID NO: 156076 - DNA, 258 bp, Artificial Sequence
  Description of Artificial Sequence: Synthetic coding sequence
atgaagcccagcggggaggaccaggccgccctggccgccggcccctgggaggagtgcttccaggccgctgtgcagctggccctgcgggccggccagatcatcaggaaggccctgacagaggagaagagggtgtccaccaagaccagcgctgctgacctggtgacagaaacagaccacctggtggaggacctgatcatcagcgagctgcgggagcgcttccccagccacaggagccccttcagcctggtgcacatgtag

SEQ ID NO: 156077 - DNA, 1071 bp, Artificial Sequence
  Description of Artificial Sequence: Synthetic coding sequence
atgctggagcagatccggcgggacatccgggacttccgcagcagcgctggcctggacaaggtgattgtgctgtggacagccaacacagagcgcttctgtgaggtgattcctggcctgaatgacacagctgagaacctgctgcggaccatcgagctgggcctggaggtgagccccagcaccctgtttgctgtggccagcatcctggagggctgtgccttcctgaatggcagcccccagaacaccctggtgcctggggccctggagctggcctggcagcaccgggtgtttgtgggcggagatgacttcaagagcggccagaccaaggtgaagtctgtgctggtggacttcctgattggcagcggcctgaagaccatgagcatcgtgtcctacaaccacctgggcaacaatgatggagagaacctgagcgcccccctgcagttccgcagcaaggaggtgtccaagagcaatgtggtggatgacatggtgcagagcaaccctgtgctgtacaccccaggagaggagccagaccactgtgtggtgatcaagtatgtgccctacgtgggggacagcaagagggccctggatgagtacaccagcgagctgatgctgggcggcaccaacaccctggtgctgcacaacacctgtgaggacagcctgctggccgcccccatcatgctggacctggccctgctgacagagctgtgccagagggtgtccttctgcacagacatggaccctgagccccagaccttccaccctgtgctgagcctgctgtccttcctgttcaaggcccccctggtgcccccaggcagccctgtggtgaatgccctcttccggcagaggagctgcatcgagaacatcctgcgggcctgtgtgggcctgcccccccagaaccacatgctgctggagcacaagatggagaggcctggccccagcctgaagagggtgggccctgtggccgccacctaccccatgctgaacaagaagggccctgtgcctgctgccaccaacggctgcacaggagatgccaacggccacctgcaggaggagccccccatgcccaccacctag

SEQ ID NO: 156078 - DNA, 1677 bp, Artificial Sequence
  Description of Artificial Sequence: Synthetic coding sequence
atggaggccgccgcccagttctttgtggagagcccagatgtggtgtatggccctgaggccatcgaggcccagtatgagtaccgcaccaccagggtgtcccgggagggcggcgtgctgaaggtgcaccccaccagcacccgcttcaccttcagaacagcccggcaggtgccccggctgggcgtgatgctggtgggctggggcggcaacaacggcagcaccctgacagctgctgtgctggccaaccggctgcggctgtcctggcccaccaggagcggcaggaaggaggccaactactacggcagcctgacccaggccggcaccgtgtccctgggcctggatgctgagggccaggaggtgtttgtgcccttctctgctgtgctgcccatggtggccccaaatgacctggtgtttgatggctgggacatcagcagcctgaacctggccgaggccatgaggcgggccaaggtgctggactggggcctgcaggagcagctgtggccccacatggaggccctgcggccccggcccagcgtgtacatccctgagttcatcgccgccaaccagagcgcccgggctgacaacctgatccctggcagccgggcccagcagctggagcagatccggcgggacatccgggacttccgcagcagcgctggcctggacaaggtgattgtgctgtggacagccaacacagagcgcttctgtgaggtgattcctggcctgaatgacacagctgagaacctgctgcggaccatcgagctgggcctggaggtgagccccagcaccctgtttgctgtggccagcatcctggagggctgtgccttcctgaatggcagcccccagaacaccctggtgcctggggccctggagctggcctggcagcaccgggtgtttgtgggcggagatgacttcaagagcggccagaccaaggtgaagtctgtgctggtggacttcctgattggcagcggcctgaagaccatgagcatcgtgtcctacaaccacctgggcaacaatgatggagagaacctgagcgcccccctgcagttccgcagcaaggaggtgtccaagagcaatgtggtggatgacatggtgcagagcaaccctgtgctgtacaccccaggagaggagccagaccactgtgtggtgatcaagtatgtgccctacgtgggggacagcaagagggccctggatgagtacaccagcgagctgatgctgggcggcaccaacaccctggtgctgcacaacacctgtgaggacagcctgctggccgcccccatcatgctggacctggccctgctgacagagctgtgccagagggtgtccttctgcacagacatggaccctgagccccagaccttccaccctgtgctgagcctgctgtccttcctgttcaaggcccccctggtgcccccaggcagccctgtggtgaatgccctcttccggcagaggagctgcatcgagaacatcctgcgggcctgtgtgggcctgcccccccagaaccacatgctgctggagcacaagatggagaggcctggccccagcctgaagagggtgggccctgtggccgccacctaccccatgctgaacaagaagggccctgtgcctgctgccaccaacggctgcacaggagatgccaacggccacctgcaggaggagccccccatgcccaccacctag

SEQ ID NO: 156079 - DNA, 1515 bp, Artificial Sequence
  Description of Artificial Sequence: Synthetic coding sequence
atggaggccgccgcccagttctttgtggagagcccagatgtggtgtatggccctgaggccatcgaggcccagtatgagtaccgcaccaccagggtgtcccgggagggcggcgtgctgaaggaggccaactactacggcagcctgacccaggccggcaccgtgtccctgggcctggatgctgagggccaggaggtgtttgtgcccttctctgctgtgctgcccatggtggccccaaatgacctggtgtttgatggctgggacatcagcagcctgaacctggccgaggccatgaggcgggccaaggtgctggactggggcctgcaggagcagctgtggccccacatggaggccctgcggccccggcccagcgtgtacatccctgagttcatcgccgccaaccagagcgcccgggctgacaacctgatccctggcagccgggcccagcagctggagcagatccggcgggacatccgggacttccgcagcagcgctggcctggacaaggtgattgtgctgtggacagccaacacagagcgcttctgtgaggtgattcctggcctgaatgacacagctgagaacctgctgcggaccatcgagctgggcctggaggtgagccccagcaccctgtttgctgtggccagcatcctggagggctgtgccttcctgaatggcagcccccagaacaccctggtgcctggggccctggagctggcctggcagcaccgggtgtttgtgggcggagatgacttcaagagcggccagaccaaggtgaagtctgtgctggtggacttcctgattggcagcggcctgaagaccatgagcatcgtgtcctacaaccacctgggcaacaatgatggagagaacctgagcgcccccctgcagttccgcagcaaggaggtgtccaagagcaatgtggtggatgacatggtgcagagcaaccctgtgctgtacaccccaggagaggagccagaccactgtgtggtgatcaagtatgtgccctacgtgggggacagcaagagggccctggatgagtacaccagcgagctgatgctgggcggcaccaacaccctggtgctgcacaacacctgtgaggacagcctgctggccgcccccatcatgctggacctggccctgctgacagagctgtgccagagggtgtccttctgcacagacatggaccctgagccccagaccttccaccctgtgctgagcctgctgtccttcctgttcaaggcccccctggtgcccccaggcagccctgtggtgaatgccctcttccggcagaggagctgcatcgagaacatcctgcgggcctgtgtgggcctgcccccccagaaccacatgctgctggagcacaagatggagaggcctggccccagcctgaagagggtgggccctgtggccgccacctaccccatgctgaacaagaagggccctgtgcctgctgccaccaacggctgcacaggagatgccaacggccacctgcaggaggagccccccatgcccaccacctag

SEQ ID NO: 156080 - DNA, 1227 bp, Artificial Sequence
  Description of Artificial Sequence: Synthetic coding sequence
atgaggcgggccaaggtgctggactggggcctgcaggagcagctgtggccccacatggaggccctgcggccccggcccagcgtgtacatccctgagttcatcgccgccaaccagagcgcccgggctgacaacctgatccctggcagccgggcccagcagctggagcagatccggcgggacatccgggacttccgcagcagcgctggcctggacaaggtgattgtgctgtggacagccaacacagagcgcttctgtgaggtgattcctggcctgaatgacacagctgagaacctgctgcggaccatcgagctgggcctggaggtgagccccagcaccctgtttgctgtggccagcatcctggagggctgtgccttcctgaatggcagcccccagaacaccctggtgcctggggccctggagctggcctggcagcaccgggtgtttgtgggcggagatgacttcaagagcggccagaccaaggtgaagtctgtgctggtggacttcctgattggcagcggcctgaagaccatgagcatcgtgtcctacaaccacctgggcaacaatgatggagagaacctgagcgcccccctgcagttccgcagcaaggaggtgtccaagagcaatgtggtggatgacatggtgcagagcaaccctgtgctgtacaccccaggagaggagccagaccactgtgtggtgatcaagtatgtgccctacgtgggggacagcaagagggccctggatgagtacaccagcgagctgatgctgggcggcaccaacaccctggtgctgcacaacacctgtgaggacagcctgctggccgcccccatcatgctggacctggccctgctgacagagctgtgccagagggtgtccttctgcacagacatggaccctgagccccagaccttccaccctgtgctgagcctgctgtccttcctgttcaaggcccccctggtgcccccaggcagccctgtggtgaatgccctcttccggcagaggagctgcatcgagaacatcctgcgggcctgtgtgggcctgcccccccagaaccacatgctgctggagcacaagatggagaggcctggccccagcctgaagagggtgggccctgtggccgccacctaccccatgctgaacaagaagggccctgtgcctgctgccaccaacggctgcacaggagatgccaacggccacctgcaggaggagccccccatgcccaccacctag

SEQ ID NO: 156081 - DNA, 1386 bp, Artificial Sequence
  Description of Artificial Sequence: Synthetic coding sequence
atgaccctgcccggcggccccaccggcatggcccggcctggaggagcccggccctgcagccctggcctggagcgggccccccggcgctctgtgggggagctgcggctgctgtttgaggcccgctgtgccgctgtggccgctgctgctgctgctggggagccccgggcccggggggccaagagaagaggaggccaggtgcccaacggcctgccccgggcccccccagcccctgtgatcccccagctgactgtgacagctgaggagccagatgtgccccccaccagccctggccccccagagcgggagcgggactgcctgcctgctgctggcagcagccacctgcagcagccccggcggctgagcaccagctctgtgagcagcacaggcagcagcagcctgctggaggacagtgaagatgacctgctgagtgacagcgagagccgcagcagaggaaatgtgcagctggaggccggagaagatgtgggccagaagaaccactggcagaagatccgcaccatggtgaacctgcctgtgatcagccccttcaagaagagatatgcctgggtgcagctggccggccacacaggcagcttcaaggctgctggcaccagcggcctcatcctgaagcgctgcagcgagcctgagcgctactgcctggcccggctgatggctgatgccctgcggggctgtgtgcctgccttccatggagtggtggagagagatggagagagctacctgcagctgcaggacctgctggatggctttgatggcccctgtgtgctggactgcaagatgggcgtgaggacctacctggaggaggagctgaccaaggcccgggagcggcccaagctgaggaaggacatgtacaagaagatgctggccgtggaccctgaggcccccacagaggaggagcacgcccagagagctgtgaccaagccccgctacatgcagtggagggagggcatcagcagcagcaccaccctgggcttccgcatcgagggcatcaagaaggcagatggcagctgcagcacagacttcaagaccaccaggagccgggagcaggtgctgcgggtgtttgaggagtttgtgcagggagatgaggaggtgctgcggcgctacctgaaccggctgcagcagatccgggacaccctggaggtgtctgagttcttcagaagacatgaagtcatcggcagcagcctgctgtttgtgcatgaccactgccaccgggccggcgtgtggctgattgactttgggaagaccacccccctgcctgatggccagatcctggaccaccggcggccctgggaggagggcaacagagaagatggctacctgctgggcctggacaacctgattggcatcctggccagcctggccgagaggtag

SEQ ID NO: 156082 - DNA, 2841 bp, Artificial Sequence
  Description of Artificial Sequence: Synthetic coding sequence
atggctgtgtactgctacgccctgaacagcctggtgatcatgaacagcgccaatgagatgaagagcggcggcggccctggccccagcggcagcgagaccccacctccaccccggcgggctgtgctgagccctggcagcgtcttcagccctggccgcggggccagcttcctgtttcctcctgctgagagcctgagccctgaggagcccaggagccctgggggctggaggtctggaagaagaaggctgaacagcagcagcggcagcggcagcggcagcagcggcagctctgtgagcagccccagctgggccggccgcctgcggggggaccggcagcaggtggtggccgccggcaccctgagccccccaggccctgaggaggccaagaggaagctgcgcatcctgcagcgggagctgcagaatgtgcaggtgaaccagaaggtgggcatgtttgaggcccacatccaggcccagagcagcgccatccaggcccccaggagcccccggctgggccgggcccggagccccagcccctgccccttccgcagcagcagccagcccccaggccgggtgctggtgcagggcgcccggtctgaggagaggaggaccaagtcctggggcgagcagtgcccagagaccagcggcacagattctggcaggaagggcggccccagcctgtgcagcagccaggtgaagaagggcatgccacccctgcccggccgggccgcccccaccggcagcgaggcccagggccccagcgcctttgtgaggatggagaagggcatcccagccagcccccgctgtggcagccccacagccatggagattgacaagaggggcagccccaccccaggcaccaggagctgcctggcccccagcctgggcctgtttggagccagcctgaccatggccacagaggtggccgcccgggtgaccagcacaggcccccaccggccccaggacctggccctgacagagcccagcggccgggcccgggagctggaggacctgcagcccccagaggccctggtggagcggcagggccagttcctgggcagcgagaccagccctgcccctgagcggggcggccccagagatggagagcccccaggcaagatgggcaagggctacctgccctgtggcatgcctggcagcggggagcctgaggtgggcaagaggcctgaggagaccaccgtgtctgtgcagagcgctgagagcagtgacagcctgtcctggagccggctgccccgggccctggcctctgtgggccctgaggaggcccggagcggggcccctgtgggcggcggccgctggcagctgagtgacagagtggagggcggcagccccaccctgggcctgctgggcggcagccccagcgcccagcccggcactggaaatgtggaggccggcatccccagcggccgcatgctggagcccctgccctgctgggatgctgccaaggacctgaaggagccccagtgccccccaggggacagagtgggcgtgcagcccggcaacagccgggtgtggcagggcaccatggagaaggccggcctggcctggacccggggcaccggggtgcagagcgagggcacctgggagagccagaggcaggacagtgatgccctgcccagccctgagctgctgccccaggaccctgacaagcccttcctgaggaaggcctgcagccccagcaacatcccagctgtgatcatcacagacatgggcacccaggaggatggagccctggaggagacccagggcagcccccggggcaacctgcccctgaggaagctgagcagcagcagcgccagcagcacaggcttcagcagcagctatgaagattctgaggaggacatcagcagtgaccctgagaggaccctggaccccaacagcgccttcctgcacaccctggaccagcagaagccccgggtgtccaagtcctggaggaagatcaagaacatggtgcactggagcccctttgtgatgtccttcaagaagaagtacccctggatccagctggccggccatgctggcagcttcaaggctgctgccaacggccgcatcctgaagaagcactgtgagagcgagcagcgctgcctggaccggctgatggtggatgtgctgcggccctttgtgcctgcctaccatggagatgtggtgaaggatggagagcgctacaaccagatggatgacctgctggccgactttgacagcccctgtgtgatggactgcaagatgggcatccgcacctacctggaggaggagctgaccaaggccaggaagaagcccagcctgaggaaggacatgtaccagaagatgattgaggtggaccctgaggcccccacagaggaggagaaggcccagagagctgtgaccaagccccgctacatgcagtggagggagaccatcagcagcacagccaccctgggcttcagaattgagggcatcaagaaggaggatggcaccgtgaacagagacttcaagaagaccaagacccgggagcaggtgacagaggccttccgggagttcaccaagggcaaccacaacatcctgattgcctacagagaccggctgaaggccatccgcaccaccctggaggtgagccccttcttcaagtgccacgaggtgattggcagcagcctgctcttcatccatgacaagaaggagcaggccaaggtgtggatgattgactttgggaagaccacccccctgcctgagggccagaccctgcagcatgatgtgccctggcaggagggcaaccgggaggatggctacctgagcggcctgaacaacctggtggacatcctgacagagatgagccaggatgcccccctggcctag

SEQ ID NO: 156083 - DNA, 1935 bp, Artificial Sequence
  Description of Artificial Sequence: Synthetic coding sequence
atggctgtgtactgctacgccctgaacagcctggtgatcatgaacagcgccaatgagatgaagagcggcggcggccctggccccagcggcagcgagaccccacctccaccccggcgggctgtgctgagccctggcagcgtcttcagccctggccgcggggccagcttcctgtttcctcctgctgagagcctgagccctgaggagcccaggagccctgggggctggaggtctggaagaagaaggctgaacagcagcagcggcagcggcagcggcagcagcggcagctctgtgagcagccccagctgggccggccgcctgcggggggaccggcagcaggtggtggccgccggcaccctgagccccccaggccctgaggaggccaagaggaagctgcgcatcctgcagcgggagctgcagaatgtgcaggtgaaccagaaggtgggcatgtttgaggcccacatccaggcccagagcagcgccatccaggcccccaggagcccccggctgggccgggcccggagccccagcccctgccccttccgcagcagcagccagcccccaggccgggtgctggtgcagggcgcccggtctgaggagaggaggaccaagtcctggggcgagcagtgcccagagaccagcggcacagattctggcaggaagggcggccccagcctgtgcagcagccaggtgaagaagggcatgccacccctgcccggccgggccgcccccaccggcagcgaggcccagggccccagcgcctttgtgaggatggagaagggcatcccagccagcccccgctgtggcagccccacagccatggagattgacaagaggggcagccccaccccaggcaccaggagctgcctggcccccagcctgggcctgtttggagccagcctgaccatggccacagaggtggccgcccgggtgaccagcacaggcccccaccggccccaggacctggccctgacagagcccagcggccgggcccgggagctggaggacctgcagcccccagaggccctggtggagcggcagggccagttcctgggcagcgagaccagccctgcccctgagcggggcggccccagagatggagagcccccaggcaagatgggcaagggctacctgccctgtggcatgcctggcagcggggagcctgaggtgggcaagaggcctgaggagaccaccgtgtctgtgcagagcgctgagagcagtgacagcctgtcctggagccggctgccccgggccctggcctctgtgggccctgaggaggcccggagcggggcccctgtgggcggcggccgctggcagctgagtgacagagtggagggcggcagccccaccctgggcctgctgggcggcagccccagcgcccagcccggcactggaaatgtggaggccggcatccccagcggccgcatgctggagcccctgccctgctgggatgctgccaaggacctgaaggagccccagtgccccccaggggacagagtgggcgtgcagcccggcaacagccgggtgtggcagggcaccatggagaaggccggcctggcctggacccggggcaccggggtgcagagcgagggcacctgggagagccagaggcaggacagtgatgccctgcccagccctgagctgctgccccaggaccctgacaagcccttcctgaggaaggcctgcagccccagcaacatcccagctgtgatcatcacagacatgggcacccaggaggatggagccctggaggagacccagggcagcccccggggcaacctgcccctgaggaagctgagcagcagcagcgccagcagcacaggcttcagcagcagctatgaagattctgaggaggacatcagcagtgaccctgagaggaccctggaccccaacagcgccttcctgcacaccctggaccagcagaagccccgggtgtag

SEQ ID NO: 156084 - DNA, 2841 bp, Artificial Sequence; identical to SEQ ID NO: 156082
  Description of Artificial Sequence: Synthetic coding sequence

SEQ ID NO: 156085 - DNA, 2052 bp, Artificial Sequence
  Description of Artificial Sequence: Synthetic coding sequence
atgaggcgctgcccctgccggggcagcctgaatgaagctgaggccggggccctgcctgctgctgccaggatgggcctggaggccccccggggcggcagaagacggcagcccggccagcagaggcctggccctggggccggggccccagctggccggcctgagggcggcggcccctgggccaggacagagggcagcagcctgcacagcgagcctgagcgggccggcctgggccctgcccctggaacagagagcccccaggccgagttctggacagatggccagacagagcctgctgctgctggcctgggcgtggagacagagcggcccaagcagaagacagagccagacaggagcagcctgcggacccacctggagtggagctggagcgagctggagaccacctgcctgtggacagagaccggcacagatggcctgtggacagacccccacagaagtgacctgcagttccagcctgaggaggccagcccctggacccagcccggggtgcacggcccctggacagagctggagacccacggcagccagacccagcctgagcgggtgaagtcctgggccgacaacctgtggacccaccagaacagcagcagcctgcagacccaccctgagggcgcctgccccagcaaggagcccagcgcagatggctcctggaaggagctgtacacagatggcagcaggacccagcaggacatcgagggcccctggacagagccctacacagatggcagccagaagaagcaggacacagaagctgccaggaagcagcccggcaccggcggcttccagatccagcaggacacagatggctcctggacccagcccagcacagatggcagccagacagcccctggaacagactgcctgctgggggagccagaagatggccccctggaggagcctgagcccggggagctgctgacccacctgtacagccacctgaagtgcagccccctgtgccctgtgcccaggctcatcatcaccccagagaccccagagcctgaggcccagcctgtgggcccccccagccgggtggagggcggcagcggcggcttcagcagcgccagcagctttgatgaaagtgaagatgatgtggtggccggcggcggcggggccagtgaccctgaagatagaagtggcagcaagccctggaagaagctgaagacagtgctgaagtacagcccctttgtggtgtccttcaggaagcactacccctgggtgcagctgagcggccacgccggcaacttccaggccggagaagatggccgcatcctgaagcgcttctgccagtgtgagcagaggagcctggagcagctgatgaaggaccccctgcggccctttgtgcctgcctactacggcatggtgctgcaggacggccagaccttcaaccagatggaggacctgctggccgactttgagggccccagcatcatggactgcaagatgggcagcaggacctacctggaggaggagctggtgaaggcccgggagcggccccggcccaggaaggacatgtatgagaagatggtggccgtggaccccggggcccccaccccagaggagcacgcccagggcgctgtgaccaagccccgctacatgcagtggagggagaccatgagcagcaccagcaccctgggcttccgcatcgagggcatcaagaaggcagatggcacctgcaacaccaacttcaagaagacccaggccctggagcaggtgaccaaggtgctggaggactttgtggatggagaccacgtgatcctgcagaagtatgtggcctgcctggaggagctgcgggaggccctggagatcagccccttcttcaagacccatgaggtggtgggcagcagcctgctgtttgtgcatgaccacacaggcctggccaaggtgtggatgattgactttgggaagacagtggccctgcctgaccaccagaccctgagccaccggctgccctgggccgagggcaacagagaagatggctacctgtggggcctggacaacatgatctgcctgctgcagggcctggcccagagctag

SEQ ID NO: 156086 - DNA, 1740 bp, Artificial Sequence
  Description of Artificial Sequence: Synthetic coding sequence
atgaggcggcccccaggaaatggagaggccgccagcgagggccctgggggctggggcctgtggggcgtgcaggagagccggcggctgtgctgtgccggccatgaccgctgcaagcaggccctgctgcagatcggcatcaacatgatggccctgcccggcggccgccacctggacagcgtgaccctgcccggccagaggctgcacctgatgcaggtggacagcgtgcagcgctggatggaggacctgaagctgatgacagaatgtgagtgcatgtgtgtgctgcaggccaagcccatcagcctggaggaggatgcccagggcgacctgatcctggccggcggccctggccctggggaccccctgcagctgctgctgaagaggggctgggtgatcagcacagagctgcggcgcatcggccagaagctggcccaggaccgctgggcccgggtgcacagcatgtctgtgcggctgacctgccacgcccgctccatggtgtctgagtacagcgctgtgtccaggaacagcctgaaggagatgggagaaattgagaagctgctgatggagaagtgcagcgagctgtctgctgtgacagagcgctgcctgcaggtggagaatgaacatgtgctgaagtccatgaaggcctgtgtgtctgagaccctgtccatgctgggccagcacttcggccagctgctggagctggccctgacccgggaggtgcaggccctggtgaggaagattgatgccagtgacaacatctacaccacagagagcaccactggaaacctcttcagcctgacccaggagggcgcccccctgtgccgcatcatcgccaaggagggcggcgtggtggccctcttcaaggtgtgccggcaggacagcttccgctgcctgtacccccaggccctgcggaccctggccagcatctgctgcgtggaggagggcgtgcaccagctggagaaggtggatggagtgctgtgcctggccgacatcctgacagacaacagccacagcgaggccaccagggctgaggccgctgctgtggtggcccaggtgaccagcccccacctgcctgtgacccagcacctgagcagcttcctggagagcatggaggagatcgtgacagccctggtgaagctgtgccaggaggccagcagtggagaggtgttcctgctggccagcgctgccctggccaacatcaccttctttgacaccatggcctgtgagatgctgctgcagctgaatgccatccgggtgctgctggaggcctgcagcgacaagcagagggtggacaccccctacacccgggaccagatcgtgaccatcctggccaacatgtctgtgctggagcagtgtgccagtgacatcatccaggagaatggagtgcagctgatcatgggcatgctgtctgagaagcccaggagcggcaccccagctgaggtggccgcctgtgagcgggtgcagcagaaggctgctgtgaccctggcccggctgagccgggaccctgatgtggcccgggaggccgtgcggctgagctgcatgagccggctgattgagctgtgccgcagccccagcgagaggaacagcagtgatgctgtgctggtggcctgcctggccgccctgcggcggctggccggcgtgtgcccagagggcctgcaggacagcgacttccagcagctggtgcagccccggctggtggacagcttcctgctgtgcagcaacatggaggagagctttgtgtag

SEQ ID NO: 156087 - DNA, 1599 bp, Artificial Sequence
  Description of Artificial Sequence: Synthetic coding sequence
atgatggccctgcccggcggccgccacctggacagcgtgaccctgcccggccagaggctgcacctgatgcaggtggacagcgtgcagcgctggatggaggacctgaagctgatgacagaatgtgagtgcatgtgtgtgctgcaggccaagcccatcagcctggaggaggatgcccagggcgacctgatcctggccggcggccctggccctggggaccccctgcagctgctgctgaagaggggctgggtgatcagcacagagctgcggagaattggccagaagctggcccaggaccgctgggcccgggtgcacagcatgtctgtgcggctgacctgccacgcccgctccatggtgtctgagtacagcgctgtgtccaggaacagcctgaaggagatgggagaaattgagaagctgctgatggagaagtgcagcgagctgtctgctgtgacagagcgctgcctgcaggtggagaatgagcacgtgctgaagtccatgaaggcctgtgtgtctgagaccctgtccatgctgggccagcacttcggccagctgctggagctggccctgacccgggaggtgcaggccctggtgaggaagattgatgccagtgacaacatctacaccacagagagcaccaccggcaacctcttcagcctgacccaggagggcgcccccctgtgccgcatcatcgccaaggagggcggcgtggtggccctcttcaaggtgtgccggcaggacagcttccgctgcctgtacccccaggccctgcggaccctggccagcatctgctgcgtggaggagggcgtgcaccagctggagaaggtggatggagtgctgtgcctggccgacatcctgacagacaacagccacagcgaggccaccagggctgaggccgctgctgtggtggcccaggtgaccagcccccacctgcctgtgacccagcacctgagcagcttcctggagagcatggaggagatcgtgacagccctggtgaagctgtgccaggaggccagcagcggggaggtgttcctgctggccagcgctgccctggccaacatcaccttctttgacaccatggcctgtgagatgctgctgcagctgaatgccatccgggtgctgctggaggcctgcagcgacaagcagagggtggacaccccctacacccgggaccagatcgtgaccatcctggccaacatgtctgtgctggagcagtgtgccagtgacatcatccaggagaatggagtgcagctgatcatgggcatgctgtctgagaagcccaggagcggcaccccagctgaggtggccgcctgtgagcgggtgcagcagaaggctgctgtgaccctggcccggctgagccgggaccctgatgtggcccgggaggccgtgcggctgagctgcatgagccgcctcatcgagctgtgccgcagccccagcgagaggaacagcagtgatgctgtgctggtggcctgcctggccgccctgcggcggctggccggcgtgtgcccagagggcctgcaggacagcgacttccagcagctggtgcagccccggctggtggacagcttcctgctgtgcagcaacatggaggagagctttgtgtag

SEQ ID NO: 156088 - DNA, 927 bp, Artificial Sequence
  Description of Artificial Sequence: Synthetic coding sequence
atgatggccctgcccggcggccgccacctggacagcgtgaccctgcccggccagaggctgcacctgatgcaggtggacagcgtgcagcgctggatggaggacctgaagctgatgacagaatgtgagtgcatgtgtgtgctgcaggccaagcccatcagcctggaggaggatgcccagggcgacctgatcctggccggcggccctggccctggggaccccctgcagctgctgctgaagaggggctgggtgatcagcacagagctgcggagaattggccagaagctggcccaggaccgctgggcccgggtgcacagcatgtctgtgcggctgacctgccacgcccgctccatggtgtctgagtacagcgctgtgtccaggaacagcctgaaggagatgggagaaattgagaagctgctgatggagaagtgcagcgagctgtctgctgtgacagagcgctgcctgcaggtggagaatgagcacgtgctgaagtccatgaaggcctgtgtgtctgagaccctgtccatgctgggccagcacttcggccagctgctggagctggccctgacccgggaggtgcaggtggagagccacagcgtgacccggctggagtgcagcggggccatcagcgcccagtgcaacctgcggctgctgggcagcagtgacagccctgccagcgccagccaggccctggtgaggaagattgatgccagtgacaacatctacaccacagagagcaccactggaaacctcttcagcctgacccaggagggcgcccccctgtgccgcatcatcgccaaggagggcggcgtggtggccctcttcaaggtgtgccggcaggacagcttccgctgcctgtacccccaggccctgcggaccctggccagcatctgctgcgtggaggagggcgtgcaccagctggagaagtag

SEQ ID NO: 156089 - DNA, 1473 bp, Artificial Sequence
  Description of Artificial Sequence: Synthetic coding sequence
atgatggccctgcccggcggccgccacctggacagcgtgaccctgcccggccagaggctgcacctgatgcaggtggacagcgtgcagcgctggatggaggacctgaagctgatgacagaatgtgagtgcatgtgtgtgctgcaggccaagcccatcagcctggaggaggatgcccagggcgacctgatcctggccggcggccctggccctggggaccccctgcagctgctgctgaagaggggctgggtgatcagcacagagctgcggagaattggccagaagctggcccaggaccgctgggcccgggtgcacagcatgtctgtgcggctgacctgccacgcccgctccatggtgtctgagtacagcgctgtgtccaggaacagcctgaaggagatgggagaaattgagaagctgctgatggagaagtgcagcgagctgtctgctgtgacagagcgctgcctgcaggtggagaatgagcacgtgctgaagtccatgaaggcctgtgtgtctgagaccctgtccatgctgggccagcacttcggccagctgctggagctggccctgacccgggaggtgcaggccctggtgaggaagattgatgccagtgacaacatctacaccacagagagcaccaccggcaacctcttcagcctgacccaggagggcgcccccctgtgccgcatcatcgccaaggtggatggagtgctgtgcctggccgacatcctgacagacaacagccacagcgaggccaccagggctgaggccgctgctgtggtggcccaggtgaccagcccccacctgcctgtgacccagcacctgagcagcttcctggagagcatggaggagatcgtgacagccctggtgaagctgtgccaggaggccagcagcggggaggtgttcctgctggccagcgctgccctggccaacatcaccttctttgacaccatggcctgtgagatgctgctgcagctgaatgccatccgggtgctgctggaggcctgcagcgacaagcagagggtggacaccccctacacccgggaccagatcgtgaccatcctggccaacatgtctgtgctggagcagtgtgccagtgacatcatccaggagaatggagtgcagctgatcatgggcatgctgtctgagaagcccaggagcggcaccccagctgaggtggccgcctgtgagcgggtgcagcagaaggctgctgtgaccctggcccggctgagccgggaccctgatgtggcccgggaggccgtgcggctgagctgcatgagccgcctcatcgagctgtgccgcagccccagcgagaggaacagcagtgatgctgtgctggtggcctgcctggccgccctgcggcggctggccggcgtgtgcccagagggcctgcaggacagcgacttccagcagctggtgcagccccggctggtggacagcttcctgctgtgcagcaacatggaggagagctttgtgtag

SEQ ID NO: 156090 - DNA, 1473 bp, Artificial Sequence; identical to SEQ ID NO: 156089
  Description of Artificial Sequence: Synthetic coding sequence

SEQ ID NO: 156091 - DNA, 1599 bp, Artificial Sequence; identical to SEQ ID NO: 156087
  Description of Artificial Sequence: Synthetic coding sequence

SEQ ID NO: 156092 - DNA, 834 bp, Artificial Sequence
  Description of Artificial Sequence: Synthetic coding sequence
atgccccggctgcatgaccacttctggagctgcagctgtgcccacagcgccaggagaagaggccccccccgggccagcgctgctggcctggccgccaaggtgggggagatgatcaacgtgtctgtgtctggccccagcctgctggccgcccatggagccccagatgctgaccctgccccccggggccgctctgctgccatgagcggccctgagcccggcagcccctaccccaacacctggcaccaccggctgctgcagaggagcctggtgctcttctctgtgggcgtggtgctggccctggtgctgaacctgctgcagatccagagaaatgtgaccctcttccctgaggaggtgattgccaccatcttcagcagcgcctggtgggtgcccccctgctgcggcacagctgctgctgtggtgggcctgctgtacccctgcatcgacagccacctgggggagccccacaagttcaagcgggagtgggcctctgtgatgcgctgcatcgctgtgtttgtgggcatcaaccacgccagcgccaagctggactttgccaacaacgtgcagctgagcctgaccctggccgccctgagcctgggcctgtggtggacctttgacaggagccgcagcggcctgggcctgggcatcaccatcgccttcctggccaccctcatcacccagttcctggtgtacaatggagtgtaccagtacaccagcccagacttcctgtacatccgctcctggctgccctgcatcttcttcagcggcggcgtgacagtgggcaacatcggccggcagctggccatgggcgtgcctgagaagccccacagcgactag

SEQ ID NO: 156093 - DNA, 537 bp, Artificial Sequence
  Description of Artificial Sequence: Synthetic coding sequence
atgccccggctgcatgaccacttctggagctgcagctgtgcccacagcgccaggagaagaggccccccccgggccagcgccaagctggactttgccaacaacgtgcagctgagcctgaccctggccgccctgagcctgggcctgtggtggacctttgacaggagccgcagcggcctgggcctgggcatcaccatcgccttcctggccaccctcatcacccagttcctggtgtacaatggagtgtaccagtacaccagcccagacttcctgtacatccgctcctggctgccctgcatcttcttcagcggcggcgtgacagtgggcaacatcggccggcagctggccatgctgatccccttctgtgaggagctgaacctgaagaccacctggctgttccacaagaccaggagcaactacagagtcttcctgaagagccccatcgtgattgagagcagcaagccacccatcctgcgggccaggaagatcctggaggagaacctgactgtggactatgacaaggactacctgttctcctag

SEQ ID NO: 156094 - DNA, 372 bp, Artificial Sequence
  Description of Artificial Sequence: Synthetic coding sequence
atgccccggctgcatgaccacttctggagctgcagctgtgcccacagcgccaggagaagaggccccccccgggccagcgctgctggcctggccgccaaggtgggggagatgatcaacgtgtctgtgtctggccccagcctgctggccgcccatggagccccagatgctgaccctgccccccggggccgctctgctgccatgagcggccctgagcccggcagcccctaccccaacacctggcaccaccggctgctgcagaggagcctggtgctcttctctgtgggcgtggtgctggccctggtgctgaacctgctgcagatccagagaaatgtgaccctcttccctgaggaggtgattgccaccatcttctag

SEQ ID NO: 156095 - DNA, 495 bp, Artificial Sequence
  Description of Artificial Sequence: Synthetic coding sequence
atgccccggctgcatgaccacttctggagctgcagctgtgcccacagcgccaggagaagaggccccccccgggccagcgctgctggcctggccgccaaggtgggggagatgatcaacgtgtctgtgtctggccccagcctgctggccgcccatggagccccagatgctgaccctgccccccggggccgctctgctgccatgagcggccctgagcccggcagcccctaccccaacacctggcaccaccggctgctgcagaggagcctggtgctcttctctgtgggcgtggtgctggccctggtgctgaacctgctgcagatccagagaaatgtgaccctcttccctgaggaggtgattgccaccatcttcagcagcgcctggtgggtgcccccctgctgcggcacagctgctggcatccacccccagatcagcagcatctttgtgctgggcagcctggtgtacttcagccaggaggccagccgctggggcacctag

SEQ ID NO: 156096 - DNA, 678 bp, Artificial Sequence
  Description of Artificial Sequence: Synthetic coding sequence
atggccgagggggagacagagagccctggccccaagaagtgtggcccctacatcagctctgtgaccagccagagcgtgaacctgatgatccggggcgtggtgctcttcttcatcggggtcttcctggccctggtgctgaacctgctgcagatccagagaaatgtgaccctcttccccccagatgtgattgccagcatcttcagcagcgcctggtgggtgcccccctgctgcggcacagccagcgctgtgattggcctgctgtacccctgcatcgacagacacctgggggagccccacaagttcaagcgggagtggagctctgtgatgagatgtgtggccgtgtttgtgggcatcaaccacgccagcgccaaggtggactttgacaacaacatccagctgagcctgaccctggccgccctgagcatcggcctgtggtggacctttgacaggagccgcagcggcttcggcctgggcgtgggcatcgccttcctggccaccgtggtgacccagctgctggtgtacaatggagtgtaccagtacaccagcccagacttcctgtatgtgcgctcctggctgccctgcatcttctttgctgggggcatcaccatgggcaacatcggccggcagctggccatgtatgagtgcaaggtgattgctgagaagagccaccaggagtag

SEQ ID NO: 156097 - DNA, 4149 bp, Artificial Sequence
  Description of Artificial Sequence: Synthetic coding sequence
atggccactggaggaagaagaggagctgctgctgcccccctgctggtggccgtggccgccctgctgctgggcgccgccggccacctgtacccaggagaggtgtgccccggcatggacatccggaacaacctgacccggctgcacgagctggagaactgcagcgtcatcgagggccacctgcagatcctgctgatgttcaagaccaggcctgaggacttccgggacctgtccttccccaagctgatcatgatcacagactacctgctgctcttccgggtgtatggcctggagagcctgaaggacctcttccccaacctgaccgtcatccggggcagccgcctcttcttcaactatgccctggtgatctttgagatggtgcacctgaaggagctgggcctgtacaacctgatgaacatcacccggggctctgtgcgcatcgagaagaacaatgagctgtgctacctggccaccatcgactggagccgcatcctggacagcgtggaggacaactacatcgtgctgaacaaggatgacaatgaagaatgtggggacatctgccctggaacagccaagggcaagaccaactgcccagccaccgtcatcaatggccagtttgtggagcgctgctggacccacagccactgccagaaggtgtgccccaccatctgcaagagccacggctgcacagctgagggcctgtgctgccacagcgagtgcctgggcaactgcagccagccagatgaccccaccaagtgtgtggcctgcaggaacttctacctggatggccgctgtgtggagacctgccccccaccctactaccacttccaggactggaggtgtgtgaacttctccttctgccaggacctgcaccacaagtgcaagaacagccggcggcagggctgccaccagtatgtgatccacaacaacaagtgcatccctgagtgccccagcggctacaccatgaacagcagcaacctgctgtgcaccccctgcctgggcccctgccccaaggtgtgccacctgctggagggggagaagaccatcgacagcgtgaccagcgcccaggagctgcggggctgcaccgtcatcaatggcagcctcatcatcaacatccggggcggcaacaacctggccgctgagctggaggccaacctgggcctcatcgaggagatcagcggctacctgaagatccgccgctcctatgccctggtgtccctgtccttcttcaggaagctgcggctcatccggggggagaccctggagatcggcaactacagcttctacgccctggacaaccagaacctgcggcagctgtgggactggagcaagcacaacctgaccatcacccagggcaagctgttcttccactacaaccccaagctgtgcctgtctgagatccacaagatggaggaggtgtctggcaccaagggccggcaggagagaaatgacatcgccctgaagaccaatggagaccaggccagctgtgaaaatgagctgctgaagttctcctacatccgcaccagctttgacaagatcctgctgcgctgggagccctactggcccccagacttccgggacctgctgggcttcatgctgttctacaaggaggccccctaccagaatgtgacagaatttgatggccaggatgcctgtggcagcaacagctggacagtggtggacattgatcctcccctgcggagcaatgaccccaagagccagaaccaccctggctggctgatgaggggcctgaagccctggacccagtatgccatctttgtgaagaccctggtgaccttcagtgatgaaagaaggacctacggggccaagagtgacatcatctacgtgcagacagatgccaccaaccccagcgtgcccctggaccccatctctgtgagcaacagcagcagccagatcatcctgaagtggaagccacccagcgaccccaatggaaacatcacccactacctggtgttctgggagcggcaggccgaggacagcgagctgtttgagctggactactgcctgaagggcctgaagctgcccagcaggacctggagccccccatttgaaagtgaggacagccagaagcacaaccagagtgaatatgaagattctgctggggagtgctgcagctgccccaagacagacagccagatcctgaaggagctggaggagagcagcttcaggaagacctttgaggactacctgcacaacgtggtgtttgtgcccaggaagaccagcagcggcaccggggctgaggacccccggcccagcaggaagagaagaagcctgggagatgtgggcaatgtgacagtggccgtgcccaccgtggccgccttccccaacaccagcagcacctctgtgcccaccagccctgaggagcaccggccctttgagaaggtggtgaacaaggagagcctggtgatcagcggcctgcggcacttcaccggctaccgcatcgagctgcaggcctgcaaccaggacaccccagaggagcgctgcagcgtggccgcctacgtgtctgcccggaccatgcctgaggccaaggcagatgacatcgtgggccctgtgacccatgagatctttgaaaataatgtggtgcacctgatgtggcaggagcccaaggagcccaacggcctgattgtgctgtatgaggtgtcctacagaagatatggagatgaggagctgcacctgtgtgtgtccaggaagcactttgccctggagcggggctgccgcctgcggggcctgagccctggcaactacagcgtgcgcatccgggccaccagcctggccggaaatggctcctggacagagcccacctacttctacgtgacagactacctggatgtgcccagcaacatcgccaagatcatcatcggccccctcatctttgtgttcctgttctctgtggtgattggcagcatctacctgttcctgaggaagaggcagccagatggccccctgggccccctgtatgccagcagcaaccctgagtacctgagcgccagtgatgtgttcccctgcagcgtgtatgtgcctgatgagtgggaggtgtcccgggagaagatcaccctgctgcgggagctgggccagggcagctttggcatggtgtatgagggcaatgcccgggacatcatcaagggggaggccgagaccagggtggccgtgaagacagtgaatgaaagtgccagcctgcgggagagaattgagttcctgaatgaggcctctgtgatgaagggcttcacctgccaccacgtggtgcggctgctgggcgtggtgtccaagggccagcccaccctggtggtgatggagctgatggcccacggggacctgaagagctacctgcggagcctgcggcctgaggccgagaacaaccctggccggcccccacccaccctgcaggagatgatccagatggctgctgagattgctgatggcatggcctacctgaatgccaagaagtttgtgcaccgggacctggccgccaggaactgcatggtggcccatgacttcaccgtgaagattggagactttggcatgacccgggacatctatgaaacagactactacaggaagggcggcaagggcctgctgcctgtgcgctggatggcccctgagagcctgaaggatggagtcttcaccaccagcagtgacatgtggagctttggagtggtgctgtgggagatcaccagcctggccgagcagccctaccagggcctgagcaatgagcaggtgctgaagtttgtgatggatggcggctacctggaccagcctgacaactgcccagagcgggtgacagacctgatgaggatgtgctggcagttcaaccccaagatgaggcccaccttcctggagatcgtgaacctgctgaaggatgacctgcaccccagcttccctgaggtgtccttcttccacagcgaggagaacaaggcccctgagagcgaggagctggagatggagtttgaggacatggagaatgtgcccctggacaggagcagccactgccagcgggaggaggccggcggcagagatggcggcagcagcctgggcttcaagaggagctatgaggagcacatcccctacacccacatgaatggaggcaagaagaatggccgcatcctgaccctgcccaggagcaaccccagctag

SEQ ID NO: 156098 - DNA, 4113 bp, Artificial Sequence
  Description of Artificial Sequence: Synthetic coding sequence
atggccactggaggaagaagaggagctgctgctgcccccctgctggtggccgtggccgccctgctgctgggcgccgccggccacctgtacccaggagaggtgtgccccggcatggacatccggaacaacctgacccggctgcacgagctggagaactgcagcgtcatcgagggccacctgcagatcctgctgatgttcaagaccaggcctgaggacttccgggacctgtccttccccaagctgatcatgatcacagactacctgctgctcttccgggtgtatggcctggagagcctgaaggacctcttccccaacctgaccgtcatccggggcagccgcctcttcttcaactatgccctggtgatctttgagatggtgcacctgaaggagctgggcctgtacaacctgatgaacatcacccggggctctgtgcgcatcgagaagaacaatgagctgtgctacctggccaccatcgactggagccgcatcctggacagcgtggaggacaactacatcgtgctgaacaaggatgacaatgaagaatgtggggacatctgccctggaacagccaagggcaagaccaactgcccagccaccgtcatcaatggccagtttgtggagcgctgctggacccacagccactgccagaaggtgtgccccaccatctgcaagagccacggctgcacagctgagggcctgtgctgccacagcgagtgcctgggcaactgcagccagccagatgaccccaccaagtgtgtggcctgcaggaacttctacctggatggccgctgtgtggagacctgccccccaccctactaccacttccaggactggaggtgtgtgaacttctccttctgccaggacctgcaccacaagtgcaagaacagccggcggcagggctgccaccagtatgtgatccacaacaacaagtgcatccctgagtgccccagcggctacaccatgaacagcagcaacctgctgtgcaccccctgcctgggcccctgccccaaggtgtgccacctgctggagggggagaagaccatcgacagcgtgaccagcgcccaggagctgcggggctgcaccgtcatcaatggcagcctcatcatcaacatccggggcggcaacaacctggccgctgagctggaggccaacctgggcctcatcgaggagatcagcggctacctgaagatccgccgctcctatgccctggtgtccctgtccttcttcaggaagctgcggctcatccggggggagaccctggagatcggcaactacagcttctacgccctggacaaccagaacctgcggcagctgtgggactggagcaagcacaacctgaccatcacccagggcaagctgttcttccactacaaccccaagctgtgcctgtctgagatccacaagatggaggaggtgtctggcaccaagggccggcaggagagaaatgacatcgccctgaagaccaatggagaccaggccagctgtgaaaatgagctgctgaagttctcctacatccgcaccagctttgacaagatcctgctgcgctgggagccctactggcccccagacttccgggacctgctgggcttcatgctgttctacaaggaggccccctaccagaatgtgacagaatttgatggccaggatgcctgtggcagcaacagctggacagtggtggacattgatcctcccctgcggagcaatgaccccaagagccagaaccaccctggctggctgatgaggggcctgaagccctggacccagtatgccatctttgtgaagaccctggtgaccttcagtgatgaaagaaggacctacggggccaagagtgacatcatctacgtgcagacagatgccaccaaccccagcgtgcccctggaccccatctctgtgagcaacagcagcagccagatcatcctgaagtggaagccacccagcgaccccaatggaaacatcacccactacctggtgttctgggagcggcaggccgaggacagcgagctgtttgagctggactactgcctgaagggcctgaagctgcccagcaggacctggagccccccatttgaaagtgaggacagccagaagcacaaccagagtgaatatgaagattctgctggggagtgctgcagctgccccaagacagacagccagatcctgaaggagctggaggagagcagcttcaggaagacctttgaggactacctgcacaacgtggtgtttgtgccccggcccagcaggaagagaagaagcctgggagatgtgggcaatgtgacagtggccgtgcccaccgtggccgccttccccaacaccagcagcacctctgtgcccaccagccctgaggagcaccggccctttgagaaggtggtgaacaaggagagcctggtgatcagcggcctgcggcacttcaccggctaccgcatcgagctgcaggcctgcaaccaggacaccccagaggagcgctgcagcgtggccgcctacgtgtctgcccggaccatgcctgaggccaaggcagatgacatcgtgggccctgtgacccatgagatctttgaaaataatgtggtgcacctgatgtggcaggagcccaaggagcccaacggcctgattgtgctgtatgaggtgtcctacagaagatatggagatgaggagctgcacctgtgtgtgtccaggaagcactttgccctggagcggggctgccgcctgcggggcctgagccctggcaactacagcgtgcgcatccgggccaccagcctggccggaaatggctcctggacagagcccacctacttctacgtgacagactacctggatgtgcccagcaacatcgccaagatcatcatcggccccctcatctttgtgttcctgttctctgtggtgattggcagcatctacctgttcctgaggaagaggcagccagatggccccctgggccccctgtatgccagcagcaaccctgagtacctgagcgccagtgatgtgttcccctgcagcgtgtatgtgcctgatgagtgggaggtgtcccgggagaagatcaccctgctgcgggagctgggccagggcagctttggcatggtgtatgagggcaatgcccgggacatcatcaagggggaggccgagaccagggtggccgtgaagacagtgaatgaaagtgccagcctgcgggagagaattgagttcctgaatgaggcctctgtgatgaagggcttcacctgccaccacgtggtgcggctgctgggcgtggtgtccaagggccagcccaccctggtggtgatggagctgatggcccacggggacctgaagagctacctgcggagcctgcggcctgaggccgagaacaaccctggccggcccccacccaccctgcaggagatgatccagatggctgctgagattgctgatggcatggcctacctgaatgccaagaagtttgtgcaccgggacctggccgccaggaactgcatggtggcccatgacttcaccgtgaagattggagactttggcatgacccgggacatctatgaaacagactactacaggaagggcggcaagggcctgctgcctgtgcgctggatggcccctgagagcctgaaggatggagtcttcaccaccagcagtgacatgtggagctttggagtggtgctgtgggagatcaccagcctggccgagcagccctaccagggcctgagcaatgagcaggtgctgaagtttgtgatggatggcggctacctggaccagcctgacaactgcccagagcgggtgacagacctgatgaggatgtgctggcagttcaaccccaagatgaggcccaccttcctggagatcgtgaacctgctgaaggatgacctgcaccccagcttccctgaggtgtccttcttccacagcgaggagaacaaggcccctgagagcgaggagctggagatggagtttgaggacatggagaatgtgcccctggacaggagcagccactgccagcgggaggaggccggcggcagagatggcggcagcagcctgggcttcaagaggagctatgaggagcacatcccctacacccacatgaatggaggcaagaagaatggccgcatcctgaccctgcccaggagcaaccccagctag

SEQ ID NO: 156099 - DNA, 252 bp, Artificial Sequence
  Description of Artificial Sequence: Synthetic coding sequence
ccctaccagaatgtgacagaatttgatggccaggatgcctgtggcagcaacagctggacagtggtggacatcgacccccccctgcggagcaatgaccccaagagccagaaccaccctggctggctgatgaggggcctgaagccctggacccagtatgccatctttgtgaagaccctggtgaccttcagtgatgagaggaggacctatggagccaagagtgacatcatctacgtgcagacagatgccacctag

SEQ ID NO: 156100 - DNA, 4017 bp, Artificial Sequence
  Description of Artificial Sequence: Synthetic coding sequence
atggccagcccccccaggcatggccccccaggccctgccagcggagatggccccaacctgaacaacaacaacaacaacaacaaccacagcgtgaggaaatgtggctacctgaggaagcagaagcacggccacaagcgcttctttgtgctgcggggccctggagctggaggagatgaggccacagctgggggcggcagcgccccccagcccccccggctggagtactatgagagcgagaagaagtggaggagcaaggccggggcccccaagagggtgattgccctggactgctgcctgaacatcaacaagagagcagatgccaagcacaagtacctgattgccctgtacaccaaggatgagtactttgctgtggccgcagaaaatgagcaggagcaggagggctggtaccgggccctgacagacctggtgtctgagggccgggctgctgctggagatgcccccccagctgctgccccagctgccagctgcagcgccagcctgcccggggccctgggcggcagcgctggagctgctggagcagaagattcctatggcctggtggccccagccacagctgcctaccgggaggtgtggcaggtgaacctgaagcccaagggcctgggccagagcaagaacctgactggagtgtaccgcctgtgcctgagcgcccggaccatcggctttgtgaagctgaactgtgagcagcccagcgtgaccctgcagctgatgaacatccgccgctgtggccacagcgacagcttcttcttcatcgaggtgggccgctctgctgtgactggacctggagagctgtggatgcaggctgatgattctgtggtggcccagaacatccacgagaccatcctggaggccatgaaggccctgaaggagctgtttgagttccggcccaggagcaagagccagagcagcggcagcagcgccacccaccccatctctgtgcctggggcccggcggcaccaccacctggtgaacctgccccccagccagacaggcctggtgcggcgcagcaggacagacagcctggccgccaccccacctgctgccaagtgcagcagctgccgggtgaggacagcctctgaaggagatggaggagctgctgctggagctgctgctgctggggcccggcctgtgtctgtggccggcagccccctgagccctggccctgtgcgggcccccctgagccgcagccacaccctgagcggcggctgcggcggccggggcagcaaggtggccctgctgcctgctggaggagccctgcagcacagccgctccatgtccatgcctgtggcccacagccccccagctgccaccagccctggcagcctgagcagcagcagcggccacggcagcggcagctacccacctcctcctggcccccacccccccctgccccaccccctgcaccacggccctggccagaggcccagcagcggcagcgccagcgccagcggcagccccagcgaccccggcttcatgagcctggatgaatatggcagcagccctggggacctgcgggccttctgcagccacaggagcaacaccccagagagcattgctgagaccccaccagccagagatggcggcggcggcggggagttctacggctacatgaccatggaccggcccctgagccactgcggccgcagctacagaagagtgtctggagatgctgcccaggacctggaccggggcctgaggaagaggacctacagcctgaccaccccagcccggcagaggcctgtgccccagcccagcagcgccagcctggatgagtacaccctgatgagggccaccttcagcggcagcgctggccgcctgtgccccagctgcccagccagcagccccaaggtggcctaccacccctacccagaggactatggagacattgaaattggcagccacaggagcagcagcagcaacctgggcgcagatgatggctacatgcccatgacccctggggccgccctggccggcagcggcagcggcagctgccgcagtgatgactacatgcccatgagccctgcctctgtgtctgcccccaagcagatcctgcagcccagggctgctgctgctgctgctgctgctgtgcccagcgctggccctgctggccctgcccccaccagcgctgctggccgcaccttccctgccagcggcggcggctacaaggccagcagccctgctgagagcagccctgaggacagcggctacatgaggatgtggtgtggcagcaagctgtccatggagcacgcagatggcaagctgctgcccaatggagactacctgaatgtgagccccagtgatgctgtgaccaccggcaccccaccagacttcttctctgctgccctgcaccctggaggagagcccctgcggggcgtgcccggctgctgctacagcagcctgcccaggagctacaaggccccctacacctgtggcggggacagcgaccagtatgtgctgatgagcagccctgtgggccgcatcctggaggaggagcggctggagccccaggccaccccaggccccagccaggccgccagcgccttcggggccggccccacccagcccccccaccctgtggtgcccagccctgtgcggcccagcggcggccggcctgagggcttcctgggccagaggggccgggctgtgcggcccacccggctgagcctggagggcctgcccagcctgcccagcatgcatgagtaccccctgcccccagagcccaagagccctggagagtacatcaacatcgactttggagagcccggggcccggctgagccccccagccccacccctgctggccagcgctgccagcagcagcagcctgctgagcgccagcagccctgccagcagcctgggcagcggcaccccaggcaccagcagtgacagccggcagaggagccccctgagtgactacatgaacctggacttcagcagccccaagagccccaagccaggggcccccagcggccaccctgtgggcagcctggatggcctgctgagccctgaggccagcagcccctacccacccctgcccccccggcccagcgccagccccagcagcagcctgcagcccccacctcctcctccagcccctggagagctgtaccgcctgcccccagccagcgctgtggccacagcccagggccctggggccgccagcagcctgagcagtgacaccggggacaatggagactacacagagatggcctttggagtggccgccaccccaccccagcccatcgccgccccacccaagccagaggccgcccgggtggccagccccaccagcggcgtgaagaggctgagcctgatggagcaggtgtctggagtggaggccttcctgcaggccagccagcccccagacccccacagaggagccaaggtgatccgggctgacccccagggcggcagaagaagacacagcagcgagaccttcagcagcaccaccaccgtgacccctgtgagccccagctttgcccacaaccccaagaggcacaacagcgcctctgtggagaatgtgtccctgaggaagagcagcgagggcggcgtgggcgtgggccctggaggaggagatgagccccccaccagcccccggcagctgcagcctgccccacccctggccccccagggccggccctggaccccaggccagcccggcggcctggtgggctgccccggcagcggcggcagccccatgaggcgggagaccagcgctggcttccagaatggcctgaactacatcgccattgatgtgcgggaggagcccggcctgcccccccagccccagcccccacctccacccctgccccagcccggggacaagagctcctggggccgcaccaggagcctgggcggcctcatctctgctgtgggcgtgggcagcactggaggcggctgcggcggccctggccctggggccctgcccccagccaacacctacgccagcattgacttcctgagccaccacctgaaggaggccaccatcgtgaaggagtag

SEQ ID NO: 156101 - DNA, 3894 bp, Artificial Sequence
  Description of Artificial Sequence: Synthetic coding sequence
atggctgtgcccagcctgtggccctggggcgcctgcctgcccgtcatcttcctgagcctgggcttcggcctggacacagtggaggtgtgccccagcctggacatccgctctgaggtggccgagctgcggcagctggagaactgcagcgtggtggagggccacctgcagatcctgctgatgttcaccgccaccggggaggacttccggggcctgtccttcccccggctgacccaggtgacagactacctgctgctcttccgggtgtatggcctggagagcctgcgggacctcttccccaacctggccgtcatccggggcaccaggctcttcctgggctacgccctggtgatctttgagatgccccacctgagagatgtggccctgcctgccctgggcgctgtgctgcggggagctgtgcgggtggagaagaaccaggagctgtgccacctgagcaccatcgactggggcctgctgcagcctgcccctggggccaaccacatcgtgggcaacaagctgggggaggagtgtgctgatgtgtgccctggggtgctgggcgctgctggggagccctgtgccaagaccaccttcagcggccacacagactaccgctgctggaccagcagccactgccagagggtgtgcccctgcccccacggcatggcctgcacagcccggggggagtgctgccacacagagtgcctgggcggctgcagccagcctgaggacccccgggcctgtgtggcctgccgccacctgtacttccagggcgcctgcctgtgggcctgccccccaggcacctaccagtatgaatcctggaggtgtgtgacagctgagcgctgtgccagcctgcacagcgtgcccggccgggccagcaccttcggcatccaccagggcagctgcctggcccagtgccccagcggcttcaccaggaacagcagcagcatcttctgccacaagtgtgagggcctgtgccccaaggagtgcaaggtgggcaccaagaccatcgacagcatccaggccgcccaggacctggtgggctgcacccacgtggagggcagcctcatcctgaacctgcggcagggctacaacctggagccccagctgcagcacagcctgggcctggtggagaccatcaccggcttcctgaagatcaagcacagctttgccctggtgtccctgggcttcttcaagaacctgaagctgatcagaggagatgccatggtggatggcaactacaccctgtatgtgctggacaaccagaacctgcagcagctgggctcctgggtggccgccggcctgaccatccctgtgggcaagatctactttgccttcaacccccggctgtgcctggagcacatctaccgcctggaggaggtgacaggcacccggggccggcagaacaaggccgagatcaaccccaggaccaacggggaccgggccgcctgccagaccaggaccctgcgctttgtgtccaatgtgacagaggccgaccgcatcctgctgcgctgggagagatatgagcccctggaggcccgggacctgctgtccttcatcgtgtactacaaggagagccccttccagaatgccacagagcacgtgggcccagatgcctgtggcacccagagctggaacctgctggatgtggagctgcccctgagcaggacccaggagcccggggtgaccctggccagcctgaagccctggacccagtatgctgtgtttgtgcgggccatcaccctgaccacagaggaggacagcccccaccagggcgcccagagccccatcgtgtacctgcggaccctgcctgctgcccccaccgtgccccaggacgtcatcagcaccagcaacagcagcagccacctgctggtgcgctggaagccacccacccagagaaatggaaacctgacctactacctggtgctgtggcagaggctggctgaagatggagacctgtacctgaatgactactgccaccggggcctgcggctgcccaccagcaacaatgaccccaggtttgatggagaagatggagaccctgaggccgagatggagagtgactgctgcccctgccagcaccccccacctggccaggtgctgccccccctggaggcccaggaggccagcttccagaagaagtttgagaacttcctgcacaatgccatcaccatccccatcagcccctggaaggtgaccagcatcaacaagagcccccagagggacagcggccgccacagaagagctgctggccccctgcggctgggcggcaacagcagtgactttgagatccaggaggacaaggtgccccgggagagagctgtgctgagcggcctgcggcacttcacagagtacagaattgacatccacgcctgcaaccacgccgcccacacagtgggctgcagcgctgccacctttgtgtttgcccggaccatgccccaccgggaggctgatggcatccctgggaaggtggcctgggaggccagcagcaagaacagcgtgctgctgcgctggctggagcccccagaccccaacggcctcatcctgaagtatgagatcaagtaccgccgcctgggggaggaggccaccgtgctgtgtgtgtcccggctgcgctatgccaagtttggaggagtgcacctggccctgctgcccccaggcaactacagcgcccgggtgcgggccaccagcctggccggaaatggctcctggacagacagcgtggccttctacatcctgggccctgaggaggaggatgctgggggcctgcacgtgctgctgacagccacccctgtgggcctgaccctgctgattgtgctggccgccctgggcttcttctacggcaagaagaggaacagaaccctgtatgcctctgtgaaccctgagtacttcagcgccagtgacatgtatgtgcctgatgagtgggaggtgccccgggagcagatcagcatcatccgggagctgggccagggcagctttggcatggtgtatgagggcctggcccggggcctggaggccggggaggagagcacccctgtggccctgaagacagtgaatgagctggccagccccagagaatgtattgagttcctgaaggaggcctctgtgatgaaggccttcaagtgccaccacgtggtgcggctgctgggcgtggtgtcccagggccagcccaccctggtgatcatggagctgatgaccaggggggacctgaagagccacctgcggagcctgcggcctgaggccgagaacaaccctggcctgccccagcctgccctgggggagatgatccagatggccggggagattgctgatggcatggcctacctggccgccaacaagtttgtgcaccgggacctggccgccaggaactgcatggtgtcccaggacttcaccgtgaagattggagactttggcatgaccagagatgtgtatgaaacagactactacaggaagggcggcaagggcctgctgcctgtgcgctggatggcccctgagagcctgaaggatggcatcttcaccacccacagtgatgtgtggagctttggagtggtgctgtgggagatcgtgaccctggccgagcagccctaccagggcctgagcaatgagcaggtgctgaagtttgtgatggatggaggagtgctggaggagctggagggctgccccctgcagctgcaggagctgatgagccgctgctggcagcccaacccccggctgcggcccagcttcacccacatcctggacagcatccaggaggagctgcggcccagcttccggctgctgtccttctactacagccctgagtgccgcggggcccggggcagcctgcccaccacagatgctgagccagacagcagccccaccccccgggactgcagcccccagaatggaggccctggccactag

SEQ ID NO: 156102 - DNA, 3060 bp, Artificial Sequence
  Description of Artificial Sequence: Synthetic coding sequence
atgagataccgcctggcctggctgctgcacccagccctgcccagcaccttccgctctgtgctgggcgcccggctgcccccacctgagcggctgtgtggcttccagaagaagacctacagcaagatgaacaacccagccatcaagagaattggcaaccacatcaccaagagccctgaggacaagcgggagtaccggggcctggagctggccaacggcatcaaggtgctgctgatcagtgaccccaccacagacaagagcagcgctgccctggatgtgcacatcggcagcctgagtgacccccccaacattgctggcctgagccacttctgtgagcacatgctgttcctgggcaccaagaagtaccccaaggaaaatgagtacagccagttcctgtctgagcacgccggcagcagcaatgccttcaccagcggggagcacaccaactactactttgatgtgtcccatgagcacctggagggcgccctggacagatttgcccagttcttcctgtgccccctgtttgatgagagctgcaaggaccgggaggtgaatgctgtggacagcgagcacgagaagaatgtgatgaatgatgcctggaggctcttccagctggagaaggccaccggcaaccccaagcaccccttcagcaagtttggcaccggcaacaagtacaccctggagacccggcccaaccaggagggcattgatgtgcggcaggagctgctgaagttccacagcgcctactacagcagcaacctgatggctgtgtgtgtgctgggccgggagagcctggatgacctgaccaacctggtggtgaagctgttcagcgaggtggagaacaagaatgtgcccctgcctgagttccctgagcaccccttccaggaggagcacctgaagcagctgtacaagatcgtgcccatcaaggacatccggaacctgtatgtgaccttccccatcccagacctgcagaagtactacaagagcaaccctggccactacctgggccacctgattggccacgagggccctggcagcctgctgtctgagctgaagagcaagggctgggtgaacaccctggtgggcggccagaaggagggcgcccggggcttcatgttcttcatcatcaacgtggacctgacagaggagggcctgctgcacgtggaggacatcatcctgcacatgttccagtacatccagaagctgcgggcagagggcccccaggagtgggtgttccaggagtgcaaggacctgaatgctgtggccttccgcttcaaggacaaggagcggccccggggctacaccagcaagattgctggcatcctgcactactaccccctggaggaggtgctgacagctgagtacctgctggaggagttccggccagacctgattgagatggtgctggacaagctgcggccagaaaatgtgcgggtggccatcgtgtccaagagctttgagggcaagacagacagaacagaggagtggtacggcacccagtacaagcaggaggccatcccagatgaagtcatcaagaagtggcagaatgctgacctgaatggcaagttcaagctgcccaccaagaatgagttcatccccaccaactttgagatcctgcccctggagaaggaggccaccccctacccagccctgatcaaggacacagccatgagcaagctgtggttcaagcaggatgacaagttcttcctgcccaaggcctgcctgaactttgagttcttcagcccctttgcctacgtggaccccctgcactgcaacatggcctacctgtacctggagctgctgaaggacagcctgaatgaatatgcctatgctgctgagctggccggcctgtcctatgacctgcagaacaccatctacggcatgtacctgtctgtgaagggctacaatgacaagcagcccatcctgctgaagaagatcatcgagaagatggccacctttgaaattgatgagaagagatttgagatcatcaaggaggcctacatgaggagcctgaacaacttccgggcagagcagccccaccagcacgccatgtactacctgcggctgctgatgacagaggtggcctggaccaaggatgagctgaaggaggccctggatgatgtgaccctgccccggctgaaggccttcatcccccagctgctgagccggctgcacatcgaggccctgctgcacggcaacatcaccaagcaggccgccctgggcatcatgcagatggtggaggacaccctcatcgagcacgcccacaccaagcccctgctgcccagccagctggtgcgctaccgggaggtgcagctgcctgaccggggctggtttgtgtaccagcagagaaatgaggtgcacaacaactgtggcatcgagatctactaccagacagacatgcagagcaccagcgagaacatgttcctggagctgttctgccagatcatcagcgagccctgcttcaacaccctgcggaccaaggagcagctgggctacatcgtgttttctggcccccggcgggccaacggcatccagggcctgcgcttcatcatccagagcgagaagccaccccactacctggagagccgggtggaggccttcctgatcaccatggagaagagcattgaggacatgacagaggaggccttccagaagcacatccaggccctggccatccggcggctggacaagcccaagaagctgtctgcagaatgtgccaagtactggggcgagatcatcagccagcagtacaactttgaccgggacaacacagaggtggcctacctgaagaccctgaccaaggaggacatcatcaagttctacaaggagatgctggccgtggatgccccccggcggcacaaggtgtctgtgcacgtgctggcccgggagatggacagctgccctgtggtgggggagttcccctgccagaatgacatcaacctgagccaggccccagccctgccccagcctgaggtgatccagaacatgacagagttcaagaggggcctgcccctcttccccctggtgaagccccacatcaacttcatggccgccaagctgtag

SEQ ID NO: 156103 - DNA, 1395 bp, Artificial Sequence
  Description of Artificial Sequence: Synthetic coding sequence
atgagcaagctgtggttcaagcaggatgacaagttcttcctgcccaaggcctgcctgaactttgagttcttcagcccctttgcctacgtggaccccctgcactgcaacatggcctacctgtacctggagctgctgaaggacagcctgaatgaatatgcctatgctgctgagctggccggcctgtcctatgacctgcagaacaccatctacggcatgtacctgtctgtgaagggctacaatgacaagcagcccatcctgctgaagaagatcatcgagaagatggccacctttgaaattgatgagaagagatttgagatcatcaaggaggcctacatgaggagcctgaacaacttccgggcagagcagccccaccagcacgccatgtactacctgcggctgctgatgacagaggtggcctggaccaaggatgagctgaaggaggccctggatgatgtgaccctgccccggctgaaggccttcatcccccagctgctgagccggctgcacatcgaggccctgctgcacggcaacatcaccaagcaggccgccctgggcatcatgcagatggtggaggacaccctgattgaacatgcccacaccaagcccctgctgcccagccagctggtgcgctaccgggaggtgcagctgcctgaccggggctggtttgtgtaccagcagagaaatgaggtgcacaacaactgtggcatcgagatctactaccagacagacatgcagagcaccagcgagaacatgttcctggagctgttctgccagatcatcagcgagccctgcttcaacaccctgcggaccaaggagcagctgggctacatcgtgttcagcggcccccggcgggccaacggcatccagggcctgcgcttcatcatccagagcgagaagccaccccactacctggagagccgggtggaggccttcctgatcaccatggagaagagcattgaggacatgacagaggaggccttccagaagcacatccaggccctggccatccggcggctggacaagcccaagaagctgtctgcagaatgtgccaagtactggggcgagatcatcagccagcagtacaactttgaccgggacaacacagaggtggcctacctgaagaccctgaccaaggaggacatcatcaagttctacaaggagatgctggccgtggatgcccccaggaggcacaaggtgtctgtgcacgtgctggcccgggagatggacagctgccctgtggtgggggagttcccctgccagaatgacatcaacctgagccaggccccagccctgccccagcctgaggtgatccagaacatgacagagttcaagaggggcctgcccctcttccccctggtgaagccccacatcaacttcatggccgccaagctgtag

SEQ ID NO: 156104 - DNA, 774 bp, Artificial Sequence
  Description of Artificial Sequence: Synthetic coding sequence
gagttcatcatccggggcggccgggtgcccagccactgcctgcacttcagccgctccttccagaagaagacctacagcaagatgaacaacccagccatcaagagaattggcaaccacatcaccaagagccctgaggacaagcgggagtaccggggcctggagctggccaacggcatcaaggtgctgctgatcagtgaccccaccacagacaagagcagcgctgccctggatgtgcacatcggcagcctgagtgacccccccaacattgctggcctgagccacttctgtgagcacatgctgttcctgggcaccaagaagtaccccaaggaaaatgagtacagccagttcctgtctgagcacgccggcagcagcaatgccttcaccagcggggagcacaccaactactactttgatgtgtcccatgagcacctggagggcgccctggacagatttgcccagttcttcctgtgccccctgtttgatgagagctgcaaggaccgggaggtgaatgctgtggacagcgagcacgagaagaatgtgatgaatgatgcctggaggctcttccagctggagaaggccaccggcaaccccaagcaccccttcagcaagtttggcaccggcaacaagtacaccctggagacccggcccaaccaggagggcattgatgtgcggcaggagctgctgaagttccacagcgcctactacagcagcaacctgatggctgtgtgtgtgctgggccgggagagcctggatgacctgaccaacctggtgtag

SEQ ID NO: 156105 - DNA, 396 bp, Artificial Sequence
  Description of Artificial Sequence: Synthetic coding sequence
atggacccccggctgcctgcctgggccctggtgctgctgggccctgccctggtgtttgccctgggccctgcccccaccccagagatgagggagaagctgtgtggccaccactttgtgcgggccctggtgcgggtgtgtggcggcccccgctggagcacagaggcccggcggcctgccaccggcggggaccgggagctgctgcagtggctggagcggcggcacctgctgcacggcctggtggccgacagcaacctgaccctgggccctggcctgcagcccctgccccagaccagccaccaccaccgccaccacagagctgctgccaccaacccagcccgctactgctgcctgagcggctgcacccagcaggacctgctgaccctgtgcccctactag

SEQ ID NO: 156106 - DNA, 474 bp, Artificial Sequence
  Description of Artificial Sequence: Synthetic coding sequence
atggacccccggctgcctgcctgggccctggtgctgctgggccctgccctggtgtttgccctgggccctgcccccaccccagagatgagggagaagctgtgtggccaccactttgtgcgggccctggtgcgggtgtgtggcggcccccgctggagcacagaggcccggcggcctgccaccggcggggaccagcgggagagccacagcgtgtcccaggccggcctgaagctgctgagcagcagcaacccccccaccctgaccttccagagcgtgggcatcagtgatgtgtcctgctacagcggctggagagatgacatctgcagcatgggctggtggcccaccgtcatcagccgctgggacctggcctgcagcccctgcccccggcccctgaccatcacagccaccaccgtgcagctgccccccaccctgcacgccacagctgcctctgtggccgtgcccaacaagacctgctag

SEQ ID NO: 156107 - DNA, 420 bp, Artificial Sequence
  Description of Artificial Sequence: Synthetic coding sequence
atggccagcctcttccgcagctacctgcctgccatctggctgctgctgagccagctgctgcgggagagcctggccgctgagctgcggggctgcggccccaggtttgggaagcacctgctgagctactgccccatgcctgagaagaccttcaccaccacccctgggggctggctgctggagagcggccggcccaaggagatggtgtccaccagcaacaacaaggatggccaggccctgggcaccaccagcgagttcatccccaacctgagccctgagctgaagaagcccctgtctgagggccagcccagcctgaagaagatcatcctgagcaggaagaagaggagcggccgccacagatttgaccccttctgctgtgaggtgatctgtgatgatggcacctctgtgaagctgtgcacctag

SEQ ID NO: 156108 - DNA, 408 bp, Artificial Sequence
  Description of Artificial Sequence: Synthetic coding sequence
atgaagggcagcatcttcaccctcttcctgttctctgtgctgtttgccatcagcgaggtgcgcagcaaggagagcgtgcggctgtgtggcctggagtacatccgcaccgtcatctacatctgtgccagcagccgctggaggaggcaccaggagggcatcccccaggcccagcaggccgagactggaaacagcttccagctgccccacaagcgggagttcagcgaggagaacccagcccagaacctgcccaaggtggatgccagcggggaggaccggctgtggggcggccagatgcccacagaggagctgtggaagagcaagaagcacagcgtgatgagccggcaggacctgcagaccctgtgctgcacagatggctgcagcatgacagacctgagcgccctgtgctag

SEQ ID NO: 156109 - DNA, 642 bp, Artificial Sequence
  Description of Artificial Sequence: Synthetic coding sequence
atgccccggctgctgcggctgagcctgctgtggctgggcctgctgctggtgcgcttcagccgggagctgagtgacatcagcagcgccaggaagctgtgtggccgctacctggtgaaggagattgagaagctgtgtggccacgccaactggagccagttccgctttgaggaggagacccccttcagccggctgattgcccaggccagcgagaaggtggaggcctacagcccctaccagtttgagagcccccagacagccagccctgcccggggccggggcaccaaccctgtgtccacctcctgggaggaggccgtgaacagctgggagatgcagagcctgcctgagtacaaggacaagaagggctacagccccctgggcaagacccgggagttcagcagcagccacaacatcaacgtgtacatccatgaaaatgccaagttccagaagaagagaagaaacaagatcaagaccctgagcaacctcttctggggccaccacccccagaggaagagaagaggctacagcgagaagtgctgcctgaccggctgcaccaaggaggagctgagcatcgcctgcctgccctacatcgacttcaagaggctgaaggagaagaggagcagcctggtgaccaagatctactag

SEQ ID NO: 156110 - DNA, 1734 bp, Artificial Sequence
  Description of Artificial Sequence: Synthetic coding sequence
atgaacaagctgtacatcggcaacctgaatgaatctgtgaccccagctgacctggagaaggtgtttgctgagcacaagatctcctacagcggccagttcctggtgaagagcggctacgcctttgtggactgcccagatgagcactgggccatgaaggccatcgagaccttcagcggcaaggtggagctgcagggcaagaggctggagattgagcacagcgtgcccaagaagcagaggagcaggaagatccagatccggaacatccccccccagctgcgctgggaggtgctggacagcctgctggcccagtatggcaccgtggagaactgtgagcaggtgaacacagaaagtgaaacagctgtggtgaatgtgacctacagcaaccgggagcagacccggcaggccatcatgaagctgaatggccaccagctggagaaccacgccctgaaggtgtcctacatcccagatgagcagatcgcccagggcccagaaaatggaagaagaggaggcttcggcagccggggccagccccggcagggcagccctgtggccgccggggccccagccaagcagcagcaggtggacatccccctgcggctgctggtgcccacccagtatgtgggcgccatcatcggcaaggagggcgccaccatccggaacatcaccaagcagacccagagcaagattgatgtgcacaggaaagaaaatgctggagctgctgagaaggccatctctgtgcacagcaccccagagggctgcagcagcgcctgcaagatgatcctggagatcatgcacaaggaggccaaggacaccaagacagcagatgaggtgcccctgaagatcctggcccacaacaactttgtgggccgcctcatcggcaaggagggcaggaacctgaagaaggtggagcaggacacagagaccaagatcaccatcagcagcctgcaggacctgaccctgtacaaccctgagaggaccatcaccgtgaagggggccatcgagaactgctgcagagctgagcaggagatcatgaagaaggtgcgggaggcctatgaaaatgatgtggccgccatgagcctgcagagccacctgatccctggcctgaacctggccgctgtgggcctcttccctgccagcagcagcgctgtgcccccaccacccagctctgtgactggagctgccccctacagcagcttcatgcaggcccctgagcaggagatggtgcaggtgttcatcccagcccaggccgtgggcgccatcatcggcaagaagggccagcacatcaagcagctgagcagatttgccagcgccagcatcaagatcgcccctcctgagaccccagacagcaaggtgaggatggtgatcatcactggacctcctgaggcccagttcaaggcccagggccgcatctacggcaagctgaaggaggagaacttcttcggccccaaggaggaggtgaagctggagacccacatccgggtgcctgccagcgctgctggccgggtgattggaaaaggaggcaagacagtgaatgagctgcagaacctgacagctgctgaggtggtggtgccccgggaccagaccccagatgaaaatgaccaggtgattgtgaagatcatcggccacttctacgccagccagatggcccagaggaagatccgggacatcctggcccaggtgaagcagcagcaccagaagggccagagcaaccaggcccaggcccggaggaagtag

SEQ ID NO: 156111 - DNA, 1317 bp, Artificial Sequence
  Description of Artificial Sequence: Synthetic coding sequence
atgaacaagctgtacatcggcaacctgaatgaatctgtgaccccagctgacctggagaaggtgtttgctgagcacaagatctcctacagcggccagttcctggtgaagagcggctacgcctttgtggactgcccagatgagcactgggccatgaaggccatcgagaccttcagcggcaaggtggagctgcagggcaagaggctggagattgagcacagcgtgcccaagaagcagaggagcaggaagatccagatccggaacatccccccccagctgcgctgggaggtgctggacagcctgctggcccagtatggcaccgtggagaactgtgagcaggtgaacacagaaagtgaaacagctgtggtgaatgtgacctacagcaaccgggagcagacccggcaggctgatgaggtgcccctgaagatcctggcccacaacaactttgtgggccgcctgattggcaaggagggcaggaacctgaagaaggtggagcaggacacagagaccaagatcaccatcagcagcctgcaggacctgaccctgtacaaccctgagaggaccatcaccgtgaagggggccatcgagaactgctgcagagctgagcaggagatcatgaagaaggtgcgggaggcctatgaaaatgatgtggccgccatgagcctgcagagccacctgatccctggcctgaacctggccgctgtgggcctcttccctgccagcagcagcgctgtgcccccaccacccagctctgtgactggagctgccccctacagcagcttcatgcaggcccctgagcaggagatggtgcaggtgttcatcccagcccaggccgtgggcgccatcatcggcaagaagggccagcacatcaagcagctgagcagatttgccagcgccagcatcaagatcgcccctcctgagaccccagacagcaaggtgaggatggtgatcatcaccggccccccagaggcccagttcaaggcccagggccgcatctacggcaagctgaaggaggagaacttcttcggccccaaggaggaggtgaagctggagacccacatccgggtgcctgccagcgctgctggccgggtcatcggcaagggcggcaagacagtgaatgagctgcagaacctgacagctgctgaggtggtggtgccccgggaccagaccccagatgaaaatgaccaggtgattgtgaagatcatcggccacttctacgccagccagatggcccagaggaagatccgggacatcctggcccaggtgaagcagcagcaccagaagggccagagcaaccaggcccaggcccggaggaagtag

SEQ ID NO: 156112 - DNA, 1671 bp, Artificial Sequence
  Description of Artificial Sequence: Synthetic coding sequence
atgatgaacaagctgtacatcggcaacctgagccctgctgtgacagcagatgacctgcggcagctgtttggagacaggaagctgcccctggccggccaggtgctgctgaagagcggctacgcctttgtggactacccagaccagaactgggccatccgggccatcgagaccctgagcggcaaggtggagctgcacggcaagatcatggaggtggactacagcgtgtccaagaagctgcggagcaggaagatccagatccggaacatccccccccacctgcagtgggaggtgctggatggcctgctggcccagtatggaacagtggagaatgtggagcaggtgaacacagacacagaaacagctgtggtgaatgtgacctacgccacccgggaggaggccaagatcgccatggagaagctgagcggccaccagtttgagaactacagcttcaagatctcctacatcccagatgaggaggtgagcagccccagccccccccagagggcccagagaggagaccacagcagccgggagcagggccacgcccctgggggcaccagccaggcccggcagattgacttccccctgcgcatcctggtgcccacccagtttgtgggcgccatcatcggcaaggagggcctgaccatcaagaacatcaccaagcagacccagagccgggtggacatccacaggaaagaaaattctggagctgctgagaagcctgtgaccatccacgccaccccagagggcaccagcgaggcctgcaggatgatcctggagatcatgcagaaggaggctgatgagaccaagctggccgaggagatccccctgaagatcctggcccacaacggcctggtgggccgcctcatcggcaaggagggcaggaacctgaagaagattgagcacgagaccggcaccaagatcaccatcagcagcctgcaggacctgagcatctacaaccctgagaggaccatcaccgtgaagggcaccgtggaggcctgtgccagcgctgagattgagatcatgaagaagctgcgggaggcctttgaaaatgacatgctggccgtgaacacccacagcggctacttcagcagcctgtacccccaccaccagtttggccccttcccccaccaccacagctacccagagcaggagatcgtgaacctcttcatccccacccaggccgtgggcgccatcatcggcaagaagggggcccacatcaagcagctggccaggtttgctggggccagcatcaagatcgccccagctgagggcccagatgtgtctgagaggatggtgatcatcaccggccccccagaggcccagttcaaggcccagggccgcatctttgggaagctgaaggaggagaacttcttcaaccccaaggaggaggtgaagctggaggcccacatccgggtgcccagcagcacagctggccgggtcatcggcaagggcggcaagacagtgaatgagctgcagaacctgaccagcgctgaggtgattgtgccccgggaccagaccccagatgaaaatgaggaggtgattgtgcgcatcatcggccacttctttgccagccagacagcccagaggaagatccgggagatcgtgcagcaggtgaagcagcaggagcagaagtacccccagggcgtggccagccagaggagcaagtag

SEQ ID NO: 156113 - DNA, 1800 bp, Artificial Sequence
  Description of Artificial Sequence: Synthetic coding sequence
atgatgaacaagctgtacatcggcaacctgagccctgctgtgacagcagatgacctgcggcagctgtttggagacaggaagctgcccctggccggccaggtgctgctgaagagcggctacgcctttgtggactacccagaccagaactgggccatccgggccatcgagaccctgagcggcaaggtggagctgcacggcaagatcatggaggtggactacagcgtgtccaagaagctgcggagcaggaagatccagatccggaacatccccccccacctgcagtgggaggtgctggatggcctgctggcccagtatggaacagtggagaatgtggagcaggtgaacacagacacagaaacagctgtggtgaatgtgacctacgccacccgggaggaggccaagatcgccatggagaagctgagcggccaccagtttgagaactacagcttcaagatctcctacatcccagatgaggaggtgagcagccccagccccccccagagggcccagagaggagaccacagcagccgggagcagggccacgcccctgggggcaccagccaggcccggcagattgacttccccctgcgcatcctggtgcccacccagtttgtgggcgccatcatcggcaaggagggcctgaccatcaagaacatcaccaagcagacccagagccgggtggacatccacaggaaagaaaattctggagctgctgagaagcctgtgaccatccacgccaccccagagggcaccagcgaggcctgcaggatgatcctggagatcatgcagaaggaggctgatgagaccaagctggccgaggagatccccctgaagatcctggcccacaacggcctggtgggccgcctcatcggcaaggagggcaggaacctgaagaagattgagcacgagaccggcaccaagatcaccatcagcagcctgcaggacctgagcatctacaaccctgagaggaccatcaccgtgaagggcaccgtggaggcctgtgccagcgctgagattgagatcatgaagaagctgcgggaggcctttgaaaatgacatgctggccgtgaaccagcaggccaacctgatccctggcctgaacctgagcgccctgggcatcttcagcacaggcctgtctgtgctgagccccccagctggccccaggggggcccctcctgctgccccctaccaccccttcaccacccacagcggctacttcagcagcctgtacccccaccaccagtttggccccttcccccaccaccacagctacccagagcaggagatcgtgaacctcttcatccccacccaggccgtgggcgccatcatcggcaagaagggggcccacatcaagcagctggccaggtttgctggggccagcatcaagatcgccccagctgagggcccagatgtgtctgagaggatggtgatcatcactggacctcctgaggcccagttcaaggcccagggccgcatctttgggaagctgaaggaggagaacttcttcaaccccaaggaggaggtgaagctggaggcccacatccgggtgcccagcagcacagctggccgggtgattggaaaaggaggcaagacagtgaatgagctgcagaacctgaccagcgctgaggtgattgtgccccgggaccagaccccagatgaaaatgaggaggtgattgtgcgcatcatcggccacttctttgccagccagacagcccagaggaagatccgggagatcgtgcagcaggtgaagcagcaggagcagaagtacccccagggcgtggccagccagaggagcaagtag

SEQ ID NO: 156114 - DNA, 1629 bp, Artificial Sequence
  Description of Artificial Sequence: Synthetic coding sequence
atgttcagctgccccggccactaccacgtggatggcttcctgaaccctggcagcaggaagatccagatccggaacatccccccccacctgcagtgggaggtgctggatggcctgctggcccagtatggcaccgtggagaatgtggagcaggtgtttgccttcagcctggtgaacacagacacagaaacagctgtggtgaatgtgacctacgccacccgggaggaggccaagatcgccatggagaagctgagcggccaccagtttgagaactacagcttcaagatctcctacatcccagatgaggaggtgagcagccccagccccccccagagggcccagagaggagaccacagcagccgggagcagggccacgcccctgggggcaccagccaggcccggcagattgacttccccctgcgcatcctggtgcccacccagtttgtgggcgccatcatcggcaaggagggcctgaccatcaagaacatcaccaagcagacccagagccgggtggacatccacaggaaggagaacagcggggctgctgagaagcctgtgaccatccacgccaccccagagggcaccagcgaggcctgcaggatgatcctggagatcatgcagaaggaggctgatgagaccaagctggccgaggagatccccctgaagatcctggcccacaacggcctggtgggccgcctgattggcaaggagggcaggaacctgaagaagattgaacatgaaacaggcaccaagatcaccatcagcagcctgcaggacctgagcatctacaaccctgagaggaccatcaccgtgaagggcaccgtggaggcctgtgccagcgctgagattgagatcatgaagaagctgcgggaggcctttgaaaatgacatgctggccgtgaaccagcaggccaacctgatccctggcctgaacctgagcgccctgggcatcttcagcacaggcctgtctgtgctgagccccccagctggccccaggggggcccccccagctgccccctaccaccccttcaccacccacagcggctacttcagcagcctgtacccccaccaccagtttggccccttcccccaccaccacagctacccagagcaggagatcgtgaacctcttcatccccacccaggccgtgggcgccatcatcggcaagaagggggcccacatcaagcagctggccaggtttgctggggccagcatcaagatcgccccagctgagggcccagatgtgtctgagaggatggtgatcatcaccggccccccagaggcccagttcaaggcccagggccgcatctttgggaagctgaaggaggagaacttcttcaaccccaaggaggaggtgaagctggaggcccacatccgggtgcccagcagcacagctggccgggtcatcggcaagggcggcaagacagtgaatgagctgcagaacctgaccagcgctgaggtgattgtgccccgggaccagaccccagatgaaaatgaggaggtgattgtgcgcatcatcggccacttctttgccagccagacagcccagaggaagatccgggagatcgtgcagcaggtgaagcagcaggagcagaagtacccccagggcgtggccagccagaggagcaagtag

SEQ ID NO: 156115 - DNA, 1740 bp, Artificial Sequence
  Description of Artificial Sequence: Synthetic coding sequence
atgaacaagctgtacatcggcaacctgtctgaaaatgctgcccccagcgacctggagagcatcttcaaggatgccaagatccctgtgtctggccccttcctggtgaagacaggctacgcctttgtggactgcccagatgagagctgggccctgaaggccatcgaggccctgagcggcaagattgagctgcacggcaagcccatcgaggtggagcacagcgtgcccaagaggcagaggatcaggaagctgcagatccggaacatccccccccacctgcagtgggaggtgctggacagcctgctggtgcagtatggagtggtggagagctgtgagcaggtgaacacagattctgaaacagctgtggtgaatgtgacctacagcagcaaggaccaggcccggcaggccctggacaagctgaatggcttccagctggagaacttcaccctgaaggtggcctacatcccagatgagatggccgcccagcagaaccccctgcagcagccccggggcagaagaggcctgggccagaggggcagcagccggcagggcagccctggctctgtgtccaagcagaagccctgtgacctgcccctgcggctgctggtgcccacccagtttgtgggcgccatcatcggcaaggagggcgccaccatccggaacatcaccaagcagacccagagcaagattgatgtgcacaggaaagaaaatgctggagctgctgagaagagcatcaccatcctgagcaccccagagggcaccagcgctgcctgcaagagcatcctggagatcatgcacaaggaggcccaggacatcaagttcacagaggagatccccctgaagatcctggcccacaacaactttgtgggccgcctcatcggcaaggagggcaggaacctgaagaagattgagcaggacacagacaccaagatcaccatcagccccctgcaggagctgaccctgtacaaccctgagaggaccatcaccgtgaagggaaatgtggagacctgtgccaaggccgaggaggagatcatgaagaagatccgggagagctatgaaaatgacatcgcctccatgaacctgcaggcccacctgatccctggcctgaacctgaatgccctgggcctcttcccccccaccagcggcatgcccccacccaccagcggccccccatctgccatgaccccaccctacccccagtttgagcagagcgagacagaaacagtgcacctgttcatcccagccctgtctgtgggcgccatcatcggcaagcagggccagcacatcaagcagctgagcagatttgctggggccagcatcaagatcgccccagctgaggccccagatgccaaggtgaggatggtgatcatcactggacctcctgaggcccagttcaaggcccagggccgcatctacggcaagatcaaggaggagaactttgtgagccccaaggaggaggtgaagctggaggcccacatccgggtgcccagctttgctgctggccgggtgattggaaaaggaggcaagacagtgaatgagctgcagaacctgagcagcgctgaggtggtggtgccccgggaccagaccccagatgaaaatgaccaggtggtggtgaagatcaccggccacttctacgcctgccaggtggcccagaggaagatccaggagatcctgacccaggtgaagcagcaccagcagcagaaggccctgcagagcggccccccccagagcaggaggaagtag

SEQ ID NO: 156116 - DNA, 7476 bp, Artificial Sequence
  Description of Artificial Sequence: Synthetic coding sequence
atgggcgctgctgctggccgcagcccccacctgggccctgccccagcccggcggccccagaggagcctgctgctgctgcagctgctgctgctggtggccgcccctggcagcacccaggcccaggccgcccccttccctgagctgtgcagctacacctgggaggccgtggacaccaagaacaacgtgctgtacaagatcaacatctgtggctctgtggacatcgtgcagtgtggccccagcagcgctgtgtgcatgcatgacctgaagaccaggacctaccacagcgtgggggacagcgtgctgcggagcgccaccaggagcctgctggagttcaacaccaccgtgtcctgtgaccagcagggcaccaaccaccgggtgcagagcagcatcgccttcctgtgtgggaagaccctgggcaccccagagtttgtgacagccacagaatgtgtgcactactttgagtggaggaccacagctgcctgcaagaaggacatcttcaaggccaacaaggaggtgccctgctacgtgtttgatgaggagctgaggaagcatgacctgaaccccctcatcaagctgagcggggcctacctggtggatgacagcgaccctgacaccagcctcttcatcaacgtgtgccgggacatcgacaccctgcgggaccccggcagccagctgcgggcctgccccccaggcacagctgcctgcctggtgcggggccaccaggcctttgatgtgggccagcccagagatggcctgaagctggtgaggaaggaccggctggtgctgtcctatgtgcgggaggaggccggcaagctggacttctgtgatggccacagccctgctgtgaccatcacctttgtgtgccccagcgagcggcgggagggcaccatccccaagctgacagccaagagcaactgccgctatgaaattgagtggatcacagaatatgcctgccaccgggactacctggagagcaagacctgcagcctgtctggagagcagcaggatgtgtccattgacctgacccccctggcccagagcggcggcagcagctacatcagtgatggcaaggagtacctgttctacctgaatgtgtgtggggagacagagatccagttctgcaacaagaagcaggccgctgtgtgccaggtgaagaagagtgacaccagccaggtgaaggctgctggccgctaccacaaccagaccctgcgctacagtgatggagacctgaccctcatctactttggaggagatgaatgtagcagcggcttccagaggatgtctgtcatcaactttgagtgcaacaagacagctggaaatgatggcaagggcacccctgtgttcaccggggaggtggactgcacctacttcttcacctgggacacagaatatgcctgtgtgaaggagaaggaggacctgctgtgtggggccacagatggcaagaagagatatgacctgagcgccctggtgagacatgctgagcctgagcagaactgggaggccgtggatggcagccagacagaaacagagaagaagcacttcttcatcaacatctgccaccgggtgctgcaggagggcaaggcccggggctgcccagaagatgctgctgtgtgtgctgtggacaagaatggcagcaagaacctgggcaagttcatcagcagccccatgaaggagaagggcaacatccagctgagctacagtgatggagatgactgtggccacggcaagaagatcaagaccaacatcaccctggtgtgcaagccaggggacctggagagcgcccctgtgctgcggaccagcggggagggcggctgcttctatgaatttgagtggcacacagctgctgcctgtgtgctgagcaagacagaaggagagaactgcaccgtgtttgacagccaggccggcttctcctttgacctgagccccctgaccaagaagaatggagcctacaaggtggagaccaagaagtatgacttctacatcaacgtgtgtggccctgtgtctgtgagcccctgccagcctgacagcggggcctgccaggtggccaagagtgatgagaagacctggaacctgggcctgagcaatgccaagctgagctactatgatggcatgatccagctgaactacagaggaggcaccccctacaacaatgaaagacacaccccccgggccaccctcatcaccttcctgtgtgacagagatgctggggtgggcttccctgagtaccaggaggaggacaacagcacctacaacttccgctggtacaccagctatgcctgcccagaggagcccctggagtgtgtggtgacagaccccagcaccctggagcagtatgacctgagcagcctggccaagtctgagggcggcctgggcggcaactggtacgccatggacaacagcggggagcacgtgacctggaggaagtactacatcaacgtgtgccggcccctgaaccctgtgcccggctgcaacagatatgccagcgcctgccagatgaagtatgagaaggaccagggcagcttcacagaggtggtgtccatcagcaacctgggcatggccaagacaggccctgtggtggaggacagcggcagcctgctgctggagtatgtgaatggaagtgcctgcaccaccagtgatggccggcagaccacctacaccacccgcatccacctggtgtgcagccggggccgcctgaacagccaccccatcttcagcctgaactgggagtgtgtggtgtccttcctgtggaacacagaggccgcctgccccatccagaccaccacagacacagaccaggcctgcagcatccgggaccccaacagcggctttgtgttcaacctgaaccccctgaacagcagccagggctacaacgtgtctggaattggcaagatcttcatgttcaacgtgtgtggcaccatgcctgtgtgtggcaccatcctgggcaagccagccagcggctgtgaggccgagacccagacagaggagctgaagaactggaagccagcccggcctgtgggcatcgagaagagcctgcagctgagcacagagggcttcatcaccctgacctacaagggccccctgagcgccaagggcacagcagatgccttcatcgtgcgctttgtgtgcaatgatgatgtgtacagcggccccctgaagttcctgcaccaggacatcgacagcggccagggcatccggaacacctactttgaatttgaaacagccctggcctgtgtgcccagccctgtggactgccaggtgacagacctggccggaaatgaatatgacctgaccggcctgagcacagtgaggaagccctggacagctgtggacacctctgtggatggcaggaagaggaccttctacctgtctgtgtgcaaccccctgccctacatccctggctgccagggcagcgctgtgggcagctgcctggtgtctgagggcaacagctggaacctgggcgtggtgcagatgagcccccaggccgccgccaacggcagcctgagcatcatgtatgtgaatggagacaagtgtggcaaccagcgcttcagcacccgcatcacctttgaatgtgcccagatcagcggcagccctgccttccagctgcaggacggctgtgaatatgtgttcatctggaggacagtggaggcctgccctgtggtgcgggtggagggggacaactgtgaggtgaaggaccccaggcatggcaacctgtatgacctgaagcccctgggcctgaatgacaccatcgtgtctgctggggagtacacctactacttccgggtgtgtgggaagctgagcagtgatgtgtgccccaccagtgacaagagcaaggtggtgagcagctgccaggagaagcgggagccccagggcttccacaaggtggccggcctgctgacccagaagctgacctatgaaaatggcctgctgaagatgaacttcaccggcggggacacctgccacaaggtgtaccagaggagcacagccatcttcttctactgtgaccggggcacccagaggcctgtgttcctgaaggagaccagtgactgcagctacctgtttgagtggaggacccagtatgcctgccccccatttgacctgacagagtgcagcttcaaggatggagctggcaacagctttgacctgagcagcctgagccgctacagcgacaactgggaggccatcactggaactggagaccctgagcactacctgatcaacgtgtgcaagagcctggccccccaggccggcacagagccctgccccccagaggccgccgcctgcctgctgggcggcagcaagcctgtgaacctgggccgggtgagagatggcccccagtggagagatggcatcatcgtgctgaagtatgtggatggagacctgtgcccagatggcatcaggaagaagagcaccaccatccgcttcacctgcagcgagagccaggtgaacagccggcccatgttcatctctgctgtggaggactgtgagtacacctttgcctggcccacagccacagcctgccccatgaagagcaatgaacatgatgactgccaggtgaccaaccccagcacaggccacctgtttgacctgagcagcctgagcggccgggccggcttcaccgctgcctacagcgagaagggcctggtgtacatgagcatctgtggagaaaatgaaaactgccccccaggagtgggcgcctgcttcggccagacccgcatctctgtgggcaaggccaacaagaggctgcgctacgtggaccaggtgctgcagctggtgtacaaggatggcagcccctgccccagcaagagcggcctgagctacaagagcgtcatcagctttgtgtgcaggcctgaggcccggcccaccaaccggcccatgctgatcagcctggacaagcagacctgcaccctcttcttctcctggcacacccccctggcctgtgagcaggccacagaatgttctgtgagaaatggcagcagcatcgtggacctgagccccctcatccacaggactggaggctatgaggcctatgatgaaagtgaagatgatgccagtgacaccaacccagacttctacatcaacatctgccagcccctgaaccccatgcacggcgtgccctgcccagctggagctgctgtgtgcaaggtgcccattgatggcccccccatcgacatcggccgggtggccggcccccccatcctgaaccccatcgccaatgagatctacctgaactttgagagcagcaccccctgcctggccgacaagcacttcaactacaccagcctcatcgccttccactgcaagaggggcgtgtccatgggcacccccaagctgctgcggaccagtgaatgtgactttgtgtttgagtgggagacccctgtggtgtgcccagatgaggtgaggatggatggctgcaccctgacagatgagcagctgctgtacagcttcaacctgagcagcctgagcaccagcaccttcaaggtgacccgggacagcaggacctacagcgtgggcgtgtgcacctttgctgtgggccctgagcagggcggctgcaaggatggcggcgtgtgcctgctgagcggcaccaagggggccagctttggccgcctgcagagcatgaagctggactaccgccaccaggatgaggccgtggtgctgtcctatgtgaatggagaccgctgccccccagagacagatgatggagtgccctgtgtgttccccttcatcttcaacgggaagagctatgaggagtgcatcatcgagagccgggccaagctgtggtgcagcaccacagctgactatgaccgggaccacgagtggggcttctgccgccacagcaacagctaccgcaccagcagcatcatcttcaagtgtgatgaagatgaagatattggccggccccaggtgttcagcgaggtgcggggctgtgatgtgacctttgagtggaagaccaaggtggtgtgcccccccaagaagctggagtgcaagtttgtgcagaagcacaagacctatgacctgcggctgctgagcagcctgaccggctcctggagcctggtgcacaacggggtgtcctactacatcaacctgtgccagaagatctacaagggccccctgggctgcagcgagcgggccagcatctgcaggaggaccaccactggagatgtgcaggtgctgggcctggtgcacacccagaagctgggcgtcatcggggacaaggtggtggtgacctacagcaagggctacccctgtggcggcaacaagacagccagcagcgtcatcgagctgacctgcaccaagacagtgggccgcccagccttcaagagatttgacatcgacagctgcacctactacttctcctgggacagcagagctgcctgtgctgtgaagccccaggaggtgcagatggtgaatggcaccatcaccaaccccatcaacgggaagagcttcagcctgggggacatctacttcaagctgttccgggccagcggggacatgaggaccaatggagacaactacctgtatgagatccagctgagcagcatcaccagcagcaggaacccagcctgcagcggggccaacatctgccaggtgaagcccaatgaccagcacttcagcaggaaggtgggcaccagtgacaagaccaagtactacctgcaggatggagacctggatgtggtgtttgccagcagcagcaaatgtgggaaggacaagaccaagtctgtgagcagcaccatcttcttccactgtgaccccctggtggaggatggcatccctgagttcagccatgaaacagctgactgccagtacctgttctcctggtacaccagcgctgtgtgccccctgggcgtgggctttgacagtgaaaatcctggagatgatggccagatgcacaagggcctgtctgagaggagccaggccgtgggcgctgtgctgagcctgctgctggtggccctgacctgctgcctgctggccctgctgctgtacaagaaggagcggcgggagaccgtcatcagcaagctgaccacctgctgccgccgcagcagcaatgtgtcctacaagtacagcaaggtgaacaaggaggaggagacagatgaaaatgaaacagagtggctgatggaggagatccagctgcccccaccccggcagggcaaggagggccaggagaatggccacatcaccaccaagtctgtgaaggccctgagcagcctgcatggagatgaccaggacagtgaagatgaggtgctgaccatccctgaggtgaaggtgcacagcggcagaggagctggagctgagagcagccaccctgtgagaaatgcccagagcaatgccctgcaggagagagaagatgacagagtgggcctggtgcggggggagaaggccaggaagggcaagagcagcagcgcccagcagaagacagtgagcagcaccaagctggtgtccttccatgatgacagtgatgaggacctgctgcacatctag

SEQ ID NO: 156117 - DNA, 780 bp, Artificial Sequence
  Description of Artificial Sequence: Synthetic coding sequence
atgtctgaggtgcctgtggcccgggtgtggctggtgctgctgctgctgactgtgcaggtgggcgtgacagctggggccccctggcagtgtgccccctgcagcgctgagaagctggccctgtgcccccctgtgtctgccagctgcagcgaggtgaccaggtctgctggctgcggctgctgccccatgtgtgccctgcccctgggcgccgcctgtggggtggccacagcccgctgtgcccggggcctgagctgccgggccctgcccggggagcagcagcccctgcacgccctgacccggggccagggcgcctgtgtgcaggagagtgatgccagcgcccctcatgctgctgaggccggcagccctgagagccctgagagcacagagatcacagaggaggagctgctggacaacttccacctgatggcccccagcgaggaggaccacagcatcctgtgggatgccatcagcacctatgatggcagcaaggccctgcacgtgaccaacatcaagaagtggaaggagccctgccgcatcgagctgtacagagtggtggagagcctggccaaggcccaggagaccagcggggaggagatcagcaagttctacctgcccaactgcaacaagaatggcttctaccacagccggcagtgtgagacctccatggatggagaggccggcctgtgctggtgtgtgtacccctggaatggcaagagaattcctggcagccctgagatccggggggaccccaactgccagatctacttcaacgtgcagaactag

SEQ ID NO: 156118 - DNA, 777 bp, Artificial Sequence
  Description of Artificial Sequence: Synthetic coding sequence
atgctgcccctgtgcctggtggccgccctgctgctggccgccggccctggccccagcctgggagatgaggccatccactgccccccctgcagcgaggagaagctggcccgctgccggccccctgtgggctgtgaggagctggtgcgggagcccggctgcggctgctgtgccacctgtgccctgggcctgggcatgccctgtggggtgtacaccccccgctgtggcagcggcctgcgctgctacccaccccggggcgtggagaagcccctgcacaccctgatgcacggccagggcgtgtgcatggagctggccgagattgaggccatccaggagagcctgcagcccagcgacaaggatgaaggagaccaccccaacaacagcttcagcccctgcagcgcccatgaccggcgctgcctgcagaagcactttgccaagatccgggacaggagcaccagcggcggcaagatgaaggtgaatggagccccccgggaggatgcccggcctgtgccccagggcagctgccagagcgagctgcaccgggccctggagcggctggccgccagccagagcaggacccatgaggacctgtacatcatccccatccccaactgtgacagaaatggaaacttccaccccaagcagtgccacccagccctggatggccagaggggcaagtgctggtgtgtggacaggaagacaggagtgaagctgcccggcggcctggagcccaagggggagctggactgccaccagctggccgacagcttccgggagtag

SEQ ID NO: 156119 - DNA, 477 bp, Artificial Sequence
  Description of Artificial Sequence: Synthetic coding sequence
atggagctggccgagattgaggccatccaggagagcctgcagcccagcgacaaggatgaaggagaccaccccaacaacagcttcagcccctgcagcgcccatgaccggcgctgcctgcagaagcactttgccaagatccgggacaggagcaccagcggcggcaagatgaaggtgaatggagccccccgggaggatgcccggcctgtgccccagggcagctgccagagcgagctgcaccgggccctggagcggctggccgccagccagagcaggacccatgaggacctgtacatcatccccatccccaactgtgacagaaatggaaacttccaccccaagcagtgccacccagccctggatggccagaggggcaagtgctggtgtgtggacaggaagacaggagtgaagctgcccggcggcctggagcccaagggggagctggactgccaccagctggccgacagcttccgggagtag

SEQ ID NO: 156120 - DNA, 849 bp, Artificial Sequence
  Description of Artificial Sequence: Synthetic coding sequence
atggagcggcccagcctgcgggccctgctgctgggcgccgccggcctgctgctgctgctgctgcccctgagcagcagcagcagcagtgacacctgtggcccctgtgagcccgccagctgcccccccctgccccccctgggctgcctgctgggggagaccagagatgcctgtggctgctgccccatgtgtgcccggggggagggggagccctgtggcggcggcggggccggccggggctactgtgcccctggcatggagtgtgtgaagagcaggaagaggaggaagggcaaggccggggctgctgctgggggccctggggtgtctggagtgtgtgtgtgcaagagccgctaccctgtgtgtggcagtgatggcaccacctaccccagcggctgccagctgcgggccgccagccagagagctgagagcagaggagagaaggccatcacccaggtgtccaagggcacctgtgagcagggccccagcatcgtgaccccacccaaggacatctggaatgtgactggagcccaggtgtacctgagctgtgaggtgattggcatccccacccctgtgctgatctggaacaaggtgaagaggggccactatggagtgcagaggacagagctgctgcccggggaccgggacaacctggccatccagacccggggcggccctgagaagcatgaggtgacaggctgggtgctggtgagccccctgagcaaagaagatgctggggagtatgaatgtcatgccagcaacagccagggccaggccagcgccagcgccaagatcaccgtggtggatgccctgcacgagatccctgtgaagaagggggagggcgctgagctgtag

SEQ ID NO: 156121 - DNA, 840 bp, Artificial Sequence
  Description of Artificial Sequence: Synthetic coding sequence
atggagcggcccagcctgcgggccctgctgctgggcgccgccggcctgctgctgctgctgctgcccctgagcagcagcagcagcagtgacacctgtggcccctgtgagcccgccagctgcccccccctgccccccctgggctgcctgctgggggagaccagagatgcctgtggctgctgccccatgtgtgcccggggggagggggagccctgtggcggcggcggggccggccggggctactgtgcccctggcatggagtgtgtgaagagcaggaagaggaggaagggcaaggccggggctgctgctgggggccctggggtgtctggagtgtgtgtgtgcaagagccgctaccctgtgtgtggcagtgatggcaccacctaccccagcggctgccagctgcgggccgccagccagagagctgagagcagaggagagaaggccatcacccaggtgtccaagggcacctgtgagcagggccccagcatcgtgaccccacccaaggacatctggaatgtgactggagcccaggtgtacctgagctgtgaggtgattggcatccccacccctgtgctgatctggaacaaggtgaagaggggccactatggagtgcagaggacagagctgctgcccggggaccgggacaacctggccatccagacccggggcggccctgagaagcatgaggtgacaggctgggtgctggtgagccccctgagcaaagaagatgctggggagtatgaatgtcatgccagcaacagccagggccaggccagcgccagcgccaagatcaccgtggtggatgccctgcacgagatccctgtgaagaagggcacccagtag

SEQ ID NO: 156122 - DNA, 393 bp, Artificial Sequence
  Description of Artificial Sequence: Synthetic coding sequence
atggagaccctgggcgccctgctggtgctggagttcctgctgctgagccctgtggaggcccagcaggccacagagcaccggctgaagccctggctggtgggcctggccgctgtggtgggcttcctgttcatcgtgtacctggtgctgctggccaaccggctgtggtgcagcaaggcccgggcagaagatgaggaggagaccaccttcaggatggagagcaacctgtaccaggaccagagcgaggacaagcgggagaagaaggaggccaaggagaaggaggagaagaggaagaaggagaagaagacagccaaggagggggagagcaacctgggcctggacctggaggagaaggagcccggggaccacgagcgggccaagagcacagtgatgtag

SEQ ID NO: 156123 - DNA, 1932 bp, Artificial Sequence
  Description of Artificial Sequence: Synthetic coding sequence
atggccctgaggaaggccggggacctggagccccagttcaccccagagcggcgcttccggctgtgctggtaccaggcccacagcggccgggccctgctgggccccccaccccaggccagccccccagctgggggcctggccctggccctgctgctgctgtcctgggtggccctgggccccaggagcctggagggcgctgaccccggcaccccaggagaggccgagggccctgcctgcccagctgcctgtgtgtgcagctatgatgatgatgctgatgagctgtctgtgttctgcagcagcaggaacctgacccggctgcctgatggagtgcctgggggcacccaggccctgtggctggatggcaacaacctgagctctgtgcccccagctgccttccagaacctgagcagcctgggcttcctgaacctgcagggcggccagctgggcagcctggagccccaggccctgctgggcctggagaacctgtgccacctgcacctggagaggaaccagctgcggagcctggccctgggcacctttgcccacaccccagccctggccagcctgggcctgagcaacaaccggctgagccggctggaggatggcctgtttgagggcctgggcagcctgtgggacctgaacctgggctggaacagcctggccgtgctgcctgatgctgccttccggggcctgggcagcctgcgggagctggtgctggccggcaaccggctggcctacctgcagcctgccctcttcagcggcctggccgagctgcgggagctggacctgagcagaaatgccctgcgggccatcaaggccaacgtgtttgtgcagctgccccggctgcagaagctgtacctggacaggaacctgattgctgctgtggcccctggggccttcctgggcctgaaggccctgcgctggctggacctgagccacaacagagtggccggcctgctggaggacaccttccctggcctgctgggcctgcgggtgctgcggctgagccacaatgccatcgccagcctgcggcccaggaccttcaaggacctgcacttcctggaggagctgcagctgggccacaaccgcatccggcagctggccgagaggagctttgagggcctgggccagctggaggtgctgaccctggaccacaaccagctgcaggaggtgaaggccggggccttcctgggcctgaccaacgtggccgtgatgaacctgagcggcaactgcctgaggaacctgcctgagcaggtgttccggggcctgggcaagctgcacagcctgcacctggagggcagctgcctgggccgcatccggccccacaccttcaccggcctgagcggcctgcggcggctcttcctgaaggacaatggcctggtgggcatcgaggagcagagcctgtggggcctggccgagctgctggagctggacctgaccagcaaccagctgacccacctgccccacaggctcttccagggcctgggcaagctggagtacctgctgctgagcaggaaccggctggccgagctgcctgcagatgccctgggccccctgcagagggccttctggctggatgtgagccacaaccggctggaggccctgcccaacagcctgctggcccccctgggccgcctgcgctacctgagcctgaggaacaacagcctgcggaccttcaccccccagcccccaggcctggagcggctgtggctggagggcaacccctgggactgtggctgccccctgaaggccctgcgggactttgccctgcagaaccccagcgctgtgcccaggtttgtgcaggccatctgtgaaggagatgactgccagcccccagcctacacctacaacaacatcacctgtgccagccccccagaggtggtgggcctggacctgcgggacctgtctgaggcccactttgccccctgctag

SEQ ID NO: 156124 - DNA, 1533 bp, Artificial Sequence
  Description of Artificial Sequence: Synthetic coding sequence
atgccccggggcttcctggtgaagaggagcaagaagagcacccctgtgtcctacagagtgcggggcggggaggatggagaccgggccctgctgctgagccccagctgtggcggggcccgggcagagcccccagcccccagccctgtgcccggccccctgcccccacctcctcctgctgagcgggcccacgccgccctggccgccgccctggcctgtgcccctggcccccagcccccaccccagggccccagggctgcccacttcggcaaccctgaggccgcccacccagcccccctgtacagccccaccaggcctgtgtcccgggagcacgagaagcacaagtactttgagaggagcttcaacctgggcagccctgtgtctgctgagagcttccccaccccagctgccctgctgggcggcggcggcggcggcggggccagcggggccggcggcggcggcacctgtggcggggaccccctgctgtttgccccagctgagctgaagatgggcacagccttctctgctggagctgaggccgcccggggccctggccctggcccccccctgcccccagctgctgccctgcggcccccaggcaagaggcctcctccacccacagctgctgagcccccagccaaggctgtgaaggcccctggggccaagaagcccaaggccatcaggaagctgcactttgaagatgaggtgaccaccagccctgtgctgggcctgaagatcaaggagggccctgtggaggccccccggggccgggccggcggggccgcccggcccctgggggagttcatctgccagctgtgcaaggaggagtatgctgacccctttgccctggcccagcacaagtgcagccgcatcgtgcgggtggagtaccgctgcccagaatgtgccaaggtgttcagctgcccagccaacctggccagccaccggcgctggcacaagcccaggcctgccccagctgctgcccgggcccctgagcctgaggccgccgcccgggcagaggcccgggaggcccctgggggcggcagtgaccgggacacccccagccctgggggcgtgtctgagagcggctctgaagatggcctgtatgagtgccaccactgtgccaagaagttccggcggcaggcctacctgaggaagcacctgctggcccaccaccaggccctgcaggccaagggggcccccctggcccccccagctgaggacctgctggccctgtacccaggcccagatgagaaggccccccaggaggccgctggagatggagagggcgccggcgtgctgggcctgagcgccagcgctgagtgccacctgtgccctgtgtgtggggagagctttgccagcaaaggagcccaggagcggcacctgcggctgctgcatgctgcccaggtgttcccctgcaagtactgcccagccaccttctacagcagccctggcctgaccaggcacatcaacaagtgccaccccagtgaaaatcggcaggtgatcctgctgcaggtgcctgtgcggcctgcctgctag

SEQ ID NO: 156125 - DNA, 1701 bp, Artificial Sequence
  Description of Artificial Sequence: Synthetic coding sequence
atgccccggggcttcctggtgaagaggaccaagaggactggaggcctgtacagagtgcggctggccgagagggtcttccccctgctgggcccccagggcgccccacccttcctggaggaggcccccagcgccagcctgcctggagctgagcgggccaccccacccacccgggaggagcccgggaagggcctgacagctgaggccgcccgggagcagagcggcagcccctgcagagctgctggggtgtccccaggcaccggcggccgggagggcgctgagtggagggctgggggccgggagggccctggccccagccccagccccagccccagccctgccaagccagctggagctgagctgcggcgggccttcctggagcgctgcctgagcagccctgtgtctgctgagagcttccctggaggagctgctgctgtggccgccttcagctgcagcgtggccccagctgctgcccccaccccaggagagcagttcctgctgcccctgcgggcccccttccctgagcccgccctgcagcctgaccctgcccccctgtctgctgccctgcagagcctgaagagagctgctggaggagagcggcggggcaaggcccccacagactgtgccagcggccctgctgctgctggcatcaagaagcccaaggccatgaggaagctgagctttgctgatgaggtgaccaccagccctgtgctgggcctgaagatcaaggaggaggagcccggggcccccagccggggcctgggcggcagcaggacccccctgggggagttcatctgccagctgtgcaaggagcagtatgctgacccctttgccctggcccagcaccgctgcagccgcatcgtgcgggtggagtaccgctgcccagaatgtgacaaggtgttcagctgcccagccaacctggccagccaccggcgctggcacaagcccaggcctgctgctgccaatgctgccaccgtgtcctctgcagatggcaagccacccagcagcagcagcagcagcagccgggacagcggggccatcgccagcttcctggccgagggcaaggagaacagcagaattgaaagaacagctgaccagcacccccaggcccgggacagcagtggagctgaccagcacccagattctgccccccggcagggcctgcaggtgctgacccaccctgagccccccctgccccagggcccctacacagaaggagtgctgggcagaagagtgcctgtgcccggcagcaccagcggcggccggggcagcgagatctttgtgtgcccctactgccacaagaagttccggcggcaggcctacctgaggaagcacctgagcacccatgaggccggcagcgcccgggccctggcccctggcttcggcagcgagcggggggcccccctggcctttgcctgccccctgtgtggggcccacttccccacagctgacatccgggagaagcaccggctgtggcatgctgtgcgggaggagctgctgctgcctgccctggccggggcccctcctgagaccagcggccccagcggccccagtgatggcagcgcccagcagatcttcagctgcaagcactgccccagcaccttcttcagcagccctggcctgaccaggcacatcaacaagtgccaccccagcgagagccggcaggtgctgctgctgcagatgcccctgcggcccggctgctag

SEQ ID NO: 156126 - DNA, 792 bp, Artificial Sequence
  Description of Artificial Sequence: Synthetic coding sequence
atggtgaagatcgccttcaacacccccacagctgtgcagaaggaggaggcccggcaggatgtggaggccctgctgagcaggacagtgaggacccagatcctgaccgggaaggagctgcgggtggccacccaggagaaggagggcagcagcggccgctgcatgctgaccctgctgggcctgtccttcatcctggccggcctcatcgtgggcggggcctgcatctacaagtacttcatgcccaagagcaccatctacagaggagagatgtgcttctttgacagtgaagatcctgccaacagcctgcggggcggggagcccaacttcctgcctgtgacagaggaggccgacatcagagaagatgacaacatcgccatcattgatgtgcctgtgcccagcttcagtgacagcgaccctgctgccatcatccatgactttgagaagggcatgacagcctacctggacctgctgctgggcaactgctacctgatgcccctgaacaccagcatcgtgatgccacccaagaacctggtggagctgtttgggaagctggccagcggccgctacctgccccagacctacgtggtgcgggaggacctggtggccgtggaggagatcagagatgtgagcaacctgggcatcttcatctaccagctgtgcaacaacaggaagagcttccggctgcggcggcgggacctgctgctgggcttcaacaagagggccatcgacaagtgctggaagatccgccacttccccaatgagttcatcgtggagaccaagatctgccaggagtag

SEQ ID NO: 156127 - DNA, 660 bp, Artificial Sequence
  Description of Artificial Sequence: Synthetic coding sequence
atggtgaagatcgccttcaacacccccacagctgtgcagaaggaggaggcccggcaggatgtggaggccctgctgagcaggacagtgaggacccagatcctgaccgggaagagcaccatctacagaggagagatgtgcttctttgacagtgaagatcctgccaacagcctgcggggcggggagcccaacttcctgcctgtgacagaggaggccgacatcagagaagatgacaacatcgccatcattgatgtgcctgtgcccagcttcagtgacagcgaccctgctgccatcatccatgactttgagaagggcatgacagcctacctggacctgctgctgggcaactgctacctgatgcccctgaacaccagcatcgtgatgccacccaagaacctggtggagctgtttgggaagctggccagcggccgctacctgccccagacctacgtggtgcgggaggacctggtggccgtggaggagatcagagatgtgagcaacctgggcatcttcatctaccagctgtgcaacaacaggaagagcttccggctgcggcggcgggacctgctgctgggcttcaacaagagggccatcgacaagtgctggaagatccgccacttccccaatgagttcatcgtggagaccaagatctgccaggagtag

SEQ ID NO: 156128 - DNA, 801 bp, Artificial Sequence
  Description of Artificial Sequence: Synthetic coding sequence
atggtgaaggtgaccttcaacagcgccctggcccagaaggaggccaagaaggatgagcccaagagcggggaggaggccctgatcatccccccagatgctgtggccgtggactgcaaggaccctgatgatgtggtgcctgtgggccagaggcgggcctggtgctggtgcatgtgcttcggcctggccttcatgctggccggggtcatcctgggcggggcctacctgtacaagtactttgccctgcagccagatgatgtgtactactgcggcatcaagtacatcaaggatgatgtgatcctgaatgagcccagcgcagatgccccagctgccctgtaccagaccatcgaggagaacatcaagatctttgaggaggaggaggtggagttcatctctgtgcctgtgcctgagtttgctgacagcgaccctgccaacatcgtgcatgacttcaacaagaagctgacagcctacctggacctgaacctggacaagtgctacgtgatccccctgaacaccagcatcgtgatgccacccaggaacctgctggagctgctgatcaacatcaaggccggcacctacctgccccagagctacctgatccacgagcacatggtgatcacagacagaattgagaacatcgaccacctgggcttcttcatctaccgcctgtgccacgacaaggagacctacaagctgcagaggcgggagaccatcaagggcatccagaagcgggaggccagcaactgctttgccatccgccactttgagaacaagtttgctgtggagaccctcatctgcagctag

SEQ ID NO: 156129 - DNA, 693 bp, Artificial Sequence
  Description of Artificial Sequence: Synthetic coding sequence
atggtgaagatctccttccagcctgctgtggccggcatcaagggggacaaggctgacaaggccagcgccagcgccccagccccagccagcgccacagagatcctgctgaccccagcccgggaggagcagcccccccagcacaggagcaagaggggcggctctgtgggcggcgtgtgctacctgtccatgggcatggtggtgctgctgatgggcctggtgtttgcctctgtgtacatctaccgctacttcttcctggcccagctggcccgggacaacttcttccgctgtggggtgctgtatgaggacagcctgagcagccaggtgaggacccagatggagctggaggaggatgtgaagatctacctggatgagaactatgaaagaatcaacgtgcctgtgccccagtttggaggaggagaccctgctgacatcatccatgacttccagaggcggggcacctacctgccccagacctacatcatccaggaggagatggtggtgacagagcacgtgtctgacaaggaggccctgggcagcttcatctaccacctgtgcaatggcaaggacacctaccgcctgcggcggcgggccacccggcggcgcatcaacaagagaggagccaagaactgcaatgccatccgccactttgagaacacctttgtggtggagaccctcatctgtggggtggtgtag

SEQ ID NO: 156130 - DNA, 804 bp, Artificial Sequence
  Description of Artificial Sequence: Synthetic coding sequence
atggtgaagatctccttccagcctgctgtggccggcatcaagggggacaaggctgacaaggccagcgccagcgccccagccccagccagcgccacagagatcctgctgaccccagcccgggaggagcagcccccccagcacaggagcaagaggggcggctctgtgggcggcgtgtgctacctgtccatgggcatggtggtgctgctgatgggcctggtgtttgcctctgtgtacatctaccgctacttcttcctggcccagctggcccgggacaacttcttccgctgtggggtgctgtatgaggacagcctgagcagccaggtgaggacccagatggagctggaggaggatgtgaagatctacctggatgagaactatgaaagaatcaacgtgcctgtgccccagtttggaggaggagaccctgctgacatcatccatgacttccagaggggcctgacagcctaccatgacatcagcctggacaagtgctacgtgattgagctgaacaccaccatcgtgctgcccccaagaaacttctgggagctgctgatgaatgtgaagaggggcacctacctgccccagacctacatcatccaggaggagatggtggtgacagaacatgtgtctgacaaggaggccctgggcagcttcatctaccacctgtgcaatggcaaggacacctaccgcctgcggcggcgggccacccggcggcgcatcaacaagagaggagccaagaactgcaatgccatccgccactttgagaacacctttgtggtggagaccctcatctgtggggtggtgtag

SEQ ID NO: 156131 - DNA, 663 bp, Artificial Sequence
  Description of Artificial Sequence: Synthetic coding sequence
atggtgaagatctccttccagcctgctgtggccggcatcaagggggacaaggctgacaaggccagcgccagcgccccagccccagccagcgccacagagatcctgctgaccccagcccggctggcccgggacaacttcttccgctgtggggtgctgtatgaggacagcctgagcagccaggtgaggacccagatggagctggaggaggatgtgaagatctacctggatgaaaattatgagcgcatcaacgtgcctgtgccccagtttggaggaggagaccctgctgacatcatccatgacttccagaggggcctgacagcctaccatgacatcagcctggacaagtgctacgtgattgagctgaacaccaccatcgtgctgccccccaggaacttctgggagctgctgatgaatgtgaagaggggcacctacctgccccagacctacatcatccaggaggagatggtggtgacagagcacgtgtctgacaaggaggccctgggcagcttcatctaccacctgtgcaatggcaaggacacctaccgcctgcggcggcgggccacccggcggcgcatcaacaagagaggagccaagaactgcaatgccatccgccactttgagaacacctttgtggtggagaccctcatctgtggggtggtgtag

SEQ ID NO: 156132 - DNA, 543 bp, Artificial Sequence
  Description of Artificial Sequence: Synthetic coding sequence
atggtgaagatctccttccagcctgctgtggccggcatcaagggggacaaggctgacaaggccagcgccagcgccccagccccagccagcgccacagagatcctgctgaccccagcccgggaggagcagcccccccagcacaggagcaagaggggcggctctgtgggcggcgtgtgctacctgtccatgggcatggtggtgctgctgatgggcctggtgtttgcctctgtgtacatctaccgctacttcttcctggcccagctggcccgggacaacttcttccgctgtggggtgctgtatgaggacagcctgagcagccaggtgaggacccagatggagctggaggaggatgtgaagatctacctggatgagaactatgaaagaatcaacgtgcctgtgccccagtttggaggaggagaccctgctgacatcatccatgacttccagaggggcctgacagcctaccatgacatcagcctggacaagtgctacgtgattgagctgaacaccaccatcgtgctgcccccaagaaacttctggtag

SEQ ID NO: 156133 - DNA, 1839 bp, Artificial Sequence
  Description of Artificial Sequence: Synthetic coding sequence
atggctgctgctggccgcctgcccagctcctgggccctcttcagccccctgctggccggcctggccctgctgggcgtgggccctgtgcctgcccgggccctgcacaacgtgacagctgagctgtttggagctgaggcctggggcaccctggccgcctttggagacctgaacagcgacaagcagacagacctgtttgtgctgcgggagagaaatgacctgattgtgttcctggccgaccagaatgccccctacttcaagcccaaggtgaaggtgtccttcaagaaccacagcgccctgatcacctctgtggtgcctggggactatgatggagacagccagatggatgtgctgctgacctacctgcccaagaactatgccaagtctgagctgggcgccgtcatcttctggggccagaaccagaccctggaccccaacaacatgaccatcctgaacagaaccttccaggatgagcccctcatcatggacttcaacggggacctgatcccagacatcttcggcatcaccaatgaaagcaaccagccccagatcctgctgggcggcaacctgtcctggcacccagccctgaccaccaccagcaagatgaggatcccccacagccacgccttcatcgacctgacagaggacttcaccgctgacctcttcctgaccaccctgaatgccaccaccagcaccttccagtttgagatctgggagaacctggatggcaacttctctgtgtccaccatcctggagaagccccagaacatgatggtggtgggccagagcgcctttgctgactttgatggagatggccacatggaccacctgctgcccggctgtgaggacaagaactgccagaagagcaccatctacctggtgcgcagcggcatgaagcagtgggtgcctgtgctgcaggacttcagcaacaagggcaccctgtggggctttgtgccctttgtggatgagcagcagcccacagagatccccatccccatcaccctgcacatcggggactacaacatggatggctacccagatgccctggtgatcctgaagaacaccagcggcagcaaccagcaggccttcctgctggagaatgtgccctgcaacaatgccagctgtgaggaggcccggaggatgttcaaggtgtactgggagctgacagacctgaaccagatcaaggatgccatggtggccaccttctttgacatctatgaagatggcatcctggacatcgtggtgctgagcaagggctacaccaagaatgactttgccatccacaccctgaagaacaactttgaagcagatgcctactttgtgaaggtgattgtgctgagcggcctgtgcagcaatgactgccccaggaagatcacccccttcggcgtgaaccagcccggcccctacatcatgtacaccaccgtggatgccaacggctacctgaagaatggcagcgctggccagctgagccagagcgcccacctggccctgcagctgccctacaacgtgctgggcctgggccgcagcgccaacttcctggaccacctgtatgtgggcatcccccggcccagcggggagaagagcatcaggaagcaggagtggacagccatcatccccaacagccagctgattgtcatcccctacccccacaacgtgcccaggtcctggagcgccaagctgtacctgacccccagcaacatcgtgctgctgacagccatcgccctgattggagtgtgtgtgttcatcctggccatcatcggcatcctgcactggcaggagaagaaggcagatgaccgggagaagaggcaggaggcccaccgcttccactttgatgccatgtag

SEQ ID NO: 156134 - DNA, 819 bp, Artificial Sequence
  Description of Artificial Sequence: Synthetic coding sequence
atggatggctacccagatgccctggtgatcctgaagaacaccagcggcagcaaccagcaggccttcctgctggagaatgtgccctgcaacaatgccagctgtgaggaggcccggaggatgttcaaggtgtactgggagctgacagacctgaaccagatcaaggatgccatggtggccaccttctttgacatctatgaagatggcatcctggacatcgtggtgctgagcaagggctacaccaagaatgactttgccatccacaccctgaagaacaactttgaagcagatgcctactttgtgaaggtgattgtgctgagcggcctgtgcagcaatgactgccccaggaagatcacccccttcggcgtgaaccagcccggcccctacatcatgtacaccaccgtggatgccaacggctacctgaagaatggcagcgctggccagctgagccagagcgcccacctggccctgcagctgccctacaacgtgctgggcctgggccgcagcgccaacttcctggaccacctgtatgtgggcatcccccggcccagcggggagaagagcatcaggaagcaggagtggacagccatcatccccaacagccagctgattgtcatcccctacccccacaacgtgcccaggtcctggagcgccaagctgtacctgacccccagcaacatcgtgctgctgacagccatcgccctgattggagtgtgtgtgttcatcctggccatcatcggcatcctgcactggcaggagaagaaggcagatgaccgggagaagaggcaggaggcccaccgcttccactttgatgccatgtag

SEQ ID NO: 156135 - DNA, 1074 bp, Artificial Sequence
  Description of Artificial Sequence: Synthetic coding sequence
atgatggtggtgggccagagcgcctttgctgactttgatggagatggccacatggaccacctgctgcccggctgtgaggacaagaactgccagaagagcaccatctacctggtgcgcagcggcatgaagcagtgggtgcctgtgctgcaggacttcagcaacaagggcaccctgtggggctttgtgccctttgtggatgagcagcagcccacagagatccccatccccatcaccctgcacatcggggactacaacatggatggctacccagatgccctggtgatcctgaagaacaccagcggcagcaaccagcaggccttcctgctggagaatgtgccctgcaacaatgccagctgtgaggaggcccggaggatgttcaaggtgtactgggagctgacagacctgaaccagatcaaggatgccatggtggccaccttctttgacatctatgaagatggcatcctggacatcgtggtgctgagcaagggctacaccaagaatgactttgccatccacaccctgaagaacaactttgaagcagatgcctactttgtgaaggtgattgtgctgagcggcctgtgcagcaatgactgccccaggaagatcaccccatttggagtgaaccagcccggcccctacatcatgtacaccaccgtggatgccaacggctacctgaagaatggatctgctggccagctgagccagagcgcccacctggccctgcagctgccctacaacgtgctgggcctgggccgcagcgccaacttcctggaccacctgtatgtgggcatcccccggcccagcggggagaagagcatcaggaagcaggagtggacagccatcatccccaacagccagctgattgtcatcccctacccccacaacgtgcccaggtcctggagcgccaagctgtacctgacccccagcaacatcgtgctgctgacagccatcgccctgattggagtgtgtgtgttcatcctggccatcatcggcatcctgcactggcaggagaagaaggcagatgaccgggagaagaggcaggaggcccaccgcttccactttgatgccatgtag

SEQ ID NO: 156136 - DNA, 1395 bp, Artificial Sequence
  Description of Artificial Sequence: Synthetic coding sequence
atggatgtgctgctgacctacctgcccaagaactatgccaagtctgagctgggcgctgtgatcttctggggccagaaccagaccctggaccccaacaacatgaccatcctgaacagaaccttccaggatgagcccctcatcatggacttcaatggagacctgatcccagacatcttcggcatcaccaatgaaagcaaccagccccagatcctgctgggcggcaacctgtcctggcacccagccctgaccaccaccagcaagatgaggatcccccacagccacgccttcatcgacctgacagaggacttcaccgctgacctcttcctgaccaccctgaatgccaccaccagcaccttccagtttgagatctgggagaacctggatggcaacttctctgtgtccaccatcctggagaagccccagaacatgatggtggtgggccagagcgcctttgctgactttgatggagatggccacatggaccacctgctgcccggctgtgaggacaagaactgccagaagagcaccatctacctggtgcgcagcggcatgaagcagtgggtgcctgtgctgcaggacttcagcaacaagggcaccctgtggggctttgtgccctttgtggatgagcagcagcccacagagatccccatccccatcaccctgcacatcggggactacaacatggatggctacccagatgccctggtgatcctgaagaacaccagcggcagcaaccagcaggccttcctgctggagaatgtgccctgcaacaatgccagctgtgaggaggcccggaggatgttcaaggtgtactgggagctgacagacctgaaccagatcaaggatgccatggtggccaccttctttgacatctatgaagatggcatcctggacatcgtggtgctgagcaagggctacaccaagaatgactttgccatccacaccctgaagaacaactttgaagcagatgcctactttgtgaaggtgattgtgctgagcggcctgtgcagcaatgactgccccaggaagatcaccccatttggagtgaaccagcccggcccctacatcatgtacaccaccgtggatgccaacggctacctgaagaatggatctgctggccagctgagccagagcgcccacctggccctgcagctgccctacaacgtgctgggcctgggccgcagcgccaacttcctggaccacctgtatgtgggcatcccccggcccagcggggagaagagcatcaggaagcaggagtggacagccatcatccccaacagccagctgattgtcatcccctacccccacaacgtgcccaggagcagccaccgctgcctgtgcttccacctgggcaacaactggcacttcaccctggccggcaaggagagcaggtag

SEQ ID NO: 156137 - DNA, 1044 bp, Artificial Sequence
  Description of Artificial Sequence: Synthetic coding sequence
atgagcctgctgtgcaggaacaagggctgcggccagcactttgaccccaacaccaacctgcctgacagctgctgccaccaccctggggtgcccatcttccatgatgccctgaagggctggagctgctgcaggaagaggacagtggacttcagcgagttcctgaacatcaagggctgcaccatgggcccccactgtgccgagaagctgcctgaggccccccagcctgagggccctgccaccagcagcagcctgcaggagcagaagcccctgaatgtcatccccaagtctgctgagaccctgcggcgggagcggcccaagtctgagctgcccctgaagctgctgcccctgaacatcagccaggccctggagatggccctggagcagaaggagctggaccaggagcctggagctggcctggacagcctcatcagaacaggcagcagctgccagaaccctggctgtgatgctgtgtaccagggccctgagagtgatgccaccccctgcacctaccaccctggggccccccgcttccacgagggcatgaagtcctggagctgctgcggcatccagaccctggactttggagccttcctggcccagcccggctgccgggtgggcagacatgactggggcaagcagctgcctgccagctgcagacatgactggcaccagacagacagcctggtggtggtgacagtgtatggccagatccccctgcctgccttcaactgggtgaaggccagccagacagagctgcacgtgcacatcgtgtttgatggcaacagagtcttccaggcccagatgaagctgtggggcgtcatcaacgtggagcagagcagcgtcttcctgatgcccagccgggtggagatcagcctggtgaaggctgaccccggctcctgggcccagctggagcacccagatgccctggccaagaaggcccgggccggcgtggtgctggagatggatgaggaggagagtgatgacagtgatgatgacctgtcctggacagaggaggaggaggaggaggaggccatgggagagtag

SEQ ID NO: 156138 - DNA, 990 bp, Artificial Sequence
  Description of Artificial Sequence: Synthetic coding sequence
atgagcacagacagctgctgccaccaccctggggtgcccatcttccatgatgccctgaagggctggagctgctgcaggaagaggacagtggacttcagcgagttcctgaacatcaagggctgcaccatgggcccccactgtgccgagaagctgcctgaggccccccagcctgagggccctgccaccagcagcagcctgcaggagcagaagcccctgaatgtcatccccaagtctgctgagaccctgcggcgggagcggcccaagtctgagctgcccctgaagctgctgcccctgaacatcagccaggccctggagatggccctggagcagaaggagctggaccaggagcctggagctggcctggacagcctcatcagaacaggcagcagctgccagaaccctggctgtgatgctgtgtaccagggccctgagagtgatgccaccccctgcacctaccaccctggggccccccgcttccacgagggcatgaagtcctggagctgctgcggcatccagaccctggactttggagccttcctggcccagcccggctgccgggtgggcagacatgactggggcaagcagctgcctgccagctgcagacatgactggcaccagacagacagcctggtggtggtgacagtgtatggccagatccccctgcctgccttcaactgggtgaaggccagccagacagagctgcacgtgcacatcgtgtttgatggcaacagagtcttccaggcccagatgaagctgtggggcgtcatcaacgtggagcagagcagcgtcttcctgatgcccagccgggtggagatcagcctggtgaaggctgaccccggctcctgggcccagctggagcacccagatgccctggccaagaaggcccgggccggcgtggtgctggagatggatgaggaggagagtgatgacagtgatgatgacctgtcctggacagaggaggaggaggaggaggaggccatgggagagtag

SEQ ID NO: 156139 - DNA, 603 bp, Artificial Sequence
  Description of Artificial Sequence: Synthetic coding sequence
atgttcaggaagggcaagaagaggcacagcagcagcagcagccagagcagcgagatcagcaccaagagcaagtctgtggacagcagcctgggcggcctgagccgcagcagcacagtggccagcctggacacagacagcaccaagagcagcggccagagcaacaacaacagcgacacctgtgccgagttccgcatcaagtatgtgggcgccatcgagaagctgaagctgtctgagggcaagggcctggagggccccctggacctgatcaactacattgatgtggcccagcaggacggcaagctgccctttgtgcccccagaggaggagttcatcatgggcgtgtccaaatatggcatcaaggtgtccaccagtgaccagtatgatgtgctgcacagacatgccctgtacctgatcatccgcatggtgtgctatgatgatggcctgggcgctgggaagagcctgctggccctgaagaccacagatgccagcaatgaggagtacagcctgtgggtgtaccagtgcaacagcctggagcaggcccaggccatctgcaaggtgctgagcacagcctttgattctgtgctgaccagcgagaagccctag

SEQ ID NO: 156140 - DNA, 603 bp, Artificial Sequence; identical to SEQ ID NO: 156139
  Description of Artificial Sequence: Synthetic coding sequence

SEQ ID NO: 156141 - DNA, 255 bp, Artificial Sequence
  Description of Artificial Sequence: Synthetic coding sequence
atgttcaggaagggcaagaagaggcacagcagcagcagcagccagagcagcgagatcagcaccaagagcaagtctgtggacagcagcctgggcggcctgagccgcagcagcacagtggccagcctggacacagacagcaccaagagcagcggccagagcaacaacaacagcgacacctgtgccgagttccgcatcaagtatgtgggcgccatcgagaagctgaagctgtctgagggcaagggcctggagggctag

SEQ ID NO: 156142 - DNA, 291 bp, Artificial Sequence
  Description of Artificial Sequence: Synthetic coding sequence
atgttcaggaagggcaagaagaggcacagcagcagcagcagccagagcagcgagatcagcaccaagagcaagtctgtggacagcagcctgggcggcctgagccgcagcagcacagtggccagcctggacacagacagcaccaagagcagcggccagagcaacaacaacagcgacacctgtgccgagttccgcatcaagtatgtgggcgccatcgagaagctgaagctgtctgagggcaagggcctggagggccccctggacctgatcaactacattgatgtggcccagtag

SEQ ID NO: 156143 - DNA, 261 bp, Artificial Sequence
  Description of Artificial Sequence: Synthetic coding sequence
atgttcaggaagggcaagaagaggcacagcagcagcagcagccagagcagcgagatcagcaccaagagcaagtctgtggacagcagcctgggcggcctgagccgcagcagcacagtggccagcctggacacagacagcaccaagagcagcggccagagcaacaacaacagcgacacctgtgccgagttccgcatcaagtatgtgggcgccatcgagaagctgaagctgtctgagggcaagggcctggagggccccctgtag

SEQ ID NO: 156144 - DNA, 411 bp, Artificial Sequence
  Description of Artificial Sequence: Synthetic coding sequence
atgttcaggaagggcaagaagaggcacagcagcagcagcagccagagcagcgagatcagcaccaagagcaagtctgtggacagcagcctgggcggcctgagccgcagcagcacagtggccagcctggacacagacagcaccaagagcagcggccagagcaacaacaacagcgacacctgtgccgagttccgcatcaagtatgtgggcgccatcgagaagctgaagctgtctgagggcaagggcctggagggccccctggacctgatcaactacattgatgtggcccagcaggacggcaagctgccctttgtgcccccagaggaggagttcatcatgggcgtgtccaaatatggcatcaaggtgtccaccagtgaccagtatgatgtgctgcacagacatgccctgtactag

SEQ ID NO: 156145 - DNA, 345 bp, Artificial Sequence
  Description of Artificial Sequence: Synthetic coding sequence
atgttcaggaagggcaagaagaggcacagcagcagcagcagccagagcagcgagatcagcaccaagagcaagtctgtggacagcagcctgggcggcctgagccgcagcagcacagtggccagcctggacacagacagcaccaagagcagcggccagagcaacaacaacagcgacacctgtgccgagttccgcatcaagtatgtgggcgccatcgagaagctgaagctgtctgagggcaagggcctggagggccccctggacctgatcaactacattgatgtggcccagcaggacggcaagctgccctttgtgcccccagaggaggagttcatcatgggcgtgtag

SEQ ID NO: 156146 - DNA, 198 bp, Artificial Sequence
  Description of Artificial Sequence: Synthetic coding sequence
atgttcaggaagggcaagaagaggcacagcagcagcagcagccagagcagcgagatcagcaccaagagcaagtctgtggacagcagcctgggcggcctgagccgcagcagcacagtggccagcctggacacagacagcaccaagagcagcggccagagcaacaacaacagcgacacctgtgccgagttccgcatctag

SEQ ID NO: 156147 - DNA, 453 bp, Artificial Sequence
  Description of Artificial Sequence: Synthetic coding sequence
atgttcaggaagggcaagaagaggcacagcagcagcagcagccagagcagcgagatcagcaccaagagcaagtctgtggacagcagcctgggcggcctgagccgcagcagcacagtggccagcctggacacagacagcaccaagagcagcggccagagcaacaacaacagcgacacctgtgccgagttccgcatcaagtatgtgggcgccatcgagaagctgaagctgtctgagggcaagggcctggagggccccctggacctgatcaactacattgatgtggcccagcaggacggcaagctgccctttgtgcccccagaggaggagttcatcatgggcgtgtccaaatatggcatcaaggtgtccaccagtgaccagtatgagcaggcccaggccatctgcaaggtgctgagcacagcctttgattctgtgctgaccagcgagaagccctag

SEQ ID NO: 156148 - DNA, 534 bp, Artificial Sequence
  Description of Artificial Sequence: Synthetic coding sequence
atgcctgtgaagaggagcctgaagctggatggcctgctggaggagaacagctttgaccccagcaagatcaccaggaagaagagcgtcatcacctacagccccaccaccggcacctgccagatgagcctgtttgccagccccaccagcagcgaggagcagaagcacagaaatggcctgagcaatgagaagaggaagaagctgaaccaccccagcctgacagagagcaaggagagcaccaccaaggacaatgatgagttcatgatgctgctgagcaaggtggagaagctgtctgaggagatcatggagatcatgcagaacctgagcagcatccaggccctggagggcagccgggagctggagaacctgattggcatcagctgtgccagccacttcctgaagcgggagatgcagaagaccaaggagctgatgaccaaggtgaacaagcagaagctgtttgagaagagcacaggcctgccccacaaggccagccgccacctggacagctatgagttcctgaaggccatcctgaactag

SEQ ID NO: 156149 - DNA, 513 bp, Artificial Sequence
  Description of Artificial Sequence: Synthetic coding sequence
atgcctgtgaagaggagcctgaagctggatggcctgctggaggagaacagctttgaccccagcaagatcaccaggaagaagagcgtcatcacctacagccccaccaccggcacctgccagatgagcctgtttgccagccccaccagcagcgaggagcagaagcacagaaatggcctgagcaatgagaagaggaagaagctgaaccaccccagcctgacagagagcaaggagagcaccaccaaggacaatgatgagttcatgatgctgctgagcaaggtggagaagctgtctgaggagatcatggagatcatgcagaacctgagcagcatccaggccctggagggcagccgggagctggagaacctgattggcatcagctgtgccagccacttcctgaagcgggagatgcagaagaccaaggagctgatgaccaaggtgaacaagcagaagctgtttgagaagagcacaggcctgccccacaagggccagccccagatgagccagcccctgtag

SEQ ID NO: 156150 - DNA, 651 bp, Artificial Sequence
  Description of Artificial Sequence: Synthetic coding sequence
atgccctttgcccctgtggcccaggcccgggtgcagtggcatgacttccgcagcctgcagcacctgctgcctgccttcaagcgcttcagctgcctgagcctgggcagctcctgggactacagcgtgaagaggagcctgaagctggatggcctgctggaggagaacagctttgaccccagcaagatcaccaggaagaagagcgtcatcacctacagccccaccaccggcacctgccagatgagcctgtttgccagccccaccagcagcgaggagcagaagcacagaaatggcctgagcaatgagaagaggaagaagctgaaccaccccagcctgacagagagcaaggagagcaccaccaaggacaatgatgagttcatgatgctgctgagcaaggtggagaagctgtctgaggagatcatggagatcatgcagaacctgagcagcatccaggccctggagggcagccgggagctggagaacctgattggcatcagctgtgccagccacttcctgaagcgggagatgcagaagaccaaggagctgatgaccaaggtgaacaagcagaagctgtttgagaagagcacaggcctgccccacaaggccagccgccacctggacagctatgagttcctgaaggccatcctgaactag

SEQ ID NO: 156151 - DNA, 3540 bp, Artificial Sequence
  Description of Artificial Sequence: Synthetic coding sequence
atggccccccggccccgggcccggcctggggtggccgtggcctgctgctggctgctgactgtggtgctgcgctgctgcgtgtccttcaacgtggatgtgaagaacagcatgaccttcagcggccctgtggaggacatgtttggctacacagtgcagcagtatgaaaatgaggagggcaagtgggtgctgattggcagccccctggtgggccagcccaagaacagaactggagatgtgtacaagtgccctgtgggccgcggggagagcctgccctgtgtgaagctggacctgcctgtgaacaccagcatccccaacgtgacagaggtgaaggagaacatgaccttcggcagcaccctggtgaccaaccccaacggcggcttcctggcctgtggccccctgtatgcctaccgctgtggccacctgcactacaccaccggcatctgcagtgatgtgagccccaccttccaggtggtgaacagcatcgcccctgtgcaggagtgcagcacccagctggacatcgtgattgtgctggatggcagcaacagcatctacccctgggacagcgtgacagccttcctgaatgacctgctggagaggatggacatcggccccaagcagacccaggtgggcatcgtgcagtacggggagaatgtgacccatgagttcaacctgaacaagtacagcagcacagaggaggtgctggtggccgccaagaagatcgtgcagaggggcggccggcagaccatgacagccctgggcatcgacacagccaggaaggaggccttcacagaggcccggggggccaggagaggagtgaagaaggtgatggtgattgtgacagatggagagagccatgacaaccaccggctgaagaaggtgatccaggactgtgaagatgagaacatccagcgcttcagcatcgccatcctgggcagctacaacagaggcaacctgagcacagagaagtttgtggaggagatcaagagcatcgccagcgagcccacagagaagcacttcttcaacgtgtctgatgagctggccctggtgaccatcgtgaagaccctgggggagcgcatctttgccctggaggccacagctgaccagagcgctgccagctttgagatggagatgagccagacaggcttcagcgcccactacagccaggactgggtgatgctgggcgctgtgggcgcctatgactggaatggcaccgtggtgatgcagaaggccagccagatcatcatccccaggaacaccaccttcaacgtggagagcaccaagaagaatgagcccctggccagctacctgggctacacagtgaacagcgccacagccagcagtggagatgtgctgtacatcgccggccagccccgctacaaccacacaggccaggtgatcatctacaggatggaggatggcaacatcaagatcctgcagaccctgagcggggagcagatcggcagctacttcggcagcatcctgaccaccacagacatcgacaaggacagcaacacagacatcctgctggtgggcgcccccatgtacatgggcacagagaaggaggagcagggcaaggtgtatgtgtatgccctgaaccagaccaggtttgagtaccagatgagcctggagcccatcaagcagacctgctgcagcagccggcagcacaacagctgcaccacagagaacaagaatgagccctgtggggccaggtttggaacagccatcgctgctgtgaaggacctgaacctggatggcttcaatgacatcgtgattggagcccccctggaggatgaccatggaggagctgtgtacatctaccacggcagcggcaagaccatcaggaaggagtatgcccagaggatccccagcggaggagatggcaagaccctgaagttcttcggccagagcatccacggggagatggacctgaatggagatggcctgacagatgtgaccatcggcggcctgggcggggccgccctcttctggagcagagatgtggccgtggtgaaggtgaccatgaactttgagcccaacaaggtgaacatccagaagaagaactgccacatggagggcaaggagaccgtgtgcatcaatgccaccgtgtgctttgatgtgaagctgaagagcaaggaggacaccatctatgaggccgacctgcagtacagagtgaccctggacagcctgcggcagatcagccgctccttcttcagcggcacccaggagaggaaggtgcagaggaacatcaccgtgaggaagtcagaatgtaccaagcacagcttctacatgctggacaagcatgacttccaggacagcgtgcgcatcaccctggacttcaacctgacagatcctgaaaatggacctgtgctggatgacagcctgcccaacagcgtgcatgagtacatcccctttgccaaggactgtggcaacaaggagaagtgcatcagtgacctgagcctgcacgtggccaccacagagaaggacctgctgattgtgcgcagccagaatgacaagttcaacgtgtccctgactgtgaagaacaccaaggacagcgcctacaacaccaggaccatcgtgcactacagccccaacctggtgttcagcggcatcgaggccatccagaaggacagctgtgagagcaaccacaacatcacctgcaaggtgggctaccccttcctgcggcggggggagatggtgaccttcaagatcctcttccagttcaacaccagctacctgatggagaatgtgaccatctacctgagcgccaccagtgacagcgaggagcccccagagaccctgagtgacaacgtggtgaacatcagcatccctgtgaagtatgaggtgggcctgcagttctacagcagcgccagcgagtaccacatcagcattgctgccaatgagaccgtgcctgaggtgatcaacagcacagaagatattggaaatgagatcaacatcttctacctgatcaggaagagcggcagcttccccatgcctgagctgaagctgagcatctccttccccaacatgaccagcaatggctaccctgtgctgtaccccaccggcctgagcagcagtgaaaatgccaactgccggccccacatctttgaggaccccttcagcatcaacagcggcaagaagatgaccaccagcacagaccacctgaagaggggcaccatcctggactgcaacacctgcaagtttgccaccatcacctgcaacctgaccagcagtgacatcagccaggtgaatgtgtccctcatcctgtggaagcccaccttcatcaagagctacttcagcagcctgaacctgaccatccggggggagctgcggagtgaaaatgccagcctggtgctgagcagcagcaaccagaagcgggagctggccatccagatcagcaaggatggcctgcccggccgggtgcccctgtgggtgatcctgctgagcgcctttgctggcctgctgctgctgatgctgctgatcctggccctgtggaagattggcttcttcaagaggcccctgaagaagaagatggagaagtag

SEQ ID NO: 156152 - DNA, 3567 bp, Artificial Sequence
  Description of Artificial Sequence: Synthetic coding sequence
atggacctgccccggggcctggtggtggcctgggccctgagcctgtggccaggcttcacagacaccttcaacatggacaccaggaagcccagggtcatccctggcagcaggacagccttcttcggctacacagtgcagcagcacgacatcagcggcaacaagtggctggtggtgggcgcccccctggagaccaacggctaccagaagacaggagatgtgtacaagtgccctgtgatccacggcaactgcaccaagctgaacctgggccgggtgaccctgagcaatgtgtctgagaggaaggacaacatgaggctgggcctgagcctggccaccaaccccaaggacaacagcttcctggcctgcagccccctgtggagccatgaatgtggcagcagctactacaccaccggcatgtgcagccgggtgaacagcaacttccgcttcagcaagacagtggccccagccctgcagcgctgccagacctacatggacatcgtgattgtgctggatggcagcaacagcatctacccctgggtggaggtgcagcacttcctgatcaacatcctgaagaagttctacatcggccctggccagatccaggtgggcgtggtgcagtacggggaggatgtggtgcatgagttccacctgaatgactacagatctgtgaaggatgtggtggaggccgccagccacatcgagcagaggggcggcacagagaccaggacagccttcggcatcgagtttgcccggtctgaggccttccagaagggcggcaggaagggggccaagaaggtgatgatcgtcatcacagatggagagagccatgacagcccagacctggagaaggtgatccagcagagcgagcgggacaacgtgaccaggtatgctgtggccgtgctgggctactacaacagaagaggcatcaaccctgagaccttcctgaatgagatcaagtacatcgccagtgaccctgatgacaagcacttcttcaacgtgacagatgaggccgccctgaaggacatcgtggatgccctgggggaccgcatcttcagcctggagggcaccaacaagaatgagaccagctttggcctggagatgagccagacaggcttcagcagccacgtggtggaggatggagtgctgctgggcgctgtgggcgcctatgactggaatggagctgtgctgaaggagaccagcgctgggaaggtgatccccctgcgggagagctacctgaaggagttccctgaggagctgaagaaccacggggcctacctgggctacacagtgacctctgtggtgagcagccggcagggccgggtgtatgtggccggggccccccgcttcaaccacacaggcaaggtgatcctcttcaccatgcacaacaacagaagcctgaccatccaccaggccatgaggggccagcagatcggcagctacttcggcagcgagatcacctctgtggacattgatggagatggagtgacagatgtgctgctggtgggcgcccccatgtacttcaatgaaggccgggagcggggcaaggtgtatgtgtatgagctgcggcagaacctgtttgtgtacaacggcaccctgaaggacagccacagctaccagaatgcccgcttcggcagcagcatcgcctctgtgcgggacctgaaccaggacagctacaatgatgtggtggtgggcgcccccctggaggacaaccacgccggggccatctacatcttccacggcttccggggcagcatcctgaagacccccaagcagaggatcacagccagcgagctggccaccggcctgcagtacttcggctgcagcatccacggccagctggacctgaatgaagatggcctgattgacctggccgtgggcgccctgggcaatgctgtgatcctgtggagcaggcctgtggtgcagatcaatgccagcctgcactttgagcccagcaagatcaacatcttccaccgggactgcaagaggagcggcagagatgccacctgcctggccgccttcctgtgcttcacccccatcttcctggccccccacttccagaccaccaccgtgggcatccgctacaatgccaccatggatgagcggcgctacaccccccgggcccacctggatgaaggaggagaccgcttcaccaacagagctgtgctgctgagcagcggccaggagctgtgtgagcgcatcaacttccacgtgctggacacagctgactatgtgaagcctgtgaccttctctgtggagtacagcctggaggaccctgaccacggccccatgctggatgatggctggcccaccaccctgcgggtgtctgtgcccttctggaatggctgcaatgaagatgagcactgtgtgcctgacctggtgctggatgcccggagtgacctgcccacagccatggagtactgccagagggtgctgaggaagccagcccaggactgcagcgcctacaccctgagctttgacaccaccgtcttcatcatcgagagcacccggcagagggtggccgtggaggccaccctggagaacagaggagaaaatgcctacagcacagtgctgaacatcagccagagcgccaacctgcagtttgccagcctcatccagaaggaggacagtgatggcagcattgaatgtgtgaatgaggagcggcggctgcagaagcaggtgtgcaatgtgtcctaccccttcttccgggccaaggccaaggtggccttccggctggactttgagttcagcaagagcatcttcctgcaccacctggagattgagctggccgccggcagtgacagcaatgaaagagacagcaccaaggaggacaacgtggcccccctgcgcttccacctgaagtatgaagcagatgtgctcttcaccaggagcagcagcctgagccactatgaggtgaagcccaacagcagcctggagagatatgatggcatcggcccccccttcagctgcatcttccgcatccagaacctgggcctcttccccatccacggcatgatgatgaagatcaccatccccatcgccaccaggagcggcaaccggctgctgaagctgcgggacttcctgacagatgaggccaacaccagctgcaacatctggggcaacagcacagagtaccggcccacccctgtggaggaggacctgcggcgggccccccagctgaaccacagcaacagtgatgtggtgtccatcaactgcaacatccggctggtgcccaaccaggagatcaacttccacctgctgggcaacctgtggctgcggagcctgaaggccctgaagtacaagtccatgaagatcatggtgaatgctgccctgcagaggcagttccacagccccttcatcttccgggaggaggaccccagccggcagatcgtgtttgagatcagcaagcaggaggactggcaggtgcccatctggatcatcgtgggcagcaccctgggcggcctgctgctgctggccctgctggtgctggccctgtggaagctgggcttcttccgcagcgccaggagaagaagagagcccggcctggaccccacccccaaggtgctggagtag

SEQ ID NO: 156153 - DNA, 3570 bp, Artificial Sequence
  Description of Artificial Sequence: Synthetic coding sequence
atggacctgccccggggcctggtggtggcctgggccctgagcctgtggccaggcttcacagacaccttcaacatggacaccaggaagcccagggtcatccctggcagcaggacagccttcttcggctacacagtgcagcagcacgacatcagcggcaacaagtggctggtggtgggcgcccccctggagaccaacggctaccagaagacaggagatgtgtacaagtgccctgtgatccacggcaactgcaccaagctgaacctgggccgggtgaccctgagcaatgtgtctgagaggaaggacaacatgaggctgggcctgagcctggccaccaaccccaaggacaacagcttcctggcctgcagccccctgtggagccatgaatgtggcagcagctactacaccaccggcatgtgcagccgggtgaacagcaacttccgcttcagcaagacagtggccccagccctgcagcgctgccagacctacatggacatcgtgattgtgctggatggcagcaacagcatctacccctgggtggaggtgcagcacttcctgatcaacatcctgaagaagttctacatcggccctggccagatccaggtgggcgtggtgcagtacggggaggatgtggtgcatgagttccacctgaatgactacagatctgtgaaggatgtggtggaggccgccagccacatcgagcagaggggcggcacagagaccaggacagccttcggcatcgagtttgcccggtctgaggccttccagaagggcggcaggaagggggccaagaaggtgatgatcgtcatcacagatggagagagccatgacagcccagacctggagaaggtgatccagcagagcgagcgggacaacgtgaccaggtatgctgtggccgtgctgggctactacaacagaagaggcatcaaccctgagaccttcctgaatgagatcaagtacatcgccagtgaccctgatgacaagcacttcttcaacgtgacagatgaggccgccctgaaggacatcgtggatgccctgggggaccgcatcttcagcctggagggcaccaacaagaatgagaccagctttggcctggagatgagccagacaggcttcagcagccacgtggtggaggatggagtgctgctgggcgctgtgggcgcctatgactggaatggagctgtgctgaaggagaccagcgctgggaaggtgatccccctgcgggagagctacctgaaggagttccctgaggagctgaagaaccacggggcctacctgggctacacagtgacctctgtggtgagcagccggcagggccgggtgtatgtggccggggccccccgcttcaaccacacaggcaaggtgatcctcttcaccatgcacaacaacagaagcctgaccatccaccaggccatgaggggccagcagatcggcagctacttcggcagcgagatcacctctgtggacattgatggagatggagtgacagatgtgctgctggtgggcgcccccatgtacttcaatgaaggccgggagcggggcaaggtgtatgtgtatgagctgcggcagaacctgtttgtgtacaacggcaccctgaaggacagccacagctaccagaatgcccgcttcggcagcagcatcgcctctgtgcgggacctgaaccaggacagctacaatgatgtggtggtgggcgcccccctggaggacaaccacgccggggccatctacatcttccacggcttccggggcagcatcctgaagacccccaagcagaggatcacagccagcgagctggccaccggcctgcagtacttcggctgcagcatccacggccagctggacctgaatgaagatggcctgattgacctggccgtgggcgccctgggcaatgctgtgatcctgtggagcaggcctgtggtgcagatcaatgccagcctgcactttgagcccagcaagatcaacatcttccaccgggactgcaagaggagcggcagagatgccacctgcctggccgccttcctgtgcttcacccccatcttcctggccccccacttccagaccaccaccgtgggcatccgctacaatgccaccatggatgagcggcgctacaccccccgggcccacctggatgaaggaggagaccgcttcaccaacagagctgtgctgctgagcagcggccaggagctgtgtgagcgcatcaacttccacgtgctggacacagctgactatgtgaagcctgtgaccttctctgtggagtacagcctggaggaccctgaccacggccccatgctggatgatggctggcccaccaccctgcgggtgtctgtgcccttctggaatggctgcaatgaagatgagcactgtgtgcctgacctggtgctggatgcccggagtgacctgcccacagccatggagtactgccagagggtgctgaggaagccagcccaggactgcagcgcctacaccctgagctttgacaccaccgtcttcatcatcgagagcacccggcagagggtggccgtggaggccaccctggagaacagaggagaaaatgcctacagcacagtgctgaacatcagccagagcgccaacctgcagtttgccagcctcatccagaaggaggacagtgatggcagcattgaatgtgtgaatgaggagcggcggctgcagaagcaggtgtgcaatgtgtcctaccccttcttccgggccaaggccaaggtggccttccggctggactttgagttcagcaagagcatcttcctgcaccacctggagattgagctggccgccggcagtgacagcaatgaaagagacagcaccaaggaggacaacgtggcccccctgcgcttccacctgaagtatgaagcagatgtgctcttcaccaggagcagcagcctgagccactatgaggtgaagcccaacagcagcctggagagatatgatggcatcggcccccccttcagctgcatcttccgcatccagaacctgggcctcttccccatccacggcatgatgatgaagatcaccatccccatcgccaccaggagcggcaaccggctgctgaagctgcgggacttcctgacagatgaggtggccaacaccagctgcaacatctggggcaacagcacagagtaccggcccacccctgtggaggaggacctgcggcgggccccccagctgaaccacagcaacagtgatgtggtgtccatcaactgcaacatccggctggtgcccaaccaggagatcaacttccacctgctgggcaacctgtggctgcggagcctgaaggccctgaagtacaagtccatgaagatcatggtgaatgctgccctgcagaggcagttccacagccccttcatcttccgggaggaggaccccagccggcagatcgtgtttgagatcagcaagcaggaggactggcaggtgcccatctggatcatcgtgggcagcaccctgggcggcctgctgctgctggccctgctggtgctggccctgtggaagctgggcttcttccgcagcgccaggagaagaagagagcccggcctggaccccacccccaaggtgctggagtag

SEQ ID NO: 156154 - DNA, 2472 bp, Artificial Sequence
  Description of Artificial Sequence: Synthetic coding sequence
atgagccagacaggcttcagcagccacgtggtggaggatggagtgctgctgggcgctgtgggcgcctatgactggaatggagctgtgctgaaggagaccagcgctgggaaggtgatccccctgcgggagagctacctgaaggagttccctgaggagctgaagaaccacggggcctacctgggctacacagtgacctctgtggtgagcagccggcagggccgggtgtatgtggccggggccccccgcttcaaccacacaggcaaggtgatcctcttcaccatgcacaacaacagaagcctgaccatccaccaggccatgaggggccagcagatcggcagctactttggaagtgagatcacctctgtggacattgatggagatggagtgacagatgtgctgctggtgggcgcccccatgtacttcaatgaaggccgggagcggggcaaggtgtatgtgtatgagctgcggcagaacctgtttgtgtacaacggcaccctgaaggacagccacagctaccagaatgccaggtttggcagcagcatcgcctctgtgcgggacctgaaccaggacagctacaatgatgtggtggtgggcgcccccctggaggacaaccacgccggggccatctacatcttccacggcttccggggcagcatcctgaagacccccaagcagaggatcacagccagcgagctggccaccggcctgcagtacttcggctgcagcatccacggccagctggacctgaatgaagatggcctgattgacctggccgtgggcgccctgggcaatgctgtgatcctgtggagcaggcctgtggtgcagatcaatgccagcctgcactttgagcccagcaagatcaacatcttccaccgggactgcaagaggagcggcagagatgccacctgcctggccgccttcctgtgcttcacccccatcttcctggccccccacttccagaccaccaccgtgggcatccgctacaatgccaccatggatgaaagacgctacaccccccgggcccacctggatgagggcggggaccgcttcaccaacagagctgtgctgctgagcagcggccaggagctgtgtgagcgcatcaacttccacgtgctggacacagctgactatgtgaagcctgtgaccttctctgtggagtacagcctggaggaccctgaccacggccccatgctggatgatggctggcccaccaccctgcgggtgtctgtgcccttctggaatggctgcaatgaagatgagcactgtgtgcctgacctggtgctggatgcccggagtgacctgcccacagccatggagtactgccagagggtgctgaggaagccagcccaggactgcagcgcctacaccctgagctttgacaccaccgtcttcatcatcgagagcacccggcagagggtggccgtggaggccaccctggagaacagaggagaaaatgcctacagcacagtgctgaacatcagccagagcgccaacctgcagtttgccagcctcatccagaaggaggacagtgatggcagcattgaatgtgtgaatgaggagcggcggctgcagaagcaggtgtgcaatgtgtcctaccccttcttccgggccaaggccaaggtggccttccggctggactttgagttcagcaagagcatcttcctgcaccacctggagattgagctggccgccggcagtgacagcaatgaaagagacagcaccaaggaggacaacgtggcccccctgcgcttccacctgaagtatgaagcagatgtgctcttcaccaggagcagcagcctgagccactatgaggtgaagcccaacagcagcctggagagatatgatggcatcggcccccccttcagctgcatcttccgcatccagaacctgggcctcttccccatccacggcatgatgatgaagatcaccatccccatcgccaccaggagcggcaaccggctgctgaagctgcgggacttcctgacagatgaggccaacaccagctgcaacatctggggcaacagcacagagtaccggcccacccctgtggaggaggacctgcggcgggccccccagctgaaccacagcaacagtgatgtggtgtccatcaactgcaacatccggctggtgcccaaccaggagatcaacttccacctgctgggcaacctgtggctgcggagcctgaaggccctgaagtacaagtccatgaagatcatggtgaatgctgccctgcagaggcagttccacagccccttcatcttccgggaggaggaccccagccggcagatcgtgtttgagatcagcaagcaggaggactggcaggtgcccatctggatcatcgtgggcagcaccctgggcggcctgctgctgctggccctgctggtgctggccctgtggaagctgggcttcttccgcagcgccaggagaagaagagagcccggcctggaccccacccccaaggtgctggagtag

SEQ ID NO: 156155 - DNA, 1953 bp, Artificial Sequence
  Description of Artificial Sequence: Synthetic coding sequence
atggacctgccccggggcctggtggtggcctgggccctgagcctgtggccaggcttcacagacaccttcaacatggacaccaggaagcccagggtcatccctggcagcaggacagccttcttcggctacacagtgcagcagcacgacatcagcggcaacaagtggctggtggtgggcgcccccctggagaccaacggctaccagaagacaggagatgtgtacaagtgccctgtgatccacggcaactgcaccaagctgaacctgggccgggtgaccctgagcaatgtgtctgagaggaaggacaacatgaggctgggcctgagcctggccaccaaccccaaggacaacagcttcctggcctgcagccccctgtggagccatgaatgtggcagcagctactacaccaccggcatgtgcagccgggtgaacagcaacttccgcttcagcaagacagtggccccagccctgcagcgctgccagacctacatggacatcgtgattgtgctggatggcagcaacagcatctacccctgggtggaggtgcagcacttcctgatcaacatcctgaagaagttctacatcggccctggccagatccaggtgggcgtggtgcagtacggggaggatgtggtgcatgagttccacctgaatgactacagatctgtgaaggatgtggtggaggccgccagccacatcgagcagaggggcggcacagagaccaggacagccttcggcatcgagtttgcccggtctgaggccttccagaagggcggcaggaagggggccaagaaggtgatgatcgtcatcacagatggagagagccatgacagcccagacctggagaaggtgatccagcagagcgagcgggacaacgtgaccaggtatgctgtggccgtgctgggctactacaacagaagaggcatcaaccctgagaccttcctgaatgagatcaagtacatcgccagtgaccctgatgacaagcacttcttcaacgtgacagatgaggccgccctgaaggacatcgtggatgccctgggggaccgcatcttcagcctggagggcaccaacaagaatgagaccagctttggcctggagatgagccagacaggcttcagcagccacgtggtggaggatggagtgctgctgggcgctgtgggcgcctatgactggaatggagctgtgctgaaggagaccagcgctgggaaggtgatccccctgcgggagagctacctgaaggagttccctgaggagctgaagaaccacggggcctacctgggctacacagtgacctctgtggtgagcagccggcagggccgggtgtatgtggccggggccccccgcttcaaccacacaggcaaggtgatcctcttcaccatgcacaacaacagaagcctgaccatccaccaggccatgaggggccagcagatcggcagctacttcggcagcgagatcacctctgtggacattgatggagatggagtgacagatgtgctgctggtgggcgcccccatgtacttcaatgaaggccgggagcggggcaaggtgtatgtgtatgagctgcggcagaacctgtttgtgtacaacggcaccctgaaggacagccacagctaccagaatgcccgcttcggcagcagcatcgcctctgtgcgggacctgaaccaggacagctacaatgatgtggtggtgggcgcccccctggaggacaaccacgccggggccatctacatcttccacggcttccggggcagcatcctgaagacccccaagcagaggatcacagccagcgagctggccaccggcctgcagtacttcggctgcagcatccacggccagctggacctgaatgaagatggcctgattgacctggccgtgggcgccctgggcaatgctgtgatcctgtggaccccaccacccaagtgctggagcgaggcccctgaggagaccctgtcctag

SEQ ID NO: 156156 - DNA, 3546 bp, Artificial Sequence
  Description of Artificial Sequence: Synthetic coding sequence
atgggccctgagaggactggagctgcccccctgcccctgctgctggtgctggccctgagccagggcatcctgaactgctgcctggcctacaacgtgggcctgcctgaggccaagatcttcagcggccccagcagcgagcagtttggctatgctgtgcagcagttcatcaaccccaagggcaactggctgctggtgggcagcccctggagcggcttccctgagaacaggatgggagatgtgtacaagtgccctgtggacctgagcacagccacctgtgagaagctgaacctgcagaccagcaccagcatccccaacgtgacagagatgaagaccaacatgagcctgggcctcatcctgaccaggaacatgggcactggaggcttcctgacctgtggccccctgtgggcccagcagtgtggcaaccagtactacaccaccggggtgtgcagcgacatcagcccagacttccagctgagcgccagcttcagccctgccacccagccctgccccagcctgattgatgtggtggtggtgtgtgatgagagcaacagcatctacccctgggatgctgtgaagaacttcctggagaagtttgtgcagggcctggacatcggccccaccaagacccaggtgggcctcatccagtatgccaacaacccccgggtggtgttcaacctgaacacctacaagaccaaggaggagatgattgtggccaccagccagaccagccagtatggaggagacctgaccaacacctttggagccatccagtatgccaggaaatatgcctacagcgctgccagcggcggcagaagaagtgccaccaaggtgatggtggtggtgacagatggagagagccatgatggctccatgctgaaggccgtcatcgaccagtgcaaccacgacaacatcctgcgctttggaattgctgtgctgggctacctgaacagaaatgccctggacaccaagaacctgatcaaggagatcaaggccatcgccagcatccccacagagcgctacttcttcaacgtgtctgatgaggccgccctgctggagaaggccggcaccctgggggagcagatcttcagcattgagggcaccgtgcagggcggggacaacttccagatggagatgagccaggtgggcttctctgctgactacagcagccagaatgacatcctgatgctgggcgctgtgggcgccttcggctggagcggcaccatcgtgcagaagaccagccacggccacctgatcttccccaagcaggcctttgaccagatcctgcaggacaggaaccacagcagctacctgggctacagcgtggccgccatcagcactggagagagcacccactttgtggccggggccccccgggccaactacacaggccagatcgtgctgtacagcgtgaatgaaaatggaaacatcaccgtcatccaggcccacagaggagaccagatcggcagctactttggatctgtgctgtgcagcgtggatgtggacaaggacaccatcacagatgtgctgctggtgggcgcccccatgtacatgtctgacctgaagaaggaggagggccgggtgtacctgttcaccatcaaggagggcatcctgggccagcaccagttcctggagggccctgagggcatcgagaacacccgcttcggcagcgccatcgccgccctgagtgacatcaacatggatggcttcaatgatgtgattgtgggcagccccctggagaaccagaacagcggggctgtgtacatctacaacggccaccagggcaccatccgcaccaagtacagccagaagatcctgggcagtgatggagccttccgcagccacctgcagtacttcggccgcagcctggatggctatggagacctgaatggagacagcatcacagatgtgtccatcggggccttcggccaggtggtgcagctgtggagccagagcattgctgatgtggccatcgaggccagcttcaccccagagaagatcaccctggtgaacaagaatgcccagatcatcctgaagctgtgcttcagcgccaagttccggcccaccaagcagaacaaccaggtggccatcgtgtacaacatcaccctggatgctgatggcttcagcagccgggtgaccagccggggcctcttcaaggaaaataatgaacgctgcctgcagaagaacatggtggtgaaccaggcccagagctgcccagagcacatcatctacatccaggagcccagtgatgtggtgaacagcctggacctgcgggtggacatcagcctggagaaccctggcaccagccctgccctggaggcctacagcgagacagccaaggtgttcagcatccccttccacaaggactgtggagaagatggcctgtgcatcagtgacctggtgctggatgtgcggcagatcccagctgcccaggagcagcccttcatcgtgagcaaccagaacaagaggctgaccttctctgtgaccctgaagaacaagcgggagagcgcctacaacacaggaattgtggtggacttctctgaaaatctcttctttgccagcttcagcctgcctgtggatggaacagaggtgacctgccaggtggccgccagccagaagtctgtggcctgtgatgtgggctacccagccctgaagcgggagcagcaggtgaccttcaccatcaactttgacttcaacctgcagaacctgcagaaccaggccagcctgtccttccaggccctgtctgagagccaggaggagaacaaggctgacaacctggtgaacctgaagatccccctgctgtatgatgctgagatccacctgaccaggagcaccaacatcaacttctatgagatcagcagtgatggaaatgtgcccagcatcgtgcacagctttgaagatgtgggccccaagttcatcttcagcctgaaggtgaccactggatctgtgcctgtgtccatggccaccgtcatcatccacatcccccagtacaccaaggagaagaaccccctgatgtacctgactggagtgcagacagacaaggccggggacatcagctgcaatgctgacatcaaccccctgaagattggccagaccagcagctctgtgtccttcaagtctgagaacttccgccacaccaaggagctgaactgcaggacagccagctgcagcaatgtgacctgctggctgaaggatgtgcacatgaagggggagtactttgtgaatgtgaccacccgcatctggaatggcacctttgccagcagcaccttccagacagtgcagctgacagctgctgctgagatcaacacctacaaccctgagatctacgtgattgaggacaacacagtgaccatccccctgatgatcatgaagccagatgagaaggccgaggtgcccaccggggtcatcatcggcagcatcatcgccggcatcctgctgctgctggccctggtggccatcctgtggaagctgggcttcttcaagaggaaatatgagaagatgaccaagaacccagatgaaattgatgagaccacagagctgagcagctag

SEQ ID NO: 156157 - DNA, 2448 bp, Artificial Sequence
  Description of Artificial Sequence: Synthetic coding sequence
atgggccctgagaggactggagctgcccccctgcccctgctgctggtgctggccctgagccagggcatcctgaactgctgcctggcctacaacgtgggcctgcctgaggccaagatcttcagcggccccagcagcgagcagtttggctatgctgtgcagcagttcatcaaccccaagggcaactggctgctggtgggcagcccctggagcggcttccctgagaacaggatgggagatgtgtacaagtgccctgtggacctgagcacagccacctgtgagaagctgaacctgcagaccagcaccagcatccccaacgtgacagagatgaagaccaacatgagcctgggcctcatcctgaccaggaacatgggcactggaggcttcctgacctgtggccccctgtgggcccagcagtgtggcaaccagtactacaccaccggggtgtgcagcgacatcagcccagacttccagctgagcgccagcttcagccctgccacccagccctgccccagcctgattgatgtggtggtggtgtgtgatgagagcaacagcatctacccctgggatgctgtgaagaacttcctggagaagtttgtgcagggcctggacatcggccccaccaagacccaggtgggcctcatccagtatgccaacaacccccgggtggtgttcaacctgaacacctacaagaccaaggaggagatgattgtggccaccagccagaccagccagtatggaggagacctgaccaacacctttggagccatccagtatgccaggaaatatgcctacagcgctgccagcggcggcagaagaagtgccaccaaggtgatggtggtggtgacagatggagagagccatgatggctccatgctgaaggccgtcatcgaccagtgcaaccacgacaacatcctgcgctttggaattgctgtgctgggctacctgaacagaaatgccctggacaccaagaacctgatcaaggagatcaaggccatcgccagcatccccacagagcgctacttcttcaacgtgtctgatgaggccgccctgctggagaaggccggcaccctgggggagcagatcttcagcattgagggcaccgtgcagggcggggacaacttccagatggagatgagccaggtgggcttctctgctgactacagcagccagaatgacatcctgatgctgggcgctgtgggcgccttcggctggagcggcaccatcgtgcagaagaccagccacggccacctgatcttccccaagcaggcctttgaccagatcctgcaggacaggaaccacagcagctacctgggctacagcgtggccgccatcagcactggagagagcacccactttgtggccggggccccccgggccaactacacaggccagatcgtgctgtacagcgtgaatgaaaatggaaacatcaccgtcatccaggcccacagaggagaccagatcggcagctactttggatctgtgctgtgcagcgtggatgtggacaaggacaccatcacagatgtgctgctggtgggcgcccccatgtacatgtctgacctgaagaaggaggagggccgggtgtacctgttcaccatcaaggagggcatcctgggccagcaccagttcctggagggccctgagggcatcgagaacacccgcttcggcagcgccatcgccgccctgagtgacatcaacatggatggcttcaatgatgtgattgtgggcagccccctggagaaccagaacagcggggctgtgtacatctacaacggccaccagggcaccatccgcaccaagtacagccagaagatcctgggcagtgatggagccttccgcagccacctgcagtacttcggccgcagcctggatggctatggagacctgaatggagacagcatcacagatgtgtccatcggggccttcggccaggtggtgcagctgtggagccagagcattgctgatgtggccatcgaggccagcttcaccccagagaagatcaccctggtgaacaagaatgcccagatcatcctgaagctgtgcttcagcgccaagttccggcccaccaagcagaacaaccaggtggccatcgtgtacaacatcaccctggatgctgatggcttcagcagccgggtgaccagccggggcctcttcaaggaaaataatgaacgctgcctgcagaagaacatggtggtgaaccaggcccagagctgcccagagcacatcatctacatccaggagcccagtgatgtggtgaacagcctggacctgcgggtggacatcagcctggagaaccctggcaccagccctgccctggaggcctacagcgagacagccaaggtgttcagcatccccttccacaaggactgtggagaagatggcctgtgcatcagtgacctggtgctggatgtgcggcagatcccagctgcccagctgatgggccagaagtag

SEQ ID NO: 156158 - DNA, 1926 bp, Artificial Sequence
  Description of Artificial Sequence: Synthetic coding sequence
atgggccctgagaggactggagctgcccccctgcccctgctgctggtgctggccctgagccagggcatcctgaactgctgcctggcctacaacgtgggcctgcctgaggccaagatcttcagcggccccagcagcgagcagtttggctatgctgtgcagcagttcatcaaccccaagggcaactggctgctggtgggcagcccctggagcggcttccctgagaacaggatgggagatgtgtacaagtgccctgtggacctgagcacagccacctgtgagaagctgaacctgcagaccagcaccagcatccccaacgtgacagagatgaagaccaacatgagcctgggcctcatcctgaccaggaacatgggcactggaggcttcctgacctgtggccccctgtgggcccagcagtgtggcaaccagtactacaccaccggggtgtgcagcgacatcagcccagacttccagctgagcgccagcttcagccctgccacccagccctgccccagcctgattgatgtggtggtggtgtgtgatgagagcaacagcatctacccctgggatgctgtgaagaacttcctggagaagtttgtgcagggcctggacatcggccccaccaagacccaggtgggcctcatccagtatgccaacaacccccgggtggtgttcaacctgaacacctacaagaccaaggaggagatgattgtggccaccagccagaccagccagtatggaggagacctgaccaacacctttggagccatccagtatgccaggaaatatgcctacagcgctgccagcggcggcagaagaagtgccaccaaggtgatggtggtggtgacagatggagagagccatgatggctccatgctgaaggccgtcatcgaccagtgcaaccacgacaacatcctgcgctttggaattgctgtgctgggctacctgaacagaaatgccctggacaccaagaacctgatcaaggagatcaaggccatcgccagcatccccacagagcgctacttcttcaacgtgtctgatgaggccgccctgctggagaaggccggcaccctgggggagcagatcttcagcattgagggcaccgtgcagggcggggacaacttccagatggagatgagccaggtgggcttctctgctgactacagcagccagaatgacatcctgatgctgggcgctgtgggcgccttcggctggagcggcaccatcgtgcagaagaccagccacggccacctgatcttccccaagcaggcctttgaccagatcctgcaggacaggaaccacagcagctacctgggctacagcgtggccgccatcagcactggagagagcacccactttgtggccggggccccccgggccaactacacaggccagatcgtgctgtacagcgtgaatgaaaatggaaacatcaccgtcatccaggcccacagaggagaccagatcggcagctactttggatctgtgctgtgcagcgtggatgtggacaaggacaccatcacagatgtgctgctggtgggcgcccccatgtacatgtctgacctgaagaaggaggagggccgggtgtacctgttcaccatcaaggagggcatcctgggccagcaccagttcctggagggccctgagggcatcgagaacacccgcttcggcagcgccatcgccgccctgagtgacatcaacatggatggcttcaatgatgtgattgtgggcagccccctggagaaccagaacagcggggctgtgtacatctacaacggccaccagggcaccatccgcaccaagtacagccagctgctgtgcaccatcatcagctgccagacctgcagcttcaggaagtcctgggaccccatggagcccctgggcgccatcagcagcaccctgggcggcccctggatggccatggagatctag

SEQ ID NO: 156159 - DNA, 2829 bp, Artificial Sequence
  Description of Artificial Sequence: Synthetic coding sequence
atgggccctgagaggactggagctgcccccctgcccctgctgctggtgctggccctgagccagggcatcctgaactgctgcctggcctacaacgtgggcctgcctgaggccaagatcttcagcggccccagcagcgagcagtttggctatgctgtgcagcagttcatcaaccccaagggcaactggctgctggtgggcagcccctggagcggcttccctgagaacaggatgggagatgtgtacaagtgccctgtggacctgagcacagccacctgtgagaagctgaacctgcagaccagcaccagcatccccaacgtgacagagatgaagaccaacatgagcctgggcctcatcctgaccaggaacatgggcactggaggcttcctgacctgtggccccctgtgggcccagcagtgtggcaaccagtactacaccaccggggtgtgcagcgacatcagcccagacttccagctgagcgccagcttcagccctgccacccagccctgccccagcctgattgatgtggtggtggtgtgtgatgagagcaacagcatctacccctgggatgctgtgaagaacttcctggagaagtttgtgcagggcctggacatcggccccaccaagacccaggtgggcctcatccagtatgccaacaacccccgggtggtgttcaacctgaacacctacaagaccaaggaggagatgattgtggccaccagccagaccagccagtatggaggagacctgaccaacacctttggagccatccagtatgccaggaaatatgcctacagcgctgccagcggcggcagaagaagtgccaccaaggtgatggtggtggtgacagatggagagagccatgatggctccatgctgaaggccgtcatcgaccagtgcaaccacgacaacatcctgcgctttggaattgctgtgctgggctacctgaacagaaatgccctggacaccaagaacctgatcaaggagatcaaggccatcgccagcatccccacagagcgctacttcttcaacgtgtctgatgaggccgccctgctggagaaggccggcaccctgggggagcagatcttcagcattgagggcaccgtgcagggcggggacaacttccagatggagatgagccaggtgggcttctctgctgactacagcagccagaatgacatcctgatgctgggcgctgtgggcgccttcggctggagcggcaccatcgtgcagaagaccagccacggccacctgatcttccccaagcaggcctttgaccagatcctgcaggacaggaaccacagcagctacctgggctacagcgtggccgccatcagcactggagagagcacccactttgtggccggggccccccgggccaactacacaggccagatcgtgctgtacagcgtgaatgaaaatggaaacatcaccgtcatccaggcccacagaggagaccagatcggcagctactttggatctgtgctgtgcagcgtggatgtggacaaggacaccatcacagatgtgctgctggtgggcgcccccatgtacatgtctgacctgaagaaggaggagggccgggtgtacctgttcaccatcaaggagggcatcctgggccagcaccagttcctggagggccctgagggcatcgagaacacccgcttcggcagcgccatcgccgccctgagtgacatcaacatggatggcttcaatgatgtgattgtgggcagccccctggagaaccagaacagcggggctgtgtacatctacaacggccaccagggcaccatccgcaccaagtacagccagaagatcctgggcagtgatggagccttccgcagccacctgcagtacttcggccgcagcctggatggctatggagacctgaatggagacagcatcacagatgtgtccatcggggccttcggccaggtggtgcagctgtggagccagagcattgctgatgtggccatcgaggccagcttcaccccagagaagatcaccctggtgaacaagaatgcccagatcatcctgaagctgtgcttcagcgccaagttccggcccaccaagcagaacaaccaggtggccatcgtgtacaacatcaccctggatgctgatggcttcagcagccgggtgaccagccggggcctcttcaaggaaaataatgaacgctgcctgcagaagaacatggtggtgaaccaggcccagagctgcccagagcacatcatctacatccaggagcccagtgatgtggtgaacagcctggacctgcgggtggacatcagcctggagaaccctggcaccagccctgccctggaggcctacagcgagacagccaaggtgttcagcatccccttccacaaggactgtggagaagatggcctgtgcatcagtgacctggtgctggatgtgcggcagatcccagctgcccaggagcagcccttcatcgtgagcaaccagaacaagaggctgaccttctctgtgaccctgaagaacaagcgggagagcgcctacaacacaggaattgtggtggacttctctgaaaatctcttctttgccagcttcagcctgcctgtggatggaacagaggtgacctgccaggtggccgccagccagaagtctgtggcctgtgatgtgggctacccagccctgaagcgggagcagcaggtgaccttcaccatcaactttgacttcaacctgcagaacctgcagaaccaggccagcctgtccttccaggccctgtctgagagccaggaggagaacaaggctgacaacctggtgaacctgaagatccccctgctgtatgatgctgagatccacctgaccaggtag

SEQ ID NO: 156160 - DNA, 3120 bp, Artificial Sequence
  Description of Artificial Sequence: Synthetic coding sequence
atggcccgggccctgtgccccctgcaggccctgtggctgctggagtgggtgctgctgctgctgggcccctgtgccgcccccccagcctgggccctgaacctggaccctgtgcagctgaccttctacgccggccccaacggcagccagtttggcttcagcctggacttccacaaggacagccacggccgggtggccatcgtggtgggcgcccccaggaccctgggccccagccaggaggagactggaggagtcttcctgtgcccctggagggctgagggcggccagtgccccagcctgctgtttgacctgagagatgagaccagaaatgtgggcagccagaccctgcagaccttcaaggcccggcagggcctgggcgcctctgtggtgtcctggagcgatgtgattgtggcctgtgccccctggcagcactggaatgtgctggagaagacagaggaggccgagaagacccctgtgggcagctgcttcctggcccagcctgagagcggccggcgggcagagtacagcccctgccggggcaacaccctgagccgcatctacgtggagaatgacttctcctgggacaagcgctactgtgaggccggcttcagctctgtggtgacccaggccggggagctggtgctgggcgcccctgggggctactacttcctgggcctgctggcccaggcccctgtggccgacatcttcagcagctaccggcccggcatcctgctgtggcacgtgagcagccagagcctgagctttgacagcagcaaccctgagtactttgatggctactggggctacagcgtggccgtgggggagtttgatggagacctgaacaccacagaatatgtggtgggcgcccccacctggagctggaccctgggcgctgtggagatcctggacagctactaccagaggctgcaccggctgcggggggagcagatggccagctacttcggccacagcgtggccgtgacagatgtgaatggagatggaagacatgacctgctggtgggcgcccccctgtacatggagagcagagctgacaggaagctggccgaggtgggccgggtgtacctgttcctgcagccccggggcccccacgccctgggcgcccccagcctgctgctgaccggcacccagctgtatggccgctttggaagtgccatcgcccccctgggggacctggacagagatggctacaatgacattgctgtggccgccccctatggaggccccagcggccggggccaggtgctggtgttcctgggccagagcgagggcctgcggagccggcccagccaggtgctggacagccccttccccaccggcagcgccttcggcttcagcctgcggggagctgtggacattgatgacaatggctacccagacctgattgtgggcgcctatggagccaaccaggtggccgtgtaccgggcccagcctgtggtgaaggcctctgtgcagctgctggtgcaggacagcctgaacccagctgtgaagagctgtgtgctgccccagaccaagacccctgtgtcctgcttcaacatccagatgtgtgtgggcgccaccggccacaacatcccccagaagctgagcctgaatgctgagctgcagctggaccggcagaagccccggcagggccggcgggtgctgctgctgggcagccagcaggccggcaccaccctgaacctggacctgggcggcaagcacagccccatctgccacaccaccatggccttcctgagagatgaagctgacttccgggacaagctgagccccatcgtgctgagcctgaatgtgtccctgcccccaacagaagctggcatggccccagctgtggtgctgcacggggacacccacgtgcaggagcagaccagaattgtgctggactgtggagaagatgatgtgtgtgtgccccagctgcagctgacagcctctgtgacaggcagccccctgctggtgggcgctgacaacgtgctggagctgcagatggatgctgccaatgaaggagagggcgcctatgaggccgagctggccgtgcacctgccccagggcgcccactacatgagggccctgagcaatgtggagggctttgagcggctcatctgcaaccagaagaaggaaaatgagaccagggtggtgctgtgtgagctgggcaaccccatgaagaagaatgcccagatcggcatcgccatgctggtgtctgtgggcaacctggaggaggccggggagagcgtgtccttccagctgcagatccgcagcaagaacagccagaaccccaacagcaagatcgtgctgctggatgtgcctgtgcgggcagaggcccaggtggagctgcggggcaacagcttccctgccagcctggtggtggccgctgaggagggggagcgggagcagaacagcctggacagctggggccccaaggtggagcacacctatgagctgcacaacaacggccctggcaccgtgaatggcctgcacctgagcatccacctgcccggccagagccagcccagcgacctgctgtacatcctggacatccagccccagggcggcctgcagtgcttcccccagccccctgtgaaccccctgaaggtggactggggcctgcccatccccagccccagccccatccacccagcccaccacaagagggaccggcggcagatcttcctgcctgagcctgagcagcccagccggctgcaggaccctgtgctggtgtcctgtgacagcgccccctgcaccgtggtgcagtgtgacctgcaggagatggcccggggccagagggccatggtgacagtgctggccttcctgtggctgcccagcctgtaccagaggcccctggaccagtttgtgctgcagagccacgcctggttcaacgtgagcagcctgccctatgctgtgccccccctgagcctgcccagaggagaggcccaggtgtggacccagctgctgcgggccctggaggagcgggccatccccatctggtgggtgctggtgggcgtgctgggcggcctgctgctgctgaccatcctggtgctggccatgtggaaggtgggcttcttcaagaggaacagaccacccctggaggaggatgatgaggagggggagtag

SEQ ID NO: 156161 - DNA, 3018 bp, Artificial Sequence
  Description of Artificial Sequence: Synthetic coding sequence
atggcccgggccctgtgccccctgcaggccctgtggctgctggagtgggtgctgctgctgctgggcccctgtgccgcccccccagcctgggccctgaacctggaccctgtgcagctgaccttctacgccggccccaacggcagccagtttggcttcagcctggacttccacaaggacagccacggccgggtggccatcgtggtgggcgcccccaggaccctgggccccagccaggaggagactggaggagtcttcctgtgcccctggagggctgagggcggccagtgccccagcctgctgtttgacctgagagatgagaccagaaatgtgggcagccagaccctgcagaccttcaaggcccggcagggcctgggcgcctctgtggtgtcctggagcgatgtgattgtggcctgtgccccctggcagcactggaatgtgctggagaagacagaggaggccgagaagacccctgtgggcagctgcttcctggcccagcctgagagcggccggcgggcagagtacagcccctgccggggcaacaccctgagccgcatctacgtggagaatgacttctcctgggacaagcgctactgtgaggccggcttcagctctgtggtgacccaggccggggagctggtgctgggcgcccctgggggctactacttcctgggcctgctggcccaggcccctgtggccgacatcttcagcagctaccggcccggcatcctgctgtggcacgtgagcagccagagcctgagctttgacagcagcaaccctgagtactttgatggctactggggctacagcgtggccgtgggggagtttgatggagacctgaacaccacagaatatgtggtgggcgcccccacctggagctggaccctgggcgctgtggagatcctggacagctactaccagaggctgcaccggctgcggggggagcagatggccagctacttcggccacagcgtggccgtgacagatgtgaatggagatggaagacatgacctgctggtgggcgcccccctgtacatggagagcagagctgacaggaagctggccgaggtgggccgggtgtacctgttcctgcagccccggggcccccacgccctgggcgcccccagcctgctgctgaccggcacccagctgtatggccgctttggaagtgccatcgcccccctgggggacctggacagagatggctacaatgacattgctgtggccgccccctatggaggccccagcggccggggccaggtgctggtgttcctgggccagagcgagggcctgcggagccggcccagccaggtgctggacagccccttccccaccggcagcgccttcggcttcagcctgcggggagctgtggacattgatgacaatggctacccagacctgattgtgggcgcctatggagccaaccaggtggccgtgtaccgggcccagcctgtggtgaaggcctctgtgcagctgctggtgcaggacagcctgaacccagctgtgaagagctgtgtgctgccccagaccaagacccctgtgtcctgcttcaacatccagatgtgtgtgggcgccaccggccacaacatcccccagaagctgagcctgaatgctgagctgcagctggaccggcagaagccccggcagggccggcgggtgctgctgctgggcagccagcaggccggcaccaccctgaacctggacctgggcggcaagcacagccccatctgccacaccaccatggccttcctgagagatgaagctgacttccgggacaagctgagccccatcgtgctgagcctgaatgtgtccctgcccccaacagaagctggcatggccccagctgtggtgctgcacggggacacccacgtgcaggagcagaccagaattgtgctggactgtggagaagatgatgtgtgtgtgccccagctgcagctgacagcctctgtgacaggcagccccctgctggtgggcgctgacaacgtgctggagctgcagatggatgctgccaatgaaggagagggcgcctatgaggccgagctggccgtgcacctgccccagggcgcccactacatgagggccctgagcaatgtggagggctttgagcggctcatctgcaaccagaagaaggaaaatgagaccagggtggtgctgtgtgagctgggcaaccccatgaagaagaatgcccagatcggcatcgccatgctggtgtctgtgggcaacctggaggaggccggggagagcgtgtccttccagctgcagatccgcagcaagaacagccagaaccccaacagcaagatcgtgctgctggatgtgcctgtgcgggcagaggcccaggtggagctgcggggcaacagcttccctgccagcctggtggtggccgctgaggagggggagcgggagcagaacagcctggacagctggggccccaaggtggagcacacctatgagctgcacaacaacggccctggcaccgtgaatggcctgcacctgagcatccacctgcccggccagagccagcccagcgacctgctgtacatcctggacatccagccccagggcggcctgcagtgcttcccccagccccctgtgaaccccctgaaggtggactggggcctgcccatccccagccccagccccatccacccagcccaccacaagagggaccggcggcagatcttcctgcctgagcctgagcagcccagccggctgcaggaccctgtgctggtgtcctgtgacagcgccccctgcaccgtggtgcagtgtgacctgcaggagatggcccggggccagagggccatggtgacagtgctggccttcctgtggctgcccagcctgtaccaggtgtggacccagctgctgcgggccctggaggagcgggccatccccatctggtgggtgctggtgggcgtgctgggcggcctgctgctgctgaccatcctggtgctggccatgtggaaggtgggcttcttcaagaggaacagaccacccctggaggaggatgatgaggagggggagtag

SEQ ID NO: 156162 - DNA, 660 bp, Artificial Sequence
  Description of Artificial Sequence: Synthetic coding sequence
atggccagctacttcggccacagcgtggccgtgacagatgtgaatggagatggaagacatgacctgctggtgggcgcccccctgtacatggagagcagagctgacaggaagctggccgaggtgggccgggtgtacctgttcctgcagccccggggcccccacgccctgggcgcccccagcctgctgctgaccggcacccagctgtatggccgcttcggcagcgccatcgcccccctgggggacctggacagagatggctacaatgacattgctgtggccgccccctacggcggccccagcggccggggccaggtgctggtgttcctgggccagagcgagggcctgcggagccggcccagccaggtgctggacagccccttccccactggaagtgccttcggcttcagcctgcggggagctgtggacattgatgacaatggctacccaggggccctggactgcctgcagctggagatgcccaagaagggcccctggacctttgctggcagcgccaagagacatggccagggcctgatgcctggcctggtgagccactacggcctgcctgagggcctgggggagaccagcagcggcggcggcggcgtgggcaacccctgggaggatgagatgaggatcccctgccccaaccggcagttctag

SEQ ID NO: 156163 - DNA, 3201 bp, Artificial Sequence
  Description of Artificial Sequence: Synthetic coding sequence
atgggccctggccccagccgggccccccgggccccccggctgatgctgtgtgccctggccctgatggtggccgccggcggctgtgtggtgtctgccttcaacctggacacccgcttcctggtggtgaaggaggccggcaaccctggcagcctgtttggctacagcgtggccctgcaccggcagacagagcggcagcagcgctacctgctgctggccggggccccccgggagctggccgtgcctgatggctacaccaacagaactggagctgtgtacctgtgccccctgacagcccacaaggatgactgtgagaggatgaacatcaccgtgaagaatgaccccggccaccacatcatcgaggacatgtggctgggcgtgacagtggccagccagggccctgctggccgggtgctggtgtgtgcccaccgctacacccaggtgctgtggagcggcagcgaggaccagaggaggatggtgggcaaatgttatgtgagaggaaatgacctggagctggacagcagtgatgactggcagacctaccacaatgagatgtgcaacagcaacacagactacctggagaccggcatgtgccagctgggcaccagcggcggcttcacccagaacacagtgtactttggagcccctggggcctacaactggaagggcaacagctacatgatccagaggaaggagtgggacctgtctgagtacagctacaaggaccctgaggaccagggcaacctgtacatcggctacaccatgcaggtgggcagcttcatcctgcaccccaagaacatcaccatcgtgactggagcccccaggcaccgccacatgggcgctgtgttcctgctgagccaggaggccggcggggacctgcggcggcggcaggtgctggagggcagccaggtgggcgcctactttggaagtgccatcgccctggccgacctgaacaatgatggctggcaggacctgctggtgggcgccccctactactttgagaggaaggaggaggtgggcggggccatctacgtgttcatgaaccaggccggcaccagcttccctgcccaccccagcctgctgctgcacggccccagcggcagcgccttcggcctgtctgtggccagcatcggggacatcaaccaggacggcttccaggacattgctgtgggcgccccctttgagggcctgggcaaggtgtacatctaccacagcagcagcaagggcctgctgcggcagccccagcaggtgatccacggggagaagctgggcctgcccggcctggccaccttcggctacagcctgagcggccagatggatgtggatgagaacttctacccagacctgctggtgggcagcctgagtgaccacatcgtgctgctgcgggcccggcctgtgatcaacatcgtgcacaagaccctggtgcccaggcctgctgtgctggaccctgccctgtgcacagccaccagctgtgtgcaggtggagctgtgctttgcctacaaccagagcgctggcaaccccaactacagaagaaacatcaccctggcctacaccctggaggccgaccgggaccggcggcccccccggctgcgctttgctggcagcgagagcgctgtgttccacggcttcttctccatgcctgagatgcgctgccagaagctggagctgctgctgatggacaacctgcgggacaagctgcggcccatcatcatctccatgaactacagcctgcccctgaggatgccagaccggccccggctgggcctgcggagcctggatgcctaccccatcctgaaccaggcccaggccctggagaaccacacagaggtgcagttccagaaggaatgtggccctgacaacaagtgtgagagcaacctgcagatgagagctgcctttgtgtctgagcagcagcagaagctgagccggctgcagtacagcagagatgtgaggaagctgctgctgagcatcaacgtgaccaacaccaggaccagcgagaggtctggagaagatgcccacgaggccctgctgaccctggtggtgcccccagccctgctgctgagctctgtgcggcccccaggggcctgccaggccaatgagaccatcttctgtgagctgggcaaccccttcaagaggaaccagaggatggagctgctgattgcctttgaggtgattggagtgaccctgcacacccgggacctgcaggtgcagctgcagctgagcaccagcagccaccaggacaacctgtggcccatgatcctgaccctgctggtggactacaccctgcagaccagcctgtccatggtgaaccaccggctgcagagcttctttggaggcaccgtgatgggagagagcggcatgaagacagtggaggatgtgggcagccccctgaagtatgagttccaggtgggccccatgggagagggcctggtgggcctgggcaccctggtgctgggcctggagtggccctatgaggtgtccaatggcaagtggctgctgtaccccacagagatcaccgtgcatggaaatggctcctggccctgccggcccccaggggacctgatcaaccccctgaacctgaccctgagtgaccccggggaccggcccagcagcccccagaggagaagacggcagctggaccccggcggcggccagggccccccacctgtgaccctggccgccgccaagaaggccaagtctgagaccgtgctgacctgtgccaccggccgggcccactgtgtgtggctggagtgccccatcccagatgcccctgtggtgaccaacgtgacagtgaaggcccgggtgtggaacagcaccttcatcgaggactacagagactttgacagagtgcgggtgaatggctgggccaccctcttcctgcggaccagcatccccaccatcaacatggagaacaagaccacctggttctctgtggacatcgacagcgagctggtggaggagctgcctgctgagattgagctgtggctggtgctggtggccgtgggcgccggcctgctgctgctgggcctcatcatcctgctgctgtggaagtgtgacttcttcaagaggacccgctactaccagatcatgcccaagtaccacgctgtgcgcatccgggaggaggagcgctacccacctcctggcagcaccctgcccaccaagaagcactgggtgacctcctggcagacccgggaccagtactactag

SEQ ID NO: 156164 - DNA, 3156 bp, Artificial Sequence
  Description of Artificial Sequence: Synthetic coding sequence
atgggccctggccccagccgggccccccgggccccccggctgatgctgtgtgccctggccctgatggtggccgccggcggctgtgtggtgtctgccttcaacctggacacccgcttcctggtggtgaaggaggccggcaaccctggcagcctgtttggctacagcgtggccctgcaccggcagacagagcggcagcagcgctacctgctgctggccggggccccccgggagctggccgtgcctgatggctacaccaacagaactggagctgtgtacctgtgccccctgacagcccacaaggatgactgtgagaggatgaacatcaccgtgaagaatgaccccggccaccacatcatcgaggacatgtggctgggcgtgacagtggccagccagggccctgctggccgggtgctggtgtgtgcccaccgctacacccaggtgctgtggagcggcagcgaggaccagaggaggatggtgggcaaatgttatgtgagaggaaatgacctggagctggacagcagtgatgactggcagacctaccacaatgagatgtgcaacagcaacacagactacctggagaccggcatgtgccagctgggcaccagcggcggcttcacccagaacacagtgtactttggagcccctggggcctacaactggaagggcaacagctacatgatccagaggaaggagtgggacctgtctgagtacagctacaaggaccctgaggaccagggcaacctgtacatcggctacaccatgcaggtgggcagcttcatcctgcaccccaagaacatcaccatcgtgactggagcccccaggcaccgccacatgggcgctgtgttcctgctgagccaggaggccggcggggacctgcggcggcggcaggtgctggagggcagccaggtgggcgcctactttggaagtgccatcgccctggccgacctgaacaatgatggctggcaggacctgctggtgggcgccccctactactttgagaggaaggaggaggtgggcggggccatctacgtgttcatgaaccaggccggcaccagcttccctgcccaccccagcctgctgctgcacggccccagcggcagcgccttcggcctgtctgtggccagcatcggggacatcaaccaggacggcttccaggacattgctgtgggcgccccctttgagggcctgggcaaggtgtacatctaccacagcagcagcaagggcctgctgcggcagccccagcaggtgatccacggggagaagctgggcctgcccggcctggccaccttcggctacagcctgagcggccagatggatgtggatgagaacttctacccagacctgctggtgggcagcctgagtgaccacatcgtgctgctgcgggcccggcctgtgatcaacatcgtgcacaagaccctggtgcccaggcctgctgtgctggaccctgccctgtgcacagccaccagctgtgtgcaggtggagctgtgctttgcctacaaccagagcgctggcaaccccaactacagaagaaacatcaccctggcctacaccctggaggccgaccgggaccggcggcccccccggctgcgctttgctggcagcgagagcgctgtgttccacggcttcttctccatgcctgagatgcgctgccagaagctggagctgctgctgatggacaacctgcgggacaagctgcggcccatcatcatctccatgaactacagcctgcccctgaggatgccagaccggccccggctgggcctgcggagcctggatgcctaccccatcctgaaccaggcccaggccctggagaaccacacagaggtgcagttccagaaggaatgtggccctgacaacaagtgtgagagcaacctgcagatgagagctgcctttgtgtctgagcagcagcagaagctgagccggctgcagtacagcagagatgtgaggaagctgctgctgagcatcaacgtgaccaacaccaggaccagcgagaggtctggagaagatgcccacgaggccctgctgaccctggtggtgcccccagccctgctgctgagctctgtgcggcccccaggggcctgccaggccaatgagaccatcttctgtgagctgggcaaccccttcaagaggaaccagaggatggagctgctgattgcctttgaggtgattggagtgaccctgcacacccgggacctgcaggtgcagctgcagctgagcaccagcagccaccaggacaacctgtggcccatgatcctgaccctgctggtggactacaccctgcagaccagcctgtccatggtgaaccaccggctgcagagcttctttggaggcaccgtgatgggagagagcggcatgaagacagtggaggatgtgggcagccccctgaagtatgagttccaggtgggccccatgggagagggcctggtgggcctgggcaccctggtgctgggcctggagtggccctatgaggtgtccaatggcaagtggctgctgtaccccacagagatcaccgtgcatggaaatggctcctggccctgccggcccccaggggacctgatcaaccccctgaacctgaccctgagtgaccccggggaccggcccagcagcccccagaggagaagacggcagctggaccccggcggcggccagggccccccacctgtgaccctggccgccgccaagaaggccaagtctgagaccgtgctgacctgtgccaccggccgggcccactgtgtgtggctggagtgccccatcccagatgcccctgtggtgaccaacgtgacagtgaaggcccgggtgtggaacagcaccttcatcgaggactacagagactttgacagagtgcgggtgaatggctgggccaccctcttcctgcggaccagcatccccaccatcaacatggagaacaagaccacctggttctctgtggacatcgacagcgagctggtggaggagctgcctgctgagattgagctgtggctggtgctggtggccgtgggcgccggcctgctgctgctgggcctcatcatcctgctgctgtggaagtgtggcttcttcaagagggcccggacccgggccctgtatgaggccaagaggcagaaggccgagatgaagagccagcccagcgagacagagcggctgacagatgactactag

SEQ ID NO: 156165 - DNA, 3114 bp, Artificial Sequence
  Description of Artificial Sequence: Synthetic coding sequence
atgctgtgtgccctggccctgatggtggccgccggcggctgtgtggtgtctgccttcaacctggacacccgcttcctggtggtgaaggaggccggcaaccctggcagcctgtttggctacagcgtggccctgcaccggcagacagagcggcagcagcgctacctgctgctggccggggccccccgggagctggccgtgcctgatggctacaccaacagaactggagctgtgtacctgtgccccctgacagcccacaaggatgactgtgagaggatgaacatcaccgtgaagaatgaccccggccaccacatcatcgaggacatgtggctgggcgtgacagtggccagccagggccctgctggccgggtgctggtgtgtgcccaccgctacacccaggtgctgtggagcggcagcgaggaccagaggaggatggtgggcaaatgttatgtgagaggaaatgacctggagctggacagcagtgatgactggcagacctaccacaatgagatgtgcaacagcaacacagactacctggagaccggcatgtgccagctgggcaccagcggcggcttcacccagaacacagtgtactttggagcccctggggcctacaactggaagggcaacagctacatgatccagaggaaggagtgggacctgtctgagtacagctacaaggaccctgaggaccagggcaacctgtacatcggctacaccatgcaggtgggcagcttcatcctgcaccccaagaacatcaccatcgtgactggagcccccaggcaccgccacatgggcgctgtgttcctgctgagccaggaggccggcggggacctgcggcggcggcaggtgctggagggcagccaggtgggcgcctactttggaagtgccatcgccctggccgacctgaacaatgatggctggcaggacctgctggtgggcgccccctactactttgagaggaaggaggaggtgggcggggccatctacgtgttcatgaaccaggccggcaccagcttccctgcccaccccagcctgctgctgcacggccccagcggcagcgccttcggcctgtctgtggccagcatcggggacatcaaccaggacggcttccaggacattgctgtgggcgccccctttgagggcctgggcaaggtgtacatctaccacagcagcagcaagggcctgctgcggcagccccagcaggtgatccacggggagaagctgggcctgcccggcctggccaccttcggctacagcctgagcggccagatggatgtggatgagaacttctacccagacctgctggtgggcagcctgagtgaccacatcgtgctgctgcgggcccggcctgtgatcaacatcgtgcacaagaccctggtgcccaggcctgctgtgctggaccctgccctgtgcacagccaccagctgtgtgcaggtggagctgtgctttgcctacaaccagagcgctggcaaccccaactacagaagaaacatcaccctggcctacaccctggaggccgaccgggaccggcggcccccccggctgcgctttgctggcagcgagagcgctgtgttccacggcttcttctccatgcctgagatgcgctgccagaagctggagctgctgctgatggacaacctgcgggacaagctgcggcccatcatcatctccatgaactacagcctgcccctgaggatgccagaccggccccggctgggcctgcggagcctggatgcctaccccatcctgaaccaggcccaggccctggagaaccacacagaggtgcagttccagaaggaatgtggccctgacaacaagtgtgagagcaacctgcagatgagagctgcctttgtgtctgagcagcagcagaagctgagccggctgcagtacagcagagatgtgaggaagctgctgctgagcatcaacgtgaccaacaccaggaccagcgagaggtctggagaagatgcccacgaggccctgctgaccctggtggtgcccccagccctgctgctgagctctgtgcggcccccaggggcctgccaggccaatgagaccatcttctgtgagctgggcaaccccttcaagaggaaccagaggatggagctgctgattgcctttgaggtgattggagtgaccctgcacacccgggacctgcaggtgcagctgcagctgagcaccagcagccaccaggacaacctgtggcccatgatcctgaccctgctggtggactacaccctgcagaccagcctgtccatggtgaaccaccggctgcagagcttctttggaggcaccgtgatgggagagagcggcatgaagacagtggaggatgtgggcagccccctgaagtatgagttccaggtgggccccatgggagagggcctggtgggcctgggcaccctggtgctgggcctggagtggccctatgaggtgtccaatggcaagtggctgctgtaccccacagagatcaccgtgcatggaaatggctcctggccctgccggcccccaggggacctgatcaaccccctgaacctgaccctgagtgaccccggggaccggcccagcagcccccagaggagaagacggcagctggaccccggcggcggccagggccccccacctgtgaccctggccgccgccaagaaggccaagtctgagaccgtgctgacctgtgccaccggccgggcccactgtgtgtggctggagtgccccatcccagatgcccctgtggtgaccaacgtgacagtgaaggcccgggtgtggaacagcaccttcatcgaggactacagagactttgacagagtgcgggtgaatggctgggccaccctcttcctgcggaccagcatccccaccatcaacatggagaacaagaccacctggttctctgtggacatcgacagcgagctggtggaggagctgcctgctgagattgagctgtggctggtgctggtggccgtgggcgccggcctgctgctgctgggcctcatcatcctgctgctgtggaagtgtggcttcttcaagagggcccggacccgggccctgtatgaggccaagaggcagaaggccgagatgaagagccagcccagcgagacagagcggctgacagatgactactag

SEQ ID NO: 156166 - DNA, 885 bp, Artificial Sequence
  Description of Artificial Sequence: Synthetic coding sequence
atgatccagaggaaggagtgggacctgtctgagtacagctacaaggaccctgaggaccagggcaacctgtacatcggctacaccatgcaggtgggcagcttcatcctgcaccccaagaacatcaccatcgtgactggagcccccaggcaccgccacatgggcgctgtgttcctgctgagccaggaggccggcggggacctgcggcggcggcaggtgctggagggcagccaggtgggcgcctacttcggcagcgccatcgccctggccgacctgaacaatgatggctggcaggacctgctggtgggcgccccctactactttgagaggaaggaggaggtgggcggggccatctacgtgttcatgaaccaggccggcaccagcttccctgcccaccccagcctgctgctgcacggccccagcggcagcgccttcggcctgtctgtggccagcattggagacatcaaccaggacggcttccaggacattgctgtgggcgccccctttgagggcctgggcaaggtgtacatctaccacagcagcagcaagggcctgctgcggcagccccagcaggtgattcatggagagaagctgggcctgcccggcctggccaccttcggctacagcctgagcggccagatggatgtggatgagaacttctacccagacctgctggtgggcagcctgagtgaccacatcgtgctgctgcgggcccggcctgtgatcaacatcgtgcacaagaccctggtgcccaggcctgctgtgctggaccctgccctgtgcacagccaccagctgtgtgcaggtggagctgtgctttgcctacaaccagagcgctggcaaccccaactacagaagaaacatcagcgagtgctggggcgccgcctag

SEQ ID NO: 156167 - DNA, 3108 bp, Artificial Sequence
  Description of Artificial Sequence: Synthetic coding sequence
atgggcggccctgctgcccccaggggggccggccgcctgcgggccctgctgctggccctggtggtggccggcatcccagctggggcctacaacctggacccccagaggcctgtgcacttccagggccctgctgacagcttcttcggctatgctgtgctggagcacttccatgacaacacccgctgggtgctggtgggcgcccccaaggctgacagcaagtacagccccagcgtgaagagccctggagctgtgttcaagtgccgggtgcacaccaacccagaccggcgctgcacagagctggacatggcccggggcaagaacagaggcaccagctgtgggaagacctgccgggaggacagagatgatgagtggatgggcgtgtccctggcccggcagcccaaggcagatggccgggtgctggcctgtgcccaccgctggaagaacatctactatgaagctgaccacatcctgccccacggcttctgctacatcatccccagcaacctgcaggccaagggccgcaccctcatcccctgctatgaggagtacaagaagaagtatggagaggagcacggcagctgccaggccggcattgctggcttcttcacagaggagctggtggtgatgggcgcccctggcagcttctactgggccggcaccatcaaggtgctgaacctgacagacaacacctacctgaagctgaatgatgaggtgatcatgaacagacgctacacctacctgggctatgctgtgacagctggccacttcagccaccccagcaccattgatgtggtgggcggggccccccaggacaagggcatcggcaaggtgtacatcttccgggctgaccggcgcagcggcaccctcatcaagatcttccaggccagcggcaagaagatgggcagctacttcggcagcagcctgtgtgctgtggacctgaatggagatggcctgagtgacctgctggtgggcgcccccatgttttctgagatcagagatgagggccaggtgacagtgtacatcaacagaggaaatggagccctggaggagcagctggccctgactggagatggagcctacaatgcccactttggagagagcatcgccagcctggatgacctggacaatgatggcttcccagatgtggccatcggggcccccaaggaggatgactttgctggagctgtgtacatctaccatggagatgctgggggcatcgtgccccagtacagcatgaagctgagcggccagaagatcaaccctgtgctgaggatgtttggccagagcatcagcggcggcatcgacatggatggaaatggctacccagatgtgacagtgggcgccttcatgtctgattctgtggtgctgctgcgggcccggcctgtgatcaccgtggatgtgtccatcttcctgcccggcagcatcaacatcacagccccccagtgccatgatggccagcagcctgtgaactgcctgaatgtgaccacctgcttctccttccacggcaagcacgtgcctggagaaattggcctgaactacgtgctgatggctgatgtggccaagaaggagaagggccagatgccccgggtgtactttgtgctgctgggggagaccatgggccaggtgacagagaagctgcagctgacctacatggaggagacctgccgccactacgtggcccacgtgaagagaagagtgcaggacgtcatcagccccatcgtgtttgaagctgcctacagcctgtctgagcacgtgactggagaggaggagcgggagctgccccccctgacccctgtgctgcgctggaagaagggccagaagatcgcccagaagaaccagacagtgtttgagaggaactgccgctctgaggactgtgccgctgacctgcagctgcagggcaagctgctgctgagctccatggatgagaagaccctgtacctggccctgggcgctgtgaagaacatcagcctgaacatcagcatcagcaacctgggagatgatgcctatgatgccaacgtgtccttcaacgtgtcccgggagctgttcttcatcaacatgtggcagaaggaggagatgggcatcagctgtgagctgctggagagtgacttcctgaagtgcagcgtgggcttccccttcatgaggagcaagagcaaatatgagttcagcgtcatctttgacaccagccacctgtctggagaggaggaggtgctgtccttcatcgtgacagcccagagcggcaacacagagaggtctgagagcctgcatgacaacaccctggtgctgatggtgcccctgatgcatgaggtggacaccagcatcaccggcatcatgagccccaccagctttgtgtatggagagagcgtggatgctgccaacttcatccagctggatgacctggagtgccacttccagcccatcaacatcaccctgcaggtgtacaacacaggccccagcaccctgcccggcagctctgtgtccatctccttccccaaccggctgagcagtggaggagctgagatgttccacgtgcaggagatggtggtgggccaggagaagggcaactgcagcttccagaagaaccccaccccctgcatcatcccccaggagcaggagaacatcttccacaccatctttgccttcttcaccaagagcggcaggaaggtgctggactgtgagaagccaggcatcagctgcctgacagcccactgcaacttcagcgccctggccaaggaggagagcaggaccatcgacatctacatgctgctgaacacagagatcctgaagaaggacagcagcagcgtcatccagttcatgagccgggccaaggtgaaggtggaccctgccctgcgggtggtggagatcgcccacggcaaccctgaggaggtgacagtggtgtttgaggccctgcacaacctggagccccggggctacgtggtgggctggatcatcgccatcagcctgctggtgggcatcctgatcttcctgctgctggccgtgctgctgtggaagatgggcttcttcagaagacgctacaaggagatcattgaagctgagaagaacagaaaagaaaatgaagattcctgggactgggtgcagaagaaccagtag

SEQ ID NO: 156168 - DNA, 696 bp, Artificial Sequence
  Description of Artificial Sequence: Synthetic coding sequence
atgtgccagcccccacccacagcccctggctcctggcctgtggcccggccctgcacagaatctgtgggccgcacccacacccagagggtgcctgccagctgctgggcccgggccggccgcagcagccggcagagccccaccccccggcagtttgccctgatgcagtacagcaacctgctgaagatccacttcaccttcacccagttccgcaccagccccagccagcagagcctggtggaccccatcgtgcagctgaagggcctgaccttcaccgccaccggcatcctgactgtggtgacccagctgttccaccacaagaatggagccaggaagagcgccaagaagatcctgattgtcatcacagatggccagaagtacaaggaccccctggagtacagtgatgtgatcccccaggccgagaaggccggcatcatccgctatgccatcggcgtgcggctcttcttcaccccagcccctggcagcgcctgcatctccttccgctgcagcgctgctggcctcatcctgctgggctgcctgtctgctgctgggggcacccgcttccctggcacccactgccaggccggggctgagtaccaccagctgagcgccagcgctggcccccgggtgcagggcggccagctgtgcagcccctggcagcaccctgaggccgctgctggggaggacctgtgcagctag

SEQ ID NO: 156169 - DNA, 3486 bp, Artificial Sequence
  Description of Artificial Sequence: Synthetic coding sequence
atgacctttggaacagtgctgctgctgtctgtgctggccagctaccacggcttcaacctggatgtggaggagcccaccatcttccaggaggatgctgggggcttcggccagagcgtggtgcagtttggaggcagccggctggtggtgggcgcccccctggaggtggtggccgccaaccagacaggccgcctgtatgactgtgccgccgccaccggcatgtgccagcccatccccctgcacatccggcctgaggccgtgaacatgagcctgggcctgaccctggccgccagcaccaacggcagccggctgctggcctgtggccccaccctgcaccgggtgtgtggggagaacagctacagcaagggcagctgcctgctgctgggcagccgctgggagatcatccagacagtgcctgatgccaccccagaatgtccccaccaggagatggacatcgtgttcctgattgatggcagcggcagcattgaccagaatgacttcaaccagatgaagggctttgtgcaggccgtgatgggccagtttgagggcacagacaccctgtttgccctgatgcagtacagcaacctgctgaagatccacttcaccttcacccagttccgcaccagccccagccagcagagcctggtggaccccatcgtgcagctgaagggcctgaccttcaccgccaccggcatcctgactgtggtgacccagctgttccaccacaagaatggagccaggaagagcgccaagaagatcctgattgtcatcacagatggccagaagtacaaggaccccctggagtacagtgatgtgatcccccaggccgagaaggccggcatcatccgctatgccatcggcgtgggccacgccttccagggccccacagcccggcaggagctgaacaccatcagcagcgccccaccccaggaccacgtgttcaaggtggacaactttgctgccctgggcagcatccagaagcagctgcaggagaagatctatgctgtggagggcacccagagccgggccagcagcagcttccagcacgagatgagccaggagggcttcagcacagccctgaccatggatggcctcttcctgggcgctgtgggcagcttctcctggagcggcggggccttcctgtacccacccaacatgagccccaccttcatcaacatgagccaggagaatgtggacatgagggacagctacctgggctacagcacagagctggccctgtggaagggcgtgcagaacctggtgctgggcgccccccgctaccagcacacaggcaaggccgtcatcttcacccaggtgtcccggcagtggaggaagaaggccgaggtgacaggcacccagatcggcagctactttggagccagcctgtgcagcgtggatgtggacagtgatggcagcacagacctgatcctgattggagccccccactactatgagcagacccggggcggccaggtgtctgtgtgccccctgccccggggccgggtgcagtggcagtgtgatgctgtgctgcggggggagcagggccacccctggggccgctttggagctgccctgactgtgctgggagatgtgaatgaagacaagctgattgatgtggccatcggggcccctggagagcaggagaacagaggagctgtgtacctgttccacggggccagcgagagcggcatcagccccagccacagccagagaattgccagcagccagctgagcccccggctgcagtacttcggccaggccctgagcggcggccaggacctgacccaggacggcctgatggacctggccgtgggcgcccggggccaggtgctgctgctgcggagcctgcctgtgctgaaggtgggcgtggccatgaggttcagccctgtggaggtggccaaggctgtgtaccgctgctgggaggagaagcccagcgccctggaggccggagatgccaccgtgtgcctgaccatccagaagagcagcctggaccagctgggggacatccagagctctgtgcgctttgacctggccctggaccccggccgcctgaccagccgggccatcttcaatgagaccaagaaccccaccctgaccaggaggaagaccctgggcctgggcatccactgtgagaccctgaagctgctgctgcctgactgtgtggaggatgtggtgagccccatcatcctgcacctgaacttcagcctggtgcgggagcccatccccagcccccagaacctgcggcctgtgctggccgtgggcagccaggacctcttcaccgccagcctgccctttgagaagaactgtggccaggacggcctgtgtgagggggacctgggcgtgaccctgtccttcagcggcctgcagaccctgactgtgggcagcagcctggagctgaatgtgattgtgacagtgtggaatgctggagaagattcctatggcaccgtggtgtccctgtactacccagctggcctgagccacagaagagtgtctggggcccagaagcagccccaccagagcgccctgcggctggcctgtgaaacagtgcccacagaagatgagggcctgcggagcagccgctgcagcgtgaaccaccccatcttccacgagggcagcaatggcaccttcatcgtgacctttgatgtgtcctacaaggccaccctgggggacaggatgctgatgagggccagcgccagcagcgagaacaacaaggccagcagcagcaaggccaccttccagctggagctgcctgtgaagtatgctgtgtacaccatgatcagccggcaggaggagagcaccaagtacttcaactttgccaccagtgatgagaagaagatgaaggaggccgagcaccgctacagagtgaacaacctgagccagagggacctggccatcagcatcaacttctgggtgcctgtgctgctgaatggagtggccgtgtgggatgtggtgatggaggcccccagccagagcctgccctgtgtgtctgagaggaagccaccccagcacagcgacttcctgacccagatcagccgcagccccatgctggactgcagcattgctgactgcctgcagttccgctgtgatgtgcccagcttctctgtgcaggaggagctggacttcaccctgaagggcaacctgagctttggctgggtgcgggagaccctgcagaagaaggtgctggtggtgtctgtggccgagatcacctttgacacctctgtgtacagccagctgcccggccaggaggccttcatgagggcccagatggagatggtgctggaggaggatgaggtgtacaatgccatccccatcatcatgggcagctctgtgggcgccctgctgctgctggccctgatcacagccaccctgtacaagctgggcttcttcaagaggcactacaaggagatgctggaggacaagccagaggacacagccaccttctctggagatgacttcagctgtgtggccccaaatgtgcccctgtcctag

SEQ ID NO: 156170 - DNA, 3534 bp, Artificial Sequence
  Description of Artificial Sequence: Synthetic coding sequence
tgtgccctgagccccaccttccacttccccagcacccgctgcagcggcatgacctttggaacagtgctgctgctgtctgtgctggccagctaccacggcttcaacctggatgtggaggagcccaccatcttccaggaggatgctgggggcttcggccagagcgtggtgcagtttggaggcagccggctggtggtgggcgcccccctggaggtggtggccgccaaccagacaggccgcctgtatgactgtgccgccgccaccggcatgtgccagcccatccccctgcacatccggcctgaggccgtgaacatgagcctgggcctgaccctggccgccagcaccaacggcagccggctgctggcctgtggccccaccctgcaccgggtgtgtggggagaacagctacagcaagggcagctgcctgctgctgggcagccgctgggagatcatccagacagtgcctgatgccaccccagaatgtccccaccaggagatggacatcgtgttcctgattgatggcagcggcagcattgaccagaatgacttcaaccagatgaagggctttgtgcaggccgtgatgggccagtttgagggcacagacaccctgtttgccctgatgcagtacagcaacctgctgaagatccacttcaccttcacccagttccgcaccagccccagccagcagagcctggtggaccccatcgtgcagctgaagggcctgaccttcaccgccaccggcatcctgactgtggtgacccagctgttccaccacaagaatggagccaggaagagcgccaagaagatcctgattgtcatcacagatggccagaagtacaaggaccccctggagtacagtgatgtgatcccccaggccgagaaggccggcatcatccgctatgccatcggcgtgggccacgccttccagggccccacagcccggcaggagctgaacaccatcagcagcgccccaccccaggaccacgtgttcaaggtggacaactttgctgccctgggcagcatccagaagcagctgcaggagaagatctatgctgtggagggcacccagagccgggccagcagcagcttccagcacgagatgagccaggagggcttcagcacagccctgaccatggatggcctcttcctgggcgctgtgggcagcttctcctggagcggcggggccttcctgtacccacccaacatgagccccaccttcatcaacatgagccaggagaatgtggacatgagggacagctacctgggctacagcacagagctggccctgtggaagggcgtgcagaacctggtgctgggcgccccccgctaccagcacacaggcaaggccgtcatcttcacccaggtgtcccggcagtggaggaagaaggccgaggtgacaggcacccagatcggcagctactttggagccagcctgtgcagcgtggatgtggacagtgatggcagcacagacctgatcctgattggagccccccactactatgagcagacccggggcggccaggtgtctgtgtgccccctgccccggggccgggtgcagtggcagtgtgatgctgtgctgcggggggagcagggccacccctggggccgctttggagctgccctgactgtgctgggagatgtgaatgaagacaagctgattgatgtggccatcggggcccctggagagcaggagaacagaggagctgtgtacctgttccacggggccagcgagagcggcatcagccccagccacagccagagaattgccagcagccagctgagcccccggctgcagtacttcggccaggccctgagcggcggccaggacctgacccaggacggcctgatggacctggccgtgggcgcccggggccaggtgctgctgctgcggagcctgcctgtgctgaaggtgggcgtggccatgaggttcagccctgtggaggtggccaaggctgtgtaccgctgctgggaggagaagcccagcgccctggaggccggagatgccaccgtgtgcctgaccatccagaagagcagcctggaccagctgggggacatccagagctctgtgcgctttgacctggccctggaccccggccgcctgaccagccgggccatcttcaatgagaccaagaaccccaccctgaccaggaggaagaccctgggcctgggcatccactgtgagaccctgaagctgctgctgcctgactgtgtggaggatgtggtgagccccatcatcctgcacctgaacttcagcctggtgcgggagcccatccccagcccccagaacctgcggcctgtgctggccgtgggcagccaggacctcttcaccgccagcctgccctttgagaagaactgtggccaggacggcctgtgtgagggggacctgggcgtgaccctgtccttcagcggcctgcagaccctgactgtgggcagcagcctggagctgaatgtgattgtgacagtgtggaatgctggagaagattcctatggcaccgtggtgtccctgtactacccagctggcctgagccacagaagagtgtctggggcccagaagcagccccaccagagcgccctgcggctggcctgtgaaacagtgcccacagaagatgagggcctgcggagcagccgctgcagcgtgaaccaccccatcttccacgagggcagcaatggcaccttcatcgtgacctttgatgtgtcctacaaggccaccctgggggacaggatgctgatgagggccagcgccagcagcgagaacaacaaggccagcagcagcaaggccaccttccagctggagctgcctgtgaagtatgctgtgtacaccatgatcagccggcaggaggagagcaccaagtacttcaactttgccaccagtgatgagaagaagatgaaggaggccgagcaccgctacagagtgaacaacctgagccagagggacctggccatcagcatcaacttctgggtgcctgtgctgctgaatggagtggccgtgtgggatgtggtgatggaggcccccagccagagcctgccctgtgtgtctgagaggaagccaccccagcacagcgacttcctgacccagatcagccgcagccccatgctggactgcagcattgctgactgcctgcagttccgctgtgatgtgcccagcttctctgtgcaggaggagctggacttcaccctgaagggcaacctgagctttggctgggtgcgggagaccctgcagaagaaggtgctggtggtgtctgtggccgagatcacctttgacacctctgtgtacagccagctgcccggccaggaggccttcatgagggcccagatggagatggtgctggaggaggatgaggtgtacaatgccatccccatcatcatgggcagctctgtgggcgccctgctgctgctggccctgatcacagccaccctgtacaagctgggcttcttcaagaggcactacaaggagatgctggaggacaagccagaggacacagccaccttctctggagatgacttcagctgtgtggccccaaatgtgcccctgtcctag

SEQ ID NO: 156171 - DNA, 3513 bp, Artificial Sequence
  Description of Artificial Sequence: Synthetic coding sequence
atgaaggacagctgcatcaccgtgatggccatggccctgctgagcggcttcttcttctttgccccagccagcagctacaacctggatgtgcggggggcccgctccttcagcccccccagggctggccgccacttcggctacagagtgctgcaggtgggcaatggagtgattgtgggcgcccctggagagggcaacagcacaggcagcctgtaccagtgccagagcggcaccggccactgcctgcctgtgaccctgcggggcagcaactacaccagcaagtacctgggcatgaccctggccacagaccccacagatggcagcatcctggcctgtgaccccggcctgagcaggacctgtgaccagaacacctacctgagcggcctgtgctacctgttccggcagaacctgcagggccccatgctgcagggccggcccggcttccaggagtgcatcaagggaaatgtggacctggtgttcctgtttgatggctccatgagcctgcagccagatgagttccagaagatcctggacttcatgaaggatgtgatgaagaagctgagcaacaccagctaccagtttgctgctgtgcagttcagcaccagctacaagacagaatttgacttcagtgactatgtgaagaggaaggaccctgatgccctgctgaagcacgtgaagcacatgctgctgctgaccaacaccttcggggccatcaactacgtggccacagaggtgttccgggaggagctgggcgcccggccagatgccaccaaggtgctgatcatcatcacagatggagaggccacagacagcggcaacattgatgctgccaaggacatcatccgctacatcatcggcatcggcaagcacttccagaccaaggagagccaggagaccctgcacaagtttgccagcaagccagccagcgagtttgtgaagatcctggacacctttgagaagctgaaggacctcttcacagagctgcagaagaagatctacgtgattgagggcaccagcaagcaggacctgaccagcttcaacatggagctgagcagcagcggcatctctgctgacctgagccggggccatgctgtggtgggcgctgtgggcgccaaggactgggccggcggcttcctggacctgaaggctgacctgcaggatgacaccttcatcggaaatgagcccctgaccccagaggtgcgggccggctacctgggctacacagtgacctggctgcccagccggcagaagaccagcctgctggccagcggggccccccgctaccagcacatgggccgggtgctgctcttccaggagccccagggcggcggccactggagccaggtgcagaccatccacggcacccagatcggcagctactttggaggagagctgtgtggggtggatgtggaccaggatggagaaacagagctgctgctgattggagcccccctcttctacggggagcagagaggaggccgggtcttcatctaccagaggcggcagctgggctttgaggaggtgtctgagctgcagggcgaccccggctaccccctgggccgctttggagaggccatcacagccctgacagacatcaatggagatggcctggtggatgtggccgtgggcgcccccctggaggagcagggcgctgtgtacatcttcaacggccgccacggcggcctgagcccccagcccagccagagaattgagggcacccaggtgctgagcggcatccagtggtttggccgcagcatccacggcgtgaaggacctggagggagatggcctggctgatgtggccgtgggcgctgagagccagatgattgtgctgagcagcaggcctgtggtggacatggtgaccctgatgtccttcagccctgctgagatccctgtgcatgaggtggagtgcagctacagcaccagcaacaagatgaaggagggcgtgaacatcaccatctgcttccagatcaagagcctcatcccccagttccagggccgcctggtggccaacctgacctacaccctgcagctggatggccacaggacccggcggcggggcctcttccctgggggcagacatgagctgcggagaaatattgctgtgaccacctccatgagctgcacagacttctccttccacttccctgtgtgtgtgcaggacctgatcagccccatcaacgtgtccctgaacttcagcctgtgggaggaggagggcaccccccgggaccagagggcccagggcaaggacatcccccccatcctgcggcccagcctgcacagcgagacctgggagatcccctttgagaagaactgtggggaggacaagaagtgtgaggccaacctgcgggtgtccttctccccagcccggagccgggccctgcggctgacagcctttgccagcctgtctgtggagctgagcctgagcaacctggaggaggatgcctactgggtgcagctggacctgcacttccccccaggcctgtccttcaggaaggtggagatgctgaagccccacagccagatccctgtgtcctgtgaggagctgcctgaggagagccggctgctgagccgggccctgagctgcaatgtgagcagccccatcttcaaggccggccacagcgtggccctgcagatgatgttcaacaccctggtgaacagctcctggggagacagcgtggagctgcacgccaacgtgacctgcaacaatgaagattctgacctgctggaggacaacagcgccaccaccatcatccccatcctgtaccccatcaacatcctgatccaggaccaggaggacagcaccctgtatgtgtccttcacccccaagggccccaagatccaccaggtgaagcacatgtaccaggtgcgcatccagcccagcatccatgaccacaacatccccaccctggaggccgtggtgggcgtgccccagccccccagcgagggccccatcacccaccagtggagcgtgcagatggagccccctgtgccctgccactatgaggacctggagcggctgcctgatgctgctgagccctgcctgcccggggccctcttccgctgccctgtggtgttccggcaggagatcctggtgcaggtgattggcaccctggagctggtgggggagattgaggccagctccatgttcagcctgtgcagcagcctgagcatctccttcaacagcagcaagcacttccacctgtatggcagcaatgccagcctggcccaggtggtgatgaaggtggatgtggtgtatgagaagcagatgctgtacctgtatgtgctgagcggcatcggcggcctgctgctgctgctgctgatcttcatcgtgctgtacaaggtgggcttcttcaagaggaacctgaaggagaagatggaggccggccggggcgtgcccaacggcatcccagctgaggacagcgagcagctggccagcggccaggaggccggggaccccggctgcctgaagcccctgcacgagaaggacagcgagagcggcggcggcaaggactag

SEQ ID NO: 156172 - DNA, 3261 bp, Artificial Sequence
  Description of Artificial Sequence: Synthetic coding sequence
atgaaggacagctgcatcaccgtgatggccatggccctgctgagcggcttcttcttctttgccccagccagcagctacaacctggatgtgcggggggcccgctccttcagcccccccagggctggccgccacttcggctacagagtgctgcaggtgggcaatggagtgattgtgggcgcccctggagagggcaacagcacaggcagcctgtaccagtgccagagcggcaccggccactgcctgcctgtgaccctgcggggcagcaactacaccagcaagtacctgggcatgaccctggccacagaccccacagatggcagcatcctgtttgctgctgtgcagttcagcaccagctacaagacagaatttgacttcagtgactatgtgaagaggaaggaccctgatgccctgctgaagcacgtgaagcacatgctgctgctgaccaacacctttggagccatcaactacgtggccacagaggtgttccgggaggagctgggcgcccggccagatgccaccaaggtgctgatcatcatcacagatggagaggccacagattctggcaacattgatgctgccaaggacatcatccgctacatcattggaattggcaagcacttccagaccaaggagagccaggagaccctgcacaagtttgccagcaagccagccagcgagtttgtgaagatcctggacacctttgagaagctgaaggacctcttcacagagctgcagaagaagatctacgtgattgagggcaccagcaagcaggacctgaccagcttcaacatggagctgagcagcagcggcatctctgctgacctgagccggggccatgctgtggtgggcgctgtgggcgccaaggactgggccggcggcttcctggacctgaaggctgacctgcaggatgacaccttcatcggaaatgagcccctgaccccagaggtgcgggccggctacctgggctacacagtgacctggctgcccagccggcagaagaccagcctgctggccagcggggccccccgctaccagcacatgggccgggtgctgctcttccaggagccccagggcggcggccactggagccaggtgcagaccatccacggcacccagatcggcagctactttggaggagagctgtgtggggtggatgtggaccaggatggagaaacagagctgctgctgattggagcccccctcttctatggagagcagaggggcggccgggtcttcatctaccagaggcggcagctgggctttgaggaggtgtctgagctgcagggcgaccccggctaccccctgggccgctttggagaggccatcacagccctgacagacatcaatggagatggcctggtggatgtggccgtgggcgcccccctggaggagcagggcgctgtgtacatcttcaacggcagacatggaggcctgagcccccagcccagccagagaattgagggcacccaggtgctgagcggcatccagtggtttggccgcagcatccatggagtgaaggacctggagggagatggcctggctgatgtggccgtgggcgctgagagccagatgattgtgctgagcagcaggcctgtggtggacatggtgaccctgatgtccttctccccagctgagatccctgtgcatgaggtggagtgcagctacagcaccagcaacaagatgaaggagggcgtgaacatcaccatctgcttccagatcaagagcctcatcccccagttccagggccgcctggtggccaacctgacctacaccctgcagctggatggccacaggaccaggagaagaggcctcttccctgggggcagacatgagctgcggaggaacattgctgtgaccacctccatgagctgcacagacttctccttccacttccctgtgtgtgtgcaggacctgatcagccccatcaacgtgtccctgaacttcagcctgtgggaggaggagggcaccccccgggaccagagagctgggaaggacatcccccccatcctgcggcccagcctgcacagcgagacctgggagatcccctttgagaagaactgtggggaggacaagaagtgtgaggccaacctgcgggtgtccttctccccagcccggagccgggccctgcggctgacagcctttgccagcctgtctgtggagctgagcctgagcaacctggaggaggatgcctactgggtgcagctggacctgcacttccccccaggcctgtccttcaggaaggtggagatgctgaagccccacagccagatccctgtgtcctgtgaggagctgcctgaggagagccggctgctgagccgggccctgagctgcaatgtgagcagccccatcttcaaggccggccacagcgtggccctgcagatgatgttcaacaccctggtgaacagctcctggggagacagcgtggagctgcacgccaacgtgacctgcaacaatgaagattctgacctgctggaggacaacagcgccaccaccatcatccccatcctgtaccccatcaacatcctgatccaggaccaggaggacagcaccctgtatgtgtccttcacccccaagggccccaagatccaccaggtgaagcacatgtaccaggtgcgcatccagcccagcatccatgaccacaacatccccaccctggaggccgtggtgggcgtgccccagccccccagcgagggccccatcacccaccagtggagcgtgcagatggagccccctgtgccctgccactatgaggacctggagcggctgcctgatgctgctgagccctgcctgcccggggccctcttccgctgccctgtggtgttccggcaggagatcctggtgcaggtgattggcaccctggagctggtgggggagattgaggccagctccatgttcagcctgtgcagcagcctgagcatctccttcaacagcagcaagcacttccacctgtatggcagcaatgccagcctggcccaggtggtgatgaaggtggatgtggtgtatgagaagcagatgctgtacctgtatgtgctgagcggcatcggcggcctgctgctgctgctgctgatcttcatcgtgctgtacaaggtgggcttcttcaagaggaacctgaaggagaagatggaggccggccggggcgtgcccaacggcatcccagctgaggacagcgagcagctggccagcggccaggaggccggggaccccggctgcctgaagcccctgcacgagaaggacagcgagagcggcggcggcaaggactag

SEQ ID NO: 156173 - DNA, 1215 bp, Artificial Sequence
  Description of Artificial Sequence: Synthetic coding sequence
atgaaggacagctgcatcaccgtgatggccatggccctgctgagcggcttcttcttctttgccccagccagcagctacaacctggatgtgcggggggcccgctccttcagcccccccagggctggccgccacttcggctacagagtgctgcagatcaagagcctcatcccccagttccagggccgcctggtggccaacctgacctacaccctgcagctggatggccacaggacccggcggcggggcctcttccctgggggcagacatgagctgcggagaaatattgctgtgaccacctccatgagctgcacagacttctccttccacttccccatgatgttcaacaccctggtgaacagctcctggggagacagcgtggagctgcacgccaacgtgacctgcaacaatgaagattctgacctgctggaggacaacagcgccaccaccatcatccccatcctgtaccccatcaacatcctgatccaggaccaggaggacagcaccctgtatgtgtccttcacccccaagggccccaagatccaccaggtgaagcacatgtaccaggtgcgcatccagcccagcatccatgaccacaacatccccaccctggaggccgtggtgggcgtgccccagccccccagcgagggccccatcacccaccagtggagcgtgcagatggagccccctgtgccctgccactatgaggacctggagcggctgcctgatgctgctgagccctgcctgcccggggccctcttccgctgccctgtggtgttccggcaggagatcctggtgcaggtgattggcaccctggagctggtgggggagattgaggccagctccatgttcagcctgtgcagcagcctgagcatctccttcaacagcagcaagcacttccacctgtatggcagcaatgccagcctggcccaggtggtgatgaaggtggatgtggtgtatgagaagcagatgctgtacctgtatgtgctgagcggcatcggcggcctgctgctgctgctgctgatcttcatcgtgctgtacaaggtgggcttcttcaagaggaacctgaaggagaagatggaggccggccggggcgtgcccaacggcatcccagctgaggacagcgagcagctggccagcggccaggaggccggggaccccggctgcctgaagcccctgcacgagaaggacagcgagagcggcggcggcaaggactag

SEQ ID NO: 156174 - DNA, 489 bp, Artificial Sequence
  Description of Artificial Sequence: Synthetic coding sequence
atgaaggacagctgcatcaccgtgatggccatggccctgctgagcggcttcttcttctttgccccagccagcagctacaacctggatgtgcggggggcccgctccttcagcccccccagggctggccgccacttcggctacagagtgctgcaggtgggcaatggagtgattgtgggcgcccctggagagggcaacagcacaggcagcctgtaccagtgccagagcggcaccggccactgcctgcctgtgaccctgcggggcagcaactacaccagcaagtacctgggcatgaccctggccacagaccccacagatggcagcatcctggcctgtgaccccggcctgagcaggacctgtgaccagaacacctacctgagcggcctgtgctacctgttccggcagaacctgcagggccccatgctgcagggccggcccggcttccaggtgtgctgctgcagcgtcttccacaagctgcagaaccgcatctag

SEQ ID NO: 156175 - DNA, 3459 bp, Artificial Sequence
  Description of Artificial Sequence: Synthetic coding sequence
atggccctgcgggtgctgctgctgacagccctgaccctgtgccacggcttcaacctggacacagaaaatgccatgaccttccaggagaatgcccggggcttcggccagagcgtggtgcagctgcagggcagccgggtggtggtgggcgccccccaggagatcgtggccgccaaccagaggggcagcctgtaccagtgtgactacagcacaggcagctgtgagcccatccggctgcaggtgcctgtggaggccgtgaacatgagcctgggcctgagcctggccgccaccaccagccccccccagctgctggcctgtggccccaccgtgcaccagacctgcagcgagaacacctacgtgaagggcctgtgcttcctgtttggcagcaacctgcggcagcagccccagaagtttcctgaggccctgcggggctgcccccaggaggacagcgacatcgccttcctgattgatggcagcggcagcatcatcccccatgacttccggaggatgaaggagtttgtgtccacagtgatggagcagctgaagaagagcaagaccctcttcagcctgatgcagtacagcgaggagttccgcatccacttcaccttcaaggagttccagaacaaccccaaccccaggagcctggtgaagcccatcacccagctgctgggccgcacccacacagccaccggcatcaggaaggtggtgcgggagctgttcaacatcaccaatggagccaggaagaatgccttcaagatcctggtggtgatcacagatggagagaagtttggagaccccctgggctatgaagatgtgattcctgaggccgaccgggagggcgtcatccgctacgtgattggagtgggagatgccttccgctctgagaagagccggcaggagctgaacaccatcgccagcaagccaccccgggaccacgtgttccaggtgaacaactttgaggccctgaagaccatccagaaccagctgcgggagaagatctttgccatcgagggcacccagacaggcagcagcagcagctttgagcacgagatgagccaggagggcttctctgctgccatcaccagcaatggccccctgctgagcacagtgggcagctatgactgggccggcggcgtcttcctgtacaccagcaaggagaagagcaccttcatcaacatgaccagggtggacagcgacatgaatgatgcctacctgggctatgctgctgccatcatcctgaggaacagagtgcagagcctggtgctgggcgccccccgctaccagcacatcggcctggtggccatgttccggcagaacacaggcatgtgggagagcaatgccaacgtgaagggcacccagattggagcctactttggagccagcctgtgcagcgtggatgtggacagcaatggcagcacagacctggtgctgattggagccccccactactatgagcagacccggggcggccaggtgtctgtgtgccccctgccccggggccgggcccgctggcagtgtgatgctgtgctgtatggagagcagggccagccctggggccgctttggagctgccctgactgtgctgggagatgtgaatggagacaagctgacagatgtggccatcggggcccctggagaggaggacaacagaggagctgtgtacctgttccacggcaccagcggcagcggcatcagccccagccacagccagagaattgctggcagcaagctgagcccccggctgcagtacttcggccagagcctgagcggcggccaggacctgaccatggatggcctggtggacctgactgtgggcgcccagggccacgtgctgctgctgcggagccagcctgtgctgcgggtgaaggccatcatggagttcaacccccgggaggtggccagaaatgtgtttgaatgtaatgaccaggtggtgaagggcaaggaggccggggaggtgcgggtgtgcctgcacgtgcagaagagcacccgggaccggctgcgggagggccagatccagagcgtggtgacctatgacctggccctggacagcggccggccccacagcagagctgtgttcaatgagaccaagaacagcacccggcggcagacccaggtgctgggcctgacccagacctgtgagaccctgaagctgcagctgcccaactgcattgaagatcctgtgagccccatcgtgctgcggctgaacttcagcctggtgggcacccccctgagcgcctttggaaacctgcggcctgtgctggccgaggatgcccagaggctcttcaccgccctcttcccctttgagaagaactgtggaaatgacaacatctgccaggatgacctgagcatcaccttctccttcatgagcctggactgcctggtggtgggcggcccccgggagttcaacgtgacagtgacagtgagaaatgatggagaagattcctaccgcacccaggtgaccttcttcttccccctggacctgagctacaggaaggtgtccaccctgcagaaccagaggagccagaggtcctggaggctggcctgtgagagcgccagcagcacagaggtgtctggggccctgaagagcaccagctgcagcatcaaccaccccatcttcccagaaaattctgaggtgaccttcaacatcacctttgatgtggacagcaaggccagcctgggcaacaagctgctgctgaaggccaacgtgaccagcgagaacaacatgcccaggaccaacaagacagagttccagctggagctgcctgtgaagtatgctgtgtacatggtggtgaccagccacggcgtgtccaccaagtacctgaacttcaccgccagcgagaacaccagccgggtgatgcagcaccagtaccaggtgagcaacctgggccagaggagcctgcccatcagcctggtgttcctggtgcctgtgcggctgaaccagaccgtcatctgggaccggccccaggtgaccttcagcgagaacctgagcagcacctgccacaccaaggagcggctgcccagccacagcgacttcctggccgagctgaggaaggcccctgtggtgaactgcagcattgctgtgtgccagaggatccagtgtgacatccccttcttcggcatccaggaggagttcaatgccaccctgaagggcaacctgagctttgactggtacatcaagaccagccacaaccacctgctgattgtgtccacagctgagatcctcttcaatgattctgtgttcaccctgctgcccggccagggcgcctttgtgcgcagccagacagagaccaaggtggagccctttgaggtgcccaaccccctgcccctgattgtgggcagctctgtgggcggcctgctgctgctggccctgatcacagctgccctgtacaagctgggcttcttcaagaggcagtacaaggacatgatgtctgagggcggccccccaggagctgagccccagtag

SEQ ID NO: 156176 - DNA, 3462 bp, Artificial Sequence
  Description of Artificial Sequence: Synthetic coding sequence
atggccctgcgggtgctgctgctgacagccctgaccctgtgccacggcttcaacctggacacagaaaatgccatgaccttccaggagaatgcccggggcttcggccagagcgtggtgcagctgcagggcagccgggtggtggtgggcgccccccaggagatcgtggccgccaaccagaggggcagcctgtaccagtgtgactacagcacaggcagctgtgagcccatccggctgcaggtgcctgtggaggccgtgaacatgagcctgggcctgagcctggccgccaccaccagccccccccagctgctggcctgtggccccaccgtgcaccagacctgcagcgagaacacctacgtgaagggcctgtgcttcctgtttggcagcaacctgcggcagcagccccagaagtttcctgaggccctgcggggctgcccccaggaggacagcgacatcgccttcctgattgatggcagcggcagcatcatcccccatgacttccggaggatgaaggagtttgtgtccacagtgatggagcagctgaagaagagcaagaccctcttcagcctgatgcagtacagcgaggagttccgcatccacttcaccttcaaggagttccagaacaaccccaaccccaggagcctggtgaagcccatcacccagctgctgggccgcacccacacagccaccggcatcaggaaggtggtgcgggagctgttcaacatcaccaatggagccaggaagaatgccttcaagatcctggtggtgatcacagatggagagaagtttggagaccccctgggctatgaagatgtgattcctgaggccgaccgggagggcgtcatccgctacgtgattggagtgggagatgccttccgctctgagaagagccggcaggagctgaacaccatcgccagcaagccaccccgggaccacgtgttccaggtgaacaactttgaggccctgaagaccatccagaaccagctgcgggagaagatctttgccatcgagggcacccagacaggcagcagcagcagctttgagcacgagatgagccaggagggcttctctgctgccatcaccagcaatggccccctgctgagcacagtgggcagctatgactgggccggcggcgtcttcctgtacaccagcaaggagaagagcaccttcatcaacatgaccagggtggacagcgacatgaatgatgcctacctgggctatgctgctgccatcatcctgaggaacagagtgcagagcctggtgctgggcgccccccgctaccagcacatcggcctggtggccatgttccggcagaacacaggcatgtgggagagcaatgccaacgtgaagggcacccagattggagcctactttggagccagcctgtgcagcgtggatgtggacagcaatggcagcacagacctggtgctgattggagccccccactactatgagcagacccggggcggccaggtgtctgtgtgccccctgccccggggccagagggcccgctggcagtgtgatgctgtgctgtatggagagcagggccagccctggggccgctttggagctgccctgactgtgctgggagatgtgaatggagacaagctgacagatgtggccatcggggcccctggagaggaggacaacagaggagctgtgtacctgttccacggcaccagcggcagcggcatcagccccagccacagccagagaattgctggcagcaagctgagcccccggctgcagtacttcggccagagcctgagcggcggccaggacctgaccatggatggcctggtggacctgactgtgggcgcccagggccacgtgctgctgctgcggagccagcctgtgctgcgggtgaaggccatcatggagttcaacccccgggaggtggccagaaatgtgtttgagtgcaatgaccaggtggtgaagggcaaggaggccggggaggtgcgggtgtgcctgcacgtgcagaagagcacccgggaccggctgcgggagggccagatccagagcgtggtgacctatgacctggccctggacagcggccggccccacagcagagctgtgttcaatgagaccaagaacagcacccggcggcagacccaggtgctgggcctgacccagacctgtgagaccctgaagctgcagctgcccaactgcatcgaggaccctgtgagccccatcgtgctgcggctgaacttcagcctggtgggcacccccctgagcgccttcggcaacctgcggcctgtgctggctgaagatgcccagaggctcttcaccgccctcttcccctttgagaagaactgtggaaatgacaacatctgccaggatgacctgagcatcaccttctccttcatgagcctggactgcctggtggtgggcggcccccgggagttcaacgtgacagtgacagtgagaaatgatggagaggacagctaccgcacccaggtgaccttcttcttccccctggacctgagctacaggaaggtgtccaccctgcagaaccagaggagccagaggtcctggaggctggcctgtgagagcgccagcagcacagaggtgtctggggccctgaagagcaccagctgcagcatcaaccaccccatcttccctgagaacagcgaggtgaccttcaacatcacctttgatgtggacagcaaggccagcctgggcaacaagctgctgctgaaggccaacgtgaccagcgagaacaacatgcccaggaccaacaagacagagttccagctggagctgcctgtgaagtatgctgtgtacatggtggtgaccagccatggagtgtccaccaagtacctgaacttcaccgccagcgagaacaccagccgggtgatgcagcaccagtaccaggtgagcaacctgggccagaggagcctgcccatcagcctggtgttcctggtgcctgtgcggctgaaccagaccgtcatctgggaccggccccaggtgaccttcagcgagaacctgagcagcacctgccacaccaaggagcggctgcccagccacagcgacttcctggccgagctgaggaaggcccctgtggtgaactgcagcattgctgtgtgccagaggatccagtgtgacatccccttcttcggcatccaggaggagttcaatgccaccctgaagggcaacctgagctttgactggtacatcaagaccagccacaaccacctgctgattgtgtccacagctgagatcctcttcaatgacagcgtcttcaccctgctgcccggccagggcgcctttgtgcgcagccagacagagaccaaggtggagccctttgaggtgcccaaccccctgcccctcatcgtgggcagctctgtgggcggcctgctgctgctggccctgatcacagctgccctgtacaagctgggcttcttcaagaggcagtacaaggacatgatgtctgagggcggccccccaggagctgagccccagtag

SEQ ID NO: 156177 - DNA, 3492 bp, Artificial Sequence
  Description of Artificial Sequence: Synthetic coding sequence
atgaccaggacccgggccgccctgctgctcttcaccgccctggccaccagcctgggcttcaacctggacacagaggagctgacagccttccgggtggacagcgctggctttggagacagcgtggtgcagtatgccaacagctgggtggtggtgggcgccccccagaagatcacagctgccaaccagacaggaggcctgtaccagtgtggctacagcactggagcctgtgagcccatcggcctgcaggtgcccccagaggccgtgaacatgagcctgggcctgagcctggccagcaccaccagccccagccagctgctggcctgtggccccaccgtgcaccatgaatgtggcaggaacatgtacctgaccggcctgtgcttcctgctgggccccacccagctgacccagaggctgcctgtgtcccggcaggagtgcccccggcaggagcaggacatcgtgttcctgattgatggcagcggcagcatcagcagcaggaactttgccaccatgatgaactttgtgcgggccgtcatcagccagttccagaggcccagcacccagttcagcctgatgcagttcagcaacaagttccagacccacttcacctttgaggagttcagaagaagcagcaaccccctgagcctgctggcctctgtgcaccagctgcagggcttcacctacacagccacagccatccagaatgtggtgcacaggctcttccacgccagctatggagccaggagagatgctgccaagatcctgattgtcatcacagatggcaagaaggagggggacagcctggactacaaggatgtgatccccatggctgatgctgctggcatcatccgctatgccatcggcgtgggcctggccttccagaacagaaattcctggaaggagctgaatgacatcgccagcaagcccagccaggagcacatcttcaaggtggaggactttgatgccctgaaggacatccagaaccagctgaaggagaagatctttgccatcgagggcacagagaccaccagcagcagcagctttgagctggagatggcccaggagggcttctctgctgtgttcaccccagatggccctgtgctgggcgctgtgggcagcttcacctggagcggcggggccttcctgtacccacccaacatgagccccaccttcatcaacatgagccaggagaatgtggacatgagggacagctacctgggctacagcacagagctggccctgtggaagggcgtgcagagcctggtgctgggcgccccccgctaccagcacacaggcaaggctgtgatcttcacccaggtgtcccggcagtggaggatgaaggccgaggtgacaggcacccagatcggcagctactttggagccagcctgtgcagcgtggatgtggacagtgatggcagcacagacctggtgctgattggagccccccactactatgagcagacccggggcggccaggtgtctgtgtgccccctgccccggggctggaggcgctggtggtgtgatgctgtgctgtatggagagcagggccacccctggggccgctttggagctgccctgactgtgctgggagatgtgaatggagacaagctgacagatgtggtgattggagcccctggagaggaggagaacagaggagctgtgtacctgttccatggagtgctgggccccagcatcagccccagccacagccagagaattgctggcagccagctgagcagccggctgcagtacttcggccaggccctgagcggcggccaggacctgacccaggacggcctggtggacctggccgtgggcgcccggggccaggtgctgctgctgcggaccaggcctgtgctgtgggtgggcgtgtccatgcagttcatcccagctgagatccccaggtctgcctttgagtgccgggagcaggtggtgtctgagcagaccctggtgcagagcaacatctgcctgtacatcgacaagaggagcaagaacctgctgggcagccgggacctgcagagctctgtgaccctggacctggccctggaccccggccgcctgagcccccgggccaccttccaggagaccaagaacagaagcctgagccgggtgcgggtgctgggcctgaaggcccactgtgagaacttcaacctgctgctgcccagctgtgtggaggacagcgtgacccccatcaccctgcggctgaacttcaccctggtgggcaagcccctgctggccttcaggaacctgcggcccatgctggccgcagatgcccagcgctacttcaccgccagcctgccctttgagaagaactgtggggctgaccacatctgccaggacaacctgggcatctccttctccttccctggcctgaagagcctgctggtgggcagcaacctggagctgaatgctgaggtgatggtgtggaatgatggagaggacagctatggcaccaccatcaccttcagccaccctgctggcctgagctaccgctacgtggccgagggccagaagcagggccagctgcggagcctgcacctgacctgtgacagcgcccctgtgggcagccagggcacctggagcaccagctgccgcatcaaccacctgatcttccggggcggggcccagatcaccttcctggccacctttgatgtgagccccaaggctgtgctgggggaccggctgctgctgacagccaacgtgtcctctgagaacaacacccccaggaccagcaagaccaccttccagctggagctgcctgtgaagtatgctgtgtacacagtggtgagcagccatgagcagttcaccaagtacctgaacttcagcgagagcgaggagaaggagagccacgtggccatgcaccgctaccaggtgaacaacctgggccagagggacctgcctgtgtccatcaacttctgggtgcctgtggagctgaaccaggaggccgtgtggatggatgtggaggtgagccacccccagaaccccagcctgcgctgcagcagcgagaagatcgcccccccagccagtgacttcctggcccacatccagaagaaccctgtgctggactgcagcattgctggctgcctgcgcttccgctgtgatgtgcccagcttctctgtgcaggaggagctggacttcaccctgaagggcaacctgagctttggctgggtgcggcagatcctgcagaagaaggtgtctgtggtgtctgtggccgagatcacctttgacacctctgtgtacagccagctgcccggccaggaggccttcatgagggcccagaccaccaccgtgctggagaagtacaaggtgcacaaccccacccccctgattgtgggcagcagcatcggcggcctgctgctgctggccctgatcacagctgtgctgtacaaggtgggcttcttcaagaggcagtacaaggagatgatggaggaggccaacggccagatcgccccagaaaatggcacccagacccccagccccccatctgagaagtag

SEQ ID NO: 156178 - DNA, 5469 bp, Artificial Sequence
  Description of Artificial Sequence: Synthetic coding sequence
atggccggcccccggcccagcccctgggcccggctgctgctggccgccctgatctctgtgtccctgagcggcaccctggccaaccgctgcaagaaggcccctgtgaagagctgcacagaatgtgtgcgggtggacaaggactgtgcctactgcacagatgagatgttccgggaccggcgctgcaacacccaggccgagctgctggccgccggctgccagcgggagagcatcgtggtgatggagagcagcttccagatcacagaggagacccagattgacaccaccctgcggcgcagccagatgagcccccagggcctgcgggtgcggctgcggcctggagaggagcggcactttgagctggaggtgtttgagcccctggagagccctgtggacctgtacatcctgatggacttcagcaacagcatgtctgatgacctggacaacctgaagaagatgggccagaacctggcccgggtgctgagccagctgaccagtgactacaccatcggctttgggaagtttgtggacaaggtgtctgtgccccagacagacatgaggcctgagaagctgaaggagccctggcccaacagcgacccccccttctccttcaagaatgtcatcagcctgacagaagatgtggatgagttcaggaacaagctgcagggcgagcgcatcagcggcaacctggatgcccctgagggcggctttgatgccatcctgcagacagctgtgtgcacccgggacatcggctggaggccagacagcacccacctgctggtgttcagcacagaaagtgccttccactatgaagcagatggagccaacgtgctggccggcatcatgagcagaaatgatgagcgctgccacctggacaccaccggcacctacacccagtaccgcacccaggactaccccagcgtgcccaccctggtgcggctgctggccaagcacaacatcatccccatctttgctgtgaccaactacagctacagctactatgagaagctgcacacctacttccctgtgagcagcctgggcgtgctgcaggaggacagcagcaacatcgtggagctgctggaggaggccttcaaccgcatccgcagcaacctggacatccgggccctggacagcccccggggcctgaggacagaggtgaccagcaagatgttccagaagaccaggacaggcagcttccacatcagaagaggagaggtgggcatctaccaggtgcagctgcgggccctggagcacgtggatggcacccacgtgtgccagctgcctgaggaccagaagggcaacatccacctgaagcccagcttcagtgatggcctgaagatggatgctggcatcatctgtgatgtgtgcacctgtgagctgcagaaggaggtgcgcagcgcccgctgcagcttcaatggagactttgtgtgtggccagtgtgtgtgcagcgagggctggagcggccagacctgcaactgcagcacaggcagcctgagtgacatccagccctgcctgcgggagggggaggacaagccctgcagcggcagaggagagtgccagtgtggccactgtgtgtgctacggggagggccgctatgagggccagttctgtgaatatgacaacttccagtgccccaggaccagcggcttcctgtgcaatgaccggggccgctgcagcatgggccagtgtgtgtgtgagcccggctggacaggccccagctgtgactgccccctgagcaatgccacctgcatcgacagcaatggaggcatctgcaatggccggggccactgtgaatgtggccgctgccactgccaccagcagagcctgtacacagacaccatctgtgagatcaactacagcgccatccaccctggcctgtgtgaggacctgcggagctgtgtgcagtgccaggcctggggcaccggggagaagaagggccgcacctgtgaggagtgcaacttcaaggtgaagatggtggatgagctgaagagagctgaggaggtggtggtgcgctgcagcttcagagatgaagatgatgactgcacctacagctacaccatggagggagatggagcccctggccccaacagcacagtgctggtgcacaagaagaaggactgccccccaggcagcttctggtggctgatccccctgctgctgctgctgctgcccctgctggccctgctgctgctgctgtgctggaagtactgtgcctgctgcaaggcctgcctggccctgctgccctgctgcaacagaggccacatggtgggcttcaaggaggaccactacatgctgcgggagaacctgatggccagtgaccacctggacacccccatgctgcggagcggcaacctgaagggcagagatgtggtgcgctggaaggtgaccaacaacatgcagaggcctggctttgccacccatgctgccagcatcaaccccacagagctggtgccctacggcctgagcctgcggctggcccggctgtgcacagagaacctgctgaagccagacaccagagaatgtgcccagctgcggcaggaggtggaggagaacctgaatgaggtgtaccggcagatctctggagtgcacaagctgcagcagaccaagttccggcagcagcccaatgccggcaagaagcaggaccacaccatcgtggacacagtgctgatggcccccaggtctgccaagccagccctgctgaagctgacagagaagcaggtggagcagagggccttccatgacctgaaggtggcccctggctactacaccctgacagctgaccaggatgcccggggcatggtggagttccaggagggcgtggagctggtggatgtgcgggtgcccctcttcatccggccagaagatgatgatgagaagcagctgctggtggaggccattgatgtgcctgctggaacagccaccctgggccggcggctggtgaacatcaccatcatcaaggagcaggccagagatgtggtgtcctttgagcagcctgagttctctgtgtccagaggagaccaggtggcccgcatccctgtgatccggcgggtgctggatggcggcaagagccaggtgtcctaccgcacccaggacggcacagcccagggcaacagagactacatccctgtggagggggagctgctcttccagcccggggaggcctggaaggagctgcaggtgaagctgctggagctgcaggaggtggacagcctgctgcggggccggcaggtgcggcgcttccacgtgcagctgagcaaccccaagtttggagcccacctgggccagccccacagcaccaccatcatcatccgggaccctgatgagctggaccgctccttcaccagccagatgctgagcagccagcccccaccccacggggacctgggcgccccccagaaccccaatgccaaggccgccggcagcaggaagatccacttcaactggctgcccccatctgggaagcccatgggctacagagtgaagtactggatccagggcgacagcgagagcgaggcccacctgctggacagcaaggtgcccagcgtggagctgaccaacctgtacccctactgtgactatgagatgaaggtgtgtgcctatggagcccagggcgagggcccctacagcagcctggtgtcctgcaggacccaccaggaggtgcccagcgagcccggccgcctggccttcaacgtggtgagcagcacagtgacccagctgtcctgggccgagcctgctgagaccaatggagagatcacagcctatgaggtgtgctacggcctggtgaatgatgacaaccggcccatcggccccatgaagaaggtgctggtggacaaccccaagaacaggatgctgctgattgagaacctgcgggagagccagccctaccgctacacagtgaaggccagaaatggagctggctggggccctgagcgggaggccatcatcaacctggccacccagcccaagaggcccatgagcatccccatcatcccagacatccccatcgtggatgcccagagcggagaagattatgacagcttcctgatgtacagtgatgatgtgctgcggagccccagcggcagccagaggcccagcgtgtctgatgacaccggctgcggctggaagtttgagcccctgctgggggaggagctggacctgcggcgggtgacctggaggctgcccccagagctgatcccccggctgagcgccagcagcggccgcagcagtgatgctgaggccccccacggccccccagatgatggaggagctgggggcaaaggaggcagcctgcccaggtctgccaccccaggccccccaggagagcacctggtgaatggccgcatggactttgccttccctggcagcaccaacagcctgcacaggatgaccaccaccagcgctgctgcctacggcacccacctgagcccccacgtgccccaccgggtgctgagcaccagcagcaccctgacccgggactacaacagcctgaccaggtctgagcacagccacagcaccaccctgccccgggactacagcaccctgacctctgtgagcagccatgacagccggctgacagctggggtgcctgacacccccacccggctggtgttttctgccctgggccccaccagcctgcgggtgtcctggcaggagccccgctgtgagcggcccctgcagggctacagcgtggagtaccagctgctgaatggaggagagctgcaccggctgaacatccccaacccagcccagacctctgtggtggtggaggacctgctgcccaaccacagctatgtgttccgggtgcgggcccagagccaggagggctggggccgggagcgggagggcgtcatcaccatcgagagccaggtgcacccccagagccccctgtgccccctgcccggcagcgccttcaccctgagcacccccagcgcccctggccccctggtgttcaccgccctgagcccagacagcctgcagctgtcctgggagcggccccggcggcccaacggggacatcgtgggctacctggtgacctgtgagatggcccagggcggcggccctgccacagccttccgggtggatggagacagccctgagagccggctgactgtgcccggcctgtctgaaaatgtgccctacaagttcaaggtgcaggcccggaccacagagggcttcggccctgagcgggagggcatcatcaccatcgagagccaggacggcggccccttcccccagctgggcagcagagctggcctcttccagcaccccctgcagagcgagtacagcagcatcaccaccacccacaccagcgccacagagcccttcctggtggatggcctgaccctgggcgcccagcacctggaggccggcggcagcctgaccaggcatgtgacccaggagtttgtgtccaggaccctgaccaccagcggcaccctgagcacccacatggaccagcagttcttccagacctag

SEQ ID NO: 156179 - DNA, 5418 bp, Artificial Sequence
  Description of Artificial Sequence: Synthetic coding sequence
atggccggcccccggcccagcccctgggcccggctgctgctggccgccctgatctctgtgtccctgagcggcaccctggccaaccgctgcaagaaggcccctgtgaagagctgcacagaatgtgtgcgggtggacaaggactgtgcctactgcacagatgagatgttccgggaccggcgctgcaacacccaggccgagctgctggccgccggctgccagcgggagagcatcgtggtgatggagagcagcttccagatcacagaggagacccagattgacaccaccctgcggcgcagccagatgagcccccagggcctgcgggtgcggctgcggcctggagaggagcggcactttgagctggaggtgtttgagcccctggagagccctgtggacctgtacatcctgatggacttcagcaacagcatgtctgatgacctggacaacctgaagaagatgggccagaacctggcccgggtgctgagccagctgaccagtgactacaccatcggctttgggaagtttgtggacaaggtgtctgtgccccagacagacatgaggcctgagaagctgaaggagccctggcccaacagcgacccccccttctccttcaagaatgtcatcagcctgacagaagatgtggatgagttcaggaacaagctgcagggcgagcgcatcagcggcaacctggatgcccctgagggcggctttgatgccatcctgcagacagctgtgtgcacccgggacatcggctggaggccagacagcacccacctgctggtgttcagcacagaaagtgccttccactatgaagcagatggagccaacgtgctggccggcatcatgagcagaaatgatgagcgctgccacctggacaccaccggcacctacacccagtaccgcacccaggactaccccagcgtgcccaccctggtgcggctgctggccaagcacaacatcatccccatctttgctgtgaccaactacagctacagctactatgagaagctgcacacctacttccctgtgagcagcctgggcgtgctgcaggaggacagcagcaacatcgtggagctgctggaggaggccttcaaccgcatccgcagcaacctggacatccgggccctggacagcccccggggcctgaggacagaggtgaccagcaagatgttccagaagaccaggacaggcagcttccacatcagaagaggagaggtgggcatctaccaggtgcagctgcgggccctggagcacgtggatggcacccacgtgtgccagctgcctgaggaccagaagggcaacatccacctgaagcccagcttcagtgatggcctgaagatggatgctggcatcatctgtgatgtgtgcacctgtgagctgcagaaggaggtgcgcagcgcccgctgcagcttcaatggagactttgtgtgtggccagtgtgtgtgcagcgagggctggagcggccagacctgcaactgcagcacaggcagcctgagtgacatccagccctgcctgcgggagggggaggacaagccctgcagcggcagaggagagtgccagtgtggccactgtgtgtgctacggggagggccgctatgagggccagttctgtgaatatgacaacttccagtgccccaggaccagcggcttcctgtgcaatgaccggggccgctgcagcatgggccagtgtgtgtgtgagcccggctggacaggccccagctgtgactgccccctgagcaatgccacctgcatcgacagcaatggaggcatctgcaatggccggggccactgtgaatgtggccgctgccactgccaccagcagagcctgtacacagacaccatctgtgagatcaactacagcgccatccaccctggcctgtgtgaggacctgcggagctgtgtgcagtgccaggcctggggcaccggggagaagaagggccgcacctgtgaggagtgcaacttcaaggtgaagatggtggatgagctgaagagagctgaggaggtggtggtgcgctgcagcttcagagatgaagatgatgactgcacctacagctacaccatggagggagatggagcccctggccccaacagcacagtgctggtgcacaagaagaaggactgccccccaggcagcttctggtggctgatccccctgctgctgctgctgctgcccctgctggccctgctgctgctgctgtgctggaagtactgtgcctgctgcaaggcctgcctggccctgctgccctgctgcaacagaggccacatggtgggcttcaaggaggaccactacatgctgcgggagaacctgatggccagtgaccacctggacacccccatgctgcggagcggcaacctgaagggcagagatgtggtgcgctggaaggtgaccaacaacatgcagaggcctggctttgccacccatgctgccagcatcaaccccacagagctggtgccctacggcctgagcctgcggctggcccggctgtgcacagagaacctgctgaagccagacaccagagaatgtgcccagctgcggcaggaggtggaggagaacctgaatgaggtgtaccggcagatctctggagtgcacaagctgcagcagaccaagttccggcagcagcccaatgccggcaagaagcaggaccacaccatcgtggacacagtgctgatggcccccaggtctgccaagccagccctgctgaagctgacagagaagcaggtggagcagagggccttccatgacctgaaggtggcccctggctactacaccctgacagctgaccaggatgcccggggcatggtggagttccaggagggcgtggagctggtggatgtgcgggtgcccctcttcatccggccagaagatgatgatgagaagcagctgctggtggaggccattgatgtgcctgctggaacagccaccctgggccggcggctggtgaacatcaccatcatcaaggagcaggccagagatgtggtgtcctttgagcagcctgagttctctgtgtccagaggagaccaggtggcccgcatccctgtgatccggcgggtgctggatggcggcaagagccaggtgtcctaccgcacccaggacggcacagcccagggcaacagagactacatccctgtggagggggagctgctcttccagcccggggaggcctggaaggagctgcaggtgaagctgctggagctgcaggaggtggacagcctgctgcggggccggcaggtgcggcgcttccacgtgcagctgagcaaccccaagtttggagcccacctgggccagccccacagcaccaccatcatcatccgggaccctgatgagctggaccgctccttcaccagccagatgctgagcagccagcccccaccccacggggacctgggcgccccccagaaccccaatgccaaggccgccggcagcaggaagatccacttcaactggctgcccccatctgggaagcccatgggctacagagtgaagtactggatccagggcgacagcgagagcgaggcccacctgctggacagcaaggtgcccagcgtggagctgaccaacctgtacccctactgtgactatgagatgaaggtgtgtgcctatggagcccagggcgagggcccctacagcagcctggtgtcctgcaggacccaccaggaggtgcccagcgagcccggccgcctggccttcaacgtggtgagcagcacagtgacccagctgtcctgggccgagcctgctgagaccaatggagagatcacagcctatgaggtgtgctacggcctggtgaatgatgacaaccggcccatcggccccatgaagaaggtgctggtggacaaccccaagaacaggatgctgctgattgagaacctgcgggagagccagccctaccgctacacagtgaaggccagaaatggagctggctggggccctgagcgggaggccatcatcaacctggccacccagcccaagaggcccatgagcatccccatcatcccagacatccccatcgtggatgcccagagcggagaagattatgacagcttcctgatgtacagtgatgatgtgctgcggagccccagcggcagccagaggcccagcgtgtctgatgacacagagcacctggtgaatggccgcatggactttgccttccctggcagcaccaacagcctgcacaggatgaccaccaccagcgctgctgcctacggcacccacctgagcccccacgtgccccaccgggtgctgagcaccagcagcaccctgacccgggactacaacagcctgaccaggtctgagcacagccacagcaccaccctgccccgggactacagcaccctgacctctgtgagcagccacggcctgccccccatctgggagcacggccgcagccggctgcccctgtcctgggccctgggcagccgcagccgggcccagatgaagggcttcccccccagccggggcccccgggacagcatcatcctggccggccggcctgctgcccccagctggggccctgacagccggctgacagctggggtgcctgacacccccacccggctggtgttcagcgccctgggccccaccagcctgcgggtgtcctggcaggagccccgctgtgagcggcccctgcagggctacagcgtggagtaccagctgctgaatggaggagagctgcaccggctgaacatccccaacccagcccagacctctgtggtggtggaggacctgctgcccaaccacagctatgtgttccgggtgcgggcccagagccaggagggctggggccgggagcgggagggcgtcatcaccatcgagagccaggtgcacccccagagccccctgtgccccctgcccggcagcgccttcaccctgagcaccccatctgcccctggccccctggtgttcaccgccctgagcccagacagcctgcagctgtcctgggagcggccccggcggcccaatggagacatcgtgggctacctggtgacctgtgagatggcccagggcggcggccctgccacagccttccgggtggatggagacagccctgagagccggctgactgtgcccggcctgtctgaaaatgtgccctacaagttcaaggtgcaggcccggaccacagagggctttggacctgagcgggagggcatcatcaccatcgagagccaggacggcggccccttcccccagctgggcagccgggccggcctcttccagcaccccctgcagagcgagtacagcagcatcaccaccacccacaccagcgccacagagcccttcctggtggatggcctgaccctgggcgcccagcacctggaggccggcggcagcctgaccaggcatgtgacccaggagtttgtgtccaggaccctgaccaccagcggcaccctgagcacccacatggaccagcagttcttccagacctag

SEQ ID NO: 156180 - DNA, 5418 bp, Artificial Sequence; identical to SEQ ID NO: 156179
  Description of Artificial Sequence: Synthetic coding sequence

SEQ ID NO: 156181 - DNA, 1932 bp, Artificial Sequence
  Description of Artificial Sequence: Synthetic coding sequence
gggggcatcgaggagacccagattgacaccaccctgcggcgcagccagatgagcccccagggcctgcgggtgcggctgcggcctggagaggagcggcactttgagctggaggtgtttgagcccctggagagccctgtggacctgtacatcctgatggacttcagcaacagcatgtctgatgacctggacaacctgaagaagatgggccagaacctggcccgggtgctgagccagctgaccagtgactacaccatcggctttgggaagtttgtggacaaggtgtctgtgccccagacagacatgaggcctgagaagctgaaggagccctggcccaacagcgacccccccttctccttcaagaatgtcatcagcctgacagaagatgtggatgagttcaggaacaagctgcagggcgagcgcatcagcggcaacctggatgcccctgagggcggctttgatgccatcctgcagacagctgtgtgcacccgggacatcggctggaggccagacagcacccacctgctggtgttcagcacagaaagtgccttccactatgaagcagatggagccaacgtgctggccggcatcatgagcagaaatgatgagcgctgccacctggacaccaccggcacctacacccagtaccgcacccaggactaccccagcgtgcccaccctggtgcggctgctggccaagcacaacatcatccccatctttgctgtgaccaactacagctacagctactatgagaagctgcacacctacttccctgtgagcagcctgggcgtgctgcaggaggacagcagcaacatcgtggagctgctggaggaggccttcaaccgcatccgcagcaacctggacatccgggccctggacagcccccggggcctgaggacagaggtgaccagcaagatgttccagaagaccaggacaggcagcttccacatcagaagaggagaggtgggcatctaccaggtgcagctgcgggccctggagcacgtggatggcacccacgtgtgccagctgcctgaggaccagaagggcaacatccacctgaagcccagcttcagtgatggcctgaagatggatgctggcatcatctgtgatgtgtgcacctgtgagctgcagaaggaggtgcgcagcgcccgctgcagcttcaatggagactttgtgtgtggccagtgtgtgtgcagcgagggctggagcggccagacctgcaactgcagcacaggcagcctgagtgacatccagccctgcctgcgggagggggaggacaagccctgcagcggcagaggagagtgccagtgtggccactgtgtgtgctacggggagggccgctatgagggccagttctgtgaatatgacaacttccagtgccccaggaccagcggcttcctgtgcaatgaccggggccgctgcagcatgggccagtgtgtgtgtgagcccggctggacaggccccagctgtgactgccccctgagcaatgccacctgcatcgacagcaatggaggcatctgcaatggccggggccactgtgaatgtggccgctgccactgccaccagcagagcctgtacacagacaccatctgtgagatcaactacagcgccatccaccctggcctgtgtgaggacctgcggagctgtgtgcagtgccaggcctggggcaccggggagaagaagggccgcacctgtgaggagtgcaacttcaaggtgaagatggtggatgagctgaagagagctgaggaggtggtggtgcgctgcagcttcagagatgaagatgatgactgcacctacagctacaccatggagggagatggagcccctggccccaacagcacagtgctggtgcacaagaagaaggactgccccccaggcagcttctggtggctgatccccctgctgctgctgctgctgcccctgctggccctgtag

SEQ ID NO: 156182 - DNA, 2367 bp, Artificial Sequence
  Description of Artificial Sequence: Synthetic coding sequence
atgggcatcgagctgctgtgcctcttcttcctgttcctgggcagaaatgaccacgtgcagggcggctgtgccctgggcggcgctgagacctgtgaggactgcctgctgattggcccccagtgtgcctggtgtgcccaggagaacttcacccaccccagcggcgtgggggagcgctgtgacaccccagccaacctgctggccaagggctgccagctgaacttcatcgagaaccctgtgtcccaggtggagatcctgaagaacaagcccctgtctgtgggccggcagaagaacagcagtgacatcgtgcagatcgccccccagagcctcatcctgaagctgcggcctggaggagcccagaccctgcaggtgcacgtgcggcagacagaggactaccctgtggacctgtactacctgatggacctgagcgcctccatggatgatgacctgaacaccatcaaggagctgggcagccggctgagcaaggagatgagcaagctgaccagcaacttccggctgggcttcggcagctttgtggagaagcctgtgagcccctttgtgaagaccaccccagaggagatcgccaacccctgcagcagcatcccctacttctgcctgcccaccttcggcttcaagcacatcctgcccctgaccaatgatgctgagcgcttcaatgagatcgtgaagaaccagaagatcagcgccaacatcgacaccccagagggcggctttgatgccatcatgcaggccgctgtgtgcaaggagaagattggctggagaaatgacagcctgcacctgctggtgtttgtgtctgatgctgacagccacttcggcatggacagcaagctggccggcatcgtcatccccaatgatggcctgtgccacctggacagcaagaatgagtacagcatgagcacagtgctggagtaccccaccatcggccagctgattgacaagctggtgcagaacaacgtgctgctgatctttgctgtgacccaggagcaggtgcacctgtatgaaaattatgccaagctgatccctggggccaccgtgggcctgctgcagaaggacagcggcaacatcctgcagctgatcatcagcgcctatgaggagctgcggtctgaggtggagctggaggtgctgggggacacagagggcctgaacctgtccttcaccgccatctgcaacaacggcaccctcttccagcaccagaagaagtgcagccacatgaaggtgggggacacagccagcttctctgtgacagtgaacatcccccactgtgagcggcgcagccgccacatcatcatcaagcctgtgggcctgggagatgccctggagctgctggtgtccccagagtgcaactgtgactgccagaaggaggtggaggtgaacagcagcaagtgccaccacggcaatggcagcttccagtgtggggtgtgtgcctgccaccctggccacatgggcccccgctgtgaatgtggggaggacatgctgagcacagacagctgcaaggaggccccagaccaccccagctgcagcggccgcggggactgctactgcggccagtgcatctgccacctgagcccctacggcaacatctacggcccctactgccagtgtgacaacttcagctgtgtgcgccacaagggcctgctgtgtggcggcaatggagactgtgactgtggggagtgtgtgtgccgcagcggctggacaggagagtactgcaactgcaccaccagcacagacagctgtgtgtctgaagatggagtgctgtgcagcggccgcggggactgtgtgtgtgggaaatgtgtgtgcaccaaccctggggccagcggccccacctgtgagcgctgccccacctgtggggacccctgcaacagcaagaggagctgcatcgagtgccacctgtctgctgctggccaggcccgggaggagtgtgtggacaagtgcaagctggccggggccaccatcagcgaggaggaggacttcagcaaggatggctctgtgtcctgcagcctgcagggagaaaatgaatgtctcatcaccttcctgatcaccacagacaatgaaggcaagaccatcatccacagcatcaatgagaaggactgccccaagccacccaacatccccatgatcatgctgggcgtgtccctggccatcctgctgattggagtggtgctgctgtgcatctggaagctgctggtgtccttccatgacaggaaggaggtggccaagtttgaagctgagaggagcaaggccaagtggcagacaggcaccaaccccctgtaccggggcagcaccagcaccttcaagaatgtgacctacaagcaccgggagaagcagaaggtggacctgagcacagactgctag

SEQ ID NO: 156183 - DNA, 2367 bp, Artificial Sequence; identical to SEQ ID NO: 156182
  Description of Artificial Sequence: Synthetic coding sequence

SEQ ID NO: 156184 - DNA, 2397 bp, Artificial Sequence
  Description of Artificial Sequence: Synthetic coding sequence
atggtggccctgcccatggtgctggtgctgctgctggtgctgagcagaggagagagcgagctggatgccaagatccccagcactggagatgccacagagtggaggaacccccacctgtccatgctgggcagctgccagcctgcccccagctgccagaagtgcatcctgagccaccccagctgtgcctggtgcaagcagctgaacttcaccgccagcggggaggccgaggcccggcgctgtgcccggcgggaggagctgctggcccggggctgccccctggaggagctggaggagccccggggccagcaggaggtgctgcaggaccagcccctgagccagggcgcccggggggagggcgccacccagctggccccccagagggtgcgggtgaccctgcggcctggagagccccagcagctgcaggtgcgcttcctgcgggcagagggctaccctgtggacctgtactacctgatggacctgagctacagcatgaaggatgacctggagcgggtgcggcagctgggccacgccctgctggtgcggctgcaggaggtgacccacagcgtgagaattggatttggcagctttgtggacaagacagtgctgccctttgtgtccacagtgcccagcaagctgcggcacccctgccccacccggctggagcgctgccagagccccttctccttccaccacgtgctgagcctgactggagatgcccaggcctttgagcgggaggtgggccggcagagcgtgtctggcaacctggacagccctgagggcggctttgatgccatcctgcaggccgccctgtgccaggagcagatcggctggagaaatgtgtcccggctgctggtgttcaccagtgatgacaccttccacacagctggagatggcaagctgggcggcatcttcatgcccagtgatggccactgccacctggacagcaatggcctgtacagccgcagcacagaatttgactaccccagcgtgggccaggtggcccaggccctgtctgctgccaacatccagcccatctttgctgtgaccagcgctgccctgcctgtgtaccaggagctgagcaagctgatccccaagtctgctgtgggggagctgtctgaggacagcagcaatgtggtgcagctgatcatggatgcctacaacagcctgagcagcacagtgaccctggagcacagcagcctgcccccaggagtgcacatctcctatgagagccagtgtgagggccctgagaagcgggagggcaaggcagaagatcggggccagtgcaaccacgtgcgcatcaaccagacagtgaccttctgggtgtccctgcaggccacccactgcctgcctgagccccacctgctgcggctgcgggccctgggcttcagcgaggagctgattgtggagctgcacaccctgtgtgactgcaactgcagcgacacccagccccaggccccccactgcagtgatggccagggccacctgcagtgtggggtgtgcagctgtgcccctggccgcctgggccgcctgtgtgagtgcagcgtggccgagctgagcagcccagacctggagagcggctgccgggccccaaatggaacaggccccctgtgcagcggcaagggccactgccagtgtggccgctgcagctgcagcggccagagcagcggccacctgtgtgaatgtgatgatgccagctgtgaaagacatgagggcatcctgtgtggcggcttcggccgctgccagtgtggggtgtgccactgccacgccaacagaacaggccgggcctgtgaatgttctggggacatggacagctgcatcagccctgagggcggcctgtgcagcggccacggccgctgcaagtgcaaccgctgccagtgcctggatggctactatggagccctgtgtgaccagtgccccggctgcaagaccccctgtgagcggcaccgggactgtgctgaatgtggggccttcagaacaggccccctggccaccaactgcagcacagcctgtgcccacaccaacgtgaccctggccctggcccccatcctggatgatggctggtgcaaggagaggaccctggacaaccagctgttcttcttcctggtggaggatgatgcccggggcaccgtggtgctgcgggtgcggccccaggagaagggagctgaccacacccaggccatcgtgctgggctgtgtgggcggcatcgtggccgtgggcctgggcctggtgctggcctaccgcctgtctgtggagatctatgacagaagagagtacagcagatttgagaaggagcagcagcagctgaactggaagcaggacagcaaccccctgtacaagagcgccatcaccaccaccatcaacccccgcttccaggaggccgacagccccaccctgtag

SEQ ID NO: 156185 - DNA, 1953 bp, Artificial Sequence
  Description of Artificial Sequence: Synthetic coding sequence
atggtggccctgcccatggtgctggtgctgctgctggtgctgagcagaggagagagcgagctggatgccaagatccccagcactggagatgccacagagtggaggaacccccacctgtccatgctgggcagctgccagcctgcccccagctgccagaagtgcatcctgagccaccccagctgtgcctggtgcaagcagctgaacttcaccgccagcggggaggccgaggcccggcgctgtgcccggcgggaggagctgctggcccggggctgccccctggaggagctggaggagccccggggccagcaggaggtgctgcaggaccagcccctgagccagggcgcccggggggagggcgccacccagctggccccccagagggtgcgggtgaccctgcggcctggagagccccagcagctgcaggtgcgcttcctgcgggcagagggctaccctgtggacctgtactacctgatggacctgagctacagcatgaaggatgacctggagcgggtgcggcagctgggccacgccctgctggtgcggctgcaggaggtgacccacagcgtgagaattggatttggcagctttgtggacaagacagtgctgccctttgtgtccacagtgcccagcaagctgcggcacccctgccccacccggctggagcgctgccagagccccttctccttccaccacgtgctgagcctgactggagatgcccaggcctttgagcgggaggtgggccggcagagcgtgtctggcaacctggacagccctgagggcggctttgatgccatcctgcaggccgccctgtgccaggagcagatcggctggagaaatgtgtcccggctgctggtgttcaccagtgatgacaccttccacacagctggagatggcaagctgggcggcatcttcatgcccagtgatggccactgccacctggacagcaatggcctgtacagccgcagcacagaatttgactaccccagcgtgggccaggtggcccaggccctgtctgctgccaacatccagcccatctttgctgtgaccagcgctgccctgcctgtgtaccaggagctgagcaagctgatccccaagtctgctgtgggggagctgtctgaggacagcagcaatgtggtgcagctgatcatggatgcctacaacagcctgagcagcacagtgaccctggagcacagcagcctgcccccaggagtgcacatctcctatgagagccagtgtgagggccctgagaagcgggagggcaaggcagaagatcggggccagtgcaaccacgtgcgcatcaaccagacagtgaccttctgggtgtccctgcaggccacccactgcctgcctgagccccacctgctgcggctgcgggccctgggcttcagcgaggagctgattgtggagctgcacaccctgtgtgactgcaactgcagcgacacccagccccaggccccccactgcagtgatggccagggccacctgcagtgtggggtgtgccgggactgtgctgaatgtggggccttcagaacaggccccctggccaccaactgcagcacagcctgtgcccacaccaacgtgaccctggccctggcccccatcctggatgatggctggtgcaaggagaggaccctggacaaccagctgttcttcttcctggtggaggatgatgcccggggcaccgtggtgctgcgggtgcggccccaggagaagggagctgaccacacccaggccatcgtgctgggctgtgtgggcggcatcgtggccgtgggcctgggcctggtgctggcctaccgcctgtctgtggagatctatgacagaagagagtacagcagatttgagaaggagcagcagcagctgaactggaagcaggacagcaaccccctgtacaagagcgccatcaccaccaccatcaacccccgcttccaggaggccgacagccccaccctgtag

SEQ ID NO: 156186 - DNA, 2397 bp, Artificial Sequence; identical to SEQ ID NO: 156184
  Description of Artificial Sequence: Synthetic coding sequence

SEQ ID NO: 156187 - DNA, 1206 bp, Artificial Sequence
  Description of Artificial Sequence: Synthetic coding sequence
atgaacctggtggccgtgatgggcgccttcaacaagggccacggcaaatgtgactgtgggaaatgtaaatgtgaccagggctggtatggagatgcctgccagtaccccaccaactgtgacctgaccaagaagaagagcaaccagatgtgcaagaacagccaggacatcatctgcagcaatgccggcacctgccactgcggccgctgcaagtgtgacaacagtgatggcagcggcctggtgtatggcaagttctgtgaatgtgatgacagagaatgtattgatgatgaaacagaggagatctgtggcggccacggcaagtgctactgcggcaactgctactgcaaggccggctggcatggagacaagtgtgagttccagtgtgacatcaccccctgggagagcaagaggcgctgcaccagcccagatggcaagatctgcagcaacagaggcacctgtgtgtgtggggagtgcacctgccatgatgtggaccccactggagactggggagacatccacggggacacctgtgaatgtgatgagcgggactgcagagctgtgtatgaccgctacagtgatgacttctgcagcggccacggccagtgcaactgtggccgctgtgactgcaaggccggctggtacggcaagaagtgtgagcacccccagagctgcaccctgtctgctgaggagagcatcaggaagtgccagggcagcagtgacctgccctgcagcggccggggcaaatgtgaatgtgggaagtgcacctgctacccacctggggacagaagagtgtatggcaagacctgtgaatgtgatgacagaagatgtgaggacctggatggagtggtgtgtggcggccacggcacctgcagctgtggccgctgtgtgtgtgagcggggctggtttgggaagctgtgccagcaccccaggaagtgcaacatgacagaggagcagagcaagaacctgtgtgagagcgcagatggcatcctgtgcagcggcaagggcagctgccactgtgggaagtgcatctgcagcgctgaggagtggtacatctctggagagttctgtgactgtgatgaccgggactgtgacaagcatgatggcctcatctgcacaggaaatggcatctgcagctgtggcaactgtgagtgctgggatggctggaatggaaatgcctgtgagatctggctgggcagcgagtacccctag

SEQ ID NO: 156188 - DNA, 1485 bp, Artificial Sequence
  Description of Artificial Sequence: Synthetic coding sequence
atgaggcctcctggcttcaggaacttcctgctgctggccagcagcctgctgtttgctggcctgtctgctgtgccccagagcttcagccccagcctgcgctcctggccaggggccgcctgccgcctgagcagagctgagagcgagcggcgctgccgggcccctggccagcccccaggggccgccctgtgccacggccggggccgctgtgactgtggggtgtgcatctgccacgtgacagagcccggcatgttcttcggccccctgtgtgagtgccacgagtgggtgtgtgagacctatgatggcagcacctgtgccggccatggaaaatgtgactgtgggaagtgcaagtgtgaccagggctggtatggagatgcctgccagtaccccaccaactgtgacctgaccaagaagaagagcaaccagatgtgcaagaacagccaggacatcatctgcagcaatgccggcacctgccactgcggccgctgcaagtgtgacaacagtgatggcagcggcctggtgtatggcaagttctgtgaatgtgatgaccgggagtgcattgatgatgaaacagaggagatctgtggcggccacggcaagtgctactgcggcaactgctactgcaaggccggctggcacggggacaagtgtgagttccagtgtgacatcaccccctgggagagcaagaggcgctgcaccagcccagatggcaagatctgcagcaacagaggcacctgtgtgtgtggagaatgtacctgccatgatgtggaccccaccggggactggggagacatccatggagacacctgtgaatgtgatgagcgggactgcagagctgtgtatgaccgctacagtgatgacttctgcagcggccacggccagtgcaactgtggccgctgtgactgcaaggccggctggtacggcaagaagtgtgagcacccccagagctgcaccctgtctgctgaggagagcatcaggaagtgccagggcagcagtgacctgccctgcagcggccggggcaaatgtgaatgtgggaagtgcacctgctacccacctggggaccggcgggtgtatggcaagacctgtgaatgtgatgaccggcgctgtgaggacctggatggagtggtgtgtggcggccacggcacctgcagctgtggccgctgtgtgtgtgagcggggctggtttgggaagctgtgccagcaccccaggaagtgcaacatgacagaggagcagagcaagaacctgtgtgagagcgcagatggcatcctgtgcagcggcaagggcagctgccactgtgggaagtgcatctgcagcgctgaggagtggtacatcagcggggagttctgtgactgtgatgaccgggactgtgacaagcatgatggcctcatctgcacaggaaatggcatctgcagctgtggcaactgtgagtgctgggatggctggaatggaaatgcctgtgagatctggctgggcagcgagtacccctag

SEQ ID NO: 156189 - DNA, 1209 bp, Artificial Sequence
  Description of Artificial Sequence: Synthetic coding sequence
atgagcggctgtgcccggcccaccactggagcccctgtgcaggccatggtgtctgtgacaggcaagtgcaagtgtgaccagggctggtatggagatgcctgccagtaccccaccaactgtgacctgaccaagaagaagagcaaccagatgtgcaagaacagccaggacatcatctgcagcaatgccggcacctgccactgcggccgctgcaagtgtgacaacagtgatggcagcggcctggtgtatggcaagttctgtgaatgtgatgaccgggagtgcattgatgatgaaacagaggagatctgtggcggccacggcaagtgctactgcggcaactgctactgcaaggccggctggcacggggacaagtgtgagttccagtgtgacatcaccccctgggagagcaagaggcgctgcaccagcccagatggcaagatctgcagcaacagaggcacctgtgtgtgtggagaatgtacctgccatgatgtggaccccaccggggactggggagacatccatggagacacctgtgaatgtgatgagcgggactgcagagctgtgtatgaccgctacagtgatgacttctgcagcggccacggccagtgcaactgtggccgctgtgactgcaaggccggctggtacggcaagaagtgtgagcacccccagagctgcaccctgtctgctgaggagagcatcaggaagtgccagggcagcagtgacctgccctgcagcggccggggcaaatgtgaatgtgggaagtgcacctgctacccacctggggaccggcgggtgtatggcaagacctgtgaatgtgatgaccggcgctgtgaggacctggatggagtggtgtgtggcggccacggcacctgcagctgtggccgctgtgtgtgtgagcggggctggtttgggaagctgtgccagcaccccaggaagtgcaacatgacagaggagcagagcaagaacctgtgtgagagcgcagatggcatcctgtgcagcggcaagggcagctgccactgtgggaagtgcatctgcagcgctgaggagtggtacatcagcggggagttctgtgactgtgatgaccgggactgtgacaagcatgatggcctcatctgcacaggaaatggcatctgcagctgtggcaactgtgagtgctgggatggctggaatggaaatgcctgtgagatctggctgggcagcgagtacccctag

SEQ ID NO: 156190 - DNA, 1062 bp, Artificial Sequence
  Description of Artificial Sequence: Synthetic coding sequence
atgtgcaagaacagccaggacatcatctgcagcaatgccggcacctgccactgcggccgctgcaagtgtgacaacagtgatggcagcggcctggtgtatggcaagttctgtgaatgtgatgacagagaatgtattgatgatgaaacagaggagatctgtggcggccacggcaagtgctactgcggcaactgctactgcaaggccggctggcatggagacaagtgtgagttccagtgtgacatcaccccctgggagagcaagaggcgctgcaccagcccagatggcaagatctgcagcaacagaggcacctgtgtgtgtggggagtgcacctgccatgatgtggaccccactggagactggggagacatccacggggacacctgtgaatgtgatgagcgggactgcagagctgtgtatgaccgctacagtgatgacttctgcagcggccacggccagtgcaactgtggccgctgtgactgcaaggccggctggtacggcaagaagtgtgagcacccccagagctgcaccctgtctgctgaggagagcatcaggaagtgccagggcagcagtgacctgccctgcagcggccggggcaaatgtgaatgtgggaagtgcacctgctacccacctggggacagaagagtgtatggcaagacctgtgaatgtgatgacagaagatgtgaggacctggatggagtggtgtgtggcggccacggcacctgcagctgtggccgctgtgtgtgtgagcggggctggtttgggaagctgtgccagcaccccaggaagtgcaacatgacagaggagcagagcaagaacctgtgtgagagcgcagatggcatcctgtgcagcggcaagggcagctgccactgtgggaagtgcatctgcagcgctgaggagtggtacatctctggagagttctgtgactgtgatgaccgggactgtgacaagcatgatggcctcatctgcacaggaaatggcatctgcagctgtggcaactgtgagtgctgggatggctggaatggaaatgcctgtgagatctggctgggcagcgagtacccctag

SEQ ID NO: 156191 - DNA, 1062 bp, Artificial Sequence; identical to SEQ ID NO: 156190
  Description of Artificial Sequence: Synthetic coding sequence

SEQ ID NO: 156192 - DNA, 903 bp, Artificial Sequence
  Description of Artificial Sequence: Synthetic coding sequence
atggccaactgtgagttcagccctgtgtctggggacaagccctgctgccgcctgagccggcgggcccagctgtgcctgggcgtgtccatcctggtgctgatcctggtggtggtgctggccgtggtggtgccccgctggaggcagcagtggagcggccctggcaccaccaagcgcttccctgagaccgtgctggcccgctgtgtgaagtacacagagatccaccctgagatgagacatgtggactgccagagcgtgtgggatgccttcaagggggccttcatcagcaagcacccctgcaacatcacagaggaggactaccagcccctgatgaagctgggcacccagacagtgccctgcaacaagatcctgctgtggagccgcatcaaggacctggcccaccagttcacccaggtgcagagggacatgttcaccctggaggacaccctgctgggctacctggctgatgacctgacctggtgtggggagttcaacaccagcaagatcaactaccagagctgcccagactggaggaaggactgcagcaacaaccctgtgtctgtgttctggaagacagtgagccgccgctttgctgaggccgcctgtgatgtggtgcacgtgatgctgaatggcagccgcagcaagatctttgacaagaacagcaccttcggctctgtggaggtgcacaacctgcagcctgagaaggtgcagaccctggaggcctgggtgatccacggcggccgggaggacagccgggacctgtgccaggaccccaccatcaaggagctggagagcatcatcagcaagaggaacatccagttcagctgcaagaacatctacagaccagacaagttcctgcagtgtgtgaagaaccctgaggacagcagctgcaccagcgagatctag

SEQ ID NO: 156193 - DNA, 942 bp, Artificial Sequence
  Description of Artificial Sequence: Synthetic coding sequence
atgaaccagctgtccttcctgctcttcctgattgccaccacccggggctggagcacagatgaggccaacacctacttcaaggagtggacctgcagcagcagccccagcctgcccaggagctgcaaggagatcaaggatgaatgtcccagcgcctttgatggcctgtacttcctgaggacagaaaatggagtcatctaccagaccttctgtgacatgaccagcggcggcggcggctggaccctggtggcctctgtgcatgaaaatgacatgagaggaaaatgtactgtgggggaccgctggagcagccagcagggcagcaaggctgtgtacccagaaggagatggcaactgggccaactacaacacctttggatctgctgaggccgccaccagtgatgactacaagaaccctggctactatgacatccaggccaaggacctgggcatctggcacgtgcccaacaagagccccatgcagcactggaggaacagcagcctgctgcgctacagaacagacaccggcttcctgcagaccctgggccacaacctgtttggcatctaccagaagtaccctgtgaagtacggggagggcaagtgctggacagacaatggacctgtgattcctgtggtgtatgactttggagatgcccagaagacagccagctactacagcccctacggccagcgggagttcaccgctggctttgtgcagttccgggtcttcaacaatgaaagagctgccaatgccctgtgtgccggcatgagggtgacaggctgcaacacagagcaccactgcatcggcggcggcggctacttccctgaggccagcccccagcagtgtggggacttcagcggctttgactggagcggctacggcacccacgtgggctacagcagcagccgggagatcacagaggccgctgtgctgctcttctacagatag

SEQ ID NO: 156194 - DNA, 978 bp, Artificial Sequence
  Description of Artificial Sequence: Synthetic coding sequence
atgctgtccatgctgcggaccatgacccggctgtgcttcctgctcttcttctctgtggccaccagcggctgcagcgctgctgctgccagcagcctggagatgctgagccgggagtttgagacctgtgccttctccttcagcagcctgcccaggagctgcaaggagatcaaggagcgctgccacagcgctggagatggcctgtacttcctgcggaccaagaatggagtggtgtaccagaccttctgtgacatgaccagcggcggcggcggctggaccctggtggcctctgtgcatgaaaatgacatgagaggaaaatgtactgtgggggaccgctggagcagccagcagggcaacaaggctgactacccagaaggagatggcaactgggccaactacaacacctttggatctgctgaggccgccaccagtgatgactacaagaaccctggctactatgacatccaggccaaggacctgggcatctggcacgtgcccaacaagagccccatgcagcactggaggaacagcgccctgctgcgctaccgcaccaacacaggcttcctgcagaggctgggccacaacctgtttggcatctaccagaagtaccctgtgaagtaccgcagcggcaagtgctggaatgacaatggacctgccatccctgtggtgtatgactttggagatgccaagaagacagccagctactacagcccctacggccagcgggagtttgtggccggctttgtgcagttccgggtcttcaacaatgaaagagctgccaatgccctgtgtgccggcatcaaggtgacaggctgcaacacagagcaccactgcatcggcggcggcggcttcttcccccagggcaagccccggcagtgtggggacttcagcgcctttgactgggatggctacggcacccacgtgaagagcagctgcagccgggagatcacagaggccgctgtgctgctcttctacagatag

SEQ ID NO: 156195 - DNA, 2736 bp, Artificial Sequence
  Description of Artificial Sequence: Synthetic coding sequence
atggatggagccatgggcccccggggcctgctgctgtgcatgtacctggtgtccctgctgatcctgcaggccatgcctgccctgggcagcgccaccggccgcagcaagagcagcgagaagaggcaggccgtggacacagctgtggatggagtcttcatccgcagcctgaaggtgaactgcaaggtgaccagcagatttgcccactacgtggtgaccagccaggtggtgaacacagccaatgaggcccgggaggtggcctttgacctggagatccccaagacagccttcatcagtgactttgctgtgacagcagatggaaatgccttcatcggggacatcaaggacaaggtgacagcctggaagcagtacaggaaggccgccatctctggagaaaatgccggcctggtgcgggccagcggccgcaccatggagcagttcaccatccacctgactgtgaacccccagagcaaggtgaccttccagctgacctatgaggaggtgctgaagaggaaccacatgcagtatgaaattgtcatcaaggtgaagcccaagcagctggtgcaccactttgaaattgatgtggacatctttgagccccagggcatcagcaagctggatgcccaggccagcttcctgcccaaggagctggccgcccagaccatcaagaagagcttcagcggcaagaagggccacgtgctcttccggcccaccgtgtcccagcagcagagctgccccacctgcagcaccagcctgctgaatggccacttcaaggtgacctatgatgtgtcccgggacaagatctgtgacctgctggtggccaacaaccactttgcccacttctttgccccccagaacctgaccaacatgaacaagaatgtggtgtttgtgattgacatcagcggctccatgaggggccagaaggtgaagcagaccaaggaggccctgctgaagatcctgggggacatgcagcccggggactactttgacctggtgctgtttggcaccagggtgcagagctggaagggcagcctggtgcaggccagcgaggccaacctgcaggccgcccaggactttgtgcggggcttcagcctggatgaggccaccaacctgaatggaggcctgctgcggggcatcgagatcctgaaccaggtgcaggagagcctgcctgagctgagcaaccacgccagcatcctgatcatgctgacagatggagaccccacagaaggagtgacagacaggagccagatcctgaagaatgtgagaaatgccatccggggccgcttccccctgtacaacctgggcttcggccacaacgtggacttcaacttcctggaggtgatgtccatggagaacaacggccgggcccagaggatctatgaggaccatgatgccacccagcagctgcagggcttctacagccaggtggccaagcccctgctggtggatgtggacctgcagtacccccaggatgctgtgctggccctgacccagaaccaccacaagcagtactatgagggcagcgagatcgtggtggccggcagaattgctgacaacaagcagagcagcttcaaggcagatgtgcaggcccacggggagggccaggagttcagcatcacctgcctggtggatgaggaggagatgaagaagctgctgcgggagcggggccacatgctggagaaccacgtggagcggctgtgggcctacctgaccatccaggagctgctggccaagaggatgaaggtggaccgggaggagcgggccaacctgagcagccaggccctgcagatgagcctggactatggctttgtgacccccctgacctccatgagcatccggggcatggctgaccaggacggcctgaagcccaccatcgacaagcccagcgaggacagcccccccctggagatgctgggccccaggaggacctttgtgctgagcgccctgcagcccagccccacccacagcagcagcaacacccagaggctgcctgacagagtgactggagtggacacagacccccacttcatcatccacgtgccccagaaggaggacaccctgtgcttcaacatcaatgaggagcccggggtcatcctgagcctggtgcaggaccccaacacaggcttctctgtgaatggccagctgattggcaacaaggcccggagccctggccagcatgatggcacctacttcggccgcctgggcatcgccaacccagccacagacttccagctggaggtgaccccccagaacatcaccctgaaccctggctttggaggccctgtgttctcctggagggaccaggccgtgctgcggcaggatggagtggtggtgaccatcaacaagaagaggaacctggtggtgtctgtggatgatggcggcacctttgaggtggtgctgcaccgggtgtggaagggcagctctgtgcaccaggacttcctgggcttctacgtgctggacagccacaggatgtctgcccggacccacggcctgctgggccagttcttccaccccatcggctttgaggtgtctgacatccaccctggcagtgaccccaccaagccagatgccaccatggtggtgaggaacagaaggctgactgtgacccggggcctgcagaaggactacagcaaggacccctggcatggagctgaggtgtcctgctggttcatccacaacaatggagctggcctgattgatggagcctacacagactacatcgtgcctgacatcttctag

SEQ ID NO: 156196 - DNA, 1872 bp, Artificial Sequence
  Description of Artificial Sequence: Synthetic coding sequence
atgaacaagaatgtggtgtttgtgattgacatcagcggctccatgaggggccagaaggtgaagcagaccaaggaggccctgctgaagatcctgggggacatgcagcccggggactactttgacctggtgctgtttggcaccagggtgcagagctggaagggcagcctggtgcaggccagcgaggccaacctgcaggccgcccaggactttgtgcggggcttcagcctggatgaggccaccaacctgaatggaggcctgctgcggggcatcgagatcctgaaccaggtgcaggagagcctgcctgagctgagcaaccacgccagcatcctgatcatgctgacagatggagaccccacagaaggagtgacagacaggagccagatcctgaagaatgtgagaaatgccatccggggccgcttccccctgtacaacctgggcttcggccacaacgtggacttcaacttcctggaggtgatgtccatggagaacaacggccgggcccagaggatctatgaggaccatgatgccacccagcagctgcagggcttctacagccaggtggccaagcccctgctggtggatgtggacctgcagtacccccaggatgctgtgctggccctgacccagaaccaccacaagcagtactatgagggcagcgagatcgtggtggccggcagaattgctgacaacaagcagagcagcttcaaggcagatgtgcaggcccacggggagggccaggagttcagcatcacctgcctggtggatgaggaggagatgaagaagctgctgcgggagcggggccacatgctggagaaccacgtggagcggctgtgggcctacctgaccatccaggagctgctggccaagaggatgaaggtggaccgggaggagcgggccaacctgagcagccaggccctgcagatgagcctggactatggctttgtgacccccctgacctccatgagcatccggggcatggctgaccaggacggcctgaagcccaccatcgacaagcccagcgaggacagcccccccctggagatgctgggccccaggaggacctttgtgctgagcgccctgcagcccagccccacccacagcagcagcaacacccagaggctgcctgacagagtgactggagtggacacagacccccacttcatcatccacgtgccccagaaggaggacaccctgtgcttcaacatcaatgaggagcccggggtcatcctgagcctggtgcaggaccccaacacaggcttctctgtgaatggccagctgattggcaacaaggcccggagccctggccagcatgatggcacctacttcggccgcctgggcatcgccaacccagccacagacttccagctggaggtgaccccccagaacatcaccctgaaccctggctttggaggccctgtgttctcctggagggaccaggccgtgctgcggcaggatggagtggtggtgaccatcaacaagaagaggaacctggtggtgtctgtggatgatggcggcacctttgaggtggtgctgcaccgggtgtggaagggcagctctgtgcaccaggacttcctgggcttctacgtgctggacagccacaggatgtctgcccggacccacggcctgctgggccagttcttccaccccatcggctttgaggtgtctgacatccaccctggcagtgaccccaccaagccagatgccaccatggtggtgaggaacagaaggctgactgtgacccggggcctgcagaaggactacagcaaggacccctggcatggagctgaggtgtcctgctggttcatccacaacaatggagctggcctgattgatggagcctacacagactacatcgtgcctgacatcttctag

SEQ ID NO: 156197 - DNA, 2310 bp, Artificial Sequence
  Description of Artificial Sequence: Synthetic coding sequence
atggagcagttcaccatccacctgactgtgaacccccagagcaaggtgaccttccagctgacctatgaggaggtgctgaagaggaaccacatgcagtatgaaattgtcatcaaggtgaagcccaagcagctggtgcaccactttgaaattgatgtggacatctttgagccccagggcatcagcaagctggatgcccaggccagcttcctgcccaaggagctggccgcccagaccatcaagaagagcttcagcggcaagaagggccacgtgctcttccggcccaccgtgtcccagcagcagagctgccccacctgcagcaccagcctgctgaatggccacttcaaggtgacctatgatgtgtcccgggacaagatctgtgacctgctggtggccaacaaccactttgcccacttctttgccccccagaacctgaccaacatgaacaagaatgtggtgtttgtgattgacatcagcggctccatgaggggccagaaggtgaagcagaccaaggaggccctgctgaagatcctgggggacatgcagcccggggactactttgacctggtgctgtttggcaccagggtgcagagctggaagggcagcctggtgcaggccagcgaggccaacctgcaggccgcccaggactttgtgcggggcttcagcctggatgaggccaccaacctgaatggaggcctgctgcggggcatcgagatcctgaaccaggtgcaggagagcctgcctgagctgagcaaccacgccagcatcctgatcatgctgacagatggagaccccacagaaggagtgacagacaggagccagatcctgaagaatgtgagaaatgccatccggggccgcttccccctgtacaacctgggcttcggccacaacgtggacttcaacttcctggaggtgatgtccatggagaacaacggccgggcccagaggatctatgaggaccatgatgccacccagcagctgcagggcttctacagccaggtggccaagcccctgctggtggatgtggacctgcagtacccccaggatgctgtgctggccctgacccagaaccaccacaagcagtactatgagggcagcgagatcgtggtggccggcagaattgctgacaacaagcagagcagcttcaaggcagatgtgcaggcccacggggagggccaggagttcagcatcacctgcctggtggatgaggaggagatgaagaagctgctgcgggagcggggccacatgctggagaaccacgtggagcggctgtgggcctacctgaccatccaggagctgctggccaagaggatgaaggtggaccgggaggagcgggccaacctgagcagccaggccctgcagatgagcctggactatggctttgtgacccccctgacctccatgagcatccggggcatggctgaccaggacggcctgaagcccaccatcgacaagcccagcgaggacagcccccccctggagatgctgggccccaggaggacctttgtgctgagcgccctgcagcccagccccacccacagcagcagcaacacccagaggctgcctgacagagtgactggagtggacacagacccccacttcatcatccacgtgccccagaaggaggacaccctgtgcttcaacatcaatgaggagcccggggtcatcctgagcctggtgcaggaccccaacacaggcttctctgtgaatggccagctgattggcaacaaggcccggagccctggccagcatgatggcacctacttcggccgcctgggcatcgccaacccagccacagacttccagctggaggtgaccccccagaacatcaccctgaaccctggctttggaggccctgtgttctcctggagggaccaggccgtgctgcggcaggatggagtggtggtgaccatcaacaagaagaggaacctggtggtgtctgtggatgatggcggcacctttgaggtggtgctgcaccgggtgtggaagggcagctctgtgcaccaggacttcctgggcttctacgtgctggacagccacaggatgtctgcccggacccacggcctgctgggccagttcttccaccccatcggctttgaggtgtctgacatccaccctggcagtgaccccaccaagccagatgccaccatggtggtgaggaacagaaggctgactgtgacccggggcctgcagaaggactacagcaaggacccctggcatggagctgaggtgtcctgctggttcatccacaacaatggagctggcctgattgatggagcctacacagactacatcgtgcctgacatcttctag

SEQ ID NO: 156198 - DNA, 1938 bp, Artificial Sequence
  Description of Artificial Sequence: Synthetic coding sequence
atggatggagccatgggcccccggggcctgctgctgtgcatgtacctggtgtccctgctgatcctgcaggccatgcctgccctgggcagcgccaccggccgcagcaagagcagcgagaagaggcaggccgtggacacagctgtggatggagtcttcatccgcagcctgaaggtgaactgcaaggtgaccagcagatttgcccactacgtggtgaccagccaggtggtgaacacagccaatgaggcccgggaggtggcctttgacctggagatccccaagacagccttcatcagtgactttgctgtgacagcagatggaaatgccttcatcggggacatcaaggacaaggtgacagcctggaagcagtacaggaaggccgccatctctggagaaaatgccggcctggtgcgggccagcggccgcaccatggagcagttcaccatccacctgactgtgaacccccagagcaaggtgaccttccagctgacctatgaggaggtgctgaagaggaaccacatgcagtatgaaattgtcatcaaggtgaagcccaagcagctggtgcaccactttgaaattgatgtggacatctttgagccccagggcatcagcaagctggatgcccaggccagcttcctgcccaaggagctggccgcccagaccatcaagaagagcttcagcggcaagaagggccacgtgctcttccggcccaccgtgtcccagcagcagagctgccccacctgcagcaccagcctgctgaatggccacttcaaggtgacctatgatgtgtcccgggacaagatctgtgacctgctggtggccaacaaccactttgcccacttctttgccccccagaacctgaccaacatgaacaagaatgtggtgtttgtgattgacatcagcggctccatgaggggccagaaggtgaagcagaccaaggaggccctgctgaagatcctgggggacatgcagcccggggactactttgacctggtgctgtttggcaccagggtgcagagctggaagggcagcctggtgcaggccagcgaggccaacctgcaggccgcccaggactttgtgcggggcttcagcctggatgaggccaccaacctgaatggaggcctgctgcggggcatcgagatcctgaaccaggtgcaggagagcctgcctgagctgagcaaccacgccagcatcctgatcatgctgacagatggagaccccacagaaggagtgacagacaggagccagatcctgaagaatgtgagaaatgccatccggggccgcttccccctgtacaacctgggcttcggccacaacgtggacttcaacttcctggaggtgatgtccatggagaacaacggccgggcccagaggatctatgaggaccatgatgccacccagcagctgcagggcttctacagccaggtggccaagcccctgctggtggatgtggacctgcagtacccccaggatgctgtgctggccctgacccagaaccaccacaagcagtactatgagggcagcgagatcgtggtggccggcagaattgctgacaacaagcagagcagcttcaaggcagatgtgcaggcccacggggagggccaggagttcagcatcacctgcctggtggatgaggaggagatgaagaagctgctgcgggagcggggccacatgctggagaaccacgtggagcggctgtgggcctacctgaccatccaggagctgctggccaagaggatgaaggtggaccgggaggagcgggccaacctgagcagccaggccctgcagatgagcctggactatggctttgtgacccccctgacctccatgagcatccggggcatggctgaccaggacggcctgaagcccaccatcgacaagcccagcctgcaccacccccgggcccctgagcggggccaccctgtgctgcagcaccagtag

SEQ ID NO: 156199 - DNA, 2841 bp, Artificial Sequence
  Description of Artificial Sequence: Synthetic coding sequence
atgaagaggctgacctgcttcttcatctgcttcttcctgtctgaggtgtctggctttgagatccccatcaatggcctgtctgaatttgtggactatgaggacctggtggagctggcccctgggaagttccagctggtggccgagaacagacgctaccagaggagcctgcctggagagagcgaggagatgatggaggaggtggaccaggtgaccctgtacagctacaaggtgcagagcaccatcaccagcaggatggccaccaccatgatccagagcaaggtggtgaacaacagcccccagccccagaatgtggtgtttgatgtgcagatccccaagggggccttcatcagcaacttctccatgacagtggatggcaagaccttccgcagcagcatcaaggagaagacagtgggccgggccctgtatgcccaggcccgggccaagggcaagacagctggcctggtgcgcagcagcgccctggacatggagaacttcagaacagaggtgaatgtgctgcccggggccaaggtgcagtttgagctgcactaccaggaggtgaagtggaggaagctgggcagctatgagcaccgcatctacctgcagcccggccgcctggccaagcacctggaggtggatgtgtgggtgattgagccccagggcctgcgcttcctgcacgtgcctgacacctttgagggccactttgatggagtgcctgtgatcagcaagggccagcagaaggcccacgtgtccttcaagcccaccgtggcccagcagaggatctgccccaactgccgggagacagctgtggatggagagctggtggtgctgtatgatgtgaagcgggaggagaaggccggggagctggaggtgttcaacggctactttgtgcacttctttgccccagacaacctggaccccatccccaagaacatcctgtttgtgattgatgtgtctggctccatgtggggcgtgaagatgaagcagacagtggaggccatgaagaccatcctggatgacctgcgggcagaggaccacttctctgtgattgacttcaaccagaacatccgcacctggagaaatgacctgatcagcgccaccaagacccaggtggctgatgccaagcgctacatcgagaagatccagcccagcggcggcaccaacatcaatgaggccctgctgcgggccatcttcatcctgaatgaggccaacaacctgggcctgctggaccccaacagcgtgtccctcatcatcctggtgtctgatggagaccccaccgtgggggagctgaagctgagcaagatccagaagaatgtgaaggagaacatccaggacaacatcagcctcttcagcctgggcatgggctttgatgtggactatgacttcctgaagaggctgagcaatgaaaaccacggcatcgcccagaggatctacggcaaccaggacaccagcagccagctgaagaagttctacaaccaggtgtccacccccctgctgagaaatgtgcagttcaactacccccacacctctgtgacagatgtgacccagaacaacttccacaactactttggaggcagcgagatcgtggtggccggcaagtttgatcctgccaagctggaccagattgaatctgtcatcacagccaccagcgccaacacccagctggtgctggagaccctggcccagatggatgacctgcaggacttcctgagcaaggacaagcatgctgaccctgacttcaccaggaagctgtgggcctacctgaccatcaaccagctgctggccgagaggagcctggcccccacagctgctgccaagaggcgcatcaccaggagcatcctgcagatgagcctggaccaccacatcgtgacccccctgaccagcctggtgattgaaaatgaggccggagatgagaggatgctggctgatgccccaccccaggaccccagctgctgcagcggggccctgtactacggcagcaaggtggtgcctgacagcacccccagctgggccaaccccagccccacccctgtgatctccatgctggcccagggcagccaggtgctggagagcaccccacctcctcatgtgatgagggtggagaatgacccccacttcatcatctacctgcccaagagccagaagaacatctgcttcaacatcgacagcgagcccgggaagatcctgaacctggtgtctgaccctgagagcggcatcgtggtgaatggccagctggtgggcgccaagaagcccaacaacgggaagctgagcacctactttgggaagctgggcttctacttccagagcgaggacatcaagattgagatcagcacagagaccatcaccctgagccacggcagcagcaccttcagcctgtcctggagcgacacagcccaggtgaccaaccagagggtgcagatctctgtgaagaaggagaaggtggtgaccatcaccctggacaaggagatgtccttctctgtgctgctgcaccgggtgtggaagaagcaccctgtgaatgtggacttcctgggcatctacatcccccccaccaacaagttcagccccaaggcccacggcctcatcggccagttcatgcaggagcccaagatccacatcttcaatgaaagacctgggaaggaccctgagaagccagaggcctccatggaggtgaagggccagaagctgatcatcacccggggcctgcagaaggactacagaacagacctggtgtttggaacagatgtgacctgctggtttgtgcacaacagcggcaagggcttcattgatggccactacaaggactactttgtgccccagctgtacagcttcctgaagaggccctag

SEQ ID NO: 156200 - DNA, 2658 bp, Artificial Sequence
  Description of Artificial Sequence: Synthetic coding sequence
atggtggccctgagccacctgggcagcgccctgcagctgggcagcctcttccccaggagccccttccggctgctgggcaagaggagcctgcctgagggcgtggccaacggcatcgaggtgtacagcaccaagatcaacagcaaggtgaccagcagatttgcccacaacgtggtgaccatgagagctgtgaacagagctgacacagccaaggaggtgtcctttgatgtggagctgcccaagacagccttcatcaccaacttcaccctgaccattgatggagtgacctacccaggaaatgtgaaggagaaggaggtggccaagaagcagtatgagaaggctgtgtcccagggcaagacagctggcctggtgaaggccagcggcaggaagctggagaagttcaccgtgtctgtgaatgtggccgccggcagcaaggtgacctttgagctgacctatgaggagctgctgaagaggcacaagggcaagtatgagatgtacctgaaggtgcagcccaagcagctggtgaagcactttgaaattgaggtggacatctttgagccccagggcatctccatgctggatgctgaggccagcttcatcaccaatgacctgctgggcagcgccctgaccaagagcttcagcggcaagaagggccacgtgtccttcaagcccagcctggaccagcagaggagctgccccacctgcacagacagcctgctgaatggagacttcaccatcacctatgatgtgaaccgggagagccctggaaatgtgcagatcgtgaatggctactttgtgcacttctttgccccccagggcctgcctgtggtgcccaagaatgtggccttcgtcatcgacatcagcggctccatggccggcaggaagctggagcagaccaaggaggccctgctgcgcatcctggaggacatgcaggaggaggactacctgaacttcatcctcttctctggagatgtgtccacctggaaggagcacctggtgcaggccaccccagagaacctgcaggaggcccggacctttgtgaagtccatggaggacaagggcatgaccaacatcaatgatggcctgctgcggggcatctccatgctgaacaaggcccgggaggagcaccgcatccctgagaggagcaccagcatcgtcatcatgctgacagatggagatgccaacgtgggggagagcaggcctgagaagatccaggagaatgtgagaaatgccatcggcggcaagttccccctgtacaacctgggcttcggcaacaacctgaactacaacttcctggagaacatggccctggagaaccacggctttgcccggcgcatctatgaagattctgatgctgacctgcagctgcagggcttctatgaggaggtggccaaccccctgctgactggagtggagatggagtacccagaaaatgccatcctggacctgacccagaacacctaccagcacttctatgatggcagcgagatcgtggtggccggccgcctggtggatgaggacatgaacagcttcaaggcagatgtgaagggccatggagccaccaatgacctgaccttcacagaggaggtggacatgaaggagatggagaaggccctgcaggagcgggactacatctttggaaactacatcgagcggctgtgggcctacctgaccatcgagcagctgctggagaagaggaagaatgcccatggagaggagaaggagaacctgacagcccgggccctggacctgagcctgaagtaccactttgtgacccccctgacctccatggtggtgaccaagccagaggacaatgaagatgagcgggccatcgctgacaagccaggagagggcttcagcgccacccctgtgtccccagccatgagctacctgaccagctaccagcccccccagaacccctactactacgtggatggagacccccacttcatcatccagatccctgagaaggatgatgccctgtgcttcaacattgatgaggcccctggcaccgtgctgcggctcatccaggatgctgtgacaggcctgactgtgaatggccagatcactggagacaagaggggcagcccagacagcaagaccaggaagacctactttgggaagctgggcatcgccaatgcccagatggacttccaggtggaggtgaccacagagaagatcaccctgtggaacagagctgtgcccagcaccttctcctggctggacacagtgacagtgacccaggacggcctgtccatgatgatcaacaggaagaacatggtggtgtcctttggagatggagtgacctttgtggtggtgctgcaccaggtgtggaagaagcaccctgtgcaccgggacttcctgggcttctacgtggtggacagccacaggatgtctgcccagacccacggcctgctgggccagttcttccagccctttgacttcaaggtgtctgacatccggcccggcagtgaccccaccaagccagatgccaccctggtggtgaagaaccaccagctgattgtgacccggggcagccagaaggactacaggaaggatgccagcatcggcaccaaggtggtgtgctggtttgtgcacaacaatggagagggcctgattgatggagtgcacacagactacatcgtgcccaacctcttctag

SEQ ID NO: 156201 - DNA, 2013 bp, Artificial Sequence
  Description of Artificial Sequence: Synthetic coding sequence
atggcctttgcctggtggccctgcctgatcctggccctgctgagcagcctggccgccagcggcttccccaggagccccttccggctgctgggcaagaggagcctgcctgagggcgtggccaatggaattgaggtgtacagcaccaagatcaacagcaaggtgaccagcagatttgcccacaacgtggtgaccatgagagctgtgaacagagctgacacagccaaggaggtgtcctttgatgtggagctgcccaagacagccttcatcaccaacttcaccctgaccattgatggagtgacctacccaggaaatgtgaaggagaaggaggtggccaagaagcagtatgagaaggctgtgtcccagggcaagacagctggcctggtgaaggccagcggcaggaagctggagaagttcaccgtgtctgtgaatgtggccgccggcagcaaggtgacctttgagctgacctatgaggagctgctgaagaggcacaagggcaagtatgagatgtacctgaaggtgcagcccaagcagctggtgaagcactttgaaattgaggtggacatctttgagccccagggcatctccatgctggatgctgaggccagcttcatcaccaatgacctgctgggcagcgccctgaccaagagcttcagcggcaagaagggccacgtgtccttcaagcccagcctggaccagcagaggagctgccccacctgcacagacagcctgctgaatggagacttcaccatcacctatgatgtgaaccgggagagccctggaaatgtgcagatcgtgaatggctactttgtgcacttctttgccccccagggcctgcctgtggtgcccaagaatgtggcctttgtgattgacatcagcggctccatggccggcaggaagctggagcagaccaaggaggccctgctgcgcatcctggaggacatgcaggaggaggactacctgaacttcatcctcttctctggagatgtgtccacctggaaggagcacctggtgcaggccaccccagagaacctgcaggaggcccggacctttgtgaagtccatggaggacaagggcatgaccaacatcaatgatggcctgctgcggggcatctccatgctgaacaaggcccgggaggagcaccgcatccctgagaggagcaccagcatcgtcatcatgctgacagatggagatgccaacgtgggggagagcaggcctgagaagatccaggagaatgtgagaaatgccatcggcggcaagttccccctgtacaacctgggctttggaaacaacctgaactacaacttcctggagaacatggccctggagaaccacggctttgcccggcgcatctatgaggacagtgatgctgacctgcagctgcagggcttctatgaggaggtggccaaccccctgctgactggagtggagatggagtacccagaaaatgccatcctggacctgacccagaacacctaccagcacttctatgatggcagcgagatcgtggtggccggccgcctggtggatgaggacatgaacagcttcaaggcagatgtgaagggccacggggccaccaatgacctgaccttcacagaggaggtggacatgaaggagatggagaaggccctgcaggagcgggactacatcttcggcaactacatcgagcggctgtgggcctacctgaccatcgagcagctgctggagaagaggaagaatgcccacggggaggagaaggagaacctgacagcccgggccctggacctgagcctgaagtaccactttgtgacccccctgacctccatggtggtgaccaagccagaagataatgaagatgagcgggccatcgctgacaagccaggagagggcggggacagccacactggagagcccaggcatgtgctgcctgaccagctgcctgccagcagcaagcccctgctgctgtgtggccggggcagccccctgcaccaccccaacagcggggagcggcgctgccccctgctgcagcacaggtag

SEQ ID NO: 156202 - DNA, 2673 bp, Artificial Sequence
  Description of Artificial Sequence: Synthetic coding sequence
atggcctttgcctggtggccctgcctgatcctggccctgctgagcagcctggccgccagcggcttccccaggagccccttccggctgctgggcaagaggagcctgcctgagggcgtggccaatggaattgaggtgtacagcaccaagatcaacagcaaggtgaccagcagatttgcccacaacgtggtgaccatgagagctgtgaacagagctgacacagccaaggaggtgtcctttgatgtggagctgcccaagacagccttcatcaccaacttcaccctgaccattgatggagtgacctacccaggaaatgtgaaggagaaggaggtggccaagaagcagtatgagaaggctgtgtcccagggcaagacagctggcctggtgaaggccagcggcaggaagctggagaagttcaccgtgtctgtgaatgtggccgccggcagcaaggtgacctttgagctgacctatgaggagctgctgaagaggcacaagggcaagtatgagatgtacctgaaggtgcagcccaagcagctggtgaagcactttgaaattgaggtggacatctttgagccccagggcatctccatgctggatgctgaggccagcttcatcaccaatgacctgctgggcagcgccctgaccaagagcttcagcggcaagaagggccacgtgtccttcaagcccagcctggaccagcagaggagctgccccacctgcacagacagcctgctgaatggagacttcaccatcacctatgatgtgaaccgggagagccctggaaatgtgcagatcgtgaatggctactttgtgcacttctttgccccccagggcctgcctgtggtgcccaagaatgtggcctttgtgattgacatcagcggctccatggccggcaggaagctggagcagaccaaggaggccctgctgcgcatcctggaggacatgcaggaggaggactacctgaacttcatcctcttctctggagatgtgtccacctggaaggagcacctggtgcaggccaccccagagaacctgcaggaggcccggacctttgtgaagtccatggaggacaagggcatgaccaacatcaatgatggcctgctgcggggcatctccatgctgaacaaggcccgggaggagcaccgcatccctgagaggagcaccagcatcgtcatcatgctgacagatggagatgccaacgtgggggagagcaggcctgagaagatccaggagaatgtgagaaatgccatcggcggcaagttccccctgtacaacctgggctttggaaacaacctgaactacaacttcctggagaacatggccctggagaaccacggctttgcccggcgcatctatgaggacagtgatgctgacctgcagctgcagggcttctatgaggaggtggccaaccccctgctgactggagtggagatggagtacccagaaaatgccatcctggacctgacccagaacacctaccagcacttctatgatggcagcgagatcgtggtggccggccgcctggtggatgaggacatgaacagcttcaaggcagatgtgaagggccacggggccaccaatgacctgaccttcacagaggaggtggacatgaaggagatggagaaggccctgcaggagcgggactacatcttcggcaactacatcgagcggctgtgggcctacctgaccatcgagcagctgctggagaagaggaagaatgcccacggggaggagaaggagaacctgacagcccgggccctggacctgagcctgaagtaccactttgtgacccccctgacctccatggtggtgaccaagccagaagataatgaagatgagcgggccatcgctgacaagccaggagaagatgctgaggccacccctgtgtccccagccatgagctacctgaccagctaccagcccccccagaacccctactactacgtggatggagacccccacttcatcatccagatccctgagaaggatgatgccctgtgcttcaacattgatgaggcccctggcaccgtgctgcggctcatccaggatgctgtgacaggcctgactgtgaatggccagatcaccggggacaagaggggcagcccagacagcaagaccaggaagacctactttgggaagctgggcatcgccaatgcccagatggacttccaggtggaggtgaccacagagaagatcaccctgtggaacagagctgtgcccagcaccttctcctggctggacacagtgacagtgacccaggacggcctgtccatgatgatcaacaggaagaacatggtggtgtcctttggagatggagtgacctttgtggtggtgctgcaccaggtgtggaagaagcaccctgtgcaccgggacttcctgggcttctacgtggtggacagccacaggatgtctgcccagacccacggcctgctgggccagttcttccagccctttgacttcaaggtgtctgacatccggcccggcagtgaccccaccaagccagatgccaccctggtggtgaagaaccaccagctgattgtgacccggggcagccagaaggactacaggaaggatgccagcatcggcaccaaggtggtgtgctggtttgtgcacaacaacggggagggcctgattgatggagtgcacacagactacatcgtgcccaacctcttctag

SEQ ID NO: 156203 - DNA, 1977 bp, Artificial Sequence
  Description of Artificial Sequence: Synthetic coding sequence
atggcctttgcctggtggccctgcctgatcctggccctgctgagcagcctggccgccagcggcttccccaggagccccttccggctgctgggcaagaggagcctgcctgagggcgtggccaatggaattgaggtgtacagcaccaagatcaacagcaaggtgaccagcagatttgcccacaacgtggtgaccatgagagctgtgaacagagctgacacagccaaggaggtgtcctttgatgtggagctgcccaagacagccttcatcaccaacttcaccctgaccattgatggagtgacctacccaggaaatgtgaaggagaaggaggtggccaagaagcagtatgagaaggctgtgtcccagggcaagacagctggcctggtgaaggccagcggcaggaagctggagaagttcaccgtgtctgtgaatgtggccgccggcagcaagaggcacaagggcaagtatgagatgtacctgaaggtgcagcccaagcagctggtgaagcactttgaaattgaggtggacatctttgagccccagggcatctccatgctggatgctgaggccagcttcatcaccaatgacctgctgggcagcgccctgaccaagagcttcagcggcaagaagggccacgtgtccttcaagcccagcctggaccagcagaggagctgccccacctgcacagacagcctgctgaatggagacttcaccatcacctatgatgtgaaccgggagagccctggaaatgtgcagatcgtgaatggctactttgtgcacttctttgccccccagggcctgcctgtggtgcccaagaatgtggcctttgtgattgacatcagcggctccatggccggcaggaagctggagcagaccaaggaggccctgctgcgcatcctggaggacatgcaggaggaggactacctgaacttcatcctcttctctggagatgtgtccacctggaaggagcacctggtgcaggccaccccagagaacctgcaggaggcccggacctttgtgaagtccatggaggacaagggcatgaccaacatcaatgatggcctgctgcggggcatctccatgctgaacaaggcccgggaggagcaccgcatccctgagaggagcaccagcatcgtcatcatgctgacagatggagatgccaacgtgggggagagcaggcctgagaagatccaggagaatgtgagaaatgccatcggcggcaagttccccctgtacaacctgggctttggaaacaacctgaactacaacttcctggagaacatggccctggagaaccacggctttgcccggcgcatctatgaggacagtgatgctgacctgcagctgcagggcttctatgaggaggtggccaaccccctgctgactggagtggagatggagtacccagaaaatgccatcctggacctgacccagaacacctaccagcacttctatgatggcagcgagatcgtggtggccggccgcctggtggatgaggacatgaacagcttcaaggcagatgtgaagggccacggggccaccaatgacctgaccttcacagaggaggtggacatgaaggagatggagaaggccctgcaggagcgggactacatcttcggcaactacatcgagcggctgtgggcctacctgaccatcgagcagctgctggagaagaggaagaatgcccacggggaggagaaggagaacctgacagcccgggccctggacctgagcctgaagtaccactttgtgacccccctgacctccatggtggtgaccaagccagaagataatgaagatgagcgggccatcgctgacaagccaggagagggcggggacagccacactggagagcccaggcatgtgctgcctgaccagctgcctgccagcagcaagcccctgctgctgtgtggccggggcagccccctgcaccaccccaacagcggggagcggcgctgccccctgctgcagcacaggtag

SEQ ID NO: 156204 - DNA, 2793 bp, Artificial Sequence
  Description of Artificial Sequence: Synthetic coding sequence
atgaagccacccaggcctgtgaggacctgcagcaaggtgctggtgctgctgagcctgctggccatccaccagaccaccacagctgagaagaatggaattgacatctacagcctgactgtggacagccgggtgagcagcagatttgcccacacagtggtgaccagccgggtggtgaacagagccaacacagtgcaggaggccaccttccagatggagctgcccaagaaggccttcatcaccaacttctccatgatcattgatggcatgacctacccaggcatcatcaaggagaaggccgaggcccaggcccagtacagcgctgctgtggccaagggcaagtctgctggcctggtgaaggccactggaagaaacatggagcagttccaggtgtctgtgtctgtggccccaaatgccaagatcacctttgagctggtgtatgaggagctgctgaagaggcggctgggcgtgtatgagctgctgctgaaggtgcggccccagcagctggtgaagcacctgcagatggacatccacatctttgagccccagggcatctccttcctggagacagagagcaccttcatgaccaaccagctggtggatgccctgaccacctggcagaacaagaccaaggcccacatccgcttcaagcccaccctgagccagcagcagaagagccctgagcagcaggagaccgtgctggatggcaacctgatcatccgctatgatgtggaccgggccatcagcggcggcagcatccagattgaaaatggctactttgtgcactactttgcccctgagggcctgaccaccatgcccaagaatgtggtgtttgtgattgacaagagcggctccatgagcggcaggaagatccagcagacccgggaggccctgatcaagatcctggatgacctgagcccccgggaccagttcaacctgattgtgttcagcacagaggccacccagtggaggcccagcctggtgcctgccagcgcagaaaatgtgaacaaggcccggagctttgctgctggcatccaggccctgggcggcaccaacatcaatgatgccatgctgatggctgtgcagctgctggacagcagcaaccaggaggagcggctgcctgagggctctgtgtccctcatcatcctgctgacagatggagaccccaccgtgggggagaccaaccccaggagcatccagaacaacgtgcgggaggccgtgtctggccgctacagcctcttctgcctgggctttggatttgatgtgtcctatgccttcctggagaagctggccctggacaatggaggcctggcccggcgcatccacgaggacagcgacagcgccctgcagctgcaggacttctaccaggaggtggccaaccccctgctgacagctgtgacctttgagtaccccagcaatgctgtggaggaggtgacccagaacaacttccggctgctcttcaagggcagcgagatggtggtggccggcaagctgcaggaccggggcccagatgtgctgacagccaccgtgtctgggaagctgcccacccagaacatcaccttccagacagagagctctgtggccgagcaggaggccgagttccagagccccaagtacatcttccacaacttcatggagcggctgtgggcctacctgaccatccagcagctgctggagcagacagtgtctgccagtgatgctgaccagcaggccctgaggaaccaggccctgaacctgagcctggcctacagctttgtgacccccctgacctccatggtggtgaccaagccagatgaccaggagcagagccaggtggccgagaagcccatggagggggagagcaggaacagaaatgtgcacagcggcagcaccttcttcaagtactacctgcagggcgccaagatccccaagccagaggccagcttcagcccccggcggggctggaaccggcaggccggggccgccggcagcaggatgaacttccggcctggggtgctgagcagccggcagctgggcctgcccggccccccagatgtgcctgaccacgccgcctaccaccccttccggcggctggccatcctgcctgccagcgcccccccagccaccagcaacccagaccctgctgtgtcccgggtgatgaacatgaagattgaggagaccaccatgaccacccagaccccagcccccatccaggcccccagcgccatcctgcccctgcccggccagagcgtggagcggctgtgtgtggaccccaggcaccggcagggccctgtgaacctgctgagtgaccctgagcagggcgtggaggtgacaggccagtatgagcgggagaaggccggcttctcctggattgaggtgaccttcaagaaccccctggtgtgggtgcacgccagccctgagcacgtggtggtgaccaggaacagaagaagcagcgcctacaagtggaaggagaccctcttctctgtgatgcctggcctgaagatgaccatggacaagacaggcctgctgctgctgagtgaccctgacaaggtgaccatcggcctgctcttctgggatggccgcggggagggcctgcggctgctgctgcgggacacagaccgcttcagcagccacgtgggcggcaccctgggccagttctaccaggaggtgctgtggggcagccctgctgccagtgatgatggccgccgcaccctgcgggtgcagggcaatgaccacagcgccacccgggagcggcggctggactaccaggagggccccccaggagtggagatcagctgctggagcgtggagctgtag

SEQ ID NO: 156205 - DNA, 2745 bp, Artificial Sequence
  Description of Artificial Sequence: Synthetic coding sequence
atgaagccacccaggcctgtgaggacctgcagcaaggtgctggtgctgctgagcctgctggccatccaccagaccaccacagctgagaagaatggaattgacatctacagcctgactgtggacagccgggtgagcagcagatttgcccacacagtggtgaccagccgggtggtgaacagagccaacacagtgcaggaggccaccttccagatggagctgcccaagaaggccttcatcaccaacttctccatgatcattgatggcatgacctacccaggcatcatcaaggagaaggccgaggcccaggcccagtacagcgctgctgtggccaagggcaagtctgctggcctggtgaaggccactggaagaaacatggagcagttccaggtgtctgtgtctgtggccccaaatgccaagatcacctttgagctggtgtatgaggagctgctgaagaggcggctgggcgtgtatgagctgctgctgaaggtgcggccccagcagctggtgaagcacctgcagatggacatccacatctttgagccccagggcatctccttcctggagacagagagcaccttcatgaccaaccagctggtggatgccctgaccacctggcagaacaagaccaaggcccacatccgcttcaagcccaccctgagccagcagcagaagagccctgagcagcaggagaccgtgctggatggcaacctgatcatccgctatgatgtggaccgggccatcagcggcggcagcatccagattgaaaatggctactttgtgcactactttgcccctgagggcctgaccaccatgcccaagaatgtggtgtttgtgattgacaagagcggctccatgagcggcaggaagatccagcagacccgggaggccctgatcaagatcctggatgacctgagcccccgggaccagttcaacctgattgtgttcagcacagaggccacccagtggaggcccagcctggtgcctgccagcgcagaaaatgtgaacaaggcccggagctttgctgctggcatccaggccctgggcggcaccaacatcaatgatgccatgctgatggctgtgcagctgctggacagcagcaaccaggaggagcggctgcctgagggctctgtgtccctcatcatcctgctgacagatggagaccccaccgtgggggagaccaaccccaggagcatccagaacaacgtgcgggaggccgtgtctggccgctacagcctcttctgcctgggctttggatttgatgtgtcctatgccttcctggagaagctggccctggacaatggaggcctggcccggcgcatccacgaggacagcgacagcgccctgcagctgcaggacttctaccaggaggtggccaaccccctgctgacagctgtgacctttgagtaccccagcaatgctgtggaggaggtgacccagaacaacttccggctgctcttcaagggcagcgagatggtggtggccggcaagctgcaggaccggggcccagatgtgctgacagccaccgtgtctgggaagctgcccacccagaacatcaccttccagacagagagctctgtggccgagcaggaggccgagttccagagccccaagtacatcttccacaacttcatggagcggctgtgggcctacctgaccatccagcagctgctggagcagacagtgtctgccagtgatgctgaccagcaggccctgaggaaccaggccctgaacctgagcctggcctacagctttgtgacccccctgacctccatggtggtgaccaagccagatgaccaggagcagagccaggtggccgagaagcccatggagggggagagcaggaacagaaatgtgcacagcgctggagctgctggcagcaggatgaacttccggcctggggtgctgagcagccggcagctgggcctgcccggccccccagatgtgcctgaccacgccgcctaccaccccttccggcggctggccatcctgcctgccagcgcccccccagccaccagcaacccagaccctgctgtgtcccgggtgatgaacatgaagattgaggagaccaccatgaccacccagaccccagcctgccccagctgcagccgcagccgggccccagctgtgcctgcccccatccaggcccccagcgccatcctgcccctgcccggccagagcgtggagcggctgtgtgtggaccccaggcaccggcagggccctgtgaacctgctgagtgaccctgagcagggcgtggaggtgacaggccagtatgagcgggagaaggccggcttctcctggattgaggtgaccttcaagaaccccctggtgtgggtgcacgccagccctgagcacgtggtggtgaccaggaacagaagaagcagcgcctacaagtggaaggagaccctcttctctgtgatgcctggcctgaagatgaccatggacaagacaggcctgctgctgctgagtgaccctgacaaggtgaccatcggcctgctcttctgggatggccgcggggagggcctgcggctgctgctgcgggacacagaccgcttcagcagccacgtgggcggcaccctgggccagttctaccaggaggtgctgtggggcagccctgctgccagtgatgatggccgccgcaccctgcgggtgcagggcaatgaccacagcgccacccgggagcggcggctggactaccaggagggccccccaggagtggagatcagctgctggagcgtggagctgtag

SEQ ID NO: 156206 - DNA, 2703 bp, Artificial Sequence
  Description of Artificial Sequence: Synthetic coding sequence
atgaagccacccaggcctgtgaggacctgcagcaaggtgctggtgctgctgagcctgctggccatccaccagaccaccacagctgagaagaatggaattgacatctacagcctgactgtggacagccgggtgagcagcagatttgcccacacagtggtgaccagccgggtggtgaacagagccaacacagtgcaggaggccaccttccagatggagctgcccaagaaggccttcatcaccaacttctccatgatcattgatggcatgacctacccaggcatcatcaaggagaaggccgaggcccaggcccagtacagcgctgctgtggccaagggcaagtctgctggcctggtgaaggccactggaagaaacatggagcagttccaggtgtctgtgtctgtggccccaaatgccaagatcacctttgagctggtgtatgaggagctgctgaagaggcggctgggcgtgtatgagctgctgctgaaggtgcggccccagcagctggtgaagcacctgcagatggacatccacatctttgagccccagggcatctccttcctggagacagagagcaccttcatgaccaaccagctggtggatgccctgaccacctggcagaacaagaccaaggcccacatccgcttcaagcccaccctgagccagcagcagaagagccctgagcagcaggagaccgtgctggatggcaacctgatcatccgctatgatgtggaccgggccatcagcggcggcagcatccagattgaaaatggctactttgtgcactactttgcccctgagggcctgaccaccatgcccaagaatgtggtgtttgtgattgacaagagcggctccatgagcggcaggaagatccagcagacccgggaggccctgatcaagatcctggatgacctgagcccccgggaccagttcaacctgattgtgttcagcacagaggccacccagtggaggcccagcctggtgcctgccagcgcagaaaatgtgaacaaggcccggagctttgctgctggcatccaggccctgggcggcaccaacatcaatgatgccatgctgatggctgtgcagctgctggacagcagcaaccaggaggagcggctgcctgagggctctgtgtccctcatcatcctgctgacagatggagaccccaccgtgggggagaccaaccccaggagcatccagaacaacgtgcgggaggccgtgtctggccgctacagcctcttctgcctgggctttggatttgatgtgtcctatgccttcctggagaagctggccctggacaatggaggcctggcccggcgcatccacgaggacagcgacagcgccctgcagctgcaggacttctaccaggaggtggccaaccccctgctgacagctgtgacctttgagtaccccagcaatgctgtggaggaggtgacccagaacaacttccggctgctcttcaagggcagcgagatggtggtggccggcaagctgcaggaccggggcccagatgtgctgacagccaccgtgtctgggaagctgcccacccagaacatcaccttccagacagagagctctgtggccgagcaggaggccgagttccagagccccaagtacatcttccacaacttcatggagcggctgtgggcctacctgaccatccagcagctgctggagcagacagtgtctgccagtgatgctgaccagcaggccctgaggaaccaggccctgaacctgagcctggcctacagctttgtgacccccctgacctccatggtggtgaccaagccagatgaccaggagcagagccaggtggccgagaagcccatggagggggagagcaggaacagaaatgtgcacagcgctggagctgctggcagcaggatgaacttccggcctggggtgctgagcagccggcagctgggcctgcccggccccccagatgtgcctgaccacgccgcctaccaccccttccggcggctggccatcctgcctgccagcgcccccccagccaccagcaacccagaccctgctgtgtcccgggtgatgaacatgaagattgaggagaccaccatgaccacccagaccccagcccccatccaggcccccagcgccatcctgcccctgcccggccagagcgtggagcggctgtgtgtggaccccaggcaccggcagggccctgtgaacctgctgagtgaccctgagcagggcgtggaggtgacaggccagtatgagcgggagaaggccggcttctcctggattgaggtgaccttcaagaaccccctggtgtgggtgcacgccagccctgagcacgtggtggtgaccaggaacagaagaagcagcgcctacaagtggaaggagaccctcttctctgtgatgcctggcctgaagatgaccatggacaagacaggcctgctgctgctgagtgaccctgacaaggtgaccatcggcctgctcttctgggatggccgcggggagggcctgcggctgctgctgcgggacacagaccgcttcagcagccacgtgggcggcaccctgggccagttctaccaggaggtgctgtggggcagccctgctgccagtgatgatggccgccgcaccctgcgggtgcagggcaatgaccacagcgccacccgggagcggcggctggactaccaggagggccccccaggagtggagatcagctgctggagcgtggagctgtag

SEQ ID NO: 156207 - DNA, 1683 bp, Artificial Sequence
  Description of Artificial Sequence: Synthetic coding sequence
atgacctacccaggcatcatcaaggagaaggccgaggcccaggcccagtacagcgctgctgtggccaagggcaagtctgctggcctggtgaaggccactggaagaaacatggagcagttccaggtgtctgtgtctgtggccccaaatgccaagatcacctttgagctggtgtatgaggagctgctgaagaggcggctgggcgtgtatgagctgctgctgaaggtgcggccccagcagctggtgaagcacctgcagatggacatccacatctttgagccccagggcatctccttcctggagacagagagcaccttcatgaccaaccagctggtggatgccctgaccacctggcagaacaagaccaaggcccacatccgcttcaagcccaccctgagccagcagcagaagagccctgagcagcaggagaccgtgctggatggcaacctgatcatccgctatgatgtggaccgggccatcagcggcggcagcatccagattgaaaatggctactttgtgcactactttgcccctgagggcctgaccaccatgcccaagaatgtggtgtttgtgattgacaagagcggctccatgagcggcaggaagatccagcagacccgggaggccctgatcaagatcctggatgacctgagcccccgggaccagttcaacctgattgtgttcagcacagaggccacccagtggaggcccagcctggtgcctgccagcgcagaaaatgtgaacaaggcccggagctttgctgctggcatccaggccctgggcggcaccaacatcaatgatgccatgctgatggctgtgcagctgctggacagcagcaaccaggaggagcggctgcctgagggctctgtgtccctcatcatcctgctgacagatggagaccccaccgtgggggagaccaaccccaggagcatccagaacaacgtgcgggaggccgtgtctggccgctacagcctcttctgcctgggctttggatttgatgtgtcctatgccttcctggagaagctggccctggacaatggaggcctggcccggcgcatccacgaggacagcgacagcgccctgcagctgcaggacttctaccaggaggtggccaaccccctgctgacagctgtgacctttgagtaccccagcaatgctgtggaggaggtgacccagaacaacttccggctgctcttcaagggcagcgagatggtggtggccggcaagctgcaggaccggggcccagatgtgctgacagccaccgtgtctgggaagctgcccacccagaacatcaccttccagacagagagctctgtggccgagcaggaggccgagttccagagccccaagtacatcttccacaacttcatggagcggctgtgggcctacctgaccatccagcagctgctggagcagacagtgtctgccagtgatgctgaccagcaggccctgaggaaccaggccctgaacctgagcctggcctacagctttgtgacccccctgacctccatggtggtgaccaagccagatgaccaggagcagagccaggtggccgagaagcccatggagggggagagcaggaacagaaatgtgcacagcggcagcaccttcttcaagtactacctgcagggcgccaagatccccaagccaggggacaaggtgggcggcggcggccgcggggactag

SEQ ID NO: 156208 - DNA, 2667 bp, Artificial Sequence
  Description of Artificial Sequence: Synthetic coding sequence
atgaagccacccaggcctgtgaggacctgcagcaaggtgctggtgctgctgagcctgctggccatccaccagaccaccacagctgagaagaatggaattgacatctacagcctgactgtggacagccgggtgagcagcagatttgcccacacagtggtgaccagccgggtggtgaacagagccaacacagtgcaggaggccaccttccagatggagctgcccaagaaggccttcatcaccaacttctccatgatcattgatggcatgacctacccaggcatcatcaaggagaaggccgaggcccaggcccagtacagcgctgctgtggccaagggcaagtctgctggcctggtgaaggccactggaagaaacatggagcagttccaggtgtctgtgtctgtggccccaaatgccaagaggcggctgggcgtgtatgagctgctgctgaaggtgcggccccagcagctggtgaagcacctgcagatggacatccacatctttgagccccagggcatctccttcctggagacagagagcaccttcatgaccaaccagctggtggatgccctgaccacctggcagaacaagaccaaggcccacatccgcttcaagcccaccctgagccagcagcagaagagccctgagcagcaggagaccgtgctggatggcaacctgatcatccgctatgatgtggaccgggccatcagcggcggcagcatccagattgaaaatggctactttgtgcactactttgcccctgagggcctgaccaccatgcccaagaatgtggtgtttgtgattgacaagagcggctccatgagcggcaggaagatccagcagacccgggaggccctgatcaagatcctggatgacctgagcccccgggaccagttcaacctgattgtgttcagcacagaggccacccagtggaggcccagcctggtgcctgccagcgcagaaaatgtgaacaaggcccggagctttgctgctggcatccaggccctgggcggcaccaacatcaatgatgccatgctgatggctgtgcagctgctggacagcagcaaccaggaggagcggctgcctgagggctctgtgtccctcatcatcctgctgacagatggagaccccaccgtgggggagaccaaccccaggagcatccagaacaacgtgcgggaggccgtgtctggccgctacagcctcttctgcctgggctttggatttgatgtgtcctatgccttcctggagaagctggccctggacaatggaggcctggcccggcgcatccacgaggacagcgacagcgccctgcagctgcaggacttctaccaggaggtggccaaccccctgctgacagctgtgacctttgagtaccccagcaatgctgtggaggaggtgacccagaacaacttccggctgctcttcaagggcagcgagatggtggtggccggcaagctgcaggaccggggcccagatgtgctgacagccaccgtgtctgggaagctgcccacccagaacatcaccttccagacagagagctctgtggccgagcaggaggccgagttccagagccccaagtacatcttccacaacttcatggagcggctgtgggcctacctgaccatccagcagctgctggagcagacagtgtctgccagtgatgctgaccagcaggccctgaggaaccaggccctgaacctgagcctggcctacagctttgtgacccccctgacctccatggtggtgaccaagccagatgaccaggagcagagccaggtggccgagaagcccatggagggggagagcaggaacagaaatgtgcacagcgctggagctgctggcagcaggatgaacttccggcctggggtgctgagcagccggcagctgggcctgcccggccccccagatgtgcctgaccacgccgcctaccaccccttccggcggctggccatcctgcctgccagcgcccccccagccaccagcaacccagaccctgctgtgtcccgggtgatgaacatgaagattgaggagaccaccatgaccacccagaccccagcccccatccaggcccccagcgccatcctgcccctgcccggccagagcgtggagcggctgtgtgtggaccccaggcaccggcagggccctgtgaacctgctgagtgaccctgagcagggcgtggaggtgacaggccagtatgagcgggagaaggccggcttctcctggattgaggtgaccttcaagaaccccctggtgtgggtgcacgccagccctgagcacgtggtggtgaccaggaacagaagaagcagcgcctacaagtggaaggagaccctcttctctgtgatgcctggcctgaagatgaccatggacaagacaggcctgctgctgctgagtgaccctgacaaggtgaccatcggcctgctcttctgggatggccgcggggagggcctgcggctgctgctgcgggacacagaccgcttcagcagccacgtgggcggcaccctgggccagttctaccaggaggtgctgtggggcagccctgctgccagtgatgatggccgccgcaccctgcgggtgcagggcaatgaccacagcgccacccgggagcggcggctggactaccaggagggccccccaggagtggagatcagctgctggagcgtggagctgtag

SEQ ID NO: 156209 - DNA, 2871 bp, Artificial Sequence
  Description of Artificial Sequence: Synthetic coding sequence
atgctgctgctgctgggcctgtgcctgggcctgagcctgtgtgtgggcagccaggaggaggcccagagctggggccacagcagcgagcaggacggcctgcgggtgccccggcaggtgcggctgctgcagaggctgaagaccaagcccctgatgacagagttctctgtgaagagcaccatcatcagccgctatgccttcaccaccgtgtcctgcaggatgctgaacagagccagcgaggaccaggacatcgagttccagatgcagatcccagctgctgccttcatcaccaacttcaccatgctgattggagacaaggtgtaccagggcgagatcacagagcgggagaagaagagcggggacagagtgaaggagaagaggaacaagaccacagaggagaatggagagaagggcacagagatcttccgggccagcgctgtgatccccagcaaggacaaggccgccttcttcctgtcctatgaggagctgctgcagaggcggctgggcaagtatgagcacagcatctctgtgcggccccagcagctgagcggccgcctgtctgtggatgtgaacatcctggagagcgctggcatcgccagcctggaggtgctgcccctgcacaacagccggcagaggggcagcggcagaggagaagatgacagcggccccccacccagcaccgtcatcaaccagaatgagacctttgccaacatcatcttcaagcccaccgtggtgcagcaggccagaattgcccagaatggcatcctgggggacttcatcatccgctatgatgtgaaccgggagcagagcatcggggacatccaggtgctgaatggctactttgtgcactactttgcccccaaggacctgccccccctgcccaagaatgtggtgtttgtgctggacagcagcgcctccatggtgggcaccaagctgcggcagaccaaggatgccctcttcaccatcctgcatgacctgcggccccaggaccgcttcagcatcatcggcttcagcaaccgcatcaaggtgtggaaggaccacctgatctctgtgaccccagacagcatcagagatggcaaggtgtacatccaccacatgagccccaccggcggcacagacatcaacggggccctgcagagggccatccggctgctgaacaagtatgtggcccacagcggcattggagacagatctgtgtccctgattgtgttcctgacagatggcaagcccaccgtgggggagacccacaccctgaagatcctgaacaacacccgggaggccgcccggggccaggtgtgcatcttcaccatcggcattggaaatgatgtggacttccggctgctggagaagctgagcctggagaactgtggcctgaccaggagagtgcatgaggaggaggatgctggcagccagctgattggcttctatgatgagatccgcacccccctgctgagtgacatcagaattgactacccacccagctctgtggtgcaggccaccaagaccctcttccccaactacttcaacggcagcgagatcatcatcgccggcaagctggtggacaggaagctggaccacctgcacgtggaggtgacagccagcaacagcaagaagttcatcatcctgaagacagatgtgcctgtgcggccccagaaggccggcaaggatgtgacaggcagccccaggcctggaggagatggagagggggacaccaaccacatcgagcggctgtggagctacctgaccaccaaggagctgctgagctcctggctgcagagtgatgatgagcctgagaaggagcggctgcggcagagggcccaggccctggccgtgtcctaccgcttcctgacccccttcacctccatgaagctgcggggccctgtgcccaggatggatggcctggaggaggcccacggcatgtctgctgccatgggccctgagcctgtggtgcagagcgtgagaggagctggcacccagcccggccccctgctgaagaagccctaccagccccgcatcaagatcagcaagacctctgtggatggagacccccactttgtggtggacttccccctgagccggctgactgtgtgcttcaacattgatggccagcccggggacatcctgcggctggtgtctgaccaccgggacagcggcgtgacagtgaatggagagctgattggagccccagccccacccaacggccacaagaagcagaggacctacctgcggaccatcaccatcctgatcaacaagccagagaggagctacctggagatcacccccagcagggtcatcctggatggaggagaccggctggtgctgccctgcaaccagagcgtggtggtgggctcctggggcctggaggtgtctgtgtctgccaatgccaacgtgacagtgaccatccagggcagcatcgccttcgtcatcctgatccacctgtacaagaagccagcccccttccagaggcaccacctgggcttctacatcgccaacagcgagggcctgagcagcaactgccacggcctgctgggccagttcctgaaccaggatgcccggctgacagaggaccctgctggccccagccagaacctgacccaccccctgctgctgcaggtgggggagggccctgaggccgtgctgactgtgaagggccaccaggtgcctgtggtgtggaagcagaggaagatctacaatggagaggagcagattgactgctggtttgccaggaacaatgctgccaagctgattgatggagagtacaaggactacctggccttccacccctttgacaccggcatggacacctggccaggaaatgtgcagggcgccctgaagctggccgccctgaagatgcaggtgcatgagggccagtag

SEQ ID NO: 156210 - DNA, 2229 bp, Artificial Sequence
  Description of Artificial Sequence: Synthetic coding sequence
atgaggaactatgacagcggccccccacccagcaccgtcatcaaccagaatgagacctttgccaacatcatcttcaagcccaccgtggtgcagcaggccagaattgcccagaatggcatcctgggggacttcatcatccgctatgatgtgaaccgggagcagagcatcggggacatccaggtgctgaatggctactttgtgcactactttgcccccaaggacctgccccccctgcccaagaatgtggtgtttgtgctggacagcagcgcctccatggtgggcaccaagctgcggcagaccaaggatgccctcttcaccatcctgcatgacctgcggccccaggaccgcttcagcatcatcggcttcagcaaccgcatcaaggtgtggaaggaccacctgatctctgtgaccccagacagcatcagagatggcaaggtgtacatccaccacatgagccccaccggcggcacagacatcaacggggccctgcagagggccatccggctgctgaacaagtatgtggcccacagcggcattggagacagatctgtgtccctgattgtgttcctgacagatggcaagcccaccgtgggggagacccacaccctgaagatcctgaacaacacccgggaggccgcccggggccaggtgtgcatcttcaccatcggcattggaaatgatgtggacttccggctgctggagaagctgagcctggagaactgtggcctgaccaggagagtgcatgaggaggaggatgctggcagccagctgattggcttctatgatgagatccgcacccccctgctgagtgacatcagaattgactacccacccagctctgtggtgcaggccaccaagaccctcttccccaactacttcaacggcagcgagatcatcatcgccggcaagctggtggacaggaagctggaccacctgcacgtggaggtgacagccagcaacagcaagaagttcatcatcctgaagacagatgtgcctgtgcggccccagaaggccggcaaggatgtgacaggcagccccaggcctggaggagatggagagggggacaccaaccacatcgagcggctgtggagctacctgaccaccaaggagctgctgagctcctggctgcagagtgatgatgagcctgagaaggagcggctgcggcagagggcccaggccctggccgtgtcctaccgcttcctgacccccttcacctccatgaagctgcggggccctgtgcccaggatggatggcctggaggaggcccacggcatgtctgctgccatgggccctgagcctgtggtgcagagcgtgagaggagctggcacccagcccggccccctgctgaagaagccctaccagccccgcatcaagatcagcaagacctctgtggatggagacccccactttgtggtggacttccccctgagccggctgactgtgtgcttcaacattgatggccagcccggggacatcctgcggctggtgtctgaccaccgggacagcggcgtgacagtgaatggagagctgattggagccccagccccacccaacggccacaagaagcagaggacctacctgcggaccatcaccatcctgatcaacaagccagagaggagctacctggagatcacccccagcagggtcatcctggatggaggagaccggctggtgctgccctgcaaccagagcgtggtggtgggctcctggggcctggaggtgtctgtgtctgccaatgccaacgtgacagtgaccatccagggcagcatcgccttcgtcatcctgatccacctgtacaagaagccagcccccttccagaggcaccacctgggcttctacatcgccaacagcgagggcctgagcagcaactgccacggcctgctgggccagttcctgaaccaggatgcccggctgacagaggaccctgctggccccagccagaacctgacccaccccctgctgctgcaggtgggggagggccctgaggccgtgctgactgtgaagggccaccaggtgcctgtggtgtggaagcagaggaagatctacaatggagaggagcagattgactgctggtttgccaggaacaatgctgccaagctgattgatggagagtacaaggactacctggccttccacccctttgacaccggcatggacacctggccaggaaatgtgcagggcgccctgaagctggccgccctgaagatgcaggtgcatgagggccagtag

SEQ ID NO: 156211 - DNA, 2109 bp, Artificial Sequence
  Description of Artificial Sequence: Synthetic coding sequence
atgctgctgctgctgggcctgtgcctgggcctgagcctgtgtgtgggcagccaggaggaggcccagagctggggccacagcagcgagcaggacggcctgcgggtgccccggcaggtgcggctgctgcagaggctgaagaccaagcccctgatgacagagttctctgtgaagagcaccatcatcagccgctatgccttcaccaccgtgtcctgcaggatgctgaacagagccagcgaggaccaggacatcgagttccagatgcagatcccagctgctgccttcatcaccaacttcaccatgctgattggagacaaggtgtaccagggcgagatcacagagcgggagaagaagagcggggacagagtgaaggagaagaggaacaagaccacagaggagaatggagagaagggcacagagatcttccgggccagcgctgtgatccccagcaaggacaaggccgccttcttcctgtcctatgaggagctgctgcagaggcggctgggcaagtatgagcacagcatctctgtgcggccccagcagctgagcggccgcctgtctgtggatgtgaacatcctggagagcgctggcatcgccagcctggaggtgctgcccctgcacaacagccggcagaggggcagcggcagaggagaagatgacagcggccccccacccagcaccgtcatcaaccagaatgagacctttgccaacatcatcttcaagcccaccgtggtgcagcaggccagaattgcccagaatggcatcctgggggacttcatcatccgctatgatgtgaaccgggagcagagcatcggggacatccaggtgctgaatggctactttgtgcactactttgcccccaaggacctgccccccctgcccaagaatgtggtgtttgtgctggacagcagcgcctccatggtgggcaccaagctgcggcagaccaaggatgccctcttcaccatcctgcatgacctgcggccccaggaccgcttcagcatcatcggcttcagcaaccgcatcaaggtgtggaaggaccacctgatctctgtgaccccagacagcatcagagatggcaaggtgtacatccaccacatgagccccaccggcggcacagacatcaacggggccctgcagagggccatccggctgctgaacaagtatgtggcccacagcggcattggagacagatctgtgtccctgattgtgttcctgacagatggcaagcccaccgtgggggagacccacaccctgaagatcctgaacaacacccgggaggccgcccggggccaggtgtgcatcttcaccatcggcattggaaatgatgtggacttccggctgctggagaagctgagcctggagaactgtggcctgaccaggagagtgcatgaggaggaggatgctggcagccagctgattggcttctatgatgagatccgcacccccctgctgagtgacatcagaattgactacccacccagctctgtggtgcaggccaccaagaccctcttccccaactacttcaacggcagcgagatcatcatcgccggcaagctggtggacaggaagctggaccacctgcacgtggaggtgacagccagcaacagcaagaagttcatcatcctgaagacagatgtgcctgtgcggccccagaaggccggcaaggatgtgacaggcagccccaggcctggaggagatggagagggggacaccaaccacatcgagcggctgtggagctacctgaccaccaaggagctgctgagctcctggctgcagagtgatgatgagcctgagaaggagcggctgcggcagagggcccaggccctggccgtgtcctaccgcttcctgacccccttcacctccatgaagctgcggggccctgtgcccaggatggatggcctggaggaggcccacggcatgtctgctgccatgggccctgagcctgtggtgcagagcgtgagaggagctggcacccagcccggccccctgctgaagaagccctaccagccccgcatcaagatcagcaagacctctgtgcggggcttccggcgggaggagcagatcttcagcaatgtgatgaagttcccctttgccagcatcctggagctgtag

SEQ ID NO: 156212 - DNA, 2088 bp, Artificial Sequence
  Description of Artificial Sequence: Synthetic coding sequence
atgctgctgctgctgggcctgtgcctgggcctgagcctgtgtgtgggcagccaggaggaggcccagagctggggccacagcagcgagcaggacggcctgcgggtgccccggcaggtgcggctgctgcagaggctgaagaccaagcccctgatgacagagttctctgtgaagagcaccatcatcagccgctatgccttcaccaccgtgtcctgcaggatgctgaacagagccagcgaggaccaggacatcgagttccagatgcagatcccagctgctgccttcatcaccaacttcaccatgctgattggagacaaggtgtaccagggcgagatcacagagcgggagaagaagagcggggacagagtgaaggagaagaggaacaagaccacagaggagaatggagagaagggcacagagatcttccgggccagcgctgtgatccccagcaaggacaaggccgccttcttcctgtcctatgaggagctgctgcagaggcggctgggcaagtatgagcacagcatctctgtgcggccccagcagctgagcggccgcctgtctgtggatgtgaacatcctggagagcgctggcatcgccagcctggaggtgctgcccctgcacaacagccggcagaggggcagcggcagaggagaagatgacagcggccccccacccagcaccgtcatcaaccagaatgagacctttgccaacatcatcttcaagcccaccgtggtgcagcaggccagaattgcccagaatggcatcctgggggacttcatcatccgctatgatgtgaaccgggagcagagcatcggggacatccaggtgctgaatggctactttgtgcactactttgcccccaaggacctgccccccctgcccaagaatgtggtgtttgtgctggacagcagcgcctccatggtgggcaccaagctgcggcagaccaaggatgccctcttcaccatcctgcatgacctgcggccccaggaccgcttcagcatcatcggcttcagcaaccgcatcaaggtgtggaaggaccacctgatctctgtgaccccagacagcatcagagatggcaaggtgtacatccaccacatgagccccaccggcggcacagacatcaacggggccctgcagagggccatccggctgctgaacaagtatgtggcccacagcggcattggagacagatctgtgtccctgattgtgttcctgacagatggcaagcccaccgtgggggagacccacaccctgaagatcctgaacaacacccgggaggccgcccggggccaggtgtgcatcttcaccatcggcattggaaatgatgtggacttccggctgctggagaagctgagcctggagaactgtggcctgaccaggagagtgcatgaggaggaggatgctggcagccagctgattggcttctatgatgagatccgcacccccctgctgagtgacatcagaattgactacccacccagctctgtggtgcaggccaccaagaccctcttccccaactacttcaacggcagcgagatcatcatcgccggcaagctggtggacaggaagctggaccacctgcacgtggaggtgacagccagcaacagcaagaagttcatcatcctgaagacagatgtgcctgtgcggccccagaaggccggcaaggatgtgacaggcagccccaggcctggaggagatggagagggggacaccaaccacatcgagcggctgtggagctacctgaccaccaaggagctgctgagctcctggctgcagagtgatgatgagcctgagaaggagcggctgcggcagagggcccaggccctggccgtgtcctaccgcttcctgacccccttcacctccatgaagctgcggggccctgtgcccaggatggatggcctggaggaggcccacggcatgtctgctgccatgggccctgagcctgtggtgcagagcgtgagaggagctggcacccagcccggccccctgctgaagaagccacccaacagcgtgaagaagaagcagaacaagaccaagaagagacatggaagagatggagtcttccccctgcaccacctgggcatcagatag

SEQ ID NO: 156213 - DNA, 2172 bp, Artificial Sequence
  Description of Artificial Sequence: Synthetic coding sequence
gacagcggccccccacccagcaccgtcatcaaccagaatgagacctttgccaacatcatcttcaagcccaccgtggtgcagcaggccagaattgcccagaatggcatcctgggggacttcatcatccgctatgatgtgaaccgggagcagagcatcggggacatccaggtgctgaatggctactttgtgcactactttgcccccaaggacctgccccccctgcccaagaatgtggtgtttgtgctggacagcagcgcctccatggtgggcaccaagctgcggcagaccaaggatgccctcttcaccatcctgcatgacctgcggccccaggaccgcttcagcatcatcggcttcagcaaccgcatcaaggtgtggaaggaccacctgatctctgtgaccccagacagcatcagagatggcaaggtgtacatccaccacatgagccccaccggcggcacagacatcaacggggccctgcagagggccatccggctgctgaacaagtatgtggcccacagcggcattggagacagatctgtgtccctgattgtgttcctgacagatggcaagcccaccgtgggggagacccacaccctgaagatcctgaacaacacccgggaggccgcccggggccaggtgtgcatcttcaccatcggcattggaaatgatgtggacttccggctgctggagaagctgagcctggagaactgtggcctgaccaggagagtgcatgaggaggaggatgctggcagccagctgattggcttctatgatgagatccgcacccccctgctgagtgacatcagaattgactacccacccagctctgtggtgcaggccaccaagaccctcttccccaactacttcaacggcagcgagatcatcatcgccggcaagctggtggacaggaagctggaccacctgcacgtggaggtgacagccagcaacagcaagaagttcatcatcctgaagacagatgtgcctgtgcggccccagaaggccggcaaggatgtgacaggcagccccaggcctggaggagatggagagggggacaccaaccacatcgagcggctgtggagctacctgaccaccaaggagctgctgagctcctggctgcagagtgatgatgagcctgagaaggagcggctgcggcagagggcccaggccctggccgtgtcctaccgcttcctgacccccttcacctccatgaagctgcggggccctgtgcccaggatggatggcctggaggaggcccacggcatgtctgctgccatgggccctgagcctgtggtgcagagcgtgagaggagctggcacccagcccggccccctgctgaagaagccctaccagccccgcatcaagatcagcaagacctctgtggatggagacccccactttgtggtggacttccccctgagccggctgactgtgtgcttcaacattgatggccagcccggggacatcctgcggctggtgtctgaccaccgggacagcggcgtgacagtgaatggagagctgattggagccccagccccacccaacggccacaagaagcagaggacctacctgcggaccatcaccatcctgatcaacaagccagagaggagctacctggagatcacccccagcagggtcatcctggatggaggagaccggctggtgctgccctgcaaccagagcgtggtggtgggctcctggggcctggaggtgtctgtgtctgccaatgccaacgtgacagtgaccatccagggcagcatcgccttcgtcatcctgatccacctgtacaagaagccagcccccttccagaggcaccacctgggcttctacatcgccaacagcgagggcctgagcagcaactgccacggcctgctgggccagttcctgaaccaggatgcccggctgacagaggaccctgctggccccagccagaacctgacccaccccctgctgctgcaggtgggggagggccctgaggccgtgctgactgtgaagggccaccaggtgcctgtggtgtggaagcagaggaagatctacaatggagaggagcagattgactgctggtttgccaggaacaatgctgccaagctgattgatggagagtacaaggactacctggccttccacccctttgacaccggcatgctgggccggggcatgagccgggagctgtag

SEQ ID NO: 156214 - DNA, 1599 bp, Artificial Sequence
  Description of Artificial Sequence: Synthetic coding sequence
atggcccccagcagccccaggcctgccctgcctgccctgctggtgctgctgggcgccctcttccctggccctggaaatgcccagacctctgtgagccccagcaaggtgatcctgccccggggcggctctgtgctggtgacctgcagcaccagctgtgaccagcccaagctgctgggcatcgagacccccctgcccaagaaggagctgctgctgcccggcaacaacaggaaggtgtatgagctgagcaatgtgcaggaggacagccagcccatgtgctacagcaactgcccagatggccagagcacagccaagaccttcctgactgtgtactggaccccagagcgggtggagctggcccccctgcccagctggcagcctgtgggcaagaacctgaccctgcgctgccaggtggagggcggggccccccgggccaacctgactgtggtgctgctgcggggggagaaggagctgaagcgggagcctgctgtgggggagcctgctgaggtgaccaccaccgtgctggtgcggcgggaccaccacggggccaacttcagctgcaggacagagctggacctgcggccccagggcctggagctgtttgagaacaccagcgccccctaccagctgcagacctttgtgctgcctgccaccccaccccagctggtgagcccccgggtgctggaggtggacacccagggcaccgtggtgtgcagcctggatggcctcttccctgtgtctgaggcccaggtgcacctggccctgggggaccagaggctgaaccccaccgtgacctatggaaatgacagcttcagcgccaaggcctctgtgtctgtgacagcagaagatgagggcacccagaggctgacctgtgctgtgatcctgggcaaccagagccaggagaccctgcagacagtgaccatctacagcttccctgcccccaacgtcatcctgaccaagccagaggtgtctgagggcacagaggtgacagtgaagtgtgaggcccacccccgggccaaggtgaccctgaatggagtgcctgcccagcccctgggcccccgggcccagctgctgctgaaggccaccccagaagataatggccgctccttcagctgcagcgccaccctggaggtggccggccagctgatccacaagaaccagacccgggagctgcgggtgctgtatggcccccggctggatgagcgggactgccccggcaactggacctggccagagaacagccagcagacccccatgtgccaggcctggggcaaccccctgcctgagctgaagtgcctgaaggatggcaccttccccctgcccatcggggagagcgtgacagtgacccgggacctggagggcacctacctgtgccgggcccggagcacccagggcgaggtgaccaggaaggtgacagtgaatgtgctgagccccaggtatgaaattgtcatcatcaccgtggtggccgccgccgtcatcatgggcacagctggcctgagcacctacctgtacaaccggcagaggaagatcaagaagtaccgcctgcagcaggcccagaagggcacccccatgaagcccaacacccaggccaccccaccctag

SEQ ID NO: 156215 - DNA, 933 bp, Artificial Sequence
  Description of Artificial Sequence: Synthetic coding sequence
atggcccccagcagccccaggcctgccctgcctgccctgctggtgctgctgggcgccctcttccctgtgtctgaggcccaggtgcacctggccctgggggaccagaggctgaaccccaccgtgacctatggaaatgacagcttcagcgccaaggcctctgtgtctgtgacagcagaagatgagggcacccagaggctgacctgtgctgtgatcctgggcaaccagagccaggagaccctgcagacagtgaccatctacagcttccctgcccccaacgtcatcctgaccaagccagaggtgtctgagggcacagaggtgacagtgaagtgtgaggcccacccccgggccaaggtgaccctgaatggagtgcctgcccagcccctgggcccccgggcccagctgctgctgaaggccaccccagaagataatggccgctccttcagctgcagcgccaccctggaggtggccggccagctgatccacaagaaccagacccgggagctgcgggtgctgtatggcccccggctggatgagcgggactgccccggcaactggacctggccagagaacagccagcagacccccatgtgccaggcctggggcaaccccctgcctgagctgaagtgcctgaaggatggcaccttccccctgcccatcggggagagcgtgacagtgacccgggacctggagggcacctacctgtgccgggcccggagcacccagggcgaggtgaccaggaaggtgacagtgaatgtgctgagccccaggtatgaaattgtcatcatcaccgtggtggccgccgccgtcatcatgggcacagctggcctgagcacctacctgtacaaccggcagaggaagatcaagaagtaccgcctgcagcaggcccagaagggcacccccatgaagcccaacacccaggccaccccaccctag

SEQ ID NO: 156216 - DNA, 828 bp, Artificial Sequence
  Description of Artificial Sequence: Synthetic coding sequence
atgagcagctttggctaccgcaccctgactgtggccctcttcaccctcatctgctgccccggcagtgatgagaaggtgtttgaggtgcacgtgcggcccaagaagctggccgtggagcccaagggcagcctggaggtgaactgcagcaccacctgcaaccagcctgaggtgggcggcctggagaccagcctggacaagatcctgctggatgagcaggcccagtggaagcactacctggtgagcaacatcagccatgacacagtgctgcagtgccacttcacctgcagcggcaagcaggagagcatgaacagcaatgtgtctgtgtaccagcccccccggcaggtgatcctgaccctgcagcccaccctggtggccgtgggcaagagcttcaccattgaatgtcgggtgcccaccgtggagcccctggacagcctgaccctcttcctgttcagaggaaatgagaccctgcactatgagaccttcggcaaggccgccccagccccccaggaggccacagccaccttcaacagcacagctgaccgggaggatggccacaggaacttcagctgcctggccgtgctggacctgatgagccggggcggcaacatcttccacaagcacagcgcccccaagatgctggagatctatgagcctgtgtctgacagccagatggtgatcatcgtgacagtggtgtctgtgctgctgagcctgtttgtgacctctgtgctgctgtgcttcatcttcggccagcacctgcggcagcagaggatgggcacctacggcgtgcgggccgcctggaggcggctgccccaggccttccggccctag

SEQ ID NO: 156217 - DNA, 828 bp, Artificial Sequence; identical to SEQ ID NO: 156216
  Description of Artificial Sequence: Synthetic coding sequence

SEQ ID NO: 156218 - DNA, 828 bp, Artificial Sequence; identical to SEQ ID NO: 156216
  Description of Artificial Sequence: Synthetic coding sequence

SEQ ID NO: 156219 - DNA, 828 bp, Artificial Sequence; identical to SEQ ID NO: 156216
  Description of Artificial Sequence: Synthetic coding sequence

SEQ ID NO: 156220 - DNA, 828 bp, Artificial Sequence; identical to SEQ ID NO: 156216
  Description of Artificial Sequence: Synthetic coding sequence

SEQ ID NO: 156221 - DNA, 1644 bp, Artificial Sequence
  Description of Artificial Sequence: Synthetic coding sequence
atggccaccatggtgcccagcgtgctgtggccccgggcctgctggaccctgctggtgtgctgcctgctgaccccaggagtgcagggccaggagttcctgctgcgggtggagccccagaaccctgtgctgtctgctgggggcagcctgtttgtgaactgcagcacagactgccccagcagcgagaagatcgccctggagaccagcctgagcaaggagctggtggccagcggcatgggctgggccgccttcaacctgagcaatgtgactggaaacagccgcatcctgtgcagcgtgtactgcaatggcagccagatcaccggcagcagcaacatcaccgtgtaccgcctgcctgagcgggtggagctggcccccctgcccccctggcagcctgtgggccagaacttcaccctgcgctgccaggtggaggatggcagccccaggaccagcctgactgtggtgctgctgcgctgggaggaggagctgagccggcagcctgctgtggaggagcctgctgaggtgacagccaccgtgctggccagcagagatgaccacggggcccccttcagctgcaggacagagctggacatgcagccccagggcctgggcctgtttgtgaacaccagcgccccccggcagctgcggacctttgtgctgcctgtgaccccaccccggctggtggccccccgcttcctggaggtggagacctcctggcctgtggactgcaccctggatggcctcttccctgccagcgaggcccaggtgtacctggccctgggggaccagatgctgaatgccaccgtgatgaaccacggggacaccctgacagccacagccacagccacagcccgggctgaccaggagggcgcccgggagatcgtgtgcaatgtgaccctgggcggggagcggcgggaggcccgggagaacctgaccgtcttctccttcctgggccccatcgtgaacctgtctgagcccacagcccacgagggcagcacagtgacagtgtcctgcatggccggggcccgggtgcaggtgaccctggatggagtgcctgctgctgcccctggccagcctgcccagctgcagctgaatgccacagaaagtgatgatggccgctccttcttctgcagcgccaccctggaggtggatggagagttcctgcacaggaacagctctgtgcagctgcgggtgctgtatggccccaagattgaccgggccacctgcccccagcacctgaagtggaaggacaagaccaggcatgtgctgcagtgccaggcccggggcaacccctacccagagctgcgctgcctgaaggagggcagcagccgggaggtgcctgtgggcatccccttctttgtgaatgtgacccacaacggcacctaccagtgccaggccagcagcagccggggcaagtacaccctggtggtggtgatggacattgaagctggcagcagccactttgtgcctgtgtttgtggccgtgctgctgaccctgggcgtggtgaccatcgtgctggccctgatgtatgtgttccgggagcaccagaggagcggcagctaccacgtgcgggaggagagcacctacctgcccctgacctccatgcagcccacagaggccatgggagaggagcccagcagagctgagtag

SEQ ID NO: 156222 - DNA, 819 bp, Artificial Sequence
  Description of Artificial Sequence: Synthetic coding sequence
atgggcagcctcttccccctgagcctgctcttcttcctggccgccgcctacccaggagtgggcagcgccctgggccgccgcaccaagagggcccagagccccaagggcagccccctggcccccagcggcacctctgtgcccttctgggtgaggatgagccctgagtttgtggccgtgcagcccgggaagtctgtgcagctgaactgcagcaacagctgcccccagccccagaacagcagcctgcggacccccctgcggcagggcaagaccctgcggggccctggctgggtgtcctaccagctgctggatgtgcgggcctggagcagcctggcccactgcctggtgacctgtgccggcaagacccgctgggccaccagccgcatcacagcctacagcgtgcctgggggcctgctgggcggggaccctgaggcctggaagccaggccacctgttcaggaagccaggggccctgcaccggcccggcagcggccagagggacctggacctgcgggtgtgctgctggaccccccggctgctggccgcccgggacctgccccgggccccccagagcagaagacctgggggcccccagcagctgggcacccactacacagatgcccggctggagccccgggcccacagctttggcctgcgcttccaccgctgcccctgccgggaccccccccactgcggccgctgtgtgcccatgcaggtgcccagctatgaggtgcctggggtgaagggagatgtgctgtgccgcctgtctgagaagaagaggaacatgaagcagagcggggagatggccatccacggcggctag

SEQ ID NO: 156223 - DNA, 816 bp, Artificial Sequence
  Description of Artificial Sequence: Synthetic coding sequence
atgggcagcctcttccccctgagcctgctcttcttcctggccgccgcctacccaggagtgggcagcgccctgggccgccgcaccaagagggcccagagccccaagggcagccccctggcccccagcggcacctctgtgcccttctgggtgaggatgagccctgagtttgtggccgtgcagcccgggaagtctgtgcagctgaactgcagcaacagctgcccccagccccagaacagcagcctgcggacccccctgcggcagggcaagaccctgcggggccctggctgggtgtcctaccagctgctggatgtgcgggcctggagcagcctggcccactgcctggtgacctgtgccggcaagacccgctgggccaccagccgcatcacagcctacaagccaccccacagcgtcatcctggagccccctgtgctgaagggcaggaagtacaccctgcgctgccacgtgacccaggtgtttcctgtgggctacctggtggtgaccctgcggcacggcagcagggtcatctacagcgagagcctggagcgcttcaccggcctggacctggccaacgtgaccctgacctatgaatttgctgctggcccccgggacttctggcagcctgtgatctgccacgcccggctgaacctggatggcctggtggtgaggaacagcagcgcccccatcaccctgatgctggcctggagccctgcccccacagccctggccagcggcagcattgctgccctggtgggcatcctgctgactgtgggcgccgcctacctgtgcaagtgcctggccatgaagagccaggcctag

SEQ ID NO: 156224 - DNA, 714 bp, Artificial Sequence
  Description of Artificial Sequence: Synthetic coding sequence
atgggcagcctcttccccctgagcctgctcttcttcctggccgccgcctacccaggagtgggcagcgccctgggccgccgcaccaagagggcccagagccccaagggcagccccctggcccccagcggcacctctgtgcccttctgggtgaggatgagccctgagtttgtggccgtgcagcccgggaagtctgtgcagctgaactgcagcaacagctgcccccagccccagaacagcagcctgcggacccccctgcggcagggcaagaccctgcggggccctggctgggtgtcctaccagctgctggatgtgcgggcctggagcagcctggcccactgcctggtgacctgtgccggcaagacccgctgggccaccagccgcatcacagcctacaagccaccccacagcgtcatcctggagccccctgtgctgaagggcaggaagtacaccctgcgctgccacgtgacccaggtgtttcctgtgggctacctggtggtgaccctgcggcacggcagcagggtcatctacagcgagagcctggagcgcttcaccggcctggacctggccaacgtgaccctgacctatgaatttgctgctggcccccgggacttctggcagcctgtgatctgccacgcccggctgaacctggatggcctggtggtgaggaacagcagcgcccccatcaccctgatgctgggggaggcccccctgtag

SEQ ID NO: 156225 - DNA, 498 bp, Artificial Sequence
  Description of Artificial Sequence: Synthetic coding sequence
atggagctgtgccgcagcctggccctgctgggcggcagcctgggcctgatgttctgcctgattgccctgagcacagacttctggtttgaagctgtgggccccacccacagcgcccacagcggcctgtggcccactggacatggagacatcatcagcggctacatccacgtgacccagaccttcagcatcatggctgtgctgtgggccctggtgtctgtgtccttcctggtgctgagctgcttccccagcctcttccccccaggccacggccccctggtgtccaccacagctgcctttgctgctgccatctccatggtggtggccatggctgtgtacaccagcgagcgctgggaccagcccccccacccccagatccagaccttcttctcctggagcttctacctgggctgggtgtctgccatcctgctgctgtgcaccggggccctgagcctgggcgcccactgcggcggcccccggcccggctatgagaccctgtag

SEQ ID NO: 156226 - DNA, 1674 bp, Artificial Sequence
  Description of Artificial Sequence: Synthetic coding sequence
atgatggtggtgctgctgggcgccaccaccctggtgctggtggccgtggccccctgggtgctgtctgctgctgctgggggcaagaacctgaagagcccccagaaggtggaggtggacatcattgatgacaacttcatcctgcgctggaacagaagtgatgaatctgtgggcaatgtgaccttctcctttgactaccagaagacaggcatggacaactggatcaagctgagcggctgccagaacatcaccagcaccaagtgcaacttcagcagcctgaagctgaatgtgtatgaggagatcaagctgcgcatccgggcagagaaggagaacaccagctcctggtatgaggtggacagcttcacccccttcaggaaggcccagatcggccccccagaggtgcacctggaggccgaggacaaggccatcgtcatccacatcagccctggcaccaaggacagcgtgatgtgggccctggatggcctgtccttcacctacagcctggtgatctggaagaacagcagcggcgtggaggagagaattgagaacatctacagccgccacaagatctacaagctgagccctgagaccacctactgcctgaaggtgaaggccgccctgctgacctcctggaagattggagtgtacagccctgtgcactgcatcaagaccaccgtggagaatgagctgcccccaccagaaaatattgaggtgtctgtgcagaaccagaactacgtgctgaagtgggactacacctacgccaacatgaccttccaggtgcagtggctgcacgccttcctgaagaggaaccctggcaaccacctgtacaagtggaagcagatcccagactgtgaaaatgtgaagaccacccagtgtgtgttcccccagaatgtgttccagaagggcatctacctgctgcgggtgcaggccagtgatggcaacaacaccagcttctggagcgaggagatcaagtttgacacagagatccaggccttcctgctgccccctgtgttcaacatccgcagcctgagtgacagcttccacatctacatcggggcccccaagcagagcggcaacacccctgtgatccaggactaccccctcatctatgagatcatcttctgggagaacaccagcaatgctgagaggaagatcatcgagaagaagacagatgtgacagtgcccaacctgaagcccctgactgtgtactgtgtgaaggcccgggcccacaccatggatgagaagctgaacaagagctctgtgttcagtgatgctgtgtgtgagaagaccaagccaggcaacaccagcaagatctggctgattgtgggcatctgcatcgccctgtttgccctgcccttcgtcatctatgctgccaaggtgttcctgcgctgcatcaactacgtgttcttccccagcctgaagcccagcagcagcattgatgagtacttcagcgagcagcccctgaagaacctgctgctgagcaccagcgaggagcagatcgagaagtgcttcatcatcgagaacatcagcaccatcgccaccgtggaggagaccaaccagacagatgaggaccacaagaagtacagcagccagaccagccaggacagcggcaactacagcaatgaagatgagagcgagagcaagaccagcgaggagctgcagcaggactttgtgtag

SEQ ID NO: 156227 - DNA, 1467 bp, Artificial Sequence
  Description of Artificial Sequence: Synthetic coding sequence
atggacaactggatcaagctgagcggctgccagaacatcaccagcaccaagtgcaacttcagcagcctgaagctgaatgtgtatgaggagatcaagctgcgcatccgggcagagaaggagaacaccagctcctggtatgaggtggacagcttcacccccttcaggaaggcccagatcggccccccagaggtgcacctggaggccgaggacaaggccatcgtcatccacatcagccctggcaccaaggacagcgtgatgtgggccctggatggcctgtccttcacctacagcctggtgatctggaagaacagcagtggagtggaggagagaattgagaacatctacagccgccacaagatctacaagctgagccctgagaccacctactgcctgaaggtgaaggccgccctgctgacctcctggaagattggagtgtacagccctgtgcactgcatcaagaccaccgtggagaatgagctgcccccacctgagaacatcgaggtgtctgtgcagaaccagaactacgtgctgaagtgggactacacctacgccaacatgaccttccaggtgcagtggctgcacgccttcctgaagagaaatcctggcaaccacctgtacaagtggaagcagatcccagactgtgaaaatgtgaagaccacccagtgtgtgttcccccagaatgtgttccagaagggcatctacctgctgcgggtgcaggccagtgatggcaacaacaccagcttctggagcgaggagatcaagtttgacacagagatccaggccttcctgctgccccctgtgttcaacatccgcagcctgagtgacagcttccacatctacatcggggcccccaagcagagcggcaacacccctgtgatccaggactaccccctcatctatgagatcatcttctgggagaacaccagcaatgctgagaggaagatcatcgagaagaagacagatgtgacagtgcccaacctgaagcccctgactgtgtactgtgtgaaggcccgggcccacaccatggatgagaagctgaacaagagcagcgtcttcagtgatgctgtgtgtgagaagaccaagccaggcaacaccagcaagatctggctgattgtgggcatctgcatcgccctgtttgccctgccctttgtgatctatgctgccaaggtgttcctgcgctgcatcaactacgtgttcttccccagcctgaagcccagcagcagcattgatgagtacttcagcgagcagcccctgaagaacctgctgctgagcaccagcgaggagcagatcgagaagtgcttcatcatcgagaacatcagcaccatcgccaccgtggaggagaccaaccagacagatgaggaccacaagaagtacagcagccagaccagccaggacagcggcaactacagcaatgaagatgaaagtgagagcaagaccagcgaggagctgcagcaggactttgtgtag

SEQ ID NO: 156228 - DNA, 1491 bp, Artificial Sequence
  Description of Artificial Sequence: Synthetic coding sequence
atgatggtggtgctgctgggcgccaccaccctggtgctggtggccgtggccccctgggtgctgtctgctgctgctgggggcaagaacctgaagagcccccagaaggtggaggtggacatcattgatgacaacttcatcctgcgctggaacagaagtgatgaatctgtgggcaatgtgaccttctcctttgactaccagaagacaggcatggacaactggatcaagctgagcggctgccagaacatcaccagcaccaagtgcaacttcagcagcctgaagctgaatgtgtatgaggagatcaagctgcgcatccgggcagagaaggagaacaccagctcctggtatgaggtggacagcttcacccccttcaggaaggcccagatcggccccccagaggtgcacctggaggccgaggacaaggccatcgtcatccacatcagccctggcaccaaggacagcgtgatgtgggccctggatggcctgtccttcacctacagcctggtgatctggaagaacagcagcggcgtggaggagagaattgagaacatctacagccgccacaagatctacaagctgagccctgagaccacctactgcctgaaggtgaaggccgccctgctgacctcctggaagattggagtgtacagccctgtgcactgcatcaagaccaccgtggagaatgagctgcccccaccagaaaatattgaggtgtctgtgcagaaccagaactacgtgctgaagtgggactacacctacgccaacatgaccttccaggtgcagtggctgcacgccttcctgaagaggaaccctggcaaccacctgtacaagtggaagcagatcccagactgtgaaaatgtgaagaccacccagtgtgtgttcccccagaatgtgttccagaagggcatctacctgctgcgggtgcaggccagtgatggcaacaacaccagcttctggagcgaggagatcaagtttgacacagagatccaggccttcctgctgccccctgtgttcaacatccgcagcctgagtgacagcttccacatctacatcggggcccccaagcagagcggcaacacccctgtgatccaggactaccccctcatctatgagatcatcttctgggagaacaccagcaatgctgagaggaagatcatcgagaagaagacagatgtgacagtgcccaacctgaagcccctgactgtgtactgtgtgaaggcccgggcccacaccatggatgaaaatgatgctgtgtgtgagtacttcagcgagcagcccctgaagaacctgctgctgagcaccagcgaggagcagatcgagaagtgcttcatcatcgagaacatcagcaccatcgccaccgtggaggagaccaaccagacagatgaggaccacaagaagtacagcagccagaccagccaggacagcggcaactacagcaatgaagatgaaagtgagagcaagaccagcgaggagctgcagcaggactttgtgtag

SEQ ID NO: 156229 - DNA, 1548 bp, Artificial Sequence
  Description of Artificial Sequence: Synthetic coding sequence
atgctgctgagccagaatgccttcatcttccgcagcctgaacctggtgctgatggtgtacatcagcctggtgtttggcatctcctatgacagcccagactacacagatgagagctgcaccttcaagatcagcctgaggaacttccgcagcatcctgtcctgggagctgaagaaccacagcatcgtgcccacccactacaccctgctgtacaccatcatgagcaagccagaggacctgaaggtggtgaagaactgtgccaacaccaccaggagcttctgtgacctgacagatgagtggaggagcacccatgaggcctacgtgacagtgctggagggcttcagcggcaacaccaccctcttcagctgcagccacaacttctggctggccatcgacatgagctttgagcccccagagtttgaaattgtgggcttcaccaaccacatcaacgtgatggtgaagttccccagcatcgtggaggaggagctgcagtttgacctgagcctggtgattgaggagcagagcgagggcatcgtgaagaagcacaagccagagatcaagggcaacatgagcggcaacttcacctacatcatcgacaagctgatccccaacaccaactactgtgtgtctgtgtacctggagcacagtgatgagcaggccgtcatcaagagccccctgaagtgcaccctgctgcccccaggccaggagagcgagagcgctgagagcgccaagattggaggcatcatcaccgtcttcctgattgccctggtgctgaccagcaccatcgtgaccctgaagtggattggctacatctgcctgaggaacagcctgcccaaggtgctgaacttccacaacttcctggcctggcccttccccaacctgccccccctggaggccatggacatggtggaggtgatctacatcaacaggaagaagaaggtgtgggactacaactatgatgatgaaagtgacagcgacacagaggccgcccccaggaccagcggcggcggctacaccatgcacggcctgactgtgcggcccctgggccaggccagcgccaccagcacagagagccagctgattgatcctgagagcgaggaggagccagacctgcctgaggtggatgtggagctgcccaccatgcccaaggacagcccccagcagctggagctgctgagcggcccctgtgaaagaaggaagagccccctgcaggaccccttccctgaggaggactacagcagcacagagggcagcggcggccgcatcaccttcaacgtggacctgaacagcgtcttcctgcgggtgctggatgatgaggacagtgatgacctggaggcccccctgatgctgagcagccacctggaggagatggtggaccctgaggaccctgacaacgtgcagagcaaccacctgctggccagcggggagggcacccagcccaccttccccagccccagcagcgagggcctgtggagcgaagatgcccccagcgaccagagcgacaccagcgagagtgatgtggacctgggagatggctacatcatgaggtag

SEQ ID NO: 156230 - DNA, 1548 bp, Artificial Sequence; identical to SEQ ID NO: 156229
  Description of Artificial Sequence: Synthetic coding sequence

SEQ ID NO: 156231 - DNA, 996 bp, Artificial Sequence
  Description of Artificial Sequence: Synthetic coding sequence
atgctgctgagccagaatgccttcatcttccgcagcctgaacctggtgctgatggtgtacatcagcctggtgtttggcatctcctatgacagcccagactacacagatgagagctgcaccttcaagatcagcctgaggaacttccgcagcatcctgtcctgggagctgaagaaccacagcatcgtgcccacccactacaccctgctgtacaccatcatgagcaagccagaggacctgaaggtggtgaagaactgtgccaacaccaccaggagcttctgtgacctgacagatgagtggaggagcacccatgaggcctacgtgacagtgctggagggcttcagcggcaacaccaccctcttcagctgcagccacaacttctggctggccatcgacatgagctttgagcccccagagtttgaaattgtgggcttcaccaaccacatcaacgtgatggtgaagttccccagcatcgtggaggaggagctgcagtttgacctgagcctggtgattgaggagcagagcgagggcatcgtgaagaagcacaagccagagatcaagggcaacatgagcggcaacttcacctacatcatcgacaagctgatccccaacaccaactactgtgtgtctgtgtacctggagcacagtgatgagcaggccgtcatcaagagccccctgaagtgcaccctgctgcccccaggccaggagagcgagagcgctgagagcgccaagattggaggcatcatcaccgtcttcctgattgccctggtgctgaccagcaccatcgtgaccctgaagtggattggctacatctgcctgaggaacagcctgcccaaggtgctgcggcagggcctggccaagggctggaatgctgtggccatccaccgctgcagccacaatgccctgcagagcgagaccccagagctgaagcagagcagctgcctgtccttccccagctcctgggactacaagagggccagcctgtgccccagcgactag

SEQ ID NO: 156232 - DNA, 996 bp, Artificial Sequence; identical to SEQ ID NO: 156231
  Description of Artificial Sequence: Synthetic coding sequence

SEQ ID NO: 156233 - DNA, 561 bp, Artificial Sequence
  Description of Artificial Sequence: Synthetic coding sequence
atgctgctgaagagccctgagaacagcctgctgcagttccagttcaagtatggagtgcccacccccaccaacgtgaccatcgagagctacaacatgaaccccatcgtgtactgggagtaccagatcatgccccaggtgcctgtgttcaccgtggaggtgaagaactacggcgtgaagaacagcgagtggattgatgcctgcatcaacatcagccaccactactgcaacatcagtgaccacgtgggggaccccagcaacagcctgtgggtgcgggtgaaggcccgggtgggccagaaggagagcgcctatgccaagtctgaggagtttgctgtgtgcagagatggcaagattggcccccccaagctggacatcaggaaggaggagaagcagatcatgattgacatcttccaccccagcgtgtttgtgaatggagatgagcaggaggtggactatgaccctgagaccacctgctacatccgggtgtacaacgtgtatgtgaggatgaatggaagtgagatcaagaggagctgtgccttcagcctcttctccttcttcatctag

SEQ ID NO: 156234 - DNA, 1470 bp, Artificial Sequence
  Description of Artificial Sequence: Synthetic coding sequence
atggccctgctcttcctgctgcccctggtgatgcagggcgtgtccagagctgagatgggcacagctgacctgggccccagctctgtgcccacccccaccaacgtgaccatcgagagctacaacatgaaccccatcgtgtactgggagtaccagatcatgccccaggtgcctgtgttcaccgtggaggtgaagaactacggcgtgaagaacagcgagtggattgatgcctgcatcaacatcagccaccactactgcaacatcagtgaccacgtgggggaccccagcaacagcctgtgggtgcgggtgaaggcccgggtgggccagaaggagagcgcctatgccaagtctgaggagtttgctgtgtgcagagatggcaagattggcccccccaagctggacatcaggaaggaggagaagcagatcatgattgacatcttccaccccagcgtgtttgtgaatggagatgagcaggaggtggactatgaccctgagaccacctgctacatccgggtgtacaacgtgtatgtgaggatgaatggaagtgagatccagtacaagatcctgacccagaaggaggatgactgtgatgagatccagtgccagctggccatccctgtgagcagcctgaacagccagtactgtgtgtctgctgagggcgtgctgcacgtgtggggcgtgaccacagagaagagcaaggaggtgtgcatcaccatcttcaacagcagcatcaagggcagcctgtggatccctgtggtggccgccctgctgctcttcctggtgctgagcctggtgttcatctgcttctacatcaagaagatcaaccccctgaaggagaagagcatcatcctgcccaagagcctcatctctgtggtgcgcagcgccaccctggagaccaagccagagagcaaatatgtgtccctcatcaccagctaccagcccttcagcctggagaaggaggtggtgtgtgaggagcccctgagccctgccaccgtgcccggcatgcacacagaggacaaccctgggaaggtggagcacacagaggagctgagcagcatcacagaggtggtgaccacagaggagaacatcccagatgtggtgcccggcagccacctgacccccatcgagcgggagagcagcagccccctgagcagcaaccagagcgagcccggcagcatcgccctgaacagctaccacagcaggaactgcagcgagagtgaccacagcagaaatggatttgacacagacagcagctgcctggagagccacagcagcctgagtgacagcgagttcccccccaacaacaagggggagatcaagacagagggccaggagctgatcaccgtcatcaaggcccccaccagctttggctatgacaagccccacgtgctggtggacctgctggtggatgattctgggaaggagagcctgattggctaccggcccacagaggacagcaaggagttctcctag

SEQ ID NO: 156235 - DNA, 486 bp, Artificial Sequence
  Description of Artificial Sequence: Synthetic coding sequence
atgctgctgaagagccctgagaacagcctgctgcagttccagttcaagtatggagtgcccacccccaccaacgtgaccatcgagagctacaacatgaaccccatcgtgtactgggagtaccagatcatgccccaggtgcctgtgttcaccgtggaggtgaagaactacggcgtgaagaacagcgagtggattgatgcctgcatcaacatcagccaccactactgcaacatcagtgaccacgtgggggaccccagcaacagcctgtgggtgcgggtgaaggcccgggtgggccagaaggagagcgcctatgccaagtctgaggagtttgctgtgtgcagagatggcaagattggcccccccaagctggacatcaggaaggaggagaagcagatcatgattgacatcttccaccccagcgtgtttgtgaatggagatgagcaggaggtggactatgaccctgagaccacctgctacatccgggtgtag

SEQ ID NO: 156236 - DNA, 825 bp, Artificial Sequence
  Description of Artificial Sequence: Synthetic coding sequence
atggccctgctcttcctgctgcccctggtgatgcagggcgtgtccagagctgagatgggcacagctgacctgggccccagctctgtgcccacccccaccaacgtgaccatcgagagctacaacatgaaccccatcgtgtactgggagtaccagatcatgccccaggtgcctgtgttcaccgtggaggtgaagaactacggcgtgaagaacagcgagtggattgatgcctgcatcaacatcagccaccactactgcaacatcagtgaccacgtgggggaccccagcaacagcctgtgggtgcgggtgaaggcccgggtgggccagaaggagagcgcctatgccaagtctgaggagtttgctgtgtgcagagatggcaagattggcccccccaagctggacatcaggaaggaggagaagcagatcatgattgacatcttccaccccagcgtgtttgtgaatggagatgagcaggaggtggactatgaccctgagaccacctgctacatccgggtgtacaacgtgtatgtgaggatgaatggaagtgagatccagtacaagatcctgacccagaaggaggatgactgtgatgagatccagtgccagctggccatccctgtgagcagcctgaacagccagtactgtgtgtctgctgagggcgtgctgcacgtgtggggcgtgaccacagagaagagcaaggaggtgtgcatcaccatcttcaacagcagcatcaagggcagcctgtggatccctgtggtggccgccctgctgctcttctgcctggcctggtacagctctgtgttcatcctgaggaagctgatccactag

SEQ ID NO: 156237 - DNA, 633 bp, Artificial Sequence
  Description of Artificial Sequence: Synthetic coding sequence
atggccctgctcttcctgctgcccctggtgatgcagggcgtgtccagagctgagatgggcacagctgacctgggccccagctctgtgcccacccccaccaacgtgaccatcgagagctacaacatgaaccccatcgtgtactgggagtaccagatcatgccccaggtgcctgtgttcaccgtggaggtgaagaactacggcgtgaaggcccgggtgggccagaaggagagcgcctatgccaagtctgaggagtttgctgtgtgcagagatggcaagattggcccccccaagctggacatcaggaaggaggagaagcagatcatgattgacatcttccaccccagcgtgtttgtgaatggagatgagcaggaggtggactatgaccctgagaccacctgctacatccgggtgtacaacgtgtatgtgaggatgaatggaagtgagatccagtacaagatcctgacccagaaggaggatgactgtgatgagatccagtgccagctggccatccctgtgagcagcctgaacagccagtactgtgtgtctgctgagggcgtgctgcacgtgtggggcgtgaccacagagaagagcaaggaggtgtgcatcaccatcttcaacagcagcatcaagtag

SEQ ID NO: 156238 - DNA, 1386 bp, Artificial Sequence
  Description of Artificial Sequence: Synthetic coding sequence
atgcccacccccaccaacgtgaccatcgagagctacaacatgaaccccatcgtgtactgggagtaccagatcatgccccaggtgcctgtgttcaccgtggaggtgaagaactacggcgtgaagaacagcgagtggattgatgcctgcatcaacatcagccaccactactgcaacatcagtgaccacgtgggggaccccagcaacagcctgtgggtgcgggtgaaggcccgggtgggccagaaggagagcgcctatgccaagtctgaggagtttgctgtgtgcagagatggcaagattggcccccccaagctggacatcaggaaggaggagaagcagatcatgattgacatcttccaccccagcgtgtttgtgaatggagatgagcaggaggtggactatgaccctgagaccacctgctacatccgggtgtacaacgtgtatgtgaggatgaatggaagtgagatccagtacaagatcctgacccagaaggaggatgactgtgatgagatccagtgccagctggccatccctgtgagcagcctgaacagccagtactgtgtgtctgctgagggcgtgctgcacgtgtggggcgtgaccacagagaagagcaaggaggtgtgcatcaccatcttcaacagcagcatcaagggcagcctgtggatccctgtggtggccgccctgctgctcttcctggtgctgagcctggtgttcatctgcttctacatcaagaagatcaaccccctgaaggagaagagcatcatcctgcccaagagcctcatctctgtggtgcgcagcgccaccctggagaccaagccagagagcaaatatgtgtccctcatcaccagctaccagcccttcagcctggagaaggaggtggtgtgtgaggagcccctgagccctgccaccgtgcccggcatgcacacagaggacaaccctgggaaggtggagcacacagaggagctgagcagcatcacagaggtggtgaccacagaggagaacatcccagatgtggtgcccggcagccacctgacccccatcgagcgggagagcagcagccccctgagcagcaaccagagcgagcccggcagcatcgccctgaacagctaccacagcaggaactgcagcgagagtgaccacagcagaaatggatttgacacagacagcagctgcctggagagccacagcagcctgagtgacagcgagttcccccccaacaacaagggggagatcaagacagagggccaggagctgatcaccgtcatcaaggcccccaccagctttggctatgacaagccccacgtgctggtggacctgctggtggatgattctgggaaggagagcctgattggctaccggcccacagaggacagcaaggagttctcctag

SEQ ID NO: 156239 - DNA, 1014 bp, Artificial Sequence
  Description of Artificial Sequence: Synthetic coding sequence
atgaggcccaccctgctgtggagcctgctgctgctgctgggcgtgtttgctgctgctgctgctgcccccccagaccccctgagccagctgcctgccccccagcaccccaagatccggctgtacaatgctgagcaggtgctgtcctgggagcctgtggccctgagcaacagcaccaggcctgtggtgtaccaggtgcagttcaagtacacagacagcaagtggttcaccgctgacatcatgagcattggagtgaactgcacccagatcacagccacagaatgtgacttcaccgctgccagccccagcgctggcttccccatggacttcaacgtgaccctgcggctgcgggcagagctgggcgccctgcacagcgcctgggtgaccatgccctggttccagcactacagaaatgtgacagtgggccccccagagaacatcgaggtgaccccaggagagggcagcctcatcatccgcttcagcagcccctttgatattgctgacaccagcacagccttcttctgctactacgtgcactactgggagaagggcggcatccagcaggtgaagggccccttccgcagcaacagcatcagcctggacaacctgaagcccagccgggtgtactgcctgcaggtgcaggcccagctgctgtggaacaagagcaacatcttccgggtgggccacctgagcaacatcagctgctatgagaccatggctgatgccagcacagagctgcagcaggtgatcctgatctctgtgggcaccttcagcctgctgtctgtgctggccggggcctgcttcttcctggtgctgaagtaccggggcctcatcaagtactggttccacaccccacccagcatccccctgcagatcgaggagtacctgaaggaccccacccagcccatcctggaggccctggacaaggacagcagccccaaggatgatgtgtgggacagcgtgtccatcatctccttccctgagaaggagcaggaggatgtgctgcagaccctgtag

SEQ ID NO: 156240 - DNA, 378 bp, Artificial Sequence
  Description of Artificial Sequence: Synthetic coding sequence
atgcacaaggaggagcacgaggtggccgtgctgggccccccacccagcaccatcctgcccaggagcaccgtcatcaacatccacagcgagacctctgtgcctgaccacgtggtgtggagcctcttcaacaccctcttcctgaactggtgctgcctgggcttcatcgcctttgcctacagcgtgaagagccgggacaggaagatggtgggagatgtgactggagcccaggcctatgccagcacagccaagtgcctgaacatctgggccctgatcctgggcatcctgatgaccatcggcttcatcctgctgctggtgtttggatctgtgacagtgtaccacatcatgctgcagatcatccaggagaagaggggctactag

SEQ ID NO: 156241 - DNA, 378 bp, Artificial Sequence; identical to SEQ ID NO: 156240
  Description of Artificial Sequence: Synthetic coding sequence

SEQ ID NO: 156242 - DNA, 300 bp, Artificial Sequence
  Description of Artificial Sequence: Synthetic coding sequence
ccccagagccagaagatgcacaaggaggagcacgaggtggccgtgctgggccccccacccagcaccatcctgcccaggagcaccgtcatcaacatccacagcgagacctctgtgcctgaccacgtggtggtgcctgtgcagcaccccctgctggagtgctgcctgggcttcatcgcctttgcctacagcgtgaagagccgggacaggaagatggtgggagatgtgactggagcccaggccctgcaccggcaggtgcctgagcacctgggcccagattctggccacccccatgaccactag

SEQ ID NO: 156243 - DNA, 378 bp, Artificial Sequence; identical to SEQ ID NO: 156240
  Description of Artificial Sequence: Synthetic coding sequence

SEQ ID NO: 156244 - DNA, 495 bp, Artificial Sequence
  Description of Artificial Sequence: Synthetic coding sequence
atgaaccacatcgtgcagaccttcagccctgtgaacagcggccagccccccaactatgagatgctgaaggaggagcaggaggtggccatgctgggcgtgccccacaacccagccccacccatgagcaccgtcatccacatccgctctgagacctctgtgcctgaccacgtggtggtgcctgtgcagcaccccctgcacgagtgctgcctgggcttcatcgcctttgcctacagcgtgaagagccgggacaggaagatggtgggagatgtgactggagcccaggccctgcaccggcaggtgcctgagcacctgggccctgactttggccacctgcatgaccacagcgcccaccaccaccccagcgtgggccggcccggccctgccatcgaccaggaggccagcctgcggcctggggccctgcctgtgacctgcatccccaggaccctgagcagcatccccaggcctgccccccggggccaggagctgtgcccctag

SEQ ID NO: 156245 - DNA, 399 bp, Artificial Sequence
  Description of Artificial Sequence: Synthetic coding sequence
atgaaccacatcgtgcagaccttcagccctgtgaacagcggccagccccccaactatgagatgctgaaggaggagcaggaggtggccatgctgggcgtgccccacaacccagccccacccatgagcaccgtcatccacatccgctctgagacctctgtgcctgaccacgtggtgtggagcctcttcaacaccctcttcatgaacacctgctgcctgggcttcatcgcctttgcctacagcgtgaagagccgggacaggaagatggtgggagatgtgactggagcccaggcctatgccagcacagccaagtgcctgaacatctgggccctgatcctgggcatcttcatgaccatcctgctgatcatcatccctgtgctggtggtgcaggcccagaggtag

SEQ ID NO: 156246 - DNA, 447 bp, Artificial Sequence
  Description of Artificial Sequence: Synthetic coding sequence
cctcccaactatgagatgctgaaggaggagcacgaggtggccgtgctgggcgccccccacaacccagccccacccaccagcaccgtcatccacatccgctctgagacctctgtgcctgaccacgtggtggtgcctgtgcagcaccccctgcacgagtgctgcctgggcttcatcgcctttgcctacagcgtgaagagccgggacaggaagatggtgggagatgtgactggagcccaggccctgcaccggcaggtgcctgagcacctgggcccagattctggccacccccatgaccacagcgcccaccgccaccccagcgctgacctgcccggcctgtggattgaccaggaggccagcctgcggcctggggccctgcccatgacctgcatccccaggacccccaccagcatccccaggcctgcccctggagctgagagctgcatctag

SEQ ID NO: 156247 - DNA, 402 bp, Artificial Sequence
  Description of Artificial Sequence: Synthetic coding sequence
atgaaccacacagtgcagaccttcttcagccctgtgaacagcggccagccccccaactatgagatgctgaaggaggagcacgaggtggccgtgctgggcgccccccacaacccagccccacccaccagcaccgtcatccacatccgctctgagacctctgtgcctgaccacgtggtgtggagcctcttcaacaccctcttcatgaacccctgctgcctgggcttcatcgcctttgcctacagcgtgaagagccgggacaggaagatggtgggagatgtgactggagcccaggcctatgccagcacagccaagtgcctgaacatctgggccctgatcctgggcatcctgatgaccatcctgctgattgtcatccctgtgctgatcttccaggcctacggctag

SEQ ID NO: 156248 - DNA, 3078 bp, Artificial Sequence
  Description of Artificial Sequence: Synthetic coding sequence
atgagcaatggctacagcacagatgagaacttccgctacctgatcagctgcttccgggcccgggtgaagatgtacatccaggtggagcctgtgctggactacctgaccttcctgcctgctgaggtgaaggagcagatccagaggacagtggccaccagcggcaacatgcaggccgtggagctgctgctgagcaccctggagaagggcgtgtggcacctgggctggacccgggagtttgtggaggccctgcggaggacaggcagccccctggccgcccgctacatgaaccctgagctgacagacctgcccagccccagctttgaaaatgcccatgatgagtacctgcagctgctgaacctgctgcagcccaccctggtggacaagctgctggtgagagatgtgctggacaagtgcatggaggaggagctgctgaccattgaagatagaaacagaattgctgctgctgagaacaatggaaatgaaagtggagtgcgggagctgctgaagagaattgtgcagaaggagaactggttcagcgccttcctgaatgtgctgcggcagacaggcaacaatgagctggtgcaggagctgaccggcagtgactgcagcgagagcaatgctgagattgagaacctgagccaggtggatggcccccaggtggaggagcagctgctgagcaccaccgtgcagcccaacctggagaaggaggtgtggggcatggagaacaacagcagcgagagcagctttgctgacagctctgtggtgtctgagagtgacaccagcctggccgagggctctgtgtcctgcctggatgagagcctgggccacaacagcaacatgggcagtgacagcggcaccatgggcagtgacagtgatgaggagaatgtggccgcccgggccagccctgagcctgagctgcagctgcggccctaccagatggaggtggcccagcctgccctggagggcaagaacatcatcatctgcctgcccactggaagtggcaagaccagggtggccgtgtacatcgccaaggaccacctggacaagaagaagaaggccagcgagcccgggaaggtgattgtgctggtgaacaaggtgctgctggtggagcagctgttcaggaaggagttccagcccttcctgaagaagtggtacagagtcatcggcctgagcggggacacccagctgaagatctccttccctgaggtggtgaagagctgtgacatcatcatcagcacagcccagatcctggagaacagcctgctgaacctggagaatggagaagatgctggggtgcagctgagtgacttcagcctcatcatcattgatgagtgccaccacaccaacaaggaggccgtgtacaacaacatcatgaggcactacctgatgcagaagctgaagaacaaccggctgaagaaggagaacaagcctgtgatccccctgccccagatcctgggcctgacagccagccctggggtgggcggggccaccaagcaggccaaggccgaggagcacatcctgaagctgtgtgccaacctggatgccttcaccatcaagacagtgaaggagaacctggaccagctgaagaaccagatccaggagccctgcaagaagtttgccatcgcagatgccacccgggaggaccccttcaaggagaagctgctggagatcatgacccgcatccagacctactgccagatgagccccatgtctgactttggcacccagccctatgagcagtgggccatccagatggagaagaaggccgccaaggagggcaacaggaaggagcgggtgtgtgccgagcacctgaggaagtacaatgaggccctgcagatcaatgacaccatccgcatgattgatgcctacacccacctggagaccttctacaatgaggagaaggacaagaagtttgctgtgattgaagatgacagtgatgagggcggagatgatgagtactgtgatggagatgaagatgaagatgacctgaagaagcccctgaagctggatgaaacagaccgcttcctgatgaccctcttctttgagaacaacaagatgctgaagaggctggccgagaacccagaatatgaaaatgagaagctgaccaagctgaggaacaccatcatggagcagtacaccaggacagaggagagcgcccggggcatcatcttcaccaagacccggcagagcgcctatgccctgagccagtggatcacagaaaatgagaagtttgctgaggtgggcgtgaaggcccaccacctgattggagctggccacagcagcgagttcaagcccatgacccagaatgagcagaaggaggtgatcagcaagttcagaacaggcaagatcaacctgctgattgccaccaccgtggccgaggagggcctggacatcaaggagtgcaacatcgtcatccgctatggcctggtgaccaatgagatcgccatggtgcaggcccggggccgggcccgggcagatgagagcacctacgtgctggtggcccacagcggcagcggcgtgattgaacatgaaacagtgaatgacttccgggagaagatgatgtacaaggccatccactgtgtgcagaacatgaagccagaggagtatgcccacaagatcctggagctgcagatgcagagcatcatggagaagaagatgaagaccaagaggaacatcgccaagcactacaagaacaaccccagcctcatcaccttcctgtgcaagaactgcagcgtgctggcctgcagcggggaggacatccacgtgattgagaagatgcaccacgtgaacatgaccccagagttcaaggagctgtacatcgtgcgggagaacaaggccctgcagaagaagtgtgccgactaccagatcaatggagagatcatctgcaagtgtggccaggcctggggcaccatgatggtgcacaagggcctggacctgccctgcctgaagatccggaactttgtggtggtgttcaagaacaacagcaccaagaagcagtacaagaagtgggtggagctgcccatcaccttccccaacctggactacagcgagtgctgcctcttcagtgatgaggactag

SEQ ID NO: 156249 - DNA, 666 bp, Artificial Sequence
  Description of Artificial Sequence: Synthetic coding sequence
atgagcaatggctacagcacagatgagaacttccgctacctgatcagctgcttccgggcccgggtgaagatgtacatccaggtggagcctgtgctggactacctgaccttcctgcctgctgaggtgaaggagcagatccagaggacagtggccaccagcggcaacatgcaggccgtggagctgctgctgagcaccctggagaagggcgtgtggcacctgggctggacccgggagtttgtggaggccctgcggaggacaggcagccccctggccgcccgctacatgaaccctgagctgacagacctgcccagccccagctttgaaaatgcccatgatgagtacctgcagctgctgaacctgctgcagcccaccctggtggacaagctgctggtgagagatgtgctggacaagtgcatggaggaggagctgctgaccattgaagatagaaacagaattgctgctgctgagaacaatggaaatgaaagtggagtgcgggagctgctgaagagaattgtgcagaaggagaactggttcagcgccttcctgaatgtgctgcggcagacaggcaacaatgagctggtgcaggagctgaccggcagtgactgcagcgagagcaatgccggcatctgcaacttcacagaggaggacagcagcaacagcgcctag

SEQ ID NO: 156250 - DNA, 3078 bp, Artificial Sequence; identical to SEQ ID NO: 156248
  Description of Artificial Sequence: Synthetic coding sequence

SEQ ID NO: 156251 - DNA, 1050 bp, Artificial Sequence
  Description of Artificial Sequence: Synthetic coding sequence
atgcctgtggagaggatgaggatgaggccctggctggaggagcagatcaacagcaacaccatccctggcctgaagtggctgaacaaggagaagaagatcttccagatcccctggatgcatgctgcccggcacggctgggatgtggagaaggatgcccccctcttcaggaactgggccatccacacaggcaagcaccagcccggggtggacaagccagaccccaagacctggaaggccaacttccgctgtgccatgaacagcctgcctgacatcgaggaggtgaaggacaagagcatcaagaagggcaacaatgccttccgggtgtacaggatgctgcccctgtctgagcggcccagcaagaagggcaagaagcccaagacagagaaggaggacaaggtgaagcacatcaagcaggagcctgtggagagcagcctgggcctgagcaatggagtgtctgacctgagcccagaatatgctgtgctgaccagcaccatcaagaatgaggtggacagcacagtgaacatcatcgtggtgggccagagccacctggacagcaacatcgagaaccaggagatcgtgaccaaccccccagacatctgccaggtggtggaggtgaccacagaaagtgatgagcagcctgtgtccatgtctgagctgtaccccctgcagatcagccctgtgtcctcctatgcagagagcgagaccacagacagcgtgcccagtgatgaggagagcgctgagggccggccccactggaggaagagaaatattgagggcaagcagtacctgagcaacatgggcacccggggcagctacctgctgcccggcatggccagctttgtgaccagcaacaagccagacctgcaggtgaccatcaaggaggagagcaaccctgtgccctacaacagctcctggccacccttccaggacctgcccctgagcagctccatgaccccagccagcagcagcagcaggccagaccgggagacccgggccagcgtcatcaagaagaccagtgacatcacccaggcccgggtgaagagctgctag

SEQ ID NO: 156252 - DNA, 414 bp, Artificial Sequence
  Description of Artificial Sequence: Synthetic coding sequence
atgcctgtggagaggatgaggatgaggccctggctggaggagcagatcaacagcaacaccatccctggcctgaagtggctgaacaaggagaagaagatcttccagatcccctggatgcatgctgcccggcacggctgggatgtggagaaggatgcccccctcttcaggaactgggccatccacacaggcaagcaccagcccggggtggacaagccagaccccaagacctggaaggccaacttccgctgtgccatgaacagcctgcctgacatcgaggaggtgaaggacaagagcatcaagaagggcaacaatgccttccgggtgtacaggatgctgcccctgtctgagcggcccagcaagaagggcaagaagcccaagacagagaaggaggacaaggtgaagcacatcaagtag

SEQ ID NO: 156253 - DNA, 414 bp, Artificial Sequence; identical to SEQ ID NO: 156252
  Description of Artificial Sequence: Synthetic coding sequence

SEQ ID NO: 156254 - DNA, 531 bp, Artificial Sequence
  Description of Artificial Sequence: Synthetic coding sequence
atgcctgtggagaggatgaggatgaggccctggctggaggagcagatcaacagcaacaccatccctggcctgaagtggctgaacaaggagaagaagatcttccagatcccctggatgcatgctgcccggcacggctgggatgtggagaaggatgcccccctcttcaggaactgggccatccacacaggcaagcaccagcccggggtggacaagccagaccccaagacctggaaggccaacttccgctgtgccatgaacagcctgcctgacatcgaggaggtgaaggacaagagcatcaagaagggcaacaatgccttccgggtgtacaggatgctgcccctgtctgagcggcccagcaagaagggcaagaagcccaagacagagaaggaggacaaggtgaagcacatcaagcaggagcctgtggagagcagcctgggcctgagcaatggagtgtctgacctgagcccagaatatgctgtgctgaccagcaccatcaagaatgaggtggacagcacagtgaacatcatctag

SEQ ID NO: 156255 - DNA, 486 bp, Artificial Sequence
  Description of Artificial Sequence: Synthetic coding sequence
atgcctgtggagaggatgaggatgaggccctggctggaggagcagatcaacagcaacaccatccctggcctgaagtggctgaacaaggagaagaagatcttccagatcccctggatgcatgctgcccggcacggctgggatgtggagaaggatgcccccctcttcaggaactgggccatccacacaggcaagcaccagcccggggtggacaagccagaccccaagacctggaaggccaacttccgctgtgccatgaacagcctgcctgacatcgaggaggtgaaggacaagagcatcaagaagggcaacaatgccttccgggtgtacaggatgctgcccctgtctgagcggcccagcaagaagggcaagaagcccaagacagagaaggaggacaaggtgaagcacatcaagcaggagcctgtggagagcagcctgggcctgagcaatggagtgtctgacctgagcccagaatatgctgtgctgtag

SEQ ID NO: 156256 - DNA, 1284 bp, Artificial Sequence
  Description of Artificial Sequence: Synthetic coding sequence
atgggcacccccaagccccgcatcctgccctggctggtgtcccagctggacctgggccagctggagggcgtggcctgggtgaacaagagcaggacccgcttccgcatcccctggaagcacggcctgcggcaggatgcccagcaggaggactttggcatcttccaggcctgggccgaggccactggagcctacgtgcccggccgggacaagccagacctgcccacctggaagaggaacttccgcagcgccctgaacaggaaggagggcctgcggctggccgaggacaggagcaaggacccccatgacccccacaagatctatgaatttgtgaacagcggcgtgggggacttcagccagcctgacaccagcccagacaccaatggaggcggcagcaccagtgacacccaggaggacatcctggatgagctgctgggcaacatggtgctggcccccctgcctgaccccggcccccccagcctggccgtggcccctgagccctgcccccagcccctgcggagccccagcctggacaaccccacccccttccccaacctgggccccagcgagaaccccctgaagaggctgctggtgcctggagaggagtgggagtttgaggtgacagccttctaccggggccggcaggtgttccagcagaccatcagctgcccagagggcctgcggctggtgggcagcgaggtgggggacaggaccctgcccggctggcctgtgaccctgcctgaccccggcatgagcctgacagaccggggcgtgatgtcctatgtgagacatgtgctgagctgcctgggcggcggcctggccctgtggagggctggccagtggctgtgggcccagaggctgggccactgccacacctactgggccgtgtctgaggagctgctgcccaacagcggccacggcccagatggagaggtgcccaaggacaaggagggcggcgtgtttgacctgggccccttcatcgtggacctgatcaccttcacagagggcagcggccgcagccccaggtatgccctgtggttctgtgtgggggagagctggccccaggaccagccctggaccaagaggctggtgatggtgaaggtggtgcccacctgcctgcgggccctggtggagatggcccgggtgggcggggccagcagcctggagaacacagtggacctgcacatcagcaacagccaccccctgagcctgaccagtgaccagtacaaggcctacctgcaggacctggtggagggcatggacttccagggccctggagagagctag

SEQ ID NO: 156257 - DNA, 903 bp, Artificial Sequence
  Description of Artificial Sequence: Synthetic coding sequence
atgggcacccccaagccccgcatcctgccctggctggtgtcccagctggacctgggccagctggagggcgtggcctgggtgaacaagagcaggacccgcttccgcatcccctggaagcacggcctgcggcaggatgcccagcaggaggactttggcatcttccaggcctgggccgaggccactggagcctacgtgcccggccgggacaagccagacctgcccacctggaagaggaacttccgcagcgccctgaacaggaaggagggcctgcggctggccgaggacaggagcaaggacccccatgacccccacaagatctatgaatttgtgaacagcggcgtgggggacttcagccagcctgacaccagcccagacaccaatggaggcggcagcaccagtgacacccaggaggacatcctggatgagctgctgggcaacatggtgctggcccccctgcctgaccccggcccccccagcctggccgtggcccctgagccctgcccccagcccctgcggagccccagcctggacaaccccacccccttccccaacctgggccccagcgagaaccccctgaagaggctgctggtgcctggagaggacctgatcaccttcacagagggcagcggccgcagccccaggtatgccctgtggttctgtgtgggggagagctggccccaggaccagccctggaccaagaggctggtgatggtgaaggtggtgcccacctgcctgcgggccctggtggagatggcccgggtgggcggggccagcagcctggagaacacagtggacctgcacatcagcaacagccaccccctgagcctgaccagtgaccagtacaaggcctacctgcaggacctggtggagggcatggacttccagggccctggagagagctag

SEQ ID NO: 156258 - DNA, 1284 bp, Artificial Sequence; identical to SEQ ID NO: 156256
  Description of Artificial Sequence: Synthetic coding sequence

SEQ ID NO: 156259 - DNA, 315 bp, Artificial Sequence
  Description of Artificial Sequence: Synthetic coding sequence
atgggcacccccaagccccgcatcctgccctggctggtgtcccagctggacctgggccagctggagggcgtggcctgggtgaacaagagcaggacccgcttccgcatcccctggaagcacggcctgcggcaggatgcccagcaggaggactttggcatcttccaggagctgggcaccttccccagccagacccccctgcggacccccatggtggaggccgtgctgctgatccccaggaagaccttctggatgagctactgggtgacctggtgctggccccacagccagatccgggacccccaggcctggctgtag

SEQ ID NO: 156260 - DNA, 846 bp, Artificial Sequence
  Description of Artificial Sequence: Synthetic coding sequence
atggtgctggcccccctgcctgaccccggcccccccagcctggccgtggcccctgagccctgcccccagcccctgcggagccccagcctggacaaccccacccccttccccaacctgggccccagcgagaaccccctgaagaggctgctggtgcctggagaggagtgggagtttgaggtgacagccttctaccggggccggcaggtgttccagcagaccatcagctgcccagagggcctgcggctggtgggcagcgaggtgggggacaggaccctgcccggctggcctgtgaccctgcctgaccccggcatgagcctgacagaccggggcgtgatgtcctatgtgagacatgtgctgagctgcctgggcggcggcctggccctgtggagggctggccagtggctgtgggcccagaggctgggccactgccacacctactgggccgtgtctgaggagctgctgcccaacagcggccacggcccagatggagaggtgcccaaggacaaggagggcggcgtgtttgacctgggccccttcatcgtggacctgatcaccttcacagagggcagcggccgcagccccaggtatgccctgtggttctgtgtgggggagagctggccccaggaccagccctggaccaagaggctggtgatggtgaaggtggtgcccacctgcctgcgggccctggtggagatggcccgggtgggcggggccagcagcctggagaacacagtggacctgcacatcagcaacagccaccccctgagcctgaccagtgaccagtacaaggcctacctgcaggacctggtggagggcatggacttccagggccctggagagagctag

SEQ ID NO: 156261 - DNA, 465 bp, Artificial Sequence
  Description of Artificial Sequence: Synthetic coding sequence
atggtgctggcccccctgcctgaccccggcccccccagcctggccgtggcccctgagccctgcccccagcccctgcggagccccagcctggacaaccccacccccttccccaacctgggccccagcgagaaccccctgaagaggctgctggtgcctggagaggacctgatcaccttcacagagggcagcggccgcagccccaggtatgccctgtggttctgtgtgggggagagctggccccaggaccagccctggaccaagaggctggtgatggtgaaggtggtgcccacctgcctgcgggccctggtggagatggcccgggtgggcggggccagcagcctggagaacacagtggacctgcacatcagcaacagccaccccctgagcctgaccagtgaccagtacaaggcctacctgcaggacctggtggagggcatggacttccagggccctggagagagctag

SEQ ID NO: 156262 - DNA, 846 bp, Artificial Sequence; identical to SEQ ID NO: 156260
  Description of Artificial Sequence: Synthetic coding sequence

SEQ ID NO: 156263 - DNA, 903 bp, Artificial Sequence; identical to SEQ ID NO: 156257
  Description of Artificial Sequence: Synthetic coding sequence

SEQ ID NO: 156264 - DNA, 465 bp, Artificial Sequence; identical to SEQ ID NO: 156261
  Description of Artificial Sequence: Synthetic coding sequence

SEQ ID NO: 156265 - DNA, 1404 bp, Artificial Sequence
  Description of Artificial Sequence: Synthetic coding sequence
atggccctgcacccccggcgggtgcggctgaagccctggctggtggcccaggtggacagcggcctgtacccaggcctcatctggctgcaccgggacagcaagcgcttccagatcccctggaagcacgccaccaggcacagcccccagcaggaggaggagaacaccatcttcaaggcctgggccgtggagaccgggaagtaccaggagggcgtggatgatcctgaccctgccaagtggaaggcccagctgcgctgtgccctgaacaagagccgggagttcaacctgatgtatgatggcaccaaggaggtgcccatgaaccctgtgaagatctaccaggtgtgtgacatcccccagccccagggcagcatcatcaaccctggcagcactggaagtgccccctgggatgagaaggacaatgatgtggatgaggaggatgaagaagatgagctggaccagagccagcaccacgtgcccatccaggacaccttccccttcctgaacatcaatggcagccccatggccccagcctctgtgggcaactgcagcgtgggcaactgcagccctgaggccgtgtggcccaagacagagcccctggagatggaggtgccccaggcccccatccagcccttctacagcagccctgagctgtggatcagcagcctgcccatgacagacctggacatcaagttccagtaccggggcaaggagtatggccagaccatgacagtgagcaacccccagggctgccgcctcttctatggagacctgggccccatgccagaccaggaggagctgtttggacctgtgtccctggagcaggtgaagtttcctggccctgagcacatcaccaatgagaagcagaagctgttcaccagcaagctgctggatgtgatggaccggggcctcatcctggaggtgtctggccacgccatctatgccatccggctgtgccagtgcaaggtgtactggagcggcccctgtgcccccagcctggtggcccccaacctgattgagcggcagaagaaggtgaagctgttctgcctggagaccttcctgagtgacctgattgcccaccagaagggccagatcgagaagcagcccccatttgagatctacctgtgctttggagaggagtggccagatggcaagcccctggagaggaagctgatcctggtgcaggtgattcctgtggtggccaggatgatctatgagatgttttctggggacttcaccaggagctttgacagcggctctgtgcggctgcagatcagcaccccagacatcaaggacaacatcgtggcccagctgaagcagctgtaccgcatcctgcagacccaggagagctggcagcccatgcagcccacccccagcatgcagctgcccccagccctgcccccccagtag

SEQ ID NO: 156266 - DNA, 831 bp, Artificial Sequence
  Description of Artificial Sequence: Synthetic coding sequence
atggccctgcacccccggcgggtgcggctgaagccctggctggtggcccaggtggacagcggcctgtacccaggcctcatctggctgcaccgggacagcaagcgcttccagatcccctggaagcacgccaccaggcacagcccccagcaggaggaggagaacaccatcttcaaggcctgggccgtggagaccgggaagtaccaggagggcgtggatgatcctgaccctgccaagtggaaggcccagctgcgctgtgccctgaacaagagccgggagttcaacctgatgtatgatggcaccaaggaggtgcccatgaaccctgtgaagatctaccaggtgtgtgacatcccccagccccagggcagcatcatcaaccctggcagcactggaagtgccccctgggatgagaaggacaatgatgtggatgaggaggatgaagaagatgagctggaccagagccagcaccacgtgcccatccaggacaccttccccttcctgaacatcaatggcagccccatggccccagcctctgtgggcaactgcagcgtgggcaactgcagccctgaggccgtgtggcccaagacagagcccctggagatggaggtgccccaggcccccatccagcccttctacagcagccctgagctgtggatcagcagcctgcccatgacagacctggacatcaagttccagtaccggggcaaggagtatggccagaccatgacagtgagcaacccccagggctgccgcctcttctatggagacctgggccccatgccagaccaggaggagctgtttggacctgtgtccctggagcaggtgaagttctag

SEQ ID NO: 156267 - DNA, 1119 bp, Artificial Sequence
  Description of Artificial Sequence: Synthetic coding sequence
atgtatgatggcaccaaggaggtgcccatgaaccctgtgaagatctaccaggtgtgtgacatcccccagccccagggcagcatcatcaaccctggcagcacaggcagcgccccctgggatgagaaggacaatgatgtggatgaagaagatgaggaggatgagctggaccagagccagcaccacgtgcccatccaggacaccttccccttcctgaacatcaatggcagccccatggccccagcctctgtgggcaactgcagcgtgggcaactgcagccctgaggccgtgtggcccaagacagagcccctggagatggaggtgccccaggcccccatccagcccttctacagcagccctgagctgtggatcagcagcctgcccatgacagacctggacatcaagttccagtaccggggcaaggagtatggccagaccatgacagtgagcaacccccagggctgccgcctcttctacggggacctgggccccatgccagaccaggaggagctgtttggacctgtgtccctggagcaggtgaagtttcctggccctgagcacatcaccaatgagaagcagaagctgttcaccagcaagctgctggatgtgatggaccggggcctcatcctggaggtgtctggccacgccatctatgccatccggctgtgccagtgcaaggtgtactggagcggcccctgtgcccccagcctggtggcccccaacctgattgaaaggcagaagaaggtgaagctgttctgcctggagaccttcctgagtgacctgattgcccaccagaagggccagatcgagaagcagcccccatttgagatctacctgtgcttcggggaggagtggccagatggcaagcccctggagaggaagctgatcctggtgcaggtgattcctgtggtggccaggatgatctatgagatgttcagcggggacttcaccaggagctttgattctggctctgtgcggctgcagatcagcaccccagacatcaaggacaacatcgtggcccagctgaagcagctgtaccgcatcctgcagacccaggagagctggcagcccatgcagcccacccccagcatgcagctgcccccagccctgcccccccagtag

SEQ ID NO: 156268 - DNA, 1281 bp, Artificial Sequence
  Description of Artificial Sequence: Synthetic coding sequence
atgtgtgacagaaatggaggccggcggctgcggcagtggctgattgagcagattgacagctccatgtacccaggcctcatctgggagaatgaggagaagtccatgttccgcatcccctggaagcatgctgggaagcaggactacaaccaggaggtggatgccagcatcttcaaggcctgggccgtgttcaagggcaagttcaaggagggggacaaggccgagcccgccacctggaagacccggctgcgctgtgccctgaacaagagcccagactttgaggaggtgacagacaggagccagctggacatcagcgagccctacaaggtgtaccgcatcgtgcctgaggaggagcagaagtgcaagctgggcgtggccacagctggctgtgtgaatgaggtgacagagatggagtgtggccgctcagaaattgatgagctgatcaaggagcccagcgtggatgactacatgggcatgatcaagaggagccccagccccccagaggcctgccgcagccagctgctgcctgactggtgggcccagcagcccagcactggagtgcccctggtgacaggctacaccacctatgatgcccaccacagcgccttcagccagatggtgatctccttctactatggaggcaagctggtgggccaggccaccaccacctgcccagagggctgccgcctgagcctgagccagcccggcctgcccggcaccaagctgtatggccctgagggcctggagctggtgcgcttccccccagcagatgccatccccagcgagcggcagaggcaggtgaccaggaagctgtttggccacctggagcggggcgtgctgctgcacagcagccggcagggcgtgtttgtgaagaggctgtgccagggccgggtcttctgcagcggaaatgctgtggtgtgcaagggccggcccaacaagctggagagagatgaggtggtgcaggtgtttgacaccagccagttcttccgggagctgcagcagttctacaacagccagggccgcctgcctgatggccgggtggtgctgtgcttcggggaggagttcccagacatggcccccctgcggagcaagctgatcctggtgcagatcgagcagctgtatgtgcggcagctggccgaggaggccggcaagagctgtggggccggctctgtgatgcaggcccctgaggagcccccaccagaccaggtgttcaggatgtttcctgacatctgtgccagccaccagaggagcttcttccgggagaaccagcagatcaccgtgtag

SEQ ID NO: 156269 - DNA, 546 bp, Artificial Sequence
  Description of Artificial Sequence: Synthetic coding sequence
atggccggcagccgggaggtggtggccatggactgtgagatggtgggcctgggcccccaccgggagagcggcctggcccgctgcagcctggtgaatgtgcacggggctgtgctgtatgacaagttcatccggcctgagggggagatcacagactaccgcaccagggtgtctggagtgaccccccagcacatggtgggcgccaccccatttgctgtggcccggctggagatcctgcagctgctgaagggcaagctggtggtgggccatgacctgaagcatgacttccaggccctgaaggaggacatgagcggctacaccatctatgacaccagcacagaccggctgctgtggagggaggccaagctggaccactgccggcgggtgtccctgcgggtgctgtctgagcggctgctgcacaagagcatccagaacagcctgctgggccacagctctgtggaggatgcccgggccaccatggagctgtaccagatcagccagaggatccgggcccggcggggcctgccccggctggccgtgtctgactag

SEQ ID NO: 156270 - DNA, 546 bp, Artificial Sequence; identical to SEQ ID NO: 156269
  Description of Artificial Sequence: Synthetic coding sequence

SEQ ID NO: 156271 - DNA, 1062 bp, Artificial Sequence
  Description of Artificial Sequence: Synthetic coding sequence
atgagcaccctgctgctgaacctggactttggagagcccccacccaagaaggccctggagggcaatgccaagcacaggaactttgtgaagaagaggcggctgctggagcggcggggcttcctgagcaagaagaaccagccccccagcaaggcccccaagctgcacagcgagcccagcaagaagggggagacccccaccgtggatggcacctggaagacccccagcttccccaagaagaagacagctgccagcagcaatggcagcggccagcccctggacaagaaggctgctgtgtcctggctgaccccagcccccagcaagaaggctgacagcgtggccgccaaggtggacctgctgggggagttccagagcgccctgcccaagatcaacagccaccccaccaggagccagaagaagagcagccagaagaagagcagcaagaagaaccacccccagaagaatgccccccagaacagcacccaggcccacagtgaaaataaatgttctggggccagccagaagctgcccaggaagatggtggccatcgactgtgagatggtgggcaccggccccaagggccacgtgagcagcctggcccgctgcagcatcgtgaactacaatggagatgtgctgtatgatgagtacatcctgcccccctgccacatcgtggactaccgcacccgctggagcggcatcaggaagcagcacatggtgaatgccacccccttcaagatcgcccggggccagatcctgaagatcctgaccgggaagatcgtggtgggccacgccatccacaatgacttcaaggccctgcagtacttccaccccaagagcctgacccgggacaccagccacatcccccccctgaacaggaaggctgactgcccagaaaatgccaccatgagcctgaagcacctgaccaagaagctgctgaacagagacatccaggtgggcaagagcggccacagctctgtggaggatgcccaggccaccatggagctgtacaagctggtggaggtggagtgggaggagcacctggccaggaaccccccaacagactag

SEQ ID NO: 156272 - DNA, 1062 bp, Artificial Sequence; identical to SEQ ID NO: 156271
  Description of Artificial Sequence: Synthetic coding sequence

SEQ ID NO: 156273 - DNA, 360 bp, Artificial Sequence
  Description of Artificial Sequence: Synthetic coding sequence
atggaggccagcgccctgaccagcagcgctgtgacctctgtggccaaggtggtgcgggtggccagcggcagcgctgtggtgctgcccctggccagaattgccaccgtggtgattggaggagtggtggccgtgcccatggtgctgagcgccatgggcttcaccgctgctggcatcgccagcagcagcattgctgccaagatgatgtctgctgctgccatcgccaatggaggcggcgtggccagcggcagcctggtggccaccctgcagagcctgggcgccaccggcctgagcggcctgaccaagttcatcctgggcagcatcggcagcgccatcgctgctgtgattgcccgcttctactag

SEQ ID NO: 156274 - DNA, 369 bp, Artificial Sequence
  Description of Artificial Sequence: Synthetic coding sequence
atggaggccagcgccctgaccagcagcgctgtgacctctgtggccaaggtggtgcgggtggccagcggcagcgctgtggtgctgcccctggccagaattgccaccgtggtgattggaggaggagagagcgtggtggccgtgcccatggtgctgagcgccatgggcttcaccgctgctggcatcgccagcagcagcattgctgccaagatgatgtctgctgctgccatcgccaacggcggcggcgtggccagcggcagcctggtggccaccctgcagagcctgggcgccaccggcctgagcggcctgaccaagttcatcctgggcagcatcggcagcgccatcgccgccgtcatcgcccgcttctactag

SEQ ID NO: 156275 - DNA, 369 bp, Artificial Sequence
  Description of Artificial Sequence: Synthetic coding sequence
atggaggccagcgccctgaccagcagcgctgtgacctctgtggccaaggtggtgcgggtggccagcggcagcgctgtggtgctgcccctggccagaattgccaccgtggtgattggaggagtggccagcatcgtggccgtgcccatggtgctgagcgccatgggcttcaccgctgctggcatcgccagcagcagcattgctgccaagatgatgtctgctgctgccatcgccaacggcggcggcgtggccagcggcagcctggtggccaccctgcagagcctgggcgccaccggcctgagcggcctgaccaagttcatcctgggcagcatcggcagcgccatcgccgccgtcatcgcccgcttctactag

SEQ ID NO: 156276 - DNA, 189 bp, Artificial Sequence
  Description of Artificial Sequence: Synthetic coding sequence
atggaggccagcgccctgaccagcagcgctgtgacctctgtggccaaggtggtgcgggtggccagcggcagcgctgtggtgctgcccctggccagaattgccaccgtggtgattggaggagtggtggccgtgcccatggtgctgagcgccatgggcttcaccgctgctggcatcgccagcagcagctag

SEQ ID NO: 156277 - DNA, 174 bp, Artificial Sequence
  Description of Artificial Sequence: Synthetic coding sequence
atggaggccagcgccctgaccagcagcgctgtgacctctgtggccaaggtggtgcgggtggccagcggcagcgctgtggtgctgcccctggccagaattgccaccgtggtgattggaggagtggtggccgtgcccatggtgctgagcgccatgggcttcaccgctgctggatag

SEQ ID NO: 156278 - DNA, 360 bp, Artificial Sequence; identical to SEQ ID NO: 156273
  Description of Artificial Sequence: Synthetic coding sequence

SEQ ID NO: 156279 - DNA, 123 bp, Artificial Sequence
  Description of Artificial Sequence: Synthetic coding sequence
atggaggccagcgccctgaccagcagcgctgtgacctctgtggccaaggtggtgcgggtggccagcggcagcgctgtggtgctgcccctggccagaattgccaccgtggtgattggaggatag

SEQ ID NO: 156280 - DNA, 282 bp, Artificial Sequence
  Description of Artificial Sequence: Synthetic coding sequence
atggaggccagcgccctgaccagcagcgctgtgacctctgtggccaaggtggtgcgggtggccagcggcagcgctgtggtgctgcccctggccagaattgccaccgtggtgattggaggagtggtggccgtgcccatggtgctgagcgccatgggcttcaccgctgctggcatcgccagcagcagcattgctgccaagatgatgtctgctgctgccatcgccaatggaggcggcgtggccagcggcagcctggtggccaccctgcagagcctgggcgcctag

SEQ ID NO: 156281 - DNA, 2358 bp, Artificial Sequence
  Description of Artificial Sequence: Synthetic coding sequence
atgggcaagaagtacaagaacatcgtgctgctgaagggcctggaggtgatcaatgactaccacttcaggatggtgaagagcctgctgagcaatgacctgaagctgaacctgaagatgagggaggagtatgacaagatccagattgctgacctgatggaggagaagttcagaggagatgctggcctgggcaagctgatcaagatctttgaggacatccccaccctggaggacctggccgagaccctgaagaaggagaagctgaaggtgaagggccctgccctgagcaggaagaggaagaaggaggtggatgccaccagccctgcccccagcaccagcagcacagtgaagacagaaggagctgaggccacccctggggcccagaagaggaagaagagcaccaaggagaaggccggccccaagggcagcaaggtgtctgaggagcagacccagccccccagccctgctggagctggcatgagcacagccatgggccgcagccccagccccaagaccagcctgagcgccccacccaacagcagcagcacagagaaccccaagacagtggccaagtgccaggtgacccccaggagaaatgtgctgcagaagaggcctgtgattgtgaaggtgctgagcaccaccaagccctttgaatatgagaccccagagatggagaagaagatcatgttccacgccaccgtggccacccagacccagttcttccacgtgaaggtgctgaacaccagcctgaaggagaagttcaacgggaagaagatcatcatcatcagtgactacctggagtatgacagcctgctggaggtgaatgaggagagcacagtgtctgaggccggccccaaccagacctttgaggtgcccaacaagatcatcaacagagccaaggagaccctgaagattgacatcctgcacaagcaggccagcggcaacatcgtgtatggagtcttcatgctgcacaagaagacagtgaaccagaagaccaccatctatgagatccaggatgaccggggcaagatggatgtggtgggcaccggccagtgccacaacatcccctgtgaggagggggacaagctgcagctgttctgcttccggctgaggaagaagaaccagatgagcaagctgatcagcgagatgcacagcttcatccagatcaagaagaagaccaaccccagaaataatgaccccaagtccatgaagctgccccaggagcagaggcagctgccctaccccagcgaggccagcaccaccttccctgagagccacctgcggaccccccagatgccacccaccacccccagcagcagcttcttcaccaagaagtctgaggacaccatcagcaagatgaatgacttcatgaggatgcagatcctgaaggagggcagccacttccctggccccttcatgaccagcatcggccctgctgagagccacccccacaccccccagatgccacccagcacccccagcagcagcttcctgaccaccaagtctgaggacaccatcagcaagatgaatgacttcatgaggatgcagatcctgaaggagggcagccacttccctggccccttcatgaccagcatcggccctgctgagagccacccccacaccccccagatgccacccagcacccccagcagcagcttcctgaccaccctgaagccccggctgaagacagagcctgaggaggtgtccattgaggacagcgcccagagcgacctgaaggaggtgatggtgctgaatgccacagagagctttgtgtatgagcccaaggagcagaagaagatgtttcatgccaccgtggccacagaaaatgaggtgttccgggtgaaggtgttcaacatcgacctgaaggagaagttcacccccaagaagatcatcgccatcgccaactacgtgtgcagaaatggcttcctggaggtgtaccccttcaccctggtggctgatgtgaatgctgacaggaacatggagatccccaagggcctcatccgcagcgcctctgtgacccccaagatcaaccagctgtgcagccagaccaagggcagctttgtgaatggagtgtttgaggtgcacaagaagaatgtgcggggggagttcacctactatgagatccaggacaacacaggcaagatggaggtggtggtgcacggccgcctgaccaccatcaactgtgaggagggggacaagctgaagctgacctgctttgagctggcccccaagagcggcaacacaggagagctgcggagcgtcatccacagccacatcaaggtgatcaagaccaggaagaacaagaaggacatcctgaacccagacagctccatggagaccagcccagacttcttcttctag

SEQ ID NO: 156282 - DNA, 2022 bp, Artificial Sequence
  Description of Artificial Sequence: Synthetic coding sequence
atgggcaagaagtacaagaacatcgtgctgctgaagggcctggaggtgatcaatgactaccacttcaggatggtgaagagcctgctgagcaatgacctgaagctgaacctgaagatgagggaggagtatgacaagatccagattgctgacctgatggaggagaagttcagaggagatgctggcctgggcaagctgatcaagatctttgaggacatccccaccctggaggacctggccgagaccctgaagaaggagaagctgaaggtgaagggccctgccctgagcaggaagaggaagaaggaggtggatgccaccagccctgcccccagcaccagcagcacagtgaagacagaaggagctgaggccacccctggggcccagaagaggaagaagagcaccaaggagaaggccggccccaagggcagcaaggtgtctgaggagcagacccagccccccagccctgctggagctggcatgagcacagccatgggccgcagccccagccccaagaccagcctgagcgccccacccaacagcagcagcacagagaaccccaagacagtggccaagtgccaggtgacccccaggagaaatgtgctgcagaagaggcctgtgattgtgaaggtgctgagcaccaccaagccctttgaatatgagaccccagagatggagaagaagatcatgttccacgccaccgtggccacccagacccagttcttccacgtgaaggtgctgaacaccagcctgaaggagaagttcaacgggaagaagatcatcatcatcagtgactacctggagtatgacagcctgctggaggtgaatgaggagagcacagtgtctgaggccggccccaaccagacctttgaggtgcccaacaagatcatcaacagagccaaggagaccctgaagattgacatcctgcacaagcaggccagcggcaacatcgtgtatggagtcttcatgctgcacaagaagacagtgaaccagaagaccaccatctatgagatccaggatgaccggggcaagatggatgtggtgggcaccggccagtgccacaacatcccctgtgaggagggggacaagctgcagctgttctgcttccggctgaggaagaagaaccagatgagcaagctgatcagcgagatgcacagcttcatccagatcaagaagaagaccaaccccagaaataatgaccccaagtccatgaagctgccccaggagcagaggcagctgccctaccccagcgaggccagcaccaccttccctgagagccacctgcggaccccccagatgccacccaccacccccagcagcagcttcttcaccaagctgaagccccggctgaagacagagcctgaggaggtgtccattgaggacagcgcccagagcgacctgaaggaggtgatggtgctgaatgccacagagagctttgtgtatgagcccaaggagcagaagaagatgtttcatgccaccgtggccacagaaaatgaggtgttccgggtgaaggtgttcaacatcgacctgaaggagaagttcacccccaagaagatcatcgccatcgccaactacgtgtgcagaaatggcttcctggaggtgtaccccttcaccctggtggctgatgtgaatgctgacaggaacatggagatccccaagggcctcatccgcagcgcctctgtgacccccaagatcaaccagctgtgcagccagaccaagggcagctttgtgaatggagtgtttgaggtgcacaagaagaatgtgcggggggagttcacctactatgagatccaggacaacacaggcaagatggaggtggtggtgcacggccgcctgaccaccatcaactgtgaggagggggacaagctgaagctgacctgctttgagctggcccccaagagcggcaacacaggagagctgcggagcgtcatccacagccacatcaaggtgatcaagaccaggaagaacaagaaggacatcctgaacccagacagctccatggagaccagcccagacttcttcttctag

SEQ ID NO: 156283 - DNA, 1245 bp, Artificial Sequence
  Description of Artificial Sequence: Synthetic coding sequence
atgggcaagaagtacaagaacatcgtgctgctgaagggcctggaggtgatcaatgactaccacttcaggatggtgaagagcctgctgagcaatgacctgaagctgaacctgaagatgagggaggagtatgacaagatccagattgctgacctgatggaggagaagttcagaggagatgctggcctgggcaagctgatcaagatctttgaggacatccccaccctggaggacctggccgagaccctgaagaaggagaagctgaaggtgaagggccctgccctgagcaggaagaggaagaaggaggtggatgccaccagccctgcccccagcaccagcagcacagtgaagacagaaggagctgaggccacccctggggcccagaagaggaagaagagcaccaaggagaaggccggccccaagggcagcaaggtgtctgaggagcagacccagccccccagccctgctggagctggcatgagcacagccatgggccgcagccccagccccaagaccagcctgagcgccccacccaacagcagcagcacagagaaccccaagacagtggccaagtgccaggtgacccccaggagaaatgtgctgcagaagaggcctgtgattgtgaaggtgctgagcaccaccaagccctttgaatatgagaccccagagatggagaagaagatcatgttccacgccaccgtggccacccagacccagttcttccacgtgaaggtgctgaacaccagcctgaaggagaagttcacccccaagaagatcatcgccatcgccaactacgtgtgcagaaatggcttcctggaggtgtaccccttcaccctggtggctgatgtgaatgctgacaggaacatggagatccccaagggcctcatccgcagcgcctctgtgacccccaagatcaaccagctgtgcagccagaccaagggcagctttgtgaatggagtgtttgaggtgcacaagaagaatgtgcggggggagttcacctactatgagatccaggacaacacaggcaagatggaggtggtggtgcacggccgcctgaccaccatcaactgtgaggagggggacaagctgaagctgacctgctttgagctggcccccaagagcggcaacacaggagagctgcggagcgtcatccacagccacatcaaggtgatcaagaccaggaagaacaagaaggacatcctgaacccagacagctccatggagaccagcccagacttcttcttctag

SEQ ID NO: 156284 - DNA, 2190 bp, Artificial Sequence
  Description of Artificial Sequence: Synthetic coding sequence
atgggcaagaagtacaagaacatcgtgctgctgaagggcctggaggtgatcaatgactaccacttcaggatggtgaagagcctgctgagcaatgacctgaagctgaacctgaagatgagggaggagtatgacaagatccagattgctgacctgatggaggagaagttcagaggagatgctggcctgggcaagctgatcaagatctttgaggacatccccaccctggaggacctggccgagaccctgaagaaggagaagctgaaggtgaagggccctgccctgagcaggaagaggaagaaggaggtggatgccaccagccctgcccccagcaccagcagcacagtgaagacagaaggagctgaggccacccctggggcccagaagaggaagaagagcaccaaggagaaggccggccccaagggcagcaaggtgtctgaggagcagacccagccccccagccctgctggagctggcatgagcacagccatgggccgcagccccagccccaagaccagcctgagcgccccacccaacagcagcagcacagagaaccccaagacagtggccaagtgccaggtgacccccaggagaaatgtgctgcagaagaggcctgtgattgtgaaggtgctgagcaccaccaagccctttgaatatgagaccccagagatggagaagaagatcatgttccacgccaccgtggccacccagacccagttcttccacgtgaaggtgctgaacaccagcctgaaggagaagttcaacgggaagaagatcatcatcatcagtgactacctggagtatgacagcctgctggaggtgaatgaggagagcacagtgtctgaggccggccccaaccagacctttgaggtgcccaacaagatcatcaacagagccaaggagaccctgaagattgacatcctgcacaagcaggccagcggcaacatcgtgtatggagtcttcatgctgcacaagaagacagtgaaccagaagaccaccatctatgagatccaggatgaccggggcaagatggatgtggtgggcaccggccagtgccacaacatcccctgtgaggagggggacaagctgcagctgttctgcttccggctgaggaagaagaaccagatgagcaagctgatcagcgagatgcacagcttcatccagatcaagaagaagaccaaccccagaaataatgaccccaagtccatgaagctgccccaggagcagaggcagctgccctaccccagcgaggccagcaccaccttccctgagagccacctgcggaccccccagatgccacccaccacccccagcagcagcttcttcaccaagaagtctgaggacaccatcagcaagatgaatgacttcatgaggatgcagatcctgaaggagggcagccacttccctggccccttcatgaccagcatcggccctgctgagagccacccccacaccccccagatgccacccagcacccccagcagcagcttcctgaccaccctgaagccccggctgaagacagagcctgaggaggtgtccattgaggacagcgcccagagcgacctgaaggaggtgatggtgctgaatgccacagagagctttgtgtatgagcccaaggagcagaagaagatgtttcatgccaccgtggccacagaaaatgaggtgttccgggtgaaggtgttcaacatcgacctgaaggagaagttcacccccaagaagatcatcgccatcgccaactacgtgtgcagaaatggcttcctggaggtgtaccccttcaccctggtggctgatgtgaatgctgacaggaacatggagatccccaagggcctcatccgcagcgcctctgtgacccccaagatcaaccagctgtgcagccagaccaagggcagctttgtgaatggagtgtttgaggtgcacaagaagaatgtgcggggggagttcacctactatgagatccaggacaacacaggcaagatggaggtggtggtgcacggccgcctgaccaccatcaactgtgaggagggggacaagctgaagctgacctgctttgagctggcccccaagagcggcaacacaggagagctgcggagcgtcatccacagccacatcaaggtgatcaagaccaggaagaacaagaaggacatcctgaacccagacagctccatggagaccagcccagacttcttcttctag

SEQ ID NO: 156285 - DNA, 2190 bp, Artificial Sequence; identical to SEQ ID NO: 156284
  Description of Artificial Sequence: Synthetic coding sequence

SEQ ID NO: 156286 - DNA, 384 bp, Artificial Sequence
  Description of Artificial Sequence: Synthetic coding sequence
atgggcaagaagtacaagaacatcgtgctgctgaagggcctggaggtgatcaatgactaccacttcaggatggtgaagagcctgctgagcaatgacctgaagctgaacctgaagatgagggaggagtatgacaagatccagattgctgacctgatggaggagaagttcagaggagatgctggcctgggcaagctgatcaagatctttgaggacatccccaccctggaggacctggccgagaccctgaagaaggagaagctgaaggtgaagggccctgccctgagcaggaagaggaagaaggaggtggatgccaccagccctgcccccagcaccagcagcacagtgaagacagaaggagctgaggccacccctggggcccagtag

SEQ ID NO: 156287 - DNA, 2202 bp, Artificial Sequence
  Description of Artificial Sequence: Synthetic coding sequence
atgtctgtgaagatgggcaagaagtacaagaacatcgtgctgctgaagggcctggaggtgatcaatgactaccacttcaggatggtgaagagcctgctgagcaatgacctgaagctgaacctgaagatgagggaggagtatgacaagatccagattgctgacctgatggaggagaagttcagaggagatgctggcctgggcaagctgatcaagatctttgaggacatccccaccctggaggacctggccgagaccctgaagaaggagaagctgaaggtgaagggccctgccctgagcaggaagaggaagaaggaggtggatgccaccagccctgcccccagcaccagcagcacagtgaagacagaaggagctgaggccacccctggggcccagaaccccaagacagtggccaagtgccaggtgacccccaggagaaatgtgctgcagaagaggcctgtgattgtgaaggtgctgagcaccaccaagccctttgaatatgagaccccagagatggagaagaagatcatgttccacgccaccgtggccacccagacccagttcttccacgtgaaggtgctgaacaccagcctgaaggagaagttcaacgggaagaagatcatcatcatcagtgactacctggagtatgacagcctgctggaggtgaatgaggagagcacagtgtctgaggccggccccaaccagacctttgaggtgcccaacaagatcatcaacagagccaaggagaccctgaagattgacatcctgcacaagcaggccagcggcaacatcgtgtatggagtcttcatgctgcacaagaagacagtgaaccagaagaccaccatctatgagatccaggatgaccggggcaagatggatgtggtgggcaccggccagtgccacaacatcccctgtgaggagggggacaagctgcagctgttctgcttccggctgaggaagaagaaccagatgagcaagctgatcagcgagatgcacagcttcatccagatcaagaagaagaccaaccccagaaataatgaccccaagtccatgaagctgccccaggagcagaggcagctgccctaccccagcgaggccagcaccaccttccctgagagccacctgcggaccccccagatgccacccaccacccccagcagcagcttcttcaccaagaagtctgaggacaccatcagcaagatgaatgacttcatgaggatgcagatcctgaaggagggcagccacttccctggccccttcatgaccagcatcggccctgctgagagccacccccacaccccccagatgccacccagcacccccagcagcagcttcctgaccaccaagtctgaggacaccatcagcaagatgaatgacttcatgaggatgcagatcctgaaggagggcagccacttccctggccccttcatgaccagcatcggccctgctgagagccacccccacaccccccagatgccacccagcacccccagcagcagcttcctgaccaccctgaagccccggctgaagacagagcctgaggaggtgtccattgaggacagcgcccagagcgacctgaaggaggtgatggtgctgaatgccacagagagctttgtgtatgagcccaaggagcagaagaagatgtttcatgccaccgtggccacagaaaatgaggtgttccgggtgaaggtgttcaacatcgacctgaaggagaagttcacccccaagaagatcatcgccatcgccaactacgtgtgcagaaatggcttcctggaggtgtaccccttcaccctggtggctgatgtgaatgctgacaggaacatggagatccccaagggcctcatccgcagcgcctctgtgacccccaagatcaaccagctgtgcagccagaccaagggcagctttgtgaatggagtgtttgaggtgcacaagaagaatgtgcggggggagttcacctactatgagatccaggacaacacaggcaagatggaggtggtggtgcacggccgcctgaccaccatcaactgtgaggagggggacaagctgaagctgacctgctttgagctggcccccaagagcggcaacacaggagagctgcggagcgtcatccacagccacatcaaggtgatcaagaccaggaagaacaagaaggacatcctgaacccagacagctccatggagaccagcccagacttcttcttctag

SEQ ID NO: 156288 - DNA, 543 bp, Artificial Sequence
  Description of Artificial Sequence: Synthetic coding sequence
atgggcaagaagtacaagaacatcgtgctgctgaagggcctggaggtgatcaatgactaccacttcaggatggtgaagagcctgctgagcaatgacctgaagctgaacctgaagatgagggaggagtatgacaagatccagattgctgacctgatggaggagaagttcagaggagatgctggcctgggcaagctgatcaagatctttgaggacatccccaccctggaggacctggccgagaccctgaagaaggagaagctgaaggtgaagggccctgccctgagcaggaagaggaagaaggaggtggatgccaccagccctgcccccagcaccagcagcacagtgaagacagaaggagctgaggccacccctggggcccagaagaggaagaagagcaccaaggagaaggccggccccaagggcagcaaggtgtctgaggagcagacccagccccccagccctgctggagctggcatgagcacagccatgggccgcagccccagccccaagaccagcctgagcgccccacccaacagcagctag

SEQ ID NO: 156289 - DNA, 1485 bp, Artificial Sequence
  Description of Artificial Sequence: Synthetic coding sequence
tgaagcacagagaaccccaagacagtggccaagtgccaggtgaccccaagaagaaatgtgctgcagaagaggcctgtgattgtgaaggtgctgagcaccaccaagccctttgaatatgagaccccagagatggagaagaagatcatgtttcatgccaccgtggccacccagacccagttcttccacgtgaaggtgctgaacaccagcctgaaggagaagttcaacgggaagaagatcatcatcatcagtgactacctggagtatgacagcctgctggaggtgaatgaggagagcacagtgtctgaggccggccccaaccagacctttgaggtgcccaacaagatcatcaacagagccaaggagaccctgaagattgacatcctgcacaagcaggccagcggcaacatcgtgtatggagtcttcatgctgcacaagaagacagtgaaccagaagaccaccatctatgagatccaggatgaccggggcaagatggatgtggtgggcaccggccagtgccacaacatcccctgtgaggagggggacaagctgcagctgttctgcttccggctgaggaagaagaaccagatgagcaagctgatcagcgagatgcacagcttcatccagatcaagaagaagaccaaccccaggaacaatgaccccaagtccatgaagctgccccaggagcagaggcagctgccctaccccagcgaggccagcaccaccttccctgagagccacctgcggaccccccagatgccacccaccacccccagcagcagcttcttcaccaagctgaagccccggctgaagacagagcctgaggaggtgtccattgaagattctgcccagagcgacctgaaggaggtgatggtgctgaatgccacagagagctttgtgtatgagcccaaggagcagaagaagatgttccacgccaccgtggccacagaaaatgaggtgttccgggtgaaggtgttcaacatcgacctgaaggagaagttcacccccaagaagatcatcgccatcgccaactacgtgtgcagaaatggcttcctggaggtgtaccccttcaccctggtggctgatgtgaatgctgacaggaacatggagatccccaagggcctcatccgcagcgcctctgtgacccccaagatcaaccagctgtgcagccagaccaagggcagctttgtgaatggagtgtttgaggtgcacaagaagaatgtgcggggggagttcacctactatgagatccaggacaacacaggcaagatggaggtggtggtgcacggccgcctgaccaccatcaactgtgaggagggggacaagctgaagctgacctgctttgagctggcccccaagagcggcaacacaggagagctgcggagcgtcatccacagccacatcaaggtgatcaagaccaggaagaacaagaaggacatcctgaacccagacagctccatggagaccagcccagacttcttcttctag

SEQ ID NO: 156290 - DNA, 753 bp, Artificial Sequence
  Description of Artificial Sequence: Synthetic coding sequence
atgaccctgagccccctgctgctcttcctgccccccctgctgctgctgctggatgtgcccacagctgctgtgcaggccagccccctgcaggccctggacttctttggaaatggacctcctgtgaactacaagacaggcaacctgtacctgcggggccccctgaagaagagcaatgcccccctggtgaatgtgaccctgtactatgaggccctgtgtggcggctgccgggccttcctgatccgggagctgttccccacctggctgctggtgatggagatcctgaatgtgaccctggtgccctatggaaatgcccaggagcagaatgtgtctggccgctgggagttcaagtgccagcacggggaggaggagtgcaagttcaacaaggtggaggcctgtgtgctggatgagctggacatggagctggccttcctgaccatcgtgtgcatggaggagtttgaggacatggagaggagcctgcccctgtgcctgcagctgtatgcccctggcctgagcccagacaccatcatggagtgtgccatgggagaccggggcatgcagctgatgcacgccaatgcccagaggacagatgccctgcagccccctcatgaatatgtgccctgggtgacagtgaatggcaagcccctggaggaccagacccagctgctgaccctggtgtgccagctgtaccagggcaagaagccagatgtgtgccccagcagcaccagcagcctgcggtctgtgtgcttcaagtag

SEQ ID NO: 156291 - DNA, 588 bp, Artificial Sequence
  Description of Artificial Sequence: Synthetic coding sequence
atggccctgctcttccccctgctggccgccctggtgatgaccagctacagccctgtgggcagcctgggctgtgacctgccccagaaccacggcctgctgagcaggaacaccctggtgctgctgcaccagatgaggcgcatcagccccttcctgtgcctgaaggaccggcgggacttccgcttcccccaggagatggtgaagggcagccagctgcagaaggcccacgtgatgtctgtgctgcacgagatgctgcagcagatcttcagcctcttccacacagagaggagcagcgctgcctggaacatgaccctgctggaccagctgcacacaggcctgcaccagcagctgcagcacctggagacctgcctgctgcaggtggtgggggagggggagagcgctggggccatcagcagccctgccctgaccctgcggcgctacttccagggcatccgggtgtacctgaaggagaagaagtacagcgactgtgcctgggaggtggtgaggatggagatcatgaagagcctcttcctgagcaccaacatgcaggagcggctgcggagcaaggaccgggacctgggcagcagctag

SEQ ID NO: 156292 - DNA, 861 bp, Artificial Sequence
  Description of Artificial Sequence: Synthetic coding sequence
atgtctgcccccctggatgctgccctgcacgccctgcaggaggagcaggcccggctgaagatgaggctgtgggacctgcagcagctgaggaaggagctgggggacagccccaaggacaaggtgcccttctctgtgcccaagatccccctggtgttccggggccacacccagcaggaccctgaggtgcccaagagcctggtgagcaacctgcgcatccactgccccctgctggccggcagcgccctgatcacctttgatgaccccaaggtggccgagcaggtgctgcagcagaaggagcacaccatcaacatggaggagtgccgcctgcgggtgcaggtgcagcccctggagctgcccatggtgaccaccatccagatgagcagccagctgtctggaagaagagtgctggtgacaggcttccctgccagcctgcggctgtctgaggaggagctgctggacaagctggagatcttcttcggcaagaccagaaatggaggaggagatgtggatgtgcgggagctgctgcccggctctgtgatgctgggctttgccagagatggagtggcccagaggctgtgccagatcggccagttcaccgtgcccctgggcggccagcaggtgcccctgcgggtgagcccctacgtgaatggagagatccagaaggccgagatccgcagccagcctgtgcccaggtctgtgctggtgctgaacatcccagacatcctggatggccctgagctgcatgatgtgctggagatccacttccagaagcccacccggggcggcggggaggtggaggccctgactgtggtgccccagggccagcagggcctggccgtgttcaccagcgagagcggctag

SEQ ID NO: 156293 - DNA, 867 bp, Artificial Sequence
  Description of Artificial Sequence: Synthetic coding sequence
atgtctgcccccctggatgctgccctgcacgccctgcaggaggagcaggcccggctgaagatgaggctgtgggacctgcagcagctgaggaaggagctgggggacagccccaaggacaaggtgcccttctctgtgcccaagatccccctggtgttccggggccacacccagcaggaccctgaggtgcccaagagcctggtgagcaacctgcgcatccactgccccctgctggccggcagcgccctgatcacctttgatgaccccaaggtggccgagcaggtgctgcagcagaaggagcacaccatcaacatggaggagtgccgcctgcgggtgcaggtgcagcccctggagctgcccatggtgaccaccatccaggtgatgatgagcagccagctgtctggaagaagagtgctggtgacaggcttccctgccagcctgcggctgtctgaggaggagctgctggacaagctggagatcttcttcggcaagaccagaaatggaggaggagatgtggatgtgcgggagctgctgcccggctctgtgatgctgggctttgccagagatggagtggcccagaggctgtgccagatcggccagttcaccgtgcccctgggcggccagcaggtgcccctgcgggtgagcccctacgtgaatggagagatccagaaggccgagatccgcagccagcctgtgcccaggtctgtgctggtgctgaacatcccagacatcctggatggccctgagctgcatgatgtgctggagatccacttccagaagcccacccggggcggcggggaggtggaggccctgactgtggtgccccagggccagcagggcctggccgtgttcaccagcgagagcggctag

SEQ ID NO: 156294 - DNA, 1335 bp, Artificial Sequence
  Description of Artificial Sequence: Synthetic coding sequence
atggctgtgaccacccggctgacctggctgcacgagaagatcctgcagaaccactttggaggcaagaggctgagcctgctgtacaagggctctgtgcacggcttcagaaatggagtgctgctggaccgctgctgcaaccagggccccaccctgaccgtcatctacagcgaggaccacatcattggagcctatgcagaggagagctaccaggagggcaagtatgccagcatcatcctgtttgccctgcaggacaccaagatcagcgagtggaagctgggcctgtgcaccccagagaccctcttctgctgtgatgtgaccaagtacaacagccccaccaacttccagattgatggaagaaacaggaaggtgatcatggacctgaagaccatggagaacctgggcctggcccagaactgcaccatcagcatccaggactatgaggtgttccgctgtgaggacagcctggatgagaggaagatcaagggcgtcatcgagctgaggaagagcctgctgagcgccctgcggacctatgagccctacggcagcctggtgcagcagatccgcatcctgctgctgggccccatcggggccggcaagagcagcttcttcaacagcgtgcgcagcgtcttccagggccacgtgacccaccaggccctggtgggcaccaacaccaccggcatcagcgagaagtaccgcacctacagcatcagagatggcaaggatggcaagtacctgcccttcatcctgtgtgacagcctgggcctgtctgagaaggagggcggcctgtgcagagatgacatcttctacatcctgaatggaaacatccgggaccgctaccagttcaaccccatggagagcatcaagctgaaccaccacgactacatcgacagccccagcctgaaggaccgcatccactgtgtggcctttgtgtttgatgccagcagcatccagtacttcagcagccagatgattgtgaagatcaagaggatcagaagagagctggtgaatgccggcgtggtgcacgtggccctgctgacccacgtggacagcatggacctgatcaccaagggggacctgattgaaattgaaagatgtgagcctgtgcgcagcaagctggaggaggtgcagaggaagctgggctttgccctgagtgacatctctgtggtgagcaactacagcagcgagtgggagctggaccctgtgaaggatgtgctgatcctgagcgccctgcggaggatgctgtgggccgcagatgacttcctggaggacctgccctttgagcagatcggcaacctgcgggaggagatcatcaactgtgcccagggcaagaagtag

SEQ ID NO: 156295 - DNA, 588 bp, Artificial Sequence
  Description of Artificial Sequence: Synthetic coding sequence
atggacctgaagaccatggagaacctgggcctggcccagaactgcaccatcagcatccaggactatgaggtgttccgctgtgaggacagcctggatgagaggaagatcaagggcgtcatcgagctgaggaagagcctgctgagcgccctgcggacctatgagccctacggcagcctggtgcagcagatccgcatcctgctgctgggccccatcggggccggcaagagcagcttcttcaacagcgtgcgcagcgtcttccagggccacgtgacccaccaggccctggtgggcaccaacaccaccggcatcagcgagaagtaccgcacctacagcatcagagatggcaaggatggcaagtacctgcccttcatcctgtgtgacagcctgggcctgtctgagaaggagggcggcctgtgcagagatgacatcttctacatcctgaatggaaacatccgggaccgctaccagttcaaccccatggagagcatcaagctgaaccaccacgactacatcgacagccccagcctgaaggaccgcatccactgtgtggcctttgtgtttgatgccagcagcatccagtacttctag

SEQ ID NO: 156296 - DNA, 231 bp, Artificial Sequence
  Description of Artificial Sequence: Synthetic coding sequence
tgactgagtgacatctctgtggtgagcaactacagcagcgagtgggagctggaccctgtgaaggatgtgctgatcctgagcgccctgcggaggatgctgtgggccgcagatgacttcctggaggacctgccctttgagcagatcggccgctggtttggaggagtggaggcctggaagaggagcggcaacctgcgggaggagatcatcaactgtgcccagggcaagaagtag

SEQ ID NO: 156297 - DNA, 390 bp, Artificial Sequence
  Description of Artificial Sequence: Synthetic coding sequence
atggagagcatcaagctgaaccaccacgactacatcgacagccccagcctgaaggaccgcatccactgtgtggcctttgtgtttgatgccagcagcatccagtacttcagcagccagatgattgtgaagatcaagaggatccggcgggagctggtgaatgctggggtggtgcacgtggccctgctgacccacgtggacagcatggacctgatcaccaagggggacctgattgaaattgagcgctgtgagcctgtgcgcagcaaggtgatgaatgatgccctgaggaagcacatcttctggggcatgctgctgcagagccacacctctgtgtacaagaacaagaacaagcagctgctgggcctgcggcgcatcaccaagctgctgaagtag

SEQ ID NO: 156298 - DNA, 585 bp, Artificial Sequence
  Description of Artificial Sequence: Synthetic coding sequence
atgctgtgtgacaccatgggcctggatggagctgagggcgccggcctgtgcatggatgacatcccccacatcctgaagggctgcatgccagaccgctaccagttcaacagcaggaagcccatcaccccagagcacagcaccttcatcaccagccccagcctgaaggaccgcatccactgtgtggcctacgtgctggacatcaacagcattgacaacctgtacagcaagatgctggccaaggtgaagcaggtgcacaaggaggtgctgaactgtggcatcgcctacgtggccctgctgaccaaggtggatgactgcagcgaggtgctgcaggacaacttcctgaacatgagccgctccatgaccagccagagccgggtgatgaatgtgcacaagatgctgggcatccccatcagcaacatcctgatggtgggcaactatgccagtgacctggagctggaccccatgaaggacatcctgatcctgagcgccctgcggcagatgctgcgggctgctgatgacttcctggaggacctgcccctggaggagactggagccatcgagcgggccctgcagccctgcatctag

SEQ ID NO: 156299 - DNA, 1359 bp, Artificial Sequence
  Description of Artificial Sequence: Synthetic coding sequence
atggaggtgaccacccggctgacctggaatgatgagaaccacctgaggaagctgctgggcaatgtgtccctgagcctgctgtacaagagctctgtgcatggaggcagcattgaggacatggtggagcgctgcagccggcagggctgcaccatcaccatggcctacatcgactacaacatgattgtggccttcatgctgggcaactacatcaacctgcacgagagcagcacagagcccaatgacagcctgtggttcagcctgcagaagaagaatgacaccacagaaattgagaccctgctgctgaacacagcccccaagatcattgatgagcagctggtgtgccgcctgagcaagacagacatcttcatcatctgccgggacaacaagatctacctggacaagatgatcaccaggaacctgaagctgcgcttctacggccaccggcagtacctggagtgtgaggtgttccgggtggagggcatcaaggacaacctggatgacatcaagaggatcatcaaggcccgggagcacaggaaccggctgctggccgacatccgggactaccggccctatgctgacctggtgtctgagatccgcatcctgctggtgggccctgtgggcagcggcaagagcagcttcttcaacagcgtgaagagcatcttccacggccacgtgacaggccaggccgtggtgggcagtgacatcaccagcatcacagagcgctaccgcatctacagcgtgaaggatggcaagaatggcaagagcctgcccttcatgctgtgtgacaccatgggcctggatggagctgagggcgccggcctgtgcatggatgacatcccccacatcctgaagggctgcatgccagaccgctaccagttcaacagcaggaagcccatcaccccagagcacagcaccttcatcaccagccccagcctgaaggaccgcatccactgtgtggcctacgtgctggacatcaacagcattgacaacctgtacagcaagatgctggccaaggtgaagcaggtgcacaaggaggtgctgaactgtggcatcgcctacgtggccctgctgaccaaggtggatgactgcagcgaggtgctgcaggacaacttcctgaacatgagccgctccatgaccagccagagccgggtgatgaatgtgcacaagatgctgggcatccccatcagcaacatcctgatggtgggcaactatgccagtgacctggagctggaccccatgaaggacatcctgatcctgagcgccctgcggcagatgctgcgggctgctgatgacttcctggaggacctgcccctggaggagactggagccatcgagcgggccctgcagccctgcatctag

SEQ ID NO: 156300 - DNA, 294 bp, Artificial Sequence
  Description of Artificial Sequence: Synthetic coding sequence
atggaggtgaccacccggctgacctggaatgatgagaaccacctgaggaagctgctgggcaatgtgtccctgagcctgctgtacaagagctctgtgcatggaggcagcattgaggacatggtggagcgctgcagccggcagggctgcaccatcaccatggcctacatcgactacaacatgattgtggccttcatgctgggcaactacatcaacctgcacgagagcagcacagagcccaatgacagcctgtggttcagcctgcagaagaagaatgacaccacagaaattgaatag

SEQ ID NO: 156301 - DNA, 1437 bp, Artificial Sequence
  Description of Artificial Sequence: Synthetic coding sequence
atgagcaccaatggagatgaccaccaggtgaaggacagcctggagcagctgcgctgccacttcacctgggagctgagcattgatgatgatgagatgccagacctggagaacagagtgctggaccagatcgagttcctggacaccaagtacagcgtgggcatccacaacctgctggcctacgtgaagcacctgaagggccagaatgaggaggccctgaagagcctgaaggaggccgagaacctgatgcaggaggagcatgacaaccaggccaacgtgcgcagcctggtgacctggggcaactttgcctggatgtactaccacatgggccgcctggccgaggcccagacctacctggacaaggtggagaacatctgcaagaagctgagcaaccccttccgctacaggatggagtgcccagaaattgactgtgaggagggctgggccctgctgaagtgtggcggcaagaactatgagcgggccaaggcctgctttgagaaggtgctggaggtggaccctgaaaatcctgagagcagcgctggctacgccatcagcgcctaccgcctggatggcttcaagctggccaccaagaaccacaagcccttcagcctgctgcccctgcggcaggccgtgcggctgaacccagacaatggctacatcaaggtgctgctggccctgaagctgcaggatgagggccaggaggccgagggggagaagtacatcgaggaggccctggccaacatgagcagccagacctacgtgttccgctatgctgccaagttctacagaaggaagggctctgtggacaaggccctggagctgctgaagaaggccctgcaggagacccccacctctgtgctgctgcaccaccagatcggcctgtgctacaaggcccagatgatccagatcaaggaggccaccaagggccagccccggggccagaaccgggagaagctggacaagatgatccgcagcgccatcttccactttgaatctgctgtggagaagaagcccacctttgaggtggcccacctggacctggccaggatgtacattgaagctggcaaccacaggaaggccgaggagaacttccagaagctgctgtgcatgaagcctgtggtggaggagaccatgcaggacatccacttccactacggccgcttccaggagttccagaagaagagtgatgtgaatgccatcatccactacctgaaggccatcaagattgagcaggccagcctgacccgggacaagagcatcaacagcctgaagaagctggtgctgaggaagctgcggaggaaggccctggacctggagagcctgagcctgctgggctttgtgtacaagctggagggcaacatgaatgaggccctggagtactatgaaagagccctgcggctggccgctgactttgaaaattctgtgcggcagggcccctag

SEQ ID NO: 156302 - DNA, 1344 bp, Artificial Sequence
  Description of Artificial Sequence: Synthetic coding sequence
atgccagacctggagaacagagtgctggaccagatcgagttcctggacaccaagtacagcgtgggcatccacaacctgctggcctacgtgaagcacctgaagggccagaatgaggaggccctgaagagcctgaaggaggccgagaacctgatgcaggaggagcatgacaaccaggccaacgtgcgcagcctggtgacctggggcaactttgcctggatgtactaccacatgggccgcctggccgaggcccagacctacctggacaaggtggagaacatctgcaagaagctgagcaaccccttccgctacaggatggagtgcccagaaattgactgtgaggagggctgggccctgctgaagtgtggcggcaagaactatgaaagagccaaggcctgctttgagaaggtgctggaggtggaccctgagaaccctgagagcagcgctggctacgccatcagcgcctaccgcctggatggcttcaagctggccaccaagaaccacaagcccttcagcctgctgcccctgcggcaggccgtgcggctgaacccagacaatggctacatcaaggtgctgctggccctgaagctgcaggatgagggccaggaggccgagggggagaagtacatcgaggaggccctggccaacatgagcagccagacctacgtgttccgctatgctgccaagttctacagaagaaaaggatctgtggacaaggccctggagctgctgaagaaggccctgcaggagacccccacctctgtgctgctgcaccaccagatcggcctgtgctacaaggcccagatgatccagatcaaggaggccaccaagggccagccccggggccagaaccgggagaagctggacaagatgatccgcagcgccatcttccactttgagagcgctgtggagaagaagcccacctttgaggtggcccacctggacctggccaggatgtacatcgaggccggcaaccacaggaaggccgaggagaacttccagaagctgctgtgcatgaagcctgtggtggaggagaccatgcaggacatccacttccactacggccgcttccaggagttccagaagaagagtgatgtgaatgccatcatccactacctgaaggccatcaagattgagcaggccagcctgacccgggacaagagcatcaacagcctgaagaagctggtgctgaggaagctgcggaggaaggccctggacctggagagcctgagcctgctgggctttgtgtacaagctggagggcaacatgaatgaggccctggagtactatgagcgggccctgcggctggccgctgactttgagaacagcgtgcggcagggcccctag

SEQ ID NO: 156303 - DNA, 1419 bp, Artificial Sequence
  Description of Artificial Sequence: Synthetic coding sequence
atgtctgagaacaacaagaacagcctggagagcagcctgcggcagctgaagtgccacttcacctggaacctgatggagggggagaacagcctggatgactttgaggacaaggtgttctacagaacagagttccagaaccgggagttcaaggccaccatgtgcaacctgctggcctacctgaagcacctgaagggccagaatgaagctgccctggagtgcctgaggaaggccgaggagctgatccagcaggagcacgccgaccaggccgagatccgcagcctggtgacctggggcaactatgcctgggtgtactaccacatgggccgcctgagtgatgtgcagatctacgtggacaaggtgaagcacgtgtgtgagaagttcagcagcccctacagaattgagagccctgagctggactgtgaggagggctggacccggctgaagtgtggcggcaaccagaatgaaagagccaaggtgtgctttgagaaggccctggagaagaagcccaagaaccctgagttcaccagcggcctggccatcgccagctaccgcctggacaactggccacccagccagaatgccatcgaccccctgcggcaggccatccggctgaacccagacaaccagtacctgaaggtgctgctggccctgaagctgcacaagatgagggaggagggggaggaggagggggagggggagaagctggtggaggaggccctggagaaggcccctggggtgacagatgtgctgcggtctgctgccaagttctacagaaggaaggatgagccagacaaggccatcgagctgctgaagaaggccctggagtacatccccaacaatgcctacctgcactgccagatcggctgctgctaccgggccaaggtgttccaggtgatgaacctgagagaaaatggcatgtatggcaagaggaagctgctggagctgattggacatgctgtggcccacctgaagaaggcagatgaggccaatgacaacctcttccgggtgtgcagcatcctggccagcctgcacgccctggccgaccagtatgaagatgctgagtactacttccagaaggagttcagcaaggagctgacccctgtggccaagcagctgctgcacctgcgctatggcaacttccagctgtaccagatgaagtgtgaggacaaggccatccaccacttcatcgagggcgtgaagatcaaccagaagagccgggagaaggagaagatgaaggacaagctgcagaagatcgccaagatgaggctgagcaagaatggagctgacagcgaggccctgcacgtgctggccttcctgcaggagctgaatgagaagatgcagcaggctgatgaagattctgagcggggcctggagagcggcagcctcatccccagcgccagctcctggaatggagagtag

SEQ ID NO: 156304 - DNA, 1356 bp, Artificial Sequence
  Description of Artificial Sequence: Synthetic coding sequence
atgcccaagaacaagaagaggaacaccccccaccggggcagcagcgctgggggcggcggcagcggggctgctgctgccacagctgccacagctgggggccagcacagaaatgtgcagcccttcagtgatgaagatgccagcattgagaccatgagccactgcagcggctacagcgaccccagcagctttgctgaagatggccctgaggtgctggatgaggagggcacccaggaggacctggagtacaagctgaagggcctgattgacctgaccctggacaagagcgccaagacccggcaggccgccctggagggcatcaagaatgccctggccagcaagatgctgtatgagttcatcctggagaggaggatgaccctgacagacagcattgagcgctgcctgaagaagggcaagagtgatgagcagagagctgctgctgccctggcctctgtgctgtgcatccagctgggccctggcatcgagagcgaggagatcctgaagaccctgggccccatcctgaagaagatcatctgtgatggcagcgcctccatgcaggcccggcagacctgtgccacctgcttcggcgtgtgctgcttcatcgccacagatgacatcacagagctgtacagcaccctggagtgcctggagaacatcttcaccaagagctacctgaaggagaaggacaccaccgtcatctgcagcacccccaacacagtgctgcacatcagcagcctgctggcctggaccctgctgctgaccatctgccccatcaatgaggtgaagaagaagctggagatgcacttccacaagctgcccagcctgctgagctgtgatgatgtgaacatgagaattgctgctggggagagcctggccctgctgtttgagctggcccggggcatcgagagtgacttcttctatgaggacatggagagcctgacccagatgctgcgggccctggccacagatggcaacaagcaccgggccaaggtggacaagaggaagcagaggtctgtgttcagagatgtgctgcgggctgtggaggagcgggacttccccacagagaccatcaagtttggacctgagaggatgtacatcgactgctgggtgaagaagcacacctatgacaccttcaaggaggtgctgggcagcggcatgcagtaccacctgcagagcaatgagttcctgagaaatgtgtttgagctgggcccccctgtgatgctggatgctgccaccctgaagaccatgaagatcagcagatttgagcggcacctgtacaacagcgctgccttcaaggcccggaccaaggcccggagcaaatgtcgggacaagagagcagatgtgggggagttcttctag

SEQ ID NO: 156305 - DNA, 1356 bp, Artificial Sequence; identical to SEQ ID NO: 156304
  Description of Artificial Sequence: Synthetic coding sequence

SEQ ID NO: 156306 - DNA, 57 bp, Artificial Sequence
  Description of Artificial Sequence: Synthetic coding sequence
atgcccaagaacaagaagaggaacaccccccaccggggcagcagcgctgggggctag

SEQ ID NO: 156307 - DNA, 96 bp, Artificial Sequence
  Description of Artificial Sequence: Synthetic coding sequence
atgcccaagaacaagaagaggaacaccccccaccggggcagcagcgctgggggcggcggcagcggggctgctgctgccacagctgccacagcctag

SEQ ID NO: 156308 - DNA, 189 bp, Artificial Sequence
  Description of Artificial Sequence: Synthetic coding sequence
atgcccaagaacaagaagaggaacaccccccaccggggcagcagcgctgggggcggcggcagcggggctgctgctgccacagctgccacagctgggggccagcacagaaatgtgcagcccttcagtgatgaagatgccagcattgagaccatgagccactgcagcggctacagcgaccccagcagctag

SEQ ID NO: 156309 - DNA, 1206 bp, Artificial Sequence
  Description of Artificial Sequence: Synthetic coding sequence
atgagccactgcagcggctacagcgaccccagcagctttgctgaagatggccctgaggtgctggatgaggagggcacccaggaggacctggagtacaagctgaagggcctgattgacctgaccctggacaagagcgccaagacccggcaggccgccctggagggcatcaagaatgccctggccagcaagatgctgtatgagttcatcctggagaggaggatgaccctgacagacagcattgagcgctgcctgaagaagggcaagagtgatgagcagagagctgctgctgccctggcctctgtgctgtgcatccagctgggccctggcatcgagagcgaggagatcctgaagaccctgggccccatcctgaagaagatcatctgtgatggcagcgcctccatgcaggcccggcagacctgtgccacctgcttcggcgtgtgctgcttcatcgccacagatgacatcacagagctgtacagcaccctggagtgcctggagaacatcttcaccaagagctacctgaaggagaaggacaccaccgtcatctgcagcacccccaacacagtgctgcacatcagcagcctgctggcctggaccctgctgctgaccatctgccccatcaatgaggtgaagaagaagctggagatgcacttccacaagctgcccagcctgctgagctgtgatgatgtgaacatgagaattgctgctggggagagcctggccctgctgtttgagctggcccggggcatcgagagtgacttcttctatgaggacatggagagcctgacccagatgctgcgggccctggccacagatggcaacaagcaccgggccaaggtggacaagaggaagcagaggtctgtgttcagagatgtgctgcgggctgtggaggagcgggacttccccacagagaccatcaagtttggacctgagaggatgtacatcgactgctgggtgaagaagcacacctatgacaccttcaaggaggtgctgggcagcggcatgcagtaccacctgcagagcaatgagttcctgagaaatgtgtttgagctgggcccccctgtgatgctggatgctgccaccctgaagaccatgaagatcagcagatttgagcggcacctgtacaacagcgctgccttcaaggcccggaccaaggcccggagcaaatgtcgggacaagagagcagatgtgggggagttcttctag

SEQ ID NO: 156310 - DNA, 474 bp, Artificial Sequence
  Description of Artificial Sequence: Synthetic coding sequence
atgcacttccacaagctgcccagcctgctgagctgtgatgatgtgaacatgagaattgctgctggggagagcctggccctgctgtttgagctggcccggggcattgaaagtgacttcttctatgaggacatggagagcctgacccagatgctgcgggccctggccacagatggcaacaagcaccgggccaaggtggacaagaggaagcagaggagcgtcttcagagatgtgctgcgggctgtggaggagcgggacttccccacagagaccatcaagtttggacctgagaggatgtacatcgactgctgggtgaagaagcacacctatgacaccttcaaggaggtgctgggcagcggcatgcagtaccacctgcagagcaatgagttcctgagaaatgtgtttgagctgggcccccctgtgatgctggatgctgccaccctgaagaccatgaagatcagcagatttgaaagatag

SEQ ID NO: 156311 - DNA, 1827 bp, Artificial Sequence
  Description of Artificial Sequence: Synthetic coding sequence
atgggccccaagaagtcctggaggagccacttcttccccctgcctgaggtgtggctgctgctgctgctgagccaggccctgagccccagccacggcccccagacccaggccggcgtgggcctggtgtggagcgtgcccctgcccagcgccctgcggagccagagctgcctgggcgcccccctgagagatgccagcgagctgaccaccgtgcacctgttccccacccggggctggggcgcccggcgggccctgtgggtgcacagcagcgccagcgccagcagcgctgccagcagaagaaggctgcgggcccaggccagcggcatcagcagcttcagcctggtggatggaggagcccccagagaagatggaggagcccggggcgtgtggctgcccagcagcggccaggtgtctgcccagaggactggaagaaggctggtgggcctggagcccacccccaccggcagcctgaccccccggccccccaggcctgtgcccggcatgccccgggccaggaagggcaacaccctgaggaagggcggccagaggcggggcggcggggcccggagcagcgcccaggccgacagcggcagcagtgatgatgaggccgccagcgaggcccggagcacagccagcgagtgccccagcctgctgagcaccacagctgaggacagcctgggcggagatgtggtggatgagcagggccagcaggaggacctggaggagaagctgaaggagtatgtggactgcctgacagacaagagcgccaagacccggcagggcgccctggagagcctgcggctggccctggccagccggctgctgcctgacttcctgctggagcggcggctgaccctggctgatgccctggagaagtgcctgaagaagggcaaaggagaggagcaggccctggccgctgctgtgctgggcctgctgtgtgtgcagctgggccctggccccaagggggaggagctgttccacagcctgcagcccctgctggtgtctgtgctgagtgacagcacagccagccctgctgcccggctgcactgtgccagcgccctgggcctgggctgctacgtggccgctgctgacatccaggacctggtgtcctgcctggcctgcctggagagcgtcttcagccgcttctacggcctgggcggcagcagcaccagccctgtggtgcctgccagcctgcacggcctgctgtctgctgccctgcaggcctgggccctgctgctgaccatctgccccagcacccagatcagccacatcctggaccggcagctgccccggctgccccagctgctgagcagcgagagcgtgaacctgagaattgctgctggggagaccatcgccctgctgtttgagctggcccgggacctggaggaggagtttgtgtatgaggacatggaggccctgtgcagcgtgctgcggaccctggccacagacagcaacaagtaccgggccaaggctgacagaagacggcagaggagcaccttccgggctgtgctgcacagcgtggagggcggggagtgtgaggaggagatcgtgcgcttcggctttgaggtgctgtacatggacagctgggcccggcaccgcatctatgctgccttcaaggaggtgctgggcagcggcatgcaccaccacctgcagaacaatgagctgctgcgggacatcttcggcctgggccctgtgctgctgctggatgccacagccctgaaggcctgcaaggtgcccaggtttgagaagcacctgtacaatgctgctgccttcaaggcccggaccaaggcccggagccgggtgcgggacaagagagctgacatcctgtag

SEQ ID NO: 156312 - DNA, 1329 bp, Artificial Sequence
  Description of Artificial Sequence: Synthetic coding sequence
atgccccgggccaggaagggcaacaccctgaggaagggcggccagaggcggggcggcggggcccggagcagcgcccaggccgacagcggcagcagtgatgatgaggccgccagcgaggcccggagcacagccagcgagtgccccagcctgctgagcaccacagctgaggacagcctgggcggagatgtggtggatgagcagggccagcaggaggacctggaggagaagctgaaggagtatgtggactgcctgacagacaagagcgccaagacccggcagggcgccctggagagcctgcggctggccctggccagccggctgctgcctgacttcctgctggagcggcggctgaccctggctgatgccctggagaagtgcctgaagaagggcaaaggagaggagcaggccctggccgctgctgtgctgggcctgctgtgtgtgcagctgggccctggccccaagggggaggagctgttccacagcctgcagcccctgctggtgtctgtgctgagtgacagcacagccagccctgctgcccggctgcactgtgccagcgccctgggcctgggctgctacgtggccgctgctgacatccaggacctggtgtcctgcctggcctgcctggagagcgtcttcagccgcttctacggcctgggcggcagcagcaccagccctgtggtgcctgccagcctgcacggcctgctgtctgctgccctgcaggcctgggccctgctgctgaccatctgccccagcacccagatcagccacatcctggaccggcagctgccccggctgccccagctgctgagcagcgagagcgtgaacctgagaattgctgctggggagaccatcgccctgctgtttgagctggcccgggacctggaggaggagtttgtgtatgaggacatggaggccctgtgcagcgtgctgcggaccctggccacagacagcaacaagtaccgggccaaggctgacagaagacggcagaggagcaccttccgggctgtgctgcacagcgtggagggcggggagtgtgaggaggagatcgtgcgcttcggctttgaggtgctgtacatggacagctgggcccggcaccgcatctatgctgccttcaaggaggtgctgggcagcggcatgcaccaccacctgcagaacaatgagctgctgcgggacatcttcggcctgggccctgtgctgctgctggatgccacagccctgaaggcctgcaaggtgcccaggtttgagaagcacctgtacaatgctgctgccttcaaggcccggaccaaggcccggagccgggtgcgggacaagagagctgacatcctgtag

SEQ ID NO: 156313 - DNA, 1521 bp, Artificial Sequence
  Description of Artificial Sequence: Synthetic coding sequence
atggcctggaacagccccagccggcggcctgtgtggcagggcggggcccccagagaagatggaggagcccggggcgtgtggctgcccagcagcggccaggtgtctgcccagaggactggaagaaggctggtgggcctggagcccacccccaccggcagcctgaccccccggccccccaggcctgtgcccggcatgccccgggccaggaagggcaacaccctgaggaagggcggccagaggcggggcggcggggcccggagcagcgcccaggccgacagcggcagcagtgatgatgaggccgccagcgaggcccggagcacagccagcgagtgccccagcctgctgagcaccacagctgaggacagcctgggcggagatgtggtggatgagcagggccagcaggaggacctggaggagaagctgaaggagtatgtggactgcctgacagacaagagcgccaagacccggcagggcgccctggagagcctgcggctggccctggccagccggctgctgcctgacttcctgctggagcggcggctgaccctggctgatgccctggagaagtgcctgaagaagggcaaaggagaggagcaggccctggccgctgctgtgctgggcctgctgtgtgtgcagctgggccctggccccaagggggaggagctgttccacagcctgcagcccctgctggtgtctgtgctgagtgacagcacagccagccctgctgcccggctgcactgtgccagcgccctgggcctgggctgctacgtggccgctgctgacatccaggacctggtgtcctgcctggcctgcctggagagcgtcttcagccgcttctacggcctgggcggcagcagcaccagccctgtggtgcctgccagcctgcacggcctgctgtctgctgccctgcaggcctgggccctgctgctgaccatctgccccagcacccagatcagccacatcctggaccggcagctgccccggctgccccagctgctgagcagcgagagcgtgaacctgagaattgctgctggggagaccatcgccctgctgtttgagctggcccgggacctggaggaggagtttgtgtatgaggacatggaggccctgtgcagcgtgctgcggaccctggccacagacagcaacaagtaccgggccaaggctgacagaagacggcagaggagcaccttccgggctgtgctgcacagcgtggagggcggggagtgtgaggaggagatcgtgcgcttcggctttgaggtgctgtacatggacagctgggcccggcaccgcatctatgctgccttcaaggaggtgctgggcagcggcatgcaccaccacctgcagaacaatgagctgctgcgggacatcttcggcctgggccctgtgctgctgctggatgccacagccctgaaggcctgcaaggtgcccaggtttgagaagcacctgtacaatgctgctgccttcaaggcccggaccaaggcccggagccgggtgcgggacaagagagctgacatcctgtag

SEQ ID NO: 156314 - DNA, 1329 bp, Artificial Sequence; identical to SEQ ID NO: 156312
  Description of Artificial Sequence: Synthetic coding sequence

SEQ ID NO: 156315 - DNA, 1713 bp, Artificial Sequence
  Description of Artificial Sequence: Synthetic coding sequence
atgaccctgctgtggtgtgtggtgtccctgtacttctacggcatcctgcagagtgatgccagcgagcgctgtgatgactggggcctggacaccatgaggcagatccaggtgtttgaagatgagcccgcccgcatcaagtgccccctgtttgagcacttcctgaagttcaactacagcacagcccacagcgctggcctgaccctcatctggtactggacccggcaggaccgggacctggaggagcccatcaacttccggctgcctgaaaatcgcatcagcaaggagaaggatgtgctgtggttccggcccaccctgctgaatgacaccggcaactacacctgcatgctgaggaacaccacctactgcagcaaggtggccttccccctggaggtggtgcagaaggacagctgcttcaacagccccatgaagctgcctgtgcacaagctgtacattgaatatggcatccagaggatcacctgccccaacgtggatggctacttccccagctctgtgaagcccaccatcacctggtacatgggctgctacaagatccagaacttcaacaacgtcatccctgagggcatgaacctgtccttcctgattgccctgatcagcaacaatggaaactacacctgtgtggtgacctacccagaaaatggaagaaccttccacctgaccaggaccctgactgtgaaggtggtgggcagccccaagaatgctgtgccccctgtgatccacagccccaatgaccacgtggtgtatgagaaggagcccggggaggagctgctgatcccctgcaccgtgtacttctccttcctgatggacagcagaaatgaggtgtggtggaccattgatggcaagaagccagatgacatcaccattgatgtgaccatcaatgaaagcatcagccacagcaggacagaagatgagaccaggacccagatcctgagcatcaagaaggtgaccagcgaggacctgaagaggagctatgtgtgccacgcccggagcgccaagggggaggtggccaaggccgccaaggtgaagcagaaggtgcctgccccccgctacacagtggagctggcctgtggctttggagccaccgtgctgctggtggtgatcctgattgtggtgtaccacgtgtactggctggagatggtgctcttctaccgggcccactttggaacagatgagaccatcctggatggcaaggagtatgacatctacgtgtcctatgccagaaatgctgaggaggaggagtttgtgctgctgaccctgcggggcgtgctggagaatgaatttggctacaagctgtgcatctttgaccgggacagcctgcccggcggcatcgtgacagatgagaccctgtccttcatccagaagagccggcggctgctggtggtgctgagccccaactacgtgctgcagggcacccaggccctgctggagctgaaggccggcctggagaacatggccagccggggcaacatcaacgtcatcctggtgcagtacaaggctgtgaaggagaccaaggtgaaggagctgaagagggccaagacagtgctgaccgtcatcaagtggaagggggagaagagcaagtacccccagggccgcttctggaagcagctgcaggtggccatgcctgtgaagaagagccccaggaggagcagcagtgatgagcagggcctgagctacagcagcctgaagaatgtgtag

SEQ ID NO: 156316 - DNA, 2064 bp, Artificial Sequence
  Description of Artificial Sequence: Synthetic coding sequence
atgaccctgctgtggtgtgtggtgtccctgtacttctacggcatcctgcagagtgatgccagcgagcgctgtgatgactggggcctggacaccatgaggcagatccaggtgtttgaagatgagcccgcccgcatcaagtgccccctgtttgagcacttcctgaagttcaactacagcacagcccacagcgctggcctgaccctcatctggtactggacccggcaggaccgggacctggaggagcccatcaacttccggctgcctgaaaatcgcatcagcaaggagaaggatgtgctgtggttccggcccaccctgctgaatgacaccggcaactacacctgcatgctgaggaacaccacctactgcagcaaggtggccttccccctggaggtggtgcagaaggacagctgcttcaacagccccatgaagctgcctgtgcacaagctgtacattgaatatggcatccagaggatcacctgccccaacgtggatggctacttccccagctctgtgaagcccaccatcacctggtacatgggctgctacaagatccagaacttcaacaacgtcatccctgagggcatgaacctgtccttcctgattgccctgatcagcaacaatggaaactacacctgtgtggtgacctacccagaaaatggaagaaccttccacctgaccaggaccctgactgtgaaggtggtgggcagccccaagaatgctgtgccccctgtgatccacagccccaatgaccacgtggtgtatgagaaggagcccggggaggagctgctgatcccctgcaccgtgtacttctccttcctgatggacagcagaaatgaggtgtggtggaccattgatggcaagaagccagatgacatcaccattgatgtgaccatcaatgaaagcatcagccacagcaggacagaagatgagaccaggacccagatcctgagcatcaagaaggtgaccagcgaggacctgaagaggagctatgtgtgccacgcccggagcgccaagggggaggtggccaaggccgccaaggtgaagcagaaggtgcctgccccccgctacacagtggagctggcctgtggctttggagccaccgtgctgctggtggtgatcctgattgtggtgtaccacgtgtactggctggagatggtgctcttctaccgggcccactttggaacagatgagaccatcctggatggcaaggagtatgacatctacgtgtcctatgccagaaatgctgaggaggaggagtttgtgctgctgaccctgcggggcgtgctggagaatgaatttggctacaagctgtgcatctttgaccgggacagcctgcccggcggcaacacagtggaggccgtgtttgacttcatccagaggagcaggaggatgattgtggtgctgagcccagactatgtgacagagaagagcatctccatgctggagttcaagctgggcgtgatgtgccagaacagcatcgccaccaagctgattgtggtggagtaccggcccctggagcacccccaccctggcatcctgcagctgaaggagagcgtgtcctttgtgtcctggaagggggagaagagcaagcacagcggcagcaagttctggaaggccctgcggctggccctgcccctgcggagcctgagcgccagcagcggctggaatgaaagctgcagcagccagagcgacatcagcctggaccacgtgcagaggagaagaagccggctgaaggagcccccagagctgcagagcagcgagagagctgctggcagccccccagcccctggcaccatgagcaagcaccggggcaagagcagcgccacctgccgctgctgcgtgacctactgtgagggggagaaccacctgaggaacaagagcagagctgagatccacaaccagccccagtgggagacccacctgtgcaagcctgtgccccaggagagcgagacccagtggatccagaatggcacccggctggagcccccagccccccagatcagcgccctggccctgcaccacttcacagacctgagcaacaacaatgacttctacatcctgtag

SEQ ID NO: 156317 - DNA, 1713 bp, Artificial Sequence; identical to SEQ ID NO: 156315
  Description of Artificial Sequence: Synthetic coding sequence

SEQ ID NO: 156318 - DNA, 1071 bp, Artificial Sequence
  Description of Artificial Sequence: Synthetic coding sequence
atgaccctgctgtggtgtgtggtgtccctgtacttctacggcatcctgcagagtgatgccagcgagcgctgtgatgactggggcctggacaccatgaggcagatccaggtgtttgaagatgagcccgcccgcatcaagtgccccctgtttgagcacttcctgaagttcaactacagcacagcccacagcgctggcctgaccctcatctggtactggacccggcaggaccgggacctggaggagcccatcaacttccggctgcctgaaaatcgcatcagcaaggagaaggatgtgctgtggttccggcccaccctgctgaatgacaccggcaactacacctgcatgctgaggaacaccacctactgcagcaaggtggccttccccctggaggtggtgcagaaggacagctgcttcaacagccccatgaagctgcctgtgcacaagctgtacattgaatatggcatccagaggatcacctgccccaacgtggatggctacttccccagctctgtgaagcccaccatcacctggtacatgggctgctacaagatccagaacttcaacaacgtcatccctgagggcatgaacctgtccttcctgattgccctgatcagcaacaatggaaactacacctgtgtggtgacctacccagaaaatggaagaaccttccacctgaccaggaccctgactgtgaaggtggtgggcagccccaagaatgctgtgccccctgtgatccacagccccaatgaccacgtggtgtatgagaaggagcccggggaggagctgctgatcccctgcaccgtgtacttctccttcctgatggacagcagaaatgaggtgtggtggaccattgatggcaagaagccagatgacatcaccattgatgtgaccatcaatgaaagcatcagccacagcaggacagaagatgagaccaggacccagatcctgagcatcaagaaggtgaccagcgaggacctgaagaggagctatgtgtgccacgcccggagcgccaagggggaggtggccaaggccgccaaggtgaagcagaagggcaacagatgtggccagtag

SEQ ID NO: 156319 - DNA, 342 bp, Artificial Sequence
  Description of Artificial Sequence: Synthetic coding sequence
atgaccctgctgtggtgtgtggtgtccctgtacttctacggcatcctgcagagtgatgccagcgagcgctgtgatgactggggcctggacaccatgaggcagatccaggtgtttgaagatgagcccgcccgcatcaagtgccccctgtttgagcacttcctgaagttcaactacagcacagcccacagcgctggcctgaccctcatctggtactggacccggcaggaccgggacctggaggagcccatcaacttccggctgcctgaaaatcgcatcagcaaggagaaggatgtgctgtggttccggcccaccctgctgaatgacaccggcaactacacctag

SEQ ID NO: 156320 - DNA, 1071 bp, Artificial Sequence; identical to SEQ ID NO: 156318
  Description of Artificial Sequence: Synthetic coding sequence

SEQ ID NO: 156321 - DNA, 1713 bp, Artificial Sequence; identical to SEQ ID NO: 156315
  Description of Artificial Sequence: Synthetic coding sequence

SEQ ID NO: 156322 - DNA, 2064 bp, Artificial Sequence; identical to SEQ ID NO: 156316
  Description of Artificial Sequence: Synthetic coding sequence

SEQ ID NO: 156323 - DNA, 1713 bp, Artificial Sequence; identical to SEQ ID NO: 156315
  Description of Artificial Sequence: Synthetic coding sequence

SEQ ID NO: 156324 - DNA, 438 bp, Artificial Sequence
  Description of Artificial Sequence: Synthetic coding sequence
atgaccctgctgtggtgtgtggtgtccctgtacttctacggcatcctgcagagtgatgccagcgagcgctgtgatgactggggcctggacaccatgaggcagatccaggtgtttgaagatgagcccgcccgcatcaagtgccccctgtttgagcacttcctgaagttcaactacagcacagcccacagcgctggcctgaccctcatctggtactggacccggcaggaccgggacctggaggagcccatcaacttccggctgcctgaaaatcgcatcagcaaggagaaggatgtgctgtggttccggcccaccctgctgaatgacaccggcaactacacctgcatgctgaggaacaccacctactgcagcaaggtggccttccccctggaggtggtgcagaaggacagctgcttcaacagccccatgaagctgccctag

SEQ ID NO: 156325 - DNA, 2091 bp, Artificial Sequence
  Description of Artificial Sequence: Synthetic coding sequence
atgaaggcccccatcccccacctgatcctgctgtatgccaccttcacccagagcctgaaggtggtgaccaagaggggcagcgcagatggctgcacagactggagcattgacatcaagaagtaccaggtgctggtgggggagcctgtgcgcatcaagtgtgccctcttctacggctacatccgcaccaactacagcctggcccagagcgctggcctgagcctgatgtggtacaagagcagcggccctggggactttgaggagcccatcgcctttgatggcagcaggatgagcaaggaggaggacagcatctggttccggcccaccctgctgcaggacagcggcctgtatgcctgcgtcatccggaacagcacctactgcatgaaggtgtccatcagcctgactgtgggagaaaatgacaccggcctgtgctacaacagcaagatgaagtactttgagaaggccgagctgagcaagagcaaggagatcagctgccgggacatcgaggacttcctgctgcccacccgggagcctgagatcctgtggtacaaggagtgcaggaccaagacctggaggcccagcatcgtgttcaagagggacaccctgctgatccgggaggtgcgggaggatgacatcggcaactacacctgtgagctgaagtatggaggctttgtggtgcggaggaccacagagctgactgtgacagcccccctgacagacaagccacccaagctgctgtaccccatggagagcaagctgaccatccaggagacccagctgggggacagcgccaacctgacctgccgggccttcttcggctacagcggagatgtgagccccctcatctactggatgaagggggagaagttcatcgaggacctggatgaaaatagagtgtgggagagtgacatccgcatcctgaaggagcacctgggggagcaggaggtgtccatcagcctcatcgtggacagcgtggaggagggggacctgggcaactacagctgctacgtggagaatggaaatggaagaagacatgcctctgtgctgctgcacaagcgggagctgatgtacacagtggagctggccggcggcctgggcgccatcctgctgctgctggtgtgcctggtgaccatctacaagtgctacaagattgagatcatgctgttctacagaaaccactttggagctgaggagctggatggagacaacaaggactatgatgcctacctgagctacaccaaggtggaccctgaccagtggaaccaggagactggagaggaggagagatttgccctggagatcctgcctgacatgctggagaagcactacggctacaagctgttcatcccagaccgggacctgatccccaccggcacctacattgaagatgtggcccgctgtgtggaccagagcaagaggctcatcatcgtgatgacccccaactacgtggtgcggcggggctggagcatctttgagctggagacccggctgaggaacatgctggtgactggagagatcaaggtgatcctgattgaatgttctgagctgcggggcatcatgaactaccaggaggtggaggccctgaagcacaccatcaagctgctgaccgtcatcaagtggcacggccccaagtgcaacaagctgaacagcaagttctggaagaggctgcagtatgagatgcccttcaagagaattgagcccatcacccatgagcaggccctggatgtgtctgagcagggcccctttggagagctgcagacagtgtctgccatctccatggccgccgccaccagcacagccctggccacagcccacccagacctgcggagcaccttccacaacacctaccacagccagatgaggcagaagcactactaccgctcctatgaatatgatgtgcccccaacaggcaccctgcccctgaccagcatcggcaaccagcacacctactgcaacatccccatgaccctcatcaatggccagaggccccagaccaagagcagccgggagcagaacccagatgaggcccacaccaacagcgccatcctgcccctgctgccccgggagaccagcatcagcagcgtcatctggtag

SEQ ID NO: 156326 - DNA, 2091 bp, Artificial Sequence; identical to SEQ ID NO: 156325
  Description of Artificial Sequence: Synthetic coding sequence

SEQ ID NO: 156327 - DNA, 2061 bp, Artificial Sequence
  Description of Artificial Sequence: Synthetic coding sequence
atgaagccacccttcctgctggccctggtggtgtgcagcgtggtgtccaccaacctgaagatggtgtccaagagaaattctgtggatggctgcatcgactggagcgtggacctgaagacctacatggccctggccggggagcctgtgcgggtgaagtgtgccctcttctacagctacatccgcaccaactacagcacagcccagagcacaggcctgcggctgatgtggtacaagaacaagggggacctggaggagcccatcatcttcagcgaggtgaggatgagcaaggaggaggacagcatctggttccacagcgctgaggcccaggacagcggcttctacacctgtgtgctgaggaacagcacctactgcatgaaggtgtccatgagcctgactgtggctgaaaatgaaagtggcctgtgctacaacagccgcatccgctacctggagaagtctgaggtgaccaagaggaaggagatcagctgcccagacatggatgacttcaagaagagtgaccaggagccagatgtggtgtggtacaaggagtgcaagcccaagatgtggaggagcatcatcatccagaagggaaatgccctgctgatccaggaggtgcaggaggaggatggcggcaactacacctgtgagctgaagtatgagggcaagctggtgcggaggaccacagagctgaaggtgacagccctgctgacagacaagccacccaagcccctcttccccatggagaaccagcccagcgtgattgatgtgcagctgggcaagcccctgaacatcccctgcaaggccttcttcggcttcagcggggagagcggccccatgatctactggatgaagggggagaagttcatcgaggagctggccggccacatccgggagggggagatccggctgctgaaggagcacctgggggagaaggaggtggagctggccctgatctttgacagcgtggtggaggccgacctggccaactacacctgccacgtggagaacagaaatggaaggaagcacgcctctgtgctgctgaggaagaaggacctgatctacaagattgagctggccggcggcctgggcgccatcttcctgctgctggtgctgctggtggtgatctacaagtgctacaacatcgagctgatgctgttctaccggcagcactttggagcagatgagaccaatgatgacaacaaggagtatgatgcctacctgagctacaccaaggtggaccaggacaccctggactgtgacaaccctgaggaggagcagtttgccctggaggtgctgcctgatgtgctggagaagcactacggctacaagctgttcatccctgagcgggacctgatccccagcggcacctacatggaggacctgaccaggtatgtggagcagagccggcggctcatcatcgtgctgaccccagactacatcctgcggcggggctggagcatctttgagctggagagccggctgcacaacatgctggtgtctggagagatcaaggtgatcctgattgagtgcacagagctgaagggcaaggtgaactgccaggaggtggagagcctgaagaggagcatcaagctgctgagcctcatcaagtggaagggcagcaagagcagcaagctgaacagcaagttctggaagcacctggtgtatgagatgcccatcaagaagaaggagatgctgccccgctgccacgtgctggacagcgctgagcagggcctgtttggagagctgcagcccatccccagcatcgccatgaccagcaccagcgccaccctggtgagcagccaggccgacctgcctgagttccaccccagcgacagcatgcagatccgccactgctgccggggctacaagcatgagatcccagccaccaccctgcctgtgcccagcctgggcaaccaccacacctactgcaacctgcccctgaccctgctgaatggccagctgcccctgaacaacaccctgaaggacacccaggagttccacaggaacagcagcctgctgcccctgagcagcaaggagctgtccttcaccagtgacatctggtag

SEQ ID NO: 156328 - DNA, 2061 bp, Artificial Sequence; identical to SEQ ID NO: 156327
  Description of Artificial Sequence: Synthetic coding sequence

SEQ ID NO: 156329 - DNA, 876 bp, Artificial Sequence
  Description of Artificial Sequence: Synthetic coding sequence
atgagggacaacaaggagtatgatgcctacctgagctacaccaaggtggaccaggacaccctggactgtgacaaccctgaggaggagcagtttgccctggaggtgctgcctgatgtgctggagaagcactacggctacaagctgttcatccctgagcgggacctgatccccagcggcacctacatggaggacctgacccgctacgtggagcagagcagaagactcatcatcgtgctgaccccagactacatcctgcggcggggctggagcatctttgagctggagagccggctgcacaacatgctggtgtctggagagatcaaggtgatcctgattgaatgtacagagctgaagggcaaggtgaactgccaggaggtggagagcctgaagaggagcatcaagctgctgagcctcatcaagtggaagggcagcaagagcagcaagctgaacagcaagttctggaagcacctggtgtatgagatgcccatcaagaagaaggagatgctgccccgctgccacgtgctggacagcgctgagcagggcctgtttggagagctgcagcccatccccagcatcgccatgaccagcaccagcgccaccctggtgagcagccaggccgacctgcctgagttccaccccagcgacagcatgcagatccgccactgctgccggggctacaagcatgagatcccagccaccaccctgcctgtgcccagcctgggcaaccaccacacctactgcaacctgcccctgaccctgctgaatggccagctgcccctgaacaacaccctgaaggacacccaggagttccacaggaacagcagcctgctgcccctgagcagcaaggagctgtccttcaccagtgacatctggtag

SEQ ID NO: 156330 - DNA, 1197 bp, Artificial Sequence
  Description of Artificial Sequence: Synthetic coding sequence
atgctgcggctgtatgtgctggtgatgggcgtgtctgccttcaccctgcagcctgctgcccacactggagctgcccggagctgccgcttccggggccgccactacaagcgggagttccggctggagggggagcctgtggccctgcgctgcccccaggtgccctactggctgtgggcctctgtgagcccccgcatcaacctgacctggcacaagaatgacagcgccaggacagtgcctggagaggaggagaccaggatgtgggcccaggatggagccctgtggctgctgcctgccctgcaggaggacagcggcacctacgtgtgcaccaccagaaatgccagctactgtgacaagatgagcattgagctgcgggtgtttgaaaatacagatgccttcctgcccttcatctcctacccccagatcctgaccctgagcaccagcggcgtgctggtgtgcccagacctgtctgagttcacccgggacaagacagatgtgaagatccagtggtacaaggacagcctgctgctggacaaggacaatgagaagttcctgtctgtgcggggcaccacccacctgctggtgcatgatgtggccctggaggatgctggctactaccgctgtgtgctgacctttgcccacgagggccagcagtacaacatcaccaggagcattgagctgcgcatcaagaagaagaaggaggagaccatccctgtgatcatcagccccctgaagaccatcagcgccagcctgggcagccggctgaccatcccctgcaaggtgttcctgggcaccggcacccccctgaccaccatgctgtggtggacagccaatgacacccacattgaaagtgcctacccaggcggccgggtgacagagggcccccggcaggagtacagcgagaacaatgaaaactacatcgaggtgcccctcatctttgatcctgtgacccgggaggacctgcacatggacttcaagtgtgtggtgcacaacaccctgtccttccagaccctgcggaccaccgtgaaggaggccagcagcaccttctcctggggcatcgtgctggcccccctgagcctggccttcctggtgctgggcggcatctggatgcaccggcgctgcaagcacaggacaggcaaggcagatggcctgactgtgctgtggccccaccaccaggacttccagagctaccccaagtag

SEQ ID NO: 156331 - DNA, 1197 bp, Artificial Sequence; identical to SEQ ID NO: 156330
  Description of Artificial Sequence: Synthetic coding sequence

SEQ ID NO: 156332 - DNA, 690 bp, Artificial Sequence
  Description of Artificial Sequence: Synthetic coding sequence
atgctgcggctgtatgtgctggtgatgggcgtgtctgccttcaccctgcagcctgctgcccacactggagctgcccggagctgccgcttccggggccgccactacaagcgggagttccggctggagggggagcctgtggccctgcgctgcccccaggtgccctactggctgtgggcctctgtgagcccccgcatcaacctgacctggcacaagaatgacagcgccaggacagtgcctggagaggaggagaccaggatgtgggcccaggatggagccctgtggctgctgcctgccctgcaggaggacagcggcacctacgtgtgcaccaccagaaatgccagctactgtgacaagatgagcattgagctgcgggtgtttgaaaatacagatgccttcctgcccttcatctcctacccccagatcctgaccctgagcaccagcggcgtgctggtgtgcccagacctgtctgagttcacccgggacaagacagatgtgaagatccagtggtacaaggacagcctgctgctggacaaggacaatgagaagttcctgtctgtgcggggcaccacccacctgctggtgcatgatgtggccctggaggatgctggctactaccgctgtgtgctgacctttgcccacgagggccagcagtacaacatcaccaggagcattgagctgcgcatcaagtag

SEQ ID NO: 156333 - DNA, 1098 bp, Artificial Sequence
  Description of Artificial Sequence: Synthetic coding sequence
atgctgccccccctgcccagccggctgggcctgctgctgctgctgctgctgtgcccagcccacgtgggcggcctgtggtgggccgtgggcagccccctggtgatggaccccaccagcatctgcaggaaggcccggcggctggccggccggcaggccgagctgtgccaggccgagcctgaggtggtggccgagctggcccggggggcccggctgggcgtgcgggagtgccagttccagttccgcttccgccgctggaactgcagcagccacagcaaggccttcggccgcatcctgcagcaggacatccgggagacagcctttgtgtttgccatcacagctgctggggccagccatgctgtgacccaggcctgcagcatgggagagctgctgcagtgtggctgccaggccccccggggccgggccccaccccggcccagcggcctgcccggcaccccaggccccccaggccctgctggcagccctgagggcagcgctgcctgggagtggggcggctgtggagatgatgtggactttggagatgagaagagccgcctcttcatggatgcccggcacaagaggggccgcggggacatccgggccctggtgcagctgcacaacaatgaagctggccgcctggccgtgcgcagccacaccaggacagaatgtaaatgtcatggcctgagcggcagctgtgccctgcggacctgctggcagaagctgccccccttccgggaggtgggcgcccggctgctggagcgcttccatggagccagccgggtgatgggcaccaatgatggcaaggccctgctgcctgctgtgaggaccctgaagcccccaggccgggctgacctgctgtatgctgctgacagcccagacttctgtgcccccaacagaagaacaggcagccctggcacccggggccgggcctgcaacagcagcgccccagacctgagcggctgtgacctgctgtgctgcggccggggccaccggcaggagagcgtgcagctggaggagaactgcctgtgccgcttccactggtgctgcgtggtgcagtgccaccgctgccgggtgaggaaggagctgagcctgtgcctgtag

SEQ ID NO: 156334 - DNA, 987 bp, Artificial Sequence
  Description of Artificial Sequence: Synthetic coding sequence
atgggcttctggatcctggccatcctgaccatcctgatgtacagcacagctgccaagttcagcaagcagagctggggcctggagaatgaggccctgattgtgcgctgcccccggcagggcaagcccagctacacagtggactggtactacagccagaccaacaagagcatccccacccaggagaggaacagagtgtttgccagcggccagctgctgaagttcctgcctgctgctgtggccgacagcggcatctacacctgcatcgtgcgcagccccaccttcaacagaacaggctacgccaacgtgaccatctacaagaagcagagcgactgcaatgtgcctgactacctgatgtacagcacagtgtctggcagcgagaagaacagcaagatctactgccccaccatcgacctgtacaactggacagcccccctggagtggttcaagaactgccaggccctgcagggcagccgctaccgggcccacaagagcttcctggtgattgacaacgtgatgacagaagatgctggggactacacctgcaagttcatccacaatgaaaatggagccaactacagcgtgacagccaccaggagcttcaccgtgaaggatgagcagggcttcagcctcttccctgtgattggagccccagcccagaatgagatcaaggaggtggagatcggcaagaatgccaacctgacctgcagcgcctgcttcggcaagggcacccagttcctggccgctgtgctgtggcagctgaatggcaccaagatcacagactttggagagccccgcatccagcaggaggagggccagaaccagagcttcagcaatggcctggcctgcctggacatggtgctgagaattgctgatgtgaaggaggaggacctgctgctgcagtatgactgcctggccctgaacctgcacggcctgcggcggcacacagtgcggctgagcaggaagaaccccagcaaggagtgcttctag

SEQ ID NO: 156335 - DNA, 780 bp, Artificial Sequence
  Description of Artificial Sequence: Synthetic coding sequence
atgggcttctggatcctggccatcctgaccatcctgatgtacagcacagctgccaagttcagcaagcagagctggggcctggagaatgaggccctgattgtgcgctgcccccggcagggcaagcccagctacacagtggactggtactacagccagaccaacaagagcatccccacccaggagaggaacagagtgtttgccagcggccagctgctgaagttcctgcctgctgctgtggccgacagcggcatctacacctgcatcgtgcgcagccccaccttcaacagaacaggctacgccaacgtgaccatctacaagaagcagagcgactgcaatgtgcctgactacctgatgtacagcacagtgtctggcagcgagaagaacagcaagatctactgccccaccatcgacctgtacaactggacagcccccctggagtggttcaagaactgccaggccctgcagggcagccgctaccgggcccacaagagcttcctggtgattgacaacgtgatgacagaagatgctggggactacacctgcaagttcatccacaatgaaaatggagccaactacagcgtgacagccaccaggagcttcaccgtgaaggtgtggtgccagagcttctgcaagctgaagaagagcctcatcttcagcaacacccactggatccagagcctgatgaggggctttgtgatggtgtactacggcgtgcacaagtgctgccgggtggtgttcaacctgtgcctgcagtacttccagcaccaccagtggccctag

SEQ ID NO: 156336 - DNA, 636 bp, Artificial Sequence
  Description of Artificial Sequence: Synthetic coding sequence
atgtacagcacagtgtctggcagcgagaagaacagcaagatctactgccccaccatcgacctgtacaactggacagcccccctggagtggttcaagaactgccaggccctgcagggcagccgctaccgggcccacaagagcttcctggtgattgacaacgtgatgacagaagatgctggggactacacctgcaagttcatccacaatgaaaatggagccaactacagcgtgacagccaccaggagcttcaccgtgaaggatgagcagggcttcagcctcttccctgtgattggagccccagcccagaatgagatcaaggaggtggagatcggcaagaatgccaacctgacctgcagcgcctgcttcggcaagggcacccagttcctggccgctgtgctgtggcagctgaatggcaccaagatcacagactttggagagccccgcatccagcaggaggagggccagaaccagagcttcagcaatggcctggcctgcctggacatggtgctgagaattgctgatgtgaaggaggaggacctgctgctgcagtatgactgcctggccctgaacctgcacggcctgcggcggcacacagtgcggctgagcaggaagaaccccagcaaagaatgcttctag

SEQ ID NO: 156337 - DNA, 945 bp, Artificial Sequence
  Description of Artificial Sequence: Synthetic coding sequence
atgggcttctggatcctggccatcctgaccatcctgatgtacagcacagctgccaagttcagcaagcagagctggggcctggagaatgaggccctgattgtgcgctgcccccggcagggcaagcccagctacacagtggactggtactacagccagaccaacaagagcatccccacccaggagaggaacagagtgtttgccagcggccagctgctgaagttcctgcctgctgctgtggccgacagcggcatctacacctgcatcgtgcgcagccccaccttcaacagaacaggctacgccaacgtgaccatctacaagaagcagagcgactgcaatgtgcctgactacctgatgtacagcacagtgtctggcagcgagaagaacagcaagatctactgccccaccatcgacctgtacaactggacagcccccctggagtggttcaagaactgccaggccctgcagggcagccgctaccgggcccacaagagcttcctggtgattgacaacgtgatgacagaagatgctggggactacacctgcaagttcatccacaatgaaaatggagccaactacagcgtgacagccaccaggagcttcaccgtgaaggatgagcagggcttcagcctcttccctgtgattggagccccagcccagaatgagatcaaggaggtggagatcggcacccagttcctggccgctgtgctgtggcagctgaatggcaccaagatcacagactttggagagccccgcatccagcaggaggagggccagaaccagagcttcagcaatggcctggcctgcctggacatggtgctgagaattgctgatgtgaaggaggaggacctgctgctgcagtatgactgcctggccctgaacctgcacggcctgcggcggcacacagtgcggctgagcaggaagaaccccagcaaggagtgcttctag

SEQ ID NO: 156338 - DNA, 117 bp, Artificial Sequence
  Description of Artificial Sequence: Synthetic coding sequence
atgggcttctggatcctggccatcctgaccatcctgatgtacagcacagctgccaagttcagcaagcagagctggggcctggagaatgaggccctgattgtgcgctgccccaggtag

SEQ ID NO: 156339 - DNA, 1728 bp, Artificial Sequence
  Description of Artificial Sequence: Synthetic coding sequence
atgtggagcctgctgctgtgtggcctgagcatcgccctgcccctgtctgtgacagcagatggctgcaaggacatcttcatgaagaatgagatcctgagcgccagccagccctttgccttcaactgcaccttcccccccatcaccagcggggaggtgtctgtgacctggtacaagaacagcagcaagatccctgtgtccaagatcatccagagccgcatccaccaggatgagacctggatcctcttcctgcccatggagtggggagacagcggcgtgtaccagtgtgtgatcaagggccgggacagctgccaccgcatccacgtgaacctgactgtgtttgagaagcactggtgtgacaccagcatcggcggcctgcccaacctgagtgatgagtacaagcagatcctgcacctgggcaaggatgacagcctgacctgccacctgcacttccccaagagctgtgtgctgggccccatcaagtggtacaaggactgcaatgagatcaagggggagcgcttcaccgtgctggagacccggctgctggtgtccaatgtgtctgctgaggaccggggcaactatgcctgccaggccatcctgacccacagcggcaagcagtatgaggtgctgaatggcatcaccgtgtccatcacagagcgggccggctacggcggctctgtgcccaagatcatctaccccaagaaccacagcattgaggtgcagctgggcaccaccctcatcgtggactgcaatgtgacagacaccaaggacaacaccaacctgcgctgctggagggtgaacaacaccctggtggatgactactatgatgagagcaagaggatccgggagggcgtggagacccacgtgtccttccgggagcacaacctgtacacagtgaacatcaccttcctggaggtgaagatggaggactatggcctgcccttcatgtgccacgccggcgtgtccacagcctacatcatcctgcagctgcctgccccagacttccgggcctacctgattggaggcctgattgccctggtggccgtggccgtgtctgtggtgtacatctacaacatcttcaagattgatattgtgctgtggtacagaagtgccttccacagcacagagaccatcgtggatggcaagctgtatgatgcctacgtgctgtaccccaagccccacaaggagagccagagacatgctgtggatgccctggtgctgaacatcctgcctgaggtgctggagcggcagtgtggctacaagctgttcatcttcggcagagatgagttccctggccaggccgtggccaacgtgattgatgaaaatgtgaagctgtgccggcggctgattgtgattgtggtgcctgagagcctgggcttcggcctgctgaagaacctgtctgaggagcagattgctgtgtacagcgccctgatccaggacggcatgaaggtgatcctgattgagctggagaagattgaggactacacagtgatgcctgagagcatccagtacatcaagcagaagcacggggccatccgctggcacggggacttcacagagcagagccagtgcatgaagaccaagttctggaagacagtgcgctaccacatgccaccccggcgctgccggcccttcccccctgtgcagctgctgcagcacaccccctgctacagaacagctggccctgagctgggcagcaggaggaagaagtgcaccctgaccaccggctag

SEQ ID NO: 156340 - DNA, 519 bp, Artificial Sequence
  Description of Artificial Sequence: Synthetic coding sequence
atgtggagcctgctgctgtgtggcctgagcatcgccctgcccctgtctgtgacagcagatggctgcaaggacatcttcatgaagaatgagatcctgagcgccagccagccctttgccttcaactgcaccttcccccccatcaccagcggggaggtgtctgtgacctggtacaagaacagcagcaagatccctgtgtccaagatcatccagagccgcatccaccaggatgagacctggatcctcttcctgcccatggagtggggagacagcggcgtgtaccagtgtgtgatcaagggccgggacagctgccaccgcatccacgtgaacctgactgtgtttgagaagcactggtgtgacaccagcatcggcggcctgcccaacctgagtgatgagtacaagcagatcctgcacctgggcaaggatgacagcctgacctgccacctgcacttccccaagagctgtgtgctgggccccatcaagtggtacaaggactgcaatgagatcaagggggagaggtag

SEQ ID NO: 156341 - DNA, 1374 bp, Artificial Sequence
  Description of Artificial Sequence: Synthetic coding sequence
atgacaggcctggtgtccctgagctacttccccctgagcaccaggagctgtgccctgcagagctgcagccctgtgtggggctgcggcccctgctgcagcgctggctgccccagccccttccactgcctgagccagcaggactgcaatgagatcaagggggagcgcttcaccgtgctggagacccggctgctggtgtccaatgtgtctgcagaagatcggggcaactatgcctgccaggccatcctgacccacagcggcaagcagtatgaggtgctgaatggcatcaccgtgtccatcaagagagctggctacggcggctctgtgcccaagatcatctaccccaagaaccacagcattgaggtgcagctgggcaccaccctcatcgtggactgcaatgtgacagacaccaaggacaacaccaacctgcgctgctggagggtgaacaacaccctggtggatgactactatgatgagagcaagaggatccgggagggcgtggagacccacgtgtccttccgggagcacaacctgtacacagtgaacatcaccttcctggaggtgaagatggaggactatggcctgcccttcatgtgccacgccggcgtgtccacagcctacatcatcctgcagctgcctgccccagacttccgggcctacctgattggaggcctgattgccctggtggccgtggccgtgtctgtggtgtacatctacaacatcttcaagattgatattgtgctgtggtacagaagtgccttccacagcacagagaccatcgtggatggcaagctgtatgatgcctacgtgctgtaccccaagccccacaaggagagccagagacatgctgtggatgccctggtgctgaacatcctgcctgaggtgctggagcggcagtgtggctacaagctgttcatcttcggcagagatgagttccctggccaggccgtggccaacgtgattgatgaaaatgtgaagctgtgccggcggctgattgtgattgtggtgcctgagagcctgggcttcggcctgctgaagaacctgtctgaggagcagattgctgtgtacagcgccctgatccaggacggcatgaaggtgatcctgattgagctggagaagattgaggactacacagtgatgcctgagagcatccagtacatcaagcagaagcacggggccatccgctggcacggggacttcacagagcagagccagtgcatgaagaccaagttctggaagacagtgcgctaccacatgccaccccggcgctgccggcccttcccccctgtgcagctgctgcagcacaccccctgctacagaacagctggccctgagctgggcagcaggaggaagaagtgcaccctgaccaccggctag

SEQ ID NO: 156342 - DNA, 1728 bp, Artificial Sequence; identical to SEQ ID NO: 156339
  Description of Artificial Sequence: Synthetic coding sequence

SEQ ID NO: 156343 - DNA, 300 bp, Artificial Sequence
  Description of Artificial Sequence: Synthetic coding sequence
atgcagccccgggtgctgctggtggtggccctgctggccctgctggccagcgcccgggccagcgaggccgaggatgccagcctgctgtccttcatgcagggctacatgaagcacgccaccaagacagccaaggatgccctgagctctgtgcaggagagccaggtggcccagcaggcccggggctgggtgacagatggcttcagcagcctgaaggactactggagcacagtgaaggacaagttcagcgagttctgggacctggaccctgaggtgcggcccaccagcgctgtggccgcctag

SEQ ID NO: 156344 - DNA, 1500 bp, Artificial Sequence
  Description of Artificial Sequence: Synthetic coding sequence
atgagcaggacagagctgcccagccccccatctgtgtggtttgaggccgagttcttccaccacatcctgcactggacccccatccccaaccagagcgagagcacctgctatgaggtggccctgctgcgctatggcatcgagagctggaacagcatcagcaactgcagccagaccctgtcctatgacctgacagctgtgaccctggacctgtaccacagcaatggctaccgggcccgggtgcgggctgtggatggcagccgccacagcaactggacagtgaccaacacccgcttctctgtggatgaggtgaccctgactgtgggctctgtgaacctggagatccacaacggcttcatcctgggcaagatccagctgccccggcccaagatggccccagccaatgacacctatgagagcatcttcagccacttccgggagtatgaaattgccatcaggaaggtgcccggcaacttcaccttcacccacaagaaggtgaagcatgagaacttcagcctgctgaccagcggggaggtgggggagttctgtgtgcaggtgaagcccagcgtggccagccgcagcaacaagggcatgtggagcaaggaggagtgcatcagcctgacccggcagtacttcaccgtgaccaacgtcatcatcttctttgcctttgtgctgctgctgagcggggccctggcctactgcctggccctgcagctgtatgtgagaagaaggaagaagctgcccagcgtgctgctcttcaagaagcccagccccttcatcttcatcagccagaggcccagccctgagacccaggacaccatccaccccctggatgaggaggccttcctgaaggtgtccccagagctgaagaacctggacctgcacggcagcacagattctggcttcggcagcaccaagcccagcctgcagacagaggagccccagttcctgctgcctgacccccacccccaggccgacaggaccctgggcaaccgggagccccctgtgctgggggacagctgcagcagcggcagcagcaacagcacagacagcggcatctgcctgcaggagcccagcctgagccccagcacaggccccacctgggagcagcaggtgggcagcaacagccggggccaggatgattctggaattgacctggtgcagaacagcgagggccgggccggggacacccagggcggcagcgccctgggccaccacagccccccagagcctgaggtgcctggagaggaggaccctgctgctgtggccttccagggctacctgcggcagacccgctgtgccgaggagaaggccaccaagacaggctgcctggaggaggagagccccctgacagatggcctgggccccaagtttggccgctgcctggtggatgaagctggcctgcaccccccagccctggccaagggctacctgaagcaggaccccctggagatgaccctggccagcagcggccccaacggcaccgtggagcccgcccactag

SEQ ID NO: 156345 - DNA, 1677 bp, Artificial Sequence
  Description of Artificial Sequence: Synthetic coding sequence
atgagcaggacagagctgcccagccccccatctgtgtggtttgaggccgagttcttccaccacatcctgcactggacccccatccccaaccagagcgagagcacctgctatgaggtggccctgctgcgctatggcatcgagagctggaacagcatcagcaactgcagccagaccctgtcctatgacctgacagctgtgaccctggacctgtaccacagcaatggctaccgggcccgggtgcgggctgtggatggcagccgccacagcaactggacagtgaccaacacccgcttctctgtggatgaggtgaccctgactgtgggctctgtgaacctggagatccacaacggcttcatcctgggcaagatccagctgccccggcccaagatggccccagccaatgacacctatgagagcatcttcagccacttccgggagtatgaaattgccatcaggaaggtgcccggcaacttcaccttcacccacaagaaggtgaagcatgagaacttcagcctgctgaccagcggggaggtgggggagttctgtgtgcaggtgaagcccagcgtggccagccgcagcaacaagggcatgtggagcaaggaggagtgcatcagcctgacccggcagtacttcaccgtgaccaacgtcatcatcttctttgcctttgtgctgctgctgagcggggccctggcctactgcctggccctgcagctgtatgtgagaagaaggaagaagctgcccagcgtgctgctcttcaagaagcccagccccttcatcttcatcagccagaggcccagccctgagacccaggacaccatccaccccctggatgaggaggccttcctgaaggtgtccccagagctgaagaacctggacctgcacggcagcacagattctggcttcggcagcaccaagcccagcctgcagacagaggagccccagttcctgctgcctgacccccacccccaggccgacaggaccctgggcaaccgggagccccctgtgctgggggacagctgcagcagcggcagcagcaacagcacagacagcggcatctgcctgcaggagcccagcctgagccccagcacaggccccacctgggagcagcaggtgggcagcaacagccggggccaggatgattctggaattgacctggtgcagaacagcgagggccgggccggggacacccagggcggcagcgccctgggccaccacagccccccagagcctgaggtgcctggagaggaggaccctgctgctgtggccttccagggctacctgcggcagacccgctgtgccgaggagaaggccaccaagacaggctgcctggaggaggagagccccctgacagatggcctgggccccaagtttggccgctgcctggtggatgaagctggcctgcaccccccagccctggccaagggctacctgaagcaggaccccctggagatgaccctggccagcagcggggcccccaccggccagtggaaccagcccacagaggagtggagcctgctggccctgagcagctgcagcgacctgggcatcagtgactggagctttgcccatgacctggcccccctgggctgtgtggccgcccctgggggcctgctgggcagcttcaacagcgacctggtgaccctgcccctcatcagcagcctgcagagcagcgagtag

SEQ ID NO: 156346 - DNA, 1290 bp, Artificial Sequence
  Description of Artificial Sequence: Synthetic coding sequence
atggccccagccaatgacacctatgagagcatcttcagccacttccgggagtatgagatcgccatcaggaaggtgcccggcaacttcaccttcacccacaagaaggtgaagcatgagaacttcagcctgctgaccagcggggaggtgggggagttctgtgtgcaggtgaagcccagcgtggccagccgcagcaacaagggcatgtggagcaaggaggagtgcatcagcctgacccggcagtacttcaccgtgaccaacgtcatcatcttctttgcctttgtgctgctgctgagcggggccctggcctactgcctggccctgcagctgtatgtgagaagaaggaagaagctgcccagcgtgctgctcttcaagaagcccagccccttcatcttcatcagccagaggcccagccctgagacccaggacaccatccaccccctggatgaggaggccttcctgaaggtgtccccagagctgaagaacctggacctgcacggcagcacagacagcggcttcggcagcaccaagcccagcctgcagacagaggagccccagttcctgctgcctgacccccacccccaggccgacaggaccctgggcaaccgggagccccctgtgctgggggacagctgcagcagcggcagcagcaacagcacagattctggcatctgcctgcaggagcccagcctgagccccagcacaggccccacctgggagcagcaggtgggcagcaacagccggggccaggatgacagcggcatcgacctggtgcagaacagcgagggccgggccggggacacccagggcggcagcgccctgggccaccacagccccccagagcctgaggtgcctggagaagaagatcctgctgctgtggccttccagggctacctgcggcagacccgctgtgccgaggagaaggccaccaagacaggctgcctggaggaggagagccccctgacagatggcctgggccccaagtttggccgctgcctggtggatgaggccggcctgcaccccccagccctggccaagggctacctgaagcaggaccccctggagatgaccctggccagcagcggggcccccaccggccagtggaaccagcccacagaggagtggagcctgctggccctgagcagctgcagcgacctgggcatcagtgactggagctttgcccatgacctggcccccctgggctgtgtggccgcccctgggggcctgctgggcagcttcaacagcgacctggtgaccctgcccctcatcagcagcctgcagagcagcgagtag

SEQ ID NO: 156347 - DNA, 1269 bp, Artificial Sequence
  Description of Artificial Sequence: Synthetic coding sequence
atgagcagcagctgcagcggcctgagccgggtgctggtggccgtggccacagccctggtgtctgccagcagcccctgcccccaggcctggggccccccaggagtgcagtatggccagcccggccgctctgtgaagctgtgctgccctggggtgacagctggggaccctgtgtcctggttcagagatggagagcccaagctgctgcagggcccagattctggcctgggccacgagctggtgctggcccaggccgacagcacagatgagggcacctacatctgccagaccctggatggagccctgggcggcaccgtgaccctgcagctgggctaccccccagcccggcctgtggtgtcctgccaggccgctgactatgagaacttcagctgcacctggagccccagccagatcagcggcctgcccacccgctacctgaccagctacaggaagaagacagtgctgggcgctgacagccagaggaggagccccagcacaggcccctggccctgcccccaggaccccctgggcgccgcccgctgtgtggtgcatggagctgagttctggagccagtaccgcatcaacgtgacagaggtgaaccccctgggcgccagcacccggctgctggatgtgtccctgcagagcatcctgcggccagaccccccccagggcctgcgggtggagagcgtgcccggctacccccggcggctgcgggcctcctggacctacccagcctcctggccctgccagccccacttcctgctgaagttccggctgcagtacagacctgcccagcacccagcctggagcacagtggagcccgccggcctggaggaggtgatcacagatgctgtggccggcctgccccatgctgtgcgggtgtctgcccgggacttcctggatgctggcacctggagcacctggagccctgaggcctggggcacccccagcacaggcaccatccccaaggagatcccagcctggggccagctgcacacccagcctgaggtggagccccaggtggacagccctgccccaccccggcccagcctgcagccccacccccggctgctggaccaccgggacagcgtggagcaggtggccgtgctggccagcctgggcatcctgtccttcctgggcctggtggccggggccctggccctgggcctgtggctgcggctgcggcggggcggcaaggatggcagccccaagccaggcttcctggccagcgtcatccctgtggacagaagacctggggcccccaacctgtag

SEQ ID NO: 156348 - DNA, 1173 bp, Artificial Sequence
  Description of Artificial Sequence: Synthetic coding sequence
atgagcagcagctgcagcggcctgagccgggtgctggtggccgtggccacagccctggtgtctgccagcagcccctgcccccaggcctggggccccccaggagtgcagtatggccagcccggccgctctgtgaagctgtgctgccctggggtgacagctggggaccctgtgtcctggttcagagatggagagcccaagctgctgcagggcccagattctggcctgggccacgagctggtgctggcccaggccgacagcacagatgagggcacctacatctgccagaccctggatggagccctgggcggcaccgtgaccctgcagctgggctaccccccagcccggcctgtggtgtcctgccaggccgctgactatgagaacttcagctgcacctggagccccagccagatcagcggcctgcccacccgctacctgaccagctacaggaagaagacagtgctgggcgctgacagccagaggaggagccccagcacaggcccctggccctgcccccaggaccccctgggcgccgcccgctgtgtggtgcatggagctgagttctggagccagtaccgcatcaacgtgacagaggtgaaccccctgggcgccagcacccggctgctggatgtgtccctgcagagcatcctgcggccagaccccccccagggcctgcgggtggagagcgtgcccggctacccccggcggctgcgggcctcctggacctacccagcctcctggccctgccagccccacttcctgctgaagttccggctgcagtacagacctgcccagcacccagcctggagcacagtggagcccgccggcctggaggaggtgatcacagatgctgtggccggcctgccccatgctgtgcgggtgtctgcccgggacttcctggatgctggcacctggagcacctggagccctgaggcctggggcacccccagcacaggcaccatccccaaggagatcccagcctggggccagctgcacacccagcctgaggtggagccccaggtggacagccctgccccaccccggcccagcctgcagccccacccccggctgctggaccaccgggacagcgtggagcaggtggccgtgctggccagcctgggcatcctgtccttcctgggcctggtggccggggccctggccctgggcctgtggtag

SEQ ID NO: 156349 - DNA, 1269 bp, Artificial Sequence; identical to SEQ ID NO: 156347
  Description of Artificial Sequence: Synthetic coding sequence

SEQ ID NO: 156350 - DNA, 1269 bp, Artificial Sequence; identical to SEQ ID NO: 156347
  Description of Artificial Sequence: Synthetic coding sequence

SEQ ID NO: 156351 - DNA, 813 bp, Artificial Sequence
  Description of Artificial Sequence: Synthetic coding sequence
atgagcagcagctgcagcggcctgagccgggtgctggtggccgtggccacagccctggtgtctgccagcagcccctgcccccaggcctggggccccccaggagtgcagtatggccagcccggccgctctgtgaagctgtgctgccctggggtgacagctggggaccctgtgtcctggttcagagatggagagcccaagctgctgcagggcccagattctggcctgggccacgagctggtgctggcccaggccgacagcacagatgagggcacctacatctgccagaccctggatggagccctgggcggcaccgtgaccctgcagctgggctaccccccagcccggcctgtggtgtcctgccaggccgctgactatgagaacttcagctgcacctggagccccagccagatcagcggcctgcccacccgctacctgaccagctacaggaagaagacagtgctgggcgctgacagccagaggaggagccccagcacaggcccctggccctgcccccaggaccccctgggcgccgcccgctgtgtggtgcatggagctgagttctggagccagtaccgcatcaacgtgacagaggtgaaccccctgggcgccagcacccggctgctggatgtgtccctgcagagcatcctgcggccagaccccccccagggcctgcgggtggagagcgtgcccggctacccccggcggctgcgggcctcctggacctacccagcctcctggccctgccagccccacttcctgctgaagttccggctgcagtacagacctgcccagcacccagcctggagcacctag

SEQ ID NO: 156352 - DNA, 504 bp, Artificial Sequence
  Description of Artificial Sequence: Synthetic coding sequence
atgagcagcagctgcagcggcctgagccgggtgctggtggccgtggccacagccctggtgtctgccagcagcccctgcccccaggcctggggccccccaggagtgcagtatggccagcccggccgctctgtgaagctgtgctgccctggggtgacagctggggaccctgtgtcctggttcagagatggagagcccaagctgctgcagggcccagattctggcctgggccacgagctggtgctggcccaggccgacagcacagatgagggcacctacatctgccagaccctggatggagccctgggcggcaccgtgaccctgcagctgggctaccccccagcccggcctgtggtgtcctgccaggccgctgactatgagaacttcagctgcacctggagccccagccagatcagcggcctgcccacccgctacctgaccagctacaggaagaagacagtgctgggcgctgacagccagaggaggagccccagcacaggcccctag

SEQ ID NO: 156353 - DNA, 420 bp, Artificial Sequence
  Description of Artificial Sequence: Synthetic coding sequence
atgagcagcagctgcagcggcctgagccgggtgctggtggccgtggccacagccctggtgtctgccagcagcccctgcccccaggcctggggccccccaggagtgcagtatggccagcccggccgctctgtgaagctgtgctgccctggggtgacagctggggaccctgtgtcctggttcagagatggagagcccaagctgctgcagggcccagattctggcctgggccacgagctggtgctggcccaggccgacagcacagatgagggcacctacatctgccagaccctggatggagccctgggcggcaccgtgaccctgcagctgggctaccccccagcccggcctgtggtgtcctgccaggccgctgactatgagaacttcagctgcacctggagccccagccagatcagcggctag

SEQ ID NO: 156354 - DNA, 1989 bp, Artificial Sequence
  Description of Artificial Sequence: Synthetic coding sequence
atggagcccctggtgacctgggtggtgcccctgctcttcctgttcctgctgagccggcagggcgccgcctgcaggaccagcgagtgctgcttccaggaccccccctacccagatgctgacagcggcagcgccagcggcccccgggacctgcgctgctaccgcatcagcagtgacagatatgaatgttcctggcagtatgagggccccacagctggggtgagccacttcctgcgctgctgcctgagcagcggccgctgctgctactttgctgctggcagcgccacccggctgcagttcagtgaccaggccggcgtgtctgtgctgtacacagtgaccctgtgggtggagagctgggccaggaaccagacagagaagagccctgaggtgaccctgcagctgtacaacagcgtgaagtatgagccccccctgggggacatcaaggtgtccaagctggccggccagctgaggatggagtgggagaccccagacaaccaggtgggcgctgaggtgcagttccgccacaggacccccagcagcccctggaagctgggggactgtggcccccaggatgatgacacagagagctgcctgtgccccctggagatgaatgtggcccaggagttccagctgcggcggcggcagctgggcagccagggcagctcctggagcaagtggagcagccctgtgtgtgtgcccccagagaaccccccccagccccaggtgcgcttctctgtggagcagctgggccaggatggaagaagaaggctgaccctgaaggagcagcccacccagctggagctgcctgagggctgccagggcctggcccctggaacagaggtgacctaccgcctgcagctgcacatgctgagctgcccctgcaaggccaaggccaccaggaccctgcacctgggcaagatgccctacctgagcggggccgcctacaacgtggccgtcatcagcagcaaccagtttggacctggcctgaaccagacctggcacatcccagctgacacccacacagagcctgtggccctgaacatctctgtgggcaccaacggcaccaccatgtactggccagcccgggcccagagcatgacctactgcatcgagtggcagcctgtgggccaggacggcggcctggccacctgcagcctgacagccccccaggaccctgaccctgctggcatggccacctacagctggagccgggagagcggggccatgggccaggagaagtgctactacatcaccatctttgccagcgcccaccctgagaagctgaccctgtggagcacagtgctgagcacctaccactttggaggaaatgccagcgctgctggcaccccccaccacgtgtctgtgaagaaccacagcctggacagcgtgtctgtggactgggcccccagcctgctgagcacctgccctggggtgctgaaggagtatgtggtgcgctgcagagatgaggacagcaagcaggtgtctgagcaccctgtgcagcccacagagacccaggtgaccctgagcggcctgcgggccggcgtggcctacacagtgcaggtgcgggctgacacagcctggctgcggggcgtgtggagccagccccagcgcttcagcattgaggtgcaggtgtctgactggctgatcttctttgccagcctgggcagcttcctgagcatcctgctggtgggcgtgctgggctacctgggcctgaacagagctgcccggcacctgtgcccccccctgcccaccccctgtgccagcagcgccatcgagttccctgggggcaaggagacctggcagtggatcaaccctgtggacttccaggaggaggccagcctgcaggaggccctggtggtggagatgtcctgggacaagggggagaggacagagcccctggagaagacagagctgcctgagggcgcccctgagctggccctggacacagagctgagcctggaggatggagaccgctgcaaggccaagatgtag

SEQ ID NO: 156355 - DNA, 1146 bp, Artificial Sequence
  Description of Artificial Sequence: Synthetic coding sequence
atggagcccctggtgacctgggtggtgcccctgctcttcctgttcctgctgagccggcagggcgccgcctgcaggaccagcgagtgctgcttccaggaccccccctacccagatgctgacagcggcagcgccagcggcccccgggacctgcgctgctaccgcatcagcagtgacagatatgaatgttcctggcagtatgagggccccacagctggggtgagccacttcctgcgctgctgcctgagcagcggccgctgctgctactttgctgctggcagcgccacccggctgcagttcagtgaccaggccggcgtgtctgtgctgtacacagtgaccctgtgggtggagagctgggccaggaaccagacagagaagagccctgaggtgaccctgcagctgtacaacagcgtgaagtatgagccccccctgggggacatcaaggtgtccaagctggccggccagctgaggatggagtgggagaccccagacaaccaggtgggcgctgaggtgcagttccgccacaggacccccagcagcccctggaagctgggggactgtggcccccaggatgatgacacagagagctgcctgtgccccctggagatgaatgtggcccaggagttccagctgcggcggcggcagctgggcagccagggcagctcctggagcaagtggagcagccctgtgtgtgtgcccccagagaaccccccccagccccaggtgcgcttctctgtggagcagctgggccaggatggaagaagaaggctgaccctgaaggagcagcccacccagctggagctgcctgagggctgccagggcctggcccctggaacagaggtgacctaccgcctgcagctgcacatgctgagctgcccctgcaaggccaaggccaccaggaccctgcacctgggcaagatgccctacctgagcggggccgcctacaacgtggccgtcatcagcagcaaccagtttggacctggcctgaaccagacctggcacatcccagctgacacccacacagatggcatgatcagcgcccactgcaacctgcggctgcctgacagccgggacagccctgccagcgccagccgggtggccggcatcaccggcatctgccaccacaccaggctcatcctgtacttctag

SEQ ID NO: 156356 - DNA, 1989 bp, Artificial Sequence; identical to SEQ ID NO: 156354
  Description of Artificial Sequence: Synthetic coding sequence

SEQ ID NO: 156357 - DNA, 2589 bp, Artificial Sequence
  Description of Artificial Sequence: Synthetic coding sequence
atggcccacaccttccggggctgcagcctggccttcatgttcatcatcacctggctgctgatcaaggccaagattgatgcctgcaagagaggagatgtgacagtgaagcccagccacgtgatcctgctgggcagcacagtgaacatcacctgcagcctgaagccccggcagggctgcttccactacagcagaagaaacaagctgatcctgtacaagtttgaccggcgcatcaacttccaccacggccacagcctgaacagccaggtgacaggcctgcccctgggcaccaccctgtttgtgtgcaagctggcctgcatcaacagtgatgagatccagatctgtggggctgagatctttgtgggcgtggcccctgagcagccccagaacctgagctgcatccagaagggggagcagggcaccgtggcctgcacctgggagcggggccgggacacccacctgtacacagagtacaccctgcagctgagcggccccaagaacctgacctggcagaagcagtgcaaggacatctactgtgactacctggactttggcatcaacctgaccccagagagccctgagagcaacttcaccgccaaggtgacagctgtgaacagcctgggcagcagcagcagcctgcccagcaccttcaccttcctggacatcgtgcggcccctgcccccctgggacatccgcatcaagttccagaaggcctctgtgagccgctgcaccctgtactggagagatgagggcctggtgctgctgaaccggctgcgctaccggcccagcaacagccggctgtggaacatggtgaatgtgaccaaggccaagggcagacatgacctgctggacctgaagcccttcacagaatatgagttccagatcagcagcaagctgcacctgtacaagggctcctggagcgactggagcgagagcctgcgggcccagaccccagaggaggagcccaccggcatgctggatgtgtggtacatgaagaggcacatcgactacagccggcagcagatcagcctcttctggaagaacctgtctgtgtctgaggcccggggcaagatcctgcactaccaggtgaccctgcaggagctgaccggcggcaaggccatgacccagaacatcaccggccacacctcctggaccaccgtcatccccaggacaggcaactgggccgtggccgtgtctgctgccaacagcaagggcagcagcctgcccacccgcatcaacatcatgaacctgtgtgaggccggcctgctggccccccggcaggtgtctgccaacagcgagggcatggacaacatcctggtgacctggcagccccccaggaaggaccccagcgctgtgcaggagtatgtggtggagtggagggagctgcaccctggaggagacacccaggtgcccctgaactggctgcggagccggccctacaacgtgtctgccctgatcagcgagaacatcaagagctacatctgctatgagatccgggtgtatgccctgagcggggaccagggcggctgcagcagcatcctgggcaacagcaagcacaaggcccccctgagcggcccccacatcaatgccatcacagaggagaagggcagcatcctgatctcctggaacagcatccctgtgcaggagcagatgggctgcctgctgcactaccgcatctactggaaggagcgggacagcaacagccagccccagctgtgtgagatcccctacagagtgtcccagaacagccaccccatcaacagcctgcagccccgggtgacctacgtgctgtggatgacagccctgacagctgctggggagagcagccatggaaatgaaagagagttctgcctgcagggcaaggccaactggatggcctttgtggcccccagcatctgcatcgccatcatcatggtgggcatcttcagcacccactacttccagcagaaggtgtttgtgctgctggccgccctgcggccccagtggtgcagccgggagatcccagaccctgccaacagcacctgtgccaagaagtaccccatcgccgaggagaagacccagctgcccctggaccggctgctgattgactggcccaccccagaggaccctgagcccctggtgatcagcgaggtgctgcaccaggtgacccctgtgttccgccaccccccctgcagcaactggccccagcgggagaagggcatccagggccaccaggccagcgagaaggacatgatgcacagcgccagcagccccccaccaccccgggccctgcaggccgagagccggcagctggtggacctgtacaaggtgctggagagccggggcagtgaccccaagccagagaacccagcctgcccctggacagtgctgcctgctggggacctgcccacccatgatggctacctgcccagcaacattgatgacctgcccagccatgaggcccccctggccgacagcctggaggagctggagccccagcacatcagcctgagcgtcttccccagcagcagcctgcaccccctgaccttcagctgtggggacaagctgaccctggaccagctgaagatgagatgtgacagcctgatgctgtag

SEQ ID NO: 156358 - DNA, 1980 bp, Artificial Sequence
  Description of Artificial Sequence: Synthetic coding sequence
atggcccacaccttccggggctgcagcctggccttcatgttcatcatcacctggctgctgatcaaggccaagattgatgcctgcaagagaggagatgtgacagtgaagcccagccacgtgatcctgctgggcagcacagtgaacatcacctgcagcctgaagccccggcagggctgcttccactacagcagaagaaacaagctgatcctgtacaagtttgaccggcgcatcaacttccaccacggccacagcctgaacagccaggtgacaggcctgcccctgggcaccaccctgtttgtgtgcaagctggcctgcatcaacagtgatgagatccagatctgtggggctgagatctttgtgggcgtggcccctgagcagccccagaacctgagctgcatccagaagggggagcagggcaccgtggcctgcacctgggagcggggccgggacacccacctgtacacagagtacaccctgcagctgagcggccccaagaacctgacctggcagaagcagtgcaaggacatctactgtgactacctggactttggcatcaacctgaccccagagagccctgagagcaacttcaccgccaaggtgacagctgtgaacagcctgggcagcagcagcagcctgcccagcaccttcaccttcctggacatcgtgcggcccctgcccccctgggacatccgcatcaagttccagaaggcctctgtgagccgctgcaccctgtactggagagatgagggcctggtgctgctgaaccggctgcgctaccggcccagcaacagccggctgtggaacatggtgaatgtgaccaaggccaagggcagacatgacctgctggacctgaagcccttcacagaatatgagttccagatcagcagcaagctgcacctgtacaagggctcctggagcgactggagcgagagcctgcgggcccagaccccagaggaggagcccaccggcatgctggatgtgtggtacatgaagaggcacatcgactacagccggcagcagatcagcctcttctggaagaacctgtctgtgtctgaggcccggggcaagatcctgcactaccaggtgaccctgcaggagctgaccggcggcaaggccatgacccagaacatcaccggccacacctcctggaccaccgtcatccccaggacaggcaactgggccgtggccgtgtctgctgccaacagcaagggcagcagcctgcccacccgcatcaacatcatgaacctgtgtgaggccggcctgctggccccccggcaggtgtctgccaacagcgagggcatggacaacatcctggtgacctggcagccccccaggaaggaccccagcgctgtgcaggagtatgtggtggagtggagggagctgcaccctggaggagacacccaggtgcccctgaactggctgcggagccggccctacaacgtgtctgccctgatcagcgagaacatcaagagctacatctgctatgagatccgggtgtatgccctgagcggggaccagggcggctgcagcagcatcctgggcaacagcaagcacaaggcccccctgagcggcccccacatcaatgccatcacagaggagaagggcagcatcctgatctcctggaacagcatccctgtgcaggagcagatgggctgcctgctgcactaccgcatctactggaaggagcgggacagcaacagccagccccagctgtgtgagatcccctacagagtgtcccagaacagccaccccatcaacagcctgcagccccgggtgacctacgtgctgtggatgacagccctgacagctgctggggagagcagccatggaaatgaaagagagttctgcctgcagggcaaggccaactggatggcctttgtggcccccagcatctgcatcgccatcatcatggtgggcatcttcagcacccactacttccagcagaagaggaggcacagctgcccctggacaggcagctag

SEQ ID NO: 156359 - DNA, 693 bp, Artificial Sequence
  Description of Artificial Sequence: Synthetic coding sequence
tgacagaagggggagcagggcaccgtggcctgcacctgggagcggggccgggacacccacctgtacacagagtacaccctgcagctgagcggccccaagaacctgacctggcagaagcagtgcaaggacatctactgtgactacctggactttggcatcaacctgaccccagagagccctgagagcaacttcaccgccaaggtgacagctgtgaacagcctgggcagcagcagcagcctgcccagcaccttcaccttcctggacatcgtgcggcccctgcccccctgggacatccgcatcaagttccagaaggcctctgtgagccgctgcaccctgtactggagagatgagggcctggtgctgctgaaccggctgcgctaccggcccagcaacagccggctgtggaacatggtgaatgtgaccaaggccaagggcagacatgacctgctggacctgaagcccttcacagaatatgagttccagatcagcagcaagctgcacctgtacaagggctcctggagcgactggagcgagagcctgcgggcccagaccccagaggaggagcccaccggcatgctggatgtgtggtacatgaagaggcacatcgactacagccggcagcagatcagcctcttctggaaggtgtccttcaagaggcagctgaagacccagggcaacaagacagagggctag

SEQ ID NO: 156360 - DNA, 1980 bp, Artificial Sequence; identical to SEQ ID NO: 156358
  Description of Artificial Sequence: Synthetic coding sequence

SEQ ID NO: 156361 - DNA, 2331 bp, Artificial Sequence
  Description of Artificial Sequence: Synthetic coding sequence
atggcccacaccttccggggctgcagcctggccttcatgttcatcatcacctggctgctgatcaaggccaagattgatgcctgcaagagaggagatgtgacagtgaagcccagccacgtgatcctgctgggcagcacagtgaacatcacctgcagcctgaagccccggcagggctgcttccactacagcagaagaaacaagctgatcctgtacaagtttgaccggcgcatcaacttccaccacggccacagcctgaacagccaggtgacaggcctgcccctgggcaccaccctgtttgtgtgcaagctggcctgcatcaacagtgatgagatccagatctgtggggctgagatctttgtgggcgtggcccctgagcagccccagaacctgagctgcatccagaagggggagcagggcaccgtggcctgcacctgggagcggggccgggacacccacctgtacacagagtacaccctgcagctgagcggccccaagaacctgacctggcagaagcagtgcaaggacatctactgtgactacctggactttggcatcaacctgaccccagagagccctgagagcaacttcaccgccaaggtgacagctgtgaacagcctgggcagcagcagcagcctgcccagcaccttcaccttcctggacatcgtgcggcccctgcccccctgggacatccgcatcaagttccagaaggcctctgtgagccgctgcaccctgtactggagagatgagggcctggtgctgctgaaccggctgcgctaccggcccagcaacagccggctgtggaacatggtgaatgtgaccaaggccaagggcagacatgacctgctggacctgaagcccttcacagaatatgagttccagatcagcagcaagctgcacctgtacaagggctcctggagcgactggagcgagagcctgcgggcccagaccccagaggaggagcccaccggcatgctggatgtgtggtacatgaagaggcacatcgactacagccggcagcagatcagcctcttctggaagaacctgtctgtgtctgaggcccggggcaagatcctgcactaccaggtgaccctgcaggagctgaccggcggcaaggccatgacccagaacatcaccggccacacctcctggaccaccgtcatccccaggacaggcaactgggccgtggccgtgtctgctgccaacagcaagggcagcagcctgcccacccgcatcaacatcatgaacctgtgtgaggccggcctgctggccccccggcaggtgtctgccaacagcgagggcatggacaacatcctggtgacctggcagccccccaggaaggaccccagcgctgtgcaggagtatgtggtggagtggagggagctgcaccctggaggagacacccaggtgcccctgaactggctgcggagccggccctacaacgtgtctgccctgatcagcgagatcccctacagagtgtcccagaacagccaccccatcaacagcctgcagccccgggtgacctacgtgctgtggatgacagccctgacagctgctggggagagcagccatggaaatgaaagagagttctgcctgcagggcaaggccaactggatggcctttgtggcccccagcatctgcatcgccatcatcatggtgggcatcttcagcacccactacttccagcagaaggtgtttgtgctgctggccgccctgcggccccagtggtgcagccgggagatcccagaccctgccaacagcacctgtgccaagaagtaccccatcgccgaggagaagacccagctgcccctggaccggctgctgattgactggcccaccccagaggaccctgagcccctggtgatcagcgaggtgctgcaccaggtgacccctgtgttccgccaccccccctgcagcaactggccccagcgggagaagggcatccagggccaccaggccagcgagaaggacatgatgcacagcgccagcagccccccaccaccccgggccctgcaggccgagagccggcagctggtggacctgtacaaggtgctggagagccggggcagtgaccccaagccagagaacccagcctgcccctggacagtgctgcctgctggggacctgcccacccatgatggctacctgcccagcaacattgatgacctgcccagccatgaggcccccctggccgacagcctggaggagctggagccccagcacatcagcctgagcgtcttccccagcagcagcctgcaccccctgaccttcagctgtggggacaagctgaccctggaccagctgaagatgagatgtgacagcctgatgctgtag

SEQ ID NO: 156362 - DNA, 681 bp, Artificial Sequence
  Description of Artificial Sequence: Synthetic coding sequence
atgagcagccccacagccagcagcaccaccccccgctgtggcaccagcgctggccctgccagccccacctggcgctgccgggccacagccctgcacctgcaccaccctgtggaccagctgccccaccaggtgctgcagcccaccaccggccagaggcagcccggcaccggcctgccctggcacagcaccccagcccagctggccctggccggcctgcggcaggcccagccccacccccagcagcagaggctgcaccagcccggcctgcggggcgtggatgcccacggcagcgctgcccacgtgccccaggccgtgccccaggccgtgcgggcccaccccccaggccagctgctgtcctgggccgctgctgtgtgcctgctgtgccagcaccacctgcagctgcccgggaagaagaggaacagcaccctgtacatcaccatgctgctgattgtgcctgtgattgtggccggggccatcatcgtgctgctgctgtacctgaagaggctgaagatcatcatcttcccccccatcccagaccccgggaagatcttcaaggagatgtttggagaccagaatgatgacaccctgcactggaagaagtatgacatctatgagaagcagaccaaggaggagacagacagcgtggtgctgattgagaacctgaagaaggccagccagtag

SEQ ID NO: 156363 - DNA, 840 bp, Artificial Sequence
  Description of Artificial Sequence: Synthetic coding sequence
atggagtggccagcccggctgtgtggcctgtgggccctgctgctgtgtgccggcggcggcggcggcggcggcggggccgcccccacagagacccagccccctgtgaccaacctgtctgtgtctgtggagaacctgtgcaccgtcatctggacctggaaccccccagagggcgccagcagcaactgcagcctgtggtacttcagccactttggagacaagcaggacaagaagatcgcccctgagaccaggaggagcattgaggtgcccctgaatgaaagaatctgcctgcaggtgggcagccagtgcagcaccaatgaaagtgagaagcccagcatcctggtggagaagtgcatcagccccccagagggggaccctgagagcgctgtgacagagctgcagtgcatctggcacaacctgagctacatgaagtgctcctggctgcccggcaggaacaccagcccagacaccaactacaccctgtactactggcacaggagcctggagaagatccaccagtgtgagaacatcttccgggagggccagtacttcggctgcagctttgacctgaccaaggtgaaggacagcagctttgagcagcacagcgtgcagatcatggtgaaggacaatgctgggaagatcaagcccagcttcaacatcgtgcccctgaccagccgggtgaagccagaccccccccacatcaagaacctgtccttccacaatgatgacctgtatgtgcagtgggagaacccccagaacttcatcagccgctgcctcttctatgaggtggaggtgaacaacagccagacagagacccacaacgtgttctacgtgcgcttctag

SEQ ID NO: 156364 - DNA, 1284 bp, Artificial Sequence
  Description of Artificial Sequence: Synthetic coding sequence
atggagtggccagcccggctgtgtggcctgtgggccctgctgctgtgtgccggcggcggcggcggcggcggcggggccgcccccacagagacccagccccctgtgaccaacctgtctgtgtctgtggagaacctgtgcaccgtcatctggacctggaaccccccagagggcgccagcagcaactgcagcctgtggtacttcagccactttggagacaagcaggacaagaagatcgcccctgagaccaggaggagcattgaggtgcccctgaatgaaagaatctgcctgcaggtgggcagccagtgcagcaccaatgaaagtgagaagcccagcatcctggtggagaagtgcatcagccccccagagggggaccctgagagcgctgtgacagagctgcagtgcatctggcacaacctgagctacatgaagtgctcctggctgcccggcaggaacaccagcccagacaccaactacaccctgtactactggcacaggagcctggagaagatccaccagtgtgagaacatcttccgggagggccagtacttcggctgcagctttgacctgaccaaggtgaaggacagcagctttgagcagcacagcgtgcagatcatggtgaaggacaatgctgggaagatcaagcccagcttcaacatcgtgcccctgaccagccgggtgaagccagaccccccccacatcaagaacctgtccttccacaatgatgacctgtatgtgcagtgggagaacccccagaacttcatcagccgctgcctcttctatgaggtggaggtgaacaacagccagacagagacccacaacgtgttctacgtgcaggaggccaagtgtgaaaatcctgagtttgaaagaaatgtggagaacaccagctgcttcatggtgcctggggtgctgcctgacaccctgaacacagtgcgcatccgggtgaagaccaacaagctgtgctatgaagatgacaagctgtggagcaactggagccaggagatgagcatcggcaagaagaggaacagcaccctgtacatcaccatgctgctgattgtgcctgtgattgtggccggggccatcatcgtgctgctgctgtacctgaagaggctgaagatcatcatcttcccccccatcccagaccccgggaagatcttcaaggagatgtttggagaccagaatgatgacaccctgcactggaagaagtatgacatctatgagaagcagaccaaggaggagacagattctgtggtgctgattgagaacctgaagaaggccagccagtag

SEQ ID NO: 156365 - DNA, 1143 bp, Artificial Sequence
  Description of Artificial Sequence: Synthetic coding sequence
atggcctttgtgtgcctggccatcggctgcctgtacaccttcctgatcagcaccaccttcggctgcaccagcagcagtgacacagagatcaaggtgaaccccccccaggactttgagatcgtggaccccggctacctgggctacctgtacctgcagtggcagccccccctgagcctggaccacttcaaggagtgcaccgtggagtatgagctgaagtacagaaacatcggcagcgagacctggaagaccatcatcaccaagaacctgcactacaaggatggctttgacctgaacaagggcatcgaggccaagatccacaccctgctgccctggcagtgcaccaatggaagtgaggtgcagagctcctgggccgagaccacctactggatcagcccccagggcatccctgagaccaaggtgcaggacatggactgtgtgtactacaactggcagtacctgctgtgctcctggaagccaggcattggagtgctgctggacaccaactacaacctcttctactggtatgagggcctggaccacgccctgcagtgtgtggactacatcaaggcagatggccagaacatcggctgccgcttcccctacctggaggccagtgactacaaggacttctacatctgtgtgaatggcagcagcgagaacaagcccatccgcagcagctacttcaccttccagctgcagaacatcgtgaagcccctgccccctgtgtacctgaccttcacccgggagagcagctgtgagatcaagctgaagtggagcatccccctgggccccatcccagcccgctgctttgattatgaaattgagatccgggaggatgacaccaccctggtgacagccaccgtggagaatgagacctacaccctgaagaccaccaatgagacccggcagctgtgctttgtggtgcgcagcaaggtgaacatctactgcagtgatgatggcatctggagcgagtggagcgacaagcagtgctgggagggggaggacctgagcaagaagaccctgctgcgcttctggctgcccttcggcttcatcctgatcctggtgatctttgtgacaggcctgctgctgaggaagcccaacacctaccccaagatgatccctgagttcttctgtgacacctag

SEQ ID NO: 156366 - DNA, 1143 bp, Artificial Sequence; identical to SEQ ID NO: 156365
  Description of Artificial Sequence: Synthetic coding sequence

SEQ ID NO: 156367 - DNA, 465 bp, Artificial Sequence
  Description of Artificial Sequence: Synthetic coding sequence
atggccccccggcgggcccggggctgcaggaccctgggcctgcctgccctgctgctgctgctgctgctgcggcccccagccacccgggagcctgctgccagcagccccagcagcaacaacacagctgccaccacagctgccatcgtgcccggcagccagctgatgcccagcaagagccccagcacaggcaccacagagatcagcagccatgagagcagccacggcacccccagccagaccacagccaagaactgggagctgacagccagcgccagccaccagcccccaggagtgtacccccagggccacagcgacaccaccgtggccatcagcaccagcacagtgctgctgtgtggcctgtctgctgtgtccctgctggcctgctacctgaagagccgggcctctgtgtgcagctgccaccccaggtctgctggccacacctgcagcgtgggctctgtgtgctag

SEQ ID NO: 156368 - DNA, 804 bp, Artificial Sequence
  Description of Artificial Sequence: Synthetic coding sequence
atggccccccggcgggcccggggctgcaggaccctgggcctgcctgccctgctgctgctgctgctgctgcggcccccagccacccggggcatcacctgccccccacccatgtctgtggagcacgccgacatctgggtgaagagctacagcctgtacagccgggagcgctacatctgcaacagcggcttcaagaggaaggccggcaccagcagcctgacagaatgtgtgctgaacaaggccaccaacgtggcccactggaccacccccagcctgaagtgcatccgggaccctgccctggtgcaccagaggcctgccccacccagcacagtgaccacagctggggtgaccccccagcctgagagcctgagccccagcggcaaggagcctgctgccagcagccccagcagcaacaacacagctgccaccacagctgccatcgtgcccggcagccagctgatgcccagcaagagccccagcacaggcaccacagagatcagcagccatgagagcagccacggcacccccagccagaccacagccaagaactgggagctgacagccagcgccagccaccagcccccaggagtgtacccccagggccacagcgacaccaccgtggccatcagcaccagcacagtgctgctgtgtggcctgtctgctgtgtccctgctggcctgctacctgaagagccggcagaccccacccctggcctctgtggagatggaggccatggaggccctgcctgtgacctggggcaccagcagcagagatgaggacctggagaactgcagccaccacctgtag

SEQ ID NO: 156369 - DNA, 612 bp, Artificial Sequence
  Description of Artificial Sequence: Synthetic coding sequence
atgtctgtggagcacgccgacatctgggtgaagagctacagcctgtacagccgggagcgctacatctgcaacagcggcttcaagaggaaggccggcaccagcagcctgacagaatgtgtgctgaacaaggccaccaacgtggcccactggaccacccccagcctgaagtgcatccgggaccctgccctggtgcaccagaggcctgccccacccagcacagtgaccacagctggggtgaccccccagcctgagagcctgagccccagcggcaaggagcctgctgccagcagccccagcagcaacaacacagctgccaccacagctgccatcgtgcccggcagccagctgatgcccagcaagagccccagcacaggcaccacagagatcagcagccatgagagcagccacggcacccccagccagaccacagccaagaactgggagctgacagccagcgccagccaccagcccccaggagtgtacccccagggccacagcgacaccaccgtggccatcagcaccagcacagtgctgctgtgtggcctgtctgctgtgtccctgctggcctgctacctgaagagcagtggagctgtgctgagctacagcggctag

SEQ ID NO: 156370 - DNA, 696 bp, Artificial Sequence
  Description of Artificial Sequence: Synthetic coding sequence
atgtctgtggagcacgccgacatctgggtgaagagctacagcctgtacagccgggagcgctacatctgcaacagcggcttcaagaggaaggccggcaccagcagcctgacagaatgtgtgctgaacaaggccaccaacgtggcccactggaccacccccagcctgaagtgcatccgggaccctgccctggtgcaccagaggcctgccccacccagcacagtgaccacagctggggtgaccccccagcctgagagcctgagccccagcggcaaggagcctgctgccagcagccccagcagcaacaacacagctgccaccacagctgccatcgtgcccggcagccagctgatgcccagcaagagccccagcacaggcaccacagagatcagcagccatgagagcagccacggcacccccagccagaccacagccaagaactgggagctgacagccagcgccagccaccagcccccaggagtgtacccccagggccacagcgacaccaccgtggccatcagcaccagcacagtgctgctgtgtggcctgtctgctgtgtccctgctggcctgctacctgaagagccggcagaccccacccctggcctctgtggagatggaggccatggaggccctgcctgtgacctggggcaccagcagcagagatgaggacctggagaactgcagccaccacctgtag

SEQ ID NO: 156371 - DNA, 510 bp, Artificial Sequence
  Description of Artificial Sequence: Synthetic coding sequence
atggccccccggcgggcccggggctgcaggaccctgggcctgcctgccctgctgctgctgctgctgctgcggcccccagccacccgggagcctgctgccagcagccccagcagcaacaacacagctgccaccacagctgccatcgtgcccggcagccagctgatgcccagcaagagccccagcacaggcaccacagagatcagcagccatgagagcagccacggcacccccagccagaccacagccaagaactgggagctgacagccagcgccagccaccagcccccaggagtgtacccccagggccacagcgacaccaccgtggccatcagcaccagcacagtgctgctgtgtggcctgtctgctgtgtccctgctggcctgctacctgaagagccggcagaccccacccctggcctctgtggagatggaggccatggaggccctgcctgtgacctggggcaccagcagcagagatgaggacctggagaactgcagccaccacctgtag

SEQ ID NO: 156372 - DNA, 609 bp, Artificial Sequence
  Description of Artificial Sequence: Synthetic coding sequence
atggccccccggcgggcccggggctgcaggaccctgggcctgcctgccctgctgctgctgctgctgctgcggcccccagccaccaggggggaccctgccctggtgcaccagaggcctgccccacccagcacagtgaccacagctggggtgaccccccagcctgagagcctgagccccagcggcaaggagcctgctgccagcagccccagcagcaacaacacagctgccaccacagctgccatcgtgcccggcagccagctgatgcccagcaagagccccagcacaggcaccacagagatcagcagccatgagagcagccacggcacccccagccagaccacagccaagaactgggagctgacagccagcgccagccaccagcccccaggagtgtacccccagggccacagcgacaccaccgtggccatcagcaccagcacagtgctgctgtgtggcctgtctgctgtgtccctgctggcctgctacctgaagagccggcagaccccacccctggcctctgtggagatggaggccatggaggccctgcctgtgacctggggcaccagcagcagagatgaggacctggagaactgcagccaccacctgtag

SEQ ID NO: 156373 - DNA, 759 bp, Artificial Sequence
  Description of Artificial Sequence: Synthetic coding sequence
atggccccccggcgggcccggggctgcaggaccctgggcctgcctgccctgctgctgctgctgctgctgcggcccccagccacccggggcatcacctgccccccacccatgtctgtggagcacgccgacatctgggtgaagagctacagcctgtacagccgggagcgctacatctgcaacagcggcttcaagaggaaggccggcaccagcagcctgacagaatgtgtgctgaacaaggccaccaacgtggcccactggaccacccccagcctgaagtgcatccgggaccctgccctggtgcaccagaggcctgccccacccagcacagtgaccacagctggggtgaccccccagcctgagagcctgagccccagcggcaaggagcctgctgccagcagccccagcagcaacaacacagctgccaccacagctgccatcgtgcccggcagccagctgatgcccagcaagagccccagcacaggcaccacagagatcagcagccatgagagcagccacggcacccccagccagaccacagccaagaactgggagctgacagccagcgccagccaccagcccccaggagtgtacccccagggccacagcgacaccaccgtggccatcagcaccagcacagtgctgctgtgtggcctgtctgctgtgtccctgctggcctgctacctgaagagccgggcctctgtgtgcagctgccaccccaggtctgctggccacacctgcagcgtgggctctgtgtgctag

SEQ ID NO: 156374 - DNA, 564 bp, Artificial Sequence
  Description of Artificial Sequence: Synthetic coding sequence
atggccccccggcgggcccggggctgcaggaccctgggcctgcctgccctgctgctgctgctgctgctgcggcccccagccaccaggggggaccctgccctggtgcaccagaggcctgccccacccagcacagtgaccacagctggggtgaccccccagcctgagagcctgagccccagcggcaaggagcctgctgccagcagccccagcagcaacaacacagctgccaccacagctgccatcgtgcccggcagccagctgatgcccagcaagagccccagcacaggcaccacagagatcagcagccatgagagcagccacggcacccccagccagaccacagccaagaactgggagctgacagccagcgccagccaccagcccccaggagtgtacccccagggccacagcgacaccaccgtggccatcagcaccagcacagtgctgctgtgtggcctgtctgctgtgtccctgctggcctgctacctgaagagccgggcctctgtgtgcagctgccaccccaggtctgctggccacacctgcagcgtgggctctgtgtgctag

SEQ ID NO: 156375 - DNA, 705 bp, Artificial Sequence
  Description of Artificial Sequence: Synthetic coding sequence
atggccccccggcgggcccggggctgcaggaccctgggcctgcctgccctgctgctgctgctgctgctgcggcccccagccacccggggcatcacctgccccccacccatgtctgtggagcacgccgacatctgggtgaagagctacagcctgtacagccgggagcgctacatctgcaacagcggcttcaagaggaaggccggcaccagcagcctgacagaatgtgtgctgaacaaggccaccaacgtggcccactggaccacccccagcctgaagtgcatcaagccagctgccagcagccccagcagcaacaacacagctgccaccacagctgccatcgtgcccggcagccagctgatgcccagcaagagccccagcacaggcaccacagagatcagcagccatgagagcagccacggcacccccagccagaccacagccaagaactgggagctgacagccagcgccagccaccagcccccaggagtgtacccccagggccacagcgacaccaccgtggccatcagcaccagcacagtgctgctgtgtggcctgtctgctgtgtccctgctggcctgctacctgaagagccggcagaccccacccctggcctctgtggagatggaggccatggaggccctgcctgtgacctggggcaccagcagcagagatgaggacctggagaactgcagccaccacctgtag

SEQ ID NO: 156376 - DNA, 660 bp, Artificial Sequence
  Description of Artificial Sequence: Synthetic coding sequence
atggccccccggcgggcccggggctgcaggaccctgggcctgcctgccctgctgctgctgctgctgctgcggcccccagccacccggggcatcacctgccccccacccatgtctgtggagcacgccgacatctgggtgaagagctacagcctgtacagccgggagcgctacatctgcaacagcggcttcaagaggaaggccggcaccagcagcctgacagaatgtgtgctgaacaaggccaccaacgtggcccactggaccacccccagcctgaagtgcatcaagccagctgccagcagccccagcagcaacaacacagctgccaccacagctgccatcgtgcccggcagccagctgatgcccagcaagagccccagcacaggcaccacagagatcagcagccatgagagcagccacggcacccccagccagaccacagccaagaactgggagctgacagccagcgccagccaccagcccccaggagtgtacccccagggccacagcgacaccaccgtggccatcagcaccagcacagtgctgctgtgtggcctgtctgctgtgtccctgctggcctgctacctgaagagccgggcctctgtgtgcagctgccaccccaggtctgctggccacacctgcagcgtgggctctgtgtgctag

SEQ ID NO: 156377 - DNA, 2601 bp, Artificial Sequence
  Description of Artificial Sequence: Synthetic coding sequence
atgggcgccgcccggagccccccatctgctgtgcccggccccctgctgggcctgctgctgctgctgctgggcgtgctggcccctgggggcgccagcctgcggctgctggaccaccgggccctggtgtgcagccagcccggcctgaactgcaccgtgaagaacagcacctgcctggatgacagctggatccaccccaggaacctgacccccagcagccccaaggacctgcagatccagctgcactttgcccacacccagcagggcgacctcttccctgtggcccacatcgagtggaccctgcagacagatgccagcatcctgtacctggagggcgctgagctgtctgtgctgcagctgaacaccaatgaaaggctgtgtgtgcgctttgagttcctgagcaagctgcggcaccaccaccggcgctggaggttcaccttcagccactttgtggtggaccctgaccaggagtatgaggtgacagtgcaccacctgcccaagcccatcccagatggagaccccaaccaccagagcaagaacttcctggtgcctgactgtgaacatgccaggatgaaggtgaccaccccctgcatgagcagcggcagcctgtgggaccccaacatcaccgtggagaccctggaggcccaccagctgcgggtgtccttcaccctgtggaatgaaagcacccactaccagatcctgctgaccagcttcccccacatggagaaccacagctgctttgagcacatgcaccacatcccagcccccaggcctgaggagttccaccagaggagcaatgtgaccctgaccctgaggaacctgaagggctgctgccgccaccaggtgcagatccagcccttcttcagcagctgcctgaatgactgcctgcggcacagcgccaccgtgtcctgcccagagatgccagacaccccagagcccatcccagactacatgcccctgtgggtgtactggttcatcaccggcatcagcatcctgctggtgggcagcgtcatcctgctgattgtgtgcatgacctggaggctggccggccctggcagcgagaagtacagtgatgacaccaagtacacagatggcctgcctgctgctgacctgatccccccacccctgaagcccaggaaggtgtggatcatctacagcgctgaccaccccctgtatgtggatgtggtgctgaagtttgcccagttcctgctgacagcctgtggcacagaggtggccctggacctgctggaggagcaggccatcagcgaggccggcgtgatgacctgggtgggccggcagaagcaggagatggtggagagcaacagcaagatcatcgtgctgtgcagccggggcacccgggccaagtggcaggccctgctgggccgcggggcccctgtgcggctgcgctgtgaccacggcaagcctgtgggggacctcttcaccgctgccatgaacatgatcctgcctgacttcaagaggcctgcctgcttcggcacctacgtggtgtgctacttcagcgaggtgtcctgtgatggagatgtgcctgacctgtttggagctgccccccgctaccccctgatggacagatttgaggaggtgtacttccgcatccaggacctggagatgttccagcccggccgcatgcaccgggtgggggagctgagcggggacaactacctgcggagccctgggggccggcagctgcgggccgccctggaccgcttccgggactggcaggtgcgctgcccagactggtttgaatgtgagaacctgtacagcgcagatgaccaggatgcccccagcctggatgaggaggtgtttgaggagcccctgctgcccccaggcactggaattgtgaagagggcccccctggtgcgggagcccggcagccaggcctgcctggccatcgaccccctggtgggggaggagggcggcgctgctgtggccaagctggagccccacctgcagccccggggccagcctgccccccagcccctgcacaccctggtgctggccgctgaggagggcgccctggtggccgctgtggagcccggccccctggctgatggagctgctgtgcggctggccctggccggggagggggaggcctgccccctgctgggcagccctggagctggaagaaattctgtgctcttcctgcctgtggaccctgaggacagccccctgggcagcagcacccccatggccagcccagacctgctgcctgaagatgtgcgggagcacctggagggcctgatgctgagcctgtttgagcagagcctgagctgccaggcccagggcggctgcagcaggcctgccatggtgctgacagacccccacaccccctatgaggaggagcagaggcagagcgtgcagagcgaccagggctacatcagccgcagcagcccccagcccccagagggcctgacagagatggaggaggaggaggaggaggagcaggaccccgggaagccagccctgcccctgagccctgaggacctggagagcctgcggagcctgcagaggcagctgctcttccggcagctgcagaagaacagcggctgggacaccatgggcagcgagagcgagggccccagcgcctag

SEQ ID NO: 156378 - DNA, 2445 bp, Artificial Sequence
  Description of Artificial Sequence: Synthetic coding sequence
atgggcgccgcccggagccccccatctgctgtgcccggccccctgctgggcctgctgctgctgctgctgggcgtgctggcccctgggggcgccagcctgcggctgctggaccaccgggccctggtgtgcagccagcccggcctgaactgcaccgtgaagaacagcacctgcctggatgacagctggatccaccccaggaacctgacccccagcagccccaaggacctgcagatccagctgcactttgcccacacccagcagggcgacctcttccctgtggcccacatcgagtggaccctgcagacagatgccagcatcctgtacctggagggcgctgagctgtctgtgctgcagctgaacaccaatgaaaggctgtgtgtgcgctttgagttcctgagcaagctgcggcaccaccaccggcgctggaggttcaccttcagccactttgtggtggaccctgaccaggagtatgaggtgacagtgcaccacctgcccaagcccatcccagatggagaccccaaccaccagagcaagaacttcctggtgcctgactgtgaacatgccaggatgaaggtgaccaccccctgcatgagcagcggcagcctgtgggaccccaacatcaccgtggagaccctggaggcccaccagctgcgggtgtccttcaccctgtggaatgaaagcacccactaccagatcctgctgaccagcttcccccacatggagaaccacagctgctttgagcacatgcaccacatcccagcccccaggcctgaggagttccaccagaggagcaatgtgaccctgaccctgaggaacctgaagggctgctgccgccaccaggtgcagatccagcccttcttcagcagctgcctgaatgactgcctgcggcacagcgccaccgtgtcctgcccagagatgccagacaccccagatggcctgcctgctgctgacctgatccccccacccctgaagcccaggaaggtgtggatcatctacagcgctgaccaccccctgtatgtggatgtggtgctgaagtttgcccagttcctgctgacagcctgtggcacagaggtggccctggacctgctggaggagcaggccatcagcgaggccggcgtgatgacctgggtgggccggcagaagcaggagatggtggagagcaacagcaagatcatcgtgctgtgcagccggggcacccgggccaagtggcaggccctgctgggccgcggggcccctgtgcggctgcgctgtgaccacggcaagcctgtgggggacctcttcaccgctgccatgaacatgatcctgcctgacttcaagaggcctgcctgcttcggcacctacgtggtgtgctacttcagcgaggtgtcctgtgatggagatgtgcctgacctgtttggagctgccccccgctaccccctgatggacagatttgaggaggtgtacttccgcatccaggacctggagatgttccagcccggccgcatgcaccgggtgggggagctgagcggggacaactacctgcggagccctgggggccggcagctgcgggccgccctggaccgcttccgggactggcaggtgcgctgcccagactggtttgaatgtgagaacctgtacagcgcagatgaccaggatgcccccagcctggatgaggaggtgtttgaggagcccctgctgcccccaggcactggaattgtgaagagggcccccctggtgcgggagcccggcagccaggcctgcctggccatcgaccccctggtgggggaggagggcggcgctgctgtggccaagctggagccccacctgcagccccggggccagcctgccccccagcccctgcacaccctggtgctggccgctgaggagggcgccctggtggccgctgtggagcccggccccctggctgatggagctgctgtgcggctggccctggccggggagggggaggcctgccccctgctgggcagccctggagctggaagaaattctgtgctcttcctgcctgtggaccctgaggacagccccctgggcagcagcacccccatggccagcccagacctgctgcctgaagatgtgcgggagcacctggagggcctgatgctgagcctgtttgagcagagcctgagctgccaggcccagggcggctgcagcaggcctgccatggtgctgacagacccccacaccccctatgaggaggagcagaggcagagcgtgcagagcgaccagggctacatcagccgcagcagcccccagcccccagagggcctgacagagatggaggaggaggaggaggaggagcaggaccccgggaagccagccctgcccctgagccctgaggacctggagagcctgcggagcctgcagaggcagctgctcttccggcagctgcagaagaacagcggctgggacaccatgggcagcgagagcgagggccccagcgcctag

SEQ ID NO: 156379 - DNA, 1509 bp, Artificial Sequence
  Description of Artificial Sequence: Synthetic coding sequence
atgagcctggtgctgctgagcctggccgccctgtgccgctctgctgtgccccgggagcccaccgtgcagtgtggcagcgagaccggccccagccctgagtggatgctgcagcacgacctgatccctggggacctgcgggacctgcgggtggagcctgtgaccacctctgtggccactggagactacagcatcctgatgaatgtgtcctgggtgctgcgggcagatgccagcatccggctgctgaaggccaccaagatctgtgtgacaggcaagagcaacttccagagctacagctgtgtgcgctgcaactacacagaggccttccagacccagacccggcccagcggcggcaagtggaccttctcctacatcggcttccctgtggagctgaacacagtgtacttcatcggggcccacaacatccccaatgccaacatgaatgaagatggccccagcatgtctgtgaacttcaccagccctggctgcctggaccacatcatgaagtacaagaagaagtgtgtgaaggccggcagcctgtgggaccccaacatcacagcctgcaagaagaatgaggagaccgtggaggtgaacttcaccaccacccccctgggcaaccgctacatggccctgatccagcacagcaccatcatcggcttcagccaggtgtttgagccccaccagaagaagcagacccgggcctctgtggtgattcctgtgactggagacagcgagggcgccaccgtgcagctgaccccctacttccccacctgtggcagtgactgcatccgccacaagggcaccgtggtgctgtgcccccagacaggagtgcccttccccctggacaacaacaagagcaagccaggcggctggctgcccctgctgctgctgagcctgctggtggccacctgggtgctggtggccggcatctacctgatgtggaggcatgagcgcatcaagaagaccagcttcagcaccaccaccctgctgccccccatcaaggtgctggtggtgtaccccagcgagatctgcttccaccacaccatctgctacttcacagagttcctgcagaaccactgccgctctgaggtgatcctggagaagtggcagaagaagaagattgctgagatgggccctgtgcagtggctggccacccagaagaaggctgctgacaaggtggtgttcctgctgagcaatgatgtgaacagcgtgtgtgatggcacctgtgggaagtctgagggcagccccagcgagaacagccaggacctcttccccctggccttcaacctcttctgcagcgacctgcggagccagatccacctgcacaagtatgtggtggtgtacttccgggagattgacaccaaggatgactacaatgccctgtctgtgtgccccaagtaccacctgatgaaggatgccacagccttctgtgccgagctgctgcacgtgaagcagcaggtgtctgctgggaagaggagccaggcctgccatgatggctgctgcagcctgtag

SEQ ID NO: 156380 - DNA, 2376 bp, Artificial Sequence
  Description of Artificial Sequence: Synthetic coding sequence
atgcctgtgccctggttcctgctgagcctggccctgggccgcagccctgtggtgctgagcctggagcggctggtgggcccccaggatgccacccactgcagccctgtgtccctggagccctggggagatgaggagcggctgcgggtgcagttcctggcccagcagagcctgagcctggcccctgtgacagctgccacagccaggacagccctgagcggcctgtctggagcagatggccggcgggaggagcggggccggggcaagtcctgggtgtgcctgagcctgggcggcagcggcaacacagagccccagaagaagggcctgagctgccgcctgtgggacagcgacatcctgtgcctgcccggggacatcgtgcctgcccctggccctgtgctggcccccacccacctgcagacagagctggtgctgcgctgccagaaggagacagactgtgacctgtgcctgcgggtggccgtgcacctggccgtgcacggccactgggaggagccagaagatgaggagaagtttggaggagctgctgacagcggcgtggaggagcccagaaatgccagcctgcaggcccaggtggtgctgtccttccaggcctaccccacagcccgctgtgtgctgctggaggtgcaggtgcctgctgccctggtgcagtttggccagagcgtgggctctgtggtgtatgactgctttgaggccgccctgggcagcgaggtgcgcatctggagctacacccagcccaggtatgagaaggagctgaaccacacccagcagctgcctgactgccggggcctggaggtgtggaacagcatccccagctgctgggccctgccctggctgaatgtgtctgcagatggagacaacgtgcacctggtgctgaatgtgtctgaggagcagcacttcggcctgagcctgtactggaaccaggtgcagggcccccccaagccccgctggcacaagaacctgaccggcccccagatcatcaccctgaaccacacagacctggtgccctgcctgtgcatccaggtgtggcccctggagccagattctgtgaggaccaacatctgccccttccgggaggacccccgggcccaccagaacctgtggcaggccgcccggctgcagctgctgaccctgcagagctggctgctggatgccccctgcagcctgcctgctgaggccgccctgtgctggagggcccctggaggagacccctgccagcccctggtgccccccctgtcctgggagaatgtgacagtggacaaggtgctggagttccccctgctgaagggccaccccaacctgtgtgtgcaggtgaacagcagcgagaagctgcagctgcaggagtgcctgtgggccgacagcctgggccccctgaaggatgatgtgctgctgctggagacccggggcccccaggacaacagaagcctgtgtgccctggagcccagcggctgcaccagcctgcccagcaaggccagcaccagggctgcccggctgggggagtacctgctgcaggacctgcagagcggccagtgcctgcagctgtgggatgatgacctgggcgccctgtgggcctgccccatggacaagtacatccacaagcgctgggccctggtgtggctggcctgcctgctgtttgctgctgccctgagcctcatcctgctgctgaagaaggaccacgccaagggctggctgcggctgctgaagcaggatgtgcgctctggagctgctgcccggggccgggccgccctgctgctgtacagcgcagatgattctggctttgagcggctggtgggcgccctggccagcgccctgtgccagctgcccctgcgggtggccgtggacctgtggagccggcgggagctgagcgcccagggccctgtggcctggttccacgcccagaggcggcagaccctgcaggagggcggcgtggtggtgctgctcttcagccctggagctgtggccctgtgcagcgagtggctgcaggatggagtgtctggccctggggcccacggcccccatgatgccttccgggccagcctgagctgtgtgctgcctgacttcctgcagggccgggcccctggcagctatgtgggcgcctgctttgaccggctgctgcacccagatgctgtgcctgccctcttcagaacagtgcctgtgttcaccctgcccagccagctgcctgacttcctgggcgccctgcagcagccccgggcccccaggagcggccgcctgcaggagcgggcagagcaggtgtcccgggccctgcagcctgccctggacagctacttccaccccccaggcaccccagcccctggccggggcgtgggccctggagctggccctggagctggagatggcacctag

SEQ ID NO: 156381 - DNA, 2118 bp, Artificial Sequence
  Description of Artificial Sequence: Synthetic coding sequence
atgcctgtgccctggttcctgctgagcctggccctgggccgcagccctgtggtgctgagcctggagcggctggtgggcccccaggatgccacccactgcagccctggcctgagctgccgcctgtgggacagcgacatcctgtgcctgcccggggacatcgtgcctgcccctggccctgtgctggcccccacccacctgcagacagagctggtgctgcgctgccagaaggagacagactgtgacctgtgcctgcgggtggccgtgcacctggccgtgcacggccactgggaggagccagaagatgaggagaagtttggaggagctgctgacagcggcgtggaggagcccagaaatgccagcctgcaggcccaggtggtgctgtccttccaggcctaccccacagcccgctgtgtgctgctggaggtgcaggtgcctgctgccctggtgcagtttggccagagcgtgggctctgtggtgtatgactgctttgaagctgccctgggcagcgaggtgcgcatctggagctacacccagcccaggtatgagaaggagctgaaccacacccagcagctgcctgccctgccctggctgaatgtgtctgcagatggagacaacgtgcacctggtgctgaatgtgtctgaggagcagcacttcggcctgagcctgtactggaaccaggtgcagggcccccccaagccccgctggcacaagaacctgaccggcccccagatcatcaccctgaaccacacagacctggtgccctgcctgtgcatccaggtgtggcccctggagccagattctgtgaggaccaacatctgccccttccgggaggacccccgggcccaccagaacctgtggcaggccgcccggctgcagctgctgaccctgcagagctggctgctggatgccccctgcagcctgcctgctgaggccgccctgtgctggagggcccctggaggagacccctgccagcccctggtgccccccctgtcctgggagaatgtgacagtggacaaggtgctggagttccccctgctgaagggccaccccaacctgtgtgtgcaggtgaacagcagcgagaagctgcagctgcaggagtgcctgtgggccgacagcctgggccccctgaaggatgatgtgctgctgctggagacccggggcccccaggacaacagaagcctgtgtgccctggagcccagcggctgcaccagcctgcccagcaaggccagcaccagggctgcccggctgggggagtacctgctgcaggacctgcagagcggccagtgcctgcagctgtgggatgatgacctgggcgccctgtgggcctgccccatggacaagtacatccacaagcgctgggccctggtgtggctggcctgcctgctgtttgctgctgccctgagcctcatcctgctgctgaagaaggaccacgccaagggctggctgcggctgctgaagcaggatgtgcgctctggagctgctgcccggggccgggccgccctgctgctgtacagcgcagatgattctggctttgagcggctggtgggcgccctggccagcgccctgtgccagctgcccctgcgggtggccgtggacctgtggagccggcgggagctgagcgcccagggccctgtggcctggttccacgcccagaggcggcagaccctgcaggagggcggcgtggtggtgctgctcttcagccctggagctgtggccctgtgcagcgagtggctgcaggatggagtgtctggccctggggcccacggcccccatgatgccttccgggccagcctgagctgtgtgctgcctgacttcctgcagggccgggcccctggcagctatgtgggcgcctgctttgaccggctgctgcacccagatgctgtgcctgccctcttcagaacagtgcctgtgttcaccctgcccagccagctgcctgacttcctgggcgccctgcagcagccccgggcccccaggagcggccgcctgcaggagcgggcagagcaggtgtcccgggccctgcagcctgccctggacagctacttccaccccccaggcaccccagcccctggccggggcgtgggccctggagctggccctggagctggagatggcacctag

SEQ ID NO: 156382 - DNA, 2163 bp, Artificial Sequence
  Description of Artificial Sequence: Synthetic coding sequence
atgcctgtgccctggttcctgctgagcctggccctgggccgcagccctgtggtgctgagcctggagcggctggtgggcccccaggatgccacccactgcagccctggcctgagctgccgcctgtgggacagcgacatcctgtgcctgcccggggacatcgtgcctgcccctggccctgtgctggcccccacccacctgcagacagagctggtgctgcgctgccagaaggagacagactgtgacctgtgcctgcgggtggccgtgcacctggccgtgcacggccactgggaggagccagaagatgaggagaagtttggaggagctgctgacagcggcgtggaggagcccagaaatgccagcctgcaggcccaggtggtgctgtccttccaggcctaccccacagcccgctgtgtgctgctggaggtgcaggtgcctgctgccctggtgcagtttggccagagcgtgggctctgtggtgtatgactgctttgaagctgccctgggcagcgaggtgcgcatctggagctacacccagcccaggtatgagaaggagctgaaccacacccagcagctgcctgactgccggggcctggaggtgtggaacagcatccccagctgctgggccctgccctggctgaatgtgtctgcagatggagacaacgtgcacctggtgctgaatgtgtctgaggagcagcacttcggcctgagcctgtactggaaccaggtgcagggcccccccaagccccgctggcacaagaacctgaccggcccccagatcatcaccctgaaccacacagacctggtgccctgcctgtgcatccaggtgtggcccctggagccagacagcgtgaggaccaacatctgccccttccgggaggacccccgggcccaccagaacctgtggcaggccgcccggctgcagctgctgaccctgcagagctggctgctggatgccccctgcagcctgcctgctgaggccgccctgtgctggagggcccctggaggagacccctgccagcccctggtgccccccctgtcctgggagaatgtgacagtggacaaggtgctggagttccccctgctgaagggccaccccaacctgtgtgtgcaggtgaacagcagcgagaagctgcagctgcaggagtgcctgtgggccgacagcctgggccccctgaaggatgatgtgctgctgctggagacccggggcccccaggacaacagaagcctgtgtgccctggagcccagcggctgcaccagcctgcccagcaaggccagcacccgggccgcccggctgggggagtacctgctgcaggacctgcagagcggccagtgcctgcagctgtgggatgatgacctgggcgccctgtgggcctgccccatggacaagtacatccacaagcgctgggccctggtgtggctggcctgcctgctgtttgctgctgccctgagcctcatcctgctgctgaagaaggaccacgccaagggctggctgcggctgctgaagcaggatgtgcgcagcggggctgctgcccggggccgggccgccctgctgctgtacagcgcagatgacagcggctttgagcggctggtgggcgccctggccagcgccctgtgccagctgcccctgcgggtggccgtggacctgtggagcagaagagagctgagcgcccagggccctgtggcctggttccacgcccagaggcggcagaccctgcaggagggcggcgtggtggtgctgctcttcagccctggagctgtggccctgtgcagcgagtggctgcaggatggagtgtctggccctggggcccacggcccccatgatgccttccgggccagcctgagctgtgtgctgcctgacttcctgcagggccgggcccctggcagctatgtgggcgcctgctttgaccggctgctgcacccagatgctgtgcctgccctcttcagaacagtgcctgtgttcaccctgcccagccagctgcctgacttcctgggcgccctgcagcagccccgggcccccaggagcggccgcctgcaggagagagctgagcaggtgtcccgggccctgcagcctgccctggacagctacttccaccccccaggcaccccagcccctggccggggcgtgggccctggggccggccctggagctggagatggcacctag

SEQ ID NO: 156383 - DNA, 1641 bp, Artificial Sequence
  Description of Artificial Sequence: Synthetic coding sequence
atggcctaccccacagcccgctgtgtgctgctggaggtgcaggtgcctgctgccctggtgcagtttggccagagcgtgggctctgtggtgtatgactgctttgaggccgccctgggcagcgaggtgcgcatctggagctacacccagcccaggtatgagaaggagctgaaccacacccagcagctgcctgccctgccctggctgaatgtgtctgcagatggagacaacgtgcacctggtgctgaatgtgtctgaggagcagcacttcggcctgagcctgtactggaaccaggtgcagggcccccccaagccccgctggcacaagaacctgaccggcccccagatcatcaccctgaaccacacagacctggtgccctgcctgtgcatccaggtgtggcccctggagccagacagcgtgaggaccaacatctgccccttccgggaggacccccgggcccaccagaacctgtggcaggccgcccggctgcagctgctgaccctgcagagctggctgctggatgccccctgcagcctgcctgctgaggccgccctgtgctggagggcccctggaggagacccctgccagcccctggtgccccccctgtcctgggagaatgtgacagtggatgtgaacagcagcgagaagctgcagctgcaggagtgcctgtgggccgacagcctgggccccctgaaggatgatgtgctgctgctggagacccggggcccccaggacaacagaagcctgtgtgccctggagcccagcggctgcaccagcctgcccagcaaggccagcaccagggctgcccggctgggggagtacctgctgcaggacctgcagagcggccagtgcctgcagctgtgggatgatgacctgggcgccctgtgggcctgccccatggacaagtacatccacaagcgctgggccctggtgtggctggcctgcctgctgtttgctgctgccctgagcctcatcctgctgctgaagaaggaccacgccaaggctgctgcccggggccgggccgccctgctgctgtacagcgcagatgacagcggctttgagcggctggtgggcgccctggccagcgccctgtgccagctgcccctgcgggtggccgtggacctgtggagcagaagagagctgagcgcccagggccctgtggcctggttccacgcccagaggcggcagaccctgcaggagggcggcgtggtggtgctgctcttcagccctggagctgtggccctgtgcagcgagtggctgcaggatggagtgtctggccctggggcccacggcccccatgatgccttccgggccagcctgagctgtgtgctgcctgacttcctgcagggccgggcccctggcagctatgtgggcgcctgctttgaccggctgctgcacccagatgctgtgcctgccctcttcagaacagtgcctgtgttcaccctgcccagccagctgcctgacttcctgggcgccctgcagcagccccgggcccccaggagcggccgcctgcaggagagagctgagcaggtgtcccgggccctgcagcctgccctggacagctacttccaccccccaggcaccccagcccctggccggggcgtgggccctggggccggccctggagctggagatggcacctag

SEQ ID NO: 156384 - DNA, 2124 bp, Artificial Sequence
  Description of Artificial Sequence: Synthetic coding sequence
atgcctgtgccctggttcctgctgagcctggccctgggccgcagccctgtggtgctgagcctggagcggctggtgggcccccaggatgccacccactgcagccctggcctgagctgccgcctgtgggacagcgacatcctgtgcctgcccggggacatcgtgcctgcccctggccctgtgctggcccccacccacctgcagacagagctggtgctgcgctgccagaaggagacagactgtgacctgtgcctgcgggtggccgtgcacctggccgtgcacggccactgggaggagccagaagatgaggagaagtttggaggagctgctgacagcggcgtggaggagcccagaaatgccagcctgcaggcccaggtggtgctgtccttccaggcctaccccacagcccgctgtgtgctgctggaggtgcaggtgcctgctgccctggtgcagtttggccagagcgtgggctctgtggtgtatgactgctttgaagctgccctgggcagcgaggtgcgcatctggagctacacccagcccaggtatgagaaggagctgaaccacacccagcagctgcctgactgccggggcctggaggtgtggaacagcatccccagctgctgggccctgccctggctgaatgtgtctgcagatggagacaacgtgcacctggtgctgaatgtgtctgaggagcagcacttcggcctgagcctgtactggaaccaggtgcagggcccccccaagccccgctggcacaagaacctgaccggcccccagatcatcaccctgaaccacacagacctggtgccctgcctgtgcatccaggtgtggcccctggagccagacagcgtgaggaccaacatctgccccttccgggaggacccccgggcccaccagaacctgtggcaggccgcccggctgcagctgctgaccctgcagagctggctgctggatgccccctgcagcctgcctgctgaggccgccctgtgctggagggcccctggaggagacccctgccagcccctggtgccccccctgtcctgggagaatgtgacagtggacaaggtgctggagttccccctgctgaagggccaccccaacctgtgtgtgcaggtgaacagcagcgagaagctgcagctgcaggagtgcctgtgggccgacagcctgggccccctgaaggatgatgtgctgctgctggagacccggggcccccaggacaacagaagcctgtgtgccctggagcccagcggctgcaccagcctgcccagcaaggccagcacccgggccgcccggctgggggagtacctgctgcaggacctgcagagcggccagtgcctgcagctgtgggatgatgacctgggcgccctgtgggcctgccccatggacaagtacatccacaagcgctgggccctggtgtggctggcctgcctgctgtttgctgctgccctgagcctcatcctgctgctgaagaaggaccacgccaaggccgccgcccggggccgggccgccctgctgctgtacagcgcagatgattctggctttgagcggctggtgggcgccctggccagcgccctgtgccagctgcccctgcgggtggccgtggacctgtggagccggcgggagctgagcgcccagggccctgtggcctggttccacgcccagaggcggcagaccctgcaggagggcggcgtggtggtgctgctcttcagccctggagctgtggccctgtgcagcgagtggctgcaggatggagtgtctggccctggggcccacggcccccatgatgccttccgggccagcctgagctgtgtgctgcctgacttcctgcagggccgggcccctggcagctatgtgggcgcctgctttgaccggctgctgcacccagatgctgtgcctgccctcttcagaacagtgcctgtgttcaccctgcccagccagctgcctgacttcctgggcgccctgcagcagccccgggcccccaggagcggccgcctgcaggagcgggcagagcaggtgtcccgggccctgcagcctgccctggacagctacttccaccccccaggcaccccagcccctggccggggcgtgggccctggagctggccctggagctggagatggcacctag

SEQ ID NO: 156385 - DNA, 213 bp, Artificial Sequence
  Description of Artificial Sequence: Synthetic coding sequence
atgcctgtgccctggttcctgctgagcctggccctgggccgcagccctgtggtgctgagcctggagcggctggtgggcccccaggatgccacccactgcagccctggcctgagctgccgcctgtgggtgacctacagcgcctgcctgggcaccagctgcctgctgcgggccccctgctggaggctgcggacctgccggcagagctggtgctag

SEQ ID NO: 156386 - DNA, 2067 bp, Artificial Sequence
  Description of Artificial Sequence: Synthetic coding sequence
atgcctgtgccctggttcctgctgagcctggccctgggccgcagccctgtggtgctgagcctggagcggctggtgggcccccaggatgccacccactgcagccctggcctgagctgccgcctgtgggacagcgacatcctgtgcctgcccggggacatcgtgcctgcccctggccctgtgctggcccccacccacctgcagacagagctggtgctgcgctgccagaaggagacagactgtgacctgtgcctgcgggtggccgtgcacctggccgtgcacggccactgggaggagccagaagatgaggagaagtttggaggagctgctgacagcggcgtggaggagcccagaaatgccagcctgcaggcccaggtggtgctgtccttccaggcctaccccacagcccgctgtgtgctgctggaggtgcaggtgcctgctgccctggtgcagtttggccagagcgtgggctctgtggtgtatgactgctttgaagctgccctgggcagcgaggtgcgcatctggagctacacccagcccaggtatgagaaggagctgaaccacacccagcagctgcctgccctgccctggctgaatgtgtctgcagatggagacaacgtgcacctggtgctgaatgtgtctgaggagcagcacttcggcctgagcctgtactggaaccaggtgcagggcccccccaagccccgctggcacaagaacctgaccggcccccagatcatcaccctgaaccacacagacctggtgccctgcctgtgcatccaggtgtggcccctggagccagattctgtgaggaccaacatctgccccttccgggaggacccccgggcccaccagaacctgtggcaggccgcccggctgcagctgctgaccctgcagagctggctgctggatgccccctgcagcctgcctgctgaggccgccctgtgctggagggcccctggaggagacccctgccagcccctggtgccccccctgtcctgggagaatgtgacagtggatgtgaacagcagcgagaagctgcagctgcaggagtgcctgtgggccgacagcctgggccccctgaaggatgatgtgctgctgctggagacccggggcccccaggacaacagaagcctgtgtgccctggagcccagcggctgcaccagcctgcccagcaaggccagcacccgggccgcccggctgggggagtacctgctgcaggacctgcagagcggccagtgcctgcagctgtgggatgatgacctgggcgccctgtgggcctgccccatggacaagtacatccacaagcgctgggccctggtgtggctggcctgcctgctgtttgctgctgccctgagcctcatcctgctgctgaagaaggaccacgccaagggctggctgcggctgctgaagcaggatgtgcgcagcggggctgctgcccggggccgggccgccctgctgctgtacagcgcagatgacagcggctttgagcggctggtgggcgccctggccagcgccctgtgccagctgcccctgcgggtggccgtggacctgtggagcagaagagagctgagcgcccagggccctgtggcctggttccacgcccagaggcggcagaccctgcaggagggcggcgtggtggtgctgctcttcagccctggagctgtggccctgtgcagcgagtggctgcaggatggagtgtctggccctggggcccacggcccccatgatgccttccgggccagcctgagctgtgtgctgcctgacttcctgcagggccgggcccctggcagctatgtgggcgcctgctttgaccggctgctgcacccagatgctgtgcctgccctcttcagaacagtgcctgtgttcaccctgcccagccagctgcctgacttcctgggcgccctgcagcagccccgggcccccaggagcggccgcctgcaggagagagctgagcaggtgtcccgggccctgcagcctgccctggacagctacttccaccccccaggcaccccagcccctggccggggcgtgggccctggggccggccctggagctggagatggcacctag

SEQ ID NO: 156387 - DNA, 2220 bp, Artificial Sequence
  Description of Artificial Sequence: Synthetic coding sequence
atggccccctggctgcagctgtgcagcgtcttcttcaccgtgaatgcctgcctgaatggcagccagctggccgtggccgccggcggcagcggccgggcccggggagctgacacctgtggctggaggggcgtgggccctgccagcagaaattctggcctgtacaacatcaccttcaagtatgacaactgcaccacctacctgaaccctgtgggcaagcacgtgattgctgatgcccagaacatcaccatcagccagtatgcctgccacgaccaggtggccgtgaccatcctgtggagccctggggccctgggcatcgagttcctgaagggcttccgggtcatcctggaggagctgaagtctgagggccggcagtgccagcagctgatcctgaaggaccccaagcagctgaacagcagcttcaagaggacaggcatggagagccagcccttcctgaacatgaagtttgaaacagactactttgtgaaggtggtgcccttccccagcatcaagaatgaaagcaactaccaccccttcttcttccgcacccgggcctgtgacctgctgctgcagcctgacaacctggcctgcaagcccttctggaagcccaggaacctgaacatcagccagcacggcagtgacatgcaggtgtcctttgaccacgccccccacaactttggcttccgcttcttctacctgcactacaagctgaagcatgagggccccttcaagaggaagacctgcaagcaggagcagaccacagagaccaccagctgcctgctgcagaatgtgtcccctggggactacatcatcgagctggtggatgacaccaacaccaccaggaaggtgatgcactacgccctgaagcctgtgcacagcccctgggccggccccatccgggctgtggccatcaccgtgcccctggtggtgatcagcgcctttgccaccctcttcaccgtgatgtgcaggaagaagcagcaggagaacatctacagccacctggatgaggagagcagcgagagcagcacctacacagctgccctgccccgggagcggctgcggccccggcccaaggtgttcctgtgctacagcagcaaggatggccagaaccacatgaatgtggtgcagtgctttgcctacttcctgcaggacttctgtggctgtgaggtggccctggacctgtgggaggacttcagcctgtgccgggagggccagcgggagtgggtgatccagaagatccacgagagccagttcatcatcgtggtgtgcagcaagggcatgaagtactttgtggacaagaagaactacaagcacaagggcggcggccggggcagcggcaagggggagctgttcctggtggccgtgtctgccatcgccgagaagctgcggcaggccaagcagagcagcagcgctgccctgagcaagttcatcgctgtgtactttgactacagctgtgaaggagatgtgcccggcatcctggacctgagcaccaagtaccgcctgatggacaacctgccccagctgtgcagccacctgcacagccgggaccacggcctgcaggagcccggccagcacacccggcagggcagcagaagaaactacttccgcagcaagagcggccgcagcctgtatgtggccatctgcaacatgcaccagttcattgatgaggagccagactggtttgagaagcagtttgtgcccttccaccccccacccctgcgctaccgggagcctgtgctggagaagtttgacagcggcctggtgctgaatgatgtgatgtgcaagccaggccctgagagtgacttctgcctgaaggtggaggccgctgtgctgggcgccactggacctgctgacagccagcacgagagccagcacggcggcctggaccaggatggagaggcccggcctgccctggatggcagcgctgccctgcagcccctgctgcacacagtgaaggccggcagccccagcgacatgccccgggacagcggcatctatgacagctctgtgcccagcagcgagctgagcctgcccctgatggagggcctgagcacagaccagacagagaccagcagcctgacagaatctgtgagcagcagcagcggcctgggggaggaggagcccccagccctgcccagcaagctgctgagcagcggcagctgcaaggctgacctgggctgccgcagctacacagatgagctgcatgctgtggcccccctgtag

SEQ ID NO: 156388 - DNA, 1788 bp, Artificial Sequence
  Description of Artificial Sequence: Synthetic coding sequence
atggagagccagcccttcctgaacatgaagtttgaaacagactactttgtgaaggtggtgcccttccccagcatcaagaatgaaagcaactaccaccccttcttcttccgcacccgggcctgtgacctgctgctgcagcctgacaacctggcctgcaagcccttctggaagcccaggaacctgaacatcagccagcacggcagtgacatgcaggtgtcctttgaccacgccccccacaactttggcttccgcttcttctacctgcactacaagctgaagcatgagggccccttcaagaggaagacctgcaagcaggagcagaccacagagaccaccagctgcctgctgcagaatgtgtcccctggggactacatcatcgagctggtggatgacaccaacaccaccaggaaggtgatgcactacgccctgaagcctgtgcacagcccctgggccggccccatccgggctgtggccatcaccgtgcccctggtggtgatcagcgcctttgccaccctcttcaccgtgatgtgcaggaagaagcagcaggagaacatctacagccacctggatgaggagagcagcgagagcagcacctacacagctgccctgccccgggagcggctgcggccccggcccaaggtgttcctgtgctacagcagcaaggatggccagaaccacatgaatgtggtgcagtgctttgcctacttcctgcaggacttctgtggctgtgaggtggccctggacctgtgggaggacttcagcctgtgccgggagggccagcgggagtgggtgatccagaagatccacgagagccagttcatcatcgtggtgtgcagcaagggcatgaagtactttgtggacaagaagaactacaagcacaagggcggcggccggggcagcggcaagggggagctgttcctggtggccgtgtctgccatcgccgagaagctgcggcaggccaagcagagcagcagcgctgccctgagcaagttcatcgctgtgtactttgactacagctgtgaaggagatgtgcccggcatcctggacctgagcaccaagtaccgcctgatggacaacctgccccagctgtgcagccacctgcacagccgggaccacggcctgcaggagcccggccagcacacccggcagggcagcagaagaaactacttccgcagcaagagcggccgcagcctgtatgtggccatctgcaacatgcaccagttcattgatgaggagccagactggtttgagaagcagtttgtgcccttccaccccccacccctgcgctaccgggagcctgtgctggagaagtttgacagcggcctggtgctgaatgatgtgatgtgcaagccaggccctgagagtgacttctgcctgaaggtggaggccgctgtgctgggcgccactggacctgctgacagccagcacgagagccagcacggcggcctggaccaggatggagaggcccggcctgccctggatggcagcgctgccctgcagcccctgctgcacacagtgaaggccggcagccccagcgacatgccccgggacagcggcatctatgacagctctgtgcccagcagcgagctgagcctgcccctgatggagggcctgagcacagaccagacagagaccagcagcctgacagaatctgtgagcagcagcagcggcctgggggaggaggagcccccagccctgcccagcaagctgctgagcagcggcagctgcaaggctgacctgggctgccgcagctacacagatgagctgcatgctgtggcccccctgtag

SEQ ID NO: 156389 - DNA, 2148 bp, Artificial Sequence
  Description of Artificial Sequence: Synthetic coding sequence
atgccccgggccagcgccagcggcgtgcctgccctgtttgtgtctggagagcagggcgtgggccctgccagcagaaattctggcctgtacaacatcaccttcaagtatgacaactgcaccacctacctgaaccctgtgggcaagcacgtgattgctgatgcccagaacatcaccatcagccagtatgcctgccacgaccaggtggccgtgaccatcctgtggagccctggggccctgggcatcgagttcctgaagggcttccgggtcatcctggaggagctgaagtctgagggccggcagtgccagcagctgatcctgaaggaccccaagcagctgaacagcagcttcaagaggacaggcatggagagccagcccttcctgaacatgaagtttgaaacagactactttgtgaaggtggtgcccttccccagcatcaagaatgaaagcaactaccaccccttcttcttccgcacccgggcctgtgacctgctgctgcagcctgacaacctggcctgcaagcccttctggaagcccaggaacctgaacatcagccagcacggcagtgacatgcaggtgtcctttgaccacgccccccacaactttggcttccgcttcttctacctgcactacaagctgaagcatgagggccccttcaagaggaagacctgcaagcaggagcagaccacagagaccaccagctgcctgctgcagaatgtgtcccctggggactacatcatcgagctggtggatgacaccaacaccaccaggaaggtgatgcactacgccctgaagcctgtgcacagcccctgggccggccccatccgggctgtggccatcaccgtgcccctggtggtgatcagcgcctttgccaccctcttcaccgtgatgtgcaggaagaagcagcaggagaacatctacagccacctggatgaggagagcagcgagagcagcacctacacagctgccctgccccgggagcggctgcggccccggcccaaggtgttcctgtgctacagcagcaaggatggccagaaccacatgaatgtggtgcagtgctttgcctacttcctgcaggacttctgtggctgtgaggtggccctggacctgtgggaggacttcagcctgtgccgggagggccagcgggagtgggtgatccagaagatccacgagagccagttcatcatcgtggtgtgcagcaagggcatgaagtactttgtggacaagaagaactacaagcacaagggcggcggccggggcagcggcaagggggagctgttcctggtggccgtgtctgccatcgccgagaagctgcggcaggccaagcagagcagcagcgctgccctgagcaagttcatcgctgtgtactttgactacagctgtgaaggagatgtgcccggcatcctggacctgagcaccaagtaccgcctgatggacaacctgccccagctgtgcagccacctgcacagccgggaccacggcctgcaggagcccggccagcacacccggcagggcagcagaagaaactacttccgcagcaagagcggccgcagcctgtatgtggccatctgcaacatgcaccagttcattgatgaggagccagactggtttgagaagcagtttgtgcccttccaccccccacccctgcgctaccgggagcctgtgctggagaagtttgacagcggcctggtgctgaatgatgtgatgtgcaagccaggccctgagagtgacttctgcctgaaggtggaggccgctgtgctgggcgccactggacctgctgacagccagcacgagagccagcacggcggcctggaccaggatggagaggcccggcctgccctggatggcagcgctgccctgcagcccctgctgcacacagtgaaggccggcagccccagcgacatgccccgggacagcggcatctatgacagctctgtgcccagcagcgagctgagcctgcccctgatggagggcctgagcacagaccagacagagaccagcagcctgacagaatctgtgagcagcagcagcggcctgggggaggaggagcccccagccctgcccagcaagctgctgagcagcggcagctgcaaggctgacctgggctgccgcagctacacagatgagctgcatgctgtggcccccctgtag

SEQ ID NO: 156390 - DNA, 1788 bp, Artificial Sequence; identical to SEQ ID NO: 156388
  Description of Artificial Sequence: Synthetic coding sequence

SEQ ID NO: 156391 - DNA, 222 bp, Artificial Sequence
  Description of Artificial Sequence: Synthetic coding sequence
atggagagccagcccttcctgaacatgaagtttgaaacagactactttgtgaaggtggtgcccttccccagcatcaagaatgaaagcaactaccaccccttcttcttccgcacccgggcctgtgacctgctgctgcagcctgacaacctggcctgcaagcccttctggaagcccaggaacctgaacatcagccagcacggcagtgacatgcaggtgtcctag

SEQ ID NO: 156392 - DNA, 1671 bp, Artificial Sequence
  Description of Artificial Sequence: Synthetic coding sequence
atgggcttctggatcctggccatcctgaccatcctgatgtacagcacagctgccaagttcagcaagcagagctggggcctggagaatgaggccctgattgtgcgctgcccccggcagggcaagcccagctacacagtggactggtactacagccagaccaacaagagcatccccacccaggagaggaacagagtgtttgccagcggccagctgctgaagttcctgcctgctgctgtggccgacagcggcatctacacctgcatcgtgcgcagccccaccttcaacagaacaggctacgccaacgtgaccatctacaagaagcagagcgactgcaatgtgcctgactacctgatgtacagcacagtgtctggcagcgagaagaacagcaagatctactgccccaccatcgacctgtacaactggacagcccccctggagtggttcaagaactgccaggccctgcagggcagccgctaccgggcccacaagagcttcctggtgattgacaacgtgatgacagaagatgctggggactacacctgcaagttcatccacaatgaaaatggagccaactacagcgtgacagccaccaggagcttcaccgtgaaggatgagcagggcttcagcctcttccctgtgattggagccccagcccagaatgagatcaaggaggtggagatcggcaagaatgccaacctgacctgcagcgcctgcttcggcaagggcacccagttcctggccgctgtgctgtggcagctgaatggcaccaagatcacagactttggagagccccgcatccagcaggaggagggccagaaccagagcttcagcaatggcctggcctgcctggacatggtgctgagaattgctgatgtgaaggaggaggacctgctgctgcagtatgactgcctggccctgaacctgcacggcctgcggcggcacacagtgcggctgagcaggaagaaccccatcgaccaccacagcatctactgcatcatcgctgtgtgcagcgtcttcctgatgctgatcaacgtgctggtgatcatcctgaagatgttctggattgaggccaccctgctgtggagggacatcgccaagccctacaagaccagaaatgatggcaagctgtatgatgcctacgtggtgtaccccaggaactacaagagcagcacagatggagccagccgggtggagcactttgtgcaccagatcctgcctgatgtgctggagaacaagtgtggctacaccctgtgcatctacggccgggacatgctgcccggggaggatgtggtgacagctgtggagaccaacatcaggaagagccgccgccacatcttcatcctgaccccccagatcacccacaacaaggagtttgcctatgagcaggaggtggccctgcactgtgccctgatccagaatgatgccaaggtgatcctgattgagatggaggccctgtctgagctggacatgctgcaggccgaggccctgcaggacagcctgcagcacctgatgaaggtgcagggcaccatcaagtggagggaggaccacatcgccaacaagaggagcctgaacagcaagttctggaagcacgtgcgctaccagatgcctgtgcccagcaagatccccaggaaggccagcagcctgacccccctggccgcccagaagcagtag

SEQ ID NO: 156393 - DNA, 513 bp, Artificial Sequence
  Description of Artificial Sequence: Synthetic coding sequence
atgaactgccgggagctgcccctgaccctgtgggtgctgatctctgtgtccacagctgagagctgcaccagccggccccacatcaccgtggtggagggggagcccttctacctgaagcactgcagctgcagcctggcccatgaaattgagaccaccaccaagtcctggtacaagagcagcggcagccaggagcacgtggagctgaaccccaggagcagcagccgcatcgccctgcatgactgtgtgctggagttctggcctgtggagctgaatgacaccggcagctacttcttccagatgaagaactacacccagaagtggaagctgaatgtcatcagaagaaacaagcacagctgcttcacagagcggcaggtgaccagcaagatcgtggaggtgaagaagttcttccagatcacctgtgaaaattcctactaccagaccctggtgaacagcaccagcctgtacaagattggcccccccatctgcaggaagaccagcagcggcctgcactag

SEQ ID NO: 156394 - DNA, 1626 bp, Artificial Sequence
  Description of Artificial Sequence: Synthetic coding sequence
atgaactgccgggagctgcccctgaccctgtgggtgctgatctctgtgtccacagctgagagctgcaccagccggccccacatcaccgtggtggagggggagcccttctacctgaagcactgcagctgcagcctggcccatgaaattgagaccaccaccaagtcctggtacaagagcagcggcagccaggagcacgtggagctgaaccccaggagcagcagccgcatcgccctgcatgactgtgtgctggagttctggcctgtggagctgaatgacaccggcagctacttcttccagatgaagaactacacccagaagtggaagctgaatgtcatcagaagaaacaagcacagctgcttcacagagcggcaggtgaccagcaagatcgtggaggtgaagaagttcttccagatcacctgtgaaaattcctactaccagaccctggtgaacagcaccagcctgtacaagaactgcaagaagctgctgctggagaacaacaagaaccccaccatcaagaagaatgctgagtttgaggaccagggctactacagctgtgtgcacttcctgcaccacaacgggaagctgttcaacatcaccaagaccttcaacatcaccatcgtggaggacaggagcaacatcgtgcctgtgctgctgggccccaagctgaaccacgtggccgtggagctgggcaagaatgtgcggctgaactgcagcgccctgctgaatgaggaggatgtgatctactggatgtttggagaggagaatggaagtgaccccaacatccacgaggagaaggagatgaggatcatgaccccagagggcaagtggcacgccagcaaggtgctgagaattgaaaatattggagagagcaacctgaatgtgctgtacaactgcaccgtggccagcactggaggaacagacaccaagagcttcatcctggtgaggaaggctgacatggctgacatccctggccacgtgttcacccggggcatgatcatcgctgtgctgatcctggtggccgtggtgtgcctggtgacagtgtgtgtgatctacagagtggacctggtgctcttctaccgccacctgaccaggagagatgagaccctgacagatggcaagacctatgatgcctttgtgtcctacctgaaggagtgcaggccagaaaatggagaggagcacacctttgctgtggagatcctgccccgggtgctggagaagcacttcggctacaagctgtgcatctttgaaagagatgtggtgcctggaggagctgtggtggatgagatccacagcctgattgagaagagcagaagactcatcatcgtgctgagcaagagctacatgagcaatgaggtgcgctatgagctggagagcggcctgcacgaggccctggtggagaggaagatcaagatcatcctgattgagttcacccctgtgacagacttcaccttcctgccccagagcctgaagctgctgaagagccaccgggtgctgaagtggaaggctgacaagagcctgagctacaacagccgcttctggaagaacctgctgtacctgatgcctgccaagacagtgaagccaggaagagatgagcctgaggtgctgcctgtgctgtctgagagctag

SEQ ID NO: 156395 - DNA, 1626 bp, Artificial Sequence; identical to SEQ ID NO: 156394
  Description of Artificial Sequence: Synthetic coding sequence

SEQ ID NO: 156396 - DNA, 1800 bp, Artificial Sequence
  Description of Artificial Sequence: Synthetic coding sequence
atgctgtgcctgggctggatcttcctgtggctggtggccggggagcgcatcaagggcttcaacatcagcggctgcagcaccaagaagctgctgtggacctacagcaccaggtctgaggaggagtttgtgctcttctgtgacctgcctgagccccagaagagccacttctgccacaggaaccggctgagccccaagcaggtgcctgagcacctgcccttcatgggcagcaatgacctgagtgatgtgcagtggtaccagcagcccagcaatggagaccccctggaggacatcaggaagagctacccccacatcatccaggacaagtgcaccctgcacttcctgaccccaggagtgaacaacagcggcagctacatctgccggcccaagatgatcaagagcccctatgatgtggcctgctgcgtgaagatgatcctggaggtgaagccccagaccaatgccagctgtgagtacagcgccagccacaagcaggacctgctgctgggcagcacaggcagcatcagctgccccagcctgagctgccagagtgatgcccagagccctgctgtgacctggtacaagaatggcaagctgctgtctgtggagaggagcaaccgcatcgtggtggatgaggtgtatgactaccaccagggcacctacgtgtgtgactacacccagagcgacacagtgtcctcctggacagtgcgggctgtggtgcaggtgaggaccatcgtgggggacaccaagctgaagccagacatcctggaccctgtggaggacaccctggaggtggagctgggcaagcccctgaccatcagctgcaaggccaggtttggatttgagagggtcttcaaccctgtgatcaagtggtacatcaaggacagcgacctggagtgggaggtgtctgtgcctgaggccaagagcatcaagagcaccctgaaggatgagatcattgaaagaaacatcatcctggagaaggtgacccagagggacctgcggaggaagtttgtgtgctttgtgcagaacagcatcggcaacaccacccagagcgtgcagctgaaggagaagaggggcgtggtgctgctgtacatcctgctgggcaccatcggcaccctggtggccgtgctggccgccagcgccctgctgtaccgccactggattgagatcgtgctgctgtaccgcacctaccagagcaaggaccagaccctgggggacaagaaggactttgatgcctttgtgtcctatgccaagtggagcagcttccccagcgaggccaccagcagcctgtctgaggagcacctggccctgagcctcttcccagatgtgctggagaacaagtatggctacagcctgtgcctgctggagagagatgtggcccctggaggagtgtatgcagaagatattgtgtccatcatcaagaggagcagaagaggcatcttcatcctgagccccaactacgtgaatggccccagcatctttgagctgcaggccgctgtgaacctggccctggatgaccagaccctgaagctgatcctgatcaagttctgctacttccaggagcctgagagcctgccccacctggtgaagaaggccctgcgggtgctgcccaccgtgacctggaggggcctgaagtctgtgccccccaacagccgcttctgggccaagatgagataccacatgcctgtgaagaacagccagggcttcacctggaaccagctgcgcatcaccagccgcatcttccagtggaagggcctgagcaggacagagaccaccggccgcagcagccagcccaaggagtggtag

SEQ ID NO: 156397 - DNA, 1374 bp, Artificial Sequence
  Description of Artificial Sequence: Synthetic coding sequence
atgatcctggaggtgaagccccagaccaatgccagctgtgagtacagcgccagccacaagcaggacctgctgctgggcagcacaggcagcatcagctgccccagcctgagctgccagagtgatgcccagagccctgctgtgacctggtacaagaatggcaagctgctgtctgtggagaggagcaaccgcatcgtggtggatgaggtgtatgactaccaccagggcacctacgtgtgtgactacacccagagcgacacagtgtcctcctggacagtgcgggctgtggtgcaggtgaggaccatcgtgggggacaccaagctgaagccagacatcctggaccctgtggaggacaccctggaggtggagctgggcaagcccctgaccatcagctgcaaggccaggtttggatttgagagggtcttcaaccctgtgatcaagtggtacatcaaggacagcgacctggagtgggaggtgtctgtgcctgaggccaagagcatcaagagcaccctgaaggatgagatcattgaaagaaacatcatcctggagaaggtgacccagagggacctgcggaggaagtttgtgtgctttgtgcagaacagcatcggcaacaccacccagagcgtgcagctgaaggagaagaggggcgtggtgctgctgtacatcctgctgggcaccatcggcaccctggtggccgtgctggccgccagcgccctgctgtaccgccactggattgagatcgtgctgctgtaccgcacctaccagagcaaggaccagaccctgggggacaagaaggactttgatgcctttgtgtcctatgccaagtggagcagcttccccagcgaggccaccagcagcctgtctgaggagcacctggccctgagcctcttcccagatgtgctggagaacaagtatggctacagcctgtgcctgctggagagagatgtggcccctggaggagtgtatgcagaagatattgtgtccatcatcaagaggagcagaagaggcatcttcatcctgagccccaactacgtgaatggccccagcatctttgagctgcaggccgctgtgaacctggccctggatgaccagaccctgaagctgatcctgatcaagttctgctacttccaggagcctgagagcctgccccacctggtgaagaaggccctgcgggtgctgcccaccgtgacctggaggggcctgaagtctgtgccccccaacagccgcttctgggccaagatgagataccacatgcctgtgaagaacagccagggcttcacctggaaccagctgcgcatcaccagccgcatcttccagtggaagggcctgagcaggacagagaccaccggccgcagcagccagcccaaggagtggtag

SEQ ID NO: 156398 - DNA, 135 bp, Artificial Sequence
  Description of Artificial Sequence: Synthetic coding sequence
atgctgtgcctgggctggatcttcctgtggctggtggccggggagcgcatcaagggcttcaacatcagcggctgcagcaccaagaagctgctgtggacctacagcaccaggtctgaggaggagtttgtgctgtag

SEQ ID NO: 156399 - DNA, 534 bp, Artificial Sequence
  Description of Artificial Sequence: Synthetic coding sequence
atgaagctgcagtgtgtgtccctgtggctgctgggcaccatcctgatcctgtgcagcgtggacaaccacggcctgcggcgctgcctgatcagcacagacatgcaccacatcgaggagagcttccaggagatcaagagggccatccaggccaaggacaccttccccaacgtgaccatcctgagcaccctggagaccctgcagatcatcaagcccctggatgtgtgctgcgtgaccaagaacctgctggccttctacgtggacagagtcttcaaggaccaccaggagcccaaccccaagatcctgaggaagatcagcagcatcgccaacagcttcctgtacatgcagaagaccctgcggcagtgccaggagcagaggcagtgccactgccggcaggaggccaccaatgccaccagggtcatccatgacaactatgaccagctggaggtgcatgctgctgccatcaagagcctgggggagctggatgtgttcctggcctggatcaacaagaaccacgaggtgatgttcagcgcctag

SEQ ID NO: 156400 - DNA, 648 bp, Artificial Sequence
  Description of Artificial Sequence: Synthetic coding sequence
atgtgcacagaaggagccttcccccacaggtctgcctgcagcctgcccctgacccacgtgcacacccacatccacgtgtgtgtgcctgtgctgtggggctctgtgccccggggcatgaagctgcagtgtgtgtccctgtggctgctgggcaccatcctgatcctgtgcagcgtggacaaccacggcctgcggcgctgcctgatcagcacagacatgcaccacatcgaggagagcttccaggagatcaagagggccatccaggccaaggacaccttccccaacgtgaccatcctgagcaccctggagaccctgcagatcatcaagcccctggatgtgtgctgcgtgaccaagaacctgctggccttctacgtggacagagtcttcaaggaccaccaggagcccaaccccaagatcctgaggaagatcagcagcatcgccaacagcttcctgtacatgcagaagaccctgcggcagtgccaggagcagaggcagtgccactgccggcaggaggccaccaatgccaccagggtcatccatgacaactatgaccagctggaggtgcatgctgctgccatcaagagcctgggggagctggatgtgttcctggcctggatcaacaagaaccacgaggtgatgttcagcgcctag

SEQ ID NO: 156401 - DNA, 792 bp, Artificial Sequence
  Description of Artificial Sequence: Synthetic coding sequence
atggacagctacctgctgatgtggggcctgctgaccttcatcatggtgcccggctgccaggccgagctgtgtgatgatgaccccccagagatcccccacgccaccttcaaggccatggcctacaaggagggcaccatgctgaactgtgagtgcaagaggggcttccgccgcatcaagagcggcagcctgtacatgctgtgcaccggcaacagcagccacagctcctgggacaaccagtgccagtgcaccagcagcgccaccaggaacaccaccaagcaggtgaccccccagcctgaggagcagaaggagaggaagaccacagagatgcagagccccatgcagcctgtggaccaggccagcctgcccggccactgccgggagcccccaccctgggagaatgaggccacagagcgcatctaccactttgtggtgggccagatggtgtactaccagtgtgtgcagggctaccgggccctgcaccggggccctgctgagagcgtgtgcaagatgacccacggcaagacccgctggacccagccccagctgatctgcacaggagaggagaagccccaggccagccctgagggccggcctgagagcgagaccagctgcctggtgaccaccacagacttccagatccagacagagatggccgccaccatggagaccagcatcttcaccacagagtaccaggtggccgtggccggctgtgtgttcctgctgatctctgtgctgctgctgagcggcctgacctggcagaggcggcagaggaagagcaggaggaccatctag

SEQ ID NO: 156402 - DNA, 603 bp, Artificial Sequence
  Description of Artificial Sequence: Synthetic coding sequence
atggacagctacctgctgatgtggggcctgctgaccttcatcatggtgcccggctgccaggccgagctgtgtgatgatgaccccccagagatcccccacgccaccttcaaggccatggcctacaaggagggcaccatgctgaactgtgagtgcaagaggggcttccgccgcatcaagagcggcagcctgtacatgctgtgcaccggcaacagcagccacagctcctgggacaaccagtgccagtgcaccagcagcgccaccaggaacaccaccaagcaggtgaccccccagcctgaggagcagaaggagaggaagaccacagagatgcagagccccatgcagcctgtggaccaggccagcctgcccggggaggagaagccccaggccagccctgagggccggcctgagagcgagaccagctgcctggtgaccaccacagacttccagatccagacagagatggccgccaccatggagaccagcatcttcaccacagagtaccaggtggccgtggccggctgtgtgttcctgctgatctctgtgctgctgctgagcggcctgacctggcagaggcggcagaggaagagcaggaggaccatctag

SEQ ID NO: 156403 - DNA, 819 bp, Artificial Sequence
  Description of Artificial Sequence: Synthetic coding sequence
atggacagctacctgctgatgtggggcctgctgaccttcatcatggtgcccggctgccaggccgagctgtgtgatgatgaccccccagagatcccccacgccaccttcaaggccatggcctacaaggagggcaccatgctgaactgtgagtgcaagaggggcttccgccgcatcaagagcggcagcctgtacatgctgtgcaccggcaacagcagccacagctcctgggacaaccagtgccagtgcaccagcagcgccaccaggaacaccaccaagcaggtgaccccccagcctgaggagcagaaggagaggaagaccacagagatgcagagccccatgcagcctgtggaccaggccagcctgcccggccactgccgggagcccccaccctgggagaatgaggccacagagcgcatctaccactttgtggtgggccagatggtgtactaccagtgtgtgcagggctaccgggccctgcaccggggccctgctgagagcgtgtgcaagatgacccacggcaagacccgctggacccagccccagctgatctgcacaggagagatggagaccagccagtttcctggagaggagaagccccaggccagccctgagggccggcctgagagcgagaccagctgcctggtgaccaccacagacttccagatccagacagagatggccgccaccatggagaccagcatcttcaccacagagtaccaggtggccgtggccggctgtgtgttcctgctgatctctgtgctgctgctgagcggcctgacctggcagaggcggcagaggaagagcaggaggaccatctag

SEQ ID NO: 156404 - DNA, 489 bp, Artificial Sequence
  Description of Artificial Sequence: Synthetic coding sequence
atggtgcccggctgccaggccgagctgtgtgatgatgaccccccagagatcccccacgccaccttcaaggccatggcctacaaggagggcaccatgctgaactgtgagtgcaagaggggcttccgccgcatcaagagcggcagcctgtacatgctgtgcaccggcaacagcagccacagctcctgggacaaccagtgccagtgcaccagcagcgccaccaggaacaccaccaagcaggtgaccccccagcctgaggagcagaaggagaggaagaccacagagatgcagagccccatgcagcctgtggaccaggccagcctgcctgacttccagatccagacagagatggccgccaccatggagaccagcatcttcaccacagagtaccaggtggccgtggccggctgtgtgttcctgctgatctctgtgctgctgctgagcggcctgacctggcagaggcggcagaggaagagcaggaggaccatctag

SEQ ID NO: 156405 - DNA, 330 bp, Artificial Sequence
  Description of Artificial Sequence: Synthetic coding sequence
tgaatcccccacgccaccttcaaggccatggcctacaaggagggcaccatgctgaactgtgagtgcaagaggggcttccgccgcatcaagagcggcagcctgtacatgctgtgcaccggcaacagcagccacagctcctgggacaaccagtgccagtgcaccagcagcgccaccaggaacaccaccaagcaggtgaccccccagcctgaggagcagaaggagaggaagaccacagagatgcagagccccatgcagcctgtggaccaggccagcctgcctgacttccagatccagacagagatggccgccaccatggagaccagcatctag

SEQ ID NO: 156406 - DNA, 1110 bp, Artificial Sequence
  Description of Artificial Sequence: Synthetic coding sequence
atggaccccaggaaggtgaatgagctgcgggcctttgtgaagatgtgcaagcaggaccccagcgtgctgcacacagaggagatgaggttcctgcgggagtgggtggagagcatgggcggcaaggtgcccccagccacccagaaggccaagtctgaggagaacaccaaggaggagaagccagacagcaagaaggtggaggaggacctgaaggcagatgagcccagcagcgaggagagtgacctggagattgacaaggagggcgtgattgaaccagacacagatgccccccaggagatgggagatgaaaatgctgagatcacagaggagatgatggaccaggccaatgacaagaaggtggccgccatcgaggccctgaatgatggagagctgcagaaggccatcgacctcttcacagatgccatcaagctgaacccccggctggccatcctgtatgccaagagggcctctgtgtttgtgaagctgcagaagcccaatgctgccatccgggactgtgaccgggccatcgagatcaacccagattctgcccagccctacaagtggaggggcaaggcccaccggctgctgggccactgggaggaggccgcccatgacctggccctggcctgcaagctggactatgatgaagatgccagcgccatgctgaaggaggtgcagccccgggcccagaagattgctgagcacaggaggaaatatgaaaggaagcgggaggagcgggagatcaaggagagaattgagcgggtgaagaaggcccgggaggagcacgagcgggcccagcgggaggaggaggcccggcggcagagcggggcccagtatggcagcttccctgggggcttccctgggggcatgcctggcaacttccctgggggcatgcctggcatgggcggcggcatgcctggcatggccggcatgcctggcctgaatgagatcctgagtgaccctgaggtgctggccgccatgcaggaccctgaggtgatggtggccttccaggatgtggcccagaacccagccaacatgagcaagtaccagagcaaccccaaggtgatgaacctgatcagcaagctgagcgccaagtttggaggccaggcctag

SEQ ID NO: 156407 - DNA, 441 bp, Artificial Sequence
  Description of Artificial Sequence: Synthetic coding sequence
atggccgccccagccctgtcctggaggctgcccctgctgatcctgctgctgcccctggccacctcctgggccagcgctgctgtgaatggcaccagccagttcacctgcttctacaacagccgggccaacatcagctgtgtgtggagccaggatggagccctgcaggacaccagctgccaggtgcacgcctggccagacagaagacgctggaaccagacctgtgagctgctgcctgtgtcccaggcctcctgggcctgcaacctgatcctgggcgccccagacagccagaagctgaccaccgtggacatcgtgaccctgcgggtgctgtgccgggagggcgtgcgctggagggtgatggccatccaggacttcaagccctttgagaacctgcggctgatggcccccatcagcctgcaggtggtgcacgtggagacccactag

SEQ ID NO: 156408 - DNA, 267 bp, Artificial Sequence
  Description of Artificial Sequence: Synthetic coding sequence
atggccgccccagccctgtcctggaggctgcccctgctgatcctgctgctgcccctggccacctcctgggccagcgctgctgtgaatggcaccagccagttcacctgcttctacaacagccgggccaacatcagctgtgtgtggagccaggatggagccctgcaggacaccagctgccaggtgcacgcctggccagacagaagacgctggaaccagacctgtgagctgctgcctgtgtcccaggcctcctgggcctgcaacctgtag

SEQ ID NO: 156409 - DNA, 567 bp, Artificial Sequence
  Description of Artificial Sequence: Synthetic coding sequence
atggccgccccagccctgtcctggaggctgcccctgctgatcctgctgctgcccctggccacctcctgggccagcgctgctgtgaatggcaccagccagttcacctgcttctacaacagccgggccaacatcagctgtgtgtggagccaggatggagccctgcaggacaccagctgccaggtgcacgcctggccagacagaagacgctggaaccagacctgtgagctgctgcctgtgtcccaggcctcctgggcctgcaacctgatcctgggcgccccagacagccagaagctgaccaccgtggacatcgtgaccctgcgggtgctgtgccgggagggcgtgcgctggagggtgatggccatccaggacttcaagccctttgagaacctgcggctgatggcccccatcagcctgcaggtggtgcacgtggagacccaccgctgcaacatctcctgggagatcagccaggccagccactactttgagcggcacctggagtttgaggcccggaccctgagccctggccacacctgggaggaggcccccctgctgaccctgaagcagtag

SEQ ID NO: 156410 - DNA, 297 bp, Artificial Sequence
  Description of Artificial Sequence: Synthetic coding sequence
atggagccccccaaccccctgggggagcagtacttcaagaggaccatgccccgcatccccaccctgaagaacctggaggacctggtgacagagtaccacggcaacttcagcgcctggagcggcgtgtccaagggcctggccgagagcctgcagcctgactacagcgagcggctgtgcctggtgtctgagatcccccccaagggcggggccctgggggagggccctggggccagcccctgcaaccagcacagcccctactgggccccaccctgctacaccctgaagccagagacctag

SEQ ID NO: 156411 - DNA, 474 bp, Artificial Sequence
  Description of Artificial Sequence: Synthetic coding sequence
atgctgaagcccagcctgcccttcaccagcctgctcttcctgcagctgcccctgctgggcgtgggcctgaacaccaccatcctgaccccaaatggaaatgaagacaccacagctgacttcttcctgaccaccatgcccacagacagcctgtctgtgtccaccctgcccctgcctgaggtgcagtgctttgtgttcaacgtggagtacatgaactgcacctggaacagcagcagcgagccccagcccaccaacctgaccctgcactactggtacaagaacagcgacaatgacaaggtgcagaagtgcagccactacctgttcagcgaggagatcaccagcggctgccagctgcagaagaaggagatccacctgtaccagacctttgtggtgcagctgcaggacccccgggagccccggcggcaggccacccagatgctgaagctgcagaacctgggcaccatcagcggcctgtag

SEQ ID NO: 156412 - DNA, 1110 bp, Artificial Sequence
  Description of Artificial Sequence: Synthetic coding sequence
atgctgaagcccagcctgcccttcaccagcctgctcttcctgcagctgcccctgctgggcgtgggcctgaacaccaccatcctgaccccaaatggaaatgaagacaccacagctgacttcttcctgaccaccatgcccacagacagcctgtctgtgtccaccctgcccctgcctgaggtgcagtgctttgtgttcaacgtggagtacatgaactgcacctggaacagcagcagcgagccccagcccaccaacctgaccctgcactactggtacaagaacagcgacaatgacaaggtgcagaagtgcagccactacctgttcagcgaggagatcaccagcggctgccagctgcagaagaaggagatccacctgtaccagacctttgtggtgcagctgcaggacccccgggagccccggcggcaggccacccagatgctgaagctgcagaacctggtgatcccctgggcccctgagaacctgaccctgcacaagctgtctgagagccagctggagctgaactggaacaaccgcttcctgaaccactgcctggagcacctggtgcagtacagaacagactgggaccacagctggacagagcagagcgtggactaccgccacaagttcagcctgcccagcgtggatggccagaagcgctacaccttccgggtgcgcagccgcttcaaccccctgtgtggcagcgcccagcactggagcgagtggagccaccccatccactggggcagcaacaccagcaaagaaaaccccttcctgtttgccctggaggccgtggtgatctctgtgggctccatgggcctcatcatcagcctgctgtgtgtgtacttctggctggagaggaccatgccccgcatccccaccctgaagaacctggaggacctggtgacagagtaccacggcaacttcagcgcctggagcggcgtgtccaagggcctggccgagagcctgcagcctgactacagcgagcggctgtgcctggtgtctgagatcccccccaagggcggggccctgggggagggccctggggccagcccctgcaaccagcacagcccctactgggccccaccctgctacaccctgaagccagagacctag

SEQ ID NO: 156413 - DNA, 540 bp, Artificial Sequence
  Description of Artificial Sequence: Synthetic coding sequence
atgggcatgaagaccccccagctggagcagagcgtggactaccgccacaagttcagcctgcccagcgtggatggccagaagcgctacaccttccgggtgcgcagccgcttcaaccccctgtgtggcagcgcccagcactggagcgagtggagccaccccatccactggggcagcaacaccagcaaagaaaaccccttcctgtttgccctggaggccgtggtgatctctgtgggctccatgggcctcatcatcagcctgctgtgtgtgtacttctggctggagaggaccatgccccgcatccccaccctgaagaacctggaggacctggtgacagagtaccacggcaacttcagcgcctggagcggcgtgtccaagggcctggccgagagcctgcagcctgactacagcgagcggctgtgcctggtgtctgagatcccccccaagggcggggccctgggggagggccctggggccagcccctgcaaccagcacagcccctactgggccccaccctgctacaccctgaagccagagacctag

SEQ ID NO: 156414 - DNA, 1662 bp, Artificial Sequence
  Description of Artificial Sequence: Synthetic coding sequence
atgagggcccctggccgcccagccctgcggcccctgcccctgccccccctgctgctgctgctgctggccgccccctggggccgggctgtgccctgtgtgtctgggggcctgcccaagccagccaacatcaccttcctgagcatcaacatgaagaatgtgctgcagtggaccccacctgagggcctgcagggcgtgaaggtgacctacacagtgcagtacttcatctacggccagaagaagtggctgaacaagtctgagtgcaggaacatcaacagaacctactgtgacctgtctgctgagaccagtgactatgagcaccagtactatgccaaggtgaaggccatctggggcaccaagtgcagcaagtgggccgagagcggccgcttctaccccttcctggagacccagatcggccccccagaggtggccctgaccacagatgagaagagcatctctgtggtgctgacagcccctgagaagtggaagagaaatcctgaggacctgcctgtgtccatgcagcagatctacagcaacctgaagtacaacgtgtctgtgctgaacaccaagagcaacagaacctggagccagtgtgtgaccaaccacaccctggtgctgacctggctggagcccaacaccctgtactgtgtgcacgtggagagctttgtgcccggccccccaagaagagcccagcccagcgagaagcagtgtgcccggaccctgaaggaccagagcagcgagttcaaggccaagatcatcttctggtacgtgctgcctgtgtccatcaccgtcttcctgttctctgtgatgggctacagcatctaccgctacatccacgtgggcaaggagaagcacccagccaacctgatcctgatctatggaaatgaatttgacaagcgcttctttgtgcctgctgagaagatcgtcatcaacttcatcaccctgaacatcagtgatgacagcaagatcagccaccaggacatgagcctgctgggcaagagcagtgatgtgagcagcctgaatgacccccagcccagcggcaacctgcggcccccccaggaggaggaggaggtgaagcacctgggctacgccagccacctgatggagatcttctgtgacagtgaagaaaatacagagggcaccagcctgacccagcaggagagcctgagcaggaccatccccccagacaagacagtgattgaatatgaatatgatgtgaggaccacagacatctgtgccggccctgaggagcaggagctgagcctgcaggaggaggtgtccacccagggcaccctgctggagagccaggccgccctggccgtgctgggcccccagaccctgcagtacagctacaccccccagctgcaggacctggaccccctggcccaggagcacacagattctgaggagggccctgaggaggagcccagcaccaccctggtggactgggacccccagacaggccgcctgtgcatccccagcctgagcagctttgaccaggacagcgagggctgtgagcccagtgaaggagatggcctgggggaggagggcctgctgagccggctgtatgaggagcccgccccagaccggcccccaggagaaaatgagacctacctgatgcagttcatggaggagtggggcctgtatgtgcagatggagaactag

SEQ ID NO: 156415 - DNA, 630 bp, Artificial Sequence
  Description of Artificial Sequence: Synthetic coding sequence
atgagggcccctggccgcccagccctgcggcccctgcccctgccccccctgctgctgctgctgctggccgccccctggggccgggctgtgccctgtgtgtctgggggcctgcccaagccagccaacatcaccttcctgagcatcaacatgaagaatgtgctgcagtggaccccacctgagggcctgcagggcgtgaaggtgacctacacagtgcagtacttcatctacggccagaagaagtggctgaacaagtctgagtgcaggaacatcaacagaacctactgtgacctgtctgctgagaccagtgactatgagcaccagtactatgccaaggtgaaggccatctggggcaccaagtgcagcaagtgggccgagagcggccgcttctaccccttcctggagacccagatcggccccccagaggtggccctgaccacagatgagaagagcatctctgtggtgctgacagcccctgagaagtggaagagaaatcctgaggacctgcctgtgtccatgcagcagatctacagcaacctgaagtacaacgtgtctgtgctgaacaccaagagcaacagaacagtgtccctgaagtggaatggagcctacatccacgtgcccctgtgcagctag

SEQ ID NO: 156416 - DNA, 1329 bp, Artificial Sequence
  Description of Artificial Sequence: Synthetic coding sequence
atgagctacaacggcctgcaccagagggtcttcaaggagctgaagctgctgaccctgtgcagcatcagcagccagatcggccccccagaggtggccctgaccacagatgagaagagcatctctgtggtgctgacagcccctgagaagtggaagaggaaccctgaggacctgcctgtgtccatgcagcagatctacagcaacctgaagtacaacgtgtctgtgctgaacaccaagagcaacagaacctggagccagtgtgtgaccaaccacaccctggtgctgacctggctggagcccaacaccctgtactgtgtgcacgtggagagctttgtgcccggccccccccggcgggcccagcccagcgagaagcagtgtgcccggaccctgaaggaccagagcagcgagttcaaggccaagatcatcttctggtacgtgctgcctgtgtccatcaccgtcttcctgttctctgtgatgggctacagcatctaccgctacatccacgtgggcaaggagaagcacccagccaacctgatcctgatctatggaaatgaatttgacaagcgcttctttgtgcctgctgagaagatcgtcatcaacttcatcaccctgaacatcagtgatgacagcaagatcagccaccaggacatgagcctgctgggcaagagcagtgatgtgagcagcctgaatgacccccagcccagcggcaacctgcggcccccccaggaggaggaggaggtgaagcacctgggctacgccagccacctgatggagatcttctgtgacagcgaggagaacacagagggcaccagcctgacccagcaggagagcctgagcaggaccatccccccagacaagacagtcatcgagtatgaatatgatgtgaggaccacagacatctgtgccggccctgaggagcaggagctgagcctgcaggaggaggtgtccacccagggcaccctgctggagagccaggccgccctggccgtgctgggcccccagaccctgcagtacagctacaccccccagctgcaggacctggaccccctggcccaggagcacacagacagcgaggagggccctgaggaggagcccagcaccaccctggtggactgggacccccagacaggccgcctgtgcatccccagcctgagcagctttgaccaggacagcgagggctgtgagcccagtgaaggagatggcctgggggaggagggcctgctgagccggctgtatgaggagcccgccccagacaggcctcctggagaaaatgagacctacctgatgcagttcatggaggagtggggcctgtatgtgcagatggagaactag

SEQ ID NO: 156417 - DNA, 1515 bp, Artificial Sequence
  Description of Artificial Sequence: Synthetic coding sequence
atgaagaatgtgctgcagtggaccccacctgagggcctgcagggcgtgaaggtgacctacacagtgcagtacttcatctacggccagaagaagtggctgaacaagtcagaatgtagaaacatcaacagaacctactgtgacctgtctgctgagaccagtgactatgagcaccagtactatgccaaggtgaaggccatctggggcaccaagtgcagcaagtgggccgagagcggccgcttctaccccttcctggagacccagatcggccccccagaggtggccctgaccacagatgagaagagcatctctgtggtgctgacagcccctgagaagtggaagaggaaccctgaggacctgcctgtgtccatgcagcagatctacagcaacctgaagtacaacgtgtctgtgctgaacaccaagagcaacagaacctggagccagtgtgtgaccaaccacaccctggtgctgacctggctggagcccaacaccctgtactgtgtgcacgtggagagctttgtgcccggccccccccggcgggcccagcccagcgagaagcagtgtgcccggaccctgaaggaccagagcagcgagttcaaggccaagatcatcttctggtacgtgctgcctgtgtccatcaccgtcttcctgttctctgtgatgggctacagcatctaccgctacatccacgtgggcaaggagaagcacccagccaacctgatcctgatctatggaaatgaatttgacaagcgcttctttgtgcctgctgagaagatcgtcatcaacttcatcaccctgaacatcagtgatgacagcaagatcagccaccaggacatgagcctgctgggcaagagcagtgatgtgagcagcctgaatgacccccagcccagcggcaacctgcggcccccccaggaggaggaggaggtgaagcacctgggctacgccagccacctgatggagatcttctgtgacagcgaggagaacacagagggcaccagcctgacccagcaggagagcctgagcaggaccatccccccagacaagacagtcatcgagtatgaatatgatgtgaggaccacagacatctgtgccggccctgaggagcaggagctgagcctgcaggaggaggtgtccacccagggcaccctgctggagagccaggccgccctggccgtgctgggcccccagaccctgcagtacagctacaccccccagctgcaggacctggaccccctggcccaggagcacacagacagcgaggagggccctgaggaggagcccagcaccaccctggtggactgggacccccagacaggccgcctgtgcatccccagcctgagcagctttgaccaggacagcgagggctgtgagcccagtgaaggagatggcctgggggaggagggcctgctgagccggctgtatgaggagcccgccccagacaggcctcctggagaaaatgagacctacctgatgcagttcatggaggagtggggcctgtatgtgcagatggagaactag

SEQ ID NO: 156418 - DNA, 1617 bp, Artificial Sequence
  Description of Artificial Sequence: Synthetic coding sequence
atgccccggggctgggccgcccccctgctgctgctgctgctgcagggcggctggggctgcccagacctggtgtgctacacagactacctgcagaccgtcatctgcatcctggagatgtggaacctgcaccccagcaccctgaccctgacctggcaggaccagtatgaggagctgaaggatgaggccaccagctgcagcctgcacaggtctgcccacaatgccacccacgccacctacacctgccacatggatgtgttccacttcatggctgatgacatcttctctgtgaacatcacagaccagagcggcaactacagccaggagtgtggcagcttcctgctggccgagagcatcaagccagccccacccttcaacgtgacagtgaccttcagcggccagtacaacatctcctggaggagtgactatgaagatcctgccttctacatgctgaagggcaagctgcagtatgagctgcagtacagaaacagaggagacccctgggccgtgagccccaggaggaagctgatctctgtggacagccgctctgtgtccctgctgcccctggagttcaggaaggacagcagctatgagctgcaggtgcgggccggccccatgcctggcagcagctaccagggcacctggagcgagtggagcgaccccgtcatcttccagacccagagcgaggagctgaaggagggctggaacccccacctgctgctgctgctgctgctggtgattgtgttcatcccagccttctggagcctgaagacccaccccctgtggaggctgtggaagaagatctgggccgtgcccagccctgagcgcttcttcatgcccctgtacaagggctgcagcggggacttcaagaagtgggtgggcgcccccttcaccggcagcagcctggagctgggcccctggagccctgaggtgcccagcaccctggaggtgtacagctgccaccccccaagaagccctgccaagaggctgcagctgacagagctgcaggagcctgctgagctggtggagagtgatggagtgcccaagcccagcttctggcccacagcccagaacagcggcggcagcgcctacagcgaggagcgggaccggccctacggcctggtgtccattgacacagtgacagtgctggatgctgagggcccctgcacctggccctgcagctgtgaagatgatggctacccagccctggacctggatgctggcctggagcccagccctggcctggaggaccccctgctggatgctggcaccaccgtgctgagctgtggctgtgtgtctgctggcagccctggcctgggcggccccctgggcagcctgctggaccggctgaagccacccctggctgatggagaggactgggccggcggcctgccctggggcggccgcagccctgggggcgtgtctgagagcgaggccggcagccccctggccggcctggacatggacacctttgacagcggctttgtgggcagtgactgcagcagccctgtggagtgtgacttcaccagccctggagatgagggccccccaagaagctacctgcggcagtgggtggtgattcctccacccctgagcagccctggcccccaggccagctag

SEQ ID NO: 156419 - DNA, 1617 bp, Artificial Sequence; identical to SEQ ID NO: 156418
  Description of Artificial Sequence: Synthetic coding sequence

SEQ ID NO: 156420 - DNA, 1617 bp, Artificial Sequence; identical to SEQ ID NO: 156418
  Description of Artificial Sequence: Synthetic coding sequence

SEQ ID NO: 156421 - DNA, 792 bp, Artificial Sequence
  Description of Artificial Sequence: Synthetic coding sequence
atgatgcccaagcactgcttcctgggcttcctgatctccttcttcctgactggagtggccggcacccagagcacccatgagagcctgaagccccagagggtgcagttccagagcaggaacttccacaacatcctgcagtggcagcccggccgggccctgaccggcaacagctctgtgtactttgtgcagtacaagatcatgttcagctgcagcatgaagagcagccaccagaagcccagcggctgctggcagcacatcagctgcaacttccctggctgcaggaccctggccaagtatggccagaggcagtggaagaacaaggaggactgctggggcacccaggagctgagctgtgacctgaccagcgagaccagtgacatccaggagccctactacggccgggtgcgggccgccagcgctggcagctacagcgagtggagcatgaccccccgcttcaccccctggtgggagaccaagattgacccccctgtgatgaacatcacccaggtgaatggcagcctgctggtgatcctgcacgcccccaacctgccctaccgctaccagaaggagaagaatgtgtccattgaggactactatgagctgctgtacagagtcttcatcatcaacaacagcctggagaaggagcagaaggtgtatgaaggagcccacagagctgtggagattgaggccctgaccccccacagcagctactgtgtggtggccgagatctaccagcccatgctggaccggcgcagccagaggtctgaggagcgctgtgtggagatcccctag

SEQ ID NO: 156422 - DNA, 393 bp, Artificial Sequence
  Description of Artificial Sequence: Synthetic coding sequence
atgatgcccaagcactgcttcctgggcttcctgatctccttcttcctgactggagtggccggcacccagagcacccatgagagcctgaagccccagagggtgcagttccagagcaggaacttccacaacatcctgcagtggcagcccggccgggccctgaccggcaacagctctgtgtactttgtgcagtacaagatctacggccagaggcagtggaagaacaaggaggactgctggggcacccaggagctgagctgtgacctgaccagcgagaccagtgacatccaggagccctactacggccgggtgcgggccgccagcgctggcagctacagcgagtggagcatgaccccccgcttcaccccctggtgggagcgggccaagggcctgtag

SEQ ID NO: 156423 - DNA, 696 bp, Artificial Sequence
  Description of Artificial Sequence: Synthetic coding sequence
atgatgcccaagcactgcttcctgggcttcctgatctccttcttcctgactggagtggccggcacccagagcacccatgagagcctgaagccccagagggtgcagttccagagcaggaacttccacaacatcctgcagtggcagcccggccgggccctgaccggcaacagctctgtgtactttgtgcagtacaagatctacggccagaggcagtggaagaacaaggaggactgctggggcacccaggagctgagctgtgacctgaccagcgagaccagtgacatccaggagccctactacggccgggtgcgggccgccagcgctggcagctacagcgagtggagcatgaccccccgcttcaccccctggtgggagaccaagattgacccccctgtgatgaacatcacccaggtgaatggcagcctgctggtgatcctgcacgcccccaacctgccctaccgctaccagaaggagaagaatgtgtccattgaggactactatgagctgctgtacagagtcttcatcatcaacaacagcctggagaaggagcagaaggtgtatgaaggagcccacagagctgtggagattgaggccctgaccccccacagcagctactgtgtggtggccgagatctaccagcccatgctggaccggcgcagccagaggtctgaggagcgctgtgtggagatcccctag

SEQ ID NO: 156424 - DNA, 1563 bp, Artificial Sequence
  Description of Artificial Sequence: Synthetic coding sequence
atggccggccctgagcgctggggccccctgctgctgtgcctgctgcaggccgcccctggccggccccggctggccccaccccagaatgtgaccctgctgagccagaacttctctgtgtacctgacctggctgcccggcctgggcaacccccaggatgtgacctactttgtggcctaccagagcagccccacccggcggcgctggagggaggtggaggagtgtgccggcaccaaggagctgctgtgcagcatgatgtgcctgaagaagcaggacctgtacaacaagttcaagggccgggtgaggacagtgagccccagcagcaagagcccctgggtggagagcgagtacctggactacctgtttgaggtggagcccgcccctcctgtgctggtgctgacccagacagaggagatcctgagcgccaatgccacctaccagctgcccccctgcatgccacccctggacctgaagtatgaggtggccttctggaaggagggcgccggcaacaagaccctcttccctgtgaccccccacggccagcctgtgcagatcaccctgcagcctgctgccagcgagcaccactgcctgagcgcccggaccatctacaccttctctgtgcccaagtacagcaagttcagcaagcccacctgcttcctgctggaggtgcctgaggccaactgggccttcctggtgctgcccagcctgctgatcctgctgctggtgattgctgctgggggcgtcatctggaagaccctgatgggcaacccctggttccagagggccaagatgccccgggccctggacttcagcggccacacccaccctgtggccaccttccagcccagcaggcctgagagcgtgaatgacctcttcctgtgcccccagaaggagctgacccggggcgtgcggcccaccccccgggtgcgggccccagccacccagcagacccgctggaagaaggacctggccgaggatgaggaggaggaggatgaggaggacacagaagatggagtgtccttccagccctacatcgagccccccagcttcctgggccaggagcaccaggcccctggccacagcgaggccggcggcgtggacagcggccggccccgggcccccctggtgcccagcgagggcagcagcgcctgggacagcagtgaccgctcctgggccagcacagtggacagctcctgggacagagctggcagcagcggctacctggccgagaagggccctggccagggccctggaggagatggccaccaggagagcctgcccccacctgagttcagcaaggacagcggcttcctggaggagctgcctgaggacaacctgagctcctgggccacctggggcaccctgcccccagagcccaacctggtgcctgggggcccccctgtgtccctgcagaccctgaccttctgctgggagagcagccctgaggaggaggaggaggcccgggagagcgagattgaggacagtgatgctggctcctggggcgctgagagcacccagaggacagaggaccggggccgcaccctgggccactacatggccaggtag

SEQ ID NO: 156425 - DNA, 735 bp, Artificial Sequence
  Description of Artificial Sequence: Synthetic coding sequence
atggccggccctgagcgctggggccccctgctgctgtgcctgctgcaggccgcccctggccggccccggctggccccaccccagaatgtgaccctgctgagccagaacttctctgtgtacctgacctggctgcccggcctgggcaacccccaggatgtgacctactttgtggcctaccagagcagccccacccggcggcgctggagggaggtggaggagtgtgccggcaccaaggagctgctgtgcagcatgatgtgcctgaagaagcaggacctgtacaacaagttcaagggccgggtgaggacagtgagccccagcagcaagagcccctgggtggagagcgagtacctggactacctgtttgaggtggagcccgcccctcctgtgctggtgctgacccagacagaggagatcctgagcgccaatgccacctaccagctgcccccctgcatgccacccctggacctgaagtatgaggtggccttctggaaggagggcgccggcaacaagaccctcttccctgtgaccccccacggccagcctgtgcagatcaccctgcagcctgctgccagcgagcaccactgcctgagcgcccggaccatctacaccttctctgtgcccaagtacagcaagttcagcaagcccacctgcttcctgctggaggtgcccggcctcttctggacccacaccccctgtggcaacctgagcgcccagcagaccagggtgcgggagtag

SEQ ID NO: 156426 - DNA, 636 bp, Artificial Sequence
  Description of Artificial Sequence: Synthetic coding sequence
atggccggccctgagcgctggggccccctgctgctgtgcctgctgcaggccgcccctggccggccccggctggccccaccccagaatgtgaccctgctgagccagaacttctctgtgtacctgacctggctgcccggcctgggcaacccccaggatgtgacctactttgtggcctaccagagcagccccacccggcggcgctggagggaggtggaggagtgtgccggcaccaaggagctgctgtgcagcatgatgtgcctgaagaagcaggacctgtacaacaagttcaagggccgggtgaggacagtgagccccagcagcaagagcccctgggtggagagcgagtacctggactacctgtttgaggtggagcccgcccctcctgtgctggtgctgacccagacagaggagatcctgagcgccaatgccacctaccagctgcccccctgcatgccacccctggacctgaagtatgaggtggccttctggaaggagggcgccggcaacaaggtgggcagcagcttccctgccccccggctgggccccctgctgcaccccttcctgctgcgcttcttcagccccagccagcctgccccagcccccctgctgcaggaggtgtttcctgtgcacagctag

SEQ ID NO: 156427 - DNA, 558 bp, Artificial Sequence
  Description of Artificial Sequence: Synthetic coding sequence
atgatgtgcctgaagaagcaggacctgtacaacaagttcaagggccgggtgaggacagtgagccccagcagcaagagcccctgggtggagagcgagtacctggactacctgtttgaggtggagcccgcccctcctgtgctggtgctgacccagacagaggagatcctgagcgccaatgccacctaccagctgcccccctgcatgccacccctggacctgaagtatgaggtggccttctggaaggagggcgccggcaacaagaccctcttccctgtgacccctcatggccagcctgtgcagatcaccctgcagcctgctgccagcgagcaccactgcctgagcgcccggaccatctacaccttctctgtgcccaagtacagcaagttcagcaagcccacctgcttcctgctggaggtgcctgaggccaactgggccttcctggtgctgcccagcctgctgatcctgctgctggtgattgctgctggaggagtcatctggaagaccctgatgggcaacccctggttccagagggccaagatgccccgggccctggtgtag

SEQ ID NO: 156428 - DNA, 1476 bp, Artificial Sequence
  Description of Artificial Sequence: Synthetic coding sequence
atggccggccctgagcgctggggccccctgctgctgtgcctgctgcaggccgcccctggccggccccggctggccccaccccagaatgtgaccctgctgagccagaacttctctgtgtacctgacctggctgcccggcctgggcaacccccaggatgtgacctactttgtggcctaccagagcagccccacccggcggcgctggagggaggtggaggagtgtgccggcaccaaggagctgctgtgcagcatgatgtgcctgaagaagcaggacctgtacaacaagttcaagggccgggtgaggacagtgagccccagcagcaagagcccctgggtggagagcgagtacctggactacctgtttgaggtggagcccgcccctcctgtgctggtgctgacccagacagaggagatcctgagcgccaatgccacctaccagctgcccccctgcatgccacccctggacctgaagtatgaggtggccttctggaaggagggcgccggcaacaagaccctcttccctgtgaccccccacggccagcctgtgcagatcaccctgcagcctgctgccagcgagcaccactgcctgagcgcccggaccatctacaccttctctgtgcccaagtacagcaagttcagcaagcccacctgcttcctgctggaggtgcctgaggccaactgggccttcctggtgctgcccagcctgctgatcctgctgctggtgattgctgctgggggcgtcatctggaagaccctgatgggcaacccctggttccagagggccaagatgccccgggccctggagctgacccggggcgtgcggcccaccccccgggtgcgggccccagccacccagcagacccgctggaagaaggacctggctgaagatgaggaggaggaggatgaggaggacacagaagatggagtgtccttccagccctacatcgagcccccatccttcctgggccaggagcaccaggcccctggccacagcgaggccggcggcgtggacagcggccggccccgggcccccctggtgcccagcgagggcagcagcgcctgggacagcagtgaccgctcctgggccagcacagtggacagctcctgggaccgggccggcagcagcggctacctggccgagaagggccctggccagggccctggaggagatggccaccaggagagcctgcccccacctgagttcagcaaggacagcggcttcctggaggagctgcctgaggacaacctgagctcctgggccacctggggcaccctgcccccagagcccaacctggtgcctgggggcccccctgtgtccctgcagaccctgaccttctgctgggagagcagccctgaggaggaggaggaggcccgggagagcgagattgaagattctgatgctggctcctggggcgctgagagcacccagaggacagaagatcggggccgcaccctgggccactacatggccaggtag

SEQ ID NO: 156429 - DNA, 459 bp, Artificial Sequence
  Description of Artificial Sequence: Synthetic coding sequence
atgagccggctgcctgtgctgctgctgctgcagctgctggtgcggcccggcctgcaggcccccatgacccagaccacccccctgaagacctcctgggtgaactgcagcaacatgattgatgagatcatcacccacctgaagcagccccccctgcccctgctggacttcaacaacctgaatggagaggaccaggacatcctgatggagaacaacctgcggcggcccaacctggaggccttcaacagagctgtgaagagcctgcagaatgccagcgccatcgagagcatcctgaagaacctgctgccctgcctgcccctggccacagctgcccccaccaggcaccccatccacatcaaggatggagactggaatgagttccggaggaagctgaccttctacctgaagaccctggagaatgcccaggcccagcagaccaccctgagcctggccatcttctag

SEQ ID NO: 156430 - DNA, 1137 bp, Artificial Sequence
  Description of Artificial Sequence: Synthetic coding sequence
atggtgctgctgtggctgaccctgctgctgattgccctgccctgcctgctgcagaccaaggaggaccccaacccccccatcaccaacctgaggatgaaggccaaggcccagcagctgacctgggacctgaacagaaatgtgacagacattgaatgtgtgaaggatgctgactacagcatgcctgctgtgaacaacagctactgccagtttggagccatcagcctgtgtgaggtgaccaactacacagtgcgggtggccaacccccccttcagcacctggatcctcttccctgagaacagcggcaagccctgggccggggctgagaacctgacctgctggattcatgatgtggacttcctgagctgctcctgggccgtgggccctggggccccagcagatgtgcagtatgacctgtacctgaatgtggccaacagacggcagcagtatgagtgcctgcactacaagacagatgcccagggcaccagaattggctgccgctttgatgacatcagccggctgagcagcggcagccagagcagccacatcctggtgcggggccgctctgctgccttcggcatcccctgcacagacaagtttgtggtgttcagccagatcgagatcctgaccccacccaacatgacagccaagtgcaacaagacccacagcttcatgcactggaagatgaggagccacttcaacaggaagttccgctatgagctgcagatccagaagaggatgcagcccgtcatcacagagcaggtgcgggacaggaccagcttccagctgctgaaccctggcacctacacagtgcagatccgggcccgggagcgggtgtatgagttcctgagcgcctggagcaccccccagagatttgaatgtgaccaggaggagggcgccaacacccgggcctggaggaccagcctgctgattgccctgggcaccctgctggccctggtgtgtgtgtttgtgatctgccgccgctacctggtgatgcagaggctcttcccccgcatcccccacatgaaggaccccatcggggacagcttccagaatgacaagctggtggtgtgggaggccggcaaggccggcctggaggagtgcctggtgacagaggtgcaggtggtgcagaagacctag

SEQ ID NO: 156431 - DNA, 903 bp, Artificial Sequence
  Description of Artificial Sequence: Synthetic coding sequence
atggtgctgctgtggctgaccctgctgctgattgccctgccctgcctgctgcagaccaaggagggcggcaagccctgggccggggctgagaacctgacctgctggattcatgatgtggacttcctgagctgctcctgggccgtgggccctggggccccagcagatgtgcagtatgacctgtacctgaatgtggccaacagacggcagcagtatgagtgcctgcactacaagacagatgcccagggcaccagaattggctgccgctttgatgacatcagccggctgagcagcggcagccagagcagccacatcctggtgcggggccgctctgctgccttcggcatcccctgcacagacaagtttgtggtgttcagccagatcgagatcctgaccccacccaacatgacagccaagtgcaacaagacccacagcttcatgcactggaagatgaggagccacttcaacaggaagttccgctatgagctgcagatccagaagaggatgcagcccgtcatcacagagcaggtgcgggacaggaccagcttccagctgctgaaccctggcacctacacagtgcagatccgggcccgggagcgggtgtatgagttcctgagcgcctggagcaccccccagagatttgaatgtgaccaggaggagggcgccaacacccgggcctggaggaccagcctgctgattgccctgggcaccctgctggccctggtgtgtgtgtttgtgatctgccgccgctacctggtgatgcagaggctcttcccccgcatcccccacatgaaggaccccatcggggacagcttccagaatgacaagctggtggtgtgggaggccggcaaggccggcctggaggagtgcctggtgacagaggtgcaggtggtgcagaagacctag

SEQ ID NO: 156432 - DNA, 495 bp, Artificial Sequence
  Description of Artificial Sequence: Synthetic coding sequence
atggtgctgctgtggctgaccctgctgctgattgccctgccctgcctgctgcagaccaaggagggcggcaagccctgggccggggctgagaacctgacctgctggattcatgatgtggacttcctgagctgctcctgggccgtgggccctggggccccagcagatgtgcagtatgacctgtacctgaatgtggccaacagacggcagcagtatgagtgcctgcactacaagacagatgcccagggcaccagaattggctgccgctttgatgacatcagccggctgagcagcggcagccagagcagccacatcctggtgcggggccgctctgctgccttcggcatcccctgcacagacaagtttgtggtgttcagccagatcgagatcctgaccccacccaacatgacagccaagtgcaacaagacccacagcttcatgcactggaagatgaggagccacttcaacaggaagttccgctatgagctgcagatctag

SEQ ID NO: 156433 - DNA, 1323 bp, Artificial Sequence
  Description of Artificial Sequence: Synthetic coding sequence
atgacctactggaggctggagaacatcgccaagacagagccccccaagatcttccgggtgaagcctgtgctgggcatcaagaggatgatccagatcgagtggatcaagccagagctggcccctgtgtccagtgacctgaagtacaccctgcgcttcagaacagtgaacagcacctcctggatggaggtgaactttgccaagaacaggaaggacaagaaccagacctacaacctgaccggcctgcagcccttcacagaatatgtgattgccctgcgctgtgctgtgaaggagagcaagttctggagcgactggagccaggagaagatgggcatgacagaggaggaggccccctgtggcctggagctgtggagggtgctgaagccagctgaggctgatggccggcggcctgtgcggctgctgtggaagaaggcccggggggcccctgtgctggagaagaccctgggctacaacatctggtactacccagagagcaacaccaacctgacagagaccatgaacaccaccaaccagcagctggagctgcacctgggcggggagagcttctgggtgtccatgatctcctacaacagcctgggcaagagccctgtggccaccctgcgcatcccagccatccaggagaagagcttccagtgcatcgaggtgatgcaggcctgtgtggccgaggaccagctggtggtgaagtggcagagcagcgccctggatgtgaacacctggatgattgagtggttcccagatgtggacagcgagcccaccaccctgtcctgggagagcgtgtcccaggccaccaactggaccatccagcaggacaagctgaagcccttctggtgctacaacatctctgtgtaccccatgctgcatgacaaggtgggggagccctacagcatccaggcctatgccaaggagggcgtgcccagcgagggccctgagaccaaggtggagaacatcggcgtgaagacagtgaccatcacctggaaggagatccccaagtctgagaggaagggcatcatctgcaactacaccatcttctaccaggccgagggcggcaagggcttctgcaagcacgcccacagcgaggtggagaagaaccccaagccccagattgatgccatggacaggcctgtggtgggcatggccccacccagccactgtgacctgcagcccggcatgaaccacctggccagcctgaacctgtctgaaaatggagccaagagcacccacctgctgggcttctggggcctgaatgaaagtgaggtgacagtgcctgagcggcgggtgctgaggaagtggaaggagctgctgtag

SEQ ID NO: 156434 - DNA, 1989 bp, Artificial Sequence
  Description of Artificial Sequence: Synthetic coding sequence
atgaagctgagcccccagcccagctgtgtgaacctgggcatgatgtggacctgggccctgtggatgctgcccagcctgtgcaagttcagcctggccgccctgcctgccaagccagagaacatcagctgtgtgtactactacaggaagaacctgacctgcacctggagccctgggaaggagaccagctacacccagtacacagtgaagaggacctacgccttcggggagaagcatgacaactgcaccaccaacagcagcaccagtgaaaatagagccagctgcagcttcttcctgccccgcatcaccatcccagacaactacaccatcgaggtggaggccgagaatggagatggagtcatcaagagccacatgacctactggaggctggagaacatcgccaagacagagccccccaagatcttccgggtgaagcctgtgctgggcatcaagaggatgatccagatcgagtggatcaagccagagctggcccctgtgtccagtgacctgaagtacaccctgcgcttcagaacagtgaacagcacctcctggatggaggtgaactttgccaagaacaggaaggacaagaaccagacctacaacctgaccggcctgcagcccttcacagaatatgtgattgccctgcgctgtgctgtgaaggagagcaagttctggagcgactggagccaggagaagatgggcatgacagaggaggaggccccctgtggcctggagctgtggagggtgctgaagccagctgaggctgatggaagaagacctgtgcggctgctgtggaagaaggcccggggggcccctgtgctggagaagaccctgggctacaacatctggtactacccagagagcaacaccaacctgacagagaccatgaacaccaccaaccagcagctggagctgcacctgggcggggagagcttctgggtgtccatgatctcctacaacagcctgggcaagagccctgtggccaccctgcgcatcccagccatccaggagaagagcttccagtgcatcgaggtgatgcaggcctgtgtggccgaggaccagctggtggtgaagtggcagagcagcgccctggatgtgaacacctggatgattgagtggttcccagatgtggacagcgagcccaccaccctgtcctgggagagcgtgtcccaggccaccaactggaccatccagcaggacaagctgaagcccttctggtgctacaacatctctgtgtaccccatgctgcatgacaaggtgggggagccctacagcatccaggcctatgccaaggagggcgtgcccagcgagggccctgagaccaaggtggagaacattggagtgaagacagtgaccatcacctggaaggagatccccaagtctgagaggaagggcatcatctgcaactacaccatcttctaccaggccgagggcggcaagggcttcagcaagacagtgaacagcagcatcctgcagtatggcctggagagcctgaagaggaagaccagctacatcgtgcaggtgatggccagcaccagcgctgggggcaccaacggcaccagcatcaacttcaagaccctgtccttctctgtgtttgagatcatcctgatcaccagcctcatcggcggcggcctgctgatcctgatcatcctgactgtggcctacggcctgaagaagcccaacaagctgacccacctgtgctggcccaccgtgcccaacccagctgagagcagcatcgccacctggcatggagatgacttcaaggacaagctgaacctgaaggagagtgatgacagcgtgaacacagaggaccgcatcctgaagccctgcagcacccccagcgacaagctggtgattgacaagctggtggtgaactttggaaatgtgctgcaggagatcttcacagatgaggccaggacaggccaggagaacaacctgggcggggagaagaatggcacccgcatcctgagcagctgccccaccagcatctag

SEQ ID NO: 156435 - DNA, 2046 bp, Artificial Sequence
  Description of Artificial Sequence: Synthetic coding sequence
atgtgcatccggcagctgaagttcttcaccacagcctgtgtgtgtgagtgcccccagaacatcctgagcccccagcccagctgtgtgaacctgggcatgatgtggacctgggccctgtggatgctgcccagcctgtgcaagttcagcctggccgccctgcctgccaagccagagaacatcagctgtgtgtactactacaggaagaacctgacctgcacctggagccctgggaaggagaccagctacacccagtacacagtgaagaggacctacgcctttggagagaagcatgacaactgcaccaccaacagcagcaccagcgagaacagagccagctgcagcttcttcctgccccgcatcaccatcccagacaactacaccatcgaggtggaggctgaaaatggagatggagtcatcaagagccacatgacctactggaggctggagaacatcgccaagacagagccccccaagatcttccgggtgaagcctgtgctgggcatcaagaggatgatccagatcgagtggatcaagccagagctggcccctgtgtccagtgacctgaagtacaccctgcgcttcagaacagtgaacagcacctcctggatggaggtgaactttgccaagaacaggaaggacaagaaccagacctacaacctgaccggcctgcagcccttcacagaatatgtgattgccctgcgctgtgctgtgaaggagagcaagttctggagcgactggagccaggagaagatgggcatgacagaggaggaggccccctgtggcctggagctgtggagggtgctgaagccagctgaggctgatggccggcggcctgtgcggctgctgtggaagaaggcccggggggcccctgtgctggagaagaccctgggctacaacatctggtactacccagagagcaacaccaacctgacagagaccatgaacaccaccaaccagcagctggagctgcacctgggcggggagagcttctgggtgtccatgatctcctacaacagcctgggcaagagccctgtggccaccctgcgcatcccagccatccaggagaagagcttccagtgcatcgaggtgatgcaggcctgtgtggccgaggaccagctggtggtgaagtggcagagcagcgccctggatgtgaacacctggatgattgagtggttcccagatgtggacagcgagcccaccaccctgtcctgggagagcgtgtcccaggccaccaactggaccatccagcaggacaagctgaagcccttctggtgctacaacatctctgtgtaccccatgctgcatgacaaggtgggggagccctacagcatccaggcctatgccaaggagggcgtgcccagcgagggccctgagaccaaggtggagaacatcggcgtgaagacagtgaccatcacctggaaggagatccccaagtctgagaggaagggcatcatctgcaactacaccatcttctaccaggccgagggcggcaagggcttcagcaagacagtgaacagcagcatcctgcagtatggcctggagagcctgaagaggaagaccagctacatcgtgcaggtgatggccagcaccagcgctgggggcaccaacggcaccagcatcaacttcaagaccctgtccttctctgtgtttgagatcatcctgatcaccagcctgattggaggcggcctgctgatcctgatcatcctgactgtggcctacggcctgaagaagcccaacaagctgacccacctgtgctggcccaccgtgcccaacccagctgagagcagcatcgccacctggcatggagatgacttcaaggacaagctgaacctgaaggagagtgatgattctgtgaacacagaagatcgcatcctgaagccctgcagcacccccagcgacaagctggtgattgacaagctggtggtgaactttggaaatgtgctgcaggagatcttcacagatgaggccaggacaggccaggagaacaacctgggcggggagaagaatggcacccgcatcctgagcagctgccccaccagcatctag

SEQ ID NO: 156436 - DNA, 1989 bp, Artificial Sequence; identical to SEQ ID NO: 156434
  Description of Artificial Sequence: Synthetic coding sequence

SEQ ID NO: 156437 - DNA, 1749 bp, Artificial Sequence
  Description of Artificial Sequence: Synthetic coding sequence
atgtgcatccggcagctgaagttcttcaccacagcctgtgtgtgtgagtgcccccagaacatcctgagcccccagcccagctgtgtgaacctgggcatgatgtggacctgggccctgtggatgctgcccagcctgtgcaagttcagcctggccgccctgcctgccaagccagagaacatcagctgtgtgtactactacaggaagaacctgacctgcacctggagccctgggaaggagaccagctacacccagtacacagtgaagaggacctacgcctttggagagaagcatgacaactgcaccaccaacagcagcaccagcgagaacagagccagctgcagcttcttcctgccccgcatcaccatcccagacaactacaccatcgaggtggaggctgaaaatggagatggagtcatcaagagccacatgacctactggaggctggagaacatcgccaagacagagccccccaagatcttccgggtgaagcctgtgctgggcatcaagaggatgatccagatcgagtggatcaagccagagctggcccctgtgtccagtgacctgaagtacaccctgcgcttcagaacagtgaacagcacctcctggatggaggtgaactttgccaagaacaggaaggacaagaaccagacctacaacctgaccggcctgcagcccttcacagaatatgtgattgccctgcgctgtgctgtgaaggagagcaagttctggagcgactggagccaggagaagatgggcatgacagaggaggaggccccctgtggcctggagctgtggagggtgctgaagccagctgaggctgatggccggcggcctgtgcggctgctgtggaagaaggcccggggggcccctgtgctggagaagaccctgggctacaacatctggtactacccagagagcaacaccaacctgacagagaccatgaacaccaccaaccagcagctggagctgcacctgggcggggagagcttctgggtgtccatgatctcctacaacagcctgggcaagagccctgtggccaccctgcgcatcccagccatccaggagaagagcttccagtgcatcgaggtgatgcaggcctgtgtggccgaggaccagctggtggtgaagtggcagagcagcgccctggatgtgaacacctggatgattgagtggttcccagatgtggacagcgagcccaccaccctgtcctgggagagcgtgtcccaggccaccaactggaccatccagcaggacaagctgaagcccttctggtgctacaacatctctgtgtaccccatgctgcatgacaaggtgggggagccctacagcatccaggcctatgccaaggagggcgtgcccagcgagggccctgagaccaaggtggagaacatcggcgtgaagacagtgaccatcacctggaaggagatccccaagtctgagaggaagggcatcatctgcaactacaccatcttctaccaggccgagggcggcaagggcttctgcaagcacgcccacagcgaggtggagaagaaccccaagccccagattgatgccatggacaggcctgtggtgggcatggccccacccagccactgtgacctgcagcccggcatgaaccacctggccagcctgaacctgtctgaaaatggagccaagagcacccacctgctgggcttctggggcctgaatgaaagtgaggtgacagtgcctgagcggcgggtgctgaggaagtggaaggagctgctgtag

SEQ ID NO: 156438 - DNA, 2295 bp, Artificial Sequence
  Description of Artificial Sequence: Synthetic coding sequence
atgtgcatccggcagctgaagttcttcaccacagcctgtgtgtgtgagtgcccccagaacatcctgagcccccagcccagctgtgtgaacctgggcatgatgtggacctgggccctgtggatgctgcccagcctgtgcaagttcagcctggccgccctgcctgccaagccagagaacatcagctgtgtgtactactacaggaagaacctgacctgcacctggagccctgggaaggagaccagctacacccagtacacagtgaagaggacctacgcctttggagagaagcatgacaactgcaccaccaacagcagcaccagcgagaacagagccagctgcagcttcttcctgccccgcatcaccatcccagacaactacaccatcgaggtggaggctgaaaatggagatggagtcatcaagagccacatgacctactggaggctggagaacatcgccaagacagagccccccaagatcttccgggtgaagcctgtgctgggcatcaagaggatgatccagatcgagtggatcaagccagagctggcccctgtgtccagtgacctgaagtacaccctgcgcttcagaacagtgaacagcacctcctggatggaggtgaactttgccaagaacaggaaggacaagaaccagacctacaacctgaccggcctgcagcccttcacagaatatgtgattgccctgcgctgtgctgtgaaggagagcaagttctggagcgactggagccaggagaagatgggcatgacagaggaggaggccccctgtggcctggagctgtggagggtgctgaagccagctgaggctgatggccggcggcctgtgcggctgctgtggaagaaggcccggggggcccctgtgctggagaagaccctgggctacaacatctggtactacccagagagcaacaccaacctgacagagaccatgaacaccaccaaccagcagctggagctgcacctgggcggggagagcttctgggtgtccatgatctcctacaacagcctgggcaagagccctgtggccaccctgcgcatcccagccatccaggagaagagcttccagtgcatcgaggtgatgcaggcctgtgtggccgaggaccagctggtggtgaagtggcagagcagcgccctggatgtgaacacctggatgattgagtggttcccagatgtggacagcgagcccaccaccctgtcctgggagagcgtgtcccaggccaccaactggaccatccagcaggacaagctgaagcccttctggtgctacaacatctctgtgtaccccatgctgcatgacaaggtgggggagccctacagcatccaggcctatgccaaggagggcgtgcccagcgagggccctgagaccaaggtggagaacatcggcgtgaagacagtgaccatcacctggaaggagatccccaagtctgagaggaagggcatcatctgcaactacaccatcttctaccaggccgagggcggcaagggcttcagcaagacagtgaacagcagcatcctgcagtatggcctggagagcctgaagaggaagaccagctacatcgtgcaggtgatggccagcaccagcgctgggggcaccaacggcaccagcatcaacttcaagaccctgtccttctctgtgtttgagatcatcctgatcaccagcctgattggaggcggcctgctgatcctgatcatcctgactgtggcctacggcctgaagaagcccaacaagctgacccacctgtgctggcccaccgtgcccaacccagctgagagcagcatcgccacctggcatggagatgacttcaaggacaagctgaacctgaaggagagtgatgattctgtgaacacagaagatcgcatcctgaagccctgcagcacccccagcgacaagctggtgattgacaagctggtggtgaactttggaaatgtgctgcaggagatcttcacagatgaggccaggacaggccaggagaacaacctgggcggggagaagaatggctacgtgacctgccccttccggccagactgccccctgggcaagagctttgaggagctgcctgtgtccccagagatcccccccaggaagagccagtacctgcggagcaggatgcctgagggcaccaggcctgaggccaaggagcagctgctcttcagcggccagagcctggtgcctgaccacctgtgtgaggagggcgcccccaacccctacctgaagaacagcgtgacagcccgggagttcctggtgtctgagaagctgcctgagcacaccaagggggaggtgtag

SEQ ID NO: 156439 - DNA, 1869 bp, Artificial Sequence
  Description of Artificial Sequence: Synthetic coding sequence
atgacctactggaggctggagaacatcgccaagacagagccccccaagatcttccgggtgaagcctgtgctgggcatcaagaggatgatccagatcgagtggatcaagccagagctggcccctgtgtccagtgacctgaagtacaccctgcgcttcagaacagtgaacagcacctcctggatggaggtgaactttgccaagaacaggaaggacaagaaccagacctacaacctgaccggcctgcagcccttcacagaatatgtgattgccctgcgctgtgctgtgaaggagagcaagttctggagcgactggagccaggagaagatgggcatgacagaggaggaggccccctgtggcctggagctgtggagggtgctgaagccagctgaggctgatggccggcggcctgtgcggctgctgtggaagaaggcccggggggcccctgtgctggagaagaccctgggctacaacatctggtactacccagagagcaacaccaacctgacagagaccatgaacaccaccaaccagcagctggagctgcacctgggcggggagagcttctgggtgtccatgatctcctacaacagcctgggcaagagccctgtggccaccctgcgcatcccagccatccaggagaagagcttccagtgcatcgaggtgatgcaggcctgtgtggccgaggaccagctggtggtgaagtggcagagcagcgccctggatgtgaacacctggatgattgagtggttcccagatgtggacagcgagcccaccaccctgtcctgggagagcgtgtcccaggccaccaactggaccatccagcaggacaagctgaagcccttctggtgctacaacatctctgtgtaccccatgctgcatgacaaggtgggggagccctacagcatccaggcctatgccaaggagggcgtgcccagcgagggccctgagaccaaggtggagaacatcggcgtgaagacagtgaccatcacctggaaggagatccccaagtctgagaggaagggcatcatctgcaactacaccatcttctaccaggccgagggcggcaagggcttcagcaagacagtgaacagcagcatcctgcagtatggcctggagagcctgaagaggaagaccagctacatcgtgcaggtgatggccagcaccagcgctgggggcaccaacggcaccagcatcaacttcaagaccctgtccttctctgtgtttgagatcatcctgatcaccagcctgattggaggcggcctgctgatcctgatcatcctgactgtggcctacggcctgaagaagcccaacaagctgacccacctgtgctggcccaccgtgcccaacccagctgagagcagcatcgccacctggcatggagatgacttcaaggacaagctgaacctgaaggagagtgatgattctgtgaacacagaagatcgcatcctgaagccctgcagcacccccagcgacaagctggtgattgacaagctggtggtgaactttggaaatgtgctgcaggagatcttcacagatgaggccaggacaggccaggagaacaacctgggcggggagaagaatggctacgtgacctgccccttccggccagactgccccctgggcaagagctttgaggagctgcctgtgtccccagagatcccccccaggaagagccagtacctgcggagcaggatgcctgagggcaccaggcctgaggccaaggagcagctgctcttcagcggccagagcctggtgcctgaccacctgtgtgaggagggcgcccccaacccctacctgaagaacagcgtgacagcccgggagttcctggtgtctgagaagctgcctgagcacaccaagggggaggtgtag

SEQ ID NO: 156440 - DNA, 468 bp, Artificial Sequence
  Description of Artificial Sequence: Synthetic coding sequence
atggtgctgagcggggccctgtgcttcaggatgaaggacagcgccctgaaggtgctgtacctgcacaacaaccagctgctggccggcggcctgcatgctgggaaggtgatcaagggggaggagatctctgtggtgcccaaccgctggctggatgccagcctgagccctgtgatcctgggcgtgcagggcggcagccagtgcctgagctgtggggtgggccaggagcccaccctgaccctggagcctgtgaacatcatggagctgtacctgggcgccaaggagagcaagagcttcaccttctaccgccgggacatgggcctgaccagcagctttgaatctgctgcctacccaggctggttcctgtgcaccgtgcctgaggccgaccagcctgtgcggctgacccagctgcctgaaaatggaggctggaatgcccccatcacagacttctacttccagcagtgtgactag

SEQ ID NO: 156441 - DNA, 468 bp, Artificial Sequence; identical to SEQ ID NO: 156440
  Description of Artificial Sequence: Synthetic coding sequence

SEQ ID NO: 156442 - DNA, 354 bp, Artificial Sequence
  Description of Artificial Sequence: Synthetic coding sequence
atggtgctgagcggggccctgtgcttcaggatgaaggacagcgccctgaaggtgctgtacctgcacaacaaccagctgctggccggcggcctgcatgctgggaaggtgatcaagggggaggagatctctgtggtgcccaaccgctggctggatgccagcctgagccctgtgatcctgggcgtgcagggcggcagccagtgcctgagctgtggggtgggccaggagcccaccctgaccctggagcctgtgaacatcatggagctgtacctgggcgccaaggagagcaagagcttcaccttctaccgccgggacatgggcctgaccagcagctttgaatctgctgcctacccctag

SEQ ID NO: 156443 - DNA, 2478 bp, Artificial Sequence
  Description of Artificial Sequence: Synthetic coding sequence
atgggctggctgtgcagcggcctgctcttccctgtgtcctgcctggtgctgctgcaggtggccagcagcggcaacatgaaggtgctgcaggagcccacctgtgtgtctgactacatgagcatcagcacctgtgagtggaagatgaatggccccaccaactgcagcacagagctgcggctgctgtaccagctggtgttcctgctgtctgaggcccacacctgcatcccagaaaataatggaggagctggctgtgtgtgccacctgctgatggatgatgtggtgtctgctgacaactacaccctggacctgtgggccggccagcagctgctgtggaagggcagcttcaagcccagcgagcacgtgaagccccgggcccctggcaacctgactgtgcacaccaacgtgtctgacaccctgctgctgacctggagcaacccctaccccccagacaactacctgtacaaccacctgacctatgctgtgaacatctggagcgaaaatgaccctgctgacttccgcatctacaacgtgacctacctggagcccagcctgagaattgctgccagcaccctgaagagcggcatctcctaccgggcccgggtgcgggcctgggcccagtgctacaacaccacctggagcgagtggagccccagcaccaagtggcacaacagctaccgggagccctttgagcagcacctgctgctgggcgtgtctgtgtcctgcatcgtcatcctggccgtgtgcctgctgtgctacgtgtccatcaccaagatcaagaaggagtggtgggaccagatccccaacccagcccggagccggctggtggccatcatcatccaggatgcccagggcagccagtgggagaagaggagccggggccaggagcccgccaagtgcccccactggaagaactgcctgaccaagctgctgccctgcttcctggagcacaacatgaagagagatgaggacccccacaaggccgccaaggagatgcccttccagggcagcggcaagagcgcctggtgccctgtggagatcagcaagacagtgctgtggccagagagcatctctgtggtgcgctgtgtggagctgtttgaggcccctgtggagtgtgaggaggaggaggaggtggaggaggagaagggcagcttctgtgccagccctgagagcagcagagatgacttccaggagggccgggagggcatcgtggcccggctgacagagagcctcttcctggacctgctgggggaggagaatggaggcttctgccagcaggacatgggagagagctgcctgctgccccccagcggcagcaccagcgcccacatgccctgggatgagttccccagcgctggccccaaggaggccccaccctggggcaaggagcagcccctgcacctggagcccagccccccagccagccccacccagagcccagacaacctgacctgcacagagacccccctggtgattgctggcaacccagcctaccgctccttcagcaacagcctgagccagagcccctgcccccgggagctgggccctgaccccctgctggcccggcacctggaggaggtggagcctgagatgccctgtgtgccccagctgtctgagcccaccaccgtgccccagcctgagcctgagacctgggagcagatcctgcggagaaatgtgctgcagcacggggctgctgctgcccctgtgtctgcccccaccagcggctaccaggagtttgtgcatgctgtggagcagggcggcacccaggccagcgctgtggtgggcctgggccccccaggagaggccggctacaaggccttcagcagcctgctggccagcagcgctgtgtccccagagaagtgtggctttggagccagcagcggggaggagggctacaagcccttccaggacctgatccctggctgccctggggaccctgcccctgtgcctgtgcccctcttcaccttcggcctggaccgggagcccccaagaagcccccagagcagccacctgcccagcagcagccctgagcacctgggcctggagcccggggagaaggtggaggacatgcccaagccacccctgccccaggagcaggccacagaccccctggtggacagcctgggcagcggcatcgtgtacagcgccctgacctgccacctgtgtggccacctgaagcagtgccacggccaggaggatggcggccagacccctgtgatggccagcccctgctgcggctgctgctgcggggacaggagcagcccccccaccacccccctgcgggccccagaccccagccctgggggcgtgcccctggaggccagcctgtgcccagccagcctggcccccagcggcatcagcgagaagagcaagagcagcagcagcttccacccagcccctggaaatgcccagagcagcagccagacccccaagatcgtgaactttgtgtctgtgggccccacctacatgagggtgtcctag

SEQ ID NO: 156444 - DNA, 2433 bp, Artificial Sequence
  Description of Artificial Sequence: Synthetic coding sequence
atgcagaaggatgcccggcgggagggcaacatgaaggtgctgcaggagcccacctgtgtgtctgactacatgagcatcagcacctgtgagtggaagatgaatggccccaccaactgcagcacagagctgcggctgctgtaccagctggtgttcctgctgtctgaggcccacacctgcatccctgagaacaacggcggggccggctgtgtgtgccacctgctgatggatgatgtggtgtctgctgacaactacaccctggacctgtgggccggccagcagctgctgtggaagggcagcttcaagcccagcgagcacgtgaagccccgggcccctggcaacctgactgtgcacaccaacgtgtctgacaccctgctgctgacctggagcaacccctaccccccagacaactacctgtacaaccacctgacctatgctgtgaacatctggagcgaaaatgaccctgctgacttccgcatctacaacgtgacctacctggagcccagcctgagaattgctgccagcaccctgaagagcggcatctcctaccgggcccgggtgcgggcctgggcccagtgctacaacaccacctggagcgagtggagccccagcaccaagtggcacaacagctaccgggagccctttgagcagcacctgctgctgggcgtgtctgtgtcctgcatcgtcatcctggccgtgtgcctgctgtgctacgtgtccatcaccaagatcaagaaggagtggtgggaccagatccccaacccagcccggagccggctggtggccatcatcatccaggatgcccagggcagccagtgggagaagaggagccggggccaggagcccgccaagtgcccccactggaagaactgcctgaccaagctgctgccctgcttcctggagcacaacatgaagagagatgaggacccccacaaggccgccaaggagatgcccttccagggcagcggcaagagcgcctggtgccctgtggagatcagcaagacagtgctgtggccagagagcatctctgtggtgcgctgtgtggagctgtttgaggcccctgtggagtgtgaggaggaggaggaggtggaggaggagaagggcagcttctgtgccagccctgagagcagcagagatgacttccaggagggccgggagggcatcgtggcccggctgacagagagcctcttcctggacctgctgggggaggagaatggaggcttctgccagcaggacatgggagagagctgcctgctgcccccatctggcagcaccagcgcccacatgccctgggatgagttccccagcgctggccccaaggaggccccaccctggggcaaggagcagcccctgcacctggagcccagccccccagccagccccacccagagcccagacaacctgacctgcacagagacccccctggtgattgctggcaacccagcctaccgctccttcagcaacagcctgagccagagcccctgcccccgggagctgggccctgaccccctgctggcccggcacctggaggaggtggagcctgagatgccctgtgtgccccagctgtctgagcccaccaccgtgccccagcctgagcctgagacctgggagcagatcctgcggagaaatgtgctgcagcacggggctgctgctgcccctgtgtctgcccccaccagcggctaccaggagtttgtgcatgctgtggagcagggcggcacccaggccagcgctgtggtgggcctgggccccccaggagaggccggctacaaggccttcagcagcctgctggccagcagcgctgtgtccccagagaagtgtggctttggagccagcagtggagaggagggctacaagcccttccaggacctgatccctggctgccctggggaccctgcccctgtgcctgtgcccctcttcaccttcggcctggaccgggagccccccaggagcccccagagcagccacctgcccagcagcagccctgagcacctgggcctggagcctggagagaaggtggaggacatgcccaagccacccctgccccaggagcaggccacagaccccctggtggacagcctgggcagcggcatcgtgtacagcgccctgacctgccacctgtgtggccacctgaagcagtgccacggccaggaggatggcggccagacccctgtgatggccagcccctgctgcggctgctgctgcggggacaggagcagcccccccaccacccccctgcgggccccagaccccagccctggaggagtgcccctggaggccagcctgtgcccagccagcctggcccccagcggcatcagcgagaagagcaagagcagcagcagcttccacccagcccctggaaatgcccagagcagcagccagacccccaagatcgtgaactttgtgtctgtgggccccacctacatgagggtgtcctag

SEQ ID NO: 156445 - DNA, 684 bp, Artificial Sequence
  Description of Artificial Sequence: Synthetic coding sequence
atgggctggctgtgcagcggcctgctcttccctgtgtcctgcctggtgctgctgcaggtggccagcagcggcaacatgaaggtgctgcaggagcccacctgtgtgtctgactacatgagcatcagcacctgtgagtggaagatgaatggccccaccaactgcagcacagagctgcggctgctgtaccagctggtgttcctgctgtctgaggcccacacctgcatcccagaaaataatggaggagctggctgtgtgtgccacctgctgatggatgatgtggtgtctgctgacaactacaccctggacctgtgggccggccagcagctgctgtggaagggcagcttcaagcccagcgagcacgtgaagccccgggcccctggcaacctgactgtgcacaccaacgtgtctgacaccctgctgctgacctggagcaacccctaccccccagacaactacctgtacaaccacctgacctatgctgtgaacatctggagcgaaaatgaccctgctgacttccgcatctacaacgtgacctacctggagcccagcctgagaattgctgccagcaccctgaagagcggcatctcctaccgggcccgggtgcgggcctgggcccagtgctacaacaccacctggagcgagtggagccccagcaccaagtggcacaacttctctgtgtgctag

SEQ ID NO: 156446 - DNA, 2478 bp, Artificial Sequence; identical to SEQ ID NO: 156443
  Description of Artificial Sequence: Synthetic coding sequence

SEQ ID NO: 156447 - DNA, 684 bp, Artificial Sequence
  Description of Artificial Sequence: Synthetic coding sequence
atgggctggctgtgcagcggcctgctcttccctgtgtcctgcctggtgctgctgcaggtggccagcagcggcaacatgaaggtgctgcaggagcccacctgtgtgtctgactacatgagcatcagcacctgtgagtggaagatgaatggccccaccaactgcagcacagagctgcggctgctgtaccagctggtgttcctgctgtctgaggcccacacctgcatcccagaaaataatggaggagctggctgtgtgtgccacctgctgatggatgatgtggtgtctgctgacaactacaccctggacctgtgggccggccagcagctgctgtggaagggcagcttcaagcccagcgagcacgtgaagccccgggcccctggcaacctgactgtgcacaccaacgtgtctgacaccctgctgctgacctggagcaacccctaccccccagacaactacctgtacaaccacctgacctatgctgtgaacatctggagcgaaaatgaccctgctgacttccgcatctacaacgtgacctacctggagcccagcctgagaattgctgccagcaccctgaagagcggcatctcctaccgggcccgggtgcgggcctgggcccagtgctacaacaccacctggagcgagtggagccccagcaccaagtggcacaacagcaacatctgctag

SEQ ID NO: 156448 - DNA, 2478 bp, Artificial Sequence; identical to SEQ ID NO: 156443
  Description of Artificial Sequence: Synthetic coding sequence

SEQ ID NO: 156449 - DNA, 1263 bp, Artificial Sequence
  Description of Artificial Sequence: Synthetic coding sequence
atgatcatcgtggcccacgtgctgctgatcctgctgggcgccacagagatcctgcaggccgacctgctgcctgatgagaagatcagcctgctgccccctgtgaacttcaccatcaaggtgacaggcctggcccaggtgctgctgcagtggaagcccaacccagaccaggagcagagaaatgtgaacctggagtaccaggtgaagatcaatgcccccaaggaggatgattatgagacccgcatcacagagagcaaatgtgtgaccatcctgcacaagggcttcagcgcctctgtgaggaccatcctgcagaatgaccacagcctgctggccagctcctgggccagcgctgagctgcacgcccctcctggcagccctggcaccagcatcgtgaacctgacctgcaccaccaacaccacagaggacaactacagccggctgcggagctaccaggtgtccctgcactgcacctggctggtgggcacagatgcccctgaggacacccagtacttcctgtactaccgctatggctcctggacagaggagtgccaggagtacagcaaggacaccctgggcaggaacatcgcctgctggttccccaggaccttcatcctgagcaagggccgggactggctggccgtgctggtgaatggcagcagcaagcacagcgccatccggccctttgaccagctgtttgccctgcacgccatcgaccagatcaacccccccctgaatgtgacagctgagattgagggcacccggctgagcatccagtgggagaagcctgtgtctgccttccccatccactgctttgattatgaggtgaagatccacaacaccagaaatggctacctgcagatcgagaagctgatgaccaatgccttcatcagcatcattgatgacctgagcaaatatgatgtgcaggtgcgggctgctgtgtcctccatgtgccgggaggccggcctgtggagcgagtggagccagcccatctacgtgggcaatgatgagcacaagcccctgcgggagtggtttgtgattgtcatcatggccaccatctgcttcatcctgctgatcctgagcctcatctgcaagatctgccacctgtggatcaagctgtttcctcccatcccagcccccaagagcaacatcaaggacctgtttgtgaccaccaactatgagaaggccggcagcagcgagacagaaattgaagtcatctgctacatcgagaagccaggagtggagaccctggaggacagcgtcttctag

SEQ ID NO: 156450 - DNA, 1008 bp, Artificial Sequence
  Description of Artificial Sequence: Synthetic coding sequence
atgatcatcgtggcccacgtgctgctgatcctgctgggcgccacagagatcctgcaggccgacctgctgcctgatgagaagatcagcctgctgccccctgtgaacttcaccatcaaggtgacaggcctggcccaggtgctgctgcagtggaagcccaacccagaccaggagcagagaaatgtgaacctggagtaccaggtgaagatcaatgcccccaaggaggatgattatgagacccgcatcacagagagcaaatgtgtgaccatcctgcacaagggcttcagcgcctctgtgaggaccatcctgcagaatgaccacagcctgctggccagctcctgggccagcgctgagctgcacgcccctcctggcagccctggcaccagcatcgtgaacctgacctgcaccaccaacaccacagaggacaactacagccggctgcggagctaccaggtgtccctgcactgcacctggctggtgggcacagatgcccctgaggacacccagtacttcctgtactaccgctatggctcctggacagaggagtgccaggagtacagcaaggacaccctgggcaggaacatcgcctgctggttccccaggaccttcatcctgagcaagggccgggactggctggccgtgctggtgaatggcagcagcaagcacagcgccatccggccctttgaccagctgtttgccctgcacgccatcgaccagatcaacccccccctgaatgtgacagctgagattgagggcacccggctgagcatccagtgggagaagcctgtgtctgccttccccatccactgctttgattatgaggtgaagatccacaacaccagaaatggctacctgcagatcgagaagctgatgaccaatgccttcatcagcatcattgatgacctgagcaaatatgatgtgcaggtgcgggctgctgtgtcctccatgtgccgggaggccggcctgtggagcgagtggagccagcccatctacgtgggcttcagcaggtag

SEQ ID NO: 156451 - DNA, 453 bp, Artificial Sequence
  Description of Artificial Sequence: Synthetic coding sequence
atgaccaatgccttcatcagcatcattgatgacctgagcaaatatgatgtgcaggtgcgggctgctgtgtcctccatgtgccgggaggccggcctgtggagcgagtggagccagcccatctacgtgggcaatgatgagcacaagcccctgcgggagtggtttgtgattgtcatcatggccaccatctgcttcatcctgctgatcctgagcctcatctgcaagatctgccacctgtggatcaagctgttcccccccatcccagcccccaagagcaacatcaaggacctgtttgtgaccaccaactatgaggtgctgtgcatcttcatctacatcctggacagcgctgacaacttcctgcagaagaagaaggccggcagcagcgagacagaaattgaagtcatctgctacatcgagaagccaggagtggagaccctggaggacagcgtcttctag

SEQ ID NO: 156452 - DNA, 1008 bp, Artificial Sequence; identical to SEQ ID NO: 156450
  Description of Artificial Sequence: Synthetic coding sequence

SEQ ID NO: 156453 - DNA, 978 bp, Artificial Sequence
  Description of Artificial Sequence: Synthetic coding sequence
atgatcatcgtggcccacgtgctgctgatcctgctgggcgccacagagatcctgcaggccgacctgctgcctgatgagaagatcagcctgctgccccctgtgaacttcaccatcaaggtgacaggcctggcccaggtgctgctgcagtggaagcccaacccagaccaggagcagagaaatgtgaacctggagtaccaggtgaagatcaatgcccccaaggaggatgattatgagacccgcatcacagagagcaaatgtgtgaccatcctgcacaagggcttcagcgcctctgtgaggaccatcctgcagaatgaccacagcctgctggccagctcctgggccagcgctgagctgcacgcccctcctggcagccctggcaccagcatcgtgaacctgacctgcaccaccaacaccacagaggacaactacagccggctgcggagctaccaggtgtccctgcactgcacctggctggtgggcacagatgcccctgaggacacccagtacttcctgtactaccgctatggctcctggacagaggagtgccaggagtacagcaaggacaccctgggcaggaacatcgcctgctggttccccaggaccttcatcctgagcaagggccgggactggctggccgtgctggtgaatggcagcagcaagcacagcgccatccggccctttgaccagctgtttgccctgcacgccatcggaaatgatgagcacaagcccctgcgggagtggtttgtgattgtcatcatggccaccatctgcttcatcctgctgatcctgagcctcatctgcaagatctgccacctgtggatcaagctgttcccccccatcccagcccccaagagcaacatcaaggacctgtttgtgaccaccaactatgagaaggccggcagcagcgagacagaaattgaggtgatctgctacatcgagaagccaggagtggagaccctggaggacagcgtcttctag

SEQ ID NO: 156454 - DNA, 330 bp, Artificial Sequence
  Description of Artificial Sequence: Synthetic coding sequence
atgatcatcgtggcccacgtgctgctgatcctgctgggcgccacagagatcctgcaggccgacctgctgcctgatgagaagatcagcctgctgccccctgtgaacttcaccatcaaggtgacaggcctggcccaggtgctgctgcagtggaagcccaacccagaccaggagcagagaaatgtgaacctggagtaccaggtgaagatcaatgcccccaaggaggatgattatgagacccgcatcacagagagcaaatgtgtgaccatcctgcacaagggcttcagcgcctctgtgaggaccatcctgcagaatgaccacagcctgctgtag

SEQ ID NO: 156455 - DNA, 1002 bp, Artificial Sequence
  Description of Artificial Sequence: Synthetic coding sequence
atgatcatcgtggcccacgtgctgctgatcctgctgggcgccacagagatcctgcaggccgacctgctgcctgatgagaagatcagcctgctgccccctgtgaacttcaccatcaaggtgacaggcctggcccaggtgctgctgcagtggaagcccaacccagaccaggagcagagaaatgtgaacctggagtaccaggtgaagatcaatgcccccaaggaggatgattatgagacccgcatcacagagagcaaatgtgtgaccatcctgcacaagggcttcagcgcctctgtgaggaccatcctgcagaatgaccacagcctgctggccagctcctgggccagcgctgagctgcacgcccctcctggcagccctggcaccagcatcgtgaacctgacctgcaccaccaacaccacagaggacaactacagccggctgcggagctaccaggtgtccctgcactgcacctggctggtgggcacagatgcccctgaggacacccagtacttcctgtactaccgctatggctcctggacagaggagtgccaggagtacagcaaggacaccctgggcaggaacatcgcctgctggttccccaggaccttcatcctgagcaagggccgggactggctggccgtgctggtgaatggcagcagcaagcacagcgccatccggccctttgaccagctgtttgccctgcacgccatcgaccagatcaacccccccctgaatgtgacagctgagattgagggcacccggctgagcatccagtgggagaagcctgtgtctgccttccccatccactgctttgattatgaggtgaagatccacaacaccagaaatggctacctgcagatcgagaagctgatgaccaatgccttcatcagcatcattgatgacctgagcaaatatgatgtgcaggtgcgggctgctgtgtcctccatgtgccgggaggccggcctgtggagcgagtggagccagcccatctacgtgggcaagtag

SEQ ID NO: 156456 - DNA, 1137 bp, Artificial Sequence
  Description of Artificial Sequence: Synthetic coding sequence
atgatcatcgtggcccacgtgctgctgatcctgctgggcgccacagagatcctgcaggccgacctgctgcctgatgagaagatcagcctgctgccccctgtgaacttcaccatcaaggtgacaggcctggcccaggtgctgctgcagtggaagcccaacccagaccaggagcagagaaatgtgaacctggagtaccaggtgaagatcaatgcccccaaggaggatgattatgagacccgcatcacagagagcaaatgtgtgaccatcctgcacaagggcttcagcgcctctgtgaggaccatcctgcagaatgaccacagcctgctggccagctcctgggccagcgctgagctgcacgcccctcctggcagccctggcaccagcatcgtgaacctgacctgcaccaccaacaccacagaggacaactacagccggctgcggagctaccaggtgtccctgcactgcacctggctggtgggcacagatgcccctgaggacacccagtacttcctgtactaccgctatggctcctggacagaggagtgccaggagtacagcaaggacaccctgggcaggaacatcgcctgctggttccccaggaccttcatcctgagcaagggccgggactggctggccgtgctggtgaatggcagcagcaagcacagcgccatccggccctttgaccagctgtttgccctgcacgccatcgaccagatcaacccccccctgaatgtgacagctgagattgagggcacccggctgagcatccagtgggagaagcctgtgtctgccttccccatccactgctttgattatgaggtgaagatccacaacaccagaaatggctacctgcagatcgagaagctgatgaccaatgccttcatcagcatcattgatgacctgagcaaatatgatgtgcaggtgcgggctgctgtgtcctccatgtgccgggaggccggcctgtggagcgagtggagccagcccatctacgtgggcaatgatgagcacaagcccctgcgggagtggtttgtgattgtcatcatggccaccatctgcttcatcctgctgatcctgagcctcatctgcaagatcaagctgggccctgtgcggaggaagctgaagagcagcgtcatctag

SEQ ID NO: 156457 - DNA, 591 bp, Artificial Sequence
  Description of Artificial Sequence: Synthetic coding sequence
atgatcatcgtggcccacgtgctgctgatcctgctgggcgccacagagatcctgcaggccgacctgctgcctgatgagaagatcagcctgctgccccctgtgaacttcaccatcaaggtgacaggcctggcccaggtgctgctgcagtggaagcccaacccagaccaggagcagagaaatgtgaacctggagtaccaggtgaagatcaatgcccccaaggaggatgattatgagacccgcatcacagagagcaaatgtgtgaccatcctgcacaagggcttcagcgcctctgtgaggaccatcctgcagaatgaccacagcctgctggccagctcctgggccagcgctgagctgcacgcccctcctggcagccctggcaccagcatcgtgaacctgacctgcaccaccaacaccacagaggacaactacagccggctgcggagctaccaggtgtccctgcactgcacctggctggtgggcacagatgcccctgaggacacccagtacttcctgtactaccgctatggctcctggacagaggagtgccaggagtacagcaaggacaccctgggcaggaacatcgcctgctag

SEQ ID NO: 156458 - DNA, 636 bp, Artificial Sequence
  Description of Artificial Sequence: Synthetic coding sequence
atgatcatcgtggcccacgtgctgctgatcctgctgggcgccacagagatcctgcaggccgacctgctgcctgatgagaagatcagcctgctgccccctgtgaacttcaccatcaaggtgacaggcctggcccaggtgctgctgcagtggaagcccaacccagaccaggagcagagaaatgtgaacctggagtaccaggtgaagatcaatgcccccaaggaggatgattatgagacccgcatcacagagagcaaatgtgtgaccatcctgcacaagggcttcagcgcctctgtgaggaccatcctgcagaatgaccacagcctgctggccagctcctgggccagcgctgagctgcacgcccctcctggaaatgatgagcacaagcccctgcgggagtggtttgtgattgtcatcatggccaccatctgcttcatcctgctgatcctgagcctcatctgcaagatctgccacctgtggatcaagctgttcccccccatcccagcccccaagagcaacatcaaggacctgtttgtgaccaccaactatgagaaggccggcagcagcgagacagaaattgaggtgatctgctacatcgagaagccaggagtggagaccctggaggacagcgtcttctag

SEQ ID NO: 156459 - DNA, 1263 bp, Artificial Sequence; identical to SEQ ID NO: 156449
  Description of Artificial Sequence: Synthetic coding sequence

SEQ ID NO: 156460 - DNA, 1002 bp, Artificial Sequence; identical to SEQ ID NO: 156455
  Description of Artificial Sequence: Synthetic coding sequence

SEQ ID NO: 156461 - DNA, 1098 bp, Artificial Sequence
  Description of Artificial Sequence: Synthetic coding sequence
atgctggccgtgggctgtgccctgctggccgccctgctggccgcccctggggccgccctggccccccggcgctgcccagcccaggaggtggcccggggcgtgctgaccagcctgcccggggacagcgtgaccctgacctgccctggggtggagccagaagataatgccaccgtgcactgggtgctgaggaagccagctgctggcagccaccccagccgctgggccggcatgggccgccgcctgctgctgcggtctgtgcagctgcatgattctggcaactacagctgctacagagctggccggcctgctggcaccgtgcacctgctggtggatgtgcccccagaggagccccagctgagctgcttcaggaagagccccctgagcaatgtggtgtgtgagtggggccccaggagcacccccagcctgaccaccaaggctgtgctgctggtgaggaagttccagaacagccctgctgaggacttccaggagccctgccagtacagccaggagagccagaagttcagctgccagctggccgtgcctgagggggacagcagcttctacatcgtgtccatgtgtgtggccagctctgtgggcagcaagttcagcaagacccagaccttccagggctgcggcatcctgcagcctgaccccccagccaacatcaccgtgacagctgtggccaggaacccccgctggctgtctgtgacctggcaggacccccacagctggaacagcagcttctaccgcctgcgctttgagctgcgctacagagctgagaggagcaagaccttcaccacctggatggtgaaggacctgcagcaccactgtgtgattcatgatgcctggagcggcctgcggcacgtggtgcagctgcgggcccaggaggagtttggccagggcgagtggagcgagtggagccctgaggccatgggcaccccctggacagagagccgcagccccccagcagaaaatgaggtgtccacccccatgcaggccctgaccaccaacaaggatgatgacaacatcctcttccgggacagcgccaatgccaccagcctgcccggcagcagaagaagaggcagctgtggcctgtag

SEQ ID NO: 156462 - DNA, 1407 bp, Artificial Sequence
  Description of Artificial Sequence: Synthetic coding sequence
atgctggccgtgggctgtgccctgctggccgccctgctggccgcccctggggccgccctggccccccggcgctgcccagcccaggaggtggcccggggcgtgctgaccagcctgcccggggacagcgtgaccctgacctgccctggggtggagccagaagataatgccaccgtgcactgggtgctgaggaagccagctgctggcagccaccccagccgctgggccggcatgggccgccgcctgctgctgcggtctgtgcagctgcatgattctggcaactacagctgctacagagctggccggcctgctggcaccgtgcacctgctggtggatgtgcccccagaggagccccagctgagctgcttcaggaagagccccctgagcaatgtggtgtgtgagtggggccccaggagcacccccagcctgaccaccaaggctgtgctgctggtgaggaagttccagaacagccctgctgaggacttccaggagccctgccagtacagccaggagagccagaagttcagctgccagctggccgtgcctgagggggacagcagcttctacatcgtgtccatgtgtgtggccagctctgtgggcagcaagttcagcaagacccagaccttccagggctgcggcatcctgcagcctgaccccccagccaacatcaccgtgacagctgtggccaggaacccccgctggctgtctgtgacctggcaggacccccacagctggaacagcagcttctaccgcctgcgctttgagctgcgctacagagctgagaggagcaagaccttcaccacctggatggtgaaggacctgcagcaccactgtgtgattcatgatgcctggagcggcctgcggcacgtggtgcagctgcgggcccaggaggagtttggccagggcgagtggagcgagtggagccctgaggccatgggcaccccctggacagagagccgcagccccccagcagaaaatgaggtgtccacccccatgcaggccctgaccaccaacaaggatgatgacaacatcctcttccgggacagcgccaatgccaccagcctgcctgtgcaggacagcagctctgtgcccctgcccaccttcctggtggccggcggcagcctggccttcggcaccctgctgtgcatcgccatcgtgctgcgcttcaagaagacctggaagctgcgggccctgaaggagggcaagacctccatgcaccccccctacagcctgggccagctggtgcctgagcggccccggcccacccctgtgctggtgcccctcatcagcccccctgtgagccccagcagcctgggcagtgacaacaccagcagccacaacagaccagatgcccgggaccccaggagcccctatgacatcagcaacacagactacttcttccccaggtag

SEQ ID NO: 156463 - DNA, 2757 bp, Artificial Sequence
  Description of Artificial Sequence: Synthetic coding sequence
atgctgaccctgcagacctggctggtgcaggccctcttcatcttcctgaccacagagagcactggagagctgctggacccctgtggctacatcagccctgagagccctgtggtgcagctgcacagcaacttcaccgctgtgtgtgtgctgaaggagaagtgcatggactacttccacgtgaatgccaactacatcgtgtggaagaccaaccacttcaccatccccaaggagcagtacaccatcatcaacagaacagccagctctgtgaccttcacagacatcgccagcctgaacatccagctgacctgcaacatcctgaccttcggccagctggagcagaatgtgtatggcatcaccatcatcagcggcctgcccccagagaagcccaagaacctgagctgcatcgtgaatgaaggcaagaagatgagatgtgagtgggatggcggccgggagacccacctggagaccaacttcaccctgaagtctgagtgggccacccacaagtttgctgactgcaaggccaagagggacacccccaccagctgcaccgtggactacagcacagtgtactttgtgaacatcgaggtgtgggtggaggctgaaaatgccctgggcaaggtgaccagtgaccacatcaactttgatcctgtgtacaaggtgaagcccaaccccccccacaacctgagcgtcatcaacagcgaggagctgagcagcatcctgaagctgacctggaccaaccccagcatcaagagcgtcatcatcctgaagtacaacatccagtaccgcaccaaggatgccagcacctggagccagatccccccagaggacacagccagcaccaggagcagcttcaccgtgcaggacctgaagcccttcacagaatatgtgttccgcatccgctgcatgaaggaggatggcaagggctactggagcgactggagcgaggaggccagcggcatcacctatgaagatcggcccagcaaggcccccagcttctggtacaagattgaccccagccacacccagggctacagaacagtgcagctggtgtggaagaccctgcccccatttgaggccaacgggaagatcctggactatgaggtgaccctgacccgctggaagagccacctgcagaactacacagtgaatgccaccaagctgactgtgaacctgaccaatgaccgctacctggccaccctgactgtgaggaacctggtgggcaagagtgatgctgctgtgctgaccatcccagcctgtgacttccaggccacccaccctgtgatggacctgaaggccttccccaaggacaacatgctgtgggtggagtggaccaccccccgggagagcgtgaagaagtacatcctggagtggtgtgtgctgagtgacaaggccccctgcatcacagactggcagcaggaggatggcaccgtgcacaggacctacctgcggggcaacctggccgagagcaagtgctacctgatcaccgtgacccctgtgtatgcagatggccctggcagccctgagagcatcaaggcctacctgaagcaggccccacccagcaagggccccaccgtgaggaccaagaaggtgggcaagaatgaagctgtgctggagtgggaccagctgcctgtggatgtgcagaatggcttcatccggaactacaccatcttctaccgcaccatcattggaaatgaaacagctgtgaatgtggacagcagccacacagagtacaccctgagcagcctgaccagtgacaccctgtacatggtgaggatggccgcctacacagatgaaggaggcaaggatggccctgagttcaccttcaccacccccaagtttgcccagggcgagattgaggccatcgtggtgcctgtgtgcctggccttcctgctgaccaccctgctgggcgtgctcttctgcttcaacaagagggacctgatcaagaagcacatctggcccaacgtgcctgaccccagcaagagccacatcgcccagtggagcccccacaccccacccaggcacaacttcaacagcaaggaccagatgtacagtgatggcaacttcacagatgtgtctgtggtggagattgaggccaatgacaagaagcccttccctgaggacctgaagagcctggacctcttcaagaaggagaagatcaacacagagggccacagcagcggcatcggcggcagcagctgcatgagcagcagccggcccagcatcagcagcagtgatgaaaatgaaagcagccagaacaccagcagcacagtgcagtacagcacagtggtgcacagcggctaccgccaccaggtgcccagcgtgcaggtgttcagccgctctgagagcacccagcccctgctggacagcgaggagaggcctgaggacctgcagctggtggaccacgtggatggaggagatggcatcctgccccggcagcagtacttcaagcagaactgcagccagcacgagagcagcccagacatcagccactttgagaggagcaagcaggtgtcctctgtgaatgaagaagattttgtgcggctgaagcagcagatcagtgaccacatcagccagagctgtggcagcggccagatgaagatgttccaggaggtgtctgctgctgatgcctttggacctggaacagagggccaggtggagagatttgagaccgtgggcatggaggccgccacagatgagggcatgcccaagagctacctgccccagacagtgcggcagggcggctacatgccccagtag

SEQ ID NO: 156464 - DNA, 990 bp, Artificial Sequence
  Description of Artificial Sequence: Synthetic coding sequence
atgctgaccctgcagacctggctggtgcaggccctcttcatcttcctgaccacagagagcactggagagctgctggacccctgtggctacatcagccctgagagccctgtggtgcagctgcacagcaacttcaccgctgtgtgtgtgctgaaggagaagtgcatggactacttccacgtgaatgccaactacatcgtgtggaagaccaaccacttcaccatccccaaggagcagtacaccatcatcaacagaacagccagctctgtgaccttcacagacatcgccagcctgaacatccagctgacctgcaacatcctgaccttcggccagctggagcagaatgtgtatggcatcaccatcatcagcggcctgcccccagagaagcccaagaacctgagctgcatcgtgaatgaaggcaagaagatgagatgtgagtgggatggcggccgggagacccacctggagaccaacttcaccctgaagtctgagtgggccacccacaagtttgctgactgcaaggccaagagggacacccccaccagctgcaccgtggactacagcacagtgtactttgtgaacatcgaggtgtgggtggaggctgaaaatgccctgggcaaggtgaccagtgaccacatcaactttgatcctgtgtacaaggtgaagcccaaccccccccacaacctgagcgtcatcaacagcgaggagctgagcagcatcctgaagctgacctggaccaaccccagcatcaagagcgtcatcatcctgaagtacaacatccagtaccgcaccaaggatgccagcacctggagccagatccccccagaggacacagccagcaccaggagcagcttcaccgtgcaggacctgaagcccttcacagaatatgtgttccgcatccgctgcatgaaggaggatggcaagggctactggagcgactggagcgaggaggccagcggcatcacctatgaggacaacatcgccagcttctag

SEQ ID NO: 156465 - DNA, 2574 bp, Artificial Sequence
  Description of Artificial Sequence: Synthetic coding sequence
atgctgaccctgcagacctggctggtgcaggccctcttcatcttcctgaccacagagagcactggagagctgctggacccctgtggctacatcagccctgagagccctgtggtgcagctgcacagcaacttcaccgctgtgtgtgtgctgaaggagaagtgcatggactacttccacgtgaatgccaactacatcgtgtggaagaccaaccacttcaccatccccaaggagcagtacaccatcatcaacagaacagccagctctgtgaccttcacagacatcgccagcctgaacatccagctgacctgcaacatcctgaccttcggccagctggagcagaatgtgtatggcatcaccatcatcagcggcctgcccccagagaagcccaagaacctgagctgcatcgtgaatgaaggcaagaagatgagatgtgagtgggatggcggccgggagacccacctggagaccaacttcaccctgaagtctgagtgggccacccacaagtttgctgactgcaaggccaagagggacacccccaccagctgcaccgtggactacagcacagtgtactttgtgaacatcgaggtgtgggtggaggctgaaaatgccctgggcaaggtgaccagtgaccacatcaactttgatcctgtgtacaaggtgaagcccaaccccccccacaacctgagcgtcatcaacagcgaggagctgagcagcatcctgaagctgacctggaccaaccccagcatcaagagcgtcatcatcctgaagtacaacatccagtaccgcaccaaggatgccagcacctggagccagatccccccagaggacacagccagcaccaggagcagcttcaccgtgcaggacctgaagcccttcacagaatatgtgttccgcatccgctgcatgaaggaggatggcaagggctactggagcgactggagcgaggaggccagcggcatcacctatgaagatcggcccagcaaggcccccagcttctggtacaagattgaccccagccacacccagggctacagaacagtgcagctggtgtggaagaccctgcccccatttgaggccaacgggaagatcctggactatgaggtgaccctgacccgctggaagagccacctgcagaactacacagtgaatgccaccaagctgactgtgaacctgaccaatgaccgctacctggccaccctgactgtgaggaacctggtgggcaagagtgatgctgctgtgctgaccatcccagcctgtgacttccagggcaacctggccgagagcaagtgctacctgatcaccgtgacccctgtgtatgcagatggccctggcagccctgagagcatcaaggcctacctgaagcaggccccacccagcaagggccccaccgtgaggaccaagaaggtgggcaagaatgaggccgtgctggagtgggaccagctgcctgtggatgtgcagaatggcttcatccggaactacaccatcttctaccgcaccatcattggaaatgaaacagctgtgaatgtggacagcagccacacagagtacaccctgagcagcctgaccagtgacaccctgtacatggtgaggatggccgcctacacagatgagggcggcaaggatggccctgagttcaccttcaccacccccaagtttgcccagggcgagattgaggccatcgtggtgcctgtgtgcctggccttcctgctgaccaccctgctgggcgtgctcttctgcttcaacaagagggacctgatcaagaagcacatctggcccaacgtgcctgaccccagcaagagccacatcgcccagtggagcccccacaccccacccaggcacaacttcaacagcaaggaccagatgtacagtgatggcaacttcacagatgtgtctgtggtggagattgaggccaatgacaagaagcccttccctgaggacctgaagagcctggacctcttcaagaaggagaagatcaacacagagggccacagcagcggcattggaggcagcagctgcatgagcagcagccggcccagcatcagcagcagtgatgaaaatgaaagcagccagaacaccagcagcacagtgcagtacagcacagtggtgcacagcggctaccgccaccaggtgcccagcgtgcaggtgttcagccgctctgagagcacccagcccctgctggacagcgaggagaggcctgaggacctgcagctggtggaccacgtggatggaggagatggcatcctgccccggcagcagtacttcaagcagaactgcagccagcacgagagcagcccagacatcagccactttgagaggagcaagcaggtgtcctctgtgaatgaggaggactttgtgcggctgaagcagcagatcagtgaccacatcagccagagctgtggcagcggccagatgaagatgttccaggaggtgtctgctgctgatgccttcggccctggaacagagggccaggtggagagatttgaaacagtgggcatggaggccgccacagatgagggcatgcccaagagctacctgccccagacagtgcggcagggcggctacatgccccagtag

SEQ ID NO: 156466 - DNA, 2757 bp, Artificial Sequence; identical to SEQ ID NO: 156463
  Description of Artificial Sequence: Synthetic coding sequence

SEQ ID NO: 156467 - DNA, 990 bp, Artificial Sequence; identical to SEQ ID NO: 156464
  Description of Artificial Sequence: Synthetic coding sequence

SEQ ID NO: 156468 - DNA, 990 bp, Artificial Sequence; identical to SEQ ID NO: 156464
  Description of Artificial Sequence: Synthetic coding sequence

SEQ ID NO: 156469 - DNA, 990 bp, Artificial Sequence
  Description of Artificial Sequence: Synthetic coding sequence
atgctgaccctgcagacctggctggtgcaggccctcttcatcttcctgaccacagagagcactggagagctgctggacccctgtggctacatcagccctgagagccctgtggtgcagctgcacagcaacttcaccgctgtgtgtgtgctgaaggagaagtgcatggactacttccacgtgaatgccaactacatcgtgtggaagaccaaccacttcaccatccccaaggagcagtacaccatcatcaacagaacagccagctctgtgaccttcacagacatcgccagcctgaacatccagctgacctgcaacatcctgaccttcggccagctggagcagaatgtgtatggcatcaccatcatcagcggcctgcccccagagaagcccaagaacctgagctgcatcgtgaatgaaggcaagaagatgagatgtgagtgggatggcggccgggagacccacctggagaccaacttcaccctgaagtctgagtgggccacccacaagtttgctgactgcaaggccaagagggacacccccaccagctgcaccgtggactacagcacagtgtactttgtgaacatcgaggtgtgggtggaggctgaaaatgccctgggcaaggtgaccagtgaccacatcaactttgatcctgtgtacaaggtgaagcccaaccccccccacaacctgagcgtcatcaacagcgaggagctgagcagcatcctgaagctgacctggaccaaccccagcatcaagagcgtcatcatcctgaagtacaacatccagtaccgcaccaaggatgccagcacctggagccagatccccccagaggacacagccagcaccaggagcagcttcaccgtgcaggacctgaagcccttcacagaatatgtgttccgcatccgctgcatgaaggaggatggcaagggctactggagcgactggagcgaggaggccagcggcatcacctatgaggacaccatcttctccttctag

SEQ ID NO: 156470 - DNA, 1380 bp, Artificial Sequence
  Description of Artificial Sequence: Synthetic coding sequence
atgaccatcctgggcaccaccttcggcatggtgttcagcctgctgcaggtggtgtctggagagagcggctacgcccagaatggagacctggaggatgctgagctggatgactacagcttcagctgctacagccagctggaggtgaatggcagccagcacagcctgacctgtgcctttgaggaccctgatgtgaacatcaccaacctggagtttgagatctgtggggccctggtggaggtgaagtgcctgaacttcaggaagctgcaggagatctacttcatcgagaccaagaagttcctgctgattggcaagagcaacatctgtgtgaaggtgggggagaagagcctgacctgcaagaagattgacctgaccaccatcgtgaagccagaggccccctttgacctgtctgtggtgtaccgggagggcgccaatgactttgtggtgaccttcaacaccagccacctgcagaagaagtatgtgaaggtgctgatgcatgatgtggcctaccggcaggagaaggatgagaacaagtggacccacgtgaacctgagcagcaccaagctgaccctgctgcagaggaagctgcagcctgctgccatgtatgagatcaaggtgcgcagcatcccagaccactacttcaagggcttctggagcgagtggagccccagctactacttccgcaccccagagatcaacaacagcagtggagagatggaccccatcctgctgaccatcagcatcctgtccttcttctctgtggccctgctggtgatcctggcctgtgtgctgtggaagaagaggatcaagcccatcgtgtggcccagcctgcctgaccacaagaagaccctggagcacctgtgcaagaagcccaggaagaacctgaatgtgtccttcaaccctgagagcttcctggactgccagatccaccgggtggatgacatccaggccagagatgaggtggagggcttcctgcaggacaccttcccccagcagctggaggagagcgagaagcagaggctgggcggagatgtgcagagccccaactgccccagtgaagatgtggtgatcaccccagagagctttggccgggacagcagcctgacctgcctggccggaaatgtgtctgcctgtgatgcccccatcctgagcagcagccgcagcctggactgccgggagagcggcaagaatggcccccacgtgtaccaggacctgctgctgagcctgggcaccaccaacagcaccctgcccccacccttcagcctgcagagcggcatcctgaccctgaaccctgtggcccagggccagcccatcctgaccagcctgggcagcaaccaggaggaggcctacgtgaccatgagcagcttctaccagaaccagtag

SEQ ID NO: 156471 - DNA, 789 bp, Artificial Sequence
  Description of Artificial Sequence: Synthetic coding sequence
atgaccatcctgggcaccaccttcggcatggtgttcagcctgctgcaggtggtgtctggagagagcggctacgcccagaatggagacctggaggatgctgagctggatgactacagcttcagctgctacagccagctggaggtgaatggcagccagcacagcctgacctgtgcctttgaggaccctgatgtgaacatcaccaacctggagtttgagatctgtggggccctggtggaggtgaagtgcctgaacttcaggaagctgcaggagatctacttcatcgagaccaagaagttcctgctgattggcaagagcaacatctgtgtgaaggtgggggagaagagcctgacctgcaagaagattgacctgaccaccatcgtgaagccagaggccccctttgacctgtctgtggtgtaccgggagggcgccaatgactttgtggtgaccttcaacaccagccacctgcagaagaagtatgtgaaggtgctgatgcatgatgtggcctaccggcaggagaaggatgagaacaagtggacccacgtgaacctgagcagcaccaagctgaccctgctgcagaggaagctgcagcctgctgccatgtatgagatcaaggtgcgcagcatcccagaccactacttcaagggcttctggagcgagtggagccccagctactacttccgcaccccagagatcaacaacagcagcggcctgagcctgtcctatggccctgtgagccccatcatccggcggctgtggaacatctttgtgaggaaccaggagaagatctag

SEQ ID NO: 156472 - DNA, 786 bp, Artificial Sequence
  Description of Artificial Sequence: Synthetic coding sequence
atgaccatcctgggcaccaccttcggcatggtgttcagcctgctgcaggtggtgtctggagagagcggctacgcccagaatggagacctggaggatgctgagctggatgactacagcttcagctgctacagccagctggaggtgaatggcagccagcacagcctgacctgtgcctttgaggaccctgatgtgaacatcaccaacctggagtttgagatctgtggggccctggtggaggtgaagtgcctgaacttcaggaagctgcaggagatctacttcatcgagaccaagaagttcctgctgattggcaagagcaacatctgtgtgaaggtgggggagaagagcctgacctgcaagaagattgacctgaccaccatcgtgaagccagaggccccctttgacctgtctgtggtgtaccgggagggcgccaatgactttgtggtgaccttcaacaccagccacctgcagaagaagtatgtgaaggtgctgatgcatgatgtggcctaccggcaggagaaggatgagaacaagtggacccacgtgaacctgagcagcaccaagctgaccctgctgcagaggaagctgcagcctgctgccatgtatgagatcaaggtgcgcagcatcccagaccactacttcaagggcttctggagcgagtggagccccagctactacttccgcaccccagagatcaacaacagcagcggcctgagcctgtcctatggccctgtgagccccatcatccggcggctgtggaacatctttgtgaggaaccaggagaagtag

SEQ ID NO: 156473 - DNA, 180 bp, Artificial Sequence
  Description of Artificial Sequence: Synthetic coding sequence
atgaccatcctgggcaccaccttcggcatggtgttcagcctgctgcaggtggtgtctggagagagcggctacgcccagaatggagacctggaggatgctgagctggatgactacagcttcagctgctacagccagctggaggtgaatggcagccagcacagcctgacctgtgccttctag

SEQ ID NO: 156474 - DNA, 159 bp, Artificial Sequence
  Description of Artificial Sequence: Synthetic coding sequence
atgaccatcctgggcaccaccttcggcatggtgttcagcctgctgcaggtggtgtctggagagagcggctacgcccagaatggagacctggaggatgctgagctggatgactacagcttcagctgctacagccagctggaggtgaatggcagccagtag

SEQ ID NO: 156475 - DNA, 1566 bp, Artificial Sequence
  Description of Artificial Sequence: Synthetic coding sequence
atgggcctgggccgctgcatctgggagggctggaccctggagagcgaggccctgcggcgggacatgggcacctggctgctggcctgcatctgcatctgcacctgtgtgtgcctgggcgtgtctgtgactggagagggccagggccccaggagcaggaccttcacctgcctgaccaacaacatcctgagaattgactgccactggagcgcccctgagctgggccagggcagcagcccctggctgctcttcaccagcaaccaggcccctgggggcacccacaagtgcatcctgcggggctctgaatgtactgtggtgctgcccccagaggccgtgctggtgcccagcgacaacttcaccatcaccttccaccactgcatgagcggccgggagcaggtgtccctggtggaccctgagtacctgccccggcggcacgtgaagctggaccccccaagtgacctgcagagcaacatcagcagcggccactgcatcctgacctggagcatcagccctgccctggagcccatgaccaccctgctgtcctatgagctggccttcaagaagcaggaggaggcctgggagcaggcccagcaccgggaccacatcgtgggcgtgacctggctgatcctggaggcctttgagctggaccccggcttcatccacgaggcccggctgcgggtgcagatggccaccctggaggatgatgtggtggaggaggagcgctacacaggccagtggagcgagtggagccagcctgtgtgcttccaggccccccagaggcagggccccctcatccccccctggggctggccaggcaacaccctggtggccgtgtccatcttcctgctgctgaccggccccacctacctgctcttcaagctgagcccccgggtgaagaggatcttctaccagaatgtgcccagccctgccatgttcttccagcccctgtacagcgtgcacaacggcaacttccagacctggatgggcgcccacggggccggcgtgctgctgagccaggactgtgccggcaccccccagggcgccctggagccctgtgtgcaggaggccacagccctgctgacctgtggccctgcccggccctggaagtctgtggccctggaggaggagcaggagggccctggcacccggctgcccggcaacctgagcagtgaagatgtgctgcctgctggctgcacagagtggagggtgcagaccctggcctacctgccccaggaggactgggcccccaccagcctgaccaggcctgcccccccagacagcgagggcagccgcagcagcagcagcagcagcagcagcaacaacaacaactactgtgccctgggctgctatggaggctggcacctgagcgccctgcccggcaacacccagagcagcggccccatcccagccctggcctgtggcctgagctgtgaccaccagggcctggagacccagcagggcgtggcctgggtgctggccggccactgccagaggcctggcctgcacgaggacctgcagggcatgctgctgcccagcgtgctgagcaaggcccgctcctggaccttctag

SEQ ID NO: 156476 - DNA, 1029 bp, Artificial Sequence
  Description of Artificial Sequence: Synthetic coding sequence
atgccccagacctgtgatggcaccggccagatgcacctgggcagcaactgctgcaagaatggccagaccctgctgcagaggacctgccacggcgtgtcctgctgcggctggtggttccaggccgcccggagcatcctgggcaagggccccagcgcccagagcctggccggctggaccctggagagcgaggccctgcggcgggacatgggcacctggctgctggcctgcatctgcatctgcacctgtgtgtgcctgggcgtgtctgtgactggagagggccagggccccaggagcaggaccttcacctgcctgaccaacaacatcctgagaattgactgccactggagcgcccctgagctgggccagggcagcagcccctggctgctcttcacccggctgctggccgcccacatcagcgccagctgtggggctgtgtctgcccccagctgctgccacctgcggcagtgcagctgccacctgaccatcagccccagcctgagcaccacagcctgcctgggcggcagccgcagcgcctggtggaccaggagcacctgccctggggacaccagcaacatcagcagcggccactgcatcctgacctggagcatcagccctgccctggagcccatgaccaccctgctgtcctatgagctggccttcaagaagcaggaggaggcctgggagcaggcccagcaccgggaccacatcgtgggcgtgacctggctgatcctggaggcctttgagctggaccccggcttcatccacgaggcccggctgcgggtgcagatggccaccctggaggatgatgtggtggaggaggagcgctacacaggccagtggagcgagtggagccagcctgtgtgcttccaggccccccagaggcagggccccctcatccccccctggggctggccaggcaacaccctggtggccgtgtccatcttcctgctgctgaccggccccacctacctgctcttcaagctgagcccccggctgggctggggccccactggacctgtgtgctgctag

SEQ ID NO: 156477 - DNA, 1503 bp, Artificial Sequence
  Description of Artificial Sequence: Synthetic coding sequence
atgggcacctggctgctggcctgcatctgcatctgcacctgtgtgtgcctgggcgtgtctgtgactggagagggccagggccccaggagcaggaccttcacctgcctgaccaacaacatcctgagaattgactgccactggagcgcccctgagctgggccagggcagcagcccctggctgctcttcaccagcaaccaggcccctgggggcacccacaagtgcatcctgcggggcagcgagtgcaccgtggtgctgcccccagaggccgtgctggtgcccagcgacaacttcaccatcaccttccaccactgcatgagcggccgggagcaggtgtccctggtggaccctgagtacctgcccaggagacatgtgaagctggacccccccagcgacctgcagagcaacatcagcagcggccactgcatcctgacctggagcatcagccctgccctggagcccatgaccaccctgctgtcctatgagctggccttcaagaagcaggaggaggcctgggagcaggcccagcaccgggaccacatcgtgggcgtgacctggctgatcctggaggcctttgagctggaccccggcttcatccacgaggcccggctgcgggtgcagatggccaccctggaggatgatgtggtggaggaggagcgctacacaggccagtggagcgagtggagccagcctgtgtgcttccaggccccccagaggcagggccccctcatccccccctggggctggccaggcaacaccctggtggccgtgtccatcttcctgctgctgaccggccccacctacctgctcttcaagctgagcccccgggtgaagaggatcttctaccagaatgtgcccagccctgccatgttcttccagcccctgtacagcgtgcacaatggaaacttccagacctggatgggcgcccatggagctggggtgctgctgagccaggactgtgccggcaccccccagggcgccctggagccctgtgtgcaggaggccacagccctgctgacctgtggccctgcccggccctggaagtctgtggccctggaggaggagcaggagggccctggcacccggctgcccggcaacctgagcagtgaagatgtgctgcctgctggctgcacagagtggagggtgcagaccctggcctacctgccccaggaggactgggcccccaccagcctgaccaggcctgcccccccagattctgagggcagccgcagcagcagcagcagcagcagcagcaacaacaacaactactgtgccctgggctgctacggcggctggcacctgagcgccctgcccggcaacacccagagcagcggccccatcccagccctggcctgtggcctgagctgtgaccaccagggcctggagacccagcagggcgtggcctgggtgctggccggccactgccagaggcctggcctgcacgaggacctgcagggcatgctgctgcccagcgtgctgagcaaggcccgctcctggaccttctag

SEQ ID NO: 156478 - DNA, 990 bp, Artificial Sequence
  Description of Artificial Sequence: Synthetic coding sequence
atgggcacctggctgctggcctgcatctgcatctgcacctgtgtgtgcctgggcgtgtctgtgactggagagggccagggccccaggagcaggaccttcacctgcctgaccaacaacatcctgagaattgactgccactggagcgcccctgagctgggccagggcagcagcccctggctgctcttcaccagcaaccaggcccctgggggcacccacaagtgcatcctgcggggcagcgagtgcaccgtggtgctgcccccagaggccgtgctggtgcccagcgacaacttcaccatcaccttccaccactgcatgagcggccgggagcaggtgtccctggtggaccctgagtacctgcccaggagacatgtgaagctggacccccccagcgacctgcagagcaacatcagcagcggccactgcatcctgacctggagcatcagccctgccctggagcccatgaccaccctgctgtcctatgagctggccttcaagaagcaggaggaggcctgggagcaggcccagcaccgggaccacatcgtgggcgtgacctggctgatcctggaggcctttgagctggaccccggcttcatccacgaggcccggctgcgggtgcagatggccaccctggaggatgatgtggtggaggaggagcgctacacaggccagtggagcgagtggagccagcctgtgtgcttccaggccccccagaggcagggccccctcatccccccctggggctggccaggcaacaccctggtggccgtgtccatcttcctgctgctgaccggccccacctacctgctcttcaagctgagcccccgggtgaagaggatcttctaccagaatgtgcccagccctgccatgttcttccagcccctgtacagcgtgcacaatggaaacttccaggtgtgtgccgagaccacagagggccacggcggccagggcctgccccgggccctggcctgcccccgctgctggctgtcctag

SEQ ID NO: 156479 - DNA, 999 bp, Artificial Sequence
  Description of Artificial Sequence: Synthetic coding sequence
atgcacctgggcagcaactgctgcaagaatggccagaccctgctgcagaggacctgccacggcgtgtcctgctgcggctggtggttccaggccgcccggagcatcctgggcaagggccccagcgcccagagcctggccggctggaccctggagagcgaggccctgcggcgggacatgggcacctggctgctggcctgcatctgcatctgcacctgtgtgtgcctgggcgtgtctgtgactggagagggccagggccccaggagcaggaccttcacctgcctgaccaacaacatcctgagaattgactgccactggagcgcccctgagctgggccagggcagcagcccctggctgctcttcacccggctgctggccgcccacatcagcgccagctgtggggctgtgtctgcccccagctgctgccacctgcggcagtgcagctgccacctgaccatcagccccagcctgagcaccacagcctgcctgggcggcagccgcagcgcctggtggaccaggagcacctgccctggggacaccagcaacatcagcagcggccactgcatcctgacctggagcatcagccctgccctggagcccatgaccaccctgctgtcctatgagctggccttcaagaagcaggaggaggcctgggagcaggcccagcaccgggaccacatcgtgggcgtgacctggctgatcctggaggcctttgagctggaccccggcttcatccacgaggcccggctgcgggtgcagatggccaccctggaggatgatgtggtggaggaggagcgctacacaggccagtggagcgagtggagccagcctgtgtgcttccaggccccccagaggcagggccccctcatccccccctggggctggccaggcaacaccctggtggccgtgtccatcttcctgctgctgaccggccccacctacctgctcttcaagctgagcccccggctgggctggggccccactggacctgtgtgctgctag

SEQ ID NO: 156480 - DNA, 1878 bp, Artificial Sequence
  Description of Artificial Sequence: Synthetic coding sequence
atggcctgctacatctaccagctgcccagctgggtgctggatgacctgtgcaggaacatggatgccctgtctgagtgggactggatggagtttgccagctatgtgatcacagacctgacccagctgaggaagatcaagtccatggagcgggtgcagggcgtgtccatcacccgggagctgctgtggtggtggggcatgaggcaggccaccgtgcagcagctggtggacctgctgtgccgcctggagctgtaccgggccgcccagatcatcctgaactggaagccagcccctgagatccgctgccccatcccagccttcccagattctgtgaagccagagaagcccctggccgcctctgtgaggaaggccgaggatgagcaggaggagggccagcctgtgaggatggccaccttccctggccctggcagcagccctgcccgggcccaccagcctgccttcctgcagcccccagaagaagatgccccccacagcctgcggagtgacctgcccaccagcagtgacagcaaggacttcagcaccagcatccccaagcaggagaagctgctgagcctggccggggacagcctcttctggagcgaggctgatgtggtgcaggccacagatgacttcaaccagaacaggaagatcagccagggcacctttgctgatgtgtaccggggccaccgccacggcaagccctttgtgttcaagaagctgcgggagacagcctgcagcagccctggcagcattgagcgcttcttccaggccgagctgcagatctgcctgcgctgctgccaccccaacgtgctgcctgtgctgggcttctgtgccgcccggcagttccacagcttcatctacccctacatggccaacggcagcctgcaggaccggctgcagggccagggcggcagtgaccccctgccctggccccagagggtgtccatctgcagcggcctgctgtgtgctgtggagtacctgcacggcctggagatcatccacagcaatgtgaagagcagcaatgtgctgctggaccagaacctgacccccaagctggcccaccccatggcccacctgtgccctgtgaacaagaggagcaagtacaccatgatgaagacccacctgctgcggaccagcgctgcctacctgcctgaggacttcatccgggtgggccagctgaccaagagggtggacatcttcagctgtggcatcgtgctggccgaggtgctgaccggcatcccagccatggacaacaacagaagccctgtgtacctgaaggacctgctgctgagtgacatccccagcagcacagccagcctgtgcagcaggaagacaggagtggagaatgtgatggccaaggagatctgccagaagtacctggagaagggagctggccgcctgcctgaggactgtgccgaggccctggccacagctgcctgcctgtgcctgcggcggaggaacaccagcctgcaggaggtgtgtggctctgtggccgctgtggaggagcggctgcggggccgggagaccctgctgccctggagcggcctgtctgagggcaccggcagcagcagcaacaccccagaggagacagatgatgtggacaacagcagcctggatgccagcagctccatgtctgtggccccctgggccggggccgccacccccctgctgcccacagaaaatggagagggccgcctgcgggtcatcgtgggccgggaggccgacagcagcagcgaggcctgtgtgggcctggagcccccccaggatgtgacagagacctcctggcagatcgagatcaatgaggccaagaggaagctgatggagaacatcctgctgtacaaggaggagaaggtggacagcattgagctgtttggcccctag

SEQ ID NO: 156481 - DNA, 1791 bp, Artificial Sequence
  Description of Artificial Sequence: Synthetic coding sequence
atggccggcaactgtggggcccggggggccctgagcgcccacaccctgctgtttgacctgcccccagccctgctgggggagctgtgtgctgtgctggacagctgtgatggagccctgggctggaggggcctggccgagcggctgagcagctcctggctggatgtgcgccacatcgagaagtatgtggaccagggcaagagcggcacccgggagctgctgtggagctgggcccagaagaacaagaccatcggggacctgctgcaggtgctgcaggagatgggccaccggcgggccatccacctgatcaccaactatggagctgtgctgagccccagcgagaagagctaccaggagggcggcttccccaacatcctcttcaaggagacagccaacgtgacagtggacaacgtgctgatccctgagcacaatgagaagggcatcctgctgaagagcagcatctccttccagaacatcatcgagggcaccaggaacttccacaaggacttcctgattggagagggggagatctttgaggtgtacagagtggagatccagaacctgacctatgctgtgaagctgttcaagcaggagaagaagatgcagtgcaagaagcactggaagcgcttcctgtctgagctggaggtgctgctgctcttccaccaccccaacatcctggagctggccgcctacttcacagaaacagagaagttctgcctgatctacccctacatgagaaatggcaccctgtttgaccggctgcagtgtgtgggggacacagcccccctgccctggcacatccgcatcggcatcctgattggcatcagcaaggccatccactacctgcacaacgtgcagccctgcagcgtcatctgtggcagcatcagcagcgccaacatcctgctggatgaccagttccagcccaagctgacagactttgccatggcccacttccgcagccacctggagcaccagagctgcaccatcaacatgaccagcagcagcagcaagcacctgtggtacatgcctgaggagtacatccggcagggcaagctgagcatcaagacagatgtgtacagctttggcatcgtcatcatggaggtgctgaccggctgccgggtggtgctggatgaccccaagcacatccagctgcgggacctgctgcgggagctgatggagaagaggggcctggacagctgcctgtccttcctggacaagaaggtgcccccctgccccaggaacttcagcgccaagctgttctgcctggccggccgctgtgccgccacccgggccaagctgcggcccagcatggatgaggtgctgaacaccctggagagcacccaggccagcctgtactttgctgaggacccccccaccagcctgaagagcttccgctgccccagccccctcttcctggagaatgtgcccagcatccctgtggaggatgatgagagccagaacaacaacctgctgcccagtgatgagggcctgagaattgacaggatgacccagaagaccccatttgagtgcagccagagcgaggtgatgttcctgagcctggacaagaagccagagagcaagagaaatgaggaggcctgcaacatgcccagcagcagctgtgaggagagctggttccccaagtacatcgtgcccagccaggacctgcggccctacaaggtgaacatcgaccccagcagcgaggcccctggccacagctgccgcagcaggcctgtggagagcagctgcagcagcaagttctcctgggatgaatatgagcagtacaagaaggagtag

SEQ ID NO: 156482 - DNA, 1608 bp, Artificial Sequence
  Description of Artificial Sequence: Synthetic coding sequence
atggccggcaactgtggggcccggggggccctgagcgcccacaccctgctgtttgacctgcccccagccctgctgggggagctgtgtgctgtgctggacagctgtgatggagccctgggctggaggggcctgggcgctgtgctgagccccagcgagaagagctaccaggagggcggcttccccaacatcctcttcaaggagacagccaacgtgacagtggacaacgtgctgatccctgagcacaatgagaagggcatcctgctgaagagcagcatctccttccagaacatcatcgagggcaccaggaacttccacaaggacttcctgattggagagggggagatctttgaggtgtacagagtggagatccagaacctgacctatgctgtgaagctgttcaagcaggagaagaagatgcagtgcaagaagcactggaagcgcttcctgtctgagctggaggtgctgctgctcttccaccaccccaacatcctggagctggccgcctacttcacagaaacagagaagttctgcctgatctacccctacatgagaaatggcaccctgtttgaccggctgcagtgtgtgggggacacagcccccctgccctggcacatcagaattggcatcctgattggcatcagcaaggccatccactacctgcacaacgtgcagccctgcagcgtcatctgtggcagcatcagcagcgccaacatcctgctggatgaccagttccagcccaagctgacagactttgccatggcccacttccgcagccacctggagcaccagagctgcaccatcaacatgaccagcagcagcagcaagcacctgtggtacatgcctgaggagtacatccggcagggcaagctgagcatcaagacagatgtgtacagctttggaattgtcatcatggaggtgctgaccggctgccgggtggtgctggatgaccccaagcacatccagctgcgggacctgctgcgggagctgatggagaagaggggcctggacagctgcctgtccttcctggacaagaaggtgcccccctgccccaggaacttcagcgccaagctgttctgcctggccggccgctgtgccgccacccgggccaagctgcggcccagcatggatgaggtgctgaacaccctggagagcacccaggccagcctgtactttgctgaagatcctcccaccagcctgaagagcttccgctgccccagccccctcttcctggagaatgtgcccagcatccctgtggaggatgatgagagccagaacaacaacctgctgcccagtgatgagggcctgagaattgacaggatgacccagaagaccccatttgaatgttcccagagcgaggtgatgttcctgagcctggacaagaagccagagagcaagagaaatgaggaggcctgcaacatgcccagcagcagctgtgaggagagctggttccccaagtacatcgtgcccagccaggacctgcggccctacaaggtgaacatcgaccccagcagcgaggcccctggccacagctgccgcagcaggcctgtggagagcagctgcagcagcaagttctcctgggatgaatatgagcagtacaagaaggagtag

SEQ ID NO: 156483 - DNA, 657 bp, Artificial Sequence
  Description of Artificial Sequence: Synthetic coding sequence
atgaacaagcccatcacccccagcacctacgtgcgctgcctgaatgtgggcctcatcaggaagctgagtgacttcatcgacccccaggagggctggaagaagctggccgtggccatcaagaagcccagcggagatgaccgctacaaccagttccacatccgccgctttgaggccctgctgcagacaggcaagagccccaccagcgagctgctgtttgactggggcaccaccaactgcaccgtgggggacctggtggacctgctgatccagaatgagttctttgccccagccagcctgctgctgcctgatgctgtgcccaagacagccaacaccctgcccagcaaggaggccatcaccgtgcagcagaagcagatgcccttctgtgacaaggacaggaccctgatgacccctgtgcagaacctggagcagagctacatgcccccagacagcagcagccctgagaacaagagcctggaggtgtctgacacccgcttccacagcttctccttctatgagctgaagaatgtgaccaacaactttgatgagcggcccatctctgtgggcggcaacaagatgggagagggcggctttggagtggtgtacaagggctacgtgaacaacaactgtggcagcgaggaggcctgcagcaatggatag

SEQ ID NO: 156484 - DNA, 1011 bp, Artificial Sequence
  Description of Artificial Sequence: Synthetic coding sequence
atgcccttctgtgacaaggacaggaccctgatgacccctgtgcagaacctggagcagagctacatgcccccagacagcagcagccctgagaacaagagcctggaggtgtctgacacccgcttccacagcttctccttctatgagctgaagaatgtgaccaacaactttgatgagcggcccatctctgtgggcggcaacaagatgggagagggcggctttggagtggtgtacaagggctacgtgaacaacaccaccgtggccgtgaagaagctggccgccatggtggacatcaccacagaggagctgaagcagcagtttgaccaggagatcaaggtgatggccaagtgccagcacgagaacctggtggagctgctgggcttcagcagtgatggagatgacctgtgcctggtgtatgtgtacatgcccaacggcagcctgctggaccggctgagctgcctggatggcaccccacccctgtcctggcacatgcgctgcaagatcgcccagggcgccgccaacggcatcaacttcctgcacgagaaccaccacatccaccgggacatcaagagcgccaacatcctgctggatgaggccttcaccgccaagatcagtgactttggcctggcccgggccagcgagaagtttgcccagacagtgatgaccagccgcatcgtgggcaccacagcctacatggcccctgaggccctgcggggggagatcacccccaagagtgacatctacagctttggagtggtgctgctggagatcatcaccggcctgcctgctgtggatgagcaccgggagccccagctgctgctggacatcaaggaggagattgaagatgaggagaagaccatcgaggactacatcgacaagaagatgaatgatgctgacagcacctctgtggaggccatgtacagcgtggccagccagtgcctgcacgagaagaagaacaagaggccagacatcaagaaggtgcagcagctgctgcaggagatgacagccagctag

SEQ ID NO: 156485 - DNA, 1011 bp, Artificial Sequence; identical to SEQ ID NO: 156484
  Description of Artificial Sequence: Synthetic coding sequence

SEQ ID NO: 156486 - DNA, 1383 bp, Artificial Sequence
  Description of Artificial Sequence: Synthetic coding sequence
atgaacaagcccatcacccccagcacctacgtgcgctgcctgaatgtgggcctcatcaggaagctgagtgacttcatcgacccccaggagggctggaagaagctggccgtggccatcaagaagcccagcggagatgaccgctacaaccagttccacatccgccgctttgaggccctgctgcagacaggcaagagccccaccagcgagctgctgtttgactggggcaccaccaactgcaccgtgggggacctggtggacctgctgatccagaatgagttctttgccccagccagcctgctgctgcctgatgctgtgcccaagacagccaacaccctgcccagcaaggaggccatcaccgtgcagcagaagcagatgcccttctgtgacaaggacaggaccctgatgacccctgtgcagaacctggagcagagctacatgcccccagacagcagcagccctgagaacaagagcctggaggtgtctgacacccgcttccacagcttctccttctatgagctgaagaatgtgaccaacaactttgatgagcggcccatctctgtgggcggcaacaagatgggagagggcggctttggagtggtgtacaagggctacgtgaacaacaccaccgtggccgtgaagaagctggccgccatggtggacatcaccacagaggagctgaagcagcagtttgaccaggagatcaaggtgatggccaagtgccagcacgagaacctggtggagctgctgggcttcagcagtgatggagatgacctgtgcctggtgtatgtgtacatgcccaacggcagcctgctggaccggctgagctgcctggatggcaccccacccctgtcctggcacatgcgctgcaagatcgcccagggcgccgccaacggcatcaacttcctgcacgagaaccaccacatccaccgggacatcaagagcgccaacatcctgctggatgaggccttcaccgccaagatcagtgactttggcctggcccgggccagcgagaagtttgcccagacagtgatgaccagccgcatcgtgggcaccacagcctacatggcccctgaggccctgcggggggagatcacccccaagagtgacatctacagctttggagtggtgctgctggagatcatcaccggcctgcctgctgtggatgagcaccgggagccccagctgctgctggacatcaaggaggagattgaagatgaggagaagaccatcgaggactacatcgacaagaagatgaatgatgctgacagcacctctgtggaggccatgtacagcgtggccagccagtgcctgcacgagaagaagaacaagaggccagacatcaagaaggtgcagcagctgctgcaggagatgacagccagctag

SEQ ID NO: 156487 - DNA, 270 bp, Artificial Sequence
  Description of Artificial Sequence: Synthetic coding sequence
atgaacaagcccatcacccccagcacctacgtgcgctgcctgaatgtgggcctcatcaggaagctgagtgacttcatcgacccccaggagggctggaagaagctggccgtggccatcaagaagcccagcggagatgaccgctacaaccagttccacatccgccgctttgaggccctgctgcagacaggcaagagccccaccagcgagctgctgtttgactggggcaccaccaactgcaccgtgggggacctggtggacctgctgatctag

SEQ ID NO: 156488 - DNA, 1383 bp, Artificial Sequence; identical to SEQ ID NO: 156486
  Description of Artificial Sequence: Synthetic coding sequence

SEQ ID NO: 156489 - DNA, 2394 bp, Artificial Sequence
  Description of Artificial Sequence: Synthetic coding sequence
atgtacctggagacccggcgggccatctttgtgttctggatcttcctgcaggtgcagggcaccaaggacatcagcatcaacatctaccacagcgagaccaaggacatcgacaaccccccaagaaatgagaccacagagagcacagagaagatgtacaagatgagcaccatgaggcgcatctttgacctggccaagcacaggaccaagaggtctgccttcttccccaccggggtgaaggtgtgcccccaggagagcatgaagcagatcctggacagcctgcaggcctactaccgcctgcgggtgtgccaggaggccgtgtgggaggcctaccgcatcttcctggaccgcatcccagacaccggggagtaccaggactgggtgtccatctgccagcaggagaccttctgcctgtttgacatcggcaagaacttcagcaacagccaggagcacctggacctgctgcagcagaggatcaagcagaggagcttcccagacaggaaggatgagatctctgctgagaagaccctgggggagcctggagagaccatcgtcatcagcacagatgtggccaacgtgtccctgggccccttccccctgaccccagatgacaccctgctgaatgagatcctggacaacaccctgaatgacaccaagatgcccaccacagagcgggagacagaatttgctgtgctggaggagcagagggtggagctgtctgtgtccctggtgaaccagaagttcaaggccgagctggccgacagccagagcccctactaccaggagctggccggcaagagccagctgcagatgcagaagatcttcaagaagctgcccggcttcaagaagatccacgtgctgggcttccggcccaagaaggagaaggatggcagcagcagcacagagatgcagctgacagccatcttcaagaggcacagcgctgaggccaagagccctgccagtgacctgctgagctttgacagcaacaagattgagagcgaggaggtgtaccacggcaccatggaggaggacaagcagcctgagatctacctgacagccacagacctgaagaggctcatcagcaaggccctggaggaggagcagagcctggatgtgggcaccatccagttcacagatgaaattgctggcagcctgcctgcctttggaccagacacccagagcgagctgcccaccagctttgctgtgatcacagaagatgccaccctgagccctgagctgccccctgtggagccccagctggagaccgtggatggagctgagcacggcctgcctgacacctcctggagccccccagccatggccagcaccagcctgtctgaggccccacccttcttcatggccagcagcatcttcagcctgacagaccagggcaccacagacaccatggccacagaccagaccatgctggtgcccggcctgaccatccccaccagtgactacagcgccatcagccagctggccctgggcatcagccaccccccagccagcagtgatgacagccgcagcagcgctggaggagaggacatggtgcgccacctggatgagatggacctgagtgacaccccagcccccagcgaggtgcctgagctgtctgaatatgtgtctgtgcctgaccacttcctggaggacaccacccctgtgtctgccctgcagtacatcaccaccagctccatgaccatcgcccccaagggccgggagctggtggtgttcttcagcctgcgggtggccaacatggccttcagcaatgacctcttcaacaagagcagcctggagtaccgggccctggagcagcagttcacccagctgctggtgccctacctgcggagcaacctgaccggcttcaagcagctggagatcctgaacttcagaaatggcagcgtcatcgtgaacagcaagatgaagtttgccaagtctgtgccctacaacctgaccaaggctgtgcacggcgtgctggaggacttccgctctgctgctgcccagcagctgcacctggagattgacagctacagcctgaacatcgagcctgctgaccaggccgacccctgcaagttcctggcctgtggggagtttgcccagtgtgtgaagaatgaaagaacagaggaggctgaatgtcgctgcaagccaggctatgacagccagggcagcctggatggcctggagcccggcctgtgtggccctggcaccaaggaatgtgaggtgctgcagggcaaaggagccccctgccgcctgcctgaccacagcgagaaccaggcctacaagacctctgtgaagaagttccagaaccagcagaacaacaaggtgatcagcaagagaaattctgagctgctgactgtggagtatgaggagttcaaccaccaggactgggagggcaactag

SEQ ID NO: 156490 - DNA, 477 bp, Artificial Sequence
  Description of Artificial Sequence: Synthetic coding sequence
gagcggcccaacggcaccagcgcccagcctgcccaggtgaagccagagttctaccggcaggccgagctgaagccctgcccctggacaggcagcaaccagaggcgctgcatcaccttctgccccaccccagaccaggccgacccctgcaagttcctggcctgtggggagtttgcccagtgtgtgaagaatgaaagaacagaggaggccgagtgccgctgcaagccaggctatgacagccagggcagcctggatggcctggagcccggcctgtgtggccctggcaccaaggaatgtgaggtgctgcagggcaagggggccccctgccgcctgcctgaccacagcgagaaccaggcctacaagacctctgtgaagaagttccagaaccagcagaacaacaaggtgatcagcaagaggaacagcgagctgctgactgtggagtatgaggagttcaaccaccaggactgggagggcaactag

SEQ ID NO: 156491 - DNA, 444 bp, Artificial Sequence
  Description of Artificial Sequence: Synthetic coding sequence
atgtacctggagacccggcgggccatctttgtgttctggatcttcctgcaggtgcagggcaccaaggtgtgccaggaggccgtgtgggaggcctaccgcatcttcctggaccgcatcccagacaccggggagtaccaggactgggtgtccatctgccagcaggagaccttctgcctgtttgacatcggcaagaacttcagcaacagccaggagcacctggacctgctgcagcagaggatcaagcagaggagcttcccagacaggaaggatgagatctctgctgagaagaccctgggggagcctggagagaccatcgtcatcagcacagagaagaacaagggcaagaccaagcccttcaacatcctgcagtttggaaacaaccaccacgagcacctgctgcccatcttctgcctgctgagcagcatcatctacacctactactag

SEQ ID NO: 156492 - DNA, 3726 bp, Artificial Sequence
  Description of Artificial Sequence: Synthetic coding sequence
atgatcatgttccccctgtttgggaagatcagcctgggcatcctgatctttgtgctgattgaaggagacttccccagcctgacagcccagacctacctgagcattgaggagatccaggagcccaagtctgctgtgtccttcctgctgcctgaggagagcacagacctgagcctggccaccaagaagaagcagcccctggaccggcgggagacagagcggcagtggctgatcagaagaagaagaagcatcctcttccccaatggagtgaagatctgcccagatgagagcgtggccgaggccgtggccaaccacgtgaagtacttcaaggtgcgggtgtgccaggaggccgtgtgggaggccttccgcaccttctgggaccggctgcccggccgggaggagtaccactactggatgaacctgtgtgaagatggagtgaccagcatctttgagatgggcaccaacttcagcgagagcgtggagcacaggagcctcatcatgaagaagctgacctacgccaaggagaccgtgagcagcagcgagctgagcagccctgtgcctgtgggggacaccagcaccctgggggacaccaccctgtctgtgccccaccctgaggtggatgcctatgagggcgccagcgagagcagcctggagaggcctgaggagagcatcagcaatgaaattgaaaatgtgattgaggaggccaccaagccagctggggagcagattgctgagttcagcatccacctgctgggcaagcagtaccgggaggagctgcaggacagcagcagcttccaccaccagcacctggaggaggagttcatcagcgaggtggagaatgccttcaccggcctgcccggctacaaggagatccgggtgctggagttccgcagccccaaggaaaatgattctggagtggatgtgtactatgctgtgaccttcaacggggaggccatcagcaacaccacctgggacctgatcagcctgcacagcaacaaggtggagaaccacggcctggtggagctggatgacaagcccaccgtggtgtacaccatcagcaacttccgggactacatcgccgagaccctgcagcagaacttcctgctgggcaacagcagcctgaacccagaccctgacagcctgcagctgatcaacgtgcggggcgtgctgcggcaccagacagaggacctggtgtggaacacccagagcagcagcctgcaggccacccccagcagcatcctggacaacaccttccaggccgcctggcccagcgcagatgagagcatcaccagcagcatcccccccctggacttcagcagcggccccccatctgccaccggccgggagctgtggagcgagagccccctgggggacctggtgtccacccacaagctggccttccccagcaagatgggcctgagcagcagccctgaggtgctggaggtgagcagcctgaccctgcacagcgtgaccccagctgtgctgcagacaggcctgcctgtggccagcgaggagaggaccagcggcagccacctggtggaggatggcctggccaacgtggaggagagcgaggacttcctgagcattgacagcctgcccagcagcagcttcacccagcctgtgcccaaggagaccatccccagcatggaggacagtgatgtgtccctgaccagcagcccctacctgaccagcagcatccccttcggcctggacagcctgaccagcaaggtgaaggaccagctgaaggtgagccccttcctgcctgatgcctccatggagaaggagctgatctttgatggcggcctgggcagcggcagcggccagaaggtggacctgatcacctggccctggagcgagaccagcagcgagaagtctgctgagcccctgagcaagccctggctggaggatgatgacagcctgctgcctgctgagattgaggacaagaagctggtgctggtggacaagatggacagcacagaccagatcagcaagcacagcaaatatgaacatgatgacaggagcacccacttccctgaggaggagcccctgagcggccctgctgtgcccatctttgctgacacagctgctgagagcgccagcctgaccctgcccaagcacatcagcgaggtgcctggggtggatgactacagcgtgaccaaggcccccctcatcctgacctctgtggccatcagcgccagcacagacaagagtgaccaggctgatgccatcctgcgggaggacatggagcagatcacagagagcagcaactatgagtggtttgattctgaggtgtccatggtgaagccagacatgcagaccctgtggaccatcctgcctgagagcgagcgggtgtggaccaggaccagcagcctggagaagctgagccgggacatcctggccagcaccccccagagcgctgaccggctgtggctgtctgtgacccagagcaccaagctgccccccaccaccatcagcaccctgctggaggatgaagtcatcatgggcgtgcaggacatcagcctggagctggacagaattggaacagactactaccagcctgagcaggtgcaggagcagaatggcaaggtgggcagctatgtggagatgagcacctctgtgcacagcacagagatggtgtctgtggcctggcccacagagggcggagatgacctgagctacacccagaccagcggggccctggtggtgttcttcagcctgcgggtgaccaacatgatgttttctgaggacctcttcaacaagaacagcctggagtacaaggccctggagcagcgcttcctggagctgctggtgccctacctgcagagcaacctgaccggcttccagaacctggagatcctgaacttcagaaatggcagcatcgtggtgaacagcaggatgaagtttgccaacagcgtgccccccaacgtgaacaatgctgtgtacatgatcctggaggacttctgcaccacagcctacaacaccatgaacctggccatcgacaagtacagcctggatgtggagagcggagatgaggccaacccctgcaagttccaggcctgcaatgagttcagcgagtgcctggtgaacccctggagcggggaggccaagtgccgctgcttccctggctacctgtctgtggaggagcggccctgccagagcctgtgtgacctgcagcctgacttctgcctgaatgatggaaaatgtgacatcatgcctggccatggagccatctgccgctgccgggtgggggagaactggtggtaccggggcaagcactgtgaggagtttgtgtctgagcctgtgatcatcggcatcaccatcgcctctgtggtgggcctgctggtgatcttcagcgccatcatctacttcttcatccgcaccctgcaggcccaccacgacagaagtgagcgggagagccccttcagcggcagcagccggcagcctgacagcctgagcagcattgaaaatgctgtgaagtacaaccctgtgtatgagagccaccgggccggctgtgagaagtatgagggcccctacccccagcaccccttctacagcagcgccagcggagatgtgattggaggcctgagccgggaggagatccggcagatgtatgagagcagcgagctgagccgggaggagatccaggagaggatgagggtgctggagctgtatgccaatgaccctgagtttgctgcctttgtgcgggagcagcaggtggaggaggtgtag

SEQ ID NO: 156493 - DNA, 201 bp, Artificial Sequence
  Description of Artificial Sequence: Synthetic coding sequence
ggctacctgtctgtggaggagcggccctgccagagcctgtgtgacctgcagcctgacttctgcctgaatgatggaaaatgtgacatcatgcctggccatggagccatctgcagcggcagcagccggcagcctgacagcctgagcagcattgaaaatgctgtgaagtacaaccctgtgtatgagagccacagagctggatag

SEQ ID NO: 156494 - DNA, 2745 bp, Artificial Sequence
  Description of Artificial Sequence: Synthetic coding sequence
atggcccagttccccaccccatttggaggcagcctggacatctgggccatcaccgtggaggagcgggccaagcatgaccagcagttccacagcctgaagcccatcagcggcttcatcaccggggaccaggccaggaacttcttcttccagagcggcctgccccagcctgtgctggcccagatctgggccctggccgacatgaacaatgatggccgcatggaccaggtggagttcagcatcgccatgaagctgatcaagctgaagctgcagggctaccagctgcccagcgccctgccccctgtgatgaagcagcagcctgtggccatcagcagcgccccagccttcggcatgggcggcatcgcctccatgccacccctgacagctgtggcccctgtgcccatgggcagcatccctgtggtgggcatgagccccaccctggtgtcctctgtgcccacagctgctgtgccccccctggccaacggggcccctcctgtgatccagcccctgcctgcctttgcccaccctgctgccaccctgcccaagagcagcagcttcagccgcagcggccctggcagccagctgaacaccaagctgcagaaggcccagagctttgatgtggcctctgtgccccctgtggccgagtgggccgtgccccagagcagccggctgaagtaccggcagctgttcaacagccatgacaagaccatgagcggccacctgaccggcccccaggcccggaccatcctgatgcagagcagcctgccccaggcccagctggccagcatctggaacctgagtgacatcgaccaggacggcaagctgacagctgaggagttcatcctggccatgcacctgattgatgtggccatgagcggccagcccctgccccctgtgctgcccccagagtacatccccccatccttcagaagagtgcgcagcggcagcggcatcagcgtcatcagcagcacctctgtggaccagaggctgcctgaggagcctgtgctggaggatgagcagcagcagctggagaagaagctgcctgtgacctttgaggacaagaagcgggagaactttgagcggggcaacctggagctggagaagaggcggcaggccctgctggagcagcagaggaaggagcaggagcggctggcccagctggagagagctgagcaggagaggaaggagcgggagcggcaggagcaggagaggaagaggcagctggagctggagaagcagctggagaagcagcgggagctggagcggcagcgggaggaggagaggaggaaggagattgaaagaagagaggccgccaagcgggagctggagcggcagaggcagctggagtgggagaggaacagacggcaggagctgctgaaccagaggaacaaggagcaggaggacatcgtggtgctgaaggccaagaagaagaccctggagtttgagctggaggccctgaatgacaagaagcaccagctggagggcaagctgcaggacatccgctgccgcctgaccacccagaggcaggagattgagagcaccaacaagagccgggagctgagaattgctgagatcacccacctgcagcagcagctgcaggagagccagcagatgctgggccgcctcatccctgagaagcagatcctgaatgaccagctgaagcaggtgcagcagaacagcctgcaccgggacagcctggtgaccctgaagagggccctggaggccaaggagctggcccggcagcacctgcgggaccagctggatgaggtggagaaggagaccaggagcaagctgcaggagattgacatcttcaacaaccagctgaaggagctgcgggagatccacaacaagcagcagctgcagaagcagaagtccatggaggccgagcggctgaagcagaaggagcaggagaggaagatcatcgagctggagaagcagaaggaggaggcccagaggcgggcccaggagcgggacaagcagtggctggagcacgtgcagcaggaggatgagcaccagaggcccaggaagctgcacgaggaggagaagctgaagcgggaggagagcgtgaagaagaaggatggagaggagaagggcaagcaggaggcccaggacaagctgggccgcctcttccaccagcaccaggagcccgccaagccagctgtgcaggccccctggagcacagctgagaagggccccctgaccatcagcgcccaggagaatgtgaaggtggtgtactaccgggccctgtacccctttgagagccgcagccatgatgagatcaccatccagcccggggacatcgtgatggtggatgagagccagacaggagagcccggctggctgggcggggagctgaagggcaagacaggctggttccctgccaactatgcagagaagatcccagaaaatgaggtgcctgcccctgtgaagcctgtgacagacagcaccagcgccccagcccccaagctggccctgcgggagaccccagcccccctggccgtgaccagcagcgagcccagcaccacccccaacaactgggccgacttcagcagcacctggcccaccagcaccaatgagaagccagagacagacaactgggatgcctgggccgcccagcccagcctgactgtgcccagcgctggccagctgcggcagaggtctgccttcaccccagccacagccaccggcagcagccccagccctgtgctgggccagcacggcttctggttcttccgggagagctgctag

SEQ ID NO: 156495 - DNA, 954 bp, Artificial Sequence
  Description of Artificial Sequence: Synthetic coding sequence
tgacccctgatggagagcgagctgctgacagagaaggaggtggccatgatctttgtgaactggaaggagctgatcatgtgcaacatcaagctgctgaaggccctgcgggtgaggaagaagatgtctggagagaagatgcctgtgaagatgattggagacatcctgagcgcccagctgccccacatgcagccctacatccgcttctgcagccggcagctgaatggagctgccctgatccagcagaagacagatgaggccccagacttcaaggagtttgtgaagaggctggccatggacccccgctgcaagggcatgcccctgagcagcttcatcctgaagcccatgcagagggtgacccgctaccccctcatcatcaagaaccagctggtgttcaacagcgtgaccaactgcctgggccccaggaagttcctgcacagcggcaagctgtacaaggccaagagcaacaaggagctgtatggcttcctgttcaatgacttcctgctgctgacccagatcaccaagcccctgggcagcagcggcacagacaaggtgttcagccccaagagcaacctgcagtacaagatgtacaagacccccatcttcctgaatgaggtgctggtgaagctgcccacagaccccagcggagatgagcccatcttccacatcagccacatcgacagagtgtacaccctgcgggcagagagcatcaatgaaagaacagcctgggtgcagaagatcaaggccgccagcgagctgtacatcgagacagagaagaagaagcgggagaaggcctacctggtgcgcagccagagggccactggaattggccgcctgatggtgaatgtggtggagggcatcgagctgaagccctgccgcagccacggcaagagcaacccctactgtgaggtgaccatgggcagccagtgccacatcaccaagaccatccaggactag

SEQ ID NO: 156496 - DNA, 5166 bp, Artificial Sequence
  Description of Artificial Sequence: Synthetic coding sequence
atggcccagttccccaccccatttggaggcagcctggacatctgggccatcaccgtggaggagcgggccaagcatgaccagcagttccacagcctgaagcccatcagcggcttcatcaccggggaccaggccaggaacttcttcttccagagcggcctgccccagcctgtgctggcccagatctgggccctggccgacatgaacaatgatggccgcatggaccaggtggagttcagcatcgccatgaagctgatcaagctgaagctgcagggctaccagctgcccagcgccctgccccctgtgatgaagcagcagcctgtggccatcagcagcgccccagccttcggcatgggcggcatcgcctccatgccacccctgacagctgtggcccctgtgcccatgggcagcatccctgtggtgggcatgagccccaccctggtgtcctctgtgcccacagctgctgtgccccccctggccaacggggcccctcctgtgatccagcccctgcctgcctttgcccaccctgctgccaccctgcccaagagcagcagcttcagccgcagcggccctggcagccagctgaacaccaagctgcagaaggcccagagctttgatgtggcctctgtgccccctgtggccgagtgggccgtgccccagagcagccggctgaagtaccggcagctgttcaacagccatgacaagaccatgagcggccacctgaccggcccccaggcccggaccatcctgatgcagagcagcctgccccaggcccagctggccagcatctggaacctgagtgacatcgaccaggacggcaagctgacagctgaggagttcatcctggccatgcacctgattgatgtggccatgagcggccagcccctgccccctgtgctgcccccagagtacatccccccatccttcagaagagtgcgcagcggcagcggcatcagcgtcatcagcagcacctctgtggaccagaggctgcctgaggagcctgtgctggaggatgagcagcagcagctggagaagaagctgcctgtgacctttgaggacaagaagcgggagaactttgagcggggcaacctggagctggagaagaggcggcaggccctgctggagcagcagaggaaggagcaggagcggctggcccagctggagagagctgagcaggagaggaaggagcgggagcggcaggagcaggagaggaagaggcagctggagctggagaagcagctggagaagcagcgggagctggagcggcagcgggaggaggagaggaggaaggagattgaaagaagagaggccgccaagcgggagctggagcggcagaggcagctggagtgggagaggaacagacggcaggagctgctgaaccagaggaacaaggagcaggaggacatcgtggtgctgaaggccaagaagaagaccctggagtttgagctggaggccctgaatgacaagaagcaccagctggagggcaagctgcaggacatccgctgccgcctgaccacccagaggcaggagattgagagcaccaacaagagccgggagctgagaattgctgagatcacccacctgcagcagcagctgcaggagagccagcagatgctgggccgcctcatccctgagaagcagatcctgaatgaccagctgaagcaggtgcagcagaacagcctgcaccgggacagcctggtgaccctgaagagggccctggaggccaaggagctggcccggcagcacctgcgggaccagctggatgaggtggagaaggagaccaggagcaagctgcaggagattgacatcttcaacaaccagctgaaggagctgcgggagatccacaacaagcagcagctgcagaagcagaagtccatggaggccgagcggctgaagcagaaggagcaggagaggaagatcatcgagctggagaagcagaaggaggaggcccagaggcgggcccaggagcgggacaagcagtggctggagcacgtgcagcaggaggatgagcaccagaggcccaggaagctgcacgaggaggagaagctgaagcgggaggagagcgtgaagaagaaggatggagaggagaagggcaagcaggaggcccaggacaagctgggccgcctcttccaccagcaccaggagcccgccaagccagctgtgcaggccccctggagcacagctgagaagggccccctgaccatcagcgcccaggagaatgtgaaggtggtgtactaccgggccctgtacccctttgagagccgcagccatgatgagatcaccatccagcccggggacatcgtgatggtgattggctgctgggtggatgagagccagacaggagagcccggctggctgggcggggagctgaagggcaagacaggctggttccctgccaactatgcagagaagatcccagaaaatgaggtgcctgcccctgtgaagcctgtgacagacagcaccagcgccccagcccccaagctggccctgcgggagaccccagcccccctggccgtgaccagcagcgagcccagcaccacccccaacaactgggccgacttcagcagcacctggcccaccagcaccaatgagaagccagagacagacaactgggatgcctgggccgcccagcccagcctgactgtgcccagcgctggccagctgcggcagaggtctgccttcaccccagccacagccaccggcagcagccccagccctgtgctgggccagggcgagaaggtggagggcctgcaggcccaggccctgtacccctggagggccaagaaggacaaccacctgaacttcaacaagaatgatgtgatcaccgtgctggagcagcaggacatgtggtggtttggagaggtgcagggccagaagggctggttccccaagagctatgtgaagctgatcagcggccccatcaggaagagcacctccatggattctggcagcagcgagagccctgccagcctgaagagggtggccagccctgctgccaagcctgtggtgtctggagaggagttcatcgccatgtacacctatgagagcagcgagcagggcgacctgaccttccagcagggagatgtgatcctggtgaccaagaaggatggagactggtggacaggcaccgtgggggacaaggccggggtcttccccagcaactacgtgcggctgaaggacagcgagggcagcggcacagctgggaagacaggcagcctgggcaagaagccagagatcgcccaggtgattgccagctacacagccaccggccctgagcagctgaccctggcccctggccagctgatcctgatcaggaagaagaaccctgggggctggtgggagggggagctgcaggcccggggcaagaagaggcagatcggctggttccctgccaactacgtgaagctgctgagccctggcaccagcaagatcacccccacagagccccccaagagcacagccctggccgctgtgtgccaggtgattggcatgtatgactacacagcccagaatgatgatgagctggccttcaacaagggccagatcatcaacgtgctgaacaaggaggaccctgactggtggaagggggaggtgaatggccaggtgggcctcttccccagcaactacgtgaagctgaccacagacatggaccccagccagcagtggtgcagcgacctgcacctgctggacatgctgacccccacagagaggaagaggcagggctacatccacgagctgattgtgacagaggagaactacgtgaatgacctgcagctggtgacagagatcttccagaagcccctgatggagagcgagctgctgacagagaaggaggtggccatgatctttgtgaactggaaggagctgatcatgtgcaacatcaagctgctgaaggccctgcgggtgaggaagaagatgtctggagagaagatgcctgtgaagatgattggagacatcctgagcgcccagctgccccacatgcagccctacatccgcttctgcagccggcagctgaatggagctgccctgatccagcagaagacagatgaggccccagacttcaaggagtttgtgaagaggctggccatggacccccgctgcaagggcatgcccctgagcagcttcatcctgaagcccatgcagagggtgacccgctaccccctcatcatcaagaacatcctggagaacaccccagagaaccacccagaccacagccacctgaagcacgccctggagaaggccgaggagctgtgcagccaggtgaatgaaggagtgcgggagaaggagaacagcgaccggctggagtggatccaggcccacgtgcagtgtgagggcctgtctgagcagctggtgttcaacagcgtgaccaactgcctgggccccaggaagttcctgcacagcggcaagctgtacaaggccaagagcaacaaggagctgtatggcttcctgttcaatgacttcctgctgctgacccagatcaccaagcccctgggcagcagcggcacagacaaggtgttcagccccaagagcaacctgcagtacaagatgtacaagacccccatcttcctgaatgaggtgctggtgaagctgcccacagaccccagcggagatgagcccatcttccacatcagccacatcgacagagtgtacaccctgcgggcagagagcatcaatgaaagaacagcctgggtgcagaagatcaaggccgccagcgagctgtacatcgagacagagaagaagaagcgggagaaggcctacctggtgcgcagccagagggccactggaattggccgcctgatggtgaatgtggtggagggcatcgagctgaagccctgccgcagccacggcaagagcaacccctactgtgaggtgaccatgggcagccagtgccacatcaccaagaccatccaggacaccctgaaccccaagtggaacagcaactgccagttcttcatccgggacctggagcaggaggtgctgtgcatcaccgtgtttgagcgggaccagttctccccagatgacttcctgggccgcacagagatccgggtggccgacatcaagaaggaccagggcagcaagggccctgtgaccaagtgcctgctgctgcacgaggtgcccaccggggagatcgtggtgcggctggacctgcagctgtttgatgagccctag

SEQ ID NO: 156497 - DNA, 4953 bp, Artificial Sequence
  Description of Artificial Sequence: Synthetic coding sequence
atggcccagttccccaccccatttggaggcagcctggacatctgggccatcaccgtggaggagcgggccaagcatgaccagcagttccacagcctgaagcccatcagcggcttcatcaccggggaccaggccaggaacttcttcttccagagcggcctgccccagcctgtgctggcccagatctgggccctggccgacatgaacaatgatggccgcatggaccaggtggagttcagcatcgccatgaagctgatcaagctgaagctgcagggctaccagctgcccagcgccctgccccctgtgatgaagcagcagcctgtggccatcagcagcgccccagccttcggcatgggcggcatcgcctccatgccacccctgacagctgtggcccctgtgcccatgggcagcatccctgtggtgggcatgagccccaccctggtgtcctctgtgcccacagctgctgtgccccccctggccaacggggcccctcctgtgatccagcccctgcctgcctttgcccaccctgctgccaccctgcccaagagcagcagcttcagccgcagcggccctggcagccagctgaacaccaagctgcagaaggcccagagctttgatgtggcctctgtgccccctgtggccgagtgggccgtgccccagagcagccggctgaagtaccggcagctgttcaacagccatgacaagaccatgagcggccacctgaccggcccccaggcccggaccatcctgatgcagagcagcctgccccaggcccagctggccagcatctggaacctgagtgacatcgaccaggacggcaagctgacagctgaggagttcatcctggccatgcacctgattgatgtggccatgagcggccagcccctgccccctgtgctgcccccagagtacatccccccatccttcagaagagtgcgcagcggcagcggcatcagcgtcatcagcagcacctctgtggaccagaggctgcctgaggagcctgtgctggaggatgagcagcagcagctggagaagaagctgcctgtgacctttgaggacaagaagcgggagaactttgagcggggcaacctggagctggagaagaggcggcaggccctgctggagcagcagaggaaggagcaggagcggctggcccagctggagagagctgagcaggagaggaaggagcgggagcggcaggagcaggagaggaagaggcagctggagctggagaagcagctggagaagcagcgggagctggagcggcagcgggaggaggagaggaggaaggagattgaaagaagagaggccgccaagcgggagctggagcggcagaggcagctggagtgggagaggaacagacggcaggagctgctgaaccagaggaacaaggagcaggaggacatcgtggtgctgaaggccaagaagaagaccctggagtttgagctggaggccctgaatgacaagaagcaccagctggagggcaagctgcaggacatccgctgccgcctgaccacccagaggcaggagattgagagcaccaacaagagccgggagctgagaattgctgagatcacccacctgcagcagcagctgcaggagagccagcagatgctgggccgcctcatccctgagaagcagatcctgaatgaccagctgaagcaggtgcagcagaacagcctgcaccgggacagcctggtgaccctgaagagggccctggaggccaaggagctggcccggcagcacctgcgggaccagctggatgaggtggagaaggagaccaggagcaagctgcaggagattgacatcttcaacaaccagctgaaggagctgcgggagatccacaacaagcagcagctgcagaagcagaagtccatggaggccgagcggctgaagcagaaggagcaggagaggaagatcatcgagctggagaagcagaaggaggaggcccagaggcgggcccaggagcgggacaagcagtggctggagcacgtgcagcaggaggatgagcaccagaggcccaggaagctgcacgaggaggagaagctgaagcgggaggagagcgtgaagaagaaggatggagaggagaagggcaagcaggaggcccaggacaagctgggccgcctcttccaccagcaccaggagcccgccaagccagctgtgcaggccccctggagcacagctgagaagggccccctgaccatcagcgcccaggagaatgtgaaggtggtgtactaccgggccctgtacccctttgagagccgcagccatgatgagatcaccatccagcccggggacatcgtgatggtgattggctgctgggtggatgagagccagacaggagagcccggctggctgggcggggagctgaagggcaagacaggctggttccctgccaactatgcagagaagatcccagaaaatgaggtgcctgcccctgtgaagcctgtgacagacagcaccagcgccccagcccccaagctggccctgcgggagaccccagcccccctggccgtgaccagcagcgagcccagcaccacccccaacaactgggccgacttcagcagcacctggcccaccagcaccaatgagaagccagagacagacaactgggatgcctgggccgcccagcccagcctgactgtgcccagcgctggccagctgcggcagaggtctgccttcaccccagccacagccaccggcagcagccccagccctgtgctgggccagggcgagaaggtggagggcctgcaggcccaggccctgtacccctggagggccaagaaggacaaccacctgaacttcaacaagaatgatgtgatcaccgtgctggagcagcaggacatgtggtggtttggagaggtgcagggccagaagggctggttccccaagagctatgtgaagctgatcagcggccccatcaggaagagcacctccatggattctggcagcagcgagagccctgccagcctgaagagggtggccagccctgctgccaagcctgtggtgtctggagaggagatcgcccaggtgattgccagctacacagccactggacctgagcagctgaccctggcccctggccagctgatcctgatcaggaagaagaaccctgggggctggtgggagggggagctgcaggcccggggcaagaagaggcagatcggctggttccctgccaactacgtgaagctgctgagccctggcaccagcaagatcacccccacagagccccccaagagcacagccctggccgctgtgtgccaggtgattggcatgtatgactacacagcccagaatgatgatgagctggccttcaacaagggccagatcatcaacgtgctgaacaaggaggaccctgactggtggaagggggaggtgaatggccaggtgggcctcttccccagcaactacgtgaagctgaccacagacatggaccccagccagcagtggtgcagcgacctgcacctgctggacatgctgacccccacagagaggaagaggcagggctacatccacgagctgattgtgacagaagaaaattatgtgaatgacctgcagctggtgacagagatcttccagaagcccctgatggagagcgagctgctgacagagaaggaggtggccatgatctttgtgaactggaaggagctgatcatgtgcaacatcaagctgctgaaggccctgcgggtgaggaagaagatgtctggagagaagatgcctgtgaagatgattggagacatcctgagcgcccagctgccccacatgcagccctacatccgcttctgcagccggcagctgaatggagctgccctgatccagcagaagacagatgaggccccagacttcaaggagtttgtgaagaggctggccatggacccccgctgcaagggcatgcccctgagcagcttcatcctgaagcccatgcagagggtgacccgctaccccctcatcatcaagaacatcctggagaacaccccagagaaccacccagaccacagccacctgaagcacgccctggagaaggccgaggagctgtgcagccaggtgaatgaaggagtgcgggagaaggaaaattctgaccggctggagtggatccaggcccacgtgcagtgtgagggcctgtctgagcagctggtgttcaacagcgtgaccaactgcctgggccccaggaagttcctgcacagcggcaagctgtacaaggccaagagcaacaaggagctgtatggcttcctgttcaatgacttcctgctgctgacccagatcaccaagcccctgggcagcagcggcacagacaaggtgttcagccccaagagcaacctgcagtacaagatgtacaagacccccatcttcctgaatgaggtgctggtgaagctgcccacagaccccagcggagatgagcccatcttccacatcagccacatcgacagagtgtacaccctgcgggcagagagcatcaatgaaagaacagcctgggtgcagaagatcaaggccgccagcgagctgtacattgaaacagagaagaagaagcgggagaaggcctacctggtgcgcagccagagggccaccggcatcggccgcctgatggtgaatgtggtggagggcatcgagctgaagccctgccgcagccacggcaagagcaacccctactgtgaggtgaccatgggcagccagtgccacatcaccaagaccatccaggacaccctgaaccccaagtggaacagcaactgccagttcttcatccgggacctggagcaggaggtgctgtgcatcaccgtgtttgagcgggaccagttctccccagatgacttcctgggccgcacagagatccgggtggccgacatcaagaaggaccagggcagcaaaggacctgtgaccaagtgcctgctgctgcacgaggtgcccactggagagatcgtggtgcggctggacctgcagctgtttgatgagccctag

SEQ ID NO: 156498 - DNA, 3237 bp, Artificial Sequence
  Description of Artificial Sequence: Synthetic coding sequence
atggcccagttccccaccccatttggaggcagcctggacatctgggccatcaccgtggaggagcgggccaagcatgaccagcagttccacagcctgaagcccatcagcggcttcatcaccggggaccaggccaggaacttcttcttccagagcggcctgccccagcctgtgctggcccagatctgggccctggccgacatgaacaatgatggccgcatggaccaggtggagttcagcatcgccatgaagctgatcaagctgaagctgcagggctaccagctgcccagcgccctgccccctgtgatgaagcagcagcctgtggccatcagcagcgccccagccttcggcatgggcggcatcgcctccatgccacccctgacagctgtggcccctgtgcccatgggcagcatccctgtggtgggcatgagccccaccctggtgtcctctgtgcccacagctgctgtgccccccctggccaacggggcccctcctgtgatccagcccctgcctgcctttgcccaccctgctgccaccctgcccaagagcagcagcttcagccgcagcggccctggcagccagctgaacaccaagctgcagaaggcccagagctttgatgtggcctctgtgccccctgtggccgagtgggccgtgccccagagcagccggctgaagtaccggcagctgttcaacagccatgacaagaccatgagcggccacctgaccggcccccaggcccggaccatcctgatgcagagcagcctgccccaggcccagctggccagcatctggaacctgagtgacatcgaccaggacggcaagctgacagctgaggagttcatcctggccatgcacctgattgatgtggccatgagcggccagcccctgccccctgtgctgcccccagagtacatccccccatccttcagaagagtgcgcagcggcagcggcatcagcgtcatcagcagcacctctgtggaccagaggctgcctgaggagcctgtgctggaggatgagcagcagcagctggagaagaagctgcctgtgacctttgaggacaagaagcgggagaactttgagcggggcaacctggagctggagaagaggcggcaggccctgctggagcagcagaggaaggagcaggagcggctggcccagctggagagagctgagcaggagaggaaggagcgggagcggcaggagcaggagaggaagaggcagctggagctggagaagcagctggagaagcagcgggagctggagcggcagcgggaggaggagaggaggaaggagattgaaagaagagaggccgccaagcgggagctggagcggcagaggcagctggagtgggagaggaacagacggcaggagctgctgaaccagaggaacaaggagcaggaggacatcgtggtgctgaaggccaagaagaagaccctggagtttgagctggaggccctgaatgacaagaagcaccagctggagggcaagctgcaggacatccgctgccgcctgaccacccagaggcaggagattgagagcaccaacaagagccgggagctgagaattgctgagatcacccacctgcagcagcagctgcaggagagccagcagatgctgggccgcctcatccctgagaagcagatcctgaatgaccagctgaagcaggtgcagcagaacagcctgcaccgggacagcctggtgaccctgaagagggccctggaggccaaggagctggcccggcagcacctgcgggaccagctggatgaggtggagaaggagaccaggagcaagctgcaggagattgacatcttcaacaaccagctgaaggagctgcgggagatccacaacaagcagcagctgcagaagcagaagtccatggaggccgagcggctgaagcagaaggagcaggagaggaagatcatcgagctggagaagcagaaggaggaggcccagaggcgggcccaggagcgggacaagcagtggctggagcacgtgcagcaggaggatgagcaccagaggcccaggaagctgcacgaggaggagaagctgaagcgggaggagagcgtgaagaagaaggatggagaggagaagggcaagcaggaggcccaggacaagctgggccgcctcttccaccagcaccaggagcccgccaagccagctgtgcaggccccctggagcacagctgagaagggccccctgaccatcagcgcccaggagaatgtgaaggtggtgtactaccgggccctgtacccctttgagagccgcagccatgatgagatcaccatccagcccggggacatcgtgatggtggatgagagccagacaggagagcccggctggctgggcggggagctgaagggcaagacaggctggttccctgccaactatgcagagaagatcccagaaaatgaggtgcctgcccctgtgaagcctgtgacagacagcaccagcgccccagcccccaagctggccctgcgggagaccccagcccccctggccgtgaccagcagcgagcccagcaccacccccaacaactgggccgacttcagcagcacctggcccaccagcaccaatgagaagccagagacagacaactgggatgcctgggccgcccagcccagcctgactgtgcccagcgctggccagctgcggcagaggtctgccttcaccccagccacagccaccggcagcagccccagccctgtgctgggccagggcgagaaggtggagggcctgcaggcccaggccctgtacccctggagggccaagaaggacaaccacctgaacttcaacaagaatgatgtgatcaccgtgctggagcagcaggacatgtggtggtttggagaggtgcagggccagaagggctggttccccaagagctatgtgaagctgatcagcggccccatcaggaagagcacctccatggacagcggcagcagcgagagccctgccagcctgaagagggtggccagccctgctgccaagcctgtggtgtctggagaggagttcatcgccatgtacacctatgagagcagcgagcagggcgacctgaccttccagcagggagatgtgatcctggtgaccaagaaggatggagactggtggacaggaacagtgggggacaaggccggggtcttccccagcaactacgtgcggctgaaggacagcgagggcagcggcacagctgggaagacaggcagcctgggcaagaagccaggccccagctgcaatgtgaagtag

SEQ ID NO: 156499 - DNA, 3663 bp, Artificial Sequence
  Description of Artificial Sequence: Synthetic coding sequence
atggcccagttccccaccccatttggaggcagcctggacatctgggccatcaccgtggaggagcgggccaagcatgaccagcagttccacagcctgaagcccatcagcggcttcatcaccggggaccaggccaggaacttcttcttccagagcggcctgccccagcctgtgctggcccagatctgggccctggccgacatgaacaatgatggccgcatggaccaggtggagttcagcatcgccatgaagctgatcaagctgaagctgcagggctaccagctgcccagcgccctgccccctgtgatgaagcagcagcctgtggccatcagcagcgccccagccttcggcatgggcggcatcgcctccatgccacccctgacagctgtggcccctgtgcccatgggcagcatccctgtggtgggcatgagccccaccctggtgtcctctgtgcccacagctgctgtgccccccctggccaacggggcccctcctgtgatccagcccctgcctgcctttgcccaccctgctgccaccctgcccaagagcagcagcttcagccgcagcggccctggcagccagctgaacaccaagctgcagaaggcccagagctttgatgtggcctctgtgccccctgtggccgagtgggccgtgccccagagcagccggctgaagtaccggcagctgttcaacagccatgacaagaccatgagcggccacctgaccggcccccaggcccggaccatcctgatgcagagcagcctgccccaggcccagctggccagcatctggaacctgagtgacatcgaccaggacggcaagctgacagctgaggagttcatcctggccatgcacctgattgatgtggccatgagcggccagcccctgccccctgtgctgcccccagagtacatccccccatccttcagaagagtgcgcagcggcagcggcatcagcgtcatcagcagcacctctgtggaccagaggctgcctgaggagcctgtgctggaggatgagcagcagcagctggagaagaagctgcctgtgacctttgaggacaagaagcgggagaactttgagcggggcaacctggagctggagaagaggcggcaggccctgctggagcagcagaggaaggagcaggagcggctggcccagctggagagagctgagcaggagaggaaggagcgggagcggcaggagcaggagaggaagaggcagctggagctggagaagcagctggagaagcagcgggagctggagcggcagcgggaggaggagaggaggaaggagattgaaagaagagaggccgccaagcgggagctggagcggcagaggcagctggagtgggagaggaacagacggcaggagctgctgaaccagaggaacaaggagcaggaggacatcgtggtgctgaaggccaagaagaagaccctggagtttgagctggaggccctgaatgacaagaagcaccagctggagggcaagctgcaggacatccgctgccgcctgaccacccagaggcaggagattgagagcaccaacaagagccgggagctgagaattgctgagatcacccacctgcagcagcagctgcaggagagccagcagatgctgggccgcctcatccctgagaagcagatcctgaatgaccagctgaagcaggtgcagcagaacagcctgcaccgggacagcctggtgaccctgaagagggccctggaggccaaggagctggcccggcagcacctgcgggaccagctggatgaggtggagaaggagaccaggagcaagctgcaggagattgacatcttcaacaaccagctgaaggagctgcgggagatccacaacaagcagcagctgcagaagcagaagtccatggaggccgagcggctgaagcagaaggagcaggagaggaagatcatcgagctggagaagcagaaggaggaggcccagaggcgggcccaggagcgggacaagcagtggctggagcacgtgcagcaggaggatgagcaccagaggcccaggaagctgcacgaggaggagaagctgaagcgggaggagagcgtgaagaagaaggatggagaggagaagggcaagcaggaggcccaggacaagctgggccgcctcttccaccagcaccaggagcccgccaagccagctgtgcaggccccctggagcacagctgagaagggccccctgaccatcagcgcccaggagaatgtgaaggtggtgtactaccgggccctgtacccctttgagagccgcagccatgatgagatcaccatccagcccggggacatcgtgatggtgaagggggagtgggtggatgagagccagacaggagagcccggctggctgggcggggagctgaagggcaagacaggctggttccctgccaactatgcagagaagatcccagaaaatgaggtgcctgcccctgtgaagcctgtgacagacagcaccagcgccccagcccccaagctggccctgcgggagaccccagcccccctggccgtgaccagcagcgagcccagcaccacccccaacaactgggccgacttcagcagcacctggcccaccagcaccaatgagaagccagagacagacaactgggatgcctgggccgcccagcccagcctgactgtgcccagcgctggccagctgcggcagaggtctgccttcaccccagccacagccaccggcagcagccccagccctgtgctgggccagggcgagaaggtggagggcctgcaggcccaggccctgtacccctggagggccaagaaggacaaccacctgaacttcaacaagaatgatgtgatcaccgtgctggagcagcaggacatgtggtggtttggagaggtgcagggccagaagggctggttccccaagagctatgtgaagctgatcagcggccccatcaggaagagcacctccatggattctggcagcagcgagagccctgccagcctgaagagggtggccagccctgctgccaagcctgtggtgtctggagaggagttcatcgccatgtacacctatgagagcagcgagcagggcgacctgaccttccagcagggagatgtgatcctggtgaccaagaaggatggagactggtggacaggcaccgtgggggacaaggccggggtcttccccagcaactacgtgcggctgaaggacagcgagggcagcggcacagctgggaagacaggcagcctgggcaagaagccagagatcgcccaggtgattgccagctacacagccaccggccctgagcagctgaccctggcccctggccagctgatcctgatcaggaagaagaaccctgggggctggtgggagggggagctgcaggcccggggcaagaagaggcagatcggctggttccctgccaactacgtgaagctgctgagccctggcaccagcaagatcacccccacagagccccccaagagcacagccctggccgctgtgtgccaggtgattggcatgtatgactacacagcccagaatgatgatgagctggccttcaacaagggccagatcatcaacgtgctgaacaaggaggaccctgactggtggaagggggaggtgaatggccaggtgggcctcttccccagcaactacgtgaagctgaccacagacatggaccccagccagcagtag

SEQ ID NO: 156500 - DNA, 5166 bp, Artificial Sequence
  Description of Artificial Sequence: Synthetic coding sequence
atggcccagttccccaccccatttggaggcagcctggacatctgggccatcaccgtggaggagcgggccaagcatgaccagcagttccacagcctgaagcccatcagcggcttcatcaccggggaccaggccaggaacttcttcttccagagcggcctgccccagcctgtgctggcccagatctgggccctggccgacatgaacaatgatggccgcatggaccaggtggagttcagcatcgccatgaagctgatcaagctgaagctgcagggctaccagctgcccagcgccctgccccctgtgatgaagcagcagcctgtggccatcagcagcgccccagccttcggcatgggcggcatcgcctccatgccacccctgacagctgtggcccctgtgcccatgggcagcatccctgtggtgggcatgagccccaccctggtgtcctctgtgcccacagctgctgtgccccccctggccaacggggcccctcctgtgatccagcccctgcctgcctttgcccaccctgctgccaccctgcccaagagcagcagcttcagccgcagcggccctggcagccagctgaacaccaagctgcagaaggcccagagctttgatgtggcctctgtgccccctgtggccgagtgggccgtgccccagagcagccggctgaagtaccggcagctgttcaacagccatgacaagaccatgagcggccacctgaccggcccccaggcccggaccatcctgatgcagagcagcctgccccaggcccagctggccagcatctggaacctgagtgacatcgaccaggacggcaagctgacagctgaggagttcatcctggccatgcacctgattgatgtggccatgagcggccagcccctgccccctgtgctgcccccagagtacatccccccatccttcagaagagtgcgcagcggcagcggcatcagcgtcatcagcagcacctctgtggaccagaggctgcctgaggagcctgtgctggaggatgagcagcagcagctggagaagaagctgcctgtgacctttgaggacaagaagcgggagaactttgagcggggcaacctggagctggagaagaggcggcaggccctgctggagcagcagaggaaggagcaggagcggctggcccagctggagagagctgagcaggagaggaaggagcgggagcggcaggagcaggagaggaagaggcagctggagctggagaagcagctggagaagcagcgggagctggagcggcagcgggaggaggagaggaggaaggagattgaaagaagagaggccgccaagcgggagctggagcggcagaggcagctggagtgggagaggaacagacggcaggagctgctgaaccagaggaacaaggagcaggaggacatcgtggtgctgaaggccaagaagaagaccctggagtttgagctggaggccctgaatgacaagaagcaccagctggagggcaagctgcaggacatccgctgccgcctgaccacccagaggcaggagattgagagcaccaacaagagccgggagctgagaattgctgagatcacccacctgcagcagcagctgcaggagagccagcagatgctgggccgcctcatccctgagaagcagatcctgaatgaccagctgaagcaggtgcagcagaacagcctgcaccgggacagcctggtgaccctgaagagggccctggaggccaaggagctggcccggcagcacctgcgggaccagctggatgaggtggagaaggagaccaggagcaagctgcaggagattgacatcttcaacaaccagctgaaggagctgcgggagatccacaacaagcagcagctgcagaagcagaagtccatggaggccgagcggctgaagcagaaggagcaggagaggaagatcatcgagctggagaagcagaaggaggaggcccagaggcgggcccaggagcgggacaagcagtggctggagcacgtgcagcaggaggatgagcaccagaggcccaggaagctgcacgaggaggagaagctgaagcgggaggagagcgtgaagaagaaggatggagaggagaagggcaagcaggaggcccaggacaagctgggccgcctcttccaccagcaccaggagcccgccaagccagctgtgcaggccccctggagcacagctgagaagggccccctgaccatcagcgcccaggagaatgtgaaggtggtgtactaccgggccctgtacccctttgagagccgcagccatgatgagatcaccatccagcccggggacatcgtgatggtgaagggggagtgggtggatgagagccagacaggagagcccggctggctgggcggggagctgaagggcaagacaggctggttccctgccaactatgcagagaagatcccagaaaatgaggtgcctgcccctgtgaagcctgtgacagacagcaccagcgccccagcccccaagctggccctgcgggagaccccagcccccctggccgtgaccagcagcgagcccagcaccacccccaacaactgggccgacttcagcagcacctggcccaccagcaccaatgagaagccagagacagacaactgggatgcctgggccgcccagcccagcctgactgtgcccagcgctggccagctgcggcagaggtctgccttcaccccagccacagccaccggcagcagccccagccctgtgctgggccagggcgagaaggtggagggcctgcaggcccaggccctgtacccctggagggccaagaaggacaaccacctgaacttcaacaagaatgatgtgatcaccgtgctggagcagcaggacatgtggtggtttggagaggtgcagggccagaagggctggttccccaagagctatgtgaagctgatcagcggccccatcaggaagagcacctccatggattctggcagcagcgagagccctgccagcctgaagagggtggccagccctgctgccaagcctgtggtgtctggagaggagttcatcgccatgtacacctatgagagcagcgagcagggcgacctgaccttccagcagggagatgtgatcctggtgaccaagaaggatggagactggtggacaggcaccgtgggggacaaggccggggtcttccccagcaactacgtgcggctgaaggacagcgagggcagcggcacagctgggaagacaggcagcctgggcaagaagccagagatcgcccaggtgattgccagctacacagccaccggccctgagcagctgaccctggcccctggccagctgatcctgatcaggaagaagaaccctgggggctggtgggagggggagctgcaggcccggggcaagaagaggcagatcggctggttccctgccaactacgtgaagctgctgagccctggcaccagcaagatcacccccacagagccccccaagagcacagccctggccgctgtgtgccaggtgattggcatgtatgactacacagcccagaatgatgatgagctggccttcaacaagggccagatcatcaacgtgctgaacaaggaggaccctgactggtggaagggggaggtgaatggccaggtgggcctcttccccagcaactacgtgaagctgaccacagacatggaccccagccagcagtggtgcagcgacctgcacctgctggacatgctgacccccacagagaggaagaggcagggctacatccacgagctgattgtgacagaggagaactacgtgaatgacctgcagctggtgacagagatcttccagaagcccctgatggagagcgagctgctgacagagaaggaggtggccatgatctttgtgaactggaaggagctgatcatgtgcaacatcaagctgctgaaggccctgcgggtgaggaagaagatgtctggagagaagatgcctgtgaagatgattggagacatcctgagcgcccagctgccccacatgcagccctacatccgcttctgcagccggcagctgaatggagctgccctgatccagcagaagacagatgaggccccagacttcaaggagtttgtgaagaggctggccatggacccccgctgcaagggcatgcccctgagcagcttcatcctgaagcccatgcagagggtgacccgctaccccctcatcatcaagaacatcctggagaacaccccagagaaccacccagaccacagccacctgaagcacgccctggagaaggccgaggagctgtgcagccaggtgaatgaaggagtgcgggagaaggagaacagcgaccggctggagtggatccaggcccacgtgcagtgtgagggcctgtctgagcagctggtgttcaacagcgtgaccaactgcctgggccccaggaagttcctgcacagcggcaagctgtacaaggccaagagcaacaaggagctgtatggcttcctgttcaatgacttcctgctgctgacccagatcaccaagcccctgggcagcagcggcacagacaaggtgttcagccccaagagcaacctgcagtacaagatgtacaagacccccatcttcctgaatgaggtgctggtgaagctgcccacagaccccagcggagatgagcccatcttccacatcagccacatcgacagagtgtacaccctgcgggcagagagcatcaatgaaagaacagcctgggtgcagaagatcaaggccgccagcgagctgtacatcgagacagagaagaagaagcgggagaaggcctacctggtgcgcagccagagggccactggaattggccgcctgatggtgaatgtggtggagggcatcgagctgaagccctgccgcagccacggcaagagcaacccctactgtgaggtgaccatgggcagccagtgccacatcaccaagaccatccaggacaccctgaaccccaagtggaacagcaactgccagttcttcatccgggacctggagcaggaggtgctgtgcatcaccgtgtttgagcgggaccagttctccccagatgacttcctgggccgcacagagatccgggtggccgacatcaagaaggaccagggcagcaagggccctgtgaccaagtgcctgctgctgcacgaggtgcccaccggggagatcgtggtgcggctggacctgcagctgtttgatgagccctag

SEQ ID NO: 156501 - DNA, 3048 bp, Artificial Sequence
  Description of Artificial Sequence: Synthetic coding sequence
atggcccagttccccaccccatttggaggcagcctggacatctgggccatcaccgtggaggagcgggccaagcatgaccagcagttccacagcctgaagcccatcagcggcttcatcaccggggaccaggccaggaacttcttcttccagagcggcctgccccagcctgtgctggcccagatctgggccctggccgacatgaacaatgatggccgcatggaccaggtggagttcagcatcgccatgaagctgatcaagctgaagctgcagggctaccagctgcccagcgccctgccccctgtgatgaagcagcagcctgtggccatcagcagcgccccagccttcggcatgggcggcatcgcctccatgccacccctgacagctgtggcccctgtgcccatgggcagcatccctgtggtgggcatgagccccaccctggtgtcctctgtgcccacagctgctgtgccccccctggccaacggggcccctcctgtgatccagcccctgcctgcctttgcccaccctgctgccaccctgcccaagagcagcagcttcagccgcagcggccctggcagccagctgaacaccaagctgcagaaggcccagagctttgatgtggcctctgtgccccctgtggccgagtgggccgtgccccagagcagccggctgaagtaccggcagctgttcaacagccatgacaagaccatgagcggccacctgaccggcccccaggcccggaccatcctgatgcagagcagcctgccccaggcccagctggccagcatctggaacctgagtgacatcgaccaggacggcaagctgacagctgaggagttcatcctggccatgcacctgattgatgtggccatgagcggccagcccctgccccctgtgctgcccccagagtacatccccccatccttcagaagagtgcgcagcggcagcggcatcagcgtcatcagcagcacctctgtggaccagaggctgcctgaggagcctgtgctggaggatgagcagcagcagctggagaagaagctgcctgtgacctttgaggacaagaagcgggagaactttgagcggggcaacctggagctggagaagaggcggcaggccctgctggagcagcagaggaaggagcaggagcggctggcccagctggagagagctgagcaggagaggaaggagcgggagcggcaggagcaggagaggaagaggcagctggagctggagaagcagctggagaagcagcgggagctggagcggcagcgggaggaggagaggaggaaggagattgaaagaagagaggccgccaagcgggagctggagcggcagaggcagctggagtgggagaggaacagacggcaggagctgctgaaccagaggaacaaggagcaggaggacatcgtggtgctgaaggccaagaagaagaccctggagtttgagctggaggccctgaatgacaagaagcaccagctggagggcaagctgcaggacatccgctgccgcctgaccacccagaggcaggagattgagagcaccaacaagagccgggagctgagaattgctgagatcacccacctgcagcagcagctgcaggagagccagcagatgctgggccgcctcatccctgagaagcagatcctgaatgaccagctgaagcaggtgcagcagaacagcctgcaccgggacagcctggtgaccctgaagagggccctggaggccaaggagctggcccggcagcacctgcgggaccagctggatgaggtggagaaggagaccaggagcaagctgcaggagattgacatcttcaacaaccagctgaaggagctgcgggagatccacaacaagcagcagctgcagaagcagaagtccatggaggccgagcggctgaagcagaaggagcaggagaggaagatcatcgagctggagaagcagaaggaggaggcccagaggcgggcccaggagcgggacaagcagtggctggagcacgtgcagcaggaggatgagcaccagaggcccaggaagctgcacgaggaggagaagctgaagcgggaggagagcgtgaagaagaaggatggagaggagaagggcaagcaggaggcccaggacaagctgggccgcctcttccaccagcaccaggagcccgccaagccagctgtgcaggccccctggagcacagctgagaagggccccctgaccatcagcgcccaggagaatgtgaaggtggtgtactaccgggccctgtacccctttgagagccgcagccatgatgagatcaccatccagcccggggacatcgtgatggtggatgagagccagacaggagagcccggctggctgggcggggagctgaagggcaagacaggctggttccctgccaactatgcagagaagatcccagaaaatgaggtgcctgcccctgtgaagcctgtgacagacagcaccagcgccccagcccccaagctggccctgcgggagaccccagcccccctggccgtgaccagcagcgagcccagcaccacccccaacaactgggccgacttcagcagcacctggcccaccagcaccaatgagaagccagagacagacaactgggatgcctgggccgcccagcccagcctgactgtgcccagcgctggccagctgcggcagaggtctgccttcaccccagccacagccaccggcagcagccccagccctgtgctgggccagggcgagaaggtggagggcctgcaggcccaggccctgtacccctggagggccaagaaggacaaccacctgaacttcaacaagaatgatgtgatcaccgtgctggagcagcaggacatgtggtggtttggagaggtgcagggccagaagggctggttccccaagagctatgtgaagctgatcagcggccccatcaggaagagcacctccatggacagcggcagcagcgagagccctgccagcctgaagagggtggccagccctgctgccaagcctgtggtgtctggagagggcctgtggaactgctgggagaaccgggagttcaggaagaagacctag

SEQ ID NO: 156502 - DNA, 3063 bp, Artificial Sequence
  Description of Artificial Sequence: Synthetic coding sequence
atggcccagttccccaccccatttggaggcagcctggacatctgggccatcaccgtggaggagcgggccaagcatgaccagcagttccacagcctgaagcccatcagcggcttcatcaccggggaccaggccaggaacttcttcttccagagcggcctgccccagcctgtgctggcccagatctgggccctggccgacatgaacaatgatggccgcatggaccaggtggagttcagcatcgccatgaagctgatcaagctgaagctgcagggctaccagctgcccagcgccctgccccctgtgatgaagcagcagcctgtggccatcagcagcgccccagccttcggcatgggcggcatcgcctccatgccacccctgacagctgtggcccctgtgcccatgggcagcatccctgtggtgggcatgagccccaccctggtgtcctctgtgcccacagctgctgtgccccccctggccaacggggcccctcctgtgatccagcccctgcctgcctttgcccaccctgctgccaccctgcccaagagcagcagcttcagccgcagcggccctggcagccagctgaacaccaagctgcagaaggcccagagctttgatgtggcctctgtgccccctgtggccgagtgggccgtgccccagagcagccggctgaagtaccggcagctgttcaacagccatgacaagaccatgagcggccacctgaccggcccccaggcccggaccatcctgatgcagagcagcctgccccaggcccagctggccagcatctggaacctgagtgacatcgaccaggacggcaagctgacagctgaggagttcatcctggccatgcacctgattgatgtggccatgagcggccagcccctgccccctgtgctgcccccagagtacatccccccatccttcagaagagtgcgcagcggcagcggcatcagcgtcatcagcagcacctctgtggaccagaggctgcctgaggagcctgtgctggaggatgagcagcagcagctggagaagaagctgcctgtgacctttgaggacaagaagcgggagaactttgagcggggcaacctggagctggagaagaggcggcaggccctgctggagcagcagaggaaggagcaggagcggctggcccagctggagagagctgagcaggagaggaaggagcgggagcggcaggagcaggagaggaagaggcagctggagctggagaagcagctggagaagcagcgggagctggagcggcagcgggaggaggagaggaggaaggagattgaaagaagagaggccgccaagcgggagctggagcggcagaggcagctggagtgggagaggaacagacggcaggagctgctgaaccagaggaacaaggagcaggaggacatcgtggtgctgaaggccaagaagaagaccctggagtttgagctggaggccctgaatgacaagaagcaccagctggagggcaagctgcaggacatccgctgccgcctgaccacccagaggcaggagattgagagcaccaacaagagccgggagctgagaattgctgagatcacccacctgcagcagcagctgcaggagagccagcagatgctgggccgcctcatccctgagaagcagatcctgaatgaccagctgaagcaggtgcagcagaacagcctgcaccgggacagcctggtgaccctgaagagggccctggaggccaaggagctggcccggcagcacctgcgggaccagctggatgaggtggagaaggagaccaggagcaagctgcaggagattgacatcttcaacaaccagctgaaggagctgcgggagatccacaacaagcagcagctgcagaagcagaagtccatggaggccgagcggctgaagcagaaggagcaggagaggaagatcatcgagctggagaagcagaaggaggaggcccagaggcgggcccaggagcgggacaagcagtggctggagcacgtgcagcaggaggatgagcaccagaggcccaggaagctgcacgaggaggagaagctgaagcgggaggagagcgtgaagaagaaggatggagaggagaagggcaagcaggaggcccaggacaagctgggccgcctcttccaccagcaccaggagcccgccaagccagctgtgcaggccccctggagcacagctgagaagggccccctgaccatcagcgcccaggagaatgtgaaggtggtgtactaccgggccctgtacccctttgagagccgcagccatgatgagatcaccatccagcccggggacatcgtgatggtggatgagagccagacaggagagcccggctggctgggcggggagctgaagggcaagacaggctggttccctgccaactatgcagagaagatcccagaaaatgaggtgcctgcccctgtgaagcctgtgacagacagcaccagcgccccagcccccaagctggccctgcgggagaccccagcccccctggccgtgaccagcagcgagcccagcaccacccccaacaactgggccgacttcagcagcacctggcccaccagcaccaatgagaagccagagacagacaactgggatgcctgggccgcccagcccagcctgactgtgcccagcgctggccagctgcggcagaggtctgccttcaccccagccacagccaccggcagcagccccagccctgtgctgggccagcctgacttcctgctgcaccccagcatgaggctgggccacatgcagccccgcatcgtgctgctcttcccagaccccctgcagtgcagcaccagccggctgctgcccatgctgcggcccaggcctggggtgcccttcctgcggagccccagctgccagagccccagccaccccagccggcccatcagtgatgctgcccccagcgtgaagttcaccctgatgcctcctggccgcatccacccctgcttcctgttcatcccagctgtgaacagcagaaattccttcctggtgtacttcatcctgcccggcggcaccctgggctgcttctacctgtgcctgccccactacctgtag

SEQ ID NO: 156503 - DNA, 3435 bp, Artificial Sequence
  Description of Artificial Sequence: Synthetic coding sequence
atggcccagttccccaccccatttggaggcagcctggacatctgggccatcaccgtggaggagcgggccaagcatgaccagcagttccacagcctgaagcccatcagcggcttcatcaccggggaccaggccaggaacttcttcttccagagcggcctgccccagcctgtgctggcccagatctgggccctggccgacatgaacaatgatggccgcatggaccaggtggagttcagcatcgccatgaagctgatcaagctgaagctgcagggctaccagctgcccagcgccctgccccctgtgatgaagcagcagcctgtggccatcagcagcgccccagccttcggcatgggcggcatcgcctccatgccacccctgacagctgtggcccctgtgcccatgggcagcatccctgtggtgggcatgagccccaccctggtgtcctctgtgcccacagctgctgtgccccccctggccaacggggcccctcctgtgatccagcccctgcctgcctttgcccaccctgctgccaccctgcccaagagcagcagcttcagccgcagcggccctggcagccagctgaacaccaagctgcagaaggcccagagctttgatgtggcctctgtgccccctgtggccgagtgggccgtgccccagagcagccggctgaagtaccggcagctgttcaacagccatgacaagaccatgagcggccacctgaccggcccccaggcccggaccatcctgatgcagagcagcctgccccaggcccagctggccagcatctggaacctgagtgacatcgaccaggacggcaagctgacagctgaggagttcatcctggccatgcacctgattgatgtggccatgagcggccagcccctgccccctgtgctgcccccagagtacatccccccatccttcagaagagtgcgcagcggcagcggcatcagcgtcatcagcagcacctctgtggaccagaggctgcctgaggagcctgtgctggaggatgagcagcagcagctggagaagaagctgcctgtgacctttgaggacaagaagcgggagaactttgagcggggcaacctggagctggagaagaggcggcaggccctgctggagcagcagaggaaggagcaggagcggctggcccagctggagagagctgagcaggagaggaaggagcgggagcggcaggagcaggagaggaagaggcagctggagctggagaagcagctggagaagcagcgggagctggagcggcagcgggaggaggagaggaggaaggagattgaaagaagagaggccgccaagcgggagctggagcggcagaggcagctggagtgggagaggaacagacggcaggagctgctgaaccagaggaacaaggagcaggaggacatcgtggtgctgaaggccaagaagaagaccctggagtttgagctggaggccctgaatgacaagaagcaccagctggagggcaagctgcaggacatccgctgccgcctgaccacccagaggcaggagattgagagcaccaacaagagccgggagctgagaattgctgagatcacccacctgcagcagcagctgcaggagagccagcagatgctgggccgcctcatccctgagaagcagatcctgaatgaccagctgaagcaggtgcagcagaacagcctgcaccgggacagcctggtgaccctgaagagggccctggaggccaaggagctggcccggcagcacctgcgggaccagctggatgaggtggagaaggagaccaggagcaagctgcaggagattgacatcttcaacaaccagctgaaggagctgcgggagatccacaacaagcagcagctgcagaagcagaagtccatggaggccgagcggctgaagcagaaggagcaggagaggaagatcatcgagctggagaagcagaaggaggaggcccagaggcgggcccaggagcgggacaagcagtggctggagcacgtgcagcaggaggatgagcaccagaggcccaggaagctgcacgaggaggagaagctgaagcgggaggagagcgtgaagaagaaggatggagaggagaagggcaagcaggaggcccaggacaagctgggccgcctcttccaccagcaccaggagcccgccaagccagctgtgcaggccccctggagcacagctgagaagggccccctgaccatcagcgcccaggagaatgtgaaggtggtgtactaccgggccctgtacccctttgagagccgcagccatgatgagatcaccatccagcccggggacatcgtgatggtggatgagagccagacaggagagcccggctggctgggcggggagctgaagggcaagacaggctggttccctgccaactatgcagagaagatcccagaaaatgaggtgcctgcccctgtgaagcctgtgacagacagcaccagcgccccagcccccaagctggccctgcgggagaccccagcccccctggccgtgaccagcagcgagcccagcaccacccccaacaactgggccgacttcagcagcacctggcccaccagcaccaatgagaagccagagacagacaactgggatgcctgggccgcccagcccagcctgactgtgcccagcgctggccagctgcggcagaggtctgccttcaccccagccacagccaccggcagcagccccagccctgtgctgggccagggcgagaaggtggagggcctgcaggcccaggccctgtacccctggagggccaagaaggacaaccacctgaacttcaacaagaatgatgtgatcaccgtgctggagcagcaggacatgtggtggtttggagaggtgcagggccagaagggctggttccccaagagctatgtgaagctgatcagcggccccatcaggaagagcacctccatggacagcggcagcagcgagagccctgccagcctgaagagggtggccagccctgctgccaagcctgtggtgtctggagaggagatcgcccaggtgattgccagctacacagccaccggccctgagcagctgaccctggcccctggccagctgatcctgatcaggaagaagaaccctgggggctggtgggagggggagctgcaggcccggggcaagaagaggcagatcggctggttccctgccaactacgtgaagctgctgagccctggcaccagcaagatcacccccacagagccccccaagagcacagccctggccgctgtgtgccaggtgattggcatgtatgactacacagcccagaatgatgatgagctggccttcaacaagggccagatcatcaacgtgctgaacaaggaggaccctgactggtggaagggggaggtgaatggccaggtgggcctcttccccagcaactacgtgaagctgaccacagacatggaccccagccagcagtag

SEQ ID NO: 156504 - DNA, 3648 bp, Artificial Sequence
  Description of Artificial Sequence: Synthetic coding sequence
atggcccagttccccaccccatttggaggcagcctggacatctgggccatcaccgtggaggagcgggccaagcatgaccagcagttccacagcctgaagcccatcagcggcttcatcaccggggaccaggccaggaacttcttcttccagagcggcctgccccagcctgtgctggcccagatctgggccctggccgacatgaacaatgatggccgcatggaccaggtggagttcagcatcgccatgaagctgatcaagctgaagctgcagggctaccagctgcccagcgccctgccccctgtgatgaagcagcagcctgtggccatcagcagcgccccagccttcggcatgggcggcatcgcctccatgccacccctgacagctgtggcccctgtgcccatgggcagcatccctgtggtgggcatgagccccaccctggtgtcctctgtgcccacagctgctgtgccccccctggccaacggggcccctcctgtgatccagcccctgcctgcctttgcccaccctgctgccaccctgcccaagagcagcagcttcagccgcagcggccctggcagccagctgaacaccaagctgcagaaggcccagagctttgatgtggcctctgtgccccctgtggccgagtgggccgtgccccagagcagccggctgaagtaccggcagctgttcaacagccatgacaagaccatgagcggccacctgaccggcccccaggcccggaccatcctgatgcagagcagcctgccccaggcccagctggccagcatctggaacctgagtgacatcgaccaggacggcaagctgacagctgaggagttcatcctggccatgcacctgattgatgtggccatgagcggccagcccctgccccctgtgctgcccccagagtacatccccccatccttcagaagagtgcgcagcggcagcggcatcagcgtcatcagcagcacctctgtggaccagaggctgcctgaggagcctgtgctggaggatgagcagcagcagctggagaagaagctgcctgtgacctttgaggacaagaagcgggagaactttgagcggggcaacctggagctggagaagaggcggcaggccctgctggagcagcagaggaaggagcaggagcggctggcccagctggagagagctgagcaggagaggaaggagcgggagcggcaggagcaggagaggaagaggcagctggagctggagaagcagctggagaagcagcgggagctggagcggcagcgggaggaggagaggaggaaggagattgaaagaagagaggccgccaagcgggagctggagcggcagaggcagctggagtgggagaggaacagacggcaggagctgctgaaccagaggaacaaggagcaggaggacatcgtggtgctgaaggccaagaagaagaccctggagtttgagctggaggccctgaatgacaagaagcaccagctggagggcaagctgcaggacatccgctgccgcctgaccacccagaggcaggagattgagagcaccaacaagagccgggagctgagaattgctgagatcacccacctgcagcagcagctgcaggagagccagcagatgctgggccgcctcatccctgagaagcagatcctgaatgaccagctgaagcaggtgcagcagaacagcctgcaccgggacagcctggtgaccctgaagagggccctggaggccaaggagctggcccggcagcacctgcgggaccagctggatgaggtggagaaggagaccaggagcaagctgcaggagattgacatcttcaacaaccagctgaaggagctgcgggagatccacaacaagcagcagctgcagaagcagaagtccatggaggccgagcggctgaagcagaaggagcaggagaggaagatcatcgagctggagaagcagaaggaggaggcccagaggcgggcccaggagcgggacaagcagtggctggagcacgtgcagcaggaggatgagcaccagaggcccaggaagctgcacgaggaggagaagctgaagcgggaggagagcgtgaagaagaaggatggagaggagaagggcaagcaggaggcccaggacaagctgggccgcctcttccaccagcaccaggagcccgccaagccagctgtgcaggccccctggagcacagctgagaagggccccctgaccatcagcgcccaggagaatgtgaaggtggtgtactaccgggccctgtacccctttgagagccgcagccatgatgagatcaccatccagcccggggacatcgtgatggtggatgagagccagacaggagagcccggctggctgggcggggagctgaagggcaagacaggctggttccctgccaactatgcagagaagatcccagaaaatgaggtgcctgcccctgtgaagcctgtgacagacagcaccagcgccccagcccccaagctggccctgcgggagaccccagcccccctggccgtgaccagcagcgagcccagcaccacccccaacaactgggccgacttcagcagcacctggcccaccagcaccaatgagaagccagagacagacaactgggatgcctgggccgcccagcccagcctgactgtgcccagcgctggccagctgcggcagaggtctgccttcaccccagccacagccaccggcagcagccccagccctgtgctgggccagggcgagaaggtggagggcctgcaggcccaggccctgtacccctggagggccaagaaggacaaccacctgaacttcaacaagaatgatgtgatcaccgtgctggagcagcaggacatgtggtggtttggagaggtgcagggccagaagggctggttccccaagagctatgtgaagctgatcagcggccccatcaggaagagcacctccatggacagcggcagcagcgagagccctgccagcctgaagagggtggccagccctgctgccaagcctgtggtgtctggagaggagttcatcgccatgtacacctatgagagcagcgagcagggcgacctgaccttccagcagggagatgtgatcctggtgaccaagaaggatggagactggtggacaggaacagtgggggacaaggccggggtcttccccagcaactacgtgcggctgaaggacagcgagggcagcggcacagctgggaagacaggcagcctgggcaagaagccagaaattgcccaggtgattgccagctacacagccactggacctgagcagctgaccctggcccctggccagctgatcctgatcaggaagaagaaccctgggggctggtgggagggggagctgcaggcccggggcaagaagaggcagatcggctggttccctgccaactacgtgaagctgctgagccctggcaccagcaagatcacccccacagagccccccaagagcacagccctggccgctgtgtgccaggtgattggcatgtatgactacacagcccagaatgatgatgagctggccttcaacaagggccagatcatcaacgtgctgaacaaggaggaccctgactggtggaagggggaggtgaatggccaggtgggcctcttccccagcaactacgtgaagctgaccacagacatggaccccagccagcagtag

SEQ ID NO: 156505 - DNA, 3537 bp, Artificial Sequence
  Description of Artificial Sequence: Synthetic coding sequence
atggcccagttccccaccccatttggaggcagcctggacatctgggccatcaccgtggaggagcgggccaagcatgaccagcagttccacagcctgaagcccatcagcggcttcatcaccggggaccaggccaggaacttcttcttccagagcggcctgccccagcctgtgctggcccagatctgggccctggccgacatgaacaatgatggccgcatggaccaggtggagttcagcatcgccatgaagctgatcaagctgaagctgcagggctaccagctgcccagcgccctgccccctgtgatgaagcagcagcctgtggccatcagcagcgccccagcctttgctgctgtgccccccctggccaatggagcccctcctgtgatccagcccctgcctgcctttgcccaccctgctgccaccctgcccaagagcagcagcttcagccgcagcggccctggcagccagctgaacaccaagctgcagaaggcccagagctttgatgtggcctctgtgccccctgtggccgagtgggccgtgccccagagcagccggctgaagtaccggcagctgttcaacagccatgacaagaccatgagcggccacctgaccggcccccaggcccggaccatcctgatgcagagcagcctgccccaggcccagctggccagcatctggaacctgagtgacatcgaccaggacggcaagctgacagctgaggagttcatcctggccatgcacctgattgatgtggccatgagcggccagcccctgccccctgtgctgcccccagagtacatcccccccagcttccggcgggtgcgcagcggcagcggcatcagcgtcatcagcagcacctctgtggaccagaggctgcctgaggagcctgtgctggaggatgagcagcagcagctggagaagaagctgcctgtgacctttgaggacaagaagagagaaaattttgagcggggcaacctggagctggagaagaggcggcaggccctgctggagcagcagaggaaggagcaggagcggctggcccagctggagcgggcagagcaggagaggaaggagcgggagcggcaggagcaggagaggaagaggcagctggagctggagaagcagctggagaagcagcgggagctggagcggcagcgggaggaggagaggaggaaggagattgaaagaagagaagctgccaagcgggagctggagcggcagaggcagctggagtgggagaggaacagacggcaggagctgctgaaccagaggaacaaggagcaggaggacatcgtggtgctgaaggccaagaagaagaccctggagtttgagctggaggccctgaatgacaagaagcaccagctggagggcaagctgcaggacatccgctgccgcctgaccacccagaggcaggagattgagagcaccaacaagagccgggagctgagaattgctgagatcacccacctgcagcagcagctgcaggagagccagcagatgctgggccgcctcatccctgagaagcagatcctgaatgaccagctgaagcaggtgcagcagaacagcctgcaccgggacagcctggtgaccctgaagagggccctggaggccaaggagctggcccggcagcacctgcgggaccagctggatgaggtggagaaggagaccaggagcaagctgcaggagattgacatcttcaacaaccagctgaaggagctgcgggagatccacaacaagcagcagctgcagaagcagaagtccatggaggccgagcggctgaagcagaaggagcaggagaggaagatcatcgagctggagaagcagaaggaggaggcccagaggcgggcccaggagcgggacaagcagtggctggagcacgtgcagcaggaggatgagcaccagaggcccaggaagctgcacgaggaggagaagctgaagcgggaggagagcgtgaagaagaaggatggagaggagaagggcaagcaggaggcccaggacaagctgggccgcctcttccaccagcaccaggagcccgccaagccagctgtgcaggccccctggagcacagctgagaagggccccctgaccatcagcgcccaggagaatgtgaaggtggtgtactaccgggccctgtacccctttgagagccgcagccatgatgagatcaccatccagcccggggacatcgtgatggtggatgagagccagacaggagagcccggctggctgggcggggagctgaagggcaagacaggctggttccctgccaactatgcagagaagatcccagaaaatgaggtgcctgcccctgtgaagcctgtgacagacagcaccagcgccccagcccccaagctggccctgcgggagaccccagcccccctggccgtgaccagcagcgagcccagcaccacccccaacaactgggccgacttcagcagcacctggcccaccagcaccaatgagaagccagagacagacaactgggatgcctgggccgcccagcccagcctgactgtgcccagcgctggccagctgcggcagaggtctgccttcaccccagccacagccaccggcagcagccccagccctgtgctgggccagggcgagaaggtggagggcctgcaggcccaggccctgtacccctggagggccaagaaggacaaccacctgaacttcaacaagaatgatgtgatcaccgtgctggagcagcaggacatgtggtggtttggagaggtgcagggccagaagggctggttccccaagagctatgtgaagctgatcagcggccccatcaggaagagcacctccatggattctggcagcagcgagagccctgccagcctgaagagggtggccagccctgctgccaagcctgtggtgtctggagaggagttcatcgccatgtacacctatgagagcagcgagcagggcgacctgaccttccagcagggagatgtgatcctggtgaccaagaaggatggagactggtggacaggcaccgtgggggacaaggccggggtcttccccagcaactacgtgcggctgaaggacagcgagggcagcggcacagctgggaagacaggcagcctgggcaagaagccagagatcgcccaggtgattgccagctacacagccaccggccctgagcagctgaccctggcccctggccagctgatcctgatcaggaagaagaaccctgggggctggtgggagggggagctgcaggcccggggcaagaagaggcagatcggctggttccctgccaactacgtgaagctgctgagccctggcaccagcaagatcacccccacagagccccccaagagcacagccctggccgctgtgtgccaggtgattggcatgtatgactacacagcccagaatgatgatgagctggccttcaacaagggccagatcatcaacgtgctgaacaaggaggaccctgactggtggaagggggaggtgaatggccaggtgggcctcttccccagcaactacgtgaagctgaccacagacatggaccccagccagcagtag

SEQ ID NO: 156506 - DNA, 3450 bp, Artificial Sequence
  Description of Artificial Sequence: Synthetic coding sequence
atggcccagttccccaccccatttggaggcagcctggacatctgggccatcaccgtggaggagcgggccaagcatgaccagcagttccacagcctgaagcccatcagcggcttcatcaccggggaccaggccaggaacttcttcttccagagcggcctgccccagcctgtgctggcccagatctgggccctggccgacatgaacaatgatggccgcatggaccaggtggagttcagcatcgccatgaagctgatcaagctgaagctgcagggctaccagctgcccagcgccctgccccctgtgatgaagcagcagcctgtggccatcagcagcgccccagccttcggcatgggcggcatcgcctccatgccacccctgacagctgtggcccctgtgcccatgggcagcatccctgtggtgggcatgagccccaccctggtgtcctctgtgcccacagctgctgtgccccccctggccaacggggcccctcctgtgatccagcccctgcctgcctttgcccaccctgctgccaccctgcccaagagcagcagcttcagccgcagcggccctggcagccagctgaacaccaagctgcagaaggcccagagctttgatgtggcctctgtgccccctgtggccgagtgggccgtgccccagagcagccggctgaagtaccggcagctgttcaacagccatgacaagaccatgagcggccacctgaccggcccccaggcccggaccatcctgatgcagagcagcctgccccaggcccagctggccagcatctggaacctgagtgacatcgaccaggacggcaagctgacagctgaggagttcatcctggccatgcacctgattgatgtggccatgagcggccagcccctgccccctgtgctgcccccagagtacatccccccatccttcagaagagtgcgcagcggcagcggcatcagcgtcatcagcagcacctctgtggaccagaggctgcctgaggagcctgtgctggaggatgagcagcagcagctggagaagaagctgcctgtgacctttgaggacaagaagcgggagaactttgagcggggcaacctggagctggagaagaggcggcaggccctgctggagcagcagaggaaggagcaggagcggctggcccagctggagagagctgagcaggagaggaaggagcgggagcggcaggagcaggagaggaagaggcagctggagctggagaagcagctggagaagcagcgggagctggagcggcagcgggaggaggagaggaggaaggagattgaaagaagagaggccgccaagcgggagctggagcggcagaggcagctggagtgggagaggaacagacggcaggagctgctgaaccagaggaacaaggagcaggaggacatcgtggtgctgaaggccaagaagaagaccctggagtttgagctggaggccctgaatgacaagaagcaccagctggagggcaagctgcaggacatccgctgccgcctgaccacccagaggcaggagattgagagcaccaacaagagccgggagctgagaattgctgagatcacccacctgcagcagcagctgcaggagagccagcagatgctgggccgcctcatccctgagaagcagatcctgaatgaccagctgaagcaggtgcagcagaacagcctgcaccgggacagcctggtgaccctgaagagggccctggaggccaaggagctggcccggcagcacctgcgggaccagctggatgaggtggagaaggagaccaggagcaagctgcaggagattgacatcttcaacaaccagctgaaggagctgcgggagatccacaacaagcagcagctgcagaagcagaagtccatggaggccgagcggctgaagcagaaggagcaggagaggaagatcatcgagctggagaagcagaaggaggaggcccagaggcgggcccaggagcgggacaagcagtggctggagcacgtgcagcaggaggatgagcaccagaggcccaggaagctgcacgaggaggagaagctgaagcgggaggagagcgtgaagaagaaggatggagaggagaagggcaagcaggaggcccaggacaagctgggccgcctcttccaccagcaccaggagcccgccaagccagctgtgcaggccccctggagcacagctgagaagggccccctgaccatcagcgcccaggagaatgtgaaggtggtgtactaccgggccctgtacccctttgagagccgcagccatgatgagatcaccatccagcccggggacatcgtgatggtgaagggggagtgggtggatgagagccagacaggagagcccggctggctgggcggggagctgaagggcaagacaggctggttccctgccaactatgcagagaagatcccagaaaatgaggtgcctgcccctgtgaagcctgtgacagacagcaccagcgccccagcccccaagctggccctgcgggagaccccagcccccctggccgtgaccagcagcgagcccagcaccacccccaacaactgggccgacttcagcagcacctggcccaccagcaccaatgagaagccagagacagacaactgggatgcctgggccgcccagcccagcctgactgtgcccagcgctggccagctgcggcagaggtctgccttcaccccagccacagccaccggcagcagccccagccctgtgctgggccagggcgagaaggtggagggcctgcaggcccaggccctgtacccctggagggccaagaaggacaaccacctgaacttcaacaagaatgatgtgatcaccgtgctggagcagcaggacatgtggtggtttggagaggtgcagggccagaagggctggttccccaagagctatgtgaagctgatcagcggccccatcaggaagagcacctccatggattctggcagcagcgagagccctgccagcctgaagagggtggccagccctgctgccaagcctgtggtgtctggagaggagatcgcccaggtgattgccagctacacagccactggacctgagcagctgaccctggcccctggccagctgatcctgatcaggaagaagaaccctgggggctggtgggagggggagctgcaggcccggggcaagaagaggcagatcggctggttccctgccaactacgtgaagctgctgagccctggcaccagcaagatcacccccacagagccccccaagagcacagccctggccgctgtgtgccaggtgattggcatgtatgactacacagcccagaatgatgatgagctggccttcaacaagggccagatcatcaacgtgctgaacaaggaggaccctgactggtggaagggggaggtgaatggccaggtgggcctcttccccagcaactacgtgaagctgaccacagacatggaccccagccagcagtag

SEQ ID NO: 156507 - DNA, 5151 bp, Artificial Sequence
  Description of Artificial Sequence: Synthetic coding sequence
atggcccagttccccaccccatttggaggcagcctggacatctgggccatcaccgtggaggagcgggccaagcatgaccagcagttccacagcctgaagcccatcagcggcttcatcaccggggaccaggccaggaacttcttcttccagagcggcctgccccagcctgtgctggcccagatctgggccctggccgacatgaacaatgatggccgcatggaccaggtggagttcagcatcgccatgaagctgatcaagctgaagctgcagggctaccagctgcccagcgccctgccccctgtgatgaagcagcagcctgtggccatcagcagcgccccagccttcggcatgggcggcatcgcctccatgccacccctgacagctgtggcccctgtgcccatgggcagcatccctgtggtgggcatgagccccaccctggtgtcctctgtgcccacagctgctgtgccccccctggccaacggggcccctcctgtgatccagcccctgcctgcctttgcccaccctgctgccaccctgcccaagagcagcagcttcagccgcagcggccctggcagccagctgaacaccaagctgcagaaggcccagagctttgatgtggcctctgtgccccctgtggccgagtgggccgtgccccagagcagccggctgaagtaccggcagctgttcaacagccatgacaagaccatgagcggccacctgaccggcccccaggcccggaccatcctgatgcagagcagcctgccccaggcccagctggccagcatctggaacctgagtgacatcgaccaggacggcaagctgacagctgaggagttcatcctggccatgcacctgattgatgtggccatgagcggccagcccctgccccctgtgctgcccccagagtacatccccccatccttcagaagagtgcgcagcggcagcggcatcagcgtcatcagcagcacctctgtggaccagaggctgcctgaggagcctgtgctggaggatgagcagcagcagctggagaagaagctgcctgtgacctttgaggacaagaagcgggagaactttgagcggggcaacctggagctggagaagaggcggcaggccctgctggagcagcagaggaaggagcaggagcggctggcccagctggagagagctgagcaggagaggaaggagcgggagcggcaggagcaggagaggaagaggcagctggagctggagaagcagctggagaagcagcgggagctggagcggcagcgggaggaggagaggaggaaggagattgaaagaagagaggccgccaagcgggagctggagcggcagaggcagctggagtgggagaggaacagacggcaggagctgctgaaccagaggaacaaggagcaggaggacatcgtggtgctgaaggccaagaagaagaccctggagtttgagctggaggccctgaatgacaagaagcaccagctggagggcaagctgcaggacatccgctgccgcctgaccacccagaggcaggagattgagagcaccaacaagagccgggagctgagaattgctgagatcacccacctgcagcagcagctgcaggagagccagcagatgctgggccgcctcatccctgagaagcagatcctgaatgaccagctgaagcaggtgcagcagaacagcctgcaccgggacagcctggtgaccctgaagagggccctggaggccaaggagctggcccggcagcacctgcgggaccagctggatgaggtggagaaggagaccaggagcaagctgcaggagattgacatcttcaacaaccagctgaaggagctgcgggagatccacaacaagcagcagctgcagaagcagaagtccatggaggccgagcggctgaagcagaaggagcaggagaggaagatcatcgagctggagaagcagaaggaggaggcccagaggcgggcccaggagcgggacaagcagtggctggagcacgtgcagcaggaggatgagcaccagaggcccaggaagctgcacgaggaggagaagctgaagcgggaggagagcgtgaagaagaaggatggagaggagaagggcaagcaggaggcccaggacaagctgggccgcctcttccaccagcaccaggagcccgccaagccagctgtgcaggccccctggagcacagctgagaagggccccctgaccatcagcgcccaggagaatgtgaaggtggtgtactaccgggccctgtacccctttgagagccgcagccatgatgagatcaccatccagcccggggacatcgtgatggtggatgagagccagacaggagagcccggctggctgggcggggagctgaagggcaagacaggctggttccctgccaactatgcagagaagatcccagaaaatgaggtgcctgcccctgtgaagcctgtgacagacagcaccagcgccccagcccccaagctggccctgcgggagaccccagcccccctggccgtgaccagcagcgagcccagcaccacccccaacaactgggccgacttcagcagcacctggcccaccagcaccaatgagaagccagagacagacaactgggatgcctgggccgcccagcccagcctgactgtgcccagcgctggccagctgcggcagaggtctgccttcaccccagccacagccaccggcagcagccccagccctgtgctgggccagggcgagaaggtggagggcctgcaggcccaggccctgtacccctggagggccaagaaggacaaccacctgaacttcaacaagaatgatgtgatcaccgtgctggagcagcaggacatgtggtggtttggagaggtgcagggccagaagggctggttccccaagagctatgtgaagctgatcagcggccccatcaggaagagcacctccatggacagcggcagcagcgagagccctgccagcctgaagagggtggccagccctgctgccaagcctgtggtgtctggagaggagttcatcgccatgtacacctatgagagcagcgagcagggcgacctgaccttccagcagggagatgtgatcctggtgaccaagaaggatggagactggtggacaggaacagtgggggacaaggccggggtcttccccagcaactacgtgcggctgaaggacagcgagggcagcggcacagctgggaagacaggcagcctgggcaagaagccagaaattgcccaggtgattgccagctacacagccactggacctgagcagctgaccctggcccctggccagctgatcctgatcaggaagaagaaccctgggggctggtgggagggggagctgcaggcccggggcaagaagaggcagatcggctggttccctgccaactacgtgaagctgctgagccctggcaccagcaagatcacccccacagagccccccaagagcacagccctggccgctgtgtgccaggtgattggcatgtatgactacacagcccagaatgatgatgagctggccttcaacaagggccagatcatcaacgtgctgaacaaggaggaccctgactggtggaagggggaggtgaatggccaggtgggcctcttccccagcaactacgtgaagctgaccacagacatggaccccagccagcagtggtgcagcgacctgcacctgctggacatgctgacccccacagagaggaagaggcagggctacatccacgagctgattgtgacagaagaaaattatgtgaatgacctgcagctggtgacagagatcttccagaagcccctgatggagagcgagctgctgacagagaaggaggtggccatgatctttgtgaactggaaggagctgatcatgtgcaacatcaagctgctgaaggccctgcgggtgaggaagaagatgtctggagagaagatgcctgtgaagatgattggagacatcctgagcgcccagctgccccacatgcagccctacatccgcttctgcagccggcagctgaatggagctgccctgatccagcagaagacagatgaggccccagacttcaaggagtttgtgaagaggctggccatggacccccgctgcaagggcatgcccctgagcagcttcatcctgaagcccatgcagagggtgacccgctaccccctcatcatcaagaacatcctggagaacaccccagagaaccacccagaccacagccacctgaagcacgccctggagaaggccgaggagctgtgcagccaggtgaatgaaggagtgcgggagaaggaaaattctgaccggctggagtggatccaggcccacgtgcagtgtgagggcctgtctgagcagctggtgttcaacagcgtgaccaactgcctgggccccaggaagttcctgcacagcggcaagctgtacaaggccaagagcaacaaggagctgtatggcttcctgttcaatgacttcctgctgctgacccagatcaccaagcccctgggcagcagcggcacagacaaggtgttcagccccaagagcaacctgcagtacaagatgtacaagacccccatcttcctgaatgaggtgctggtgaagctgcccacagaccccagcggagatgagcccatcttccacatcagccacatcgacagagtgtacaccctgcgggcagagagcatcaatgaaagaacagcctgggtgcagaagatcaaggccgccagcgagctgtacattgaaacagagaagaagaagcgggagaaggcctacctggtgcgcagccagagggccaccggcatcggccgcctgatggtgaatgtggtggagggcatcgagctgaagccctgccgcagccacggcaagagcaacccctactgtgaggtgaccatgggcagccagtgccacatcaccaagaccatccaggacaccctgaaccccaagtggaacagcaactgccagttcttcatccgggacctggagcaggaggtgctgtgcatcaccgtgtttgagcgggaccagttctccccagatgacttcctgggccgcacagagatccgggtggccgacatcaagaaggaccagggcagcaaaggacctgtgaccaagtgcctgctgctgcacgaggtgcccactggagagatcgtggtgcggctggacctgcagctgtttgatgagccctag

SEQ ID NO: 156508 - DNA, 4983 bp, Artificial Sequence
  Description of Artificial Sequence: Synthetic coding sequence
atggcccagttccccaccccatttggaggcagcctggacatctgggccatcaccgtggaggagcgggccaagcatgaccagcagttccacagcctgaagcccatcagcggcttcatcaccggggaccaggccaggaacttcttcttccagagcggcctgccccagcctgtgctggcccagatctgggccctggccgacatgaacaatgatggccgcatggaccaggtggagttcagcatcgccatgaagctgatcaagctgaagctgcagggctaccagctgcccagcgccctgccccctgtgatgaagcagcagcctgtggccatcagcagcgccccagccttcggcatgggcggcatcgcctccatgccacccctgacagctgtggcccctgtgcccatgggcagcatccctgtggtgggcatgagccccaccctggtgtcctctgtgcccacagctgctgtgccccccctggccaacggggcccctcctgtgatccagcccctgcctgcctttgcccaccctgctgccaccctgcccaagagcagcagcttcagccgcagcggccctggcagccagctgaacaccaagctgcagaaggcccagagctttgatgtggcctctgtgccccctgtggccgagtgggccgtgccccagagcagccggctgaagtaccggcagctgttcaacagccatgacaagaccatgagcggccacctgaccggcccccaggcccggaccatcctgatgcagagcagcctgccccaggcccagctggccagcatctggaacctgagtgacatcgaccaggacggcaagctgacagctgaggagttcatcctggccatgcacctgattgatgtggccatgagcggccagcccctgccccctgtgctgcccccagagtacatccccccatccttcagaagagtgcgcagcggcagcggcatcagcgtcatcagcagcacctctgtggaccagaggctgcctgaggagcctgtgctggaggatgagcagcagcagctggagaagaagctgcctgtgacctttgaggacaagaagcgggagaactttgagcggggcaacctggagctggagaagaggcggcaggccctgctggagcagcagaggaaggagcaggagcggctggcccagctggagagagctgagcaggagaggaaggagcgggagcggcaggagcaggagaggaagaggcagctggagctggagaagcagctggagaagcagcgggagctggagcggcagcgggaggaggagaggaggaaggagattgaaagaagagaggccgccaagcgggagctggagcggcagaggcagctggagtgggagaggaacagacggcaggagctgctgaaccagaggaacaaggagcaggaggacatcgtggtgctgaaggccaagaagaagaccctggagtttgagctggaggccctgaatgacaagaagcaccagctggagggcaagctgcaggacatccgctgccgcctgaccacccagaggcaggagattgagagcaccaacaagagccgggagctgagaattgctgagatcacccacctgcagcagcagctgcaggagagccagcagatgctgggccgcctcatccctgagaagcagatcctgaatgaccagctgaagcaggtgcagcagaacagcctgcaccgggacagcctggtgaccctgaagagggccctggaggccaaggagctggcccggcagcacctgcgggaccagctggatgaggtggagaaggagaccaggagcaagctgcaggagattgacatcttcaacaaccagctgaaggagctgcgggagatccacaacaagcagcagctgcagaagcagaagtccatggaggccgagcggctgaagcagaaggagcaggagaggaagatcatcgagctggagaagcagaaggaggaggcccagaggcgggcccaggagcgggacaagcagtggctggagcacgtgcagcaggaggatgagcaccagaggcccaggaagctgcacgaggaggagaagctgaagcgggaggagagcgtgaagaagaaggatggagaggagaagggcaagcaggaggcccaggacaagctgggccgcctcttccaccagcaccaggagcccgccaagccagctgtgcaggccccctggagcacagctgagaagggccccctgaccatcagcgcccaggagaatgtgaaggtggtgtactaccgggccctgtacccctttgagagccgcagccatgatgagatcaccatccagcccggggacatcgtgatggtggatgagagccagacaggagagcccggctggctgggcggggagctgaagggcaagacaggctggttccctgccaactatgcagagaagatcccagaaaatgaggtgcctgcccctgtgaagcctgtgacagacagcaccagcgccccagcccccaagctggccctgcgggagaccccagcccccctggccgtgaccagcagcgagcccagcaccacccccaacaactgggccgacttcagcagcacctggcccaccagcaccaatgagaagccagagacagacaactgggatgcctgggccgcccagcccagcctgactgtgcccagcgctggccagctgcggcagaggtctgccttcaccccagccacagccaccggcagcagccccagccctgtgctgggccagggcgagaaggtggagggcctgcaggcccaggccctgtacccctggagggccaagaaggacaaccacctgaacttcaacaagaatgatgtgatcaccgtgctggagcagcaggacatgtggtggtttggagaggtgcagggccagaagggctggttccccaagagctatgtgaagctgatcagcggccccatcaggaagagcacctccatggacagcggcagcagcgagagccctgccagcctgaagagggtggccagccctgctgccaagcctgtggtgtctggagaggagttcatcgccatgtacacctatgagagcagcgagcagggcgacctgaccttccagcagggagatgtgatcctggtgaccaagaaggatggagactggtggacaggaacagtgggggacaaggccggggtcttccccagcaactacgtgcggctgaaggacagcgagggcagcggcacagctgggaagacaggcagcctgggcaagaagccagaaattgcccaggtgattgccagctacacagccactggacctgagcagctgaccctggcccctggccagctgatcctgatcaggaagaagaaccctgggggctggtgggagggggagctgcaggcccggggcaagaagaggcagatcggctggttccctgccaactacgtgaagctgctgagccctggcaccagcaagatcacccccacagagccccccaagagcacagccctggccgctgtgtgccaggtgattggcatgtatgactacacagcccagaatgatgatgagctggccttcaacaagggccagatcatcaacgtgctgaacaaggaggaccctgactggtggaagggggaggtgaatggccaggtgggcctcttccccagcaactacgtgaagctgaccacagacatggaccccagccagcagtggtgcagcgacctgcacctgctggacatgctgacccccacagagaggaagaggcagggctacatccacgagctgattgtgacagaagaaaattatgtgaatgacctgcagctggtgacagagatcttccagaagcccctgatggagagcgagctgctgacagagaaggaggtggccatgatctttgtgaactggaaggagctgatcatgtgcaacatcaagctgctgaaggccctgcgggtgaggaagaagatgtctggagagaagatgcctgtgaagatgattggagacatcctgagcgcccagctgccccacatgcagccctacatccgcttctgcagccggcagctgaatggagctgccctgatccagcagaagacagatgaggccccagacttcaaggagtttgtgaagaggctggccatggacccccgctgcaagggcatgcccctgagcagcttcatcctgaagcccatgcagagggtgacccgctaccccctcatcatcaagaaccagctggtgttcaacagcgtgaccaactgcctgggccccaggaagttcctgcacagcggcaagctgtacaaggccaagagcaacaaggagctgtatggcttcctgttcaatgacttcctgctgctgacccagatcaccaagcccctgggcagcagcggcacagacaaggtgttcagccccaagagcaacctgcagtacaagatgtacaagacccccatcttcctgaatgaggtgctggtgaagctgcccacagaccccagcggagatgagcccatcttccacatcagccacatcgacagagtgtacaccctgcgggcagagagcatcaatgaaagaacagcctgggtgcagaagatcaaggccgccagcgagctgtacattgaaacagagaagaagaagcgggagaaggcctacctggtgcgcagccagagggccaccggcatcggccgcctgatggtgaatgtggtggagggcatcgagctgaagccctgccgcagccacggcaagagcaacccctactgtgaggtgaccatgggcagccagtgccacatcaccaagaccatccaggacaccctgaaccccaagtggaacagcaactgccagttcttcatccgggacctggagcaggaggtgctgtgcatcaccgtgtttgagcgggaccagttctccccagatgacttcctgggccgcacagagatccgggtggccgacatcaagaaggaccagggcagcaaaggacctgtgaccaagtgcctgctgctgcacgaggtgcccactggagagatcgtggtgcggctggacctgcagctgtttgatgagccctag

SEQ ID NO: 156509 - DNA, 348 bp, Artificial Sequence
  Description of Artificial Sequence: Synthetic coding sequence
atggcccagttccccaccccatttggaggcagcctggacatctgggccatcaccgtggaggagcgggccaagcatgaccagcagttccacagcctgaagcccatcagcggcttcatcaccggggaccaggccaggaacttcttcttccagagcggcctgccccagcctgtgctggcccagatctgggccctggccgacatgaacaatgatggccgcatggaccaggtggagttcagcatcgccatgaagctgatcaagctgaagctgcagggctaccagctgcccagcgccctgccccctgtgatgaagcagcagcctgtggccatcagcagcgccccagccttctag

SEQ ID NO: 156510 - DNA, 237 bp, Artificial Sequence
  Description of Artificial Sequence: Synthetic coding sequence
atggcccagttccccaccccatttggaggcagcctggacatctgggccatcaccgtggaggagcgggccaagcatgaccagcagttccacagcctgaagcccatcagcggcttcatcaccggggaccaggccaggaacttcttcttccagagcggcctgccccagcctgtgctggcccagatctgggccctggccgacatgaacaatgatggccgcatggaccaggtggagttctag

SEQ ID NO: 156511 - DNA, 5094 bp, Artificial Sequence
  Description of Artificial Sequence: Synthetic coding sequence
atgatggcccagttccccacagccatgaatggaggccccaacatgtgggccatcaccagcgaggagaggaccaagcatgaccggcagtttgacaacctgaagcccagcggcggctacatcactggagaccaggccaggaacttcttcctgcagagcggcctgcctgcccctgtgctggccgagatctgggccctgagtgacctgaacaaggatggcaagatggaccagcaggagttcagcatcgccatgaagctgatcaagctgaagctgcagggccagcagctgcctgtggtgctgccccccatcatgaagcagccccccatgttcagccccctcatcagcgccaggtttggcatgggctccatgcccaacctgagcatcccccagcccctgcccccagctgcccccatcaccagcctgagcagcgccaccagcggcaccaacctgccccccctgatgatgcccacccccctggtgcccagcgtgtccaccagcagcctgcccaatggaacagccagcctcatccagcccctgcccatcccctacagcagcagcaccctgccccacggcagcagctacagcctgatgatgggcggctttggaggagccagcatccagaaggcccagagcctgattgacctgggcagcagcagcagcaccagcagcacagccagcctgagcggcaacagccccaagacaggcaccagcgagtgggccgtgccccagcccacccggctgaagtaccggcagaagttcaacaccctggacaagtccatgagcggctacctgagcggcttccaggccagaaatgccctgctgcagagcaacctgagccagacccagctggccaccatctggaccctggctgatgtggatggagatggccagctgaaggccgaggagttcatcctggccatgcacctgacagacatggccaaggccggccagcccctgcccctgaccctgcccccagagctggtgccccccagcttccggggcggcaagcagattgacagcatcaatggcaccctgcccagctaccagaagatgcaggaggaggagccccagaagaagctgcctgtgacctttgaggacaagaggaaggccaactatgagcggggcaacatggagctggagaagaggcggcaggccctgatggagcagcagcagcgggaggccgagaggaaggcccagaaggagaaggaggagtgggagaggaagcagcgggagctgcaggagcaggagtggaagaagcagctggagctggagaagaggctggagaagcagcgggagctggagcggcagcgggaggaggagaggaggaaggacatcgagcggcgggaggccgccaagcaggagctggagcggcagaggcggctggagtgggagcgcatccggcggcaggagctgctgaaccagaagaaccgggagcaggaggagatcgtgcggctgaacagcaagaagaagaacctgcacctggagctggaggccctgaatggcaagcaccagcagatcagcggccgcctgcaggatgtgcggctgaagaagcagacccagaagacagagctggaggtgctggacaagcagtgtgacctggagatcatggagatcaagcagctgcagcaggagctgcaggagtaccagaacaagctgatctacctggtgcctgagaagcagctgctgaatgaaagaatcaagaacatgcagttcagcaacaccccagacagcggcgtgtccctgctgcacaagaagagcctggagaaggaggagctgtgccagaggctgaaggagcagctggatgccctggagaaggagacagccagcaagctgtctgagatggacagcttcaacaaccagctgaagtgtggcaacatggatgacagcgtgctgcagtgcctgctgagcctgctgagctgcctgaacaacctcttcctgctgctgaaggagctgcgggagacctacaacacccagcagctggccctggagcagctgtacaagatcaagagggacaagctgaaggagattgaaaggaagaggctggagctgatgcagaagaagaagctggaggatgaggccgccaggaaggccaagcagggcaaggagaacctgtggaaggagaacctgaggaaggaggaggaggagaagcagaagaggctgcaggaggagaagacccaggagaagatccaggaggaggagaggaaggccgaggagaagcagaggaaggacaaggacaccctgaaggccgaggagaagaagcgggagacagcctctgtgctggtgaactaccgggccctgtacccctttgaggccagaaatcatgatgagatgtccttcaacagcggggacatcatccaggtggatgagaagacagtgggggagcccggctggctgtatggcagcttccagggcaactttggctggttcccctgcaactacgtggagaagatgcccagcagtgaaaatgagaaggctgtgagccccaagaaggccctgctgcccccaacagtgtccctgagcgccaccagcaccagcagcgagcccctgagcagcaaccagcctgcctctgtgacagactaccagaatgtgtccttcagcaacctgactgtgaacacctcctggcagaagaagagcgccttcaccaggacagtgtccccaggctctgtgagccccatccacggccagggccaggtggtggagaacctgaaggcccaggccctgtgctcctggacagccaagaaggacaaccacctgaacttcagcaagcatgacatcatcaccgtgctggagcagcaggagaactggtggtttggagaggtgcacggcggccggggctggttccccaagagctatgtgaagatcatccctggcagcgaggtgaagcgggaggagcctgaggccctgtatgctgctgtgaacaagaagcccaccagcgctgcctacagcgtgggggaggagtacatcgccctgtacccctacagctctgtggagcccggggacctgaccttcacagaaggagaggagatcctggtgacccagaaggatggagagtggtggacaggcagcatcggggacaggagcggcatcttccccagcaactacgtgaagcccaaggaccaggagagctttggcagcgccagcaagagcggggccagcaacaagaagccagaaattgcccaggtgaccagcgcctacgtggccagcggcagcgagcagctgagcctggcccctggccagctgatcctgatcctgaagaagaacaccagcggctggtggcagggcgagctgcaggcccggggcaagaagaggcagaagggctggttccctgccagccacgtgaagctgctgggccccagcagcgagcgggccaccccagccttccaccctgtgtgccaggtgattgccatgtatgactatgctgccaacaatgaagatgagctgtccttcagcaagggccagctgatcaacgtgatgaacaaggatgatcctgactggtggcagggcgagatcaacggggtgacaggcctcttccccagcaactacgtgaagatgaccacagacagcgaccccagccagcagtggtgtgccgacctgcagaccctggacaccatgcagcccatcgagaggaagaggcagggctacatccacgagctgatccagacagaggagcgctacatggctgacctgcagctggtggtggaggtgttccagaagaggatggccgagagcggcttcctgacagaaggagagatggccctgatctttgtgaactggaaggagctgatcatgagcaacaccaagctgctgaaggccctgcgggtgaggaagaagacaggaggagagaagatgcctgtgcagatgattggagacatcctggccgctgagctgagccacatgcaggcctacatccgcttctgcagctgccagctgaatggagctgccctgctgcagcagaagacagatgaggacacagacttcaaggagttcctgaagaagctggccagtgacccccgctgcaagggcatgcccctgagcagcttcctgctgaagcccatgcagaggatcacccgctaccccctgctgatccgcagcatcctggagaacaccccagagagccatgctgaccacagcagcctgaagctggccctggagagagctgaggagctgtgcagccaggtgaatgaaggagtgcgggagaaggagaacagcgaccggctggagtggatccaggcccacgtgcagtgtgagggcctggccgagcagctgatcttcaacagcctgaccaactgcctgggccccaggaagctgctgcacagcggcaagctgtacaagaccaagagcaacaaggagctgcacggcttcctgttcaatgacttcctgctgctgacctacatggtgaagcagtttgctgtgagcagcggcagcgagaagctgttcagcagcaagagcaatgcccagttcaagatgtacaagacccccatcttcctgaatgaggtgctggtgaagctgcccacagaccccagcagtgatgagcctgtgttccacatcagccacatcgacagagtgtacaccctgaggacagacaacatcaatgaaagaacagcctgggtgcagaagatcaaggccgccagcgagcagtacatcgacacagagaagaagaagcgggagaaggcctaccaggcccggagccagaagaccagcggcatcggccgcctgatggtgcacgtgattgaggccacagagctgaaggcctgcaagcccaacgggaagagcaacccctactgtgagatctccatgggcagccagagctacaccaccaggaccatccaggacaccctgaaccccaagtggaacttcaactgccagttcttcatcaaggacctgtaccaggatgtgctgtgcctgaccctgtttgaccgggaccagttctccccagatgacttcctgggccgcacagagatccctgtggccaagatcagaacagagcaggagagcaagggccccatgacccggcggctgctgctgcacgaggtgcccactggagaggtgtgggtgcgctttgacctgcagctgtttgagcagaagaccctgctgtag

SEQ ID NO: 156512 - DNA, 5013 bp, Artificial Sequence
  Description of Artificial Sequence: Synthetic coding sequence
atgatggcccagttccccacagccatgaatggaggccccaacatgtgggccatcaccagcgaggagaggaccaagcatgaccggcagtttgacaacctgaagcccagcggcggctacatcactggagaccaggccaggaacttcttcctgcagagcggcctgcctgcccctgtgctggccgagatctgggccctgagtgacctgaacaaggatggcaagatggaccagcaggagttcagcatcgccatgaagctgatcaagctgaagctgcagggccagcagctgcctgtggtgctgccccccatcatgaagcagccccccatgttcagccccctcatcagcgccaggtttggcatgggctccatgcccaacctgagcatcccccagcccctgcccccagctgcccccatcaccagcctgagcagcgccaccagcggcaccaacctgccccccctgatgatgcccacccccctggtgcccagcgtgtccaccagcagcctgcccaatggaacagccagcctcatccagcccctgcccatcccctacagcagcagcaccctgccccacggcagcagctacagcctgatgatgggcggctttggaggagccagcatccagaaggcccagagcctgattgacctgggcagcagcagcagcaccagcagcacagccagcctgagcggcaacagccccaagacaggcaccagcgagtgggccgtgccccagcccacccggctgaagtaccggcagaagttcaacaccctggacaagtccatgagcggctacctgagcggcttccaggccagaaatgccctgctgcagagcaacctgagccagacccagctggccaccatctggaccctggctgatgtggatggagatggccagctgaaggccgaggagttcatcctggccatgcacctgacagacatggccaaggccggccagcccctgcccctgaccctgcccccagagctggtgccccccagcttccggggcggcaagcagattgacagcatcaatggcaccctgcccagctaccagaagatgcaggaggaggagccccagaagaagctgcctgtgacctttgaggacaagaggaaggccaactatgagcggggcaacatggagctggagaagaggcggcaggccctgatggagcagcagcagcgggaggccgagaggaaggcccagaaggagaaggaggagtgggagaggaagcagcgggagctgcaggagcaggagtggaagaagcagctggagctggagaagaggctggagaagcagcgggagctggagcggcagcgggaggaggagaggaggaaggacatcgagcggcgggaggccgccaagcaggagctggagcggcagaggcggctggagtgggagcgcatccggcggcaggagctgctgaaccagaagaaccgggagcaggaggagatcgtgcggctgaacagcaagaagaagaacctgcacctggagctggaggccctgaatggcaagcaccagcagatcagcggccgcctgcaggatgtgcggctgaagaagcagacccagaagacagagctggaggtgctggacaagcagtgtgacctggagatcatggagatcaagcagctgcagcaggagctgcaggagtaccagaacaagctgatctacctggtgcctgagaagcagctgctgaatgaaagaatcaagaacatgcagttcagcaacaccccagacagcggcgtgtccctgctgcacaagaagagcctggagaaggaggagctgtgccagaggctgaaggagcagctggatgccctggagaaggagacagccagcaagctgtctgagatggacagcttcaacaaccagctgaaggagctgcgggagacctacaacacccagcagctggccctggagcagctgtacaagatcaagagggacaagctgaaggagattgaaaggaagaggctggagctgatgcagaagaagaagctggaggatgaagctgccaggaaggccaagcagggcaaggagaacctgtggaaggagaacctgaggaaggaggaggaggagaagcagaagaggctgcaggaggagaagacccaggagaagatccaggaggaggagaggaaggccgaggagaagcagaggaaggacaaggacaccctgaaggccgaggagaagaagcgggagacagcctctgtgctggtgaactaccgggccctgtacccctttgaggccaggaaccatgatgagatgtccttcaacagcggggacatcatccaggtggatgagaagacagtgggggagcccggctggctgtatggcagcttccagggcaactttggctggttcccctgcaactacgtggagaagatgcccagcagtgaaaatgagaaggctgtgagccccaagaaggccctgctgccccccaccgtgtccctgagcgccaccagcaccagcagcgagcccctgagcagcaaccagcctgcctctgtgacagactaccagaatgtgtccttcagcaacctgactgtgaacacctcctggcagaagaagagcgccttcaccaggacagtgtccccaggctctgtgagccccatccacggccagggccaggtggtggagaacctgaaggcccaggccctgtgctcctggacagccaagaaggacaaccacctgaacttcagcaagcatgacatcatcaccgtgctggagcagcaggagaactggtggtttggagaggtgcatggaggccggggctggttccccaagagctatgtgaagatcatccctggcagcgaggtgaagcgggaggagcctgaggccctgtatgctgctgtgaacaagaagcccaccagcgctgcctacagcgtgggggaggagtacatcgccctgtacccctacagctctgtggagcccggggacctgaccttcacagaaggagaggagatcctggtgacccagaaggatggagagtggtggacaggcagcattggagacagaagtggcatcttccccagcaactacgtgaagcccaaggaccaggagagctttggaagtgccagcaagagcggggccagcaacaagaagccagagatcgcccaggtgaccagcgcctacgtggccagcggcagcgagcagctgagcctggcccctggccagctgatcctgatcctgaagaagaacaccagcggctggtggcagggcgagctgcaggcccggggcaagaagaggcagaagggctggttccctgccagccacgtgaagctgctgggccccagcagcgagcgggccaccccagccttccaccctgtgtgccaggtgattgccatgtatgactatgctgccaacaatgaagatgagctgtccttcagcaagggccagctgatcaacgtgatgaacaaggatgatcctgactggtggcagggcgagatcaatggagtgacaggcctcttccccagcaactacgtgaagatgaccacagacagcgaccccagccagcagtggtgtgccgacctgcagaccctggacaccatgcagcccattgaaaggaagaggcagggctacatccacgagctgatccagacagaggagcgctacatggctgacctgcagctggtggtggaggtgttccagaagaggatggccgagagcggcttcctgacagaaggagagatggccctgatctttgtgaactggaaggagctgatcatgagcaacaccaagctgctgaaggccctgcgggtgaggaagaagacaggaggagagaagatgcctgtgcagatgattggagacatcctggccgctgagctgagccacatgcaggcctacatccgcttctgcagctgccagctgaatggagctgccctgctgcagcagaagacagatgaggacacagacttcaaggagttcctgaagaagctggccagtgacccccgctgcaagggcatgcccctgagcagcttcctgctgaagcccatgcagaggatcacccgctaccccctgctgatccgcagcatcctggagaacaccccagagagccacgccgaccacagcagcctgaagctggccctggagcgggcagaggagctgtgcagccaggtgaatgaaggagtgcgggagaaggaaaattctgaccggctggagtggatccaggcccacgtgcagtgtgagggcctggccgagcagctgatcttcaacagcctgaccaactgcctgggccccaggaagctgctgcacagcggcaagctgtacaagaccaagagcaacaaggagctgcacggcttcctgttcaatgacttcctgctgctgacctacatggtgaagcagtttgctgtgagcagcggcagcgagaagctgttcagcagcaagagcaatgcccagttcaagatgtacaagacccccatcttcctgaatgaggtgctggtgaagctgcccacagaccccagcagtgatgagcccgtcttccacatcagccacatcgacagagtgtacaccctgaggacagacaacatcaatgaaagaacagcctgggtgcagaagatcaaggccgccagcgagcagtacatcgacacagagaagaagaagcgggagaaggcctaccaggcccggagccagaagaccagcggcatcggccgcctgatggtgcacgtgattgaggccacagagctgaaggcctgcaagcccaacgggaagagcaacccctactgtgagatctccatgggcagccagagctacaccaccaggaccatccaggacaccctgaaccccaagtggaacttcaactgccagttcttcatcaaggacctgtaccaggatgtgctgtgcctgaccctgtttgaccgggaccagttctccccagatgacttcctgggccgcacagagatccctgtggccaagatcagaacagagcaggagagcaagggccccatgacccggcggctgctgctgcacgaggtgcccaccggggaggtgtgggtgcgctttgacctgcagctgtttgagcagaagaccctgctgtag

SEQ ID NO: 156513 - DNA, 5013 bp, Artificial Sequence; identical to SEQ ID NO: 156512
  Description of Artificial Sequence: Synthetic coding sequence

SEQ ID NO: 156514 - DNA, 1836 bp, Artificial Sequence
  Description of Artificial Sequence: Synthetic coding sequence
atggcccagttccccacagccatgaatggaggccccaacatgtgggccatcaccagcgaggagaggaccaagcatgaccggcagtttgacaacctgaagcccagcggcggctacatcaccggggaccaggccaggaacttcttcctgcagagcggcctgcctgcccctgtgctggccgagatctgggccctgagtgacctgaacaaggatggcaagatggaccagcaggagttcagcatcgccatgaagctgatcaagctgaagctgcagggccagcagctgcctgtggtgctgccccccatcatgaagcagccccccatgttcagccccctcatcagcgcccgcttcggcatgggctccatgcccaacctgagcatcccccagcccctgcccccagctgcccccatcaccagcctgagcagcgccaccagcggcaccaacctgccccccctgatgatgcccacccccctggtgcccagcgtgtccaccagcagcctgcccaacggcacagccagcctcatccagcccctgcccatcccctacagcagcagcaccctgccccacggcagcagctacagcctgatgatgggcggctttggaggagccagcatccagaaggcccagagcctgattgacctgggcagcagccgctcctggagcagcggcagcagcgcccacagccctgccacccaccgggcccccctgagcagccctgtgcccaacagcagcaccagcagcacagccagcctgagcggcaacagccccaagacaggcaccagcgagtgggccgtgccccagcccacccggctgaagtaccggcagaagttcaacaccctggacaagtccatgagcggctacctgagcggcttccaggccagaaatgccctgctgcagagcaacctgagccagacccagctggccaccatctggaccctggctgatgtggatggagatggccagctgaaggccgaggagttcatcctggccatgcacctgacagacatggccaaggccggccagcccctgcccctgaccctgcccccagagctggtgccccccagcttccggggcggcaagcagattgacagcatcaatggcaccctgcccagctaccagaagatgcaggaggaggagccccagaagaagctgcctgtgacctttgaggacaagaggaaggccaactatgagcggggcaacatggagctggagaagaggcggcaggccctgatggagcagcagcagcgggaggccgagaggaaggcccagaaggagaaggaggagtgggagaggaagcagcgggagctgcaggagcaggagtggaagaagcagctggagctggagaagaggctggagaagcagcgggagctggagcggcagcgggaggaggagaggaggaaggacatcgagcggcgggaggccgccaagcaggagctggagcggcagaggcggctggagtgggagcgcatccggcggcaggagctgctgaaccagaagaaccgggagcaggaggagatcgtgcggctgaacagcaagaagaagaacctgcacctggagctggaggccctgaatggcaagcaccagcagatcagcggccgcctgcaggatgtgcggctgaagaagcagacccagaagacagagctggaggtgctggacaagcagtgtgacctggagatcatggagatcaagcagctgcagcaggagctgcaggagtaccagaacaagctgatctacctggtgcctgagaagcagctgctgaatgaaagaatcaagaacatgcagttcagcaacaccccagacagcggcgtgtccctgctgcacaagaagagcctggagtag

SEQ ID NO: 156515 - DNA, 3750 bp, Artificial Sequence
  Description of Artificial Sequence: Synthetic coding sequence
atgatggcccagttccccacagccatgaatggaggccccaacatgtgggccatcaccagcgaggagaggaccaagcatgaccggcagtttgacaacctgaagcccagcggcggctacatcactggagaccaggccaggaacttcttcctgcagagcggcctgcctgcccctgtgctggccgagatctgggccctgagtgacctgaacaaggatggcaagatggaccagcaggagttcagcatcgccatgaagctgatcaagctgaagctgcagggccagcagctgcctgtggtgctgccccccatcatgaagcagccccccatgttcagccccctcatcagcgccaggtttggcatgggctccatgcccaacctgagcatcccccagcccctgcccccagctgcccccatcaccagcctgagcagcgccaccagcggcaccaacctgccccccctgatgatgcccacccccctggtgcccagcgtgtccaccagcagcctgcccaatggaacagccagcctcatccagcccctgcccatcccctacagcagcagcaccctgccccacggcagcagctacagcctgatgatgggcggctttggaggagccagcatccagaaggcccagagcctgattgacctgggcagcagcagcagcaccagcagcacagccagcctgagcggcaacagccccaagacaggcaccagcgagtgggccgtgccccagcccacccggctgaagtaccggcagaagttcaacaccctggacaagtccatgagcggctacctgagcggcttccaggccagaaatgccctgctgcagagcaacctgagccagacccagctggccaccatctggaccctggctgatgtggatggagatggccagctgaaggccgaggagttcatcctggccatgcacctgacagacatggccaaggccggccagcccctgcccctgaccctgcccccagagctggtgccccccagcttccggggcggcaagcagattgacagcatcaatggcaccctgcccagctaccagaagatgcaggaggaggagccccagaagaagctgcctgtgacctttgaggacaagaggaaggccaactatgagcggggcaacatggagctggagaagaggcggcaggccctgatggagcagcagcagcgggaggccgagaggaaggcccagaaggagaaggaggagtgggagaggaagcagcgggagctgcaggagcaggagtggaagaagcagctggagctggagaagaggctggagaagcagcgggagctggagcggcagcgggaggaggagaggaggaaggacatcgagcggcgggaggccgccaagcaggagctggagcggcagaggcggctggagtgggagcgcatccggcggcaggagctgctgaaccagaagaaccgggagcaggaggagatcgtgcggctgaacagcaagaagaagaacctgcacctggagctggaggccctgaatggcaagcaccagcagatcagcggccgcctgcaggatgtgcggctgaagaagcagacccagaagacagagctggaggtgctggacaagcagtgtgacctggagatcatggagatcaagcagctgcagcaggagctgcaggagtaccagaacaagctgatctacctggtgcctgagaagcagctgctgaatgaaagaatcaagaacatgcagttcagcaacaccccagacagcggcgtgtccctgctgcacaagaagagcctggagaaggaggagctgtgccagaggctgaaggagcagctggatgccctggagaaggagacagccagcaagctgtctgagatggacagcttcaacaaccagctgaagtgtggcaacatggatgacagcgtgctgcagtgcctgctgagcctgctgagctgcctgaacaacctcttcctgctgctgaaggagctgcgggagacctacaacacccagcagctggccctggagcagctgtacaagatcaagagggacaagctgaaggagattgaaaggaagaggctggagctgatgcagaagaagaagctggaggatgaggccgccaggaaggccaagcagggcaaggagaacctgtggaaggagaacctgaggaaggaggaggaggagaagcagaagaggctgcaggaggagaagacccaggagaagatccaggaggaggagaggaaggccgaggagaagcagaggaaggacaaggacaccctgaaggccgaggagaagaagcgggagacagcctctgtgctggtgaactaccgggccctgtacccctttgaggccagaaatcatgatgagatgtccttcaacagcggggacatcatccaggtggatgagaagacagtgggggagcccggctggctgtatggcagcttccagggcaactttggctggttcccctgcaactacgtggagaagatgcccagcagtgaaaatgagaaggctgtgagccccaagaaggccctgctgcccccaacagtgtccctgagcgccaccagcaccagcagcgagcccctgagcagcaaccagcctgcctctgtgacagactaccagaatgtgtccttcagcaacctgactgtgaacacctcctggcagaagaagagcgccttcaccaggacagtgtccccaggctctgtgagccccatccacggccagggccaggtggtggagaacctgaaggcccaggccctgtgctcctggacagccaagaaggacaaccacctgaacttcagcaagcatgacatcatcaccgtgctggagcagcaggagaactggtggtttggagaggtgcacggcggccggggctggttccccaagagctatgtgaagatcatccctggcagcgaggtgaagcgggaggagcctgaggccctgtatgctgctgtgaacaagaagcccaccagcgctgcctacagcgtgggggaggagtacatcgccctgtacccctacagctctgtggagcccggggacctgaccttcacagaaggagaggagatcctggtgacccagaaggatggagagtggtggacaggcagcatcggggacaggagcggcatcttccccagcaactacgtgaagcccaaggaccaggagagctttggcagcgccagcaagagcggggccagcaacaagaagccagaaattgcccaggtgaccagcgcctacgtggccagcggcagcgagcagctgagcctggcccctggccagctgatcctgatcctgaagaagaacaccagcggctggtggcagggcgagctgcaggcccggggcaagaagaggcagaagggctggttccctgccagccacgtgaagctgctgggccccagcagcgagcgggccaccccagccttccaccctgtgtgccaggtgattgccatgtatgactatgctgccaacaatgaagatgagctgtccttcagcaagggccagctgatcaacgtgatgaacaaggatgatcctgactggtggcagggcgagatcaacggggtgacaggcctcttccccagcaactacgtgaagatgaccacagacagcgaccccagccagcagtggtgtgccgacctgcagaccctggacaccatgcagcccatcgagaggaagaggcagggctacatccacgagctgatccagacagaggagcgctacatggctgacctgcagctggtggtggaggtgcggcggctgctgctggccagcagccggggcatctgctgcctgtcctag

SEQ ID NO: 156516 - DNA, 1899 bp, Artificial Sequence
  Description of Artificial Sequence: Synthetic coding sequence
atgaaccgctacaccaccatccggcagctgggagatggcacctacggctctgtgctgctgggccgcagcattgagagcggggagctgattgccatcaagaagatgaagaggaagttctacagctgggaggagtgcatgaacctgcgggaggtgaagagcctgaagaagctgaaccacgccaacgtggtgaagctgaaggaggtgatcagagaaaatgaccacctgtacttcatctttgagtacatgaaggagaacctgtaccagctgatcaaggagaggaacaagctgtttcctgagagcgccatccggaacatcatgtaccagatcctgcagggcctggccttcatccacaagcacggcttcttccaccgggacctgaagccagagaacctgctgtgcatgggccctgagctggtgaagattgctgactttggcctggcccgggagatccgcagcaagccaccctacacagattatgtgtccacccgctggtaccgggcccctgaggtgctgctgcggagcaccaactacagcagccccattgatgtgtgggccgtgggctgcatcatggccgaggtgtacaccctgcggcccctcttccctggggccagcgagattgacaccatcttcaagatctgccaggtgctgggcacccccaagaagacagactggccagagggctaccagctgagcagcgccatgaacttccgctggccccagtgtgtgcccaacaacctgaagaccctcatccccaatgccagcagcgaggccgtgcagctgctgcgggacatgctgcagtgggaccccaagaagaggcccacagccagccaggccctgcgctacccctacttccaggtgggccaccccctgggcagcaccacccagaacctgcaggacagcgagaagccccagaagggcatcctggagaaggccggccccccaccctacatcaagcctgtgcccccagcccagcccccagccaagccccacacccgcatcagcagccggcagcaccaggccagccagccccccctgcacctgacctacccctacaaggccgaggtgtccaggacagaccaccccagccacctgcaggaggacaagcccagccccctgctcttccccagcctgcacaacaagcacccccagagcaagatcacagctggcctggagcacaagaatggagagatcaagcccaagagcagaagacgctggggcctcatcagccgcagcaccaaggacagtgatgactgggccgacctggatgacctggacttcagccccagcctgagcagaattgacctgaagaacaagaagaggcagagtgatgacaccctgtgccgctttgaatctgtgctggacctgaagcccagcgagcctgtgggcactggaaacagcgcccccacccagaccagctaccagaggcgggacacccccaccctgcggtctgctgccaagcagcactacctgaagcacagccgctacctgcccggcatcagcatcagaaatggcatcctgagcaaccctgggaaggagttcatcccccccaacccctggagcagcagcggcctgagcggcaagagcagcggcaccatgtctgtcatcagcaaggtgaacagcgtgggcagcagcagcaccagcagcagcggcctgaccggcaactacgtgcccagcttcctgaagaaggagatcggcagcgccatgcagagggtgcacctggcccccatcccagaccccagccctggctacagcagcctgaaggccatgaggccccaccctggccggcccttcttccacacccagcccaggagcaccccaggcctcatcccccggcccccagctgcccagcctgtgcacggccgcacagactgggccagcaaatatgccagcagaagatag

SEQ ID NO: 156517 - DNA, 1899 bp, Artificial Sequence; identical to SEQ ID NO: 156516
  Description of Artificial Sequence: Synthetic coding sequence

SEQ ID NO: 156518 - DNA, 738 bp, Artificial Sequence
  Description of Artificial Sequence: Synthetic coding sequence
atgtgtgccgaggtgggccctgccctgtgccggggcatggagaggaacagcctgggctgctgtgaggcccccaagaagctgagcctgtccttcagcattgaggccatcctgaagaggcctgcccggcggagtgacatggacaggcctgagggccctggagaggagggccctggagaggccgccgccagcggcagcggcctggagaagccacccaaggaccagccccaggagggcaggaagagcaagagaagagtgaggaccaccttcaccacagagcagctgcacgagctggagaagatcttccacttcacccactacccagatgtgcacatccgcagccagctggccgcccgcatcaacctgcctgaggcccgggtgcagatctggttccagaaccagagggccaagtggaggaagcaggagaagattggcaacctgggcgccccccagcagctgtctgaggcctctgtggccctgcccaccaacctggatgtggccggccccacctggaccagcacagccctgcggcggctggccccacccaccagctgctgccccagcgcccaggaccagctggccagcgcctggttccctgcctggatcaccctgctgcctgcccacccctgggagacccagcctgtgcccggcctgcccatccaccagacctgcatccctgtgctgtgcatcctgcccccaccccaccccaagtggggcagcatctgtgccaccagcacctag

SEQ ID NO: 156519 - DNA, 738 bp, Artificial Sequence; identical to SEQ ID NO: 156518
  Description of Artificial Sequence: Synthetic coding sequence

SEQ ID NO: 156520 - DNA, 1749 bp, Artificial Sequence
  Description of Artificial Sequence: Synthetic coding sequence
atggccaatgaagactgccccaaggctgctgacagccccttcagcagtgacaagcacgcccagctgatcctggcccagatcaacaagatgagaaatggccagcacttctgtgatgtgcagctgcaggtgggccaggagagcttcaaggcccaccggctggtgctggccgccagcagcccctactttgctgccctcttcaccggcggcatgaaggagagcagcaaggatgtggtgcccatcctgggcattgaagctggcatcttccagatcctgctggacttcatctacacaggaattgtgaacatcggcgtgaacaacgtgcaggagctgatcatcgctgctgacatgctgcagctgacagaggtggtgcacctgtgctgtgagttcctgaagggccagattgaccccctgaactgcatcggcatcttccagttcagcgagcagatcgcctgccacgacctgctggagttcagcgagaactacatccacgtgcacttcctggaggtgcacagcggggaggagttcctggccctgaccaaggaccagctgatcaagatcctgcggtctgaggagctgagcattgaagatgagtaccaggtgttcctggccgccatgcagtggatcctgaaggacctgggcaagaggaggaagcacgtggtggaggtgctggaccccatccgcttccccctgctgcccccccagaggctgctgaagtacatcgagggcgtgtctgacttcaacctgcgggtggccctgcagaccctgctgaaggagtactgtgaggtgtgcaagagccccaaggagaacaagttctgcagcttcctgcagaccagcaaggtgcggcccaggaagaaggccaggaagtacctgtatgctgtgggcggctacacccggctgcagggcggccgctggagcgacagccgggccctgagctgtgtggagagatttgacaccttcagccagtactggaccaccgtgagcagcctgcaccaggcccggagcggcctgggcgtgacagtgctgggcggcatggtgtatgccatcggcggggagaaggacagcatgatctttgactgcacagaatgttatgaccctgtgaccaagcagtggaccaccgtggcctccatgaaccacccccgctgtggcctgggcgtgtgtgtgtgctatggagccatctatgccctgggcggctgggtgggcgctgagatcggcaacaccatcgagagatttgatcctgatgagaacaagtgggaggtggtgggcaacatggctgtgagccgctactacttcggctgctgtgagatgcagggcctcatctacgtgattggaggcatcagcaatgaaggcatcgagctgcggagctttgaggtgtatgaccccctgagcaagcgctggagccccctgccccccatgggcacccggcgggcctacctgggcgtggccgccctgaatgactgcatctacagcgtgggcggctggaatgagacccaggatgccctgcacacagtggagaagtacagctttgaggaggagaagtgggtggaggtggcctccatgaaggtgccccgggccggcatgtgtgtggtggccgtgaatggcctgctgtatgtgtctgggggccgcagcagcagccatgacttcctggccccagacacccacagatatgaggtgttccggctgaagtgggagaacatgtgcatcctcttcaatgaccacaagaccctgaccaagggcatcttcaacctgtag

SEQ ID NO: 156521 - DNA, 1755 bp, Artificial Sequence
  Description of Artificial Sequence: Synthetic coding sequence
atggccaatgaagactgccccaaggctgctgacagccccttcagcagtgacaagcacgcccagctgatcctggcccagatcaacaagatgagaaatggccagcacttctgtgatgtgcagctgcaggtgggccaggagagcttcaaggcccaccggctggtgctggccgccagcagcccctactttgctgccctcttcaccggcggcatgaaggagagcagcaaggatgtggtgcccatcctgggcattgaagctggcatcttccagatcctgctggacttcatctacacaggaattgtgaacatcggcgtgaacaacgtgcaggagctgatcatcgctgctgacatgctgcagctgacagaggtggtgcacctgtgctgtgagttcctgaagggccagattgaccccctgaactgcatcggcatcttccagttcagcgagcagatcgcctgccacgacctgctggagttcagcgagaactacatccacgtgcacttcctggaggtgcacagcggggaggagttcctggccctgaccaaggaccagctgatcaagatcctgcggtctgaggagctgagcattgaagatgagtaccaggtgttcctggccgccatgcagtggatcctgaaggacctgggcaagaggaggaagcacgtggtggaggtgctggaccccatccgcttccccctgctgcccccccagaggctgctgaagtacatcgagggcgtgtctgacttcaacctgcgggtggccctgcagaccctgctgaaggagtactgtgaggtgtgcaagagccccaaggagaacaagttctgcagcttcctgcagaccagcaaggtgcggcccaggaagaaggccaggaagtacctgtatgctgtgggcggctacacccggctgcagggcggccgctggagcgacagccgggccctgagctgtgtggagagatttgacaccttcagccagtactggaccaccgtgagcagcctgcaccaggcccggagcggcctgggcgtgacagtgctgggcggcatggtgtatgccatcggcggggagaaggacagcatgatctttgactgcacagaatgttatgaccctgtgaccaagcagtggaccaccgtggcctccatgaaccacccccgctgtggcctgggcgtgtgtgtgtgctatggagccatctatgccctgggcggctgggtgggcgctgagatcggcaacaccatcgagagatttgatcctgatgagaacaagtgggaggtggtgggcaacatggctgtgagccgctactacttcggctgctgtgagatgcagggcctcatctacgtgattggaggcatcagcaatgaaggcatcgagctgcggagctttgaggtgtatgaccccctgagcaagcgctggagccccctgccccccatgggcacccggcgggcctacctgggcgtggccgccctgaatgactgcatctacagcgtgggcggctggaatgagacccaggatgccctgcacacagtggagaagtacagctttgaggaggagaagtgggtggaggtggcctccatgaaggtgccccgggccggcatgtgtgtggtggccgtgaatggcctgctgtatgtgtctgggggccgcagcagcagccatgacttcctggcccctggcaccctggacagcgtggaggtgtacaacccccacagcgacacctggacagaaattggcaacatgatcaccagccgctgtgagggcggcgtggccgtgctgtag

SEQ ID NO: 156522 - DNA, 3879 bp, Artificial Sequence
  Description of Artificial Sequence: Synthetic coding sequence
atgagagctgtgctgacctggagggacaaggccgagcactgcatcaatgacatcgccttcaagccagatggcacccagctgatcctggccgccggcagccggctgctggtgtatgacaccagtgatggcaccctgctgcagcccctgaagggccacaaggacacagtgtactgtgtggcctatgccaaggatggcaagagatttgccagcggcagcgctgacaagagcgtcatcatctggaccagcaagctggagggcatcctgaagtacacctcctggagcgtgatgagcagcctgcacctgcacctgcccttcctgggcctgcacaagacagtgcgggtgacagccacagacaaggcccccaagggccagggcggcagaattgactgcctgcggcccagcgtgcagaaccagcccggccagaagcacaatgatgccatccagtgtgtgtcctacaaccccatcacccaccagctggccagctgcagcagcagtgactttggcctgtggagccctgagcagaagtctgtgtccaagcacaagagcagcagcaagatcatctgctgctcctggaccaatgatggccagtacctggccctgggcatgttcaacggcatcatcagcatccggaacaagaatggagaggagaaggtgaagattgaaagacctgggggcagcctgagccccatctggagcatctgctggaaccccagcagccgctgggagagcttctggatgaacagagaaaatgaagatgctgaagatgtgattgtgaaccgctacatccaggagatccccagcaccctgaagtctgctgtgtacagcagccagggcagcgaggccgaggaggaggagcctgaggaggaggatgacagccccagagatgacaacctggaggagagaaatgacatcctggccgtggccgactggggccagaaggtgtccttctaccagctgagcggcaagcagatcggcaaggaccgggccctgaactttgacccctgctgcatctcctacttcaccaagggggagtacatcctgctgggcggcagtgacaagcaggtgtccctcttcaccaaggatggagtgcggctgggcaccgtgggggagcagaacagctgggtgtggacctgccaggccaagccagacagcaactacgtggtggtgggctgccaggacggcaccatctccttctaccagctgatcttcagcacagtgcacggcctgtacaaggacagatatgcctacagagacagcatgacagatgtgattgtgcagcacctgatcacagagcagaaggtgcgcatcaagtgcaaggagctggtgaagaagatcgccatctacagaaaccggctggccatccagctgcctgagaagatcctgatctatgagctgtacagcgaggacctgagtgacatgcactacagagtgaaggagaagatcatcaagaagtttgagtgcaacctgctggtggtgtgtgccaaccacatcatcctgtgccaggagaagaggctgcagtgcctgtccttctctggagtgaaggagcgggagtggcagatggagagcctcatccgctacatcaaggtgattggaggccccccaggccgggagggcctgctggtgggcctgaagaatggccagatcctgaagatctttgtggacaacctgtttgccatcgtgctgctgaagcaggccacagctgtgcgctgcctggacatgtctgccagcaggaagaagctggccgtggtggatgaaaatgacacctgcctggtgtatgacatcgacaccaaggagctgctcttccaggagcccaatgccaacagcgtggcctggaacacccagtgtgaggacatgctgtgcttcagcggcggcggctacctgaacatcaaggccagcaccttccctgtgcaccggcagaagctgcagggctttgtggtgggctacaacggcagcaagatcttctgcctgcacgtgttcagcatctctgctgtggaggtgccccagagcgcccccatgtaccagtacctggacaggaagctgttcaaggaggcctaccagatcgcctgcctgggcgtgacagacacagactggagggagctggccatggaggccctggagggcctggactttgaaacagccaagaaggccttcatccgggtgcaggacctgcgctacctggagctgatcagcagcattgaggagaggaagaagagaggagagaccaacaatgacctcttcctggctgatgtgttctcctaccagggcaagttccacgaggccgccaagctgtacaagaggagcggccacgagaacctggccctggagatgtacacagacctgtgcatgtttgaatatgccaaggacttcctgggcagcggggaccccaaggagaccaagatgctgatcaccaagcaggccgactgggccaggaacatcaaggagcccaaggctgctgtggagatgtacatctctgctggggagcacgtgaaggccatcgagatctgtggggaccacggctgggtggacatgctgattgatattgccaggaagctggacaaggccgagcgggagcccctgctgctgtgtgccacctacctgaagaagctggacagccctggctatgctgctgagacctacctgaagatgggagacctgaagagcctggtgcagctgcacgtggagacccagcgctgggatgaggcctttgccctgggggagaagcaccctgagttcaaggatgacatctacatgccctatgcccagtggctggctgaaaatgacagatttgaggaggcccagaaggccttccacaaggccggccggcagcgggaggccgtgcaggtgctggagcagctgaccaacaatgctgtggccgagagccgcttcaatgatgctgcctactactactggatgctgtccatgcagtgcctggacatcgcccaggaccctgcccagaaggacaccatgctgggcaagttctaccacttccagaggctggccgagctgtaccacggctaccacgccatccaccgccacacagaggaccccttctctgtgcacaggcctgagaccctcttcaacatcagccgcttcctgctgcacagcctgcccaaggacacccccagcggcatcagcaaggtgaagatcctcttcaccctggccaagcagagcaaggccctgggcgcctaccgcctggcccggcatgcctatgacaagctgcggggcctgtacatcccagcccgcttccagaagagcattgagctgggcaccctgaccatccgggccaagcccttccatgattctgaggagctggtgcccctgtgctaccgctgcagcaccaacaaccccctgctgaacaacctgggcaatgtgtgcatcaactgccggcagcccttcatcttcagcgccagcagctatgatgtgctgcacctggtggagttctacctggaggagggcatcacagatgaggaggccatcagcctgattgacctggaggtgctgcggcccaagagagatgaccggcagctggagatcgccaacaacagcagccagatcctgcggctggtggagaccaaggacagcattggagatgaggaccccttcaccgccaagctgagctttgagcagggcggcagcgagtttgtgcctgtggtggtgtcccggctggtgctgcgctccatgagcagaagagatgtgctgatcaagcgctggcccccacccctgcgctggcagtacttccgcagcctgctgcctgatgccagcatcaccatgtgccccagctgcttccagatgttccacagcgaggactatgagctgctggtgctgcagcacggctgctgcccctactgccgccgctgcaaggatgaccccggcccctag

SEQ ID NO: 156523 - DNA, 3549 bp, Artificial Sequence
  Description of Artificial Sequence: Synthetic coding sequence
atgagagctgtgctgacctggagggacaaggccgagcactgcatcaatgacatcgccttcaagccagatggcacccagctgatcctggccgccggcagccggctgctggtgtatgacaccagtgatggcaccctgctgcagcccctgaagggccacaaggacacagtgtactgtgtggcctatgccaaggatggcaagagatttgccagcggcagcgctgacaagagcgtcatcatctggaccagcaagctggagggcatcctgaagtacacccacaatgatgccatccagtgtgtgtcctacaaccccatcacccaccagctggccagctgcagcagcagtgactttggcctgtggagccctgagcagaagtctgtgtccaagcacaagagcagcagcaagatcatctgctgctcctggaccaatgatggccagtacctggccctgggcatgtttaatggcatcatcagcatccggaacaagaatggagaggagaaggtgaagattgaaagacctgggggcagcctgagccccatctggagcatctgctggaaccccagccgggaggagagaaatgacatcctggccgtggccgactggggccagaaggtgtccttctaccagctgagcggcaagcagatcggcaaggaccgggccctgaactttgacccctgctgcatctcctacttcaccaagggggagtacatcctgctgggcggcagtgacaagcaggtgtccctcttcaccaaggatggagtgcggctgggcaccgtgggggagcagaacagctgggtgtggacctgccaggccaagccagacagcaactacgtggtggtgggctgccaggacggcaccatctccttctaccagctgatcttcagcacagtgcacggcctgtacaaggacagatatgcctacagagacagcatgacagatgtgattgtgcagcacctgatcacagagcagaaggtgcgcatcaagtgcaaggagctggtgaagaagatcgccatctacagaaaccggctggccatccagctgcctgagaagatcctgatctatgagctgtacagcgaggacctgagtgacatgcactacagagtgaaggagaagatcatcaagaagtttgagtgcaacctgctggtggtgtgtgccaaccacatcatcctgtgccaggagaagaggctgcagtgcctgtccttctctggagtgaaggagcgggagtggcagatggagagcctcatccgctacatcaaggtgattggaggccccccaggccgggagggcctgctggtgggcctgaagaatggccagatcctgaagatctttgtggacaacctgtttgccatcgtgctgctgaagcaggccacagctgtgcgctgcctggacatgtctgccagcaggaagaagctggccgtggtggatgaaaatgacacctgcctggtgtatgacatcgacaccaaggagctgctcttccaggagcccaatgccaacagcgtggcctggaacacccagtgtgaggacatgctgtgcttcagcggcggcggctacctgaacatcaaggccagcaccttccctgtgcaccggcagaagctgcagggctttgtggtgggctacaacggcagcaagatcttctgcctgcacgtgttcagcatctctgctgtggaggtgccccagagcgcccccatgtaccagtacctggacaggaagctgttcaaggaggcctaccagatcgcctgcctgggcgtgacagacacagactggagggagctggccatggaggccctggagggcctggactttgaaacagccaagaaggccttcatccgggtgcaggacctgcgctacctggagctgatcagcagcattgaggagaggaagaagagaggagagaccaacaatgacctcttcctggctgatgtgttctcctaccagggcaagttccacgaggccgccaagctgtacaagaggagcggccacgagaacctggccctggagatgtacacagacctgtgcatgtttgaatatgccaaggacttcctgggcagcggggaccccaaggagaccaagatgctgatcaccaagcaggccgactgggccaggaacatcaaggagcccaaggctgctgtggagatgtacatctctgctggggagcacgtgaaggccatcgagatctgtggggaccacggctgggtggacatgctgattgatattgccaggaagctggacaaggccgagcgggagcccctgctgctgtgtgccacctacctgaagaagctggacagccctggctatgctgctgagacctacctgaagatgggagacctgaagagcctggtgcagctgcacgtggagacccagcgctgggatgaggcctttgccctgggggagaagcaccctgagttcaaggatgacatctacatgccctatgcccagtggctggctgaaaatgacagatttgaggaggcccagaaggccttccacaaggccggccggcagcgggaggccgtgcaggtgctggagcagctgaccaacaatgctgtggccgagagccgcttcaatgatgctgcctactactactggatgctgtccatgcagtgcctggacatcgcccaggaccctgcccagaaggacaccatgctgggcaagttctaccacttccagaggctggccgagctgtaccacggctaccacgccatccaccgccacacagaggaccccttctctgtgcacaggcctgagaccctcttcaacatcagccgcttcctgctgcacagcctgcccaaggacacccccagcggcatcagcaaggtgaagatcctcttcaccctggccaagcagagcaaggccctgggcgcctaccgcctggcccggcatgcctatgacaagctgcggggcctgtacatcccagcccgcttccagaagagcattgagctgggcaccctgaccatccgggccaagcccttccatgattctgaggagctggtgcccctgtgctaccgctgcagcaccaacaaccccctgctgaacaacctgggcaatgtgtgcatcaactgccggcagcccttcatcttcagcgccagcagctatgatgtgctgcacctggtggagttctacctggaggagggcatcacagatgaggaggccatcagcctgattgacctggaggtgctgcggcccaagagagatgaccggcagctggagatcgccaacaacagcagccagatcctgcggctggtggagaccaaggacagcattggagatgaggaccccttcaccgccaagctgagctttgagcagggcggcagcgagtttgtgcctgtggtggtgtcccggctggtgctgcgctccatgagcagaagagatgtgctgatcaagcgctggcccccacccctgcgctggcagtacttccgcagcctgctgcctgatgccagcatcaccatgtgccccagctgcttccagatgttccacagcgaggactatgagctgctggtgctgcagcacggctgctgcccctactgccgccgctgcaaggatgaccccggcccctag

SEQ ID NO: 156524 - DNA, 3726 bp, Artificial Sequence
  Description of Artificial Sequence: Synthetic coding sequence
atgagagctgtgctgacctggagggacaaggccgagcactgcatcaatgacatcgccttcaagccagatggcacccagctgatcctggccgccggcagccggctgctggtgtatgacaccagtgatggcaccctgctgcagcccctgaagggccacaaggacacagtgtactgtgtggcctatgccaaggatggcaagagatttgccagcggcagcgctgacaagagcgtcatcatctggaccagcaagctggagggcatcctgaagtacacccacaatgatgccatccagtgtgtgtcctacaaccccatcacccaccagctggccagctgcagcagcagtgactttggcctgtggagccctgagcagaagtctgtgtccaagcacaagagcagcagcaagatcatctgctgctcctggaccaatgatggccagtacctggccctgggcatgtttaatggcatcatcagcatccggaacaagaatggagaggagaaggtgaagattgaaagacctgggggcagcctgagccccatctggagcatctgctggaaccccagcagccgctgggagagcttctggatgaaccgggagaatgaagatgctgaagatgtgattgtgaaccgctacatccaggagatccccagcaccctgaagtctgctgtgtacagcagccagggcagcgaggccgaggaggaggagcctgaggaggaggatgacagccccagagatgacaacctggaggagagaaatgacatcctggccgtggccgactggggccagaaggtgtccttctaccagctgagcggcaagcagatcggcaaggaccgggccctgaactttgacccctgctgcatctcctacttcaccaagggggagtacatcctgctgggcggcagtgacaagcaggtgtccctcttcaccaaggatggagtgcggctgggcaccgtgggggagcagaacagctgggtgtggacctgccaggccaagccagacagcaactacgtggtggtgggctgccaggacggcaccatctccttctaccagctgatcttcagcacagtgcacggcctgtacaaggacagatatgcctacagagacagcatgacagatgtgattgtgcagcacctgatcacagagcagaaggtgcgcatcaagtgcaaggagctggtgaagaagatcgccatctacagaaaccggctggccatccagctgcctgagaagatcctgatctatgagctgtacagcgaggacctgagtgacatgcactacagagtgaaggagaagatcatcaagaagtttgagtgcaacctgctggtggtgtgtgccaaccacatcatcctgtgccaggagaagaggctgcagtgcctgtccttcagcggcgtgaaggagcgggagtggcagatggagagcctcatccgctacatcaaggtgattggaggccccccaggccgggagggcctgctggtgggcctgaagaatggccagatcctgaagatctttgtggacaacctgtttgccatcgtgctgctgaagcaggccacagctgtgcgctgcctggacatgtctgccagcaggaagaagctggccgtggtggatgaaaatgacacctgcctggtgtatgacatcgacaccaaggagctgctcttccaggagcccaatgccaacagcgtggcctggaacacccagtgtgaggacatgctgtgcttcagcggcggcggctacctgaacatcaaggccagcaccttccctgtgcaccggcagaagctgcagggctttgtggtgggctacaacggcagcaagatcttctgcctgcacgtgttcagcatctctgctgtggaggtgccccagagcgcccccatgtaccagtacctggacaggaagctgttcaaggaggcctaccagatcgcctgcctgggcgtgacagacacagactggagggagctggccatggaggccctggagggcctggactttgaaacagccaagaaggccttcatccgggtgcaggacctgcgctacctggagctgatcagcagcattgaggagaggaagaagagaggagagaccaacaatgacctcttcctggctgatgtgttctcctaccagggcaagttccatgaagctgccaagctgtacaagaggagcggccacgagaacctggccctggagatgtacacagacctgtgcatgtttgaatatgccaaggacttcctgggcagcggggaccccaaggagaccaagatgctgatcaccaagcaggccgactgggccaggaacatcaaggagcccaaggctgctgtggagatgtacatctctgctggggagcacgtgaaggccatcgagatctgtggggaccacggctgggtggacatgctgattgacatcgccaggaagctggacaaggccgagcgggagcccctgctgctgtgtgccacctacctgaagaagctggacagccctggctacgccgctgagacctacctgaagatgggagacctgaagagcctggtgcagctgcacgtggagacccagcgctgggatgaggcctttgccctgggggagaagcaccctgagttcaaggatgacatctacatgccctatgcccagtggctggccgagaatgacagatttgaggaggcccagaaggccttccacaaggccggccggcagcgggaggccgtgcaggtgctggagcagctgaccaacaatgctgtggccgagagccgcttcaatgatgctgcctactactactggatgctgtccatgcagtgcctggacatcgcccaggaccctgcccagaaggacaccatgctgggcaagttctaccacttccagaggctggccgagctgtaccacggctaccacgccatccaccgccacacagaggaccccttctctgtgcacaggcctgagaccctcttcaacatcagccgcttcctgctgcacagcctgcccaaggacaccccatctggcatcagcaaggtgaagatcctcttcaccctggccaagcagagcaaggccctgggcgcctaccgcctggcccggcatgcctatgacaagctgcggggcctgtacatcccagcccgcttccagaagagcattgagctgggcaccctgaccatccgggccaagcccttccatgacagcgaggagctggtgcccctgtgctaccgctgcagcaccaacaaccccctgctgaacaacctgggcaatgtgtgcatcaactgccggcagcccttcatcttcagcgccagcagctatgatgtgctgcacctggtggagttctacctggaggagggcatcacagatgaggaggccatcagcctgattgacctggaggtgctgcggcccaagagagatgaccggcagctggagatcgccaacaacagcagccagatcctgcggctggtggagaccaaggacagcattggagatgaggaccccttcaccgccaagctgagctttgagcagggcggcagcgagtttgtgcctgtggtggtgtcccggctggtgctgcgctccatgagcagaagagatgtgctgatcaagcgctggcccccacccctgcgctggcagtacttccgcagcctgctgcctgatgccagcatcaccatgtgccccagctgcttccagatgttccacagtgaagattatgagctgctggtgctgcagcacggctgctgcccctactgccgccgctgcaaggatgatcctggcccctag

SEQ ID NO: 156525 - DNA, 3396 bp, Artificial Sequence
  Description of Artificial Sequence: Synthetic coding sequence
atgagagctgtgctgacctggagggacaaggccgagcactgcatcaatgacatcgccttcaagccagatggcacccagctgatcctggccgccggcagccggctgctggtgtatgacaccagtgatggcaccctgctgcagcccctgaagggccacaaggacacagtgtactgtgtggcctatgccaaggatggcctgtggagccctgagcagaagtctgtgtccaagcacaagagcagcagcaagatcatctgctgctcctggaccaatgatggccagtacctggccctgggcatgtttaatggcatcatcagcatccggaacaagaatggagaggagaaggtgaagattgaaagacctgggggcagcctgagccccatctggagcatctgctggaaccccagccgggaggagagaaatgacatcctggccgtggccgactggggccagaaggtgtccttctaccagctgagcggcaagcagatcggcaaggaccgggccctgaactttgacccctgctgcatctcctacttcaccaagggggagtacatcctgctgggcggcagtgacaagcaggtgtccctcttcaccaaggatggagtgcggctgggcaccgtgggggagcagaacagctgggtgtggacctgccaggccaagccagacagcaactacgtggtggtgggctgccaggacggcaccatctccttctaccagctgatcttcagcacagtgcacggcctgtacaaggacagatatgcctacagagacagcatgacagatgtgattgtgcagcacctgatcacagagcagaaggtgcgcatcaagtgcaaggagctggtgaagaagatcgccatctacagaaaccggctggccatccagctgcctgagaagatcctgatctatgagctgtacagcgaggacctgagtgacatgcactacagagtgaaggagaagatcatcaagaagtttgagtgcaacctgctggtggtgtgtgccaaccacatcatcctgtgccaggagaagaggctgcagtgcctgtccttctctggagtgaaggagcgggagtggcagatggagagcctcatccgctacatcaaggtgattggaggccccccaggccgggagggcctgctggtgggcctgaagaatggccagatcctgaagatctttgtggacaacctgtttgccatcgtgctgctgaagcaggccacagctgtgcgctgcctggacatgtctgccagcaggaagaagctggccgtggtggatgaaaatgacacctgcctggtgtatgacatcgacaccaaggagctgctcttccaggagcccaatgccaacagcgtggcctggaacacccagtgtgaggacatgctgtgcttcagcggcggcggctacctgaacatcaaggccagcaccttccctgtgcaccggcagaagctgcagggctttgtggtgggctacaacggcagcaagatcttctgcctgcacgtgttcagcatctctgctgtggaggtgccccagagcgcccccatgtaccagtacctggacaggaagctgttcaaggaggcctaccagatcgcctgcctgggcgtgacagacacagactggagggagctggccatggaggccctggagggcctggactttgaaacagccaagaaggccttcatccgggtgcaggacctgcgctacctggagctgatcagcagcattgaggagaggaagaagagaggagagaccaacaatgacctcttcctggctgatgtgttctcctaccagggcaagttccacgaggccgccaagctgtacaagaggagcggccacgagaacctggccctggagatgtacacagacctgtgcatgtttgaatatgccaaggacttcctgggcagcggggaccccaaggagaccaagatgctgatcaccaagcaggccgactgggccaggaacatcaaggagcccaaggctgctgtggagatgtacatctctgctggggagcacgtgaaggccatcgagatctgtggggaccacggctgggtggacatgctgattgatattgccaggaagctggacaaggccgagcgggagcccctgctgctgtgtgccacctacctgaagaagctggacagccctggctatgctgctgagacctacctgaagatgggagacctgaagagcctggtgcagctgcacgtggagacccagcgctgggatgaggcctttgccctgggggagaagcaccctgagttcaaggatgacatctacatgccctatgcccagtggctggctgaaaatgacagatttgaggaggcccagaaggccttccacaaggccggccggcagcgggaggccgtgcaggtgctggagcagctgaccaacaatgctgtggccgagagccgcttcaatgatgctgcctactactactggatgctgtccatgcagtgcctggacatcgcccaggccgaccctgcccagaaggacaccatgctgggcaagttctaccacttccagaggctggccgagctgtaccacggctaccacgccatccaccgccacacagaggaccccttctctgtgcacaggcctgagaccctcttcaacatcagccgcttcctgctgcacagcctgcccaaggacaccccatctggcatcagcaaggtgaagatcctcttcaccctggccaagcagagcaaggccctgggcgcctaccgcctggcccggcatgcctatgacaagctgcggggcctgtacatcccagcccgcttccagaagagcattgagctgggcaccctgaccatccgggccaagcccttccatgacagcgaggagctggtgcccctgtgctaccgctgcagcaccaacaaccccctgctgaacaacctgggcaatgtgtgcatcaactgccggcagcccttcatcttcagcgccagcagctatgatgtgctgcacctggtggagttctacctggaggagggcatcacagatgaggaggccatcagcctgattgacctggaggtgctgcggcccaagagagatgaccggcagctggagatcgccaacaacagcagccagatcctgcggctggtggagaccaaggacagcattggagatgaggaccccttcaccgccaagctgagctttgagcagggcggcagcgagtttgtgcctgtggtggtgtcccggctggtgctgcgctccatgagcagaagagatgtgctgatcaagcgctggcccccacccctgcgctggcagtacttccgcagcctgctgcctgatgccagcatcaccatgtgccccagctgcttccagatgttccacagtgaagattatgagctgctggtgctgcagcacggctgctgcccctactgccgccgctgcaaggatgatcctggcccctag

SEQ ID NO: 156526 - DNA, 3276 bp, Artificial Sequence
  Description of Artificial Sequence: Synthetic coding sequence
atgtttaatggcatcatcagcatccggaacaagaatggagaggagaaggtgaagattgaaagacctgggggcagcctgagccccatctggagcatctgctggaaccccagcagccgctgggagagcttctggatgaaccgggagaatgaagatgctgaagatgtgattgtgaaccgctacatccaggagatccccagcaccctgaagtctgctgtgtacagcagccagggcagcgaggccgaggaggaggagcctgaggaggaggatgacagccccagagatgacaacctggaggagagaaatgacatcctggccgtggccgactggggccagaaggtgtccttctaccagctgagcggcaagcagatcggcaaggaccgggccctgaactttgacccctgctgcatctcctacttcaccaagggggagtacatcctgctgggcggcagtgacaagcaggtgtccctcttcaccaaggatggagtgcggctgggcaccgtgggggagcagaacagctgggtgtggacctgccaggccaagccagacagcaactacgtggtggtgggctgccaggacggcaccatctccttctaccagctgatcttcagcacagtgcacggcctgtacaaggacagatatgcctacagagacagcatgacagatgtgattgtgcagcacctgatcacagagcagaaggtgcgcatcaagtgcaaggagctggtgaagaagatcgccatctacagaaaccggctggccatccagctgcctgagaagatcctgatctatgagctgtacagcgaggacctgagtgacatgcactacagagtgaaggagaagatcatcaagaagtttgagtgcaacctgctggtggtgtgtgccaaccacatcatcctgtgccaggagaagaggctgcagtgcctgtccttcagcggcgtgaaggagcgggagtggcagatggagagcctcatccgctacatcaaggtgattggaggccccccaggccgggagggcctgctggtgggcctgaagaatggccagatcctgaagatctttgtggacaacctgtttgccatcgtgctgctgaagcaggccacagctgtgcgctgcctggacatgtctgccagcaggaagaagctggccgtggtggatgaaaatgacacctgcctggtgtatgacatcgacaccaaggagctgctcttccaggagcccaatgccaacagcgtggcctggaacacccagtgtgaggacatgctgtgcttcagcggcggcggctacctgaacatcaaggccagcaccttccctgtgcaccggcagaagctgcagggctttgtggtgggctacaacggcagcaagatcttctgcctgcacgtgttcagcatctctgctgtggaggtgccccagagcgcccccatgtaccagtacctggacaggaagctgttcaaggaggcctaccagatcgcctgcctgggcgtgacagacacagactggagggagctggccatggaggccctggagggcctggactttgaaacagccaagaaggccttcatccgggtgcaggacctgcgctacctggagctgatcagcagcattgaggagaggaagaagagaggagagaccaacaatgacctcttcctggctgatgtgttctcctaccagggcaagttccatgaagctgccaagctgtacaagaggagcggccacgagaacctggccctggagatgtacacagacctgtgcatgtttgaatatgccaaggacttcctgggcagcggggaccccaaggagaccaagatgctgatcaccaagcaggccgactgggccaggaacatcaaggagcccaaggctgctgtggagatgtacatctctgctggggagcacgtgaaggccatcgagatctgtggggaccacggctgggtggacatgctgattgacatcgccaggaagctggacaaggccgagcgggagcccctgctgctgtgtgccacctacctgaagaagctggacagccctggctacgccgctgagacctacctgaagatgggagacctgaagagcctggtgcagctgcacgtggagacccagcgctgggatgaggcctttgccctgggggagaagcaccctgagttcaaggatgacatctacatgccctatgcccagtggctggccgagaatgacagatttgaggaggcccagaaggccttccacaaggccggccggcagcgggaggccgtgcaggtgctggagcagctgaccaacaatgctgtggccgagagccgcttcaatgatgctgcctactactactggatgctgtccatgcagtgcctggacatcgcccaggaccctgcccagaaggacaccatgctgggcaagttctaccacttccagaggctggccgagctgtaccacggctaccacgccatccaccgccacacagaggaccccttctctgtgcacaggcctgagaccctcttcaacatcagccgcttcctgctgcacagcctgcccaaggacaccccatctggcatcagcaaggtgaagatcctcttcaccctggccaagcagagcaaggccctgggcgcctaccgcctggcccggcatgcctatgacaagctgcggggcctgtacatcccagcccgcttccagaagagcattgagctgggcaccctgaccatccgggccaagcccttccatgacagcgaggagctggtgcccctgtgctaccgctgcagcaccaacaaccccctgctgaacaacctgggcaatgtgtgcatcaactgccggcagcccttcatcttcagcgccagcagctatgatgtgctgcacctggtggagttctacctggaggagggcatcacagatgaggaggccatcagcctgattgacctggaggtgctgcggcccaagagagatgaccggcagctggagatcgccaacaacagcagccagatcctgcggctggtggagaccaaggacagcattggagatgaggaccccttcaccgccaagctgagctttgagcagggcggcagcgagtttgtgcctgtggtggtgtcccggctggtgctgcgctccatgagcagaagagatgtgctgatcaagcgctggcccccacccctgcgctggcagtacttccgcagcctgctgcctgatgccagcatcaccatgtgccccagctgcttccagatgttccacagtgaagattatgagctgctggtgctgcagcacggctgctgcccctactgccgccgctgcaaggatgatcctggcccctag

SEQ ID NO: 156527 - DNA, 3099 bp, Artificial Sequence
  Description of Artificial Sequence: Synthetic coding sequence
atgtttaatggcatcatcagcatccggaacaagaatggagaggagaaggtgaagattgaaagacctgggggcagcctgagccccatctggagcatctgctggaaccccagccgggaggagagaaatgacatcctggccgtggccgactggggccagaaggtgtccttctaccagctgagcggcaagcagatcggcaaggaccgggccctgaactttgacccctgctgcatctcctacttcaccaagggggagtacatcctgctgggcggcagtgacaagcaggtgtccctcttcaccaaggatggagtgcggctgggcaccgtgggggagcagaacagctgggtgtggacctgccaggccaagccagacagcaactacgtggtggtgggctgccaggacggcaccatctccttctaccagctgatcttcagcacagtgcacggcctgtacaaggacagatatgcctacagagacagcatgacagatgtgattgtgcagcacctgatcacagagcagaaggtgcgcatcaagtgcaaggagctggtgaagaagatcgccatctacagaaaccggctggccatccagctgcctgagaagatcctgatctatgagctgtacagcgaggacctgagtgacatgcactacagagtgaaggagaagatcatcaagaagtttgagtgcaacctgctggtggtgtgtgccaaccacatcatcctgtgccaggagaagaggctgcagtgcctgtccttctctggagtgaaggagcgggagtggcagatggagagcctcatccgctacatcaaggtgattggaggccccccaggccgggagggcctgctggtgggcctgaagaatggccagatcctgaagatctttgtggacaacctgtttgccatcgtgctgctgaagcaggccacagctgtgcgctgcctggacatgtctgccagcaggaagaagctggccgtggtggatgaaaatgacacctgcctggtgtatgacatcgacaccaaggagctgctcttccaggagcccaatgccaacagcgtggcctggaacacccagtgtgaggacatgctgtgcttcagcggcggcggctacctgaacatcaaggccagcaccttccctgtgcaccggcagaagctgcagggctttgtggtgggctacaacggcagcaagatcttctgcctgcacgtgttcagcatctctgctgtggaggtgccccagagcgcccccatgtaccagtacctggacaggaagctgttcaaggaggcctaccagatcgcctgcctgggcgtgacagacacagactggagggagctggccatggaggccctggagggcctggactttgaaacagccaagaaggccttcatccgggtgcaggacctgcgctacctggagctgatcagcagcattgaggagaggaagaagagaggagagaccaacaatgacctcttcctggctgatgtgttctcctaccagggcaagttccacgaggccgccaagctgtacaagaggagcggccacgagaacctggccctggagatgtacacagacctgtgcatgtttgaatatgccaaggacttcctgggcagcggggaccccaaggagaccaagatgctgatcaccaagcaggccgactgggccaggaacatcaaggagcccaaggctgctgtggagatgtacatctctgctggggagcacgtgaaggccatcgagatctgtggggaccacggctgggtggacatgctgattgatattgccaggaagctggacaaggccgagcgggagcccctgctgctgtgtgccacctacctgaagaagctggacagccctggctatgctgctgagacctacctgaagatgggagacctgaagagcctggtgcagctgcacgtggagacccagcgctgggatgaggcctttgccctgggggagaagcaccctgagttcaaggatgacatctacatgccctatgcccagtggctggctgaaaatgacagatttgaggaggcccagaaggccttccacaaggccggccggcagcgggaggccgtgcaggtgctggagcagctgaccaacaatgctgtggccgagagccgcttcaatgatgctgcctactactactggatgctgtccatgcagtgcctggacatcgcccaggaccctgcccagaaggacaccatgctgggcaagttctaccacttccagaggctggccgagctgtaccacggctaccacgccatccaccgccacacagaggaccccttctctgtgcacaggcctgagaccctcttcaacatcagccgcttcctgctgcacagcctgcccaaggacacccccagcggcatcagcaaggtgaagatcctcttcaccctggccaagcagagcaaggccctgggcgcctaccgcctggcccggcatgcctatgacaagctgcggggcctgtacatcccagcccgcttccagaagagcattgagctgggcaccctgaccatccgggccaagcccttccatgattctgaggagctggtgcccctgtgctaccgctgcagcaccaacaaccccctgctgaacaacctgggcaatgtgtgcatcaactgccggcagcccttcatcttcagcgccagcagctatgatgtgctgcacctggtggagttctacctggaggagggcatcacagatgaggaggccatcagcctgattgacctggaggtgctgcggcccaagagagatgaccggcagctggagatcgccaacaacagcagccagatcctgcggctggtggagaccaaggacagcattggagatgaggaccccttcaccgccaagctgagctttgagcagggcggcagcgagtttgtgcctgtggtggtgtcccggctggtgctgcgctccatgagcagaagagatgtgctgatcaagcgctggcccccacccctgcgctggcagtacttccgcagcctgctgcctgatgccagcatcaccatgtgccccagctgcttccagatgttccacagcgaggactatgagctgctggtgctgcagcacggctgctgcccctactgccgccgctgcaaggatgaccccggcccctag

SEQ ID NO: 156528 - DNA, 3252 bp, Artificial Sequence
  Description of Artificial Sequence: Synthetic coding sequence
atgagagctgtgctgacctggagggacaaggccgagcactgcatcaatgacatcgccttcaagccagatggcacccagctgatcctggccgccggcagccggctgctggtgtatgacaccagtgatggcaccctgctgcagcccctgaagggccacaaggacacagtgtactgtgtggcctatgccaaggatggcctgtggagccctgagcagaagtctgtgtccaagcacaagagcagcagcaagatcatctgctgccgggaggagagaaatgacatcctggccgtggccgactggggccagaaggtgtccttctaccagctgagcggcaagcagatcggcaaggaccgggccctgaactttgacccctgctgcatctcctacttcaccaagggggagtacatcctgctgggcggcagtgacaagcaggtgtccctcttcaccaaggatggagtgcggctgggcaccgtgggggagcagaacagctgggtgtggacctgccaggccaagccagacagcaactacgtggtggtgggctgccaggacggcaccatctccttctaccagctgatcttcagcacagtgcacggcctgtacaaggacagatatgcctacagagacagcatgacagatgtgattgtgcagcacctgatcacagagcagaaggtgcgcatcaagtgcaaggagctggtgaagaagatcgccatctacagaaaccggctggccatccagctgcctgagaagatcctgatctatgagctgtacagcgaggacctgagtgacatgcactacagagtgaaggagaagatcatcaagaagtttgagtgcaacctgctggtggtgtgtgccaaccacatcatcctgtgccaggagaagaggctgcagtgcctgtccttcagcggcgtgaaggagcgggagtggcagatggagagcctcatccgctacatcaaggtgattggaggccccccaggccgggagggcctgctggtgggcctgaagaatggccagatcctgaagatctttgtggacaacctgtttgccatcgtgctgctgaagcaggccacagctgtgcgctgcctggacatgtctgccagcaggaagaagctggccgtggtggatgaaaatgacacctgcctggtgtatgacatcgacaccaaggagctgctcttccaggagcccaatgccaacagcgtggcctggaacacccagtgtgaggacatgctgtgcttcagcggcggcggctacctgaacatcaaggccagcaccttccctgtgcaccggcagaagctgcagggctttgtggtgggctacaacggcagcaagatcttctgcctgcacgtgttcagcatctctgctgtggaggtgccccagagcgcccccatgtaccagtacctggacaggaagctgttcaaggaggcctaccagatcgcctgcctgggcgtgacagacacagactggagggagctggccatggaggccctggagggcctggactttgaaacagccaagaaggccttcatccgggtgcaggacctgcgctacctggagctgatcagcagcattgaggagaggaagaagagaggagagaccaacaatgacctcttcctggctgatgtgttctcctaccagggcaagttccatgaagctgccaagctgtacaagaggagcggccacgagaacctggccctggagatgtacacagacctgtgcatgtttgaatatgccaaggacttcctgggcagcggggaccccaaggagaccaagatgctgatcaccaagcaggccgactgggccaggaacatcaaggagcccaaggctgctgtggagatgtacatctctgctggggagcacgtgaaggccatcgagatctgtggggaccacggctgggtggacatgctgattgacatcgccaggaagctggacaaggccgagcgggagcccctgctgctgtgtgccacctacctgaagaagctggacagccctggctacgccgctgagacctacctgaagatgggagacctgaagagcctggtgcagctgcacgtggagacccagcgctgggatgaggcctttgccctgggggagaagcaccctgagttcaaggatgacatctacatgccctatgcccagtggctggccgagaatgacagatttgaggaggcccagaaggccttccacaaggccggccggcagcgggaggccgtgcaggtgctggagcagctgaccaacaatgctgtggccgagagccgcttcaatgatgctgcctactactactggatgctgtccatgcagtgcctggacatcgcccaggccgaccctgcccagaaggacaccatgctgggcaagttctaccacttccagaggctggccgagctgtaccacggctaccacgccatccaccgccacacagaggaccccttctctgtgcacaggcctgagaccctcttcaacatcagccgcttcctgctgcacagcctgcccaaggacacccccagcggcatcagcaaggtgaggaagatcctcttcaccctggccaagcagagcaaggccctgggcgcctaccgcctggcccggcatgcctatgacaagctgcggggcctgtacatcccagcccgcttccagaagagcattgagctgggcaccctgaccatccgggccaagcccttccatgacagcgaggagctggtgcccctgtgctaccgctgcagcaccaacaaccccctgctgaacaacctgggcaatgtgtgcatcaactgccggcagcccttcatcttcagcgccagcagctatgatgtgctgcacctggtggagttctacctggaggagggcatcacagatgaggaggccatcagcctgattgacctggaggtgctgcggcccaagagagatgaccggcagctggagatcgccaacaacagcagccagatcctgcggctggtggagaccaaggacagcattggagatgaggaccccttcaccgccaagctgagctttgagcagggcggcagcgagtttgtgcctgtggtggtgtcccggctggtgctgcgctccatgagcagaagagatgtgctgatcaagcgctggcccccacccctgcgctggcagtacttccgcagcctgctgcctgatgccagcatcaccatgtgccccagctgcttccagatgttccacagtgaagattatgagctgctggtgctgcagcacggctgctgcccctactgccgccgctgcaaggatgatcctggcccctag

SEQ ID NO: 156529 - DNA, 2886 bp, Artificial Sequence
  Description of Artificial Sequence: Synthetic coding sequence
atgagagctgtgctgacctggagggacaaggccgagcactgcatcaatgacatcgccttcaagccagatggcacccagctgatcctggccgccggcagccggctgctggtgtatgacaccagtgatggcaccctgctgcagcccctgaagggccacaaggacacagtgtactgtgtggcctatgccaaggatggcaagagatttgccagcggcagcgctgacaagagcgtcatcatctggaccagcaagctggagggcatcctgaagtacacccacaatgatgccatccagtgtgtgtcctacaaccccatcacccaccagctggccagctgcagcagcagtgactttggcctgtggagccctgagcagaagtctgtgtccaagcacaagagcagcagcaagatcatctgctgctcctggaccaatgatggccagtacctggccctgggcatgtttaatggcatcatcagcatccggaacaagaatggagaggagaaggtgaagattgaaagacctgggggcagcctgagccccatctggagcatctgctggaaccccagccgggaggagagaaatgacatcctggccgtggccgactggggccagaaggtgtccttctaccagctgagcggcaagcagatcggcaaggaccgggccctgaactttgacccctgctgcatctcctacttcaccaagggggagtacatcctgctgggcggcagtgacaagcaggtgtccctcttcaccaaggatggagtgcggctgggcaccgtgggggagcagaacagctgggtgtggacctgccaggccaagccagacagcaactacgtggtggtgggctgccaggacggcaccatctccttctaccagctgatcttcagcacagtgcacggcctgtacaaggacagatatgcctacagagacagcatgacagatgtgattgtgcagcacctgatcacagagcagaaggtgcgcatcaagtgcaaggagctggtgaagaagatcgccatctacagaaaccggctggccatccagctgcctgagaagatcctgatctatgagctgtacagcgaggacctgagtgacatgcactacagagtgaaggagaagatcatcaagaagtttgagtgcaacctgctggtggtgtgtgccaaccacatcatcctgtgccaggagaagaggctgcagtgcctgtccttctctggagtgaaggagcgggagtggcagatggagagcctcatccgctacatcaaggtgattggaggccccccaggccgggagggcctgctggtgggcctgaagaatggccagatcctgaagatctttgtggacaacctgtttgccatcgtgctgctgaagcaggccacagctgtgcgctgcctggacatgtctgccagcaggaagaagctggccgtggtggatgaaaatgacacctgcctggtgtatgacatcgacaccaaggagctgctcttccaggagcccaatgccaacagcgtggcctggaacacccagtgtgaggacatgctgtgcttcagcggcggcggctacctgaacatcaaggccagcaccttccctgtgcaccggcagaagctgcagggctttgtggtgggctacaacggcagcaagatcttctgcctgcacgtgttcagcatctctgctgtggaggtgccccagagcgcccccatgtaccagtacctggacaggaagctgttcaaggaggcctaccagatcgcctgcctgggcgtgacagacacagactggagggagctggccatggaggccctggagggcctggactttgaaacagccaagaaggccttcatccgggtgcaggacctgcgctacctggagctgatcagcagcattgaggagaggaagaagagaggagagaccaacaatgacctcttcctggctgatgtgttctcctaccagggcaagttccacgaggccgccaagctgtacaagaggagcggccacgagaacctggccctggagatgtacacagacctgtgcatgtttgaatatgccaaggacttcctgggcagcggggaccccaaggagaccaagatgctgatcaccaagcaggccgactgggccaggaacatcaaggagcccaaggctgctgtggagatgtacatctctgctggggagcacgtgaaggccatcgagatctgtggggaccacggctgggtggacatgctgattgatattgccaggaagctggacaaggccgagcgggagcccctgctgctgtgtgccacctacctgaagaagctggacagccctggctatgctgctgagacctacctgaagatgggagacctgaagagcctggtgcagctgcacgtggagacccagcgctgggatgaggcctttgccctgggggagaagcaccctgagttcaaggatgacatctacatgccctatgcccagtggctggctgaaaatgacagatttgaggaggcccagaaggccttccacaaggccggccggcagcgggaggccgtgcaggtgctggagcagctgaccaacaatgctgtggccgagagccgcttcaatgatgctgcctactactactggatgctgtccatgcagtgcctggacatcgcccaggaccctgcccagaaggacaccatgctgggcaagttctaccacttccagaggctggccgagctgtaccacggctaccacgccatccaccgccacacagaggaccccttctctgtgcacaggcctgagaccctcttcaacatcagccgcttcctgctgcacagcctgcccaaggacacccccagcggcatcagcaaggtgtgtgagaacaccctgcacctgggccaggccgagcagggcccccgctgcctgcaggccggccctgcccggctgtag

SEQ ID NO: 156530 - DNA, 3357 bp, Artificial Sequence
  Description of Artificial Sequence: Synthetic coding sequence
atgagagctgtgctgacctggagggacaaggccgagcactgcatcaatgacatcgccttcaagccagatggcacccagctgatcctggccgccggcagccggctgctggtgtatgacaccagtgatggcaccctgctgcagcccctgaagggccacaaggacacagtgtactgtgtggcctatgccaaggatgtgctgtgcatcgagggcctgtggagccctgagcagaagtctgtgtccaagcacaagagcagcagcaagatcatctgctgctcctggaccaatgatggccagtacctggccctgggcatgttcaacggcatcatcagcatccggaacaagaatggagaggagaaggtgaagattgaaagacctgggggcagcctgagccccatctggagcatctgctggaaccccagccgggaggagagaaatgacatcctggccgtggccgactggggccagaaggtgtccttctaccagctgagcggcaagcagatcggcaaggaccgggccctgaactttgacccctgctgcatctcctacttcaccaagggggagtacatcctgctgggcggcagtgacaagcaggtgtccctcttcaccaaggatggagtgcggctgggcaccgtgggggagcagaacagctgggtgtggacctgccaggccaagccagacagcaactacgtggtggtgggctgccaggacggcaccatctccttctaccagctgatcttcagcacagtgcacggcctgtacaaggacagatatgcctacagagacagcatgacagatgtgattgtgcagcacctgatcacagagcagaaggtgcgcatcaagtgcaaggagctggtgaagaagatcgccatctacagaaaccggctggccatccagctgcctgagaagatcctgatctatgagctgtacagcgaggacctgagtgacatgcactacagagtgaaggagaagatcatcaagaagtttgagtgcaacctgctggtggtgtgtgccaaccacatcatcctgtgccaggagaagaggctgcagtgcctgtccttcagcggcgtgaaggagcgggagtggcagatggagagcctcatccgctacatcaaggtgattggaggccccccaggccgggagggcctgctggtgggcctgaagaatggccagatcctgaagatctttgtggacaacctgtttgccatcgtgctgctgaagcaggccacagctgtgcgctgcctggacatgtctgccagcaggaagaagctggccgtggtggatgaaaatgacacctgcctggtgtatgacatcgacaccaaggagctgctcttccaggagcccaatgccaacagcgtggcctggaacacccagtgtgaggacatgctgtgcttcagcggcggcggctacctgaacatcaaggccagcaccttccctgtgcaccggcagaagctgcagggctttgtggtgggctacaacggcagcaagatcttctgcctgcacgtgttcagcatctctgctgtggaggtgccccagagcgcccccatgtaccagtacctggacaggaagctgttcaaggaggcctaccagatcgcctgcctgggcgtgacagacacagactggagggagctggccatggaggccctggagggcctggactttgaaacagccaagaaggagaggaagaagagaggagagaccaacaatgacctcttcctggctgatgtgttctcctaccagggcaagttccatgaagctgccaagctgtacaagaggagcggccacgagaacctggccctggagatgtacacagacctgtgcatgtttgaatatgccaaggacttcctgggcagcggggaccccaaggagaccaagatgctgatcaccaagcaggccgactgggccaggaacatcaaggagcccaaggctgctgtggagatgtacatctctgctggggagcacgtgaaggccatcgagatctgtggggaccacggctgggtggacatgctgattgacatcgccaggaagctggacaaggccgagcgggagcccctgctgctgtgtgccacctacctgaagaagctggacagccctggctacgccgctgagacctacctgaagatgggagacctgaagagcctggtgcagctgcacgtggagacccagcgctgggatgaggcctttgccctgggggagaagcaccctgagttcaaggatgacatctacatgccctatgcccagtggctggccgagaatgacagatttgaggaggcccagaaggccttccacaaggccggccggcagcgggaggccgtgcaggtgctggagcagctgaccaacaatgctgtggccgagagccgcttcaatgatgctgcctactactactggatgctgtccatgcagtgcctggacatcgcccaggccgaccctgcccagaaggacaccatgctgggcaagttctaccacttccagaggctggccgagctgtaccacggctaccacgccatccaccgccacacagaggaccccttctctgtgcacaggcctgagaccctcttcaacatcagccgcttcctgctgcacagcctgcccaaggacacccccagcggcatcagcaaggtgaagatcctcttcaccctggccaagcagagcaaggccctgggcgcctaccgcctggcccggcatgcctatgacaagctgcggggcctgtacatcccagcccgcttccagaagagcattgagctgggcaccctgaccatccgggccaagcccttccatgattctgaggagctggtgcccctgtgctaccgctgcagcaccaacaaccccctgctgaacaacctgggcaatgtgtgcatcaactgccggcagcccttcatcttcagcgccagcagctatgatgtgctgcacctggtggagttctacctggaggagggcatcacagatgaggaggccatcagcctgattgacctggaggtgctgcggcccaagagagatgaccggcagctggagatcgccaacaacagcagccagatcctgcggctggtggagaccaaggacagcattggagatgaggaccccttcaccgccaagctgagctttgagcagggcggcagcgagtttgtgcctgtggtggtgtcccggctggtgctgcgctccatgagcagaagagatgtgctgatcaagcgctggcccccacccctgcgctggcagtacttccgcagcctgctgcctgatgccagcatcaccatgtgccccagctgcttccagatgttccacagcgaggactatgagctgctggtgctgcagcacggctgctgcccctactgccgccgctgcaaggatgaccccggcccctag

SEQ ID NO: 156531 - DNA, 5250 bp, Artificial Sequence
  Description of Artificial Sequence: Synthetic coding sequence
atgcacctgaagcacctgcggaccctgctgagcccccaggatggagctgccaaggtgacctgcatggcctggagccagaacaatgccaagtttgctgtgtgcaccgtggacagagtggtgctgctgtatgatgagcacggggagcggcgggacaagttcagcaccaagccagctgacatgaagtatggcaggaagagctacatggtgaagggcatggccttctccccagacagcaccaagatcgccatcggccagacagacaacatcatctacgtgtacaagattggagaggactggggagacaagaaggtgatctgcaacaagttcatccagaccagcgctgtgacctgcctgcagtggccagctgagtacatcatcgtgtttggcctggccgagggcaaggtgcggctggccaacaccaagaccaacaagagcagcaccatctatggaacagagagctatgtggtgtccctgaccaccaactgcagcggcaagggcatcctgagcggccacgcagatggcaccatcgtgcgctacttctttgatgatgagggcagcggggagagccagggcaagctggtgaaccacccctgccccccctatgccctggcctgggccaccaacagcatcgtggccgccggctgtgacaggaagatcgtggcctacggcaaggagggccacatgctgcagacctttgactacagccgggacccccaggagcgggagttcaccacagctgtgagcagccctgggggccagagcgtggtgctgggcagctatgaccggctgcgggtcttcaactggatccccaggaggagcatctgggaggaggccaagcccaaggagatcaccaacctgtacaccatcacagccctggcctggaagagagatggcagccggctgtgtgtgggcaccctgtgtggcggcgtggagcagtttgactgctgcctgcggcgcagcatctacaagaacaagtttgagctgacctacgtgggccccagccaggtgattgtgaagaacctgagcagcggcaccagggtggtgctgaagagccactacggctatgaggtggaggaggtgaagatcctgggcaaggagcgctacctggtggcccacaccagcgagaccctgctgctgggggacctgaacaccaaccggctgtctgagatcgcctggcagggcagcggcggcaatgagaagtacttctttgaaaatgaaaatgtgtgcatgatcttcaatgctggggagctgaccctggtggagtatggcaacaatgacaccctgggctctgtgaggacagagttcatgaacccccacctgatctctgtgcgcatcaatgaacgctgccagaggggcacagaggacaacaagaagctggcctacctgattgacatcaagaccatcgccatcgtggacctgattggaggctacaacattggaacagtgtcccatgagagccgggtggactggctggagctgaatgagaccggccacaagctgctcttccgggacaggaagctgcggctgcacctgtatgacatcgagagctgcagcaagaccatgatcctgaacttctgcagctacatgcagtgggtgcccggcagtgatgtgctggtggcccagaacagaaacagcctgtgtgtgtggtacaacatcgaggcccctgagcgggtgaccatgttcaccatcagaggagatgtgattggcctggagcggggcggcggcaagacagaggtgatggtgatggagggcgtgaccaccgtggcctacaccctggatgagggcctgattgaatttggaacagccattgatgatggcaactacatccgggccacagccttcctggagaccctggagatgaccccagagacagaggccatgtggaagaccctgagcaagctggccctggaggcccggcagctgcacatcgccgagcgctgcttcagcgccctgggccaggtggccaaggcccgcttcctgcacgagaccaatgaaattgctgaccaggtgtcccgggagtatggaggagagggcacagacttctaccaggtgcgggcccggctggccatgctggagaagaactacaagctggccgagatgatcttcctggagcagaatgctgtggaggaggccatgggcatgtaccaggagctgcaccgctgggatgaatgtattgctgtggccgaggccaagggccacccagccctggagaagctgcggcgcagctactaccagtggctgatggacacccagcaggaggagcgggccggggagctgcaggagagccagggagatggcctggccgccatcagcctgtacctgaaggccggcctgcctgccaaggccgcccggctggtgctgacccgggaggagctgctggccaacacagagctggtggagcacatcacagctgccctgatcaagggggagctgtatgaaagagctggggacctgtttgagaagatccacaacccccagaaggccctggagtgctacagaaaaggaaatgccttcatgaaggctgtggagctggcccggctggccttccctgtggaggtggtgaagctggaggaggcctggggagaccacctggtgcagcagaagcagctggatgctgccatcaaccactacatcgaggcccgctgcagcatcaaggccattgaagctgccctgggcgcccggcagtggaagaaggccatctacatcctggacctgcaggacaggaacacagccagcaagtactaccccctggtggcccagcactacgccagcctgcaggagtatgaaattgctgaggagctgtacaccaagggggacaggaccaaggatgccatcgacatgtacacccaggccggccgctgggagcaggcccacaagctggccatgaagtgcatgaggccagaagatgtgtctgtgctgtacatcacccaggcccaggagatggagaagcagggcaagtaccgggaggccgagcggctgtatgtgacagtgcaggagccagacctggccatcaccatgtacaagaagcacaagctgtatgatgacatgatccggctggtgggcaagcaccacccagacctgctgagtgacacccacctgcacctgggcaaggagctggaggccgagggccgcctgcaggaggccgagtaccactacctggaggcccaggagtggaaggccaccgtgaacatgtaccgggccagcggcctgtgggaggaggcctacagagtggcccggacccagggcggggccaatgcccacaagcacgtggcctacctgtgggccaagagcctgggcggggaggccgctgtgcggctgctgaacaagctgggcctgctggaggccgctgtggaccacgccgctgacaactgcagctttgaatttgcctttgagctgagccggctggccctgaagcacaagaccccagaggtgcacctgaagtatgccatgttcctggaggatgagggcaagtttgaggaggccgaggccgagttcatccgggccggcaagcccaaggaggccgtgctgatgtttgtgcacaaccaggactgggaggccgcccagagggtggccgaggcccatgaccctgacagcgtggccgaggtgctggtgggccaggcccggggggccctggaggagaaggacttccagaaggccgagggcctgctgctgcgggcccagaggcctggcctggccctgaactactacaaggaggccggcctgtggagcgatgccctgcgcatctgcaaggactatgtgcccagccagctggaggccctgcaggaggagtatgaaagagaggccaccaagaagggggcccggggcgtggagggctttgtggagcaggcccggcactgggagcaggccggggagtacagcagagctgtggactgctacctgaaggtgcgggacagcggcaacagcggcctggccgagaagtgctggatgaaggctgctgagctgagcatcaagttcctgcccccccagaggaacatggaggtggtgctggccgtgggcccccagctgattggaattggcaagcacagcgctgctgctgagctgtacctgaacctggacctggtgaaggaggccattgatgccttcattgaaggagaggagtggaacaaggccaagagggtggccaaggagctggaccccaggtatgaagattatgtggaccagcactacaaggagttcctgaagaaccagggcaaggtggacagcctggtgggcgtggatgtgattgctgccctggacctgtatgtggagcagggccagtgggacaagtgcattgaaacagccaccaagcagaactacaagatcctgcacaagtatgtggccctgtatgccacccacctgatccgggagggcagcagcgcccaggccctggccctgtatgtgcagcacggggccccagccaacccccagaacttcaacatctacaagaggatcttcacagacatggtgagcagccctggcaccaactgtgccgaggcctaccacagctgggccgacctgagagatgtgctcttcaacctgtgtgagaacctggtgaagagcagcgaggccaacagccctgcccacgaggagttcaagaccatgctgctgattgcccactactatgccaccaggtctgctgcccagagcgtgaagcagctggagaccgtggccgcccggctgtctgtgtccctgctgcggcacacccagctgctgcctgtggacaaggccttctatgaggccggcattgctgccaaggctgtgggctgggacaacatggccttcatcttcctgaaccgcttcctggacctgacagatgccatcgaggagggcaccctggatggcctggaccacagcgacttccaggacacagacatcccctttgaggtgcccctgcctgccaagcagcacgtgcctgaggccgagcgggaggaggtgcgggactgggtgctgactgtgtccatggaccagaggctggagcaggtgctgcccagagatgagcggggggcctatgaggccagcctggtggccgccagcactggagtgcgggccctgccctgcctgatcaccggctaccccatcctgaggaacaagattgagttcaagaggcctgggaaggccgccaacaaggacaactggaacaagttcctgatggccatcaagaccagccacagccctgtgtgccaggatgtgctgaagttcatcagccagtggtgtggcggcctgcccagcaccagcttctccttccagtag

SEQ ID NO: 156532 - DNA, 1536 bp, Artificial Sequence
  Description of Artificial Sequence: Synthetic coding sequence
atggcctggagccagaacaatgccaagtttgctgtgtgcaccgtggacagagtggtgctgctgtatgatgaacatggagagcggcgggacaagttcagcaccaagccagctgacatgaagtatggcaggaagagctacatggtgaagggcatggccttctccccagacagcaccaagatcgccatcggccagacagacaacatcatctacgtgtacaagatcggggaggactggggagacaagaaggtgatctgcaacaagttcatccagaccagcgctgtgacctgcctgcagtggccagctgagtacatcatcgtgtttggcctggccgagggcaaggtgcggctggccaacaccaagaccaacaagagcagcaccatctacggcacagagagctatgtggtgtccctgaccaccaactgcagcggcaagggcatcctgagcggccatgctgatggcaccatcgtgcgctacttctttgatgatgagggcagcggggagagccagggcaagctggtgaaccacccctgccccccctatgccctggcctgggccaccaacagcatcgtggccgccggctgtgacaggaagatcgtggcctacggcaaggagggccacatgctgcagacctttgactacagccgggacccccaggagcgggagttcaccacagctgtgagcagccctgggggccagagcgtggtgctgggcagctatgaccggctgcgggtcttcaactggatcccccggcgcagcatctgggaggaggccaagcccaaggagatcaccaacctgtacaccatcacagccctggcctggaagagagatggcagccggctgtgtgtgggcaccctgtgtggcggcgtggagcagtttgactgctgcctgcggcgcagcatctacaagaacaagtttgagctgacctacgtgggccccagccaggtgattgtgaagaacctgagcagcggcaccagggtggtgctgaagagccactacggctatgaggtggaggaggtgaagatcctgggcaaggagcgctacctggtggcccacaccagcgagaccctgctgctgggggacctgaacaccaaccggctgtctgaaattgcctggcagggcagcggcggcaatgagaagtacttctttgaaaatgaaaatgtgtgcatgatcttcaatgctggggagctgaccctggtggagtatggcaacaatgacaccctgggctctgtgaggacagagttcatgaacccccacctgatctctgtgcgcatcaatgaacgctgccagaggggcacagaggacaacaagaagctggcctacctgattgacatcaagaccatcgccatcgtggacctgattggaggctacaacatcggcaccgtgtcccatgagagccgggtggactggctggagctgaatgaaacaggccacaagctgctcttccgggacaggaagctgcgggtgagaagagccaccaaggccctgggcatcggctggcccacagaaggagtgcggcaggccgccacccgggactag

SEQ ID NO: 156533 - DNA, 369 bp, Artificial Sequence
  Description of Artificial Sequence: Synthetic coding sequence
atgacccacctgctgctgacagccaccgtgaccccatctgagcagaacagcagccgggagcccggctgggagacagccatggccaaggacatcctgggggaggccggcctgcactttgatgagctgaacaagctgcgggtgctggaccctgaggtgacccagcagaccatcgagctgaaggaggagtgcaaggactttgtggacaagattggccagttccagaagatcgtgggcggcctgattgagctggtggaccagctggccaaggaggccgagaatgagaagatgaaggtgcgcagcgcctgcctgccccccacctcctggccaggcaccctggtgcactaccccctcatccccctgcccagctag

SEQ ID NO: 156534 - DNA, 447 bp, Artificial Sequence
  Description of Artificial Sequence: Synthetic coding sequence
atggccaaggacatcctgggggaggccggcctgcactttgatgagctgaacaagctgcgggtgctggaccctgaggtgacccagcagaccatcgagctgaaggaggagtgcaaggactttgtggacaagattggccagttccagaagatcgtgggcggcctgattgagctggtggaccagctggccaaggaggccgagaatgagaagatgaagagcctggccgtgagcccccggctggagtgcaccggggccatcagcgcccactgcaagctgtgcctgagtgacagcagtgacagccccaccagccccagccgggtgggcggcaccaccggccaccgctgcagcgagctggcccagatctacagcaaggccgagaggagcagcacagctgccaccagcagccccaacagcaggaaagaaaatgctgccaggaaggtgtctggatag

SEQ ID NO: 156535 - DNA, 399 bp, Artificial Sequence
  Description of Artificial Sequence: Synthetic coding sequence
atggccaaggacatcctgggggaggccggcctgcactttgatgagctgaacaagctgcgggtgctggaccctgaggtgacccagcagaccatcgagctgaaggaggagtgcaaggactttgtggacaagattggccagttccagaagatcgtgggcggcctgattgagctggtggaccagctggccaaggaggccgagaatgagaagatgaaggccatcggggccaggaacctgctgaagagcatcgccaagcagcgggaggcccagcagcagcagctgcaggccctgattgctgagaagaagatgcagctggagcgctacagagtggagtatgaggccctgtgcaaggtggaggccgagcagaatgagttcatcgaccagttcatcttccagaagtag

SEQ ID NO: 156536 - DNA, 216 bp, Artificial Sequence
  Description of Artificial Sequence: Synthetic coding sequence
gacatcctgggggaggccggcctgcactttgatgagctgaacaagctgcgggtgctggaccctgaggtgacccagcagaccatcgagctgaaggaggagtgcaaggactttgtggacaagattggccagttccagaagatcgtgggcggcctcatcgagctggtggaccagctggccaaggaggctgaaaatgagaagatgaaggtgtctggatag

SEQ ID NO: 156537 - DNA, 345 bp, Artificial Sequence
  Description of Artificial Sequence: Synthetic coding sequence
atggccaaggacatcctgggggaggccggcctgcactttgatgagctgaacaagctgcgggtgctggaccctgaggtgacccagcagaccatcgagctgaaggaggagtgcaaggactttgtggacaagattggccagttccagaagatcgtgggcggcctgattgagctggtggaccagctggccaaggaggccgagaatgagaagatgaaggccatcggggccaggaacctgctgaagagcatcgccaagcagcgggaggcccagcagcagcagctgcaggccctgattgctgagaagaagatgcagctggagagaaatgagctgaagatcagcctgctgtag

SEQ ID NO: 156538 - DNA, 477 bp, Artificial Sequence
  Description of Artificial Sequence: Synthetic coding sequence
atgacccacctgctgctgacagccaccgtgaccccatctgagcagaacagcagccgggagcccggctgggagacagccatggccaaggacatcctgggggaggccggcctgcactttgatgagctgaacaagctgcgggtgctggaccctgaggtgacccagcagaccatcgagctgaaggaggagtgcaaggactttgtggacaagattggccagttccagaagatcgtgggcggcctgattgagctggtggaccagctggccaaggaggccgagaatgagaagatgaaggccatcggggccaggaacctgctgaagagcatcgccaagcagcgggaggcccagcagcagcagctgcaggccctgattgctgagaagaagatgcagctggagcgctacagagtggagtatgaggccctgtgcaaggtggaggccgagcagaatgagttcatcgaccagttcatcttccagaagtag

SEQ ID NO: 156539 - DNA, 399 bp, Artificial Sequence; identical to SEQ ID NO: 156535
  Description of Artificial Sequence: Synthetic coding sequence

SEQ ID NO: 156540 - DNA, 642 bp, Artificial Sequence
  Description of Artificial Sequence: Synthetic coding sequence
atggaggacctgctggacctggatgaggagctgcgctacagcctggccaccagccgggccaagatgggccggcgggcccagcaggagagcgcccaggccgagaaccacctgaatggcaagaacagcagcctgaccctgactggagagaccagcagcgccaagctgccccgctgccggcagggcggctgggccggggacagcgtgaaggccagcaatggcacccagacaggcaagcagcagctggacctgaatgcctgctaccacaagacccaccaccgggacctgggcctggccagcctggaggaggccgacatccccatcatcccagacctggaggaggtgcaggaggaggactttgtgctgcaggtggccgccccacccagcatccagatcaagagggtgatgacctacagagacctggacaatgacctgatgaagtacagcgccatccagaccctggatggagaaattgacctgaagctgctgaccaaggtgctggcccctgagcacgaggtgcgggaggatgatgtgggctgggactgggaccacctgttcacagaggtgagcagcgaggtgctgacagagtgggaccccctgcagacagagaaggaggaccctgctggccaggcccggcacacctag

SEQ ID NO: 156541 - DNA, 627 bp, Artificial Sequence
  Description of Artificial Sequence: Synthetic coding sequence
atggaggacctgctggacctggatgaggagctgcgctacagcctggccaccagccgggccaagatgggccggcgggcccagcaggagagcgcccaggccgagaaccacctgaatggcaagaacagcagcctgaccctgactggagagaccagcagcgccaagctgccccgctgccggcagggcggctgggccggggacagcgtgaaggccagcaagttccggaggaaggccagcgaggagattgaggacttccggctgcggccccagagcctgaatggaagtgactatggaggagacatccccatcatcccagacctggaggaggtgcaggaggaggactttgtgctgcaggtggccgcccctccttccatccagatcaagagggtgatgacctacagagacctggacaatgacctgatgaagtacagcgccatccagaccctggatggagaaattgacctgaagctgctgaccaaggtgctggcccctgagcacgaggtgagagaagatgatgtgggctgggactgggaccacctgttcacagaggtgtcctctgaggtgctgacagagtgggaccccctgcagacagagaaggaggaccctgctggccaggcccggcacacctag

SEQ ID NO: 156542 - DNA, 342 bp, Artificial Sequence
  Description of Artificial Sequence: Synthetic coding sequence
atggaggacctgctggacctggatgaggagctgcgctacagcctggccaccagccgggccaagatgggccggcgggcccagcaggagagcgcccaggccgagaaccacctgaatggcaagaacagcagcctgaccctgactggagagaccagcagcgccaagctgccccgctgccggcagggcggctgggccggggacagcgtgaaggccagcaagttccggaggaaggccagcgaggagattgaggagtatgtgagcagcatcctgatcctgatggtgtcctatgtggacctgggccagcagtgcagcctgggcggccatgacctcttccacctgtgctag

SEQ ID NO: 156543 - DNA, 1290 bp, Artificial Sequence
  Description of Artificial Sequence: Synthetic coding sequence
atgacagctgccctggccgtggtgaccaccagcggcctggaggatggagtgcccaggagcagaggagagggcactggagaggtggtgctggagcggggccctggggccgcctaccacatgtttgtggtgatggaggacctggtggagaagctgaagctgctgcgctatgaggaggagttcctgaggaagagcaacctgaaggcccccagccgccactactttgccctgcccaccaaccctggagagcagttctacatgttctgcaccctggccgcctggctgatcaacaaggccggccggccctttgagcagccccaggagtatgatgaccccaatgccaccatcagcaacatcctgtctgagctgcggagctttggaagaacagctgacttcccccccagcaagctgaagagcggctacggggagcacgtgtgctacgtgctggactgctttgctgaggaggccctgaagtacatcggcttcacctggaagaggcccatctaccctgtggaggagctggaggaggagagcgtggccgaggatgatgctgagctgaccctgaacaaggtggatgaggagtttgtggaggaggagacagacaatgaggagaacttcatcgacctgaatgtgctgaaggcccagacctaccacctggacatgaatgaaacagccaagcaggaggacatcctggagagcaccacagatgctgctgagtggagcctggaggtggagcgggtgctgccccagctgaaggtgaccatcagaacagacaacaaggactggaggatccacgtggaccagatgcaccagcacaggtctggaattgaaagtgccctgaaggagaccaagggcttcctggacaagctgcacaatgagatcaccaggaccctggagaagatcagcagccgggagaagtacatcaacaaccagctggagaacctggtgcaggagtaccgggccgcccaggcccagctgtctgaggccaaggagcgctaccagcagggcaatggaggagtgacagagaggacccggctgctgtctgaggtgatggaggagctggagaaggtgaagcaggagatggaggagaagggcagctccatgacagatggagcccccctggtgaagatcaagcagagcctgaccaagctgaagcaggagaccgtggagatggacatccgcatcggcatcgtggagcacaccctgctgcagagcaagctgaaggagaagagcaacatgaccaggaacatgcacgccaccgtcatccctgagcccgccaccggcttctactag

SEQ ID NO: 156544 - DNA, 2334 bp, Artificial Sequence
  Description of Artificial Sequence: Synthetic coding sequence
atgaggctgaagatcagcctgctgaaggagcccaagcaccaggagctggtgtcctgtgtgggctggaccacagctgaggagctgtacagctgcagtgatgaccaccagatcgtgaagtggaacctgctgaccagcgagaccacccagatcgtgaagctgcctgatgacatctaccccatcgacttccactggttccccaagagcctgggcgtgaagaagcagacccaggccgagagctttgtgctgaccagcagtgatggcaagttccacctgatcagcaagctgggccgggtggagaagtctgtggaggcccactgtggggctgtgctggccggccgctggaactatgagggcacagccctggtgacagtgggggaggatggccagatcaagatctggagcaagacaggcatgctgcggagcaccctggcccagcagggcacccctgtgtacagcgtggcctggggcccagattctgagaaggtgctgtacacagctgggaagcagctgatcatcaagcccctgcagcccaatgccaaggtgctgcagtggaaggcccatgatggcatcatcctgaaggtggactggaacagcgtgaatgacctgatcctgtctgctggggaggactgcaagtacaaggtgtgggacagctatggccggcccctgtacaacagccagccccatgagcaccccatcacctctgtggcctgggccccagatggagagctgtttgctgtgggcagcttccacaccctgcggctgtgtgacaagacaggctggagctatgccctggagaagcccaacacaggcagcatcttcaacatcgcctggagcattgatggcacccagattgctggggcctgtggaaatggccacgtggtgtttgcccacgtggtggagcagcactgggagtggaagaacttccaggtgaccctgaccaagagaagagccatgcaggtgagaaatgtgctgaatgatgctgtggacctgctggagttccgggacagagtcatcaaggccagcctgaactatgcccacctggtggtgtccaccagcctgcagtgctacgtgttcagcaccaagaactggaacacccccatcatctttgacctgaaggagggcaccgtgtccctcatcctgcaggccgagcggcacttcctgctggtggatggcagcagcatctacctgtacagctatgagggccgcttcatcagcagccccaagtttcctggcatgaggacagacatcctgaatgcccagacagtgtccctgagcaatgacaccatcgccatccgggacaaggcagatgagaagatcatcttcctgtttgaggccagcacaggcaagcccctgggagatggcaagttcctgagccacaagaatgagatcctggagatcgccctggaccagaagggcctgaccaatgacaggaagatcgccttcatcgacaagaacagagacctgtgcatcacctctgtgaagagatttgggaaggaggagcagatcatcaagctgggcaccatggtgcacaccctggcctggaatgacacctgcaacatcctgtgtggcctgcaggacacccgcttcatcgtgtggtactaccccaacacagtgtatgtggaccgggacatcctgcccaagaccctgtatgaaagagatgccagcgagttcagcaagaacccccacatcgtgtcctttgtgggcaaccaggtgaccatccggcgggcagatggcagcctggtgcacatcagcatcaccccctacccagccatcctgcatgaatatgtgagcagcagcaagtgggaggatgctgtgcggctgtgccgctttgtgaaggagcagaccatgtgggcctgcctggccgccatggctgtggccaacagagacatgaccacagctgagatcgcctatgctgccatcggggagattgacaaggtgcagtacatcaacagcatcaagaacctgcccagcaaggagagcaagatggcccacatcctgctcttcagcggcaacatccaggaggccgagatcgtgctgctgcaggccggcctggtgtaccaggccatccagatcaacatcaacctgtacaactgggagcgggccctggagctggccgtgaagtacaagacccacgtggacacagtgctggcctaccggcagaagttcctggagaccttcggcaagcaggagaccaacaagcgctacctgcactatgcagagggcctgcagattgactgggagaagatcaaggccaagattgagatggagatcaccaaggagcgggagcagagcagcagcagccagagcagcaagagcatcggcctgaagccctag

SEQ ID NO: 156545 - DNA, 195 bp, Artificial Sequence
  Description of Artificial Sequence: Synthetic coding sequence
atgaggctgaagatcagcctgctgaaggagcccaagcaccaggagctggtgtcctgtgtgggctggaccacagctgaggagctgtacagctgcagtgatgaccaccagatcgtgaagtggaacctgctgaccagcgagaccacccagatcgtgaagctgcctgatgacatctaccccatcgacttccactggtag

SEQ ID NO: 156546 - DNA, 1923 bp, Artificial Sequence
  Description of Artificial Sequence: Synthetic coding sequence
atgctgcggagcaccctggcccagcagggcacccctgtgtacagcgtggcctggggccctgacagcgagaaggtgctgtacacagctgggaagcagctgatcatcaagcccctgcagcccaatgccaaggtgctgcagtggaaggcccatgatggcatcatcctgaaggtggactggaacagcgtgaatgacctgatcctgtctgctggggaggactgcaagtacaaggtgtgggacagctatggccggcccctgtacaacagccagccccatgagcaccccatcacctctgtggcctgggccccagatggagagctgtttgctgtgggcagcttccacaccctgcggctgtgtgacaagacaggctggagctatgccctggagaagcccaacacaggcagcatcttcaacatcgcctggagcattgatggcacccagattgctggggcctgtggaaatggacatgtggtgtttgcccacgtggtggagcagcactgggagtggaagaacttccaggtgaccctgaccaagaggcgggccatgcaggtgagaaatgtgctgaatgatgctgtggacctgctggagttccgggacagagtcatcaaggccagcctgaactatgcccacctggtggtgtccaccagcctgcagtgctacgtgttcagcaccaagaactggaacacccccatcatctttgacctgaaggagggcaccgtgtccctcatcctgcaggccgagcggcacttcctgctggtggatggcagcagcatctacctgtacagctatgagggccgcttcatcagcagccccaagtttcctggcatgaggacagacatcctgaatgcccagacagtgtccctgagcaatgacaccatcgccatccgggacaaggcagatgagaagatcatcttcctgtttgaggccagcacaggcaagcccctgggagatggcaagttcctgagccacaagaatgagatcctggagatcgccctggaccagaagggcctgaccaatgacaggaagatcgccttcatcgacaagaacagagacctgtgcatcacctctgtgaagagatttgggaaggaggagcagatcatcaagctgggcaccatggtgcacaccctggcctggaatgacacctgcaacatcctgtgtggcctgcaggacacccgcttcatcgtgtggtactaccccaacacagtgtatgtggaccgggacatcctgcccaagaccctgtatgaaagagatgccagcgagttcagcaagaacccccacatcgtgtcctttgtgggcaaccaggtgaccatcagaagagcagatggcagcctggtgcacatcagcatcaccccctacccagccatcctgcacgagtatgtgagcagcagcaagtgggaggatgctgtgcggctgtgccgctttgtgaaggagcagaccatgtgggcctgcctggccgccatggctgtggccaacagagacatgaccacagctgagatcgcctatgctgccatcggggagattgacaaggtgcagtacatcaacagcatcaagaacctgcccagcaaggagagcaagatggcccacatcctgctcttcagcggcaacatccaggaggccgagatcgtgctgctgcaggccggcctggtgtaccaggccatccagatcaacatcaacctgtacaactgggagcgggccctggagctggccgtgaagtacaagacccacgtggacacagtgctggcctaccggcagaagttcctggagaccttcggcaagcaggagaccaacaagcgctacctgcactacgccgagggcctgcagattgactgggagaagatcaaggccaagattgagatggagatcaccaaggagcgggagcagagcagcagcagccagagcagcaagagcatcggcctgaagccctag

SEQ ID NO: 156547 - DNA, 366 bp, Artificial Sequence
  Description of Artificial Sequence: Synthetic coding sequence
atgaggctgaagatcagcctgctgaaggagcccaagcaccaggagctggtgtcctgtgtgggctggaccacagctgaggagctgtacagctgcagtgatgaccaccagatcgtgaagtggaacctgctgaccagcgagaccacccagatcgtgaagctgcctgatgacatctaccccatcgacttccactggttccccaagagcctgggcgtgaagaagcagacccaggccgagagctttgtgctgaccagcagtgatggcaagttccacctgatcagcaagctgggccgggtggagaagtctgtggaggcccactgtggggctgtgctggccggccgctggaactatgagggcacagccctgtag

SEQ ID NO: 156548 - DNA, 1923 bp, Artificial Sequence; identical to SEQ ID NO: 156546
  Description of Artificial Sequence: Synthetic coding sequence

SEQ ID NO: 156549 - DNA, 540 bp, Artificial Sequence
  Description of Artificial Sequence: Synthetic coding sequence
atgaggctgaagatcagcctgctgaaggagcccaagcaccaggagctggtgtcctgtgtgggctggaccacagctgaggagctgtacagctgcagtgatgaccaccagatcgtgaagtggaacctgctgaccagcgagaccacccagatcgtgaagctgcctgatgacatctaccccatcgacttccactggttccccaagagcctgggcgtgaagaagcagacccaggccgagagctttgtgctgaccagcagtgatggcaagttccacctgatcagcaagctgggccgggtggagaagtctgtggaggcccactgtggggctgtgctggccggccgctggaactatgagggcacagccctggtgacagtgggggaggatggccagatcaagatctggagcaagacaggcatgctgcggagcaccctggcccagcagggcacccctgtgtacagcgtggcctggggcccagattctgagaaggtgctgtacacagctgggaagcagctgatcatcaagcccctgcagcccaatgcctag

SEQ ID NO: 156550 - DNA, 1227 bp, Artificial Sequence
  Description of Artificial Sequence: Synthetic coding sequence
atggcctctgtggccagctgtgacagccggcccagcagtgatgagctgcccggggaccccagcagccaggaggaggatgaagattatgactttgaggacagagtgtctgacagcggcagctacagcagcgccagcagtgactatgatgacctggagcctgagtggctggacagcgtgcagaagaatggagagctgttctacctggagctgtctgaagatgaggaggagagcctgctgcctgagacccccaccgtgaaccacgtgcgcttctctgaaaatgagatcatcattgaagatgactacaaggagaggaagaagtatgagcccaagctgaagcagttcaccaagatcctgcggaggaagaggctgctgcccaagcgctgcaacaagaagaacagcaatgacaatggacctgtgtccatcctgaagcaccagagcaaccagaagacaggagtgattgtgcagcagcgctacaaggatgtgaatgtgtatgtgaaccccaagaagctgaccgtcatcaaggccaaggagcagctgaagctgctggaggtgctggtgggcatcatccaccagaccaagtggagctggaggagaacaggcaagcagggagatggagagcggctggtggtgcacggcctgctgcccggcggcagcgccatgaagagcggccaggtgctgattggagatgtgctggtggccgtgaatgatgtggatgtgaccacagagaacatcgagcgggtgctgagctgcatccctggccccatgcaggtgaagctgacctttgaaaatgcctatgatgtgaagcgggagaccagccacccccggcagaagaagacccagagcaacaccagtgacctggtgaagctgctgtggggcgaggaggtggagggcatccagcagagcggcctgaacaccccccacatcatcatgtacctgaccctgcagctggacagcgagaccagcaaggaggagcaggagatcctgtaccactaccccatgtctgaggccagccagaagctgaagtctgtgcggggcatcttcctgaccctgtgtgacatgctggagaatgtgacaggcacccaggtgaccagcagcagcctgctgctgaatggcaagcagatccacgtggcctactggaaggagagtgacaagctgctgctgattggcctgcctgctgaggagattgagctgcccagcagcgcccacacccacggggagagaaattag

SEQ ID NO: 156551 - DNA, 2829 bp, Artificial Sequence
  Description of Artificial Sequence: Synthetic coding sequence
atggcctctgtggccagctgtgacagccggcccagcagtgatgagctgcccggggaccccagcagccaggaggaggatgaagattatgactttgaggacagagtgtctgacagcggcagctacagcagcgccagcagtgactatgatgacctggagcctgagtggctggacagcgtgcagaagaatggagagctgttctacctggagctgtctgaagatgaggaggagagcctgctgcctgagacccccaccgtgaaccacgtgcgcttctctgaaaatgagatcatcattgaagatgactacaaggagaggaagaagtatgagcccaagctgaagcagttcaccaagatcctgcggaggaagaggctgctgcccaagcgctgcaacaagaagaacagcaatgacaatggacctgtgtccatcctgaagcaccagagcaaccagaagacaggagtgattgtgcagcagcgctacaaggatgtgaatgtgtatgtgaaccccaagaagctgaccgtcatcaaggccaaggagcagctgaagctgctggaggtgctggtgggcatcatccaccagaccaagtggagctggaggagaacaggcaagcagggagatggagagcggctggtggtgcacggcctgctgcccggcggcagcgccatgaagagcggccaggtgctgattggagatgtgctggtggccgtgaatgatgtggatgtgaccacagagaacatcgagcgggtgctgagctgcatccctggccccatgcaggtgaagctgacctttgaaaatgcctatgatgtgaagcgggagaccagccacccccggcagaagaagacccagagcaacaccagtgacctggtgaagctgctgtggggcgaggaggtggagggcatccagcagagcggcctgaacaccccccacatcatcatgtacctgaccctgcagctggacagcgagaccagcaaggaggagcaggagatcctgtaccactaccccatgtctgaggccagccagaagctgaagtctgtgcggggcatcttcctgaccctgtgtgacatgctggagaatgtgacaggcacccaggtgaccagcagcagcctgctgctgaatggcaagcagatccacgtggcctactggaaggagagtgacaagctgctgctgattggcctgcctgctgaggaggtgcccctgccccggctgaggaacatgattgaaaatgtcatccagaccctgaagttcatgtatggcagcctggacagcgccttctgccagattgaaaatgtgccccggctggaccacttcttcaacctcttcttccagagggccctgcagcctgccaagctgcacagcagcgccagccccagcgcccagcagtatgatgccagcagcgctgtgctgctggacaacctgcccggggtgcgctggctgaccctgcccctggagatcaagatggagctggacatggccctgagtgacctggaggccgctgactttgctgagctgtctgaggactactatgacatgagaagactctacaccatcctgggcagcagcctcttctacaagggctacctgatctgcagccacctgcccaaggatgacctgattgatattgctgtgtactgccgccactactgcctgctgcccctggccgccaagcagagaattggccagctgatcatctggagggaggtgttcccccagcaccacctgcggcccctggccgacagcagcacagaggtgtttcctgagcctgagggccgctacttcctgctggtggtgggcctgaagcactacatgctgtgtgtgctgctggaggccggcggctgtgccagcaaggccatcggcagccctggccctgactgtgtgtatgtggaccaggtgaagaccaccctgcaccagctggatggagtggacagcagaattgatgagcggctggccagcagccctgtgccctgcctgagctgtgccgactggttcctgaccggcagccgggagaagacagacagcctgaccaccagccccatcctgagccggctgcagggcaccagcaaggtggccaccagccccacctgcaggaggaccctgtttggagactacagcctgaagaccaggaagcccagccccagctgcagcagcggcggcagtgacaatggctgtgagggcggggaggatgatggcttcagcccccacaccaccccagatgctgtgaggaagcagcgggagagccagggcagtgatggcctggaggagagcggcaccctgctgaaggtgaccaagaagaagagcaccctgcccaaccccttccacctgggcaacctgaagaaggacctgcctgagaaggagctggagatctacaacacagtgaagctgaccagcggccctgagaacaccctcttccactacgtggccctggagaccgtgcagggcatcttcatcacccccaccctggaggaggtggcccagctgagcggcagcatccacccccagctgatcaagaacttccaccagtgctgcctgagcatccgggctgtgttccagcagaccctggtggaggagaagaagaagggcctgaacagcggggaccacagcgacagcgccaagtctgtgagcagcctgaaccctgtgaaggagcacggcgtgctgtttgagtgcagccctggcaactggacagaccagaagaaggcccctcctgtgatggcctactgggtggtgggccgcctcttcctgcaccccaagccccaggagctgtatgtgtgcttccatgacagcgtgacagagatcgccatcgagatcgccttcaagctgttcttcggcctgaccctgtag

SEQ ID NO: 156552 - DNA, 2688 bp, Artificial Sequence
  Description of Artificial Sequence: Synthetic coding sequence
atgaacaagtctgagaacctgctgtttgctggcagcagcctggccagccaggtgcacgccgctgctgtgaatggagacaagggggccctgcagaggctcatcgtgggcaacagcgccctgaaggacaaggaggaccagtttggaagaacacccctgatgtactgtgtgctggccgaccggctggactgtgctgatgccctgctgaaggccggggctgatgtgaacaagacagaccacagccagaggacagccctgcacctggccgcccagaagggcaactaccgcttcatgaagctgctgctgacccggcgggccaactggatgcagaaggacctggaggagatgacccccctgcacctgaccaccaggcacaggagccccaagtgcctggccctgctgctgaagttcatggcccctggagaggtggacacccaggacaagaacaagcagacagccctgcactggagcgcctactacaacaaccctgagcacgtgaagctgctgatcaagcatgacagcaacatcggcatcccagatgtggagggcaagatccccctgcactgggccgccaaccacaaggaccccagcgctgtgcacacagtgcgctgcatcctggatgctgcccccacagagagcctgctgaactggcaggactatgagggccgcacccccctgcactttgctgtggctgatggaaatgtgacagtggtggatgtgctgaccagctatgagagctgcaacatcaccagctatgacaacctcttccgcacccccctgcactgggccgccctgctgggccacgcccagatcgtgcacctgctgctggagaggaacaagagcggcaccatccccagcgacagccagggcgccacccccctgcactacgccgcccagagcaactttgctgagaccgtgaaggtgttcctgaagcaccccagcgtgaaggatgacagcgacctggagggccgcaccagcttcatgtgggccgccggcaagggcagtgatgatgtgctgcggaccatgctgagcctgaagagtgacatcgacatcaacatggctgacaagtatggaggaacagccctgcatgctgctgccctgagcggccacgtgtccacagtgaagctgctgctggagaacaatgcccaggtggatgccacagatgtgatgaagcacacccccctcttccgggcctgtgagatgggccacaaggatgtgatccagaccctcatcaagggcggggcccgggtggacctggtggaccaggacggccacagcctgctgcactgggccgccctgggcggcaatgctgatgtgtgccagatcctgattgagaacaagatcaaccccaacgtgcaggactatgccggccgcacccccctgcagtgtgccgcctatggaggctacatcaactgcatggctgtgctgatggagaacaatgctgaccccaacatccaggacaaggagggccgcacagccctgcactggagctgcaacaacggctacctggatgccatcaagctgctgctggactttgctgccttccccaaccagatggagaacaatgaggagcgctacacccccctggactatgccctgctgggggagagacatgaagtcatccagttcatgctggagcacggggccctgagcattgctgccatccaggacattgctgccttcaagatccaggccgtgtacaagggctacaaggtgaggaaggccttccgggacaggaagaacctgctgatgaagcatgagcagctgaggaaggatgctgctgccaagaagcgggaggaggagaacaagaggaaggaggccgagcagcagaagggccgccgcagcccagacagctgccggccccaggccctgccctgcctgcccagcacccaggatgtgcccagccggcagagccgggcccccagcaagcagcccccagctggaaatgtggcccagggccctgagccccgggacagccggggcagccctgggggcagcctgggcggggccctgcagaaggagcagcacgtgtccagtgacctgcagggcaccaacagccggcggcccaatgaaacagcccgggagcacagcaagggccagagcgcctgtgtgcacttccggcccaatgaaggaagtgatggcagccgccaccctggggtgcccagcgtggagaagagccgggagctgcggctgcagatcatccagcgggagaggaggaggaaggagctgttcaggaagaagaacaaggctgctgctgtgatccagagggcctggaggagctaccagctgaggaagcacctgagccacctgcggcacatgaagcagctgggcgctggagatgtggaccgctggaggcaggagagcacagccctgctgctgcaggtgtggaggaaggagctggagctgaagttcccccagaccacagctgtgtccaaggcccccaagagccccagcaagggcaccagcggcaccaagagcaccaagcacagcgtgctgaagcagatctacggctgcagccatgagggcaagatccaccaccccaccaggtctgtgaaggccagctctgtgctgcggctgaacagcgtgagcaacctgcagtgcatccacctgctggagaacagcggccgcagcaagaacttctcctacaacctgcagagcgccacccagcccaagaacaagaccaagccctag

SEQ ID NO: 156553 - DNA, 3198 bp, Artificial Sequence
  Description of Artificial Sequence: Synthetic coding sequence
atgaacaagtctgagaacctgctgtttgctggcagcagcctggccagccaggtgcacgccgctgctgtgaatggagacaagggggccctgcagaggctcatcgtgggcaacagcgccctgaaggacaaggaggaccagtttggaagaacacccctgatgtactgtgtgctggccgaccggctggactgtgctgatgccctgctgaaggccggggctgatgtgaacaagacagaccacagccagaggacagccctgcacctggccgcccagaagggcaactaccgcttcatgaagctgctgctgacccggcgggccaactggatgcagaaggacctggaggagatgacccccctgcacctgaccaccaggcacaggagccccaagtgcctggccctgctgctgaagttcatggcccctggagaggtggacacccaggacaagaacaagcagacagccctgcactggagcgcctactacaacaaccctgagcacgtgaagctgctgatcaagcatgacagcaacatcggcatcccagatgtggagggcaagatccccctgcactgggccgccaaccacaaggaccccagcgctgtgcacacagtgcgctgcatcctggatgctgcccccacagagagcctgctgaactggcaggactatgagggccgcacccccctgcactttgctgtggctgatggaaatgtgacagtggtggatgtgctgaccagctatgagagctgcaacatcaccagctatgacaacctcttccgcacccccctgcactgggccgccctgctgggccacgcccagatcgtgcacctgctgctggagaggaacaagagcggcaccatccccagcgacagccagggcgccacccccctgcactacgccgcccagagcaactttgctgagaccgtgaaggtgttcctgaagcaccccagcgtgaaggatgacagcgacctggagggccgcaccagcttcatgtgggccgccggcaagggcagtgatgatgtgctgcggaccatgctgagcctgaagagtgacatcgacatcaacatggctgacaagtatggaggaacagccctgcatgctgctgccctgagcggccacgtgtccacagtgaagctgctgctggagaacaatgcccaggtggatgccacagatgtgatgaagcacacccccctcttccgggcctgtgagatgggccacaaggatgtgatccagaccctcatcaagggcggggcccgggtggacctggtggaccaggacggccacagcctgctgcactgggccgccctgggcggcaatgctgatgtgtgccagatcctgattgagaacaagatcaaccccaacgtgcaggactatgccggccgcacccccctgcagtgtgccgcctatggaggctacatcaactgcatggctgtgctgatggagaacaatgctgaccccaacatccaggacaaggagggccgcacagccctgcactggagctgcaacaacggctacctggatgccatcaagctgctgctggactttgctgccttccccaaccagatggagaacaatgaggagcgctacacccccctggactatgccctgctgggggagagacatgaagtcatccagttcatgctggagcacggggccctgagcattgctgccatccaggacattgctgccttcaagatccaggccgtgtacaagggctacaaggtgaggaaggccttccgggacaggaagaacctgctgatgaagcatgagcagctgaggaaggatgctgctgccaagaagcgggaggaggagaacaagaggaaggaggccgagcagcagaagggccgccgcagcccagacagctgccggccccaggccctgccctgcctgcccagcacccaggatgtgcccagccggcagagccgggcccccagcaagcagcccccagctggaaatgtggcccagggccctgagccccgggacagccggggcagccctgggggcagcctgggcggggccctgcagaaggagcagcacgtgtccagtgacctgcagggcaccaacagccggcggcccaatgaaacagcccgggagcacagcaagggccagagcgcctgtgtgcacttccggcccaatgaaggaagtgatggcagccgccaccctggggtgcccagcgtggagaagagcagaggagaaacagctggagatgagcgctgtgccaagggcaaaggatttgtgaagcagcccagctgcatccgggtggccggcccagatgagaagggggaggacagcagaagagctgctgccagcctgccccctcatgacagccactggaagcccagcagaagacatgacacagagcccaaggccaagtgtgccccccagaagaggaggacccaggagctgcggggcggccgctgcagccctgctggcagcagcaggcctggcagcgcccggggggaggccgtgcatgctggccagaaccccccccaccacaggacccccaggaacaaggtgacccaggccaagctgactggaggcctgtacagccacctgccccagagcacagaggagctgcggagcggggcccggcggctggagaccagcaccctgtctgaggacttccaggtgtccaaggagacagatcctgcccctggccccctgagcggccagagcgtgaacatcgacctgctgcctgtggagctgcggctgcagatcatccagcgggagaggaggaggaaggagctgttcaggaagaagaacaaggctgctgctgtgatccagagggcctggaggagctaccagctgaggaagcacctgagccacctgcggcacatgaagcagctgggcgctggagatgtggaccgctggaggcaggagagcacagccctgctgctgcaggtgtggaggaaggagctggagctgaagttcccccagaccacagctgtgtccaaggcccccaagagccccagcaagggcaccagcggcaccaagagcaccaagcacagcgtgctgaagcagatctacggctgcagccatgagggcaagatccaccaccccaccaggtctgtgaaggccagctctgtgctgcggctgaacagcgtgagcaacctgcagtgcatccacctgctggagaacagcggccgcagcaagaacttctcctacaacctgcagagcgccacccagcccaagaacaagaccaagccctag

SEQ ID NO: 156554 - DNA, 306 bp, Artificial Sequence
  Description of Artificial Sequence: Synthetic coding sequence
atgaacaagtctgagaacctgctgtttgctggcagcagcctggccagccaggtgcacgccgctgctgtgaatggagacaagggggccctgcagaggctcatcgtgggcaacagcgccctgaaggacaaggaggaccagtttggaagaacacccctgatgtactgtgtgctggccgaccggctggactgtgctgatgccctgctgaaggccggggctgatgtgaacaagacagaccacagccagaggacagccctgcacctggccgcccagaaggccctgcggaccatcagcacaggccgcatctag

SEQ ID NO: 156555 - DNA, 2967 bp, Artificial Sequence
  Description of Artificial Sequence: Synthetic coding sequence
atgaagctgctgctgacccggcgggccaactggatgcagaaggacctggaggagatgacccccctgcacctgaccaccaggcacaggagccccaagtgcctggccctgctgctgaagttcatggcccctggagaggtggacacccaggacaagaacaagcagacagccctgcactggagcgcctactacaacaaccctgagcacgtgaagctgctgatcaagcatgacagcaacatcggcatcccagatgtggagggcaagatccccctgcactgggccgccaaccacaaggaccccagcgctgtgcacacagtgcgctgcatcctggatgctgcccccacagagagcctgctgaactggcaggactatgagggccgcacccccctgcactttgctgtggctgatggaaatgtgacagtggtggatgtgctgaccagctatgagagctgcaacatcaccagctatgacaacctcttccgcacccccctgcactgggccgccctgctgggccacgcccagatcgtgcacctgctgctggagaggaacaagagcggcaccatccccagcgacagccagggcgccacccccctgcactacgccgcccagagcaactttgctgagaccgtgaaggtgttcctgaagcaccccagcgtgaaggatgacagcgacctggagggccgcaccagcttcatgtgggccgccggcaagggcagtgatgatgtgctgcggaccatgctgagcctgaagagtgacatcgacatcaacatggctgacaagtatggaggaacagccctgcatgctgctgccctgagcggccacgtgtccacagtgaagctgctgctggagaacaatgcccaggtggatgccacagatgtgatgaagcacacccccctcttccgggcctgtgagatgggccacaaggatgtgatccagaccctcatcaagggcggggcccgggtggacctggtggaccaggacggccacagcctgctgcactgggccgccctgggcggcaatgctgatgtgtgccagatcctgattgagaacaagatcaaccccaacgtgcaggactatgccggccgcacccccctgcagtgtgccgcctatggaggctacatcaactgcatggctgtgctgatggagaacaatgctgaccccaacatccaggacaaggagggccgcacagccctgcactggagctgcaacaacggctacctggatgccatcaagctgctgctggactttgctgccttccccaaccagatggagaacaatgaggagcgctacacccccctggactatgccctgctgggggagagacatgaagtcatccagttcatgctggagcacggggccctgagcattgctgccatccaggacattgctgccttcaagatccaggccgtgtacaagggctacaaggtgaggaaggccttccgggacaggaagaacctgctgatgaagcatgagcagctgaggaaggatgctgctgccaagaagcgggaggaggagaacaagaggaaggaggccgagcagcagaagggccgccgcagcccagacagctgccggccccaggccctgccctgcctgcccagcacccaggatgtgcccagccggcagagccgggcccccagcaagcagcccccagctggaaatgtggcccagggccctgagccccgggacagccggggcagccctgggggcagcctgggcggggccctgcagaaggagcagcacgtgtccagtgacctgcagggcaccaacagccggcggcccaatgaaacagcccgggagcacagcaagggccagagcgcctgtgtgcacttccggcccaatgaaggaagtgatggcagccgccaccctggggtgcccagcgtggagaagagcagaggagaaacagctggagatgagcgctgtgccaagggcaaaggatttgtgaagcagcccagctgcatccgggtggccggcccagatgagaagggggaggacagcagaagagctgctgccagcctgccccctcatgacagccactggaagcccagcagaagacatgacacagagcccaaggccaagtgtgccccccagaagaggaggacccaggagctgcggggcggccgctgcagccctgctggcagcagcaggcctggcagcgcccggggggaggccgtgcatgctggccagaaccccccccaccacaggacccccaggaacaaggtgacccaggccaagctgactggaggcctgtacagccacctgccccagagcacagaggagctgcggagcggggcccggcggctggagaccagcaccctgtctgaggacttccaggtgtccaaggagacagatcctgcccctggccccctgagcggccagagcgtgaacatcgacctgctgcctgtggagctgcggctgcagatcatccagcgggagaggaggaggaaggagctgttcaggaagaagaacaaggctgctgctgtgatccagagggcctggaggagctaccagctgaggaagcacctgagccacctgcggcacatgaagcagctgggcgctggagatgtggaccgctggaggcaggagagcacagccctgctgctgcaggtgtggaggaaggagctggagctgaagttcccccagaccacagctgtgtccaaggcccccaagagccccagcaagggcaccagcggcaccaagagcaccaagcacagcgtgctgaagcagatctacggctgcagccatgagggcaagatccaccaccccaccaggtctgtgaaggccagctctgtgctgcggctgaacagcggcaaggccgccacagccaagcagatggtgggcaagaacatgggcaagcacttccccctcttccacccccagaggcagaagaccctggagcagatctggccaggcttcagcaatggccacctgatctcctgggactactactgcagccagcacctgagcccctag

SEQ ID NO: 156556 - DNA, 3723 bp, Artificial Sequence
  Description of Artificial Sequence: Synthetic coding sequence
atgtctgtgaaggagggcgcccagaggaagtgggccgccctgaaggagaagctgggcccccaggacagcgaccccacagaggccaacctggagagcgctgaccctgagctgtgcatccggctgctgcagatgcccagcgtggtgaactacagcggcctgaggaagaggctggagggcagtgatggcggctggatggtgcagttcctggagcagagcggcctggacctgctgctggaggccctggcccggctgagcggccggggcgtggcccgcatcagtgatgccctgctgcagctgacctgtgtgtcctgtgtgcgggctgtgatgaacagccggcagggcatcgagtacatcctgagcaaccagggctacgtgcggcagctgagccaggccctggacaccagcaatgtgatggtgaagaagcaggtgtttgagctgctggccgccctgtgcatctacagccctgagggccacgtgctgaccctggatgccctggaccactacaagacagtgtgcagccagcagtaccgcttcagcatcgtgatgaatgagctgagcggcagtgacaacgtgccctacgtggtgaccctgctgagcgtcatcaatgctgtgatcctgggccctgaggacctgcgggcccggacccagctgagaaatgagttcatcggcctgcagctgctggatgtgctggcccggctgcgggacctggaggatgctgacctgctgatccagctggaggcctttgaggaggccaaggccgaggatgaggaggagctgctgcgggtgtctggaggagtggacatgagcagccaccaggaggtgtttgccagcctcttccacaaggtgtcctgcagccctgtgtctgcccagctgctgtctgtgctgcagggcctgctgcacctggagcccaccctgcggagcagccagctgctgtgggaggccctggagagcctggtgaacagagctgtgctgctggccagtgatgcccaggagtgcaccctggaggaggtggtggagcggctgctgtctgtgaagggccggccccggcccagccccctggtgaaggcccacaagtctgtgcaggccaacctggaccagagccagaggggcagcagcccccagaacaccaccacccccaagcccagcgtggagggccagcagcctgctgctgctgctgcctgtgagcctgtggaccacgcccagagcgagagcatcctgaaggtgtcccagccccgggccctggagcagcaggccagcaccccacctcctcctcctcctccacccctgctgcccggcagcagcgctgagcccccacctcctcctcctcctccacccctgcccagcgtgggcgccaaggccctgcccacagcccctcctcctccacccctgcccggcctgggcgccatggcccccccagccccacccctgcccccacccctgcccggcagctgtgagttcctgcccccacctcctccacccctgcccggcctgggctgccccccacctcctccacccctgctgcccggcatgggctggggccccccacctcctcctccacccctgctgccctgcacctgcagcccccctgtggccggcggcatggaggaggtgattgtggcccaggtggaccacggcctgggcagcgcctgggtgcccagccacagaagagtgaacccccccaccctgaggatgaagaagctgaactggcagaagctgcccagcaatgtggcccgggagcacaacagcatgtgggccagcctgagcagcccagatgctgaggccgtggagccagacttcagcagcattgaaagactcttctccttccctgctgccaagcccaaggagcccaccatggtggccccccgggccaggaaggagcccaaggagatcaccttcctggatgccaagaagagcctgaacctgaacatcttcctgaagcagttcaagtgcagcaatgaggaggtggccgccatgatccgggccggggacaccaccaagtttgatgtggaggtgctgaagcagctgctgaagctgctgcctgagaagcatgaaattgagaacctgcgggccttcacagaggagcgggccaagctggccagcgctgaccacttctacctgctgctgctggccatcccctgctaccagctgagaattgagtgcatgctgctgtgtgagggcgctgctgctgtgctggacatggtgcggcccaaggcccagctggtgctggccgcctgtgagagcctgctgaccagccggcagctgcccatcttctgccagctgatcctgcgcatcggcaacttcctgaactacggcagccacactggagatgctgatggcttcaagatcagcaccctgctgaagctgacagagaccaagagccagcagaacagagtgaccctgctgcaccacgtgctggaggaggccgagaagagccacccagacctgctgcagctgccccgggacctggagcagcccagccaggccgccggcatcaacctggagatcatccgctctgaggccagcagcaacctgaagaagctgctggagacagagaggaaggtgtctgcctctgtggccgaggtgcaggagcagtacacagagcggctgcaggccagcatcagcgccttccgggccctggatgagctgtttgaggccatcgagcagaagcagcgggagctggccgactacctgtgtgaagatgcccagcagctgagcctggaggacaccttcagcaccatgaaggccttccgggacctcttcctgcgggccctgaaggagaacaaggacaggaaggagcaggccgccaaggccgagaggaggaagcagcagctggccgaggaggaggcccggcggcccagaggagaagatggcaagcctgtgaggaagggccctgggaagcaggaggaggtgtgtgtgattgatgccctgctggccgacatcaggaagggcttccagctgaggaagacagcccggggccgcggggacacagatggcggcagcaaggccgcctccatggaccccccccgggccacagagcctgtggccaccagcaacccagctggggaccctgtgggcagcacccgctgcccagccagcgagcccggcctggatgccaccacagccagcgagagccggggctgggacctggtggatgctgtgaccccaggcccccagcccaccctggagcagctggaggagggcggcccccggcccctggagcggcgcagctcctggtacgtggatgccagtgatgtgctgaccacagaggacccccagtgcccccagcccctggagggcgcctggcctgtgaccctgggagatgcccaggccctgaagcccctgaagttcagcagcaaccagcccccagctgctggcagcagccggcaggatgccaaggaccccaccagcctgctgggcgtgctgcaggccgaggccgacagcaccagcgagggcctggaggatgctgtgcacagcagaggagcccggcccccagctgctggccctggaggagatgaagatgaagatgaggaggacacagcccctgagagcgccctggacaccagcctggacaagagcttctctgaagatgctgtgacagacagcagcggcagcggcaccctgccccgggcccggggccgggccagcaagggcaccgggaagaggaggaagaagaggcccagccgcagccaggagggcctgcggccccggcccaaggccaagtag

SEQ ID NO: 156557 - DNA, 3750 bp, Artificial Sequence
  Description of Artificial Sequence: Synthetic coding sequence
atgtctgtgaaggagggcgcccagaggaagtgggccgccctgaaggagaagctgggcccccaggacagcgaccccacagaggccaacctggagagcgctgaccctgagctgtgcatccggctgctgcagatgcccagcgtggtgaactacagcggcctgaggaagaggctggagggcagtgatggcggctggatggtgcagttcctggagcagagcggcctggacctgctgctggaggccctggcccggctgagcggccggggcgtggcccgcatcagtgatgccctgctgcagctgacctgtgtgtcctgtgtgcgggctgtgatgaacagccggcagggcatcgagtacatcctgagcaaccagggctacgtgcggcagctgagccaggccctggacaccagcaatgtgatggtgaagaagcaggtgtttgagctgctggccgccctgtgcatctacagccctgagggccacgtgctgaccctggatgccctggaccactacaagacagtgtgcagccagcagtaccgcttcagcatcgtgatgaatgagctgagcggcagtgacaacgtgccctacgtggtgaccctgctgagcgtcatcaatgctgtgatcctgggccctgaggacctgcgggcccggacccagctgagaaatgagttcatcggcctgcagctgctggatgtgctggcccggctgcgggacctggaggatgctgacctgctgatccagctggaggcctttgaggaggccaaggccgaggatgaggaggagctgctgcgggtgtctggaggagtggacatgagcagccaccaggaggtgtttgccagcctcttccacaaggtgtcctgcagccctgtgtctgcccagctgctgtctgtgctgcagggcctgctgcacctggagcccaccctgcggagcagccagctgctgtgggaggccctggagagcctggtgaacagagctgtgctgctggccagtgatgcccaggagtgcaccctggaggaggtggtggagcggctgctgtctgtgaagggccggccccggcccagccccctggtgaaggcccacaagtctgtgcaggccaacctggaccagagccagaggggcagcagcccccagaacaccaccacccccaagcccagcgtggagggccagcagcctgctgctgctgctgcctgtgagcctgtggaccacgcccagagcgagagcatcctgaaggtgtcccagccccgggccctggagcagcaggccagcaccccacctcctcctcctcctccacccctgctgcccggcagcagcgctgagcccccacctcctcctcctcctccacccctgcccagcgtgggcgccaaggccctgcccacagcccctcctcctccacccctgcccggcctgggcgccatggcccccccagccccacccctgcccccacccctgcccggcagctgtgagttcctgcccccacctcctccacccctgcccggcctgggctgccccccacctcctccacccctgctgcccggcatgggctggggccccccacctcctcctccacccctgctgccctgcacctgcagcccccctgtggccggcggcatggaggaggtgattgtggcccaggtggaccacggcctgggcagcgcctgggtgcccagccacagaagagtgaacccccccaccctgaggatgaagaagctgaactggcagaagctgcccagcaatgtggcccgggagcacaacagcatgtgggccagcctgagcagcccagatgctgaggccgtggagccagacttcagcagcattgaaagactcttctccttccctgctgccaagcccaaggagcccaccatggtggccccccgggccaggaaggagcccaaggagatcaccttcctggatgccaagaagagcctgaacctgaacatcttcctgaagcagttcaagtgcagcaatgaggaggtggccgccatgatccgggccggggacaccaccaagtttgatgtggaggtgctgaagcagctgctgaagctgctgcctgagaagcatgaaattgagaacctgcgggccttcacagaggagcgggccaagctggccagcgctgaccacttctacctgctgctgctggccatcccctgctaccagctgagaattgagtgcatgctgctgtgtgagggcgctgctgctgtgctggacatggtgcggcccaaggcccagctggtgctggccgcctgtgagagcctgctgaccagccggcagctgcccatcttctgccagctgatcctgcgcatcggcaacttcctgaactacggcagccacactggagatgctgatggcttcaagatcagcaccctgctgaagctgacagagaccaagagccagcagaacagagtgaccctgctgcaccacgtgctggaggaggccgagaagagccacccagacctgctgcagctgccccgggacctggagcagcccagccaggccgccggcatcaacctggagatcatccgctctgaggccagcagcaacctgaagaagctgctggagacagagaggaaggtgtctgcctctgtggccgaggtgcaggagcagtacacagagcggctgcaggccagcatcagcgccttccgggccctggatgagctgtttgaggccatcgagcagaagcagcgggagctggccgactacctgtgtgaagatgcccagcagctgagcctggaggacaccttcagcaccatgaaggccttccgggacctcttcctgcgggccctgaaggagaacaaggacaggaaggagcaggccgccaaggccgagaggaggaagcagcagctggccgaggaggaggcccggcggcccagaggagaagatggcaagcctgtgaggaagggccctgggaagcaggaggaggtgtgtgtgattgatgccctgctggccgacatcaggaagggcttccagctgaggaagacagcccggggccgcggggacacagatggcggcagcaaggccgcctccatggaccccccccgggccacagagcctgtggccaccagcaacccagctggggaccctgtgggcagcacccgctgcccagccagcgagcccggcctggatgccaccacagccagcgagagccggggctgggacctggtggatgctgtgaccccaggcccccagcccaccctggagcagctggaggagggcggcccccggcccctggagcggcgcagctcctggtacgtggatgccagtgatgtgctgaccacagaggacccccagtgcccccagcccctggagggcgcctggcctgtgaccctgggagatgcccaggccctgaagcccctgaagttcagcagcaaccagcccccagctgctggcagcagccggcaggatgccaaggaccccaccagcctgctgggcgtgctgcaggccgaggccgacagcaccagcgagggcctggaggatgctgtgcacagcagaggagcccggcccccagctgctggccctggaggagatgaagatgaagatgaggaggacacagcccctgagagcgccctggacaccagcctggacaagagcttctctgaagatgctgtgacagacagcagcggcagcggcaccctgccccgggcccggggccgggccagcaagggcaccgggaagaggaggaagaagaggcccagccgcagccaggaggaggtgcccccagacagtgatgacaacaagaccaagaagctgtgtgtgatccagtag

SEQ ID NO: 156558 - DNA, 705 bp, Artificial Sequence
  Description of Artificial Sequence: Synthetic coding sequence
atgtctgtgaaggagggcgcccagaggaagtgggccgccctgaaggagaagctgggcccccaggacagcgaccccacagaggccaacctggagagcgctgaccctgagctgtgcatccggctgctgcagatgcccagcgtggtgaactacagcggcctgaggaagaggctggagggcagtgatggcggctggatggtgcagttcctggagcagagcggcctggacctgctgctggaggccctggcccggctgagcggccggggcgtggcccgcatcagtgatgccctgctgcagctgacctgtgtgtcctgtgtgcgggctgtgatgaacagccggcagggcatcgagtacatcctgagcaaccagggctacgtgcggcagctgagccaggccctggacaccagcaatgtgatggtgaagaagcaggtgtttgagctgctggccgccctgtgcatctacagccctgagggccacgtgctgaccctggatgccctggaccactacaagacagtgtgcagccagcagtaccgcttcagcatcgtgatgaatgagctgagcggcagtgacaacgtgccctacgtggtgaccctgctgagcgtcatcaatgctgtgatcctgggccctgaggacctgcgggcccggacccagctgagaaatgagttcatcggcctgcagctgctggatgtgctggcccggctgaggtag

SEQ ID NO: 156559 - DNA, 1758 bp, Artificial Sequence
  Description of Artificial Sequence: Synthetic coding sequence
atgagccagcagcacaccctgcctgtgaccctgagccctgccctgagccaggagctgctgaagacagtgcccccacctgtgaacacccaccaggagcagatgaagcagcccacccccctgcccccaccctgccagaaggtgcctgtggagctgcctgtggaggtgcccagcaagcaggaggagaagcacatgacagctgtgaagggcctgcctgagcaggagtgtgagcagcagcagaaggagccccaggagcaggagctgcagcagcagcactgggagcagcacgaggagtaccagaaggccgagaaccctgagcagcagctgaagcaggagaagacccagagggaccagcagctgaacaagcagctggaggaggagaagaagctgctggaccagcagctggaccaggagctggtgaagagagatgagcagctgggcatgaagaaggagcagctgctggagctgcctgagcagcaggagggccacctgaagcacctggagcagcaggagggccagctgaagcaccctgagcagcaggagggccagctggagctgcctgagcagcaggagggccagctggagctgcctgagcagcaggagggccagctggagctgcctgagcagcaggagggccagctggagctgcctgagcagcaggagggccagctggagctgcctgagcagcaggagggccagctggagctgccccagcagcaggagggccagctggagctgtctgagcagcaggagggccagctggagctgtctgagcagcaggagggccagctgaagcacctggagcaccaggagggccagctggaggtgcctgaggagcagatgggccagctgaagtacctggagcagcaggagggccagctgaagcacctggaccagcaggagaagcagcctgagctgcctgagcagcagatgggccagctgaagcacctggagcagcaggagggccagcccaagcacctggagcagcaggagggccagctggagcagctggaggagcaggagggccagctgaagcacctggagcagcaggagggccagctggagcacctggagcaccaggagggccagctgggcctgcctgagcagcaggtgctgcagctgaagcagctggagaagcagcagggccagcccaagcacctggaggaggaggagggccagctgaagcacctggtgcagcaggagggccagctgaagcacctggtgcagcaggagggccagctggagcagcaggagcggcaggtggagcacctggagcagcaggtgggccagctgaagcacctggaggagcaggagggccagctgaagcacctggagcagcagcagggccagctggaggtgcctgagcagcaggtgggccagcccaagaacctggagcaggaggagaagcagctggagctgcctgagcagcaggagggccaggtgaagcacctggagaagcaggaggcccagctggagctgcctgagcagcaggtgggccagcccaagcacctggagcagcaggagaagcacctggagcaccctgagcagcaggacggccagctgaagcacctggagcagcaggagggccagctgaaggacctggagcagcagaagggccagctggagcagcctgtgtttgccccagcccctggccaggtgcaggacatccagcctgccctgcccaccaagggggaggtgctgctgcctgtggagcaccagcagcagaagcaggaggtgcagtggccacccaagcacaagtag

SEQ ID NO: 156560 - DNA, 1320 bp, Artificial Sequence
  Description of Artificial Sequence: Synthetic coding sequence
atgaagaaggagcagctgctggagctgcctgagcagcaggagggccacctgaagcacctggagcagcaggagggccagctgaagcaccctgagcagcaggagggccagctggagctgcctgagcagcaggagggccagctggagctgcctgagcagcaggagggccagctggagctgcctgagcagcaggagggccagctggagctgcctgagcagcaggagggccagctggagctgcctgagcagcaggagggccagctggagctgccccagcagcaggagggccagctggagctgtctgagcagcaggagggccagctggagctgtctgagcagcaggagggccagctgaagcacctggagcaccaggagggccagctggaggtgcctgaggagcagatgggccagctgaagtacctggagcagcaggagggccagctgaagcacctggaccagcaggagaagcagcctgagctgcctgagcagcagatgggccagctgaagcacctggagcagcaggagggccagcccaagcacctggagcagcaggagggccagctggagcagctggaggagcaggagggccagctgaagcacctggagcagcaggagggccagctggagcacctggagcaccaggagggccagctgggcctgcctgagcagcaggtgctgcagctgaagcagctggagaagcagcagggccagcccaagcacctggaggaggaggagggccagctgaagcacctggtgcagcaggagggccagctgaagcacctggtgcagcaggagggccagctggagcagcaggagcggcaggtggagcacctggagcagcaggtgggccagctgaagcacctggaggagcaggagggccagctgaagcacctggagcagcagcagggccagctggaggtgcctgagcagcaggtgggccagcccaagaacctggagcaggaggagaagcagctggagctgcctgagcagcaggagggccaggtgaagcacctggagaagcaggaggcccagctggagctgcctgagcagcaggtgggccagcccaagcacctggagcagcaggagaagcacctggagcaccctgagcagcaggacggccagctgaagcacctggagcagcaggagggccagctgaaggacctggagcagcagaagggccagctggagcagcctgtgtttgccccagcccctggccaggtgcaggacatccagcctgccctgcccaccaagggggaggtgctgctgcctgtggagcaccagcagcagaagcaggaggtgcagtggccacccaagcacaagtag

SEQ ID NO: 156561 - DNA, 1914 bp, Artificial Sequence
  Description of Artificial Sequence: Synthetic coding sequence
atgggcctgctgagccagggcagccccctgtcctgggaggagaccaagagacatgctgaccacgtgagaagacatggcatcctgcagttcctgcacatctaccacgctgtgaaggacagacacaaggatgtgctgaagtggggagatgaggtggagtacatgctggtgtcctttgaccacgagaacaagaaggtgcggctggtgctgagcggggagaaggtgctggagaccctgcaggagaagggggagaggaccaaccccaaccaccccaccctgtggaggccagaatatggcagctacatgattgagggcaccccaggccagccctacggcggcaccatgtctgagttcaacacagtggaggccaacatgaggaagaggaggaaggaggccaccagcatcctggaggagaaccaggccctgtgcaccatcaccagcttcccccggctgggctgccccggcttcaccctgcctgaggtgaagcccaaccctgtggagggcggggccagcaagagcctcttcttcccagatgaggccatcaacaagcacccccgcttcagcaccctgaccaggaacatccgccaccggcggggggagaaggtggtgatcaacgtgcccatcttcaaggacaagaacacccccagccccttcatcgagaccttcacagaagatgatgaggccagccgggccagcaagccagaccacatctacatggatgccatgggcttcggcatgggcaactgctgcctgcaggtgaccttccaggcctgcagcatcagcgaggcccgctacctgtatgaccagctggccaccatctgccccatcgtgatggccctgtctgctgccagccccttctaccggggctacgtgtctgacatcgactgccgctggggcgtcatcagcgcctctgtggatgacaggacccgggaggagcggggcctggagcccctgaagaacaacaactaccgcatcagcaagagccgctatgacagcattgacagctacctgagcaaatgtggggagaagtacaatgacatcgacctgaccatcgacaaggagatctatgagcagctgctgcaggagggcatcgaccacctgctggcccagcacgtggcccacctgttcatccgggaccccctgaccctgtttgaggagaagatccacctggatgatgccaatgaaagtgaccactttgagaacatccagagcaccaactggcagaccatgaggttcaagcccccaccacccaacagcgacatcggctggagggtggagttccggcccatggaggtgcagctgacagactttgaaaattctgcctacgtggtgtttgtggtgctgctgaccagggtcatcctgagctacaagctggacttcctgatccccctgagcaaggtggatgagaacatgaaggtggcccagaagagagatgctgtgctgcagggcatgttctacttcaggaaggacatctgcaagggcggcaatgctgtggtggatggctgcggcaaggcccagaacagcacagagctggccgctgaggagtacaccctgatgagcattgacaccatcatcaatggcaaggagggcgtcttccctggcctcatccccatcctgaacagctacctggagaacatggaggtggatgtggacacccgctgcagcatcctgaactacctgaagctgatcaagaagagggccagcggggagctgatgacagtggcccgctggatgagggagttcatcgccaaccacccagactacaagcaggacagcgtcatcacagatgagatgaactacagcctcatcctgaagtgcaaccagatcgccaatgagctgtgtgagtgcccagagctgctgggcagcgccttcaggaaggtgaagtacagcggcagcaagacagacagcagcaactag

SEQ ID NO: 156562 - DNA, 870 bp, Artificial Sequence
  Description of Artificial Sequence: Synthetic coding sequence
atgtacttcctgacccccatcctggtggccatcctgtgcatcctggtggtgtggatcttcaagaatgctgaccgctccatggagaagaagaagggggagcccaggaccagggctgaggcccggccctgggtggatgaggacctgaaggacagcagtgacctgcaccaggccgaggaggatgctgatgagtggcaggagagtgaagaaaatgtggagcacatccccttcagccacaaccactacccagagaaggagatggtgaagaggagccaggagttctatgagctgctgaacaagagaagatctgtgcgcttcatcagcaatgagcaggtgcccatggaggtgattgacaacgtcatcagaacagctggaacagcccccagcggggcccacacagagccctggacctttgtggtggtgaaggaccctgatgtgaagcacaagatcaggaagatcatcgaggaggaggaggagatcaactacatgaagaggatgggccaccgctgggtgacagacctgaagaagctgcggaccaactggatcaaggagtacctggacacagcccccatcctgatcctgatcttcaagcaggtgcacggctttgctgccaacgggaagaagaaggtgcactactacaatgagatctctgtgtccatcgcctgtggcatcctgctggccgccctgcagaatgccggcctggtgacagtgaccaccacccccctgaactgtggcccccggctgcgggtgctgctgggccggcctgcccacgagaagctgctgatgctgctgcctgtgggctaccccagcaaggaggccaccgtgcctgacctgaagaggaagcccctggaccagatcatggtgacagtgtag

SEQ ID NO: 156563 - DNA, 813 bp, Artificial Sequence
  Description of Artificial Sequence: Synthetic coding sequence
atgtacttcctgacccccatcctggtggccatcctgtgcatcctggtggtgtggatcttcaagaatgctgaccgctccatggagaagaagaagggggagcccaggaccagggctgaggcccggccctgggtggatgaggacctgaaggacagcagtgacctgcaccaggccgaggaggatgctgatgagtggcaggagagtgaagaaaatgtggagcacatccccttcagccacaaccactacccagagaaggagatggtgaagaggagccaggagttctatgagctgctgaacaagagaagatctgtgcgcttcatcagcaatgagcaggtgcccatggaggtgattgacaacgtcatcagaacagctggaacagcccccagcggggcccacacagagccctggacctttgtggtggtgaaggaccctgatgtgaagcacaagatcaggaagatcatcgaggaggaggaggagatcaactacatgaagaggatgggccaccgctgggtgacagacctgaagaagctgcggaccaactggatcaaggagtacctggacacagcccccatcctgatcctgatcttcaagcaggtgcacggctttgctgccaacgggaagaagaaggtgcactactacaatgagatctctgtgtccatcgcctgtggcatcctgctggccgccctgcaggtgaacaacggcatcaccatgaggcaccagacagcccggcaccgccacctgattgagggccctggccgcagcagcgaggcctgcagcaagctgagcagccagggctgccccggcttctactgctag

SEQ ID NO: 156564 - DNA, 744 bp, Artificial Sequence
  Description of Artificial Sequence: Synthetic coding sequence
atgtacttcctgacccccatcctggtggccatcctgtgcatcctggtggtgtggatcttcaagaatgctgaccgctccatggagaagaagaagggggagcccaggaccagggctgaggcccggccctgggtggatgaggacctgaaggacagcagtgacctgcaccaggccgaggaggatgctgatgagtggcaggagagtgaagaaaatgtggagcacatccccttcagccacaaccactacccagagaaggagatggtgaagaggagccaggagttctatgagctgctgaacaagagaagatctgtgcgcttcatcagcaatgagcaggtgcccatggaggtgattgacaacgtcatcagaacagctggaacagcccccagcggggcccacacagagccctggacctttgtggtggtgaaggaccctgatgtgaagcacaagatcaggaagatcatcgaggaggaggaggagatcaactacatgaagaggatgggccaccgctgggtgacagacctgaagaagctgcggaccaactggatcaaggagtacctggacacagcccccatcctgatcctgatcttcaagcaggtgcacggctttgctgccaacgggaagaagaaggtgcactactacaatgagatctctgtgtccatcgcctgtggcatcctgctggccgccctgcaggtgtttgggaagatcatcctgaaggagctggccctgatctccttcctgaacctgtag

SEQ ID NO: 156565 - DNA, 855 bp, Artificial Sequence
  Description of Artificial Sequence: Synthetic coding sequence
atgtacttcctgacccccatcctggtggccatcctgtgcatcctggtggtgtggatcttcaagaatgctgaccgctccatggagaagaagaagggggagcccaggaccagggctgaggcccggccctgggtggatgaggacctgaaggacagcagtgacctgcaccaggccgaggaggatgctgatgagtggcaggagagtgaagaaaatgtggagcacatccccttcagccacaaccactacccagagaaggagatggtgaagaggagccaggagttctatgagctgctgaacaagagaagatctgtgcgcttcatcagcaatgagcaggtgcccatggaggtgattgacaacgtcatcagaacagctggaacagcccccagcggggcccacacagagccctggacctttgtggtggtgaaggaccctgatgtgaagcacaagatcaggaagatcatcgaggaggaggaggagatcaactacatgaagaggatgggccaccgctgggtgacagacctgaagaagctgcggaccaactggatcaaggagtacctggacacagcccccatcctgatcctgatcttcaagcaggtgcacggctttgctgccaacgggaagaagaaggtgcactactacaatgagatctctgtgtccatcgcctgtggcatcctgctggccgccctgcaggtgaacaacggcatcaccatgaggcaccagacagcccggcaccgccacctgattgagggccctggccgcagcagcgaggcctgcagcaagctgagcagccagggctgccctggggccagcgctgctggcagcctcttccactttgccattgaatttgctgccccctag

SEQ ID NO: 156566 - DNA, 2850 bp, Artificial Sequence
  Description of Artificial Sequence: Synthetic coding sequence
atggagcccccaggccgcagcagccgcagcacagccagccacaccctgcaccagtactgctgccccacccaggtgctggacagcatgaagctgacccccagcggccgcctggccgagagctctgtggagggagatgcccctggcagtgacctgagcacagctgtggacagccctggcagccagcccccctaccgcctgagccagctgccccccagcagcagccacatgggcggccccccagctggggtgggcctgccctgggcccagagggcccggctgcagcctgcctctgtggccctgaggaagcaggaggaggaggagatcaagaggagcaaggccctgagtgacagctatgagctgagcacagacctgcaggacaagaaggtggagatgctggagaggaaatatggaggcagcttcctgagcagaagagctgcccggaccatccagacagccttccggcagtacaggatgaacaagaactttgagcggctgcggagcagcgccagcgagagcaggatgagccgccgcatcatcctgagcaacatgaggatgcagttctcctttgaggagtatgagaaggcccagaacccagcctactttgagggcaagccagccagcctggatgaaggagccatggccggggcccggagccaccggctggagcggggcctgccctatggaggcagctgtggcggcggcattgatggcggcggcagctctgtgaccaccagcggggagttcagcaatgacatcacagagctggaggacagcttcagcaagcaggtgaagagcctggccgagagcattgatgaggccctgaactgccaccccagcggccccatgtctgaggagcccggcagcgcccagctggagaagcgggagagcaaggagcagcaggaggacagcagcgccaccagcttcagtgacctgcccctgtacctggatgacacagtgccccagcagagccctgagcggctgcccagcacagagcccccaccccagggccggcctgagttctgggccccagcccccctgccccctgtgcccccacctgtgcccagcggcaccagagaagatggcagccgggaggagggcacccggcggggccctggctgcctggagtgccgggacttccggctgcgggccgcccacctgcccctgctgaccatcgagcccccaagtgacagctctgtggacctgagtgacagaagtgaccggggctctgtgcaccggcagctggtgtatgaagcagatggctgcagcccccacggcaccctgaagcacaagggccccccaggccgggcccccatcccccaccgccactacccagcccctgagggccctgccccagcccctcctggccccctgcccccagcccccaacagcggcaccggccccagcggcgtggccggcggccggcggctgggcaaatgtgaggccgccggggagaacagtgatggaggagacaatgaaagcctggagagcagcagcaacagcaatgagaccatcaactgcagcagcggcagcagcagccgggacagcctgcgggagcccccagccaccggcctgtgcaagcagacctaccagcgggagaccaggcacagctgggacagccctgccttcaacaatgatgtggtgcagaggaggcactaccgcatcggcctgaacctcttcaacaagaagccagagaagggcatccagtacctgattgagcggggcttcctgagtgacacccctgtgggcgtggcccacttcatcctggagaggaagggcctgagccggcagatgattggagagttcctgggcaaccggcagaagcagttcaacagagatgtgctggactgtgtggtggatgagatggacttcagctccatggacctggatgatgccctgaggaagttccagagccacatccgggtgcagggcgaggcccagaaggtggagcggctcatcgaggccttcagccagcgctactgtgtgtgcaacccagccctggtgcggcagttcagaaatccagacaccatcttcatcctggcctttgccatcatcctgctgaacacagacatgtacagccccagcgtgaaggccgagaggaagatgaagctggatgacttcatcaagaacctgcggggcgtggacaatggagaggacatcccccgggacctgctggtgggcatctaccagaggatccagggccgggagctgcggaccaatgatgaccacgtgtcccaggtgcaggccgtggagaggatgattgtgggcaagaagcctgtgctgagcctgccccaccggcggctggtgtgctgctgccagctgtatgaggtgcctgaccccaaccggccccagaggctgggcctgcaccagcgggaggtgttcctgttcaatgacctgctggtggtgaccaagatcttccagaagaagaagatcctggtgacctacagcttccggcagagcttccccctggtggagatgcacatgcagctgttccagaacagctactaccagtttggcatcaagctgctgtctgctgtgcctggaggagagaggaaggtgctgatcatcttcaatgcccccagcctgcaggaccggctgcgcttcaccagtgacctgcgggagagcattgctgaggtgcaggagatggagaagtacagagtggagagcgagctggagaagcagaagggcatgatgaggcccaatgccagccagcccggcggggccaaggacagcgtgaatggcaccatggcccggagcagcctggaggacacctacggggctggagatggcctgaagagaggagccctgagcagcagcctgcgggacctgagtgatgctggggtgtgctactag

SEQ ID NO: 156567 - DNA, 4437 bp, Artificial Sequence
  Description of Artificial Sequence: Synthetic coding sequence
atggaggccggcagcggccccccaggcggccctggcagcgagagccccaacagagctgtggagtacctgctggagctgaacaacatcatcgagagccagcagcagctgctggagacccagaggcggcgcatcgaggagctggagggccagctggaccagctgacccaggagaacagagacctgcgggaggagagccagctgcacagaggagagctgcaccgggacccccatggagcccgggacagccctggccgggagagccagtaccagaacctgcgggagacccagttccaccaccgggagctgcgggagagccagttccaccaggccgccagagatgtgggctaccccaaccgggagggcgcctaccagaaccgggaggccgtgtacagagacaaggagagagatgccagctaccccctgcaggacaccaccggctacacagcccgggagagagatgtggcccagtgccacctgcaccacgagaacccagccctgggccgggagcggggcggccgggaggccggccctgcccaccctggccgggagaaggaggccggctacagcgctgctgtgggcgtgggcccccggcccccccgggagcggggccagctgagcagaggagccagccgcagcagcagccctggagctgggggcggccacagcaccagcaccagcaccagccctgccaccaccctgcagagaaatgtggagggagatgcccctggcagtgacctgagcacagctgtggacagccctggcagccagcccccctaccgcctgagccagctgccccccagcagcagccacatgggcggccccccagctggggtgggcctgccctgggcccagagggcccggctgcagcctgcctctgtggccctgaggaagcaggaggaggaggagatcaagaggagcaaggccctgagtgacagctatgagctgagcacagacctgcaggacaagaaggtggagatgctggagaggaaatatggaggcagcttcctgagccggcgggccgcccggaccatccagacagccttccggcagtacaggatgaacaagaactttgagcggctgcggagcagcgccagcgagagcaggatgagccgccgcatcatcctgagcaacatgaggatgcagttctcctttgaggagtatgagaaggcccagaacccagcctactttgagggcaagccagccagcctggatgagggcgccatggccggggcccggagccaccggctggagcggggcctgccctacggcggcagctgtggcggcggcattgatggcggcggcagctctgtgaccaccagcggggagttcagcaatgacatcacagagctggaggacagcttcagcaagcaggtgaagagcctggccgagagcattgatgaggccctgaactgccaccccagcggccccatgtctgaggagcccggcagcgcccagctggagaagcgggagagcaaggagcagcaggaggacagcagcgccaccagcttcagtgacctgcccctgtacctggatgacacagtgccccagcagagccctgagcggctgcccagcacagagcccccaccccagggccggcctgagttctgggccccagcccccctgccccctgtgcccccacctgtgcccagcggcacccgggaggatggcagccgggaggagggcacccggcggggccctggctgcctggagtgccgggacttccggctgcgggccgcccacctgcccctgctgaccatcgagccccccagcgacagctctgtggacctgagtgacagaagtgaccggggctctgtgcaccggcagctggtgtatgaagcagatggctgcagcccccacggcaccctgaagcacaagggccccccaggccgggcccccatcccccaccgccactacccagcccctgagggccctgccccagcccctcctggccccctgcccccagcccccaacagcggcaccggccccagcggcgtggccggcggccgccgcctgggcaaatgtgaggccgctggagaaaattctgatggaggagacaatgaaagcctggagagcagcagcaacagcaatgagaccatcaactgcagcagcggcagcagcagccgggacagcctgcgggagcccccagccaccggcctgtgcaagcagacctaccagcgggagaccaggcacagctgggacagccctgccttcaacaatgatgtggtgcagaggaggcactacagaattggcctgaacctcttcaacaagaagccagagaagggcatccagtacctgattgaaagaggcttcctgagtgacacccctgtgggcgtggcccacttcatcctggagaggaagggcctgagccggcagatgattggagagttcctgggcaaccggcagaagcagttcaacagagatgtgctggactgtgtggtggatgagatggacttcagctccatggacctggatgatgccctgaggaagttccagagccacatccgggtgcagggcgaggcccagaaggtggagcggctgattgaggccttcagccagcgctactgtgtgtgcaacccagccctggtgcggcagttcaggaacccagacaccatcttcatcctggcctttgccatcatcctgctgaacacagacatgtacagccccagcgtgaaggccgagaggaagatgaagctggatgacttcatcaagaacctgcggggcgtggacaacggggaggacatcccccgggacctgctggtgggcatctaccagaggatccagggccgggagctgcggaccaatgatgaccacgtgtcccaggtgcaggccgtggagaggatgattgtgggcaagaagcctgtgctgagcctgccccaccggcggctggtgtgctgctgccagctgtatgaggtgcctgaccccaaccggccccagaggctgggcctgcaccagcgggaggtgttcctgttcaatgacctgctggtggtgaccaagatcttccagaagaagaagatcctggtgacctacagcttccggcagagcttccccctggtggagatgcacatgcagctgttccagaacagctactaccagtttggcatcaagctgctgtctgctgtgcctggaggagagaggaaggtgctgatcatcttcaatgcccccagcctgcaggaccggctgcgcttcaccagtgacctgcgggagagcattgctgaggtgcaggagatggagaagtacagagtggagagcgagctggagaagcagaagggcatgatgaggcccaatgccagccagcctggaggagccaaggacagcgtgaatggcaccatggcccggagcagcctggaggacacctatggagctggagatggcctgaagagaggagccctgagcagcagcctgcgggacctgagtgatgctgggaagagaggaagaagaaacagcgtgggcagcctggacagcaccatcgagggcagcgtcatcagcagcccccggccccaccagaggatgcctcctcctcctcctcctcctcctcctgaggagtacaagagccagaggcctgtgagcaacagcagcagcttcctgggcagcctgtttggcagcaagaggggcaagggccccttccagatgcctcctccacccaccggccaggccagcgccagcagcagcagcgccagcagcacccaccaccaccaccaccaccaccaccacggccacagccatggaggcctgggcgtgctgcctgatggccagagcaagctgcaggccctgcacgcccagtactgccagggccctggccctgcccccccaccctacctgcccccccagcagcccagcctgcccccaccaccccagcagcccccacccctgccccagctgggcagcatccccccacctccagccagcgcccctcctgtgggcccccaccgccacttccacgcccacggccctgtgcccggcccccagcactacaccctgggccggcccggccgggcccccaggagaggagctgggggccacccccagtttgccccccacggccgccaccccctgcaccagcccaccagccccctgcccctgtacagccctgccccccagcaccccccagcccacaagcagggccccaagcacttcatcttcagccaccacccccagatgatgcctgctgctggagctgctgggggccctggcagccggcccccaggcggcagctacagccacccccaccacccccagagccccctgagcccccacagccccatccccccccaccccagctacccacccctgcccccacccagcccccacaccccccacagccccctgccccccaccagcccccacggccccctgcacgccagcggccccccaggcacagccaacccccccagcgccaaccccaaggccaagcccagccgcatcagcacagtggtgtag

SEQ ID NO: 156568 - DNA, 4467 bp, Artificial Sequence
  Description of Artificial Sequence: Synthetic coding sequence
atggaggccggcagcggccccccaggcggccctggcagcgagagccccaacagagctgtggagtacctgctggagctgaacaacatcatcgagagccagcagcagctgctggagacccagaggcggcgcatcgaggagctggagggccagctggaccagctgacccaggagaacagagacctgcgggaggagagccagctgcacagaggagagctgcaccgggacccccatggagcccgggacagccctggccgggagagccagtaccagaacctgcgggagacccagttccaccaccgggagctgcgggagagccagttccaccaggccgccagagatgtgggctaccccaaccgggagggcgcctaccagaaccgggaggccgtgtacagagacaaggagagagatgccagctaccccctgcaggacaccaccggctacacagcccgggagagagatgtggcccagtgccacctgcaccacgagaacccagccctgggccgggagcggggcggccgggaggccggccctgcccaccctggccgggagaaggaggccggctacagcgctgctgtgggcgtgggcccccggcccccccgggagcggggccagctgagcagaggagccagccgcagcagcagccctggagctgggggcggccacagcaccagcaccagcaccagccctgccaccaccctgcagaggaagagtgatggagagaacagcaggacagtgtctgtggagggagatgcccctggcagtgacctgagcacagctgtggacagccctggcagccagcccccctaccgcctgagccagctgccccccagcagcagccacatgggcggccccccagctggggtgggcctgccctgggcccagagggcccggctgcagcctgcctctgtggccctgaggaagcaggaggaggaggagatcaagaggagcaaggccctgagtgacagctatgagctgagcacagacctgcaggacaagaaggtggagatgctggagaggaaatatggaggcagcttcctgagccggcgggccgcccggaccatccagacagccttccggcagtacaggatgaacaagaactttgagcggctgcggagcagcgccagcgagagcaggatgagccgccgcatcatcctgagcaacatgaggatgcagttctcctttgaggagtatgagaaggcccagaacccagcctactttgagggcaagccagccagcctggatgagggcgccatggccggggcccggagccaccggctggagcggggcctgccctacggcggcagctgtggcggcggcattgatggcggcggcagctctgtgaccaccagcggggagttcagcaatgacatcacagagctggaggacagcttcagcaagcaggtgaagagcctggccgagagcattgatgaggccctgaactgccaccccagcggccccatgtctgaggagcccggcagcgcccagctggagaagcgggagagcaaggagcagcaggaggacagcagcgccaccagcttcagtgacctgcccctgtacctggatgacacagtgccccagcagagccctgagcggctgcccagcacagagcccccaccccagggccggcctgagttctgggccccagcccccctgccccctgtgcccccacctgtgcccagcggcacccgggaggatggcagccgggaggagggcacccggcggggccctggctgcctggagtgccgggacttccggctgcgggccgcccacctgcccctgctgaccatcgagccccccagcgacagctctgtggacctgagtgacagaagtgaccggggctctgtgcaccggcagctggtgtatgaagcagatggctgcagcccccacggcaccctgaagcacaagggccccccaggccgggcccccatcccccaccgccactacccagcccctgagggccctgccccagcccctcctggccccctgcccccagcccccaacagcggcaccggccccagcggcgtggccggcggccgccgcctgggcaaatgtgaggccgctggagaaaattctgatggaggagacaatgaaagcctggagagcagcagcaacagcaatgagaccatcaactgcagcagcggcagcagcagccgggacagcctgcgggagcccccagccaccggcctgtgcaagcagacctaccagcgggagaccaggcacagctgggacagccctgccttcaacaatgatgtggtgcagaggaggcactacagaattggcctgaacctcttcaacaagaagccagagaagggcatccagtacctgattgaaagaggcttcctgagtgacacccctgtgggcgtggcccacttcatcctggagaggaagggcctgagccggcagatgattggagagttcctgggcaaccggcagaagcagttcaacagagatgtgctggactgtgtggtggatgagatggacttcagctccatggacctggatgatgccctgaggaagttccagagccacatccgggtgcagggcgaggcccagaaggtggagcggctgattgaggccttcagccagcgctactgtgtgtgcaacccagccctggtgcggcagttcaggaacccagacaccatcttcatcctggcctttgccatcatcctgctgaacacagacatgtacagccccagcgtgaaggccgagaggaagatgaagctggatgacttcatcaagaacctgcggggcgtggacaacggggaggacatcccccgggacctgctggtgggcatctaccagaggatccagggccgggagctgcggaccaatgatgaccacgtgtcccaggtgcaggccgtggagaggatgattgtgggcaagaagcctgtgctgagcctgccccaccggcggctggtgtgctgctgccagctgtatgaggtgcctgaccccaaccggccccagaggctgggcctgcaccagcgggaggtgttcctgttcaatgacctgctggtggtgaccaagatcttccagaagaagaagatcctggtgacctacagcttccggcagagcttccccctggtggagatgcacatgcagctgttccagaacagctactaccagtttggcatcaagctgctgtctgctgtgcctggaggagagaggaaggtgctgatcatcttcaatgcccccagcctgcaggaccggctgcgcttcaccagtgacctgcgggagagcattgctgaggtgcaggagatggagaagtacagagtggagagcgagctggagaagcagaagggcatgatgaggcccaatgccagccagcctggaggagccaaggacagcgtgaatggcaccatggcccggagcagcctggaggacacctatggagctggagatggcctgaagagaggagccctgagcagcagcctgcgggacctgagtgatgctgggaagagaggaagaagaaacagcgtgggcagcctggacagcaccatcgagggcagcgtcatcagcagcccccggccccaccagaggatgcctcctcctcctcctcctcctcctcctgaggagtacaagagccagaggcctgtgagcaacagcagcagcttcctgggcagcctgtttggcagcaagaggggcaagggccccttccagatgcctcctccacccaccggccaggccagcgccagcagcagcagcgccagcagcacccaccaccaccaccaccaccaccaccacggccacagccatggaggcctgggcgtgctgcctgatggccagagcaagctgcaggccctgcacgcccagtactgccagggccctggccctgcccccccaccctacctgcccccccagcagcccagcctgcccccaccaccccagcagcccccacccctgccccagctgggcagcatccccccacctccagccagcgcccctcctgtgggcccccaccgccacttccacgcccacggccctgtgcccggcccccagcactacaccctgggccggcccggccgggcccccaggagaggagctgggggccacccccagtttgccccccacggccgccaccccctgcaccagcccaccagccccctgcccctgtacagccctgccccccagcaccccccagcccacaagcagggccccaagcacttcatcttcagccaccacccccagatgatgcctgctgctggagctgctgggggccctggcagccggcccccaggcggcagctacagccacccccaccacccccagagccccctgagcccccacagccccatccccccccaccccagctacccacccctgcccccacccagcccccacaccccccacagccccctgccccccaccagcccccacggccccctgcacgccagcggccccccaggcacagccaacccccccagcgccaaccccaaggccaagcccagccgcatcagcacagtggtgtag

SEQ ID NO: 156569 - DNA, 3549 bp, Artificial Sequence
  Description of Artificial Sequence: Synthetic coding sequence
atggagagcctgctggagaaccctgtgcgggctgtgctgtacctgaaggagctgacagccatcgtgcagaaccagcagagcctcatccacacccagcgggagagaattgatgagctggagcggcggctggatgagctgtctgcagaaaatagaagcctgtgggagcaccagcagctgctgcaggcccagcccccacctggcctggtgccccccagcagcgcccccctgcctgctgccccagccacagccccagctgctgctgcccgggcccaggagcccctgcaggaccagggccagaggtctgctgctgccccccacccagccccagaccggcccccccggcagcaccacggccagctgctggagcagccccagaggggccctggcagccgggcccacaccccccagagcccccacaagcacctgggcacccagggcgctgtgacagacaaggagaaggagcggccccccagctgctgtgccgctgctggggccctgctgcagcacaagagccccagcgccctgggcaaaggagtgctgagccggcggccagaaaatgagaccgtgctgcaccagttctgctgcccagctgctgatgcctgcagcgacctggccagccagagtgatggcagctgcacccaggccggcggcggcatggaggacagcgtggtggccgctgctgctgtggccgccggccggcccagcgcccacgcccccaaggcccaggcccaggagctgcaggaggaggaggagaggcctggagctggagctgccagcccccgggccggcccccagcacaaggccagccctggccggcagcagcctgccctggccacagccctgtgcccccacgccccagctgccagtgactatgagctgagcctggacctgaagaacaagcagatcgagatgctggagcacaagtatggaggccacctggtgtcccggcgggccgcctgcaccatccagacagccttccggcagtaccagctgagcaagaactttgagaagatccggaacagcctgctggagagccggctgccccggcgcatcagcctgaggaaggtgcgcagccccacagctgagagcctggccgctgagaaggccctgatggagggctacggcctggtgggcctgcccctggtgcgcagccccagcctgccccccacctttgctggcaccctgacagagctggaggacagcttcacagagcaggtgcagagcctggccaagagcattgatgatgccctgagcacctggagcctgaagaccatgtgcagcctgcgggagagcggggcctaccagctgcaccaggccctgcaggccgccgccggccccccaggcctggaggccgagggccgggcccctgagagcgctggccctggccctggagatgatgctgctgagaccccaggcctgcccccagcccacagcggcaccctgatgatggccttcagagatgtgacagtgcagatcgccaaccagaacatctctgtgagcagcagcacagccctgtctgtggccaactgcctgggcgcccagacagtgcaggccccagctgagcctgctgctgggaaggccgagcagggcgagaccagcggccgggaggcccctgaggccccagctgtgggccgggaggatgccagcgctgaggacagctgtgccgaggccgccgccagcggggctgctgatggagccacagcccccaagacagaggaggaggaggaggaggaggagacagctgaggtgggcagaggagctgaggccgaggccggggacctggagcagctgagcagcagcagcaccagcaccaagagcgccaagagcggcagcgaggccagcgccagcgccagcaaggatgccctgcaggccatgatcctgagcctgccccgctaccactgtgaaaatcctgccagctgcaagagccccaccctgagcacagacaccctgaggaagaggctgtacagaattggcctgaacctcttcaacatcaacccagacaagggcatccagttcctgatcagccggggcttcatcccagacacccccatcggcgtggcccacttcctgctgcagaggaagggcctgagccggcagatgattggagagttcctgggcaacagcaagaagcagttcaacagagatgtgctggactgtgtggtggatgagatggacttcagctccatggagctggatgaggccctgaggaagttccaggcccacatccgggtgcagggcgaggcccagaaggtggagcggctgattgaggccttcagccagcgctactgcatgtgcaaccctgaggtggtgcagcagttccacaacccagacaccatcttcatcctggcctttgccatcatcctgctgaacacagacatgtacagccccaacatcaagccagacaggaagatgatgctggaggacttcatccggaacctgcggggcgtggatgatggagctgacatcccccgggagctggtggtgggcatctatgagcgcatccagcagaaggagctgaagagcaatgaagatcatgtgacctacgtgaccaaggtggagaagagcatcgtgggcatgaagacagtgctgtctgtgccccaccggcggctggtgtgctgcagccggctgtttgaggtgacagatgtgaacaagctgcagaagcaggccgcccaccagcgggaggtgttcctgttcaatgacctgctggtgatcctgaagctgtgccccaagaagaagagcagcagcacctacaccttctgcaagtctgtgggcctgctgggcatgcagttccagctgtttgaaaatgagtactacagccacggcatcaccctggtgacccccctgagcggcagcgagaagaagcaggtgctgcacttctgtgccctgggcagtgatgagatgcagaagtttgtggaggacctgaaggagagcattgctgaggtgacagagctggagcagatcagaattgagtgggagctggagaagcagcagggcaccaagaccctgtccttcaagccctgtggggcccagggcgacccccagagcaagcagggcagccccacagccaagcgggaggccgccctgcgggagaggcctgctgagagcacagtggaggtgtccatccacaaccggctgcagaccagccagcacaacagcggcctgggcgctgagcggggggcccctgtgcccccaccagacctgcagcccagccccccccggcagcagaccccacccctgcccccacctccacccaccccacctggcaccctggtgcagtgccagcagatcgtgaaggtgattgtgctggacaagccctgcctggccaggatggagcccctgctgagccaggccctgagctgctacaccagcagcagcagtgacagctgtggcagcacccccctgggcggccctggcagccctgtgaaggtgacccaccagccccccctgcccccacctcctccaccctacaaccacccccaccagttctgccccccaggcagcctgctgcacggccaccgctacagcagcggcagccgcagcctggtgtag

SEQ ID NO: 156570 - DNA, 2280 bp, Artificial Sequence
  Description of Artificial Sequence: Synthetic coding sequence
atgctggagcacaagtatggaggccacctggtgtccagaagagctgcctgcaccatccagacagccttccggcagtaccagctgagcaagaactttgagaagatccggaacagcctgctggagagccggctgccccggcgcatcagcctgaggaaggtgcgcagccccacagctgagagcctggccgctgagaaggccctgatggagggctacggcctggtgggcctgcccctggtgcgcagccccagcctgccccccacctttgctggcaccctgacagagctggaggacagcttcacagagcaggtgcagagcctggccaagagcattgatgatgccctgagcacctggagcctgaagaccatgtgcagcctgcgggagagcggggcctaccagctgcaccaggccctgcaggccgctgctggccccccaggcctggaggccgagggccgggcccctgagagcgctggccctggccctggagatgatgctgctgagaccccaggcctgcccccagcccacagcggcaccctgatgatggccttcagagatgtgacagtgcagatcgccaaccagaacatctctgtgagcagcagcacagccctgtctgtggccaactgcctgggcgcccagacagtgcaggccccagctgagcctgctgctgggaaggccgagcagggcgagaccagcggccgggaggcccctgaggccccagctgtgggcagagaagatgccagcgctgaggacagctgtgccgaggccgccgccagcggggctgctgatggagccacagcccccaagacagaggaggaggaggaggaggaggagacagctgaggtgggccgcggggctgaggccgaggccggggacctggagcagctgagcagcagcagcaccagcaccaagagcgccaagagcggcagcgaggccagcgccagcgccagcaaggatgccctgcaggccatgatcctgagcctgccccgctaccactgtgagaacccagccagctgcaagagccccaccctgagcacagacaccctgaggaagaggctgtaccgcatcggcctgaacctcttcaacatcaacccagacaagggcatccagttcctgatcagccggggcttcatcccagacacccccatcggcgtggcccacttcctgctgcagaggaagggcctgagccggcagatgattggagagttcctgggcaacagcaagaagcagttcaacagagatgtgctggactgtgtggtggatgagatggacttcagctccatggagctggatgaggccctgaggaagttccaggcccacatccgggtgcagggcgaggcccagaaggtggagcggctcatcgaggccttcagccagcgctactgcatgtgcaaccctgaggtggtgcagcagttccacaacccagacaccatcttcatcctggcctttgccatcatcctgctgaacacagacatgtacagccccaacatcaagccagacaggaagatgatgctggaggacttcatccggaacctgcggggcgtggatgatggagctgacatcccccgggagctggtggtgggcatctatgaaagaatccagcagaaggagctgaagagcaatgaagaccacgtgacctacgtgaccaaggtggagaagagcatcgtgggcatgaagacagtgctgtctgtgccccaccggcggctggtgtgctgcagccggctgtttgaggtgacagatgtgaacaagctgcagaagcaggccgcccaccagcgggaggtgttcctgttcaatgacctgctggtgatcctgaagctgtgccccaagaagaagagcagcagcacctacaccttctgcaagtctgtgggcctgctgggcatgcagttccagctgtttgaaaatgagtactacagccacggcatcaccctggtgacccccctgagcggcagcgagaagaagcaggtgctgcacttctgtgccctgggcagtgatgagatgcagaagtttgtggaggacctgaaggagagcattgctgaggtgacagagctggagcagatccgcatcgagtgggagctggagaagcagcagggcaccaagaccctgtccttcaagccctgtggggcccagggcgacccccagagcaagcagggcagccccacagccaagcgggaggccgccctgcgggagaggcctgctgagagcacagtggaggtgctgatcaatgccagccctgcccggctgaccatcctgcccatcagccgggacaccatcaagagctactgctag

SEQ ID NO: 156571 - DNA, 3549 bp, Artificial Sequence; identical to SEQ ID NO: 156569
  Description of Artificial Sequence: Synthetic coding sequence

SEQ ID NO: 156572 - DNA, 1797 bp, Artificial Sequence
  Description of Artificial Sequence: Synthetic coding sequence
atgaagcccaccggcacagacccccgcatcctgagcattgctgctgaggtggccaagagccctgagcagaatgtgcctgtgatcctgctgaagctgaaggagatcatcaacatcacccccctgggcagcagcgagctgaagaagatcaagcaggacatctactgctatgacctgatccagtactgcctgctggtgctgagccaggactacagccgcatccagggcggctggaccaccatcagccagctgacccagatcctgagccactgctgcgtgggcctggagcccggggaggatgctgaggagttctacaatgagctgctgcccagcgctgctgagaacttcctggtgctgggccggcagctgcagacctgcttcatcaatgctgccaaggccgaggagaaggatgagctgctgcacttcttccagatcgtgacagacagcctcttctggctgctgggcggccacgtggagctgatccagaatgtgctgcagagcgaccacttcctgcacctgctgcaggccgacaacgtgcagatcggcagcgctgtgatgatgatgctgcagaacatcctgcagatcaacagcggggacctgctgcgcatcggcaggaaggccctgtacagcatcctggatgaggtgatcttcaagctgttcagcacccccagccctgtgatccgcagcacagccaccaagctgctgctgctgatggccgagagccaccaggagatcctgatcctgctgcggcagagcacctgctacaagggcctgcggcggctgctgagcaagcaggagaccggcacagagttcagccaggagctgcggcagctggtgggcctgctgagccccatggtgtaccaggaggtggaggagcagaagctgcaccaggccgcctgcctgatccaggcctactggaagggcttccagaccaggaagaggctgaagaagctgcccagcgctgtgattgccctgcagaggagcttccgcagcaagaggagcaagatgctgctggagatcaaccggcagaaggaggaggaggacctgaagctgcagctgcagctgcagaggcagagggccatgaggctgagccgggagctgcagctgtccatgctggagatcgtgcaccctggccaggtggagaagcactaccgggagatggaggagaagagcgccctgatcatccagaagcactggaggggctaccgggagaggaagaacttccaccagcagaggcagagcctgattgagtacaaggctgctgtgaccctgcagagagctgccctgaagttcctggccaagtgcaggaagaagaagaagctgtttgccccctggaggggcctgcaggagctgacagatgcccggcgggtggagctgaagaagagggtggatgattatgtgagaagacacctgggcagccccatgtctgatgtggtgtcccgggagctgcacgcccaggcccaggagcggctgcagcactacttcatgggccgggccctggaggagcgggcccagcagcaccgggaggccctgattgcccagatcagcaccaacgtggagcagctgatgaaggcccccagcctgaaggaggccgagggcaaggagcctgagctgttcctgagccgcagcaggcctgtggccgccaaggccaagcaggcccacctgaccaccctgaagcacatccaggccccctggtggaagaagctgggggaggagagcggagatgaaattgatgtgcccaaggatgagctgagcattgagctggagaacctcttcatcggcggcaccaagcccccatag

SEQ ID NO: 156573 - DNA, 1398 bp, Artificial Sequence
  Description of Artificial Sequence: Synthetic coding sequence
atgaagcccaccggcacagacccccgcatcctgagcattgctgctgaggtggccaagagccctgagcagaatgtgcctgtgatcctgctgaagctgaaggagatcatcaacatcacccccctgggcagcagcgagctgaagaagatcaagcaggacatctactgctatgacctgatccagtactgcctgctggtgctgagccaggactacagccgcatccagggcggctggaccaccatcagccagctgacccagatcctgagccactgctgcgtgggcctggagcccggggaggatgctgaggagttctacaatgagctgctgcccagcgctgctgagaacttcctggtgctgggccggcagctgcagacctgcttcatcaatgctgccaaggccgaggagaaggatgagctgctgcacttcttccagatcgtgacagacagcctcttctggctgctgggcggccacgtggagctgatccagaatgtgctgcagagcgaccacttcctgcacctgctgcaggccgacaacgtgcagatcggcagcgctgtgatgatgatgctgcagaacatcctgcagatcaacagaagcaagaggagcaagatgctgctggagatcaaccggcagaaggaggaggaggacctgaagctgcagctgcagctgcagaggcagagggccatgaggctgagccgggagctgcagctgtccatgctggagatcgtgcaccctggccaggtggagaagcactaccgggagatggaggagaagagcgccctgatcatccagaagcactggaggggctaccgggagaggaagaacttccaccagcagaggcagagcctcatcgagtacaaggctgctgtgaccctgcagagagctgccctgaagttcctggccaagtgcaggaagaagaagaagctgtttgccccctggaggggcctgcaggagctgacagatgccaggagagtggagctgaagaagagggtggatgattatgtgcggcggcacctgggcagccccatgtctgatgtggtgtcccgggagctgcacgcccaggcccaggagcggctgcagcactacttcatgggccgggccctggaggagcgggcccagcagcaccgggaggccctgattgcccagatcagcaccaacgtggagcagctgatgaaggcccccagcctgaaggaggccgagggcaaggagcctgagctgttcctgagccgcagcaggcctgtggccgccaaggccaagcaggcccacctgaccaccctgaagcacatccaggccccctggtggaagaagctgggggaggagagcggagatgaaattgatgtgcccaaggatgagctgagcattgagctggagaacctcttcatcggcggcaccaagccaccctag

SEQ ID NO: 156574 - DNA, 264 bp, Artificial Sequence
  Description of Artificial Sequence: Synthetic coding sequence
atgaagcccaccggcacagacccccgcatcctgagcattgctgctgaggtggccaagagccctgagcagaatgtgcctgtgatcctgctgaagctgaaggagatcatcaacatcacccccctgggcagcagcgagctgaagaagatcaagcaggacatctactgctatgacctgatccagtactgcctgctggtgctgagccaggactacagccgcatccagggcggctggaccaccatcagccagctgacccagatcctgtag

SEQ ID NO: 156575 - DNA, 1332 bp, Artificial Sequence
  Description of Artificial Sequence: Synthetic coding sequence
atggaggaggacagcctggaggacagcaacctgccccccaaggtgtggcacagcgagatgacagtgtctgtgactggagagccccccagcacagtggaggaggagggcatccccaaggagacagacatcgagatcatccctgagatccctgagaccctggagcccctgagcctgcctgatgtgctgcgcatctctgctgtgctggaggacaccacagaccagctgagcatcctgaactacatcatgcctgtgcagtatgagggccggcagagcatctgtgtgaagagccgggagatgaacctggagggcaccaacctggacaagctgcccatggccagcaccatcaccaagatccccagccccctcatcacagaggagggccccaacctgcctgagatccgccaccggggccgctttgctgtggagttcaacaagatgcaggacctggtgttcaagaagcccacccggcagaccatcatgaccacagagaccctgaagaagatccagattgaccggcagttcttcagtgatgtgattgctgacaccatcaaggagctgcaggacagcgccacctacaacagcctgctgcaggccctgagcaaggagcgggagaacaagatgcacttctatgacatcatcgcccgggaggagaagggcaggaagcagatcatcagcctgcagaagcagctgatcaacgtgaagaaggagtggcagtttgaggtgcagagccagaatgagtacatcgccaacctgaaggaccagctgcaggagatgaaggccaagagcaacctggagaaccgctacatgaagaccaacacagagctgcagatcgcccagacccagaagaagtgcaacagaacagaggagctgctggtggaggagattgagaagctgaggatgaagacagaggaggaggcccggacccacacagaaattgagatgttcctgaggaaggagcagcagaagctggaggagcggctggagttctggatggagaagtatgacaaggacacagagatgaagcagaatgagctgaatgccctgaaggccaccaaggccagtgacctggcccacctgcaggacctggccaagatgatccgggagtatgagcaggtgatcattgaagatcgcatcgagaaggagaggagcaagaagaaggtgaagcaggacctgctggagctgaagagcgtcatcaagctgcaggcctggtggaggggcaccatgatccggcgggagattggaggcttcaagatgcccaaggacaaggtggacagcaaggacagcaagggcaagggcaagggcaaggacaagaggcggggcaagaagaagtag

SEQ ID NO: 156576 - DNA, 165 bp, Artificial Sequence
  Description of Artificial Sequence: Synthetic coding sequence
atggaggaggacagcctggaggacagcaacctgccccccaaggtgtggcacagcgagatgacagtgtctgtgactggagagccccccagcacagtggaggaggagggcatccccaaggagacagacatcgagatcatccctgagatccctgagaccctggagtag

SEQ ID NO: 156577 - DNA, 1332 bp, Artificial Sequence; identical to SEQ ID NO: 156575
  Description of Artificial Sequence: Synthetic coding sequence

SEQ ID NO: 156578 - DNA, 4974 bp, Artificial Sequence
  Description of Artificial Sequence: Synthetic coding sequence
atgtctgctgctgatgaggtggatggcctgggcgtggcccggccccactacggctctgtgctggacaatgaaaggctgacagctgaggagatggatgagcggcggcggcagaatgtggcctatgagtacctgtgccacctggaggaggccaagcgctggatggaggcctgcctgggggaggacctgccccccaccacagagctggaggagggcctgagaaatggagtgtacctggccaagctgggcaacttcttcagccccaaggtggtgtccctgaagaagatctatgaccgggagcagacccgctacaaggccaccggcctgcacttccgccacacagacaacgtcatccagtggctgaatgccatggatgagatcggcctgcccaagatcttctacccagagaccacagacatctatgacaggaagaacatgccccgctgcatctactgcatccacgccctgagcctgtacctgttcaagctgggcctggccccccagatccaggacctgtatggcaaggtggacttcacagaggaggagatcaacaacatgaagacagagctggagaagtatggcatccagatgcctgccttcagcaagattggaggcatcctggccaatgagctgtctgtggatgaagctgccctgcatgctgctgtgattgccatcaatgaggccatcgaccggcgcatcccagctgacacctttgctgccctgaagaaccccaatgccatgctggtgaacctggaggagcccctggccagcacctaccaggacatcctgtaccaggccaagcaggacaagatgaccaatgccaagaacagaacagagaacagcgagcgggagagagatgtgtatgaggagctgctgacccaggccgagatccagggcaacatcaacaaggtgaacaccttcagcgccctggccaacatcgacctggccctggagcagggagatgccctggccctcttccgggccctgcagagccctgccctgggcctgcggggcctgcagcagcagaacagcgactggtacctgaagcagctgctgagtgacaagcagcagaagaggcagagcggccagacagaccccctgcagaaggaggagctgcagagcggcgtggatgctgccaacagcgctgcccagcagtaccagaggcggctggccgctgtggccctgatcaatgctgccatccagaagggcgtggccgagaagacagtgctggagctgatgaaccctgaggcccagctgccccaggtgtacccctttgctgctgacctgtaccagaaggagctggccaccctgcagaggcagagccctgagcacaacctgacccaccctgagctgtctgtggccgtggagatgctgagctctgtggccctgatcaacagagccctggagagcggagatgtgaacacagtgtggaagcagctgagcagctctgtgacaggcctgaccaacatcgaggaggagaactgccagcgctacctggatgagctgatgaagctgaaggcccaggcccacgcagaaaataatgagttcatcacctggaatgacatccaggcctgtgtggaccacgtgaacctggtggtgcaggaggagcacgagcgcatcctggccatcggcctcatcaatgaggccctggatgaaggagatgcccagaagaccctgcaggccctgcagatcccagctgccaagctggagggcgtgctggccgaggtggcccagcactaccaggacaccctcatccgggccaagcgggagaaggcccaggagatccaggatgagagcgctgtgctgtggctggatgagatccagggcggcatctggcagagcaacaaggacacccaggaggcccagaagtttgccctgggcatctttgccatcaatgaagctgtggagagcggagatgtgggcaagaccctgagcgccctgcggagcccagatgtgggcctgtatggagtcatcccagaatgtggggagacctaccacagcgacctggccgaggccaagaagaagaagctggccgtgggggacaacaacagcaagtgggtgaagcactgggtgaagggcggctactactactaccacaacctggagacccaggagggcggctgggatgagccccccaactttgtgcagaacagcatgcagctgagccgggaggagatccagagcagcatcagcggcgtgacagctgcctacaaccgggagcagctgtggctggccaatgaaggcctcatcacccggctgcaggcccgctgccggggctacctggtgcggcaggagttccgcagcaggatgaacttcctgaagaagcagatcccagccatcacctgcatccagagccagtggaggggctacaagcagaagaaggcctaccaggaccggctggcctacctgcggagccacaaggatgaggtggtgaagatccagagcctggccaggatgcaccaggccaggaagcgctacagagaccggctgcagtacttccgggaccacatcaatgacatcatcaagatccaggccttcatccgggccaacaaggccagagatgactacaagaccctcatcaatgctgaggacccccccatggtggtggtgaggaagtttgtgcacctgctggaccagagcgaccaggacttccaggaggagctggacctgatgaagatgagggaggaggtgatcaccctcatccgcagcaaccagcagctggagaatgacctgaacctgatggacatcaagattggcctgctggtgaagaacaagatcaccctgcaggatgtggtgagccacagcaagaagctgaccaagaagaacaaggagcagctgagtgacatgatgatgatcaacaagcagaagggcggcctgaaggccctgagcaaggagaagcgggagaagctggaggcctaccagcacctgttctacctgctgcagaccaaccccacctacctggccaagctgatcttccagatgccccagaacaagagcaccaagttcatggacagcgtcatcttcaccctgtacaactatgccagcaaccagcgggaggagtacctgctgctgcggctcttcaagacagccctgcaggaggagatcaagagcaaggtggaccagatccaggagatcgtgacaggcaaccccaccgtcatcaagatggtggtgtccttcaacagaggagcccggggccagaatgccctgcggcagatcctggcccctgtggtgaaggagatcatggatgacaagagcctgaacatcaagacagatcctgtggacatctacaagtcctgggtgaaccagatggagagccagacaggagaggccagcaagctgccctatgatgtgaccccagagcaggccctggcccacgaggaggtgaagacccggctggacagcagcatccggaacatgagagctgtgacagacaagttcctgagcgccatcgtgtcctctgtggacaagatcccctacggcatgaggttcatcgccaaggtgctgaaggacagcctgcacgagaagttcccagatgctggggaggatgagctgctgaagatcatcggcaacctgctgtactaccgctacatgaacccagccatcgtggccccagatgcctttgacatcatcgacctgtctgctgggggccagctgaccacagaccagaggaggaacctgggcagcatcgccaagatgctgcagcacgccgccagcaacaagatgttcctgggggacaatgcccacctgagcatcatcaatgagtacctgagccagagctaccagaagttccgccgcttcttccagacagcctgtgatgtgcctgagctgcaggacaagttcaacgtggatgagtacagcgacctggtgaccctgaccaagcctgtgatctacatcagcattggagagatcatcaacacccacaccctgctgctggaccaccaggatgccatcgcccctgagcacaatgaccccatccacgagctgctggatgacctgggggaggtgcccaccatcgagagcctgattggagagagcagcggcaacctgaatgaccccaacaaggaggccctggccaagacagaggtgtccctgaccctgaccaacaagtttgatgtgcctggagatgaaaatgctgagatggatgcccggaccatcctgctgaacaccaagaggctcatcgtggatgtgatccgcttccagcccggggagaccctgacagagatcctggagaccccagccaccagcgagcaggaggccgagcaccagagggccatgcagaggcgggccatcagagatgccaagaccccagacaagatgaagaagagcaagtctgtgaaggaggacagcaacctgaccctgcaggagaagaaggagaagatccagacaggcctgaagaagctgacagagctgggcaccgtggaccccaagaacaagtaccaggagctgatcaatgacatcgcccgggacatccggaaccagaggcgctaccggcagaggaggaaggccgagctggtgaagctgcagcagacctatgctgccctgaacagcaaggccaccttctacggggagcaggtggactactacaagagctacatcaagacctgcctggacaacctggccagcaagggcaaggtgtccaagaagccccgggagatgaagggcaagaagagcaagaagatcagcctgaagtacacagctgcccggctgcacgagaagggcgtgctgctggagattgaggacctgcaggtgaaccagttcaagaatgtcatctttgagatcagccccacagaggaggtgggggactttgaggtgaaggccaagttcatgggcgtgcagatggagaccttcatgctgcactaccaggacctgctgcagctgcagtatgaaggagtggccgtgatgaagctgtttgaccgggccaaggtgaatgtgaacctgctgatcttcctgctgaacaagaagttctacggcaagtag

SEQ ID NO: 156579 - DNA, 4728 bp, Artificial Sequence
  Description of Artificial Sequence: Synthetic coding sequence
atgcctcatgaggagctgcccagcctgcagaggcccaggtatggcagcatcgtggatgatgagcggctgtctgctgaggagatggatgaaagaagacggcagaacatcgcctatgagtacctgtgccacctggaggaggccaagcgctggatggaggtgtgcctggtggaggagctgccccccaccacagagctggaggagggcctgagaaatggagtgtacctggccaagctggccaagttctttgcccccaagatggtgtctgagaagaagatctatgatgtggagcagacccgctacaagaagagcggcctgcacttccgccacacagacaacacagtgcagtggctgcgggccatggagagcatcggcctgcccaagatcttctacccagagaccacagatgtgtatgacaggaagaacatccccaggatgatctactgcatccacgccctgagcctgtacctgttcaagctgggcatcgccccccagatccaggacctgctgggcaaggtggacttcacagaggaggagatcagcaacatgaggaaggagctggagaagtatggcatccagatgcccagcttcagcaagattggaggcatcctggccaatgagctgtctgtggatgaggccgccctgcacgccgctgtgattgccatcaatgaggccgtggagaagggcattgctgagcagacagtggtgaccctgaggaaccccaatgctgtgctgaccctggtggatgacaacctggcccctgagtaccagaaggagctgtgggatgccaagaagaagaaggaggagaatgcccggctgaagaacagctgcatcagcgaggaggagagagatgcctatgaggagctgctgacccaggccgagatccagggcaacatcaacaaggtgaaccggcaggccgctgtggaccacatcaatgctgtgattcctgagggggaccctgagaacaccctgctggccctgaagaagccagaggcccagctgcctgctgtgtacccctttgctgctgccatgtaccagaatgagctgttcaacctgcagaagcagaacaccatgaactacctggcccacgaggagctgctgattgctgtggagatgctgtctgctgtggccctgctgaaccaggccctggagagcaatgacctggtgtctgtgcagaaccagctgcggagccctgccatcggcctgaacaacctggacaaggcctacgtggagagatatgccaacaccctgctgtctgtgaagctggaggtgctgagccagggccaggacaacctgtcctggaatgagatccagaactgcatcgacatggtgaatgcccagatccaggaggagaatgacagagtggtggccgtgggctacatcaatgaggccattgatgagggcaaccccctgcggaccctggagaccctgctgctgcccacagccaacatcagtgatgtggaccctgcccacgcccagcactaccaggatgtgctgtaccacgccaagagccagaagctgggggacagcgagagcgtgtccaaggtgctgtggctggatgagatccagcaggccgtggatgatgccaacgtggacaaggaccgggccaagcagtgggtgaccctggtggtggatgtgaaccagtgcctggagggcaagaagagcagtgacatcctgtctgtgctgaagagcagcaccagcaatgccaatgacatcatcccagaatgtgccgacaagtactatgatgccctggtgaaggccaaggagctgaagtctgagcgggtgtccagtgatggctcctggctgaagctgaacctgcacaagaagtatgactactactacaacacagacagcaaggagagctcctgggtgaccccagagagctgcctgtacaaggagagctggctgaccgggaaggagattgaggacatcatcgaggaggtgacagtgggctacatccgggagaacatctggagcgccagcgaggagctgctgctgcgcttccaggccaccagcagcggccccatcctgcgggaggagtttgaggccaggaagagcttcctgcacgagcaggaggagaatgtggtgaagatccaggccttctggaagggctacaagcagaggaaggagtacatgcaccggcggcagaccttcatcgacaacacagacagcatcgtgaagatccagagctggttcaggatggccacagccaggaagagctacctgagccggctgcagtacttccgggaccacaacaatgagatcgtgaagatccagagcctgctgcgggccaacaaggccagagatgactacaagaccctggtgggctctgaaaatccacccctgaccgtcatcaggaagtttgtgtacctgctggaccagagcgacctggacttccaggaggagctggaggtggcccggctgcgggaggaggtggtgaccaagatccgggccaaccagcagctggagaaggacctgaacctgatggacatcaagattggcctgctggtgaagaaccgcatcaccctggaggatgtgatcagccacagcaagaagctgaacaagaagaagggcggggagatggagatcctgaacaacacagacaaccagggcatcaagagcctgagcaaggagaggaggaagaccctggagacctaccagcagctgttctacctgctgcagaccaaccccctgtacctggccaagctgatcttccagatgccccagaacaagagcaccaagttcatggacaccgtcatcttcaccctgtacaactatgccagcaaccagcgggaggagtacctgctgctgaagctgttcaagacagccctggaggaggagatcaagagcaaggtggaccaggtgcaggacatcgtgactggaaaccccaccgtcatcaagatggtggtgtccttcaacagaggagcccggggccagaacaccctgcggcagctgctggcccctgtggtgaaggagatcattgatgacaagagcctcatcatcaacaccaaccctgtggaggtgtacaaggcctgggtgaaccagctggagacccagacaggagaggccagcaagctgccctatgatgtgaccacagagcaggccctgacctacccagaggtgaagaacaagctggaggccagcattgagaacctgcggcgggtgacagacaaggtgctgaacagcatcatcagcagcctggacctgctgccctacggcctgcgctacatcgccaaggtgctgaagaacagcatccacgagaagttcccagatgccacagaagatgagctgctgaagatcgtgggcaacctgctgtactaccgctacatgaacccagccatcgtggccccagatggctttgacatcatcgacatgacagctgggggccagatcaacagcgaccagaggaggaacctgggctctgtggccaaggtgctgcagcacgccgccagcaacaagctgtttgaaggagaaaatgagcacctgagctccatgaacaactacctgtctgagacctaccaggagttcaggaagtacttcaaggaggcctgcaatgtgcctgagcctgaggagaagttcaacatggacaagtacacagacctggtgacagtgtccaagcctgtgatctacatcagcattgaggagatcatcagcacccacagcctgctgctggagcaccaggatgccatcgcccctgagaagaatgacctgctgtctgagctgctgggcagcctgggggaggtgcccaccgtggagagcttcctgggggagggcgctgtggaccccaatgaccccaacaaggccaacaccctgagccagctgagcaagacagagatcagcctggtgctgaccagcaaatatgacattgaagatggagaggccatcgacagccgcagcctgatgatcaagaccaagaagctgatcattgatgtgatccggaaccagcccggcaacaccctgacagagatcctggagaccccagccacagcccagcaggaggtggaccacgccacagacatggtgtcccgggccatgattgacagcaggaccccagaggagatgaagcacagccagagcatgattgaagatgcccagctgcccctggagcagaagaagaggaagatccagaggaacctgcggaccctggagcagacaggccacgtgtcctctgagaacaagtaccaggacatcctgaatgagatcgccaaggacatccggaaccagaggatctacaggaagctgaggaaggccgagctggccaagctgcagcagaccctgaatgccctgaacaagaaggccgccttctatgaggagcagatcaactactatgacacctacatcaagacctgcctggacaacctgaagaggaagaacaccaggaggagcatcaagctggatggaaaaggagagcccaagggggccaagagggccaagcctgtgaagtacacagctgccaagctgcacgagaagggcgtgctgctggacattgatgacctgcagaccaaccagttcaagaatgtgacctttgacatcatcgccacagaagatgtgggcatctttgatgtgcgcagcaagttcctgggcgtggagatggagaaggtgcagctgaacatccaggacctgctgcagatgcagtatgaaggagtggccgtgatgaagatgtttgacaaggtgaaggtgaatgtgaacctgctgatctacctgctgaacaagaagttctacggcaagtag

SEQ ID NO: 156580 - DNA, 3234 bp, Artificial Sequence
  Description of Artificial Sequence: Synthetic coding sequence
atggtgaatgcccagatccaggaggagaatgacagagtggtggccgtgggctacatcaatgaggccattgatgagggcaaccccctgcggaccctggagaccctgctgctgcccacagccaacatcagtgatgtggaccctgcccacgcccagcactaccaggatgtgctgtaccacgccaagagccagaagctgggggacagcgagagcgtgtccaaggtgctgtggctggatgagatccagcaggccgtggatgatgccaacgtggacaaggaccgggccaagcagtgggtgaccctggtggtggatgtgaaccagtgcctggagggcaagaagagcagtgacatcctgtctgtgctgaagagcagcaccagcaatgccaatgacatcatcccagaatgtgccgacaagtactatgatgccctggtgaaggccaaggagctgaagtctgagcgggtgtccagtgatggctcctggctgaagctgaacctgcacaagaagtatgactactactacaacacagacagcaaggagagctcctgggtgaccccagagagctgcctgtacaaggagagctggctgaccgggaaggagattgaggccttctggaagggctacaagcagaggaaggagtacatgcaccggcggcagaccttcatcgacaacacagacagcatcgtgaagatccagagctggttcaggatggccacagccaggaagagctacctgagccggctgcagtacttccgggaccacaacaatgagatcgtgaagatccagagcctgctgcgggccaacaaggccagagatgactacaagaccctggtgggctctgaaaatccacccctgaccgtcatcaggaagtttgtgtacctgctggaccagagcgacctggacttccaggaggagctggaggtggcccggctgcgggaggaggtggtgaccaagatccgggccaaccagcagctggagaaggacctgaacctgatggacatcaagattggcctgctggtgaagaaccgcatcaccctggaggatgtgatcagccacagcaagaagctgaacaagaagaagggcggggagatggagatcctgaacaacacagacaaccagggcatcaagagcctgagcaaggagaggaggaagaccctggagacctaccagcagctgttctacctgctgcagaccaaccccctgtacctggccaagctgatcttccagatgccccagaacaagagcaccaagttcatggacaccgtcatcttcaccctgtacaactatgccagcaaccagcgggaggagtacctgctgctgaagctgttcaagacagccctggaggaggagatcaagagcaaggtggaccaggtgcaggacatcgtgactggaaaccccaccgtcatcaagatggtggtgtccttcaacagaggagcccggggccagaacaccctgcggcagctgctggcccctgtggtgaaggagatcattgatgacaagagcctcatcatcaacaccaaccctgtggaggtgtacaaggcctgggtgaaccagctggagacccagacaggagaggccagcaagctgccctatgatgtgaccacagagcaggccctgacctacccagaggtgaagaacaagctggaggccagcattgagaacctgcggcgggtgacagacaaggtgctgaacagcatcatcagcagcctggacctgctgccctacggcctgcgctacatcgccaaggtgctgaagaacagcatccacgagaagttcccagatgccacagaagatgagctgctgaagatcgtgggcaacctgctgtactaccgctacatgaacccagccatcgtggccccagatggctttgacatcatcgacatgacagctgggggccagatcaacagcgaccagaggaggaacctgggctctgtggccaaggtgctgcagcacgccgccagcaacaagctgtttgaaggagaaaatgagcacctgagctccatgaacaactacctgtctgagacctaccaggagttcaggaagtacttcaaggaggcctgcaatgtgcctgagcctgaggagaagttcaacatggacaagtacacagacctggtgacagtgtccaagcctgtgatctacatcagcattgaggagatcatcagcacccacagcctgctgctggagcaccaggatgccatcgcccctgagaagaatgacctgctgtctgagctgctgggcagcctgggggaggtgcccaccgtggagagcttcctgggggagggcgctgtggaccccaatgaccccaacaaggccaacaccctgagccagctgagcaagacagagatcagcctggtgctgaccagcaaatatgacattgaagatggagaggccatcgacagccgcagcctgatgatcaagaccaagaagctgatcattgatgtgatccggaaccagcccggcaacaccctgacagagatcctggagaccccagccacagcccagcaggaggtggaccacgccacagacatggtgtcccgggccatgattgacagcaggaccccagaggagatgaagcacagccagagcatgattgaagatgcccagctgcccctggagcagaagaagaggaagatccagaggaacctgcggaccctggagcagacaggccacgtgtcctctgagaacaagtaccaggacatcctgaatgagatcgccaaggacatccggaaccagaggatctacaggaagctgaggaaggccgagctggccaagctgcagcagaccctgaatgccctgaacaagaaggccgccttctatgaggagcagatcaactactatgacacctacatcaagacctgcctggacaacctgaagaggaagaacaccaggaggagcatcaagctggatggaaaaggagagcccaagggggccaagagggccaagcctgtgaagtacacagctgccaagctgcacgagaagggcgtgctgctggacattgatgacctgcagaccaaccagttcaagaatgtgacctttgacatcatcgccacagaagatgtgggcatctttgatgtgcgcagcaagttcctgggcgtggagatggagaaggtgcagctgaacatccaggacctgctgcagatgcagtatgaaggagtggccgtgatgaagatgtttgacaaggtgaaggtgaatgtgaacctgctgatctacctgctgaacaagaagttctacggcaagtag

SEQ ID NO: 156581 - DNA, 3216 bp, Artificial Sequence
  Description of Artificial Sequence: Synthetic coding sequence
atgcacagcctgcccggggtggtggccgtgggctacatcaatgaggccattgatgagggcaaccccctgcggaccctggagaccctgctgctgcccacagccaacatcagtgatgtggaccctgcccacgcccagcactaccaggatgtgctgtaccacgccaagagccagaagctgggggacagcgagagcgtgtccaaggtgctgtggctggatgagatccagcaggccgtggatgatgccaacgtggacaaggaccgggccaagcagtgggtgaccctggtggtggatgtgaaccagtgcctggagggcaagaagagcagtgacatcctgtctgtgctgaagagcagcaccagcaatgccaatgacatcatcccagaatgtgccgacaagtactatgatgccctggtgaaggccaaggagctgaagtctgagcgggtgtccagtgatggctcctggctgaagctgaacctgcacaagaagtatgactactactacaacacagacagcaaggagagctcctgggtgaccccagagagctgcctgtacaaggagagctggctgaccgggaaggagattgaggccttctggaagggctacaagcagaggaaggagtacatgcaccggcggcagaccttcatcgacaacacagacagcatcgtgaagatccagagctggttcaggatggccacagccaggaagagctacctgagccggctgcagtacttccgggaccacaacaatgagatcgtgaagatccagagcctgctgcgggccaacaaggccagagatgactacaagaccctggtgggctctgaaaatccacccctgaccgtcatcaggaagtttgtgtacctgctggaccagagcgacctggacttccaggaggagctggaggtggcccggctgcgggaggaggtggtgaccaagatccgggccaaccagcagctggagaaggacctgaacctgatggacatcaagattggcctgctggtgaagaaccgcatcaccctggaggatgtgatcagccacagcaagaagctgaacaagaagaagggcggggagatggagatcctgaacaacacagacaaccagggcatcaagagcctgagcaaggagaggaggaagaccctggagacctaccagcagctgttctacctgctgcagaccaaccccctgtacctggccaagctgatcttccagatgccccagaacaagagcaccaagttcatggacaccgtcatcttcaccctgtacaactatgccagcaaccagcgggaggagtacctgctgctgaagctgttcaagacagccctggaggaggagatcaagagcaaggtggaccaggtgcaggacatcgtgactggaaaccccaccgtcatcaagatggtggtgtccttcaacagaggagcccggggccagaacaccctgcggcagctgctggcccctgtggtgaaggagatcattgatgacaagagcctcatcatcaacaccaaccctgtggaggtgtacaaggcctgggtgaaccagctggagacccagacaggagaggccagcaagctgccctatgatgtgaccacagagcaggccctgacctacccagaggtgaagaacaagctggaggccagcattgagaacctgcggcgggtgacagacaaggtgctgaacagcatcatcagcagcctggacctgctgccctacggcctgcgctacatcgccaaggtgctgaagaacagcatccacgagaagttcccagatgccacagaagatgagctgctgaagatcgtgggcaacctgctgtactaccgctacatgaacccagccatcgtggccccagatggctttgacatcatcgacatgacagctgggggccagatcaacagcgaccagaggaggaacctgggctctgtggccaaggtgctgcagcacgccgccagcaacaagctgtttgaaggagaaaatgagcacctgagctccatgaacaactacctgtctgagacctaccaggagttcaggaagtacttcaaggaggcctgcaatgtgcctgagcctgaggagaagttcaacatggacaagtacacagacctggtgacagtgtccaagcctgtgatctacatcagcattgaggagatcatcagcacccacagcctgctgctggagcaccaggatgccatcgcccctgagaagaatgacctgctgtctgagctgctgggcagcctgggggaggtgcccaccgtggagagcttcctgggggagggcgctgtggaccccaatgaccccaacaaggccaacaccctgagccagctgagcaagacagagatcagcctggtgctgaccagcaaatatgacattgaagatggagaggccatcgacagccgcagcctgatgatcaagaccaagaagctgatcattgatgtgatccggaaccagcccggcaacaccctgacagagatcctggagaccccagccacagcccagcaggaggtggaccacgccacagacatggtgtcccgggccatgattgacagcaggaccccagaggagatgaagcacagccagagcatgattgaagatgcccagctgcccctggagcagaagaagaggaagatccagaggaacctgcggaccctggagcagacaggccacgtgtcctctgagaacaagtaccaggacatcctgaatgagatcgccaaggacatccggaaccagaggatctacaggaagctgaggaaggccgagctggccaagctgcagcagaccctgaatgccctgaacaagaaggccgccttctatgaggagcagatcaactactatgacacctacatcaagacctgcctggacaacctgaagaggaagaacaccaggaggagcatcaagctggatggaaaaggagagcccaagggggccaagagggccaagcctgtgaagtacacagctgccaagctgcacgagaagggcgtgctgctggacattgatgacctgcagaccaaccagttcaagaatgtgacctttgacatcatcgccacagaagatgtgggcatctttgatgtgcgcagcaagttcctgggcgtggagatggagaaggtgcagctgaacatccaggacctgctgcagatgcagtatgaaggagtggccgtgatgaagatgtttgacaaggtgaaggtgaatgtgaacctgctgatctacctgctgaacaagaagttctacggcaagtag

SEQ ID NO: 156582 - DNA, 1134 bp, Artificial Sequence
  Description of Artificial Sequence: Synthetic coding sequence
atgggctgcttcaagggcgtggtggccgtgggctacatcaatgaggccattgatgagggcaaccccctgcggaccctggagaccctgctgctgcccacagccaacatcagtgatgtggaccctgcccacgcccagcactaccaggatgtgctgtaccacgccaagagccagaagctgggggacagcgagagcgtgtccaaggtgctgtggctggatgagatccagcaggccgtggatgatgccaacgtggacaaggaccgggccaagcagtgggtgaccctggtggtggatgtgaaccagtgcctggagggcaagaagagcagtgacatcctgtctgtgctgaagagcagcaccagcaatgccaatgacatcatcccagaatgtgccgacaagtactatgatgccctggtgaaggccaaggagctgaagtctgagcgggtgtccagtgatggctcctggctgaagctgaacctgcacaagaagtatgactactactacaacacagacagcaaggagagctcctgggtgaccccagagagctgcctgtacaaggagagctggctgaccgggaaggagattgaggacatcatcgaggaggtgacagtgggctacatccgggagaacatctggagcgccagcgaggagctgctgctgcgcttccaggccaccagcagcggccccatcctgcgggaggagtttgaggccaggaagagcttcctgcacgagcaggaggagaatgtggtgaagatccaggccttctggaagggctacaagcagaggaaggagtacatgcaccggcggcagaccttcatcgacaacacagacagcatcgtgaagatccagagctggttcaggatggccacagccaggaagagctacctgagccggctgcagtacttccgggaccacaacaatgaaattgtgaagatccagagcctgctgcgggccaacaaggccagagatgactacaagaccctggtgggcagcgagaacccccccctgaccgtcatcaggaagtttgtgtacctgctggaccagagcgacctggacttccaggaggagctggaggtggcccggctgcgggaggaggtggtgaccaagatccgggccaaccagcagctggagaagacctag

SEQ ID NO: 156583 - DNA, 3084 bp, Artificial Sequence
  Description of Artificial Sequence: Synthetic coding sequence
atggcccagaacacagagaaccacgaccctgtgggcagcatcctgatccagatccacgaggacctgtaccagctgaaggagaagctgaccaagttcagccctgaggagaagggggagaccctggacatccagagcctggagacagccatcaagaggacagaggtgggcctgcgcatccacatcgagaagtacctgaatgtggtgaaccagaatgtgctgaccacctctgtgaatgatgagagcctgtacaccccccaggccagcaagtggctgctgcccaccgtcatcgaccagaagagcttcatcttcccccaggagagcgagggcaccttctggcagccccagaggcagcacagcagcagcctgcctgtgttcccccgggccaagatcaaggtgtccaagctgatcaagggcagcaacatcagcagcctgactgtgctgcccagcagccactgcacagacccctacttcacccccatccctgtgctgcaggctgatgcccacaagggcatcctgtccatgattgagcggggcctcatccccccaacagcccgcatcaccttccagaacccccccatcacccccagggctgcccccctgcacagctttgatgaggccaggaagatccccaccgtggccaccttcaccatcccccgggagcccccacccagccctgctgaggtgaagttcttccccaagaagcagaggagcaagggcaagagccgccgcagccggggccaccacgacaggaaggccatgaaggtgaagacccccctgcgggccctgaagagcctgtgggactatgacttcctgatctatgatggagtgattgacaacacagccccagacttcctggccttcaaggagcacttcagcctggcctggggcggcatcttcagcctgctggagcacgtggagaagttcctgaggaactatgccatccctgaggtgaagatcaagggcaacaacctggtggccctgctgcctgagtttgagctgaccaacaagctgaccaggtatgacctgctgtctgtgctggaggaccctgcccacgtgcagatgctgatcaacctgcccggccagcgctacaagggccaggacggcaacagcgaggccgccatgaagatccaggccacctggaagtgctacaaggccaggaagttcttcctgttctaccggcagcagaagtgggccagcggggtcatcgccatcgcctggctgctgtactgccacaagacccggctgaagaagatcctgaaggagagccggcagaggcacctggagaacttccgcatccgggccaagcacctggccgccaactggaaccgcatccgcaccagcaggaggaccatcatccacatccccagcctgggctacagccagcctgtgcgggagcacatcgctgacttcaacacccagcagaacatgcagctgggccgcctgtgtgacatcctggatgccaacgtgaatgtcatctacatctgcagccaccacatgaatgatgagctggtgctgtactacaagaagatcctgagcctgcatgctgctgtgaagagcggcaacctggaggacagaagtgacctgcaggaccgcttcaagatcatcaccccagaggccgtgaacatcttccccaagcaccacatgtgcctggccacccacctgatgtacagccccaaggccatcaagaggatcaagaacctgatccggggcacagaggcctacatcgtgtctggcctgctgcacagagatgacctggccgtggccgacatgctggacatccccatcctgggcagcgagcctgagctggcccacctgtacagcaccaagagcggcggcaagagggtgtttgacagcgccaacgtggccgtgcccccaggcatctatgacatctacagccagcagcagatgattgagcagctgagccagctgatcacagaccacctgcagatccagcgctggctgttcaagatggattctgagttcagaggaaatggaacagccttctgtgacatccccagctacctgaagtgctacaagtgggtgctgaaggagagcagccgctatggcctggaggactggaggaagaagtgggcccaggagcccgccctggtgaagatcagcgaggagctggccggcatcctggcccagcacgcccagcctgtgaatgagaagcgcttccccacctggaggaagttcctgcagaccttcctgagccagggcggcgtgattgaggccttccccccagctgacaacgtgaccaacctgactgtggacatgctgattgagcccaacgggaagatctctgtgctgagcactggagaccagctgcacgccgagagccccttcatcagcagcggcaccaccgtgccccagacctctgtggacccccaggtgctgacctacctgtgcctgcagatcggcaaggcctgcaggatgagagatgtggtgggctacttcagcattgacctggtgaccttcatcgaccccagcaccctggagcagcaggtgtgggccaccggcctgaacctggcctacagcgaccagctggccctgacccagctgaccctgtacctgaccaacggccacctggactgcagcctgagcaccctggaggtgcccaggtttgtgcccaaggagaggaagaagaccaagtgcatgtctgccctgtccatgcccatgctggccaccagccgctatgctgtgatgaccacccagctgcggcacagcaacctgagcctggtgttccactacgtgttcctgcagatctgccgggcccacggcatcggctatgatgtggaggagcggcagggcaccgtcttcatcctgtatgagcacctgaagaggcacaagctgggcatgctgaccatcggggaggacctgcagggcgtgctgatgacctttgcccggcacctgttcatcatccaccaggagatcagcgcccccaacatgcagggcgagaccaacttcaagaccaccatcgctgacatcgagaccatcctgcgggtgaccaaggagaacaagatgagatttgaggaggagcagcagagcaaggatgacaagaacctgagcaagcccaagaagtag

SEQ ID NO: 156584 - DNA, 2091 bp, Artificial Sequence
  Description of Artificial Sequence: Synthetic coding sequence
atgattgaaagaggcctcatccccccaacagcccgcatcaccttccagaacccccccatcaccccccgggccgcccccctgcacagctttgatgaggccaggaagatccccaccgtggccaccttcaccatcccccgggagcccccacccagccctgctgaggtgaagttcttccccaagaagcagaggagcaagggcaagagcagaagaagccggggccaccacgacaggaaggccatgaaggtgaagacccccctgcgggccctgaagagcctgtgggactatgacttcctgatctatgatggagtcatcgacaacacagccccagacttcctggccttcaaggagcacttcagcctggcctggggcggcatcttcagcctgctggagcacgtggagaagttcctgagaaattatgccatccctgaggtgaagatcaagggcaacaacctggtggccctgctgcctgagtttgagctgaccaacaagctgaccaggtatgacctgctgtctgtgctggaggaccctgcccacgtgcagatgctgatcaacctgcccggccagcgctacaagggccaggacggcaacagcgaggccgccatgaagatccaggccacctggaagtgctacaaggccaggaagttcttcctgttctaccggcagcagaagtgggccagcggcgtgattgccatcgcctggctgctgtactgccacaagacccggctgaagaagatcctgaaggagagccggcagaggcacctggagaacttccgcatccgggccaagcacctggccgccaactggaaccgcatccgcaccagcaggaggaccatcatccacatccccagcctgggctacagccagcctgtgcgggagcacatcgctgacttcaacacccagcagaacatgcagctgggccgcctgtgtgacatcctggatgccaacgtgaatgtcatctacatctgcagccaccacatgaatgatgagctggtgctgtactacaagaagatcctgagcctgcacgccgctgtgaagagcggcaacctggaggacagaagtgacctgcaggaccgcttcaagatcatcaccccagaggccgtgaacatcttccccatgattgagcagctgagccagctgatcacagaccacctgcagatccagcgctggctgttcaagatggattctgagttcagaggaaatggaacagccttctgtgacatccccagctacctgaagtgctacaagtgggtgctgaaggagagcagccgctatggcctggaggactggaggaagaagtgggcccaggagcccgccctggtgaagatcagcgaggagctggccggcatcctggcccagcacgcccagcctgtgaatgagaagcgcttccccacctggaggaagttcctgcagaccttcctgagccagggcggcgtgattgaggccttccccccagctgacaacgtgaccaacctgactgtggacatgctgattgagcccaacgggaagatctctgtgctgagcactggagaccagctgcacgccgagagccccttcatcagcagcggcaccaccgtgccccagacctctgtggacccccaggtgctgacctacctgtgcctgcagatcggcaaggcctgcaggatgagagatgtggtgggctacttcagcattgacctggtgaccttcatcgaccccagcaccctggagcagcaggtgtgggccaccggcctgaacctggcctacagcgaccagctggccctgacccagctgaccctgtacctgaccaacggccacctggactgcagcctgagcaccctggaggtgcccaggtttgtgcccaaggagaggaagaagaccaagtgcatgtctgccctgtccatgcccatgctggccaccagccgctatgctgtgatgaccacccagctgcggcacagcaacctgagcctggtgttccactacgtgttcctgcagatctgccgggcccacggcatcggctatgatgtggagaacaacagaagaggcagccctgggggcccccatgacctgtgcagccccagcctgcaccaccccagcaggaacatcagcacctag

SEQ ID NO: 156585 - DNA, 1866 bp, Artificial Sequence
  Description of Artificial Sequence: Synthetic coding sequence
atgaccaaggccatgaaggtgaagacccccctgcgggccctgaagagcctgtgggactatgacttcctgatctatgatggagtgattgacaacacagccccagacttcctggccttcaaggagcacttcagcctggcctggggcggcatcttcagcctgctggagcacgtggagaagttcctgaggaactatgccatccctgaggtgaagatcaagggcaacaacctggtggccctgctgcctgagtttgagctgaccaacaagctgaccaggtatgacctgctgtctgtgctggaggaccctgcccacgtgcagatgctgatcaacctgcccggccagcgctacaagggccaggacggcaacagcgaggccgccatgaagatccaggccacctggaagtgctacaaggccaggaagttcttcctgttctaccggcagcagaagtgggccagcggggtcatcgccatcgcctggctgctgtactgccacaagacccggctgaagaagatcctgaaggagagccggcagaggcacctggagaacttccgcatccgggccaagcacctggccgccaactggaaccgcatccgcaccagcaggaggaccatcatccacatccccagcctgggctacagccagcctgtgcgggagcacatcgctgacttcaacacccagcagaacatgcagctgggccgcctgtgtgacatcctggatgccaacgtgaatgtcatctacatctgcagccaccacatgaatgatgagctggtgctgtactacaagaagatcctgagcctgcatgctgctgtgaagagcggcaacctggaggacagaagtgacctgcaggaccgcttcaagatcatcaccccagaggccgtgaacatcttccccatgattgagcagctgagccagctgatcacagaccacctgcagatccagcgctggctgttcaagatggacagcgagttcagaggaaatggaacagccttctgtgacatccccagctacctgaagtgctacaagtgggtgctgaaggagagcagccgctatggcctggaggactggaggaagaagtgggcccaggagcccgccctggtgaagatcagcgaggagctggccggcatcctggcccagcacgcccagcctgtgaatgagaagcgcttccccacctggaggaagttcctgcagaccttcctgagccagggcggcgtcatcgaggccttccccccagctgacaacgtgaccaacctgactgtggacatgctgattgagcccaacgggaagatctctgtgctgagcactggagaccagctgcatgctgagagccccttcatcagcagcggcaccaccgtgccccagacctctgtggacccccaggtgctgacctacctgtgcctgcagatcggcaaggcctgcaggatgagagatgtggtgggctacttcagcattgacctggtgaccttcatcgaccccagcaccctggagcagcaggtgtgggccaccggcctgaacctggcctacagcgaccagctggccctgacccagctgaccctgtacctgaccaacggccacctggactgcagcctgagcaccctggaggtgcccaggtttgtgcccaaggagaggaagaagaccaagtgcatgtctgccctgtccatgcccatgctggccaccagccgctatgctgtgatgaccacccagctgcggcacagcaacctgagcctggtgttccactacgtgttcctgcagatctgccgggcccatggaattggctatgatgtggagaacaacagaagaggcagccctgggggcccccatgacctgtgcagccccagcctgcaccaccccagcaggaacatcagcacctag

SEQ ID NO: 156586 - DNA, 2055 bp, Artificial Sequence
  Description of Artificial Sequence: Synthetic coding sequence
atgaaggtgaagacccccctgcgggccctgaagagcctgtgggactatgacttcctgatctatgatggagtgattgacaacacagccccagacttcctggccttcaaggagcacttcagcctggcctggggcggcatcttcagcctgctggagcacgtggagaagttcctgaggaactatgccatccctgaggtgaagatcaagggcaacaacctggtggccctgctgcctgagtttgagctgaccaacaagctgaccaggtatgacctgctgtctgtgctggaggaccctgcccacgtgcagatgctgatcaacctgcccggccagcgctacaagggccaggacggcaacagcgaggccgccatgaagatccaggccacctggaagtgctacaaggccaggaagttcttcctgttctaccggcagcagaagtgggccagcggggtcatcgccatcgcctggctgctgtactgccacaagacccggctgaagaagatcctgaaggagagccggcagaggcacctggagaacttccgcatccgggccaagcacctggccgccaactggaaccgcatccgcaccagcaggaggaccatcatccacatccccagcctgggctacagccagcctgtgcgggagcacatcgctgacttcaacacccagcagaacatgcagctgggccgcctgtgtgacatcctggatgccaacgtgaatgtcatctacatctgcagccaccacatgaatgatgagctggtgctgtactacaagaagatcctgagcctgcatgctgctgtgaagagcggcaacctggaggacagaagtgacctgcaggaccgcttcaagatcatcaccccagaggccgtgaacatcttccccatgattgagcagctgagccagctgatcacagaccacctgcagatccagcgctggctgttcaagatggacagcgagttcagaggaaatggaacagccttctgtgacatccccagctacctgaagtgctacaagtgggtgctgaaggagagcagccgctatggcctggaggactggaggaagaagtgggcccaggagcccgccctggtgaagatcagcgaggagctggccggcatcctggcccagcacgcccagcctgtgaatgagaagcgcttccccacctggaggaagttcctgcagaccttcctgagccagggcggcgtcatcgaggccttccccccagctgacaacgtgaccaacctgactgtggacatgctgattgagcccaacgggaagatctctgtgctgagcactggagaccagctgcatgctgagagccccttcatcagcagcggcaccaccgtgccccagacctctgtggacccccaggtgctgacctacctgtgcctgcagatcggcaaggcctgcaggatgagagatgtggtgggctacttcagcattgacctggtgaccttcatcgaccccagcaccctggagcagcaggtgtgggccaccggcctgaacctggcctacagcgaccagctggccctgacccagctgaccctgtacctgaccaacggccacctggactgcagcctgagcaccctggaggtgcccaggtttgtgcccaaggagaggaagaagaccaagtgcatgtctgccctgtccatgcccatgctggccaccagccgctatgctgtgatgaccacccagctgcggcacagcaacctgagcctggtgttccactacgtgttcctgcagatctgccgggcccatggaattggctatgatgtggaggagcggcagggcaccgtcttcatcctgtatgagcacctgaagaggcacaagctgggcatgctgaccatcggggaggacctgcagggcgtgctgatgacctttgcccggcacctgttcatcatccaccaggagatcagcgcccccaacatgcagggcgagaccaacttcaagaccaccatcgctgacatcgagaccatcctgcgggtgaccaaggagaacaagatgagatttgaggaggagcagcagagcaaggatgacaagaacctgagcaagcccaagaagtag

SEQ ID NO: 156587 - DNA, 507 bp, Artificial Sequence
  Description of Artificial Sequence: Synthetic coding sequence
atggcccagaacacagagaaccacgaccctgtgggcagcatcctgatccagatccacgaggacctgtaccagctgaaggagaagctgaccaagttcagccctgaggagaagggggagaccctggacatccagagcctggagacagccatcaagaggacagaggtgggcctgcgcatccacatcgagaagtacctgaatgtggtgaaccagaatgtgctgaccacctctgtgaatgatgagagcctgtacaccccccaggccagcaagtggctgctgcccaccgtcatcgaccagaagagcttcatcttcccccaggagagcgagggcaccttctggcagccccagaggcagcacagcagcagcctgcctgtgttcccccgggccaagaggaagattggcctgaatgtgaagatcctgcaggaccctgagaacatccaccacagagctgctgtgaatgccaactacggcatcagcctgccctacatcaaccagaggaaggcctgctag

SEQ ID NO: 156588 - DNA, 339 bp, Artificial Sequence
  Description of Artificial Sequence: Synthetic coding sequence
atgaggctggaggagctgaagaggctgcagaaccccctggagcaggtgaatgatggcaagtacagctttgagaaccaccagctggccatggatgctgagaacaacatcgagaagtaccccctgaacctgcagcccctggagagcaaggtgaagatcatccagagggcctggagggagtacctgcagaggcaggagcccctgggcaagaggagccccagcccccccagcgtgtcctctgagaagctgagcagctctgtgtccatgaacaccttcagtgacagcagcacccctgtgtctgtgatgttcctgttcctgtgcccagacctgaccttcaactag

SEQ ID NO: 156589 - DNA, 480 bp, Artificial Sequence
  Description of Artificial Sequence: Synthetic coding sequence
atgaggctggaggagctgaagaggctgcagaaccccctggagcaggtgaatgatggcaagtacagctttgagaaccaccagctggccatggatgctgagaacaacatcgagaagtaccccctgaacctgcagcccctggagagcaaggtgaagatcatccagagggcctggagggagtacctgcagaggcaggagcccctgggcaagaggagccccagcccccccagcgtgtcctctgagaagctgagcagctctgtgtccatgaacaccttcagtgacagcagcaccccatttgcccgggcccctgtgggcaagatccacccctacatctcctggaggctgcagagccctggggacaagctgcccggcggcaggaaggtgatcctgctgtacctggaccagctggcccggcccaccggcttcatccacaccctgaaggagccccagatcgagcggctgggcttcctgaccctgcagtag

SEQ ID NO: 156590 - DNA, 399 bp, Artificial Sequence
  Description of Artificial Sequence: Synthetic coding sequence
atgaggctggaggagctgaagaggctgcagaaccccctggagcaggtgaatgatggcaagtacagctttgagaacatccagagggcctggagggagtacctgcagaggcaggagcccctgggcaagaggagccccagccccccatctgtgagcagcgagaagctgagcagctctgtgtccatgaacaccttcagtgacagcagcaccccatttgcccgggcccctgtgggcaagatccacccctacatctcctggaggctgcagagccctggggacaagctgcccggcggcaggaaggtgatcctgctgtacctggaccagctggcccggcccaccggcttcatccacaccctgaaggagccccagatcgagcggctgggcttcctgaccctgcagtag

SEQ ID NO: 156591 - DNA, 2892 bp, Artificial Sequence
  Description of Artificial Sequence: Synthetic coding sequence
atggatgcccccaaggccggctacgcctttgagtacctgattgagaccctgaatgacagcagccacaagaagttctttgatgtgtccaagctgggcaccaagtatgatgtgctgccctacagcatccgggtgctgctggaggccgctgtgaggaactgtgatggcttcctgatgaagaaggaggatgtgatgaacatcctggactggaagaccaagcagagcaatgtggaggtgcccttcttccctgcccgggtgctgctgcaggacttcaccggcatcccagccatggtggactttgctgccatgagggaggccgtgaagaccctgggcggggaccctgagaaggtgcacccagcctgccccacagacctgactgtggaccacagcctgcagattgacttcagcaaatgtgccatccagaatgcccccaaccctgggggcggggacctgcagaaggccggcaagctgagccctgtgaaggtgcagcccaagaagctgccctgccggggccagaccacctgccggggcagctgtgacagcggggagctgggcagaaattctggcaccttcagcagccagatcgagaacacccccatcctgtgccccttccacctgcagcctgtgcctgagcctgagaccgtgctgaagaaccaggaggtggagtttggaagaaaccgggagcggctgcagttcttcaagtggagcagcagggtcttcaagaatgtggccgtcatccccccaggcaccggcatggcccaccagatcaacctggagtacctgagccgggtggtgtttgaggagaaggacctgctcttcccagattctgtggtgggcacagacagccacatcaccatggtgaatggcctgggcatcctgggctggggcgtgggcggcattgaaacagaagctgtgatgctgggcctgcctgtgtccctgaccctgcctgaggtggtgggctgtgagctgaccggcagcagcaacccctttgtgaccagcattgatgtggtgctgggcatcaccaagcacctgcggcaggtgggcgtggccggcaagtttgtggagttcttcggcagcggcgtgtcccagctgagcatcgtggacaggaccaccatcgccaacatgtgcccagaatatggagccatcctgtccttcttccctgtggacaacgtgaccctgaagcacctggagcacacaggcttcagcaaggccaagctggagagcatggagacctacctgaaggctgtgaagctgttcagaaatgaccagaacagcagtggagagcctgagtacagccaggtgatccagatcaacctgaacagcatcgtgcccagcgtgtctggccccaagaggccccaggacagagtggccgtgacagacatgaagagtgacttccaggcctgcctgaatgagaaggtgggcttcaagggcttccagattgctgctgagaagcagaaggacatcgtgtccatccactatgagggcagcgagtacaagctgagccacggctctgtggtgattgctgctgtgatcagctgcaccaacaactgcaaccccagcgtgatgctggccgccggcctgctggccaagaaggctgtggaggccggcctgcgggtgaagccctacatccgcaccagcctgagccctggcagcggcatggtgacccactacctgagcagcagcggcgtgctgccctacctgagcaagctgggctttgaaattgtgggctacggctgcagcatctgtgtgggcaacacagcccccctgagtgatgctgtgctgaatgctgtgaagcagggcgacctggtgacctgtggcatcctgagcggcaacaagaactttgagggccgcctgtgtgactgtgtgcgggccaactacctggccagcccccccctggtggtggcctatgccatcgccggcaccgtgaacatcgacttccagacagagcccctgggcacagaccccaccgggaagaacatctacctgcatgacatctggcccagccgggaggaggtgcaccgggtggaggaggagcacgtgatcctgtccatgttcaaggccctgaaggacaagattgagatgggcaacaagcgctggaacagcctggaggccccagacagcgtgctcttcccctgggacctgaagagcacctacatccgctgccccagcttctttgacaagctgaccaaggagcccatcgccctgcaggccattgaaaatgcccacgtgctgctgtacctgggggacagcgtgaccacagaccacatcagccctgctggcagcatcgccagaaattctgctgctgccaagtacctgaccaacagaggcctgaccccccgggagttcaacagctatggagccaggagaggaaatgatgctgtgatgacccggggcacctttgccaacatcaagctgttcaacaagttcatcggcaagccagcccccaagaccatccacttccccagcggccagaccctggatgtgtttgaggccgctgagctgtaccagaaggagggcatccccctcatcatcctggccggcaagaagtatggcagcggcaacagccgggactgggccgccaagggcccctacctgctgggcgtgaaggctgtgctggccgagagctatgagaagatccacaaggaccacctgattggcatcggcatcgcccccctgcagttcctgcctggagaaaatgctgacagcctgggcctgagcggccgggagaccttcagcctgaccttccctgaggagctgagccctggcatcaccctgaacatccagaccagcacaggcaaggtgttttctgtgattgccagctttgaagatgatgtggagatcaccctgtacaagcatggaggcctgctgaactttgtggccaggaagttctcctag

SEQ ID NO: 156592 - DNA, 96 bp, Artificial Sequence
  Description of Artificial Sequence: Synthetic coding sequence
atggactatgtggaggacaagctgagcagcgagtttgtgttcaacaaccccaacatcaagggcacctgtggctgtggggagagcttcaacatctag

SEQ ID NO: 156593 - DNA, 261 bp, Artificial Sequence
  Description of Artificial Sequence: Synthetic coding sequence
atgtctgccagcctggtgcgggccaccgtgcgggctgtgtccaagaggaagctgcagcccaccagggctgccctgaccctgacccccagcgctgtgaacaagatcaagcagctgctgaaggacaagccagagcacgtgggcgtgaaggtgggcgtgaggacccggggctgcaatggcctgagctacaccctggagtacaccaagaccaagggggacagtgatgaggaggtgatccaggacggctggagcgctgtggtgtag

SEQ ID NO: 156594 - DNA, 390 bp, Artificial Sequence
  Description of Artificial Sequence: Synthetic coding sequence
atgtctgccagcctggtgcgggccaccgtgcgggctgtgtccaagaggaagctgcagcccaccagggctgccctgaccctgacccccagcgctgtgaacaagatcaagcagctgctgaaggacaagccagagcacgtgggcgtgaaggtgggcgtgaggacccggggctgcaatggcctgagctacaccctggagtacaccaagaccaagggggacagtgatgaggaggtgatccaggatggagtgcgggtcttcatcgagaagaaggcccagctgaccctgctgggcacagagatggactatgtggaggacaagctgagcagcgagtttgtgttcaacaaccccaacatcaagggcacctgtggctgtggggagagcttcaacatctag

SEQ ID NO: 156595 - DNA, 531 bp, Artificial Sequence
  Description of Artificial Sequence: Synthetic coding sequence
atggtggccgccggcggcggggccaggacagagggcgctgtgagaagaagcctgtggaggcagtgtgcccggcgggtgcatggagagaagctgcggcggcccaccttcggccccaggcacagaggagctggaacagccaagatgtctgccagcctggtgcgggccaccgtgcgggctgtgtccaagaggaagctgcagcccacccgggccgccctgaccctgaccccatctgctgtgaacaagatcaagcagctgctgaaggacaagccagagcacgtgggcgtgaaggtgggcgtgaggacccggggctgcaatggcctgagctacaccctggagtacaccaagaccaagggggacagtgatgaggaggtgatccaggatggagtgcgggtcttcatcgagaagaaggcccagctgaccctgctgggcacagagatggactatgtggaggacaagctgagcagcgagtttgtgttcaacaaccccaacatcaagggcacctgtggctgtggggagagcttcaacatctag

SEQ ID NO: 156596 - DNA, 504 bp, Artificial Sequence
  Description of Artificial Sequence: Synthetic coding sequence
atggctgctgctggggccttccggctgcggcgggccgccagcgccctgctgctgcggagcccccggctgcctgcccgggagctgagcgccccagcccggctgtaccacaagaaggtggtggaccactatgagaaccccagaaatgtgggcagcctggacaagaccagcaagaatgtgggcaccggcctggtgggcgccccagcctgtggagatgtgatgaagctgcagatccaggtggatgagaagggcaagatcgtggatgcccgcttcaagaccttcggctgcggcagcgccatcgccagcagcagcctggccacagagtgggtgaagggcaagacagtggaggaggccctgaccatcaagaacacagacatcgccaaggagctgtgcctgccccctgtgaagctgcactgcagcatgctggctgaagatgccatcaaggccgccctggccgactacaagctgaagcaggagcccaagaagggggaggccgagaagaagtag

SEQ ID NO: 156597 - DNA, 390 bp, Artificial Sequence
  Description of Artificial Sequence: Synthetic coding sequence
atggtgctgattgacatgtctgtggacctgagcacccaggtggtggaccactatgagaaccccagaaatgtgggcagcctggacaagaccagcaagaatgtgggcaccggcctggtgggcgccccagcctgtggagatgtgatgaagctgcagatccaggtggatgagaagggcaagatcgtggatgcccgcttcaagaccttcggctgcggcagcgccatcgccagcagcagcctggccacagagtgggtgaagggcaagacagtggaggaggccctgaccatcaagaacacagacatcgccaaggagctgtgcctgccccctgtgaagctgcactgcagcaagtctgtgctcttccctgctgaggagaagacccagctgagcccctag

SEQ ID NO: 156598 - DNA, 429 bp, Artificial Sequence
  Description of Artificial Sequence: Synthetic coding sequence
atggtgctgattgacatgtctgtggacctgagcacccaggtggtggaccactatgagaaccccagaaatgtgggcagcctggacaagaccagcaagaatgtgggcaccggcctggtgggcgccccagcctgtggagatgtgatgaagctgcagatccaggtggatgagaagggcaagatcgtggatgcccgcttcaagaccttcggctgcggcagcgccatcgccagcagcagcctggccacagagtgggtgaagggcaagacagtggaggaggccctgaccatcaagaacacagacatcgccaaggagctgtgcctgccccctgtgaagctgcactgcagcatgctggccgaggatgccatcaaggccgccctggccgactacaagctgaagcaggagcccaagaagggggaggccgagaagaagtag

SEQ ID NO: 156599 - DNA, 1443 bp, Artificial Sequence
  Description of Artificial Sequence: Synthetic coding sequence
atgtccttcccccagctgggctacccccagtacctgtctgctgctggccctggggcctacggcggggagaggcctggggtgctggccgctgctgctgctgctgctgctgctgccagcagcggccggcctggagctgctgagctgggcggcggggccggggctgctgctgtgacctctgtgctgggcatgtatgctgctgctggcccctatgctggggcccccaactacagcgccttcctgccctatgctgctgacctgagcctcttcagccagatgggcagccagtatgagctgaaggacaaccctggggtgcacccagccacctttgctgcccacacagccccagcctactacccctacggccagttccagtatggagaccccggccggcccaagaatgccacccgggagagcaccagcaccctgaaggcctggctgaatgagcacaggaagaacccctaccccaccaagggggagaagatcatgctggccatcatcaccaagatgaccctgacccaggtgtccacctggtttgccaatgcccggcggcggctgaagaaggagaacaaggtgacctggggcgcccggagcaaggaccaggaggatggagccctgtttggaagtgacacagaaggagaccctgagaaggccgaggatgatgaggagattgacctggagagcattgacatcgacaagattgatgaacatgatggagaccagagcaatgaagatgatgaggacaaggccgaggcccctcatgccccagctgcccccagcgccctggcccgggaccagggcagccccctggccgctgctgatgtgctgaagccccaggacagccccctgggcctggccaaggaggcccctgagcccggcagcacccggctgctgagccctggagctgctgctgggggcctgcagggcgcccctcatggcaagcccaagatctggagcctggccgagacagccaccagcccagatggagcccccaaggccagccccccacctcctgctggccaccctggggcccacggccccagcgctggggcccccctgcagcacccagccttcctgcccagccacggcctgtacacctgccacatcggcaagttcagcaactggaccaacagcgccttcctggcccagggcagcctgctgaacatgaggagcttcctgggcgtgggcgcccctcatgctgccccccacggcccccacctgcctgcccctcctccaccccagccccctgtggccatcgcccctggggccctgaatggagacaaggcctctgtgcgcagcagccccaccctgcctgagcgggacctggtgcccaggccagacagccctgcccagcagctgaagagccccttccagcctgtgcgggacaacagcctggccccccaggagggcaccccccgcatcctggccgccctgcccagcgcctag

SEQ ID NO: 156600 - DNA, 1416 bp, Artificial Sequence
  Description of Artificial Sequence: Synthetic coding sequence
atgagctacccccagggctacctgtaccaggcccctggcagcctggccctgtacagctgcccagcctatggagccagcgccctggccgcccccaggtctgaggagctggcccggagcgccagcggcagcgccttcagcccctacccaggcagcgctgccttcaccgcccaggccgccaccggcttcggcagccccctgcagtacagcgcagatgctgctgctgctgctgctggcttccccagctacatgggcgccccctatgatgcccacaccaccggcatgactggagccatctcctaccacccctacggcagcgctgcctacccctaccagctgaatgaccctgcctacaggaagaatgccaccagagatgccacagccaccctgaaggcctggctgaatgagcacaggaagaacccctaccccaccaagggggagaagatcatgctggccatcatcaccaagatgaccctgacccaggtgtccacctggtttgccaatgcccggcggcggctgaagaaggagaacaagatgacctgggcccccaggaacaagtcagaagatgaagatgaagatgaaggagatgccaccaggagcaaggatgagagcccagacaaggcccaggagggcacagagaccagcgcagaagatgagggcatcagcctgcacgtggacagcctgacagaccacagctgcagcgctgagagtgatggagagaagctgccctgcagagctggggaccccctgtgtgagagcggcagcgagtgcaaggacaagtatgatgacctggaggatgatgaagatgatgatgaggagggggagcggggcctggccccacccaagcctgtgaccagcagccccctgaccggcctggaggcccccctgctgagccccccacctgaggccgccccccggggcggcaggaagaccccccagggcagcaggaccagccctggggcccctcctccagccagcaagcccaagctgtggagcctggccgagatcgccaccagtgacctgaagcagcccagcctgggccctggctgcggccccccaggcctgcctgctgctgctgccccagccagcactggagcccctcctgggggcagcccctacccagccagccccctgctgggccggcccctgtactacaccagccccttctacggcaactacaccaactacggcaacctgaatgctgccctgcagggccagggcctgctgcgctacaacagcgctgctgctgcccctggagaggccctgcacacagcccccaaggccgccagtgatgctgggaaggccggggcccaccccctggagagccactaccgcagccctgggggcggctatgagcccaagaaggatgccagcgagggctgcaccgtggtgggcggcggcgtgcagccctacctgtag

SEQ ID NO: 156601 - DNA, 1416 bp, Artificial Sequence; identical to SEQ ID NO: 156600
  Description of Artificial Sequence: Synthetic coding sequence

SEQ ID NO: 156602 - DNA, 1506 bp, Artificial Sequence
  Description of Artificial Sequence: Synthetic coding sequence
atgtccttcccccagctgggctaccagtacatccggcccctgtaccccagcgagaggcctggagctgctgggggcagcggcggcagcgctggggcccggggcggcctgggcgctggggccagcgagctgaatgccagcggcagcctgagcaatgtgctgagctctgtgtatggagccccctatgctgctgctgctgctgctgctgctgcccagggctatggagccttcctgccctatgctgctgagctgcccatcttcccccagctgggcgcccagtatgagctgaaggacagccctggggtgcagcaccctgctgctgctgctgccttcccccacccccacccagccttctacccctacggccagtaccagtttggagaccccagccggcccaagaatgccacccgggagagcaccagcaccctgaaggcctggctgaatgagcacaggaagaacccctaccccaccaagggggagaagatcatgctggccatcatcaccaagatgaccctgacccaggtgtccacctggtttgccaatgcccggcggcggctgaagaaggagaacaagatgacctgggcccccaggagcaggacagatgaggagggcaatgcctacggcagcgagcgggaggaggaggatgaggaggaggatgaggaggatggcaagcgggagctggagctggaggaggaggagctgggcggggaggaggaggacaccggcggggagggcctggctgatgatgatgaagatgaggagattgacctggagaacctggatggagctgccacagagcctgagctgagcctggccggggccgccaggagagatggagacctgggcctgggccccatcagtgacagcaagaacagcgacagcgaggacagcagcgagggcctggaggaccggcccctgcctgtgctgagcctggccccagcccctcctcctgtggccgtggccagccccagcctgcccagcccccctgtgtccctggacccctgtgccccagccccagccccagccagcgccctgcagaagcccaagatctggagcctggccgagacagccaccagcccagacaaccccaggaggagccccccaggagctgggggcagccccccaggagctgctgtggcccccagcgccctgcagctgagccctgctgctgctgctgctgctgcccaccggctggtgtctgcccccctgggcaagtttcctgcctggaccaaccggcccttccctggccccccacctggcccccggctgcaccccctgagcctgctgggcagcgccccaccccacctgctgggcctgcctggagctgctggccaccctgctgctgctgctgcctttgcccggcctgctgagcctgagggcggcacagaccgctgcagcgccctggaggtggagaagaagctgctgaagacagccttccagcctgtgccccggcggccccagaaccacctggatgctgccctggtgctgagcgccctgagcagcagctag

SEQ ID NO: 156603 - DNA, 741 bp, Artificial Sequence
  Description of Artificial Sequence: Synthetic coding sequence
atgctgtggaggcagctgatctactggcagctgctggccctcttcttcctgcccttctgcctgtgccaggatgagtacatggagagcccccagacaggaggcctgcccccagactgcagcaagtgctgccacggggactacagcttccggggctaccagggccccccaggccccccaggccccccaggcatccctggcaaccacggcaacaatggaaacaacggggccactggacatgaaggagccaagggggagaagggggacaagggggacctgggccccagaggagagcggggccagcacggccccaagggggagaagggctacccaggcatccccccagagctgcagatcgccttcatggccagcctggccacccacttcagcaaccagaacagcggcatcatcttcagctctgtggagaccaacatcggcaacttctttgatgtgatgacaggccgctttggagcccctgtgtctggagtgtacttcttcaccttctccatgatgaagcatgaagatgtggaggaggtgtatgtgtacctgatgcacaatggaaacacagtgttctccatgtacagctatgagatgaagggcaagagtgacaccagcagcaaccacgctgtgctgaagctggccaagggagatgaggtgtggctgaggatgggaaatggagccctgcacggggaccaccagcgcttcagcacctttgctggcttcctgctgtttgagaccaagtag

SEQ ID NO: 156604 - DNA, 1560 bp, Artificial Sequence
  Description of Artificial Sequence: Synthetic coding sequence
atgagctacccccagtttggctacccctacagcagcgccccccagttcctgatggccaccaacagcctgagcacctgctgtgagagcggcggccgcaccctggccgacagcggccctgctgccagcgcccaggcccctgtgtactgccctgtgtatgagagccggctgctggccacagcccggcatgagctgaacagcgctgctgccctgggcgtgtatggaggcccctatggaggcagccagggctacggcaactacgtgacctacggcagcgaggccagcgccttctacagcctgaacagctttgacagcaaggatggcagcggcagcgcccacggcggcctggccccagctgctgctgcctactacccctatgagcccgccctgggccagtacccctatgacagatatggcaccatggacagcggcaccaggaggaagaatgccacccgggagaccaccagcaccctgaaggcctggctgcaggagcacaggaagaacccctaccccaccaagggggagaagatcatgctggccatcatcaccaagatgaccctgacccaggtgtccacctggtttgccaatgcccggcggcggctgaagaaggagaacaagatgacctggcccccaagaaataaatgtgctgatgagaagaggccctatgcagagggggaggaggaggagggcggggaggaggaggcccgggaggagcccctgaagagcagcaagaatgctgagcctgtgggcaaggaggagaaggagctggagctgagtgacctggatgactttgaccccctggaggccgagcccccagcctgtgagctgaagccacccttccacagcctggatggcggcctggagcgggtgcctgctgccccagatggccctgtgaaggaggccagcggggccctgaggatgagcctggccgccggcggcggggccgccctggatgaggacctggagcgggcccggagctgcctgcggtctgctgctgctggccctgagcccctgcccggggctgagggcggcccccaggtgtgtgaggccaagctgggctttgtgcctgctggggccagcgctggcctggaggccaagccccgcatctggagcctggcccacacagccacagctgctgctgctgctgccaccagcctgagccagacagagttccccagctgcatgctgaagaggcagggccctgctgccccagctgctgtgagcagcgccccagccaccagccccagcgtggccctgccccacagcggggccctggacagacaccaggacagccctgtgaccagcctgaggaactgggtggatggagtcttccatgaccccatcctgcggcacagcaccctgaaccaggcctgggccacagccaagggggccctgctggaccccggccccctgggccgcagcctgggcgctggggccaacgtgctgacagcccccctggcccgggccttccccccagctgtgccccaggatgccccagctgctggggccgcccgggagctgctggccctgcccaaggccggcggcaagcccttctgtgcctag

SEQ ID NO: 156605 - DNA, 1560 bp, Artificial Sequence; identical to SEQ ID NO: 156604
  Description of Artificial Sequence: Synthetic coding sequence

SEQ ID NO: 156606 - DNA, 1452 bp, Artificial Sequence
  Description of Artificial Sequence: Synthetic coding sequence
atgagctacccccagggctacctgtaccagcccagcgccagcctggccctgtacagctgcccagcctacagcaccagcgtcatcagcggccccaggacagatgagctgggccgcagcagcagcggcagcgccttcagcccctatgccggcagcacagccttcaccgcccccagccctggctacaacagccacctgcagtatggagctgaccctgctgctgctgctgctgctgccttcagcagctatgtgggcagcccctatgaccacaccccaggcatggccggcagcctgggctaccacccctatgctgcccccctgggcagctacccctatggagaccctgcctacaggaagaatgccaccagagatgccacagccaccctgaaggcctggctgaatgagcacaggaagaacccctaccccaccaagggggagaagatcatgctggccatcatcaccaagatgaccctgacccaggtgtccacctggtttgccaatgcccggcggcggctgaagaaggagaacaagatgacctggacccccaggaacagaagtgaagatgaggaggaggaggagaacatcgacctggagaagaatgatgaagatgagccccagaagccagaggacaagggggaccctgagggccctgaggccggcggcgctgagcagaaggccgccagcggctgtgagcggctgcagggcccccccaccccagctgggaaggagacagagggcagcctgagtgacagcgacttcaaggagcccccatctgagggccgcctggatgccctgcagggcccccccaggactggaggccccagccctgctggccctgctgctgcccggctggctgaagatcctgccccccactacccagctggggccccagcccctggcccccaccctgctgctggggaggtgcccccaggccctgggggccccagcgtcatccacagccccccacctcctcctcctcctgctgtgctggccaagcccaagctgtggagcctggccgagatcgccaccagcagtgacaaggtgaaggatggcggcggcggcaatgaaggcagcccctgccccccctgccccggccccatcgccggccaggccctgggcggcagccgggccagccctgccccagcccccagccgcagccccagcgcccagtgccccttccctgggggcaccgtgctgagccggcccctgtactacacagcccccttctacccaggctacaccaactacggcagctttggccacctgcacggccaccctggccctggccctggccccaccactggacctggcagccacttcaacggcctgaaccagacagtgctgaacagagcagatgccctggccaaggaccccaagatgctgcggagccagagccagctggacctgtgcaaggacagcccctatgagctgaagaagggcatgtctgacatctag

SEQ ID NO: 156607 - DNA, 441 bp, Artificial Sequence
  Description of Artificial Sequence: Synthetic coding sequence
atgagctacccccagggctacctgtaccagcccagcgccagcctggccctgtacagctgcccagcctacagcaccagcgtcatcagcggccccaggacagatgagctgggccgcagcagcagcggcagcgccttcagcccctatgccggcagcacagccttcaccgcccccagccctggctacaacagccacctgcagtatggagctgaccctgctgctgctgctgctgctgccttcagcagctatgtgctgctgaagaaggagaagaagagcctggacttcccctgcttcccccccctgcggcccacctgtgtgcgcagccctgctgagcggggcgtggcctctgtggcccaggccagcatctgcatggagggccgggctgctgtggcccggagcgcccacggcggcagcccctatgcccaccgggtgcccggcccctag

SEQ ID NO: 156608 - DNA, 498 bp, Artificial Sequence
  Description of Artificial Sequence: Synthetic coding sequence
atgggctgggacctgactgtgaagatgctggccggaaatgagttccaggtgtccctgagcagctccatgtctgtgtctgagctgaaggcccagatcacccagaagattggagtgcacgccttccagcagaggctggccgtgcaccccagcggcgtggccctgcaggacagagtgcccctggccagccagggcctgggccctggcagcacagtgctgctggtggtggacaagtgtgatgagcccctgagcatcctggtgaggaacaacaagggccgcagcagcacctatgaggtgcggctgacccagacagtggcccacctgaagcagcaggtgtctggcctggagggcgtgcaggatgacctcttctggctgacctttgagggcaagcccctggaggaccagctgcccctgggggagtatggcctgaagcccctgagcacagtgttcatgaacctgcggctgcggggcggcggcacagagcccggcggccgctcctag

SEQ ID NO: 156609 - DNA, 3129 bp, Artificial Sequence
  Description of Artificial Sequence: Synthetic coding sequence
atggctgatgcctttggagatgagctgttctctgtgtttgaaggagacagcaccacagctgctggcaccaagaaggacaaggagaaggacaagggcaagtggaagggccccccaggcagcgctgacaaggccggcaagagatttgatggcaagctgcagagcgagagcaccaacaacgggaagaacaagagagatgtggactttgagggcacagatgagcccatctttgggaagaagccccgcatcgaggagagcatcacagaggacctgagcctggccgacctgatgccccgggtgaaggtgcagagcgtggagaccgtggagggctgcacccatgaggtggccctgcctgctgaggaggactacctgcccctgaagccccgggtgggcaaggccgccaaggagtaccccttcatcctggatgccttccagcgggaggccatccagtgtgtggacaacaaccagagcgtgctggtgtctgcccacaccagcgctgggaagacagtgtgtgccgagtatgccatcgccctggccctgcgggagaagcagagggtcatcttcaccagccccatcaaggccctgagcaaccagaagtaccgggagatgtatgaggagttccaggatgtgggcctgatgactggagatgtgaccatcaaccccacagccagctgcctggtgatgaccacagagatcctgcgctccatgctgtaccggggcagcgaggtgatgagggaggtggcctgggtgatctttgatgagatccactacatgagggacagcgagcggggcgtggtgtgggaggagaccatcatcctgctgcctgacaacgtgcactacgtgttcctgagcgccaccatccccaatgcccggcagtttgctgagtggatctgccacctgcacaagcagccctgccacgtgatctacacagactaccggcccacccccctgcagcactacatcttccctgctggaggagatggcctgcacctggtggtggatgaaaatggagacttccgggaggacaacttcaacacagccatgcaggtgctgagagatgctggggacctggccaagggggaccagaagggcaggaaaggaggcaccaagggccccagcaatgtgttcaagatcgtgaagatgatcatggagaggaacttccagcccgtcatcatcttctccttcagcaagaaggactgtgaggcctatgccctgcagatgaccaagctggacttcaacacagatgaggagaagaagatggtggaggaggtgttcagcaatgccatcgactgcctgagtgatgaggacaagaagctgccccaggtggagcacgtgctgcccctgctgaagaggggcatcggcatccaccacggcggcctgctgcccatcctgaaggagaccatcgagatcctcttcagcgagggcctcatcaaggccctgtttgccacagagacctttgccatgggcatcaacatgcctgccaggacagtgctcttcaccaatgccaggaagtttgatggcaaggacttccgctggatcagcagcggggagtacatccagatgagcggccgggccggccggcggggcatggatgaccggggcatcgtcatcctgatggtggatgagaagatgagccccaccatcggcaagcagctgctgaagggcagcgctgaccccctgaacagcgccttccacctgacctacaacatggtgctgaacctgctgcgggtggaggagatcaaccctgagtacatgctggagaagagcttctaccagttccagcactaccgggccatccctggggtggtggagaaggtgaagaacagcgaggagcagtacaacaagatcgtcatccccaatgaggagagcgtggtgatctactacaagatccggcagcagctggccaagctgggcaaggagattgaggagtacatccacaagcccaagtactgcctgcccttcctgcagcccggccgcctggtgaaggtgaagaatgaaggagatgactttggctggggcgtggtggtgaacttcagcaagaagagcaatgtgaagcccaacagcggggagctggaccccctgtatgtggtggaggtgctgctgcgctgcagcaaggagagcctgaagaacagcgccacagaggccgccaagccagccaagccagatgagaagggggagatgcaggtggtgcctgtgctggtgcacctgctgagcgccatcagctctgtgcggctgtacatccccaaggacctgcggcctgtggacaaccggcagagcgtgctgaagagcatccaggaggtgcagaagcgcttcccagatggcatccccctgctggaccccattgatgacatgggcatccaggaccagggcctgaagaaggtgatccagaaggtggaggcctttgagcacaggatgtacagccaccccctgcacaatgaccccaacctggagaccgtgtacaccctgtgtgagaagaaggcccagatcgccatcgacatcaagagcgccaagcgggagctgaagaaggccaggacagtgctgcagatggatgagctgaagtgcaggaagagggtgctgcggcggctgggctttgccaccagcagtgatgtgattgagatgaagggccgggtggcctgtgagatcagcagcgcagatgagctgctgctgacagagatgatgttcaacggcctcttcaatgacctgtctgctgagcaggccacagccctgctgagctgctttgtgttccaggagaacagcagcgagatgcccaagctgacagagcagctggccggccccctgcggcagatgcaggagtgtgccaagagaattgccaaggtgtctgctgaggccaagctggagattgatgaggagacctacctgagcagcttcaagccccacctgatggatgtggtgtacacctgggccactggagccacctttgcccacatctgcaagatgacagatgtgtttgagggcagcatcatccgctgcatgaggcggctggaggagctgctgcggcagatgtgccaggccgccaaggccatcggcaacacagagctggagaacaagtttgctgagggcatcaccaagatcaagagggacatcgtgtttgctgccagcctgtacctgtag

SEQ ID NO: 156610 - DNA, 981 bp, Artificial Sequence
  Description of Artificial Sequence: Synthetic coding sequence
atgggagacatgggagacccccccaagaagaagaggctcatcagcctgtgtgtgggctgcggcaaccagatccatgaccagtacatcctgcgggtgtccccagacctggagtggcacgccgcctgcctgaagtgtgccgagtgcaaccagtacctggatgagagctgcacctgctttgtgagagatggcaagacctactgcaagagggactacatccggctgtatggcatcaagtgtgccaagtgcagcatcggcttcagcaagaatgactttgtgatgagggcccggagcaaggtgtaccacatcgagtgcttccgctgtgtggcctgcagccggcagctgatccctggagatgaatttgccctgcgggaggatggcctcttctgcagagctgaccatgatgtggtggagcgggccagcctgggcgctggggaccccctgagccccctgcacccagcccggcccctgcagatggctgctgagcccatcagcgcccggcagcctgccctgcggccccacgtgcacaagcagcctgagaagaccaccagggtgaggacagtgctgaatgagaagcagctgcacaccctgcggacctgctatgctgccaaccccaggccagatgccctgatgaaggagcagctggtggagatgacaggcctgagccccagggtcatccgggtgtggttccagaacaagcgctgcaaggacaagaagaggagcatcatgatgaagcagctgcagcagcagcagcccaatgacaagacagccaaccctgtggaggtgcagagctaccagcccccctggaaggtgctgagtgactttgccctgcagagcgacatcgaccagcctgccttccagcagctggtgaacttcagcgagggcggccctggcagcaacagcactggaagtgaggtggcctccatgagcagccagctgcctgacacccccaacagcatggtggccagccccatcgaggcctag

SEQ ID NO: 156611 - DNA, 270 bp, Artificial Sequence
  Description of Artificial Sequence: Synthetic coding sequence
atgggcatcctgaagctgcaggtgttcctgattgtgctgtctgtggccctgaaccacctgaaggccacccccatcgagagccaccaggtggagaagaggaagtgcaacacagccacctgtgccacccagaggctggccaacttcctggtgcacagcagcaacaactttggagccatcctgagcagcaccaacgtgggcagcaacacctacggcaagagaaatgctgtggaggtgctgaagcgggagcccctgaactacctgcccctgtag

SEQ ID NO: 156612 - DNA, 240 bp, Artificial Sequence
  Description of Artificial Sequence: Synthetic coding sequence
atgggcatcctgaagctgcaggtgttcctgattgtgctgtctgtggccctgaaccacctgaaggccacccccatcgagagccaccaggtggagaagaggaagtgcaacacagccacctgtgccacccagaggctggccaacttcctggtgcacagcagcaacaactttggagccatcctgagcagcaccaacgtgggcagcaacacctacggcaagagaaatgctgtggaggtgctgtag

SEQ ID NO: 156613 - DNA, 270 bp, Artificial Sequence; identical to SEQ ID NO: 156611
  Description of Artificial Sequence: Synthetic coding sequence

SEQ ID NO: 156614 - DNA, 1449 bp, Artificial Sequence
  Description of Artificial Sequence: Synthetic coding sequence
atgagcggccacaagtgctacccctgggacctgcaggacagatatgcccaggacaagtctgtggtgaacaagatgcagcagaagtactgggagaccaagcaggccttcatcaaggccaccgggaagaaggaggatgaacatgtggtggccagtgatgctgacctggatgccaagctggagctgttccacagcatccagaggacctgcctggacctgagcaaggccatcgtgctgtaccagaagaggatctgcttcctgagccaggaggagaatgagctgggcaagttcctgcggagccagggcttccaggacaagacccgggccggcaagatgatgcaggccaccgggaaggccctgtgcttcagcagccagcagaggctggccctgaggaaccccctgtgccgcttccaccaggaggtggagaccttccgccaccgggccatcagtgacacctggctgactgtgaacaggatggagcagtgcaggacagagtacagaggagccctgctgtggatgaaggatgtgtcccaggagctggaccctgacctgtacaagcagatggagaagttcaggaaggtgcagacccaggtgcggctggccaagaagaactttgacaagctgaagatggatgtgtgccagaaggtggacctgctgggcgccagccgctgcaacctgctgagccacatgctggccacctaccagaccaccctgctgcacttctgggagaagaccagccacaccatggccgccatccacgagagcttcaagggctaccagccctatgagttcaccaccctgaagagcctgcaggaccccatgaagaagctggtggagaaggaggagaagaagaagatcaaccagcaggagagcacagatgctgctgtgcaggagcccagccagctgatcagcctggaggaggagaaccagaggaaggagagcagcagcttcaagacagaagatggcaagagcatcctgagcgccctggacaagggcagcacccacacagcctgcagcggccccattgatgagctgctggacatgaagtctgaggagggcgcctgcctgggccctgtggccggcaccccagagcctgagggcgctgacaaggatgacctgctgctgctgtctgagatcttcaatgccagcagcctggaggagggggagttcagcaaggagtgggccgctgtgtttggagatggccaggtgaaggagcctgtgcccaccatggccctgggggagccagaccccaaggcccagacaggcagcggcttcctgcccagccagctgctggaccagaacatgaaggacctgcaggccagcctgcaggagcccgccaaggccgccagtgacctgacagcctggttcagcctgtttgctgacctggaccccctgagcaacccagatgctgtgggcaagacagacaaggagcacgagctgctgaatgcctag

SEQ ID NO: 156615 - DNA, 774 bp, Artificial Sequence
  Description of Artificial Sequence: Synthetic coding sequence
atgagcggccacaagtgcagctacccctgggacctgcaggacagatatgcccaggacaagtctgtggtgaacaagatgcagcagaagtactgggagaccaagcaggccttcatcaaggccaccgggaagaaggaggatgagcacgtggtggccagtgatgctgacctggatgccaagctggagctgttccacagcatccagaggacctgcctggacctgagcaaggccatcgtgctgtaccagaagaggatctgcttcctgagccaggaggagaatgagctgggcaagttcctgcggagccagggcttccaggacaagaccagggctgggaagatgatgcaggccaccgggaaggccctgtgcttcagcagccagcagaggctggccctgaggaaccccctgtgccgcttccaccaggaggtggagaccttccgccaccgggccatcagtgacacctggctgactgtgaacaggatggagcagtgcaggacagagtacagaggagccctgctgtggatgaaggatgtgtcccaggagctggaccctgacctgtacaagcagatggagaagttcaggaaggtgcagacccaggtgcggctggccaagaagaactttgacaagctgaagatggatgtgtgccagaaggtggacctgctgggcgccagccgctgcaacctgctgagccacatgctggccacctaccagctggcctgggaccagtggcagggccccaggaacctgaaggtgctgaccaagatgacctgctgctgctag

SEQ ID NO: 156616 - DNA, 1452 bp, Artificial Sequence
  Description of Artificial Sequence: Synthetic coding sequence
atgagcggccacaagtgcagctacccctgggacctgcaggacagatatgcccaggacaagtctgtggtgaacaagatgcagcagaagtactgggagaccaagcaggccttcatcaaggccaccgggaagaaggaggatgagcacgtggtggccagtgatgctgacctggatgccaagctggagctgttccacagcatccagaggacctgcctggacctgagcaaggccatcgtgctgtaccagaagaggatctgcttcctgagccaggaggagaatgagctgggcaagttcctgcggagccagggcttccaggacaagaccagggctgggaagatgatgcaggccaccgggaaggccctgtgcttcagcagccagcagaggctggccctgaggaaccccctgtgccgcttccaccaggaggtggagaccttccgccaccgggccatcagtgacacctggctgactgtgaacaggatggagcagtgcaggacagagtacagaggagccctgctgtggatgaaggatgtgtcccaggagctggaccctgacctgtacaagcagatggagaagttcaggaaggtgcagacccaggtgcggctggccaagaagaactttgacaagctgaagatggatgtgtgccagaaggtggacctgctgggcgccagccgctgcaacctgctgagccacatgctggccacctaccagaccaccctgctgcacttctgggagaagaccagccacaccatggccgccatccacgagagcttcaagggctaccagccctatgagttcaccaccctgaagagcctgcaggaccccatgaagaagctggtggagaaggaggagaagaagaagatcaaccagcaggagagcacagatgctgctgtgcaggagcccagccagctgatcagcctggaggaggagaaccagaggaaggagagcagcagcttcaagacagaagatggcaagagcatcctgagcgccctggacaagggcagcacccacacagcctgcagcggccccattgatgagctgctggacatgaagtctgaggagggcgcctgcctgggccctgtggccggcaccccagagcctgagggcgctgacaaggatgacctgctgctgctgtctgagatcttcaatgccagcagcctggaggagggggagttcagcaaggagtgggccgctgtgtttggagatggccaggtgaaggagcctgtgcccaccatggccctgggggagccagaccccaaggcccagacaggcagcggcttcctgcccagccagctgctggaccagaacatgaaggacctgcaggccagcctgcaggagcccgccaaggccgccagtgacctgacagcctggttcagcctgtttgctgacctggaccccctgagcaacccagatgctgtgggcaagacagacaaggagcacgagctgctgaatgcctag

SEQ ID NO: 156617 - DNA, 1452 bp, Artificial Sequence; identical to SEQ ID NO: 156616
  Description of Artificial Sequence: Synthetic coding sequence

SEQ ID NO: 156618 - DNA, 1452 bp, Artificial Sequence; identical to SEQ ID NO: 156616
  Description of Artificial Sequence: Synthetic coding sequence

SEQ ID NO: 156619 - DNA, 1539 bp, Artificial Sequence
  Description of Artificial Sequence: Synthetic coding sequence
atgagcggccacaagtgcagctacccctgggacctgcaggacagatatgcccaggacaagtctgtggtgaacaagatgcagcagaagtactgggagaccaagcaggccttcatcaaggccaccgggaagaaggaggatgagcacgtggtggccagtgatgctgacctggatgccaagctggagctgttccacagcatccagaggacctgcctggacctgagcaaggccatcgtgctgtaccagaagaggatctgcttcctgagccaggaggagaatgagctgggcaagttcctgcggagccagggcttccaggacaagaccagggctgggaagatgatgcaggccaccgggaaggccctgtgcttcagcagccagcagaggctggccctgaggaaccccctgtgccgcttccaccaggaggtggagaccttccgccaccgggccatcagtgacacctggctgactgtgaacaggatggagcagtgcaggacagagtacagaggagccctgctgtggatgaaggatgtgtcccaggagctggaccctgacctgtacaagcagatggagaagttcaggaaggtgcagacccaggtgcggctggccaagaagaactttgacaagctgaagatggatgtgtgccagaaggtggacctgctgggcgccagccgctgcaacctgctgagccacatgctggccacctaccagaccaccctgctgcacttctgggagaagaccagccacaccatggccgccatccacgagagcttcaagggctaccagccctatgagttcaccaccctgaagagcctgcaggaccccatgaagaagctggtggagaaggaggagaagaagaagatcaaccagcaggagagcacagatgctgctgtgcaggagcccagccagtacctgcagaacatctgcctggagatgaaggccaacagcgacatcaagatgctgcagaagggcaaggagggccagcagatcggcatcctgatcagcctggaggaggagaaccagaggaaggagagcagcagcttcaagacagaagatggcaagagcatcctgagcgccctggacaagggcagcacccacacagcctgcagcggccccattgatgagctgctggacatgaagtctgaggagggcgcctgcctgggccctgtggccggcaccccagagcctgagggcgctgacaaggatgacctgctgctgctgtctgagatcttcaatgccagcagcctggaggagggggagttcagcaaggagtgggccgctgtgtttggagatggccaggtgaaggagcctgtgcccaccatggccctgggggagccagaccccaaggcccagacaggcagcggcttcctgcccagccagctgctggaccagaacatgaaggacctgcaggccagcctgcaggagcccgccaaggccgccagtgacctgacagcctggttcagcctgtttgctgacctggaccccctgagcaacccagatgctgtgggcaagacagacaaggagcacgagctgctgaatgcctag

SEQ ID NO: 156620 - DNA, 405 bp, Artificial Sequence
  Description of Artificial Sequence: Synthetic coding sequence
atgagcggccacaagtgctacccctgggacctgcaggacagatatgcccaggacaagtctgtggtgaacaagatgcagcagaagtactgggagaccaagcaggccttcatcaaggccaccgggaagaaggaggatgaacatgtggtggccagtgatgctgacctggatgccaagctggagctgttccacagcatccagaggacctgcctggacctgagcaaggccatcgtgctgtaccagaagaggatctgcttcctgagccaggaggagaatgagctgggcaagttcctgcggagccagggcttccaggacaagacccgggccggcaagatgatgcaggccaccgggaaggccctgtgcttcagcagccagcagaggctggccctgaggaaccccctgtgctag

SEQ ID NO: 156621 - DNA, 489 bp, Artificial Sequence
  Description of Artificial Sequence: Synthetic coding sequence
atgagcggccacaagtgcagctacccctgggacctgcaggacagatatgcccaggacaagtctgtggtgaacaagatgcagcagaagtactgggagaccaagcaggccttcatcaaggccaccgggaagaaggaggatgagcacgtggtggccagtgatgctgacctggatgccaagctggagctgttccacagcatccagaggacctgcctggacctgagcaaggccatcgtgctgtaccagaagaggatctgcttcctgagccaggaggagaatgagctgggcaagttcctgcggagccagggcttccaggacaagaccagggctgggaagatgatgcaggccaccgggaaggccctgtgcttcagcagccagcagaggctggccctgaggaaccccctgtgccgcttccaccaggaggtggagaccttccgccaccgggccatcagtgacacctggctgactgtgaacaggatggagcagtgctag

SEQ ID NO: 156622 - DNA, 666 bp, Artificial Sequence
  Description of Artificial Sequence: Synthetic coding sequence
atggctgctgcccggcccagcctgggccgggtgctgcccggcagctctgtgctcttcctgtgtgacatgcaggagaagttccgccacaacatcgcctacttcccccagatcgtgtctgtggccgccaggatgctgaaggtggcccggctgctggaggtgcctgtgatgctgacagagcagtacccccagggcctgggccccaccgtgcctgagctgggcacagagggcctgcggcccctggccaagacctgcttctccatggtgcctgccctgcagcaggagctggacagccggccccagctgcggtctgtgctgctgtgtggcatcgaggcccaggcctgcatcctggaccccaggagctacccaggcctggccctgaccagcctgtacccccagaacaccaccctggacctgctggaccggggcctgcaggtgcacgtggtggtggatgcctgcagcagccgcagccaggtggaccggctggtggccctggccaggatgaggcagagcggggccttcctgagcaccagcgagggcctcatcctgcagctggtgggagatgctgtgcacccccagttcaaggagatccagaagctgatcaaggagcccgccccagattctggcctgctgggcctcttccagggccagaacagcctgctgcactag

SEQ ID NO: 156623 - DNA, 618 bp, Artificial Sequence
  Description of Artificial Sequence: Synthetic coding sequence
atggctgctgcccggcccagcctgggccgggtgctgcccggcagctctgtgctcttcctgtgtgacatgcaggagaagttccgccacaacatcgcctacttcccccagatcgtgtctgtggccgccaggatgctgaaggtggcccggctgctggaggtgcctgtgatgctgacagagcagtacccccagggcctgggccccaccgtgcctgagctgggcacagagggcctgcggcccctggccaagacctgcttctccatggtgcctgccctgcagcaggagctggacagccggccccagctgcggtctgtgctgctgtgtggcatcgaggcccaggcctgcatcctgaacaccaccctggacctgctggaccggggcctgcaggtgcacgtggtggtggatgcctgcagcagccgcagccaggtggaccggctggtggccctggccaggatgaggcagagcggggccttcctgagcaccagcgagggcctcatcctgcagctggtgggagatgctgtgcacccccagttcaaggagatccagaagctgatcaaggagcccgccccagattctggcctgctgggcctcttccagggccagaacagcctgctgcactag

SEQ ID NO: 156624 - DNA, 408 bp, Artificial Sequence
  Description of Artificial Sequence: Synthetic coding sequence
atggctgctgcccggcccagcctgggccgggtgctgcccggcagctctgtgctcttcctgtgtgacatgcaggagaagttccgccacaacatcgcctacttcccccagatcgtgtctgtggccgccaggatgctgaagaacaccaccctggacctgctggaccggggcctgcaggtgcacgtggtggtggatgcctgcagcagccgcagccaggtggaccggctggtggccctggccaggatgaggcagagcggggccttcctgagcaccagcgagggcctcatcctgcagctggtgggagatgctgtgcacccccagttcaaggagatccagaagctgatcaaggagcccgccccagattctggcctgctgggcctcttccagggccagaacagcctgctgcactag

SEQ ID NO: 156625 - DNA, 1101 bp, Artificial Sequence
  Description of Artificial Sequence: Synthetic coding sequence
atggccggccctgcctggatcagcaaggtgtcccggctgctgggcgccttccacaaccccaagcaggtgacccggggcttcaccggcggcgtgcagacagtgaccctcatccctggagatggcatcggccctgagatctctgctgctgtgatgaagatctttgatgctgccaaggcccccatccagtgggaggagagaaatgtgacagccatccagggccctgggggcaagtggatgatccccagcgaggccaaggagagcatggacaagaacaagatgggcctgaagggccccctgaagacccccatcgctgctggccaccccagcatgaacctgctgctgaggaagacctttgacctgtatgccaacgtgcggccctgtgtgtccattgagggctacaagaccccctacacagatgtgaacatcgtgaccatcagagaaaatacagaaggagagtacagcggcatcgagcacgtgattgtggatggagtggtgcagagcatcaagctgatcacagagggcgccagcaagagaattgctgagtttgcctttgaatatgccaggaacaaccacaggagcaatgtgacagctgtgcacaaggccaacatcatgaggatgtctgatggcctcttcctgcagaagtgccgggaggtggccgagagctgcaaggacatcaagttcaatgagatgtacctggacacagtgtgcctgaacatggtgcaggaccccagccagtttgatgtgctggtgatgcccaacctgtatggagacatcctgagtgacctgtgtgccggcctgattggaggcctgggcgtgaccccatctggcaacatcggggccaatggagtggccatctttgagagcgtgcacggcacagccccagacattgctgggaaggacatggccaaccccacagccctgctgctgtctgctgtgatgatgctgcggcacatgggcctgtttgaccacgccgccagaattgaagctgcctgctttgccaccatcaaggatggcaagagcctgaccaaggacctgggcggcaatgccaagtgcagcgacttcacagaggagatctgccggcgggtgaaggacctggactag

SEQ ID NO: 156626 - DNA, 774 bp, Artificial Sequence
  Description of Artificial Sequence: Synthetic coding sequence
atgaacctgctgctgaggaagacctttgacctgtatgccaacgtgcggccctgtgtgtccattgagggctacaagaccccctacacagatgtgaacatcgtgaccatccgggagaacacagaaggagagtacagcggcattgaacatgtgattgtggatggagtggtgcagagcatcaagctgatcacagaaggagccagcaagagaattgctgagtttgcctttgaatatgccaggaacaaccacaggagcaatgtgacagctgtgcacaaggccaacatcatgaggatgtctgatggcctcttcctgcagaagtgccgggaggtggccgagagctgcaaggacatcaagttcaatgagatgtacctggacacagtgtgcctgaacatggtgcaggaccccagccagtttgatgtgctggtgatgcccaacctgtatggagacatcctgagtgacctgtgtgccggcctcatcggcggcctgggcgtgacccccagcggcaacattggagccaacggggtggccatctttgaatctgtgcatggaacagccccagacattgctgggaaggacatggccaaccccacagccctgctgctgtctgctgtgatgatgctgcggcacatgggcctgtttgaccatgctgcccgcatcgaggccgcctgctttgccaccatcaaggatggcaagagcctgaccaaggacctgggcggcaatgccaagtgcagcgacttcacagaggagatctgcagaagagtgaaggacctggactag

SEQ ID NO: 156627 - DNA, 495 bp, Artificial Sequence
  Description of Artificial Sequence: Synthetic coding sequence
atggccgccctgtctggagtgcgctggctgacccgggccctggtgtctgctggcaaccctggggcctggaggggcctgagcaccagcgctgctgcccacgccgccagccgcagccaggctgaagatgtgcgggtggagggcagcttccctgtgaccatgctgcctggagatggagtgggccctgagctgatgcatgctgtgaaggaggtgttcaaggctgctgctgtgcctgtggagttccaggagcaccacctgtctgaggtgcagaacatggccagcgaggagaagctggagcaggtgctgagctccatgaaggagaacaaggtggccatcatcggcaagatccacacccccatggagtacaagggggagctggccagctatgacatgaggctgcggaggaagctggacctgtttgccaacgtggtgcacgtgaagagcctgcccggctatgattctgcccagcagagcaggcctggggaccacagcaggtag

SEQ ID NO: 156628 - DNA, 1158 bp, Artificial Sequence
  Description of Artificial Sequence: Synthetic coding sequence
atggccgccctgtctggagtgcgctggctgacccgggccctggtgtctgctggcaaccctggggcctggaggggcctgagcaccagcgctgctgcccacgccgccagccgcagccaggctgaagatgtgcgggtggagggcagcttccctgtgaccatgctgcctggagatggagtgggccctgagctgatgcatgctgtgaaggaggtgttcaaggctgctgctgtgcctgtggagttccaggagcaccacctgtctgaggtgcagaacatggccagcgaggagaagctggagcaggtgctgagctccatgaaggagaacaaggtggccatcatcggcaagatccacacccccatggagtacaagggggagctggccagctatgacatgaggctgcggaggaagctggacctgtttgccaacgtggtgcacgtgaagagcctgcccggctacatgaccaggcacaacaacctggacctggtgatcatccgggagcagacagaaggagagtacagcagcctggagcacgagagcgcccggggcgtgattgagtgcctgaagatcgtgacccgggccaagagccagagaattgccaagtttgcctttgattatgccaccaagaagggccggggcaaggtgacagctgtgcacaaggccaacatcatgaagctgggagatggcctcttcctgcagtgctgtgaggaggtggccgagctgtaccccaagatcaagtttgagaccatgatcatcgacaactgctgcatgcagctggtgcagaacccctaccagtttgatgtgctggtgatgcccaacctgtatggcaacatcatcgacaacctggccgccggcctggtgggcggggccggcgtggtgcctggagagagctacagcgcagaatatgctgtgtttgaaacaggagcccggcacccctttgcccaggccgtgggcagaaatattgccaaccccacagccatgctgctgagcgccagcaacatgctgcggcacctgaacctggagtaccacagctccatgattgctgatgctgtgaagaaggtgatcaaggtgggcaaggtgaggacccgggacatgggcggctacagcaccaccacagacttcatcaagtctgtgattggccacctgcagaccaagggcagctag

SEQ ID NO: 156629 - DNA, 1152 bp, Artificial Sequence
  Description of Artificial Sequence: Synthetic coding sequence
atggccgccctgtctggagtgcgctggctgacccgggccctggtgtctgctggcaaccctggggcctggaggggcctgagcaccagcgctgctgcccacgccgccagccgcagccaggctgaagatgtgcgggtggagggcagcttccctgtgaccatgctgcctggagatggagtgggccctgagctgatgcatgctgtgaaggaggtgttcaaggctgctgctgtgcctgtggagttccaggagcaccacctgtctgaggtgcagaacatggccagcgaggagaagctggagcaggtgctgagctccatgaaggagaacaaggtggccatcatcggcaagatccacacccccatggagtacaagggggagctggccagctatgacatgaggctgcggaggaagctggacctgtttgccaacgtggtgcacgtgaagagcctgcccggctacatgaccaggcacaacaacctggacctggtgatcatccgggagcagacagaaggagagtacagcagcctggagcacgagagcgcccggggcgtgattgagtgcctgaagatcgtgacccgggccaagagccagagaattgccaagtttgcctttgattatgccaccaagaagggccggggcaaggtgacagctgtgcacaaggccaacatcatgaagctgggagatggcctcttcctgcagtgctgtgaggaggtggccgagctgtaccccaagatcaagtttgagaccatgatcatcgacaactgctgcatgcagctggtgcagaacccctaccagtttgatgtgctggtgatgcccaacctgtatggcaacatcatcgacaacctggccgccggcctggtgggcggggccggcgtggtgcctggagagagctacagcgcagaatatgctgtgtttgaaacaggagcccggcacccctttgcccaggccgtgggcagaaatattgccaaccccacagccatgctgctgagcgccagcaacatgctgcggcacctgaacctggagtaccacagctccatgattgctgatgctgtgaagaaggtgatcaaggtgggcaaggtgaggaccagtgacatgggcggctacgccacctgccacgacttcacagaagctgtgattgctgccctgccccacccctag

SEQ ID NO: 156630 - DNA, 702 bp, Artificial Sequence
  Description of Artificial Sequence: Synthetic coding sequence
atgaagatgggagagcgctggagcagcctcttccccttccctgtgagccccagctgctgcttcctgctgacccagagcgcccggggcgtgattgagtgcctgaagatcgtgacccgggccaagagccagagaattgccaagtttgcctttgattatgccaccaagaagggccggggcaaggtgacagctgtgcacaaggccaacatcatgaagctgggagatggcctcttcctgcagtgctgtgaggaggtggccgagctgtaccccaagatcaagtttgagaccatgatcatcgacaactgctgcatgcagctggtgcagaacccctaccagtttgatgtgctggtgatgcccaacctgtatggcaacatcatcgacaacctggccgccggcctggtgggcggggccggcgtggtgcctggagagagctacagcgcagaatatgctgtgtttgaaacaggagcccggcacccctttgcccaggccgtgggcagaaatattgccaaccccacagccatgctgctgagcgccagcaacatgctgcggcacctgaacctggagtaccacagctccatgattgctgatgctgtgaagaaggtgatcaaggtgggcaaggtgaggacccgggacatgggcggctacagcaccaccacagacttcatcaagtctgtgattggccacctgcagaccaagggcagctag

SEQ ID NO: 156631 - DNA, 795 bp, Artificial Sequence
  Description of Artificial Sequence: Synthetic coding sequence
atggagagcggcaagacagccagccccaagtccatgcccaaggatgcccagatgatggcccagatcctgaaggacatgggcatcacagaatatgagcccagggtcatcaaccagatgctggagtttgccttccgctacgtgaccaccatcctggatgatgccaagatctacagcagccacgccaagaaggccaccgtggatgctgatgatgtgcggctggccatccagtgcagagctgaccagagcttcaccagccccccaccccgggacttcctgctggacatcgcccggcagaggaaccagacccccctgcccctcatcaagccctacagcggcccccggctgcccccagaccgctactgcctgacagcccccaactaccgcctgaagagcctgcagaagaaggccagcaccagcgctggccgcatcaccgtgccccggctgtctgtgggctctgtgaccagccggcccagcacccccaccctgggcacccccaccccccagaccatgtctgtgtccaccaaggtgggcacccccatgagcctgaccggccagcgcttcaccgtgcagatgcccaccagccagagccctgctgtgaaggccagcatcccagccaccagcgctgtgcagaatgtgctgatcaaccccagcctgattggcagcaagaacatcctgatcaccaccaacatgatgagcagccagaacacagccaatgaaagcagcaatgccctgaagaggaagagagaagatgatgatgatgatgatgatgatgatgatgattatgacaacctgtag

SEQ ID NO: 156632 - DNA, 906 bp, Artificial Sequence
  Description of Artificial Sequence: Synthetic coding sequence
atggccatcagaagaaacagagtggccctgaagggcaacatcgagaccaaccacaacctgccccccagccacaagagcaggaacaacatcctgcggaccagcctggacctgtatgccaacgtcatccactgcaagagcctgcccggggtggtgaccaggcacaaggacatcgacatcctgattgtgcgggagaacacagaaggagagtacagcagcctggagcatgaatctgtggccggcgtggtggagagcctgaagatcatcaccaaggccaagagcctgagaattgctgaatatgccttcaagctggcccaggagagcggcaggaagaaggtgacagctgtgcacaaggccaacatcatgaagctgggagatggcctcttcctgcagtgctgccgggaggtggccgcccgctacccccagatcacctttgagaacatgattgtggacaacaccaccatgcagctggtgtcccggccccagcagtttgatgtgatggtgatgcccaacctgtatggcaacatcgtgaacaacgtgtgtgccggcctggtgggcggccctggcctggtggccggggccaactacggccacgtgtatgctgtgtttgaaacagccaccaggaacacaggcaagagcatcgccaacaagaacatcgccaaccccacagccaccctgctggccagctgcatgatgctggaccacctgaagctgcacagctatgccaccagcatcaggaaggctgtgctggcctccatggacaatgaaaatggcctggtgtgtgccgagcccgcctgtgtgctgcagatgcacaccccagacatcggcggccagggcaccaccagcgaggccatccaggacgtcatccgccacatccgggtcatcaatggccgggctgtggaggcctag

SEQ ID NO: 156633 - DNA, 1143 bp, Artificial Sequence
  Description of Artificial Sequence: Synthetic coding sequence
atggccctgaaggtggccaccgtggccggcagcgctgccaaggctgtgctgggccctgccctgctgtgccggccctgggaggtgctgggcgcccacgaggtgcccagcaggaacatcttcagcgagcagaccatcccccccagcgccaagtatggaggccgccacacagtgaccatgatccctggagatggcatcggccctgagctgatgctgcacgtgaagtctgtgttcagacatgcctgtgtgcctgtggactttgaggaggtgcacgtgagcagcaatgctgatgaggaggacatcagaaatgccatcatggccatcagaagaaacagagtggccctgaagggcaacatcgagaccaaccacaacctgccccccagccacaagagcaggaacaacatcctgcggaccagcctggacctgtatgccaacgtcatccactgcaagagcctgcccggggtggtgaccaggcacaaggacatcgacatcctgattgtgcgggagaacacagaaggagagtacagcagcctggagcatgaatctgtggccggcgtggtggagagcctgaagatcatcaccaaggccaagagcctgagaattgctgaatatgccttcaagctggcccaggagagcggcaggaagaaggtgacagctgtgcacaaggccaacatcatgaagctgggagatggcctcttcctgcagtgctgccgggaggtggccgcccgctacccccagatcacctttgagaacatgattgtggacaacaccaccatgcagctggtgtcccggccccagcagtttgatgtgatggtgatgcccaacctgtatggcaacatcgtgaacaacgtgtgtgccggcctggtgggcggccctggcctggtggccggggccaactacggccacgtgtatgctgtgtttgaaacagccaccaggaacacaggcaagagcatcgccaacaagaacatcgccaaccccacagccaccctgctggccagctgcatgatgctggaccacctgaagctgcacagctatgccaccagcatcaggaaggctgtgctggcctccatggacaatgaaaatgtgcgcttccccagccaccccaccctgctgcccaggcctgtgagcccctgcagcctgctgtag

SEQ ID NO: 156634 - DNA, 525 bp, Artificial Sequence
  Description of Artificial Sequence: Synthetic coding sequence
atgtacacctttgaccaggccaccggcggcacagcccagtttgaggcccacagtgatgcccaggccctggtgctgctggatgtgaccccagaccagagcatggtggatgagggcatggcccgggaggtgatcaaccgcatccagaagctgaggaagaagtgcaacctggtgcccacagatgagatcaccgtgtactacaaggccaagtctgagggcacctacctgaacagcgtgattgagagccacacagagttcatcttcaccaccatcaaggcccccctgaagccctaccctgtgagccccagcgacaaggtgctgatccaggagaagacccagctgaagggcagcgagctggagatcaccctgacccggggcagcagcctgcccggccctgcctgtgcctacgtgaacctgaacatctgtgccaatggaagtgagcagggcgagatgcagtggatcatccctgagatctaccacttctggaagccccgctggagcatcgcccctgggaagagcaagaggtag

SEQ ID NO: 156635 - DNA, 525 bp, Artificial Sequence; identical to SEQ ID NO: 156634
  Description of Artificial Sequence: Synthetic coding sequence

SEQ ID NO: 156636 - DNA, 3789 bp, Artificial Sequence
  Description of Artificial Sequence: Synthetic coding sequence
atgctgcagcaggtgcctgagaacatcaacttccctgctgaggaggagaagatcctggagttctggacagagttcaactgcttccaggagtgcctgaagcagagcaagcacaagcccaagttcaccttctatgatggccccccatttgccaccggcctgccccactacggccacatcctggccggcaccatcaaggacatcgtgaccaggtatgcccaccagagcggcttccacgtggacagaagatttggctgggactgccacggcctgcctgtggagtatgaaattgacaagaccctgggcatccggggcccagaagatgtggccaagatgggcatcacagagtacaacaaccagtgccgggccatcgtgatgagatacagcgctgagtggaagagcacagtgtcccggctgggccgctggattgactttgacaatgactacaagaccctgtacccccagttcatggagagcgtgtggtgggtgttcaagcagctgtatgacaagggcctggtgtacagaggagtgaaggtgatgcccttcagcacagcctgcaacacccccctgagcaactttgagagccaccagaactacaaggatgtgcaggaccccagcgtgtttgtgaccttccccctggaggaggatgaaacagtgtccctggtggcctggaccaccaccccctggaccctgcccagcaacctggccgtgtgtgtgaaccctgagatgcagtatgtgaagatcaaggatgtggcccggggccgcctgctgatcctgatggaggcccggctgagcgccctgtacaagctggagagtgactatgagatcctggagcgcttccctggggcctacctgaagggcaagaagtaccggcccctgtttgactacttcctgaagtgcaaggaaaatggagccttcaccgtgctggtggacaactacgtgaaggaggaggagggcactggagtggtgcaccaggccccctactttggagctgaggactacagagtgtgcatggacttcaacatcatcaggaaggacagcctgcctgtgtgccctgtggatgccagcggctgcttcaccacagaggtgacagactttgctggccagtatgtgaaggatgctgacaagagcatcatccgcaccctgaaggagcagggccgcctgctggtggccaccaccttcacccacagctaccccttctgctggaggagtgacacccccctcatctacaaggctgtgcccagctggtttgtgcgggtggagaacatggtggaccagctgctgaggaacaatgacctgtgctactgggtgcctgagctggtgcgggagaagagatttggaaactggctgaaggatgcccgggactggaccatcagcaggaaccgctactggggcacccccatccccctgtgggtgtctgatgactttgaggaggtggtgtgcatcggctctgtggccgagctggaggagctgagcggggccaagatcagtgacctgcaccgggagagcgtggaccacctgaccatccccagccgctgtgggaagggcagcctgcaccgcatcagcgaggtgtttgactgctggtttgagagcggctccatgccctatgcccaggtgcactacccctttgagaacaagcgggagtttgaagatgccttccctgctgacttcatcgccgagggcatcgaccagacccggggctggttctacaccctgctggtgctggccacagccctgtttggccagccccccttcaagaatgtcatcgtgaatggcctggtgctggccagtgatggccagaagatgagcaagaggaagaagaactacccagaccctgtgtccatcatccagaagtacggggctgatgccctgcggctgtacctgatcaacagccctgtggtgcgggcagagaacctgcgcttcaaggaggagggcgtgagagatgtgctgaaggatgtgctgctgccctggtacaatgcctaccgcttcctgatccagaatgtgctgcggctgcagaaggaggaggagattgagttcctgtacaatgaaaatacagtgcgggagagccccaacatcacagaccgctggatcctgtccttcatgcagagcctcatcggcttctttgaaacagagatggccgcctaccgcctgtacacagtggtgccccggctggtgaagtttgtggacatcctgaccaactggtacgtgaggatgaacagaagaaggctgaagggagaaaatggcatggaggactgtgtgatggccctggagaccctcttctctgtgctgctgagcctgtgccgcctgatggccccctacacccccttcctgacagagctgatgtaccagaacctgaaggtgctgattgatcctgtgtctgtgcaggacaaggacaccctgagcatccactacctgatgctgccccgggtgcgggaggagctgattgacaagaagacagagagcgctgtgtcccagatgcagagcgtgattgagctgggccgggtcatccgggacaggaagaccatccccatcaagtaccccctgaaggagatcgtggtgatccaccaggaccctgaggccctgaaggacatcaagagcctggagaagtacatcatcgaggagctgaatgtgaggaaggtgaccctgagcacagacaagaacaagtatggcatccggctgcgggcagagccagaccacatggtgctgggcaagaggctgaagggggccttcaaggctgtgatgaccagcatcaagcagctgagcagcgaggagctggagcagttccagaagacaggcaccatcgtggtggagggccacgagctgcatgatgaggacatccggctgatgtacacctttgaccaggccactggaggaacagcccagtttgaggcccacagtgatgcccaggccctggtgctgctggatgtgaccccagaccagagcatggtggatgagggcatggcccgggaggtgatcaaccgcatccagaagctgaggaagaagtgcaacctggtgcccacagatgagatcaccgtgtactacaaggccaagtctgagggcacctacctgaacagcgtcatcgagagccacacagagttcatcttcaccaccatcaaggcccccctgaagccctaccctgtgagccccagcgacaaggtgctgatccaggagaagacccagctgaagggcagcgagctggagatcaccctgacccggggcagcagcctgcccggccctgcctgtgcctacgtgaacctgaacatctgtgccaacggcagcgagcagggcggcgtgctgctgctggagaaccccaagggggacaaccggctggacctgctgaagctgaagtctgtggtgaccagcatcttcggcgtgaagaacacagagctggccgtgttccatgatgaaacagagatccagaaccagacagacctgctgagcctgagcggcaagaccctgtgtgtgacagctggcagcgcccccagcctcatcaacagcagcagcaccctgctgtgccagtacatcaacctgcagctgctgaatgccaagccccaggagtgcctgatgggcaccgtgggcaccctgctgctggagaaccccctgggccagaatggcctgacccaccagggcctgctgtatgaggccgccaaggtgtttggcctgcggagcaggaagctgaagctgttcctgaatgagacccagacccaggagatcacagaggacatccctgtgaagaccctgaacatgaagacagtgtatgtgtctgtgctgcccaccacagctgacttctag

SEQ ID NO: 156637 - DNA, 3729 bp, Artificial Sequence
  Description of Artificial Sequence: Synthetic coding sequence
atgctgcagcaggtgcctgagaacatcaacttccctgctgaggaggagaagatcctggagttctggacagagttcaactgcttccaggagtgcctgaagcagagcaagcacaagcccaagttcaccttctatgatggccccccatttgccaccggcctgccccactacggccacatcctggccggcaccatcaaggacatcgtgaccaggtatgcccaccagagcggcttccacgtggacagaagatttggctgggactgccacggcctgcctgtggagtatgaaattgacaagaccctgggcatccggggcccagaagatgtggccaagatgggcatcacagagtacaacaaccagtgccgggccatcgtgatgagatacagcgctgagtggaagagcacagtgtcccggctgggccgctggattgactttgacaatgactacaagaccctgtacccccagttcatggagagcgtgtggtgggtgttcaagcagctgtatgacaagggcctggtgtacagaggagtgaaggtgatgcccttcagcacagcctgcaacacccccctgagcaactttgagagccaccagaactacaaggatgtgcaggaccccagcgtgtttgtgaccttccccctggaggaggatgaaacagtgtccctggtggcctggaccaccaccccctggaccctgcccagcaacctggccgtgtgtgtgaaccctgagatgcagtatgtgaagatcaaggatgtggcccggggccgcctgctgatcctgatggaggcccggctgagcgccctgtacaagctggagagtgactatgagatcctggagcgcttccctggggcctacctgaagggcaagaagtaccggcccctgtttgactacttcctgaagtgcaaggaaaatggagccttcaccgtgctggtggacaactacgtgaaggaggaggagggcactggagtggtgcaccaggccccctactttggagctgaggactacagagtgtgcatggacttcaacatcatcaggaaggacagcctgcctgtgtgccctgtggatgccagcggctgcttcaccacagaggtgacagactttgctggccagtatgtgaaggatgctgacaagagcatcatccgcaccctgaaggagcagggccgcctgctggtggccaccaccttcacccacagctaccccttctgctggaggagtgacacccccctcatctacaaggctgtgcccagctggtttgtgcgggtggagaacatggtggaccagctgctgaggaacaatgacctgtgctactgggtgcctgagctggtgcgggagaagagatttggaaactggctgaaggatgcccgggactggaccatcagcaggaaccgctactggggcacccccatccccctgtgggtgtctgatgactttgaggaggtggtgtgcatcggctctgtggccgagctggaggagctgagcggggccaagatcagtgacctgcaccgggagagcgtggaccacctgaccatccccagccgctgtgggaagggcagcctgcaccgcatcagcgaggtgtttgactgctggtttgagagcggctccatgccctatgcccaggtgcactacccctttgagaacaagcgggagtttgaagatgccttccctgctgacttcatcgccgagggcatcgaccagacccggggctggttctacaccctgctggtgctggccacagccctgtttggccagccccccttcaagaatgtcatcgtgaatggcctggtgctggccagtgatggccagaagatgagcaagaggaagaagaactacccagaccctgtgtccatcatccagaagtacggggctgatgccctgcggctgtacctgatcaacagccctgtggtgcgggcagagaacctgcgcttcaaggaggagggcgtgagagatgtgctgaaggatgtgctgctgccctggtacaatgcctaccgcttcctgatccagaatgtgctgcggctgcagaaggaggaggagattgagttcctgtacaatgaaaatacagtgcgggagagccccaacatcacagaccgctggatcctgtccttcatgcagagcctcatcggcttctttgaaacagagatggccgcctaccgcctgtacacagtggtgccccggctggtgaagtttgtggacatcctgaccaactggtacgtgaggatgaacagaagaaggctgaagggagaaaatggcatggaggactgtgtgatggccctggagaccctcttctctgtgctgctgagcctgtgccgcctgatggccccctacacccccttcctgacagagctgatgtaccagaacctgaaggtgctgattgatcctgtgtctgtgcaggacaaggacaccctgagcatccactacctgatgctgccccgggtgcgggaggagctgattgacaagaagacagagagcgctgtgtcccagatgcagagcgtgattgagctgggccgggtcatccgggacaggaagaccatccccatcaagtaccccctgaaggagatcgtggtgatccaccaggaccctgaggccctgaaggacatcaagagcctggagaagtacatcatcgaggagctgaatgtgaggaaggtgaccctgagcacagacaagaacaagtatggcatccggctgcgggcagagccagaccacatggtgctgggcaagaggctgaagggggccttcaaggctgtgatgaccagcatcaagcagctgagcagcgaggagctggagcagttccagaagacaggcaccatcgtggtggagggccacgagctgcatgatgaggacatccggctgatgtacacctttgaccaggccactggaggaacagcccagtttgaggcccacagtgatgcccaggccctggtgctgctggatgtgaccccagaccagagcatggtggatgagggcatggcccgggaggtgatcaaccgcatccagaagctgaggaagaagtgcaacctggtgcccacagatgagatcaccgtgtactacaaggccaagtctgagggcacctacctgaacagcgtcatcgagagccacacagagttcatcttcaccaccatcaaggcccccctgaagccctaccctgtgagccccagcgacaaggtgctgatccaggagaagacccagctgaagggcagcgagctggagatcaccctgacccggggcagcagcctgcccggccctgcctgtgcctacgtgaacctgaacatctgtgccaacggcagcgagcagggcggcgtgctgctgctggagaaccccaagggggacaaccggctggacctgctgaagctgaagtctgtggtgaccagcatcttcggcgtgaagaacacagagctggccgtgttccatgatgaaacagagatccagaaccagacagacctgctgagcctgagcggcaagaccctgtgtgtgacagctggcagcgcccccagcctcatcaacagcagcagcaccctgctgtgccagtacatcaacctgcagctgctgaatgccaagccccaggagtgcctgatgggcaccgtgggcaccctgctgctggagaaccccctgggccagaatggcctgacccaccagggcctgctgtatgaggccgccaaggtgtttggcctgcggagcaggaagctgaagctgttcctgaatgagacccagacccaggagatcacagaggacatcccctag

SEQ ID NO: 156638 - DNA, 993 bp, Artificial Sequence
  Description of Artificial Sequence: Synthetic coding sequence
atgctgcagcaggtgcctgagaacatcaacttccctgctgaggaggagaagatcctggagttctggacagagttcaactgcttccaggagtgcctgaagcagagcaagcacaagcccaagttcaccttctatgatggccccccatttgccaccggcctgccccactacggccacatcctggccggcaccatcaaggacatcgtgaccaggtatgcccaccagagcggcttccacgtggacagaagatttggctgggactgccacggcctgcctgtggagtatgaaattgacaagaccctgggcatccggggcccagaagatgtggccaagatgggcatcacagagtacaacaaccagtgccgggccatcgtgatgagatacagcgctgagtggaagagcacagtgtcccggctgggccgctggattgactttgacaatgactacaagaccctgtacccccagttcatggagagcgtgtggtgggtgttcaagcagctgtatgacaagggcctggtgtacagaggagtgaaggtgatgcccttcagcacagcctgcaacacccccctgagcaactttgagagccaccagaactacaaggatgtgcaggaccccagcgtgtttgtgaccttccccctggaggaggatgaaacagtgtccctggtggcctggaccaccaccccctggaccctgcccagcaacctggccgtgtgtgtgaaccctgagatgcagtatgtgaagatcaaggatgtggcccggggccgcctgctgatcctgatggaggcccggctgagcgccctgtacaagctggagagtgactatgagatcctggagcgcttccctggggcctacctgaagggcaagaagtaccggcccctgtttgactacttcctgaagtgcaaggaaaatggagccttcaccgtgctggtggacaactacgtgaaggaggaggagggcactggagtggtgcaccaggccccctactttggagcctag

SEQ ID NO: 156639 - DNA, 513 bp, Artificial Sequence
  Description of Artificial Sequence: Synthetic coding sequence
atggccccctacacccccttcctgacagagctgatgtaccagaacctgaaggtgctgattgatcctgtgtctgtgcaggacaaggacaccctgagcatccactacctgatgctgccccgggtgcgggaggagctgattgacaagaagacagagagcgctgtgtcccagatgcagagcgtgattgagctgggccgggtcatccgggacaggaagaccatccccatcaagctgaagggcagcgagctggagatcaccctgacccggggcagcagcctgcccggccctgcctgtgcctacgtgaacctgaacatctgtgccaatggaagtgagcagggcggcgtgctgctgctggagaaccccaagggggacaaccggctggacctgctgaagctgaagtctgtggtgaccagcatctttggagtgaagaacacagagctggccgtgttccatgatgaaacagagatccagaaccagacagacctgctgagcctgagcggcaagaccctgtgctag

SEQ ID NO: 156640 - DNA, 3789 bp, Artificial Sequence; identical to SEQ ID NO: 156636
  Description of Artificial Sequence: Synthetic coding sequence

SEQ ID NO: 156641 - DNA, 3459 bp, Artificial Sequence
  Description of Artificial Sequence: Synthetic coding sequence
atgggcatcacagagtacaacaaccagtgccgggccatcgtgatgagatacagcgctgagtggaagagcacagtgtcccggctgggccgctggattgactttgacaatgactacaagaccctgtacccccagttcatggagagcgtgtggtgggtgttcaagcagctgtatgacaagggcctggtgtacagaggagtgaaggtgatgcccttcagcacagcctgcaacacccccctgagcaactttgagagccaccagaactacaaggatgtgcaggaccccagcgtgtttgtgaccttccccctggaggaggatgaaacagtgtccctggtggcctggaccaccaccccctggaccctgcccagcaacctggccgtgtgtgtgaaccctgagatgcagtatgtgaagatcaaggatgtggcccggggccgcctgctgatcctgatggaggcccggctgagcgccctgtacaagctggagagtgactatgagatcctggagcgcttccctggggcctacctgaagggcaagaagtaccggcccctgtttgactacttcctgaagtgcaaggaaaatggagccttcaccgtgctggtggacaactacgtgaaggaggaggagggcactggagtggtgcaccaggccccctactttggagctgaggactacagagtgtgcatggacttcaacatcatcaggaaggacagcctgcctgtgtgccctgtggatgccagcggctgcttcaccacagaggtgacagactttgctggccagtatgtgaaggatgctgacaagagcatcatccgcaccctgaaggagcagggccgcctgctggtggccaccaccttcacccacagctaccccttctgctggaggagtgacacccccctcatctacaaggctgtgcccagctggtttgtgcgggtggagaacatggtggaccagctgctgaggaacaatgacctgtgctactgggtgcctgagctggtgcgggagaagagatttggaaactggctgaaggatgcccgggactggaccatcagcaggaaccgctactggggcacccccatccccctgtgggtgtctgatgactttgaggaggtggtgtgcatcggctctgtggccgagctggaggagctgagcggggccaagatcagtgacctgcaccgggagagcgtggaccacctgaccatccccagccgctgtgggaagggcagcctgcaccgcatcagcgaggtgtttgactgctggtttgagagcggctccatgccctatgcccaggtgcactacccctttgagaacaagcgggagtttgaagatgccttccctgctgacttcatcgccgagggcatcgaccagacccggggctggttctacaccctgctggtgctggccacagccctgtttggccagccccccttcaagaatgtcatcgtgaatggcctggtgctggccagtgatggccagaagatgagcaagaggaagaagaactacccagaccctgtgtccatcatccagaagtacggggctgatgccctgcggctgtacctgatcaacagccctgtggtgcgggcagagaacctgcgcttcaaggaggagggcgtgagagatgtgctgaaggatgtgctgctgccctggtacaatgcctaccgcttcctgatccagaatgtgctgcggctgcagaaggaggaggagattgagttcctgtacaatgaaaatacagtgcgggagagccccaacatcacagaccgctggatcctgtccttcatgcagagcctcatcggcttctttgaaacagagatggccgcctaccgcctgtacacagtggtgccccggctggtgaagtttgtggacatcctgaccaactggtacgtgaggatgaacagaagaaggctgaagggagaaaatggcatggaggactgtgtgatggccctggagaccctcttctctgtgctgctgagcctgtgccgcctgatggccccctacacccccttcctgacagagctgatgtaccagaacctgaaggtgctgattgatcctgtgtctgtgcaggacaaggacaccctgagcatccactacctgatgctgccccgggtgcgggaggagctgattgacaagaagacagagagcgctgtgtcccagatgcagagcgtgattgagctgggccgggtcatccgggacaggaagaccatccccatcaagtaccccctgaaggagatcgtggtgatccaccaggaccctgaggccctgaaggacatcaagagcctggagaagtacatcatcgaggagctgaatgtgaggaaggtgaccctgagcacagacaagaacaagtatggcatccggctgcgggcagagccagaccacatggtgctgggcaagaggctgaagggggccttcaaggctgtgatgaccagcatcaagcagctgagcagcgaggagctggagcagttccagaagacaggcaccatcgtggtggagggccacgagctgcatgatgaggacatccggctgatgtacacctttgaccaggccactggaggaacagcccagtttgaggcccacagtgatgcccaggccctggtgctgctggatgtgaccccagaccagagcatggtggatgagggcatggcccgggaggtgatcaaccgcatccagaagctgaggaagaagtgcaacctggtgcccacagatgagatcaccgtgtactacaaggccaagtctgagggcacctacctgaacagcgtcatcgagagccacacagagttcatcttcaccaccatcaaggcccccctgaagccctaccctgtgagccccagcgacaaggtgctgatccaggagaagacccagctgaagggcagcgagctggagatcaccctgacccggggcagcagcctgcccggccctgcctgtgcctacgtgaacctgaacatctgtgccaacggcagcgagcagggcggcgtgctgctgctggagaaccccaagggggacaaccggctggacctgctgaagctgaagtctgtggtgaccagcatcttcggcgtgaagaacacagagctggccgtgttccatgatgaaacagagatccagaaccagacagacctgctgagcctgagcggcaagaccctgtgtgtgacagctggcagcgcccccagcctcatcaacagcagcagcaccctgctgtgccagtacatcaacctgcagctgctgaatgccaagccccaggagtgcctgatgggcaccgtgggcaccctgctgctggagaaccccctgggccagaatggcctgacccaccagggcctgctgtatgaggccgccaaggtgtttggcctgcggagcaggaagctgaagctgttcctgaatgagacccagacccaggagatcacagaggacatccctgtgaagaccctgaacatgaagacagtgtatgtgtctgtgctgcccaccacagctgacttctag

SEQ ID NO: 156642 - DNA, 750 bp, Artificial Sequence
  Description of Artificial Sequence: Synthetic coding sequence
atggccccctacacccccttcctgacagagctgatgtaccagaacctgaaggtgctgattgatcctgtgtctgtgcaggacaaggacaccctgagcatccactacctgatgctgccccgggtgcgggaggagctgattgacaagaagacagagagcgctgtgtcccagatgcagagcgtgattgagctgggccgggtcatccgggacaggaagaccatccccatcaagtaccccctgaaggagatcgtggtgatccaccaggaccctgaggccctgaaggacatcaagagcctggagaagtacatcatcgaggagctgaatgtgaggaaggtgaccctgagcacagacaagaacaagtatggcatccggctgcgggcagagccagaccacatggtgctgggcaagaggctgaagggggccttcaaggctgtgatgaccagcatcaagcagctgagcagcgaggagctggagcagttccagaagacaggcaccatcgtggtggagggccacgagctgcatgatgaggacatccggctgatgtacacctttgaccaggccactggaggaacagcccagtttgaggcccacagtgatgcccaggccctggtgctgctggatgtgaccccagaccagagcatggtggatgagggcatggcccgggaggtgatcaaccgcatccagaagctgaggaagaagtgcaacctggtgcccacagatgagatcaccgtgtactacaaggccaagagctag

SEQ ID NO: 156643 - DNA, 513 bp, Artificial Sequence; identical to SEQ ID NO: 156639
  Description of Artificial Sequence: Synthetic coding sequence

SEQ ID NO: 156644 - DNA, 816 bp, Artificial Sequence
  Description of Artificial Sequence: Synthetic coding sequence
atgatggtgctgctgctgcagctggactgcctgaccatggacatctacctgcgggacaaggacaccctgagcatccactacctgatgctgccccgggtgcgggaggagctgattgacaagaagacagagagcgctgtgtcccagatgcagagcgtgattgagctgggccgggtcatccgggacaggaagaccatccccatcaagctgaagggcagcgagctggagatcaccctgacccggggcagcagcctgcccggccctgcctgtgcctacgtgaacctgaacatctgtgccaatggaagtgagcagggcggcgtgctgctgctggagaaccccaagggggacaaccggctggacctgctgaagctgaagtctgtggtgaccagcatctttggagtgaagaacacagagctggccgtgttccatgatgaaacagagatccagaaccagacagacctgctgagcctgagcggcaagaccctgtgtgtgacagctggcagcgcccccagcctcatcaacagcagcagcaccctgctgtgccagtacatcaacctgcagctgctgaatgccaagccccaggagtgcctgatgggcaccgtgggcaccctgctgctggagaaccccctgggccagaatggcctgacccaccagggcctgctgtatgaagctgccaaggtgtttggcctgcggagcaggaagctgaagctgttcctgaatgagacccagacccaggagatcacagaggacatccctgtgaagaccctgaacatgaagacagtgtatgtgtctgtgctgcccaccacagctgacttctag

SEQ ID NO: 156645 - DNA, 3039 bp, Artificial Sequence
  Description of Artificial Sequence: Synthetic coding sequence
atgcgctggggcctgcggccccggggccctggagctgctgccctggccacagcccggagcctgtggggcaccccccggctgccctgcagccctggctggcagggcgccaccaagaggctgctggtgcgctctgtgtctggggccagcaaccaccagcccaacagcaacagcggccgctacagagacacagtgctgctgccccagaccagcttccccatgaagctgctgggccggcagcagcctgacacagagctggagatccagcagaagtgtggcttcagcgagctgtacagctggcagcgggagaggaaggtgaagacagagttctgcctgcatgatggccccccctatgccaatggagacccccacgtgggccacgccctgaacaagatcctgaaggacatcgccaaccgcttccacatgatgaatggcagcaagatccactttgtgcccggctgggactgccacggcctgcccatcgagatcaaggtgctgtctgagctgggccgggaggcccagaacctgagcgccatggagatcaggaagaaggcccggagctttgccaaggccgccatcgagaagcagaagagcgccttcatccgctggggcatcatggctgactggaacaactgctactacacctttgatggcaagtatgaggccaagcagctgcggaccttctaccagatgtatgacaagggcctggtgtaccgcagctacaagcctgtgttctggagccccagcagcaggacagccctggccgaggccgagctggagtacaaccctgagcacgtgagccgcagcatctacgtgaagttccccctgctgaagcccagccccaagctggccagcctgattgatggcagcagccctgtgtccatcctggtgtggaccacccagccctggaccatcccagccaatgaagctgtgtgctacatgcctgagagcaaatatgctgtggtgaagtgcagcaagagcggggacctgtatgtgctggccgctgacaaggtggcctctgtggccagcaccctggagaccacctttgagaccatcagcaccctgtctggagtggacctggagaatggcacctgcagccaccccctcatcccagacaaggccagccccctgctgcctgccaaccacgtgaccatggccaagggcaccggcctggtgcacacagccccagcccacggcatggaggactatggagtggccagccagcacaacctgcccatggactgcctggtggatgaagatggagtcttcacagatgtggccggccctgagctgcagaacaaggctgtgctggaggagggcacagatgtggtgatcaagatgctgcagacagccaagaacctgctgaaggaggagaagctggtgcacagctacccctatgactggaggaccaagaagcctgtggtgatccgggccagcaagcagtggttcatcaacatcacagacatcaagacagctgccaaggagctgctgaagaaggtgaagttcatccctggcagcgccctgaatggcatggtggagatgatggaccggcggccctactggtgcatcagccggcagagggtgtggggcgtgcccatccctgtgttccaccacaagaccaaggatgagtacctgatcaacagccagaccacagagcacatcgtgaagctggtggagcagcacggcagtgacatctggtggaccctgcccccagagcagctgctgcccaaggaggtgctgtctgaggtgggcggcccagatgccctggagtatgtgcccggccaggacatcctggacatctggtttgattctggcacctcctggagctatgtgctgcccggccctgaccagagagctgacctgtacctggagggcaaggaccagctgggcggctggttccagagcagcctgctgacctctgtggccgccaggaagagggccccctacaagacagtcatcgtgcacggcttcaccctgggggagaagggggagaagatgagcaagagcctgggcaatgtcatccacccagatgtggtggtgaatggaggccaggaccagagcaaggagcccccctatggagcagatgtgctgcgctggtgggtggccgacagcaatgtgttcacagaggtggccatcggccccagcgtgctgaatgctgccagagatgacatcagcaagctgaggaacaccctgcgcttcctgctgggcaatgtggccgacttcaaccctgagacagacagcatccctgtgaatgacatgtatgtgattgaccagtacatgctgcacctgctgcaggacctggccaacaagatcacagagctgtacaagcagtatgactttgggaaggtggtgcggctgctgcggaccttctacacccgggagctgagcaacttctacttcagcatcatcaaggaccggctgtactgtgagaaggaaaatgaccccaagaggaggagctgccagacagccctggtggagatcctggatgtgattgtgcgcagctttgcccccatcctgccccacctggccgaggaggtgttccagcacatcccctacatcaaggagcccaagtctgtgttcagaacaggctggatcagcaccagcagcatctggaagaagccaggcctggaggaggccgtggagagcgcctgtgccatgagggacagcttcctgggcagcatccctgggaagaatgctgctgagtacaaggtgatcaccgtgattgagcccggcctgctgtttgagatcatcgagatgctgcagagcgaggagaccagcagcaccagccagctgaatgagctgatgatggccagcgagagcaccctgctggcccaggagccccgggagatgacagcagatgtgattgagctgaagggcaagttcctgatcaacctggagggcggggacatccgggaggagagcagctacaaggtgattgtgatgcccaccaccaaggagaagtgcccccgctgctggaagtacacagctgagagcagtgacaccctgtgcccccgctgtgccgaggtggtgtctgggaagtag

SEQ ID NO: 156646 - DNA, 2823 bp, Artificial Sequence
  Description of Artificial Sequence: Synthetic coding sequence
atgaagctgctgggccggcagcagcctgacacagagctggagatccagcagaagtgtggcttcagcgagctgtacagctggcagcgggagaggaaggtgaagacagagttctgcctgcatgatggccccccctatgccaatggagacccccacgtgggccacgccctgaacaagatcctgaaggacatcgccaaccgcttccacatgatgaatggcagcaagatccactttgtgcccggctgggactgccacggcctgcccatcgagatcaaggtgctgtctgagctgggccgggaggcccagaacctgagcgccatggagatcaggaagaaggcccggagctttgccaaggccgccatcgagaagcagaagagcgccttcatccgctggggcatcatggctgactggaacaactgctactacacctttgatggcaagtatgaggccaagcagctgcggaccttctaccagatgtatgacaagggcctggtgtaccgcagctacaagcctgtgttctggagccccagcagcaggacagccctggccgaggccgagctggagtacaaccctgagcacgtgagccgcagcatctacgtgaagttccccctgctgaagcccagccccaagctggccagcctgattgatggcagcagccctgtgtccatcctggtgtggaccacccagccctggaccatcccagccaatgaagctgtgtgctacatgcctgagagcaaatatgctgtggtgaagtgcagcaagagcggggacctgtatgtgctggccgctgacaaggtggcctctgtggccagcaccctggagaccacctttgagaccatcagcaccctgtctggagtggacctggagaatggcacctgcagccaccccctcatcccagacaaggccagccccctgctgcctgccaaccacgtgaccatggccaagggcaccggcctggtgcacacagccccagcccacggcatggaggactatggagtggccagccagcacaacctgcccatggactgcctggtggatgaagatggagtcttcacagatgtggccggccctgagctgcagaacaaggctgtgctggaggagggcacagatgtggtgatcaagatgctgcagacagccaagaacctgctgaaggaggagaagctggtgcacagctacccctatgactggaggaccaagaagcctgtggtgatccgggccagcaagcagtggttcatcaacatcacagacatcaagacagctgccaaggagctgctgaagaaggtgaagttcatccctggcagcgccctgaatggcatggtggagatgatggaccggcggccctactggtgcatcagccggcagagggtgtggggcgtgcccatccctgtgttccaccacaagaccaaggatgagtacctgatcaacagccagaccacagagcacatcgtgaagctggtggagcagcacggcagtgacatctggtggaccctgcccccagagcagctgctgcccaaggaggtgctgtctgaggtgggcggcccagatgccctggagtatgtgcccggccaggacatcctggacatctggtttgattctggcacctcctggagctatgtgctgcccggccctgaccagagagctgacctgtacctggagggcaaggaccagctgggcggctggttccagagcagcctgctgacctctgtggccgccaggaagagggccccctacaagacagtcatcgtgcacggcttcaccctgggggagaagggggagaagatgagcaagagcctgggcaatgtcatccacccagatgtggtggtgaatggaggccaggaccagagcaaggagcccccctatggagcagatgtgctgcgctggtgggtggccgacagcaatgtgttcacagaggtggccatcggccccagcgtgctgaatgctgccagagatgacatcagcaagctgaggaacaccctgcgcttcctgctgggcaatgtggccgacttcaaccctgagacagacagcatccctgtgaatgacatgtatgtgattgaccagtacatgctgcacctgctgcaggacctggccaacaagatcacagagctgtacaagcagtatgactttgggaaggtggtgcggctgctgcggaccttctacacccgggagctgagcaacttctacttcagcatcatcaaggaccggctgtactgtgagaaggaaaatgaccccaagaggaggagctgccagacagccctggtggagatcctggatgtgattgtgcgcagctttgcccccatcctgccccacctggccgaggaggtgttccagcacatcccctacatcaaggagcccaagtctgtgttcagaacaggctggatcagcaccagcagcatctggaagaagccaggcctggaggaggccgtggagagcgcctgtgccatgagggacagcttcctgggcagcatccctgggaagaatgctgctgagtacaaggtgatcaccgtgattgagcccggcctgctgtttgagatcatcgagatgctgcagagcgaggagaccagcagcaccagccagctgaatgagctgatgatggccagcgagagcaccctgctggcccaggagccccgggagatgacagcagatgtgattgagctgaagggcaagttcctgatcaacctggagggcggggacatccgggaggagagcagctacaaggtgattgtgatgcccaccaccaaggagaagtgcccccgctgctggaagtacacagctgagagcagtgacaccctgtgcccccgctgtgccgaggtggtgtctgggaagtag

SEQ ID NO: 156647 - DNA, 855 bp, Artificial Sequence
  Description of Artificial Sequence: Synthetic coding sequence
atggccggctgtgccgcccgggcccctcctggcagcgaggcccggctgagcctggccaccttcctgctgggcgcctctgtgctggccctgcccctgctgacccgggccggcctgcagggccgcacaggcctggccctgtatgtggccggcctgaatgccctgctgctgctgctgtacagaccaccccgctaccagatcgccatccgggcctgcttcctgggctttgtgtttggctgcggcaccctgctgtccttcagccagagctcctggagccacttcggctggtacatgtgcagcctgagcctcttccactacagcgagtacctggtgacagctgtgaacaaccccaagagcctgagcctggacagcttcctgctgaaccacagcctggagtacacagtggccgccctgagctcctggctggagttcaccctggagaacatcttctggccagagctgaagcagatcacctggctgtctgtgacaggcctgctgatggtggtgtttggagaatgtctgaggaaggccgccatgttcaccgctggcagcaacttcaaccacgtggtgcagaatgagaagagtgacacccacaccctggtgaccagcggcgtgtatgcctggttccgccaccccagctatgtgggctggttctactggagcatcggcacccaggtgatgctgtgcaaccccatctgtggggtgtcctatgccctgactgtgtggaggttcttccgggacagaacagaggaggaggagatcagcctcatccacttctttggagaggagtacctggagtacaagaagagggtgcccaccggcctgcccttcatcaagggcgtgaaggtggacctgtag

SEQ ID NO: 156648 - DNA, 351 bp, Artificial Sequence
  Description of Artificial Sequence: Synthetic coding sequence
atggccggctgtgccgcccgggcccctcctggcagcgaggcccggctgagcctggccaccttcctgctgggcgcctctgtgctggccctgcccctgctgacccgggccggcctgcagggccgcacaggcctggccctgtatgtggccggcctgaatgccctgctgctgctgctgtacagaccaccccgctaccagatcgccatccgggcctgcttcctgggctttgtgtttggctgcggcaccctgctgtccttcagccagagctcctggagccacttcggctggagccacctggtgcacccccacagccactgccgcatcttcccctacaccatgatctctgtgccctag

SEQ ID NO: 156649 - DNA, 567 bp, Artificial Sequence
  Description of Artificial Sequence: Synthetic coding sequence
atgtgcagcctgagcctcttccactacagcgagtacctggtgacagctgtgaacaaccccaagagcctgagcctggacagcttcctgctgaaccacagcctggagtacacagtggccgccctgagctcctggctggagttcaccctggagaacatcttctggccagagctgaagcagatcacctggctgtctgtgacaggcctgctgatggtggtgtttggagaatgtctgaggaaggccgccatgttcaccgctggcagcaacttcaaccacgtggtgcagaatgagaagagtgacacccacaccctggtgaccagcggcgtgtatgcctggttccgccaccccagctatgtgggctggttctactggagcatcggcacccaggtgatgctgtgcaaccccatctgtggggtgtcctatgccctgactgtgtggaggttcttccgggacagaacagaggaggaggagatcagcctcatccacttctttggagaggagtacctggagtacaagaagagggtgcccaccggcctgcccttcatcaagggcgtgaaggtggacctgtag

SEQ ID NO: 156650 - DNA, 1272 bp, Artificial Sequence
  Description of Artificial Sequence: Synthetic coding sequence
atggccacagccacccggctgctgggctggagggtggcctcctggaggctgcggccccccctggccggctttgtgtcccagagggcccacagcctgctgcctgtggatgatgccatcaatggcctgtctgaggagcagaggcagctgcggcagaccatggccaagttcctgcaggagcacctggcccccaaggcccaggagattgacaggagcaatgagttcaagaacctgcgggagttctggaagcagctgggcaacctgggcgtgctgggcatcacagcccctgtgcagtatggaggcagcggcctgggctacctggagcacgtgctggtgatggaggagatcagccgggccagcggggctgtgggcctgtcctatggagcccacagcaacctgtgcatcaaccagctggtgagaaatggaaatgaggcccagaaggagaagtacctgcccaagctgatctctggagagtacatcggggccctggccatgtctgagcccaatgccggcagtgatgtggtgtccatgaagctgaaggccgagaagaagggcaaccactacatcctgaatggaaacaagttctggatcaccaacggcccagatgctgatgtgctgattgtgtatgccaagacagacctggccgctgtgcctgccagccggggcatcacagccttcatcgtggagaagggcatgcctggcttcagcaccagcaagaagctggacaagctgggcatgaggggcagcaacacctgtgagctgatctttgaggactgcaagatcccagctgccaacatcctgggccatgaaaataaaggagtgtatgtgctgatgagcggcctggacctggagcggctggtgctggccggcggccccctgggcctgatgcaggccgtgctggaccacaccatcccctacctgcacgtgcgggaggccttcggccagaagattggccacttccagctgatgcagggcaagatggctgacatgtacacccggctgatggcctgccggcagtatgtgtacaacgtggccaaggcctgtgatgagggccactgcacagccaaggactgtgccggggtcatcctgtacagcgcagaatgtgccacccaggtggccctggatggcatccagtgctttggaggaaatggctacatcaatgacttccccatgggccgcttcctgagagatgccaagctgtatgagatcggggccggcaccagcgaggtgcggcggctggtgattggccgggccttcaatgctgacttccactag

SEQ ID NO: 156651 - DNA, 1191 bp, Artificial Sequence
  Description of Artificial Sequence: Synthetic coding sequence
atggccgagatggccacagccacccggctgctgggctggagggtggcctcctggaggctgcggccccccctggccggctttgtgtcccagagggcccacagcctgctgcctgtggatgatgccatcaatggcctgtctgaggagcagaggcaggagttctggaagcagctgggcaacctgggcgtgctgggcatcacagcccctgtgcagtatggaggcagcggcctgggctacctggagcacgtgctggtgatggaggagatcagccgggccagcggggctgtgggcctgtcctatggagcccacagcaacctgtgcatcaaccagctggtgagaaatggaaatgaggcccagaaggagaagtacctgcccaagctgatcagcggggagtacatcggggccctggccatgtctgagcccaatgccggcagtgatgtggtgtccatgaagctgaaggccgagaagaagggcaaccactacatcctgaatggaaacaagttctggatcaccaatggaccagatgctgatgtgctgattgtgtatgccaagacagacctggccgctgtgcctgccagccggggcatcacagccttcatcgtggagaagggcatgcctggcttcagcaccagcaagaagctggacaagctgggcatgaggggcagcaacacctgtgagctgatctttgaggactgcaagatcccagctgccaacatcctgggccacgagaacaagggcgtgtatgtgctgatgagcggcctggacctggagcggctggtgctggccggcggccccctgggcctgatgcaggccgtgctggaccacaccatcccctacctgcacgtgcgggaggccttcggccagaagattggccacttccagctgatgcagggcaagatggctgacatgtacacccggctgatggcctgccggcagtatgtgtacaacgtggccaaggcctgtgatgagggccactgcacagccaaggactgtgccggggtcatcctgtacagcgcagaatgtgccacccaggtggccctggatggcatccagtgcttcggcggcaatggctacatcaatgacttccccatgggccgcttcctgagagatgccaagctgtatgaaattggagctggcaccagcgaggtgcggcggctggtgattggccgggccttcaatgctgacttccactag

SEQ ID NO: 156652 - DNA, 1281 bp, Artificial Sequence
  Description of Artificial Sequence: Synthetic coding sequence
atggccgagatggccacagccacccggctgctgggctggagggtggcctcctggaggctgcggccccccctggccggctttgtgtcccagagggcccacagcctgctgcctgtggatgatgccatcaatggcctgtctgaggagcagaggcagctgcggcagaccatggccaagttcctgcaggagcacctggcccccaaggcccaggagattgacaggagcaatgagttcaagaacctgcgggagttctggaagcagctgggcaacctgggcgtgctgggcatcacagcccctgtgcagtatggaggcagcggcctgggctacctggagcacgtgctggtgatggaggagatcagccgggccagcggggctgtgggcctgtcctatggagcccacagcaacctgtgcatcaaccagctggtgagaaatggaaatgaggcccagaaggagaagtacctgcccaagctgatcagcggggagtacatcggggccctggccatgtctgagcccaatgccggcagtgatgtggtgtccatgaagctgaaggccgagaagaagggcaaccactacatcctgaatggaaacaagttctggatcaccaatggaccagatgctgatgtgctgattgtgtatgccaagacagacctggccgctgtgcctgccagccggggcatcacagccttcatcgtggagaagggcatgcctggcttcagcaccagcaagaagctggacaagctgggcatgaggggcagcaacacctgtgagctgatctttgaggactgcaagatcccagctgccaacatcctgggccacgagaacaagggcgtgtatgtgctgatgagcggcctggacctggagcggctggtgctggccggcggccccctgggcctgatgcaggccgtgctggaccacaccatcccctacctgcacgtgcgggaggccttcggccagaagattggccacttccagctgatgcagggcaagatggctgacatgtacacccggctgatggcctgccggcagtatgtgtacaacgtggccaaggcctgtgatgagggccactgcacagccaaggactgtgccggggtcatcctgtacagcgcagaatgtgccacccaggtggccctggatggcatccagtgcttcggcggcaatggctacatcaatgacttccccatgggccgcttcctgagagatgccaagctgtatgaaattggagctggcaccagcgaggtgcggcggctggtgattggccgggccttcaatgctgacttccactag

SEQ ID NO: 156653 - DNA, 1716 bp, Artificial Sequence
  Description of Artificial Sequence: Synthetic coding sequence
atgagggccctgcgggaccgggccggcctgctgctgtgtgtgctgctgctggccgccctgctggaggccgccctgggcctgcctgtgaagaagccccggctgcggggccccaggcctggcagcctgacccggctggccgaggtgtctgccagcccagacccccggcccctgaaggaggaggaggaggcccccctgctgcccaggacccacctgcaggccgagccccaccagcacggctgctggacagtgacagagcctgctgccatgaccccaggaaatgccaccccacccaggaccccagaggtgacccccctgcggctggagctgcagaagctgcccggcctggccaacaccaccctgagcacccccaacccagacacccaggccagcgccagcccagacccccggcccctgcgggaggaggaggaggcccggctgctgcccaggacccacctgcaggccgagctgcaccagcacggctgctggacagtgacagagcctgctgccctgaccccaggaaatgccaccccacccaggacccaggaggtgacccccctgctgctggagctgcagaagctgcctgagctggtgcacgccaccctgagcacccccaacccagacaaccaggtgaccatcaaggtggtggaggacccccaggccgaggtgtccattgacctgctggccgagcccagcaaccccccaccccaggacaccctgtcctggctgcctgccctgtggagcttcctgtggggagactacaagggggaggagaaggaccgggcccctggagagaagggggaggagaaggaggaggatgaggactaccccagcgaggacatcgagggggaggaccaggaggacaaggaggaggatgaggaggagcaggccctgtggttcaacggcaccacagacaactgggaccagggctggctggcccctggggactgggtgttcaaggacagcgtgtcctatgactatgagccccagaaggagtggagcccctggagcccctgcagcggcaactgcagcacaggcaagcagcagaggacccggccctgtggctacggctgcacagccacagagaccaggacctgtgacctgcccagctgccctggaacagaggacaaggacaccctgggcctgcccagcgaggagtggaagctgctggccagaaatgccacagacatgcatgaccaggatgtggacagctgtgagaagtggctgaactgcaagagtgacttcctgatcaagtacctgagccagatgctgcgggacctgcccagctgcccctgtgcctaccccctggaggccatggacagccctgtgtccctgcaggatgagcaccagggccgctccttccgctggagagatgccagcggcccccgggagcggctggacatctaccagcccacagcccgcttctgcctgcgctccatgctgtctggagagagcagcaccctggccgcccagcactgctgctatgatgaggacagccggctgctgacccggggcaaaggagctggcatgcccaacctgatcagcacagacttcagccccaagctgcacttcaagtttgacaccaccccctggatcctgtgcaagggggactggagccggctgcatgctgtgctgccccccaacaacggccgggcctgcacagacaaccccctggaggaggagtacctggcccagctgcaggaggccaaggagtactag

SEQ ID NO: 156654 - DNA, 1452 bp, Artificial Sequence
  Description of Artificial Sequence: Synthetic coding sequence
atgaccccaggaaatgccaccccacccaggaccccagaggtgacccccctgcggctggagctgcagaagctgcccggcctggccaacaccaccctgagcacccccaacccagacacccaggccagcgccagcccagacccccggcccctgcgggaggaggaggaggcccggctgctgcccaggacccacctgcaggccgagctgcaccagcacggctgctggacagtgacagagcctgctgccctgaccccaggaaatgccaccccacccaggacccaggaggtgacccccctgctgctggagctgcagaagctgcctgagctggtgcacgccaccctgagcacccccaacccagacaaccaggtgaccatcaaggtggtggaggacccccaggccgaggtgtccattgacctgctggccgagcccagcaaccccccaccccaggacaccctgtcctggctgcctgccctgtggagcttcctgtggggagactacaagggggaggagaaggaccgggcccctggagagaagggggaggagaaggaggaggatgaggactaccccagcgaggacatcgagggggaggaccaggaggacaaggaggaggatgaggaggagcaggccctgtggttcaacggcaccacagacaactgggaccagggctggctggcccctggggactgggtgttcaaggacagcgtgtcctatgactatgagccccagaaggagtggagcccctggagcccctgcagcggcaactgcagcacaggcaagcagcagaggacccggccctgtggctacggctgcacagccacagagaccaggacctgtgacctgcccagctgccctggaacagaggacaaggacaccctgggcctgcccagcgaggagtggaagctgctggccagaaatgccacagacatgcatgaccaggatgtggacagctgtgagaagtggctgaactgcaagagtgacttcctgatcaagtacctgagccagatgctgcgggacctgcccagctgcccctgtgcctaccccctggaggccatggacagccctgtgtccctgcaggatgagcaccagggccgctccttccgctggagagatgccagcggcccccgggagcggctggacatctaccagcccacagcccgcttctgcctgcgctccatgctgtctggagagagcagcaccctggccgcccagcactgctgctatgatgaggacagccggctgctgacccggggcaaaggagctggcatgcccaacctgatcagcacagacttcagccccaagctgcacttcaagtttgacaccaccccctggatcctgtgcaagggggactggagccggctgcatgctgtgctgccccccaacaacggccgggcctgcacagacaaccccctggaggaggagtacctggcccagctgcaggaggccaaggagtactag

SEQ ID NO: 156655 - DNA, 1473 bp, Artificial Sequence
  Description of Artificial Sequence: Synthetic coding sequence
atgagggccctgcgggaccgggccggcctgctgctgtgtgtgctgctgctggccgccctgctggaggccgccctgggcctgcctgtgaagaagccccggctgcggggccccaggcctggcagcctgacccggctggccgaggtgtctgccagcccagacccccggcccctgaaggaggaggaggaggcccccctgctgcccaggacccacctgcaggccgagccccaccagcacggctgctggacagtgacagagcctgctgccatgaccccaggaaatgccaccccacccaggaccccagaggtgacccccctgcggctggagctgcagaagctgcccggcctggccaacaccaccctgagcacccccaacccagacacccaggtgaccatcaaggtggtggaggacccccaggccgaggtgtccattgacctgctggccgagcccagcaaccccccaccccaggacaccctgtcctggctgcctgccctgtggagcttcctgtggggagactacaagggggaggagaaggaccgggcccctggagagaagggggaggagaaggaggaggatgaggactaccccagtgaagatattgaaggagaggaccaggaggacaaggaggaggatgaggaggagcaggccctgtggttcaacggcaccacagacaactgggaccagggctggctggcccctggggactgggtgttcaaggacagcgtgtcctatgactatgagccccagaaggagtggagcccctggagcccctgcagcggcaactgcagcacaggcaagcagcagaggacccggccctgtggctacggctgcacagccacagagaccaggacctgtgacctgcccagctgccccggcacagaggacaaggacaccctgggcctgcccagcgaggagtggaagctgctggccagaaatgccacagacatgcatgaccaggatgtggacagctgtgagaagtggctgaactgcaagagtgacttcctgatcaagtacctgagccagatgctgcgggacctgcccagctgcccctgtgcctaccccctggaggccatggacagccctgtgtccctgcaggatgagcaccagggccgctccttccgctggagagatgccagcggcccccgggagcggctggacatctaccagcccacagcccgcttctgcctgcgctccatgctgagcggggagagcagcaccctggccgcccagcactgctgctatgatgaggacagccggctgctgacccggggcaagggggccggcatgcccaacctgatcagcacagacttcagccccaagctgcacttcaagtttgacaccaccccctggatcctgtgcaagggggactggagccggctgcatgctgtgctgccccccaacaacggccgggcctgcacagacaaccccctggaggaggagtacctggcccagctgcaggaggccaaggagtactag

SEQ ID NO: 156656 - DNA, 1473 bp, Artificial Sequence
  Description of Artificial Sequence: Synthetic coding sequence
atgagggccctgcgggaccgggccggcctgctgctgtgtgtgctgctgctggccgccctgctggaggccgccctgggcctgcctgtgaagaagccccggctgcggggccccaggcctggcagcctgacccggctggccgaggccagcgccagcccagacccccggcccctgcgggaggaggaggaggcccggctgctgcccaggacccacctgcaggccgagctgcaccagcacggctgctggacagtgacagagcctgctgccctgaccccaggaaatgccaccccacccaggacccaggaggtgacccccctgctgctggagctgcagaagctgcctgagctggtgcacgccaccctgagcacccccaacccagacaaccaggtgaccatcaaggtggtggaggacccccaggccgaggtgtccattgacctgctggccgagcccagcaaccccccaccccaggacaccctgtcctggctgcctgccctgtggagcttcctgtggggagactacaagggggaggagaaggaccgggcccctggagagaagggggaggagaaggaggaggatgaggactaccccagtgaagatattgaaggagaggaccaggaggacaaggaggaggatgaggaggagcaggccctgtggttcaacggcaccacagacaactgggaccagggctggctggcccctggggactgggtgttcaaggacagcgtgtcctatgactatgagccccagaaggagtggagcccctggagcccctgcagcggcaactgcagcacaggcaagcagcagaggacccggccctgtggctacggctgcacagccacagagaccaggacctgtgacctgcccagctgccccggcacagaggacaaggacaccctgggcctgcccagcgaggagtggaagctgctggccagaaatgccacagacatgcatgaccaggatgtggacagctgtgagaagtggctgaactgcaagagtgacttcctgatcaagtacctgagccagatgctgcgggacctgcccagctgcccctgtgcctaccccctggaggccatggacagccctgtgtccctgcaggatgagcaccagggccgctccttccgctggagagatgccagcggcccccgggagcggctggacatctaccagcccacagcccgcttctgcctgcgctccatgctgagcggggagagcagcaccctggccgcccagcactgctgctatgatgaggacagccggctgctgacccggggcaagggggccggcatgcccaacctgatcagcacagacttcagccccaagctgcacttcaagtttgacaccaccccctggatcctgtgcaagggggactggagccggctgcatgctgtgctgccccccaacaacggccgggcctgcacagacaaccccctggaggaggagtacctggcccagctgcaggaggccaaggagtactag

SEQ ID NO: 156657 - DNA, 879 bp, Artificial Sequence
  Description of Artificial Sequence: Synthetic coding sequence
atgagggccctgcgggaccgggccggcctgctgctgtgtgtgctgctgctggccgccctgctggaggccgccctgggcctgcctgtgaagaagccccggctgcggggccccaggcctggcagcctgacccggctggccgaggtgtctgccagcccagacccccggcccctgaaggaggaggaggaggcccccctgctgcccaggacccacctgcaggccgagccccaccagcacggctgctggacagtgacagagcctgctgccatgaccccaggaaatgccaccccacccaggaccccagaggtgacccccctgcggctggagctgcagaagctgcccggcctggccaacaccaccctgagcacccccaacccagacacccaggccagcgccagcccagacccccggcccctgcgggaggaggaggaggcccggctgctgcccaggacccacctgcaggccgagctgcaccagcacggctgctggacagtgacagagcctgctgccctgaccccaggaaatgccaccccacccaggacccaggaggtgacccccctgctgctggagctgcagaagctgcctgagctggtgcacgccaccctgagcacccccaacccagacaaccagaccatgagcctgcggcgcagcggcgtgcccggcctgcctgctgtgggcacagctgccctggccagcagccggggcctgggccctgtggccatggccgccctgccccccaggcctgtgcctgtgacctgcccccctgtgctggccctgcggaccaggaccccctgggccagccctgtgcgcagcggcagctcctggccagccatgctgcggacctgcatgatcaagatgtggacagctgtgcgctctggatag

SEQ ID NO: 156658 - DNA, 924 bp, Artificial Sequence
  Description of Artificial Sequence: Synthetic coding sequence
atggccagaaatgctgagaaggccatgacagccctggcccgcttccggcaggcccagctggaggagggcaaggtgaaggagcggcggcccttcctggcctctgaatgtacagagctgcccaaggccgagaagtggaggcggcagatcatcggggagatcagcaagaaggtggcccagatccagaatgccggcctgggggagttccgcatccgggacctgaatgatgagatcaacaagctgctgcgggagaagggccactgggaggtgcgcatcaaggagctgggcggccctgactatggcaaggtgggccccaagatgctggaccacgagggcaaggaggtgcccggcaacagaggctacaagtactttggagctgccaaggacctgcccggggtgcgggagctgtttgagaaggagcggcaggtgcgctggctgatgcctgtgatcccagccctgtgggaggccgaggccggcggcagccaggccctgcccccacccaggaagaccagggctgagctgatgaaggccatcgactttgagtactacggctacctggatgaagatgatggagtcatcgtgcccctggagcaggagtatgagaagaagctgcgggcagagctggtggagaagtggaaggccgagcgggaggcccggctggcccggggggagaaggaggaggaggaggaggaggaggaggagatcaacatctatgctgtgacagaggaggagagtgatgaggagggcagccaggagaagggaggagatgacagccagcagaagttcatcgcccacgtgcctgtgcccagccagcaggagattgaggaggccctggtgcggaggaagaagatggagctgctgcagaagtatgccagcgagaccctgcaggcccagagcgaggaggcccggcggctgctgggctactag

SEQ ID NO: 156659 - DNA, 858 bp, Artificial Sequence
  Description of Artificial Sequence: Synthetic coding sequence
atggccagaaatgctgagaaggccatgacagccctggcccgcttccggcaggcccagctggaggagggcaaggtgaaggagcggcggcccttcctggcctctgaatgtacagagctgcccaaggccgagaagtggaggcggcagatcatcggggagatcagcaagaaggtggcccagatccagaatgccggcctgggggagttccgcatccgggacctgaatgatgagatcaacaagctgctgcgggagaagggccactgggaggtgcgcatcaaggagctgggcggccctgactatggcaaggtgggccccaagatgctggaccacgagggcaaggaggtgcccggcaacagaggctacaagtactttggagctgccaaggacctgcccggggtgcgggagctgtttgagaaggagcccctgcccccacccaggaagaccagggctgagctgatgaaggccatcgactttgagtactacggctacctggatgaagatgatggagtcatcgtgcccctggagcaggagtatgagaagaagctgcgggcagagctggtggagaagtggaaggccgagcgggaggcccggctggcccggggggagaaggaggaggaggaggaggaggaggaggagatcaacatctatgctgtgacagaggaggagagtgatgaggagggcagccaggagaagggaggagatgacagccagcagaagttcatcgcccacgtgcctgtgcccagccagcaggagattgaggaggccctggtgcggaggaagaagatggagctgctgcagaagtatgccagcgagaccctgcaggcccagagcgaggaggcccggcggctgctgggctactag

SEQ ID NO: 156660 - DNA, 2712 bp, Artificial Sequence
  Description of Artificial Sequence: Synthetic coding sequence
atgtctgacagcggcagccagctgggctccatgggcagcctgaccatgaagagccagctgcagatcaccgtcatcagcgccaagctgaaggagaacaagaagaactggtttggccccagcccctacgtggaggtgacagtggatggccagagcaagaagacagagaagtgcaacaacaccaacagccccaagtggaagcagcccctgaccgtcatcgtgacccctgtgtccaagctgcacttccgggtgtggagccaccagaccctgaagagtgatgtgctgctgggcacagctgccctggacatctatgagaccctgaagagcaacaacatgaagctggaggaggtggtggtgaccctgcagctgggcggggacaaggagcccacagagaccatcggggacctgagcatctgcctggatggcctgcagctggagagcgaggtggtgaccaatggagagaccacctgcagtgaaaatggagtgtccctgtgcctgccccggctggagtgcaacagcgccatcagcgcccactgcaacctgtgcctgcccggcctgagtgacagccccatcagcgccagccgggtggccggcttcaccggggccagccagaatgatgatggcagccgcagcaaggatgagaccagggtgtccaccaatggaagtgatgatcctgaagatgctggagctggagaaaatagaagagtgtctggcaacaacagccccagcctgagcaatggaggcttcaagcccagcaggcctccccggcccagcaggcctcctccacccaccccaagaagacctgcctctgtgaatggcagccccagcgccaccagcgagagtgatggcagcagcacaggcagcctgccccccaccaacaccaacaccaacaccagcgagggcgccaccagcggcctcatcatccccctgaccatcagcggcggcagcggcccccggcccctgaaccctgtgacccaggcccccctgcccccaggctgggagcagagggtggaccagcacggccgggtgtactacgtggaccacgtggagaagaggaccacctgggacaggcctgagcccctgcccccaggctgggagcggcgggtggacaacatgggccgcatctactacgtggaccacttcaccaggaccaccacctggcagaggcccaccctggagagcgtgagaaattatgagcagtggcagctgcagaggagccagctgcagggcgccatgcagcagttcaaccagcgcttcatctacggcaaccaggacctgtttgccaccagccagagcaaggagtttgaccccctgggccccctgcccccaggctgggagaagaggacagacagcaatggccgggtgtactttgtgaaccacaacacccgcatcacccagtgggaggaccccaggagccagggccagctgaatgagaagcccctgcctgagggctgggagatgaggttcaccgtggatggcatcccctactttgtggaccacaacagaaggaccaccacctacatcgaccccaggacaggcaagagcgccctggacaatggcccccagatcgcctacgtgcgggacttcaaggccaaggtgcagtacttccgcttctggtgccagcagctggccatgccccagcacatcaagatcaccgtgaccaggaagaccctgtttgaagattccttccagcagatcatgtccttcagcccccaggacctgcggcggcggctgtgggtgatcttccctggagaggagggcctggactatggaggagtggcccgggagtggttcttcctgctgagccatgaggtgctgaaccccatgtactgcctgtttgaatatgccggcaaggacaactactgcctgcagatcaacccagccagctacatcaacccagaccacctgaagtacttccgcttcatcggccgcttcatcgccatggccctcttccacggcaagttcatcgacaccggcttcagcctgcccttctacaagaggatcctgaacaagcctgtgggcctgaaggacctggagagcattgatcctgagttctacaacagcctcatctgggtgaaggagaacaacatcgaggagtgtgacctggagatgtacttctctgtggacaaggagatcctgggggagatcaagagccatgacctgaagcccaatggaggcaacatcctggtgacagaggagaacaaggaggagtacatccgcatggtggccgagtggaggctgagcagaggagtggaggagcagacccaggccttctttgagggcttcaatgagatcctgccccagcagtacctgcagtactttgatgccaaggagctggaggtgctgctgtgtggcatgcaggagattgacctgaatgactggcagagacatgccatctaccgccactacgcccggaccagcaagcagatcatgtggttctggcagtttgtgaaggagattgacaatgagaagaggatgaggctgctgcagtttgtgacaggcacctgccgcctgcctgtgggcggctttgctgacctgatgggcagcaatggcccccagaagttctgcatcgagaaggtgggcaaggagaactggctgcccaggagccacacctgcttcaaccggctggacctgcccccctacaagagctatgagcagctgaaggagaagctgctgtttgccatcgaggagacagagggcttcggccaggagtag

SEQ ID NO: 156661 - DNA, 2589 bp, Artificial Sequence
  Description of Artificial Sequence: Synthetic coding sequence
atgtctgacagcggcagccagctgggctccatgggcagcctgaccatgaagagccagctgcagatcaccgtcatcagcgccaagctgaaggagaacaagaagaactggtttggccccagcccctacgtggaggtgacagtggatggccagagcaagaagacagagaagtgcaacaacaccaacagccccaagtggaagcagcccctgaccgtcatcgtgacccctgtgtccaagctgcacttccgggtgtggagccaccagaccctgaagagtgatgtgctgctgggcacagctgccctggacatctatgagaccctgaagagcaacaacatgaagctggaggaggtggtggtgaccctgcagctgggcggggacaaggagcccacagagaccatcggggacctgagcatctgcctggatggcctgcagctggagagcgaggtggtgaccaatggagagaccacctgcagcgagagcgccagccagaatgatgatggcagccgcagcaaggatgagaccagggtgtccaccaacggcagtgatgatcctgaagatgctggggccggggagaacagaagagtgtctggcaacaacagccccagcctgagcaatggaggcttcaagcccagccggcccccccggcccagccggcccccaccacccaccccccggcggcctgcctctgtgaatggcagccccagcgccaccagcgagagtgatggcagcagcacaggcagcctgccccccaccaacaccaacaccaacaccagcgagggcgccaccagcggcctcatcatccccctgaccatcagcggcggcagcggcccccggcccctgaaccctgtgacccaggcccccctgcccccaggctgggagcagagggtggaccagcacggccgggtgtactacgtggaccacgtggagaagaggaccacctgggacaggcctgagcccctgcccccaggctgggagaggagagtggacaacatgggccgcatctactacgtggaccacttcaccaggaccaccacctggcagaggcccaccctggagagcgtgaggaactatgagcagtggcagctgcagaggagccagctgcagggcgccatgcagcagttcaaccagcgcttcatctacggcaaccaggacctgtttgccaccagccagagcaaggagtttgaccccctgggccccctgcccccaggctgggagaagaggacagacagcaatggccgggtgtactttgtgaaccacaacacccgcatcacccagtgggaggaccccaggagccagggccagctgaatgagaagcccctgcctgagggctgggagatgaggttcaccgtggatggcatcccctactttgtggaccacaacagaaggaccaccacctacatcgaccccaggacaggcaagagcgccctggacaatggcccccagatcgcctacgtgcgggacttcaaggccaaggtgcagtacttccgcttctggtgccagcagctggccatgccccagcacatcaagatcaccgtgaccaggaagaccctgtttgaggacagcttccagcagatcatgtccttcagcccccaggacctgcggcggcggctgtgggtgatcttccctggagaggagggcctggactatggaggagtggcccgggagtggttcttcctgctgagccatgaggtgctgaaccccatgtactgcctgtttgaatatgctgggaaggacaactactgcctgcagatcaacccagccagctacatcaacccagaccacctgaagtacttccgcttcatcggccgcttcatcgccatggccctcttccacggcaagttcatcgacaccggcttcagcctgcccttctacaagaggatcctgaacaagcctgtgggcctgaaggacctggagagcattgatcctgagttctacaacagcctcatctgggtgaaggagaacaacattgaagaatgtgacctggagatgtacttctctgtggacaaggagatcctgggggagatcaagagccatgacctgaagcccaacggcggcaacatcctggtgacagaggagaacaaggaggagtacatccgcatggtggccgagtggaggctgagccggggcgtggaggagcagacccaggccttctttgagggcttcaatgagatcctgccccagcagtacctgcagtactttgatgccaaggagctggaggtgctgctgtgtggcatgcaggagattgacctgaatgactggcagagacatgccatctaccgccactacgcccggaccagcaagcagatcatgtggttctggcagtttgtgaaggagattgacaatgagaagaggatgaggctgctgcagtttgtgacaggcacctgccgcctgcctgtgggcggctttgctgacctgatgggcagcaatggcccccagaagttctgcatcgagaaggtgggcaaggagaactggctgcccaggagccacacctgcttcaaccggctggacctgcccccctacaagagctatgagcagctgaaggagaagctgctgtttgccatcgaggagacagagggcttcggccaggagtag

SEQ ID NO: 156662 - DNA, 2259 bp, Artificial Sequence
  Description of Artificial Sequence: Synthetic coding sequence
atgaagctggaggaggtggtggtgaccctgcagctgggcggggacaaggagcccacagagaccatcggggacctgagcatctgcctggatggcctgcagctggagagcgaggtggtgaccaatggagagaccacctgcagcgagagcgccagccagaatgatgatggcagccgcagcaaggatgagaccagggtgtccaccaacggcagtgatgatcctgaagatgctggggccggggagaacagaagagtgtctggcaacaacagccccagcctgagcaatggaggcttcaagcccagccggcccccccggcccagccggcccccaccacccaccccccggcggcctgcctctgtgaatggcagccccagcgccaccagcgagagtgatggcagcagcacaggcagcctgccccccaccaacaccaacaccaacaccagcgagggcgccaccagcggcctcatcatccccctgaccatcagcggcggcagcggcccccggcccctgaaccctgtgacccaggcccccctgcccccaggctgggagcagagggtggaccagcacggccgggtgtactacgtggaccacgtggagaagaggaccacctgggacaggcctgagcccctgcccccaggctgggagaggagagtggacaacatgggccgcatctactacgtggaccacttcaccaggaccaccacctggcagaggcccaccctggagagcgtgaggaactatgagcagtggcagctgcagaggagccagctgcagggcgccatgcagcagttcaaccagcgcttcatctacggcaaccaggacctgtttgccaccagccagagcaaggagtttgaccccctgggccccctgcccccaggctgggagaagaggacagacagcaatggccgggtgtactttgtgaaccacaacacccgcatcacccagtgggaggaccccaggagccagggccagctgaatgagaagcccctgcctgagggctgggagatgaggttcaccgtggatggcatcccctactttgtggaccacaacagaaggaccaccacctacatcgaccccaggacaggcaagagcgccctggacaatggcccccagatcgcctacgtgcgggacttcaaggccaaggtgcagtacttccgcttctggtgccagcagctggccatgccccagcacatcaagatcaccgtgaccaggaagaccctgtttgaggacagcttccagcagatcatgtccttcagcccccaggacctgcggcggcggctgtgggtgatcttccctggagaggagggcctggactatggaggagtggcccgggagtggttcttcctgctgagccatgaggtgctgaaccccatgtactgcctgtttgaatatgctgggaaggacaactactgcctgcagatcaacccagccagctacatcaacccagaccacctgaagtacttccgcttcatcggccgcttcatcgccatggccctcttccacggcaagttcatcgacaccggcttcagcctgcccttctacaagaggatcctgaacaagcctgtgggcctgaaggacctggagagcattgatcctgagttctacaacagcctcatctgggtgaaggagaacaacattgaagaatgtgacctggagatgtacttctctgtggacaaggagatcctgggggagatcaagagccatgacctgaagcccaacggcggcaacatcctggtgacagaggagaacaaggaggagtacatccgcatggtggccgagtggaggctgagccggggcgtggaggagcagacccaggccttctttgagggcttcaatgagatcctgccccagcagtacctgcagtactttgatgccaaggagctggaggtgctgctgtgtggcatgcaggagattgacctgaatgactggcagagacatgccatctaccgccactacgcccggaccagcaagcagatcatgtggttctggcagtttgtgaaggagattgacaatgagaagaggatgaggctgctgcagtttgtgacaggcacctgccgcctgcctgtgggcggctttgctgacctgatgggcagcaatggcccccagaagttctgcatcgagaaggtgggcaaggagaactggctgcccaggagccacacctgcttcaaccggctggacctgcccccctacaagagctatgagcagctgaaggagaagctgctgtttgccatcgaggagacagagggcttcggccaggagtag

SEQ ID NO: 156663 - DNA, 3717 bp, Artificial Sequence
  Description of Artificial Sequence: Synthetic coding sequence
atgagggcccagggccggggccgcctgccccggcggctgctgctgctgctggccctgtgggtgcaggccgcccggcccatgggctactttgagctgcagctgagcgccctgagaaatgtgaatggagagctgctgagcggggcctgctgtgatggagatggccgcaccaccagggctgggggctgcggccatgatgaatgtgacacctacgtgcgggtgtgcctgaaggagtaccaggccaaggtgacccccaccggcccctgcagctatggccacggggccacccctgtgctgggcggcaacagcttctacctgcccccagctggagctgctggggaccgggcccgggcccgggcccgggccggcggggaccaggaccccggcctggtggtgatccccttccagtttgcctggcccaggagcttcaccctgattgtggaggcctgggactgggacaatgacaccaccccaaatgaggagctgctgattgagcgggtgtcccatgctggcatgatcaacccagaagatcgctggaagagcctgcacttcagcggccacgtggcccacctggagctgcagatccgggtgcgctgtgatgagaactactacagcgccacctgcaacaagttctgccggcccagaaatgacttcttcggccactacacctgtgaccagtatggcaacaaggcctgcatggatggctggatgggcaaggagtgcaaggaggccgtgtgcaagcagggctgcaacctgctgcatggaggctgcaccgtgcctggagaatgtcgctgcagctatggctggcagggccgcttctgtgatgaatgtgtgccctacccaggctgtgtgcacggcagctgtgtggagccctggcagtgcaactgtgagaccaactggggcggcctgctgtgtgacaaggacctgaactactgcggcagccaccacccctgcaccaatggaggcacctgcatcaatgctgagccagaccagtaccgctgcacctgcccagatggctacagcggcaggaactgtgagaaggccgagcacgcctgcaccagcaacccctgtgccaacggcggcagctgccacgaggtgcccagcggctttgagtgccactgccccagcggctggagcggccccacctgtgccctggacattgatgaatgtgccagcaacccctgtgccgccggcggcacctgtgtggaccaggtggatggctttgagtgcatctgcccagagcagtgggtgggcgccacctgccagctggatgccaatgaatgtgagggcaagccctgcctgaatgccttcagctgcaagaacctgattggaggctactactgtgactgcatccctggctggaagggcatcaactgccacatcaacgtgaatgactgccggggccagtgccagcacggcggcacctgcaaggacctggtgaatggctaccagtgtgtgtgcccccggggctttggaggccgccactgtgagctggagagagatgaatgtgccagcagcccctgccacagcggcggcctgtgtgaggacctggctgatggcttccactgccactgcccccagggcttcagcggccccctgtgtgaggtggatgtggacctgtgtgagcccagcccctgcagaaatggagcccgctgctacaacctggagggggactactactgtgcctgcccagatgactttggaggcaagaactgcagcgtgccccgggagccctgccctggaggagcctgccgggtgattgatggctgcggcagtgatgctggccctggcatgcctggaacagctgccagcggcgtgtgtggcccccacggccgctgtgtgtcccagcccggcggcaacttcagctgcatctgtgacagcggcttcaccggcacctactgccatgaaaatattgatgactgcctgggccagccctgcagaaatggaggcacctgcattgatgaggtggatgccttccgctgcttctgccccagcggctgggagggggagctgtgtgacaccaaccccaatgactgcctgcctgacccctgccacagccggggccgctgctatgacctggtgaatgacttctactgtgcctgtgatgatggctggaagggcaagacctgccacagccgggagttccagtgtgatgcctacacctgcagcaatggaggcacctgctatgacagcggggacaccttccgctgtgcctgccccccaggctggaagggcagcacctgtgctgtggccaagaacagcagctgcctgcccaacccctgtgtgaatggaggcacctgtgtgggcagcggggccagcttcagctgcatctgcagagatggctgggagggccgcacctgcacccacaacaccaatgactgcaaccccctgccctgctacaacggcggcatctgtgtggatggagtgaactggttccgctgtgaatgtgcccctggctttgctggccctgactgccgcatcaacattgatgagtgccagagcagcccctgtgcctacggggccacctgtgtggatgagatcaatggctaccgctgcagctgccccccaggccgggccggcccccgctgccaggaggtgattggcttcggccgcagctgctggagccggggcacccccttcccccacggcagctcctgggtggaggactgcaacagctgccgctgcctggatggccggcgggactgcagcaaggtgtggtgtggctggaagccctgcctgctggccggccagcctgaggccctgagcgcccagtgccccctgggccagcgctgcctggagaaggcccctggccagtgcctgcggcccccctgtgaggcctggggagaatgtggggctgaggagccccccagcaccccctgcctgcccaggagcggccacctggacaacaactgtgcccggctgaccctgcacttcaacagagaccacgtgccccagggcaccaccgtgggcgccatctgcagcggcatccgcagcctgcctgccaccagggctgtggcccgggaccggctgctggtgctgctgtgtgaccgggccagcagcggggccagcgctgtggaggtggccgtgtccttcagccctgcccgggacctgcctgacagcagcctcatccagggcgccgcccacgccatcgtggccgccatcacccagaggggcaacagcagcctgctgctggccgtgacagaggtgaaggtggagaccgtggtgactggaggcagcagcacaggcctgctggtgcctgtgctgtgtggggccttctctgtgctgtggctggcctgtgtggtgctgtgtgtgtggtggaccaggaagaggaggaaggagcgggagaggagccggctgccccgggaggagagcgccaacaaccagtgggcccccctgaaccccatccggaaccccatcgagaggcctgggggccacaaggatgtgctgtaccagtgcaagaacttcaccccacctccaagaagagcagatgaggccctgcccggccctgctggccacgccgctgtgcgggaggatgaagaagatgaggacctgggccgcggggaggaggacagcctggaggccgagaagttcctgagccacaagttcaccaaggaccccggccgcagccctggccggcctgcccactgggccagcggccccaaggtggacaacagagctgtgcgcagcatcaatgaggcccgctatgccggcaaggagtag

SEQ ID NO: 156664 - DNA, 3603 bp, Artificial Sequence
  Description of Artificial Sequence: Synthetic coding sequence
atgagggcccagggccggggccgcctgccccggcggctgctgctgctgctggccctgtgggtgcaggccgcccggcccatgggctactttgagctgcagctgagcgccctgagaaatgtgaatggagagctgctgagcggggcctgctgtgatggagatggccgcaccaccagggctgggggctgcggccatgatgaatgtgacacctacgtgcgggtgtgcctgaaggagtaccaggccaaggtgacccccaccggcccctgcagctatggccacggggccacccctgtgctgggcggcaacagcttctacctgcccccagctggagctgctggggaccgggcccgggcccgggcccgggccggcggggaccaggaccccggcctggtggtgatccccttccagtttgcctggcccaggagcttcaccctgattgtggaggcctgggactgggacaatgacaccaccccaaatgaggagctgctgattgagcgggtgtcccatgctggcatgatcaacccagaagatcgctggaagagcctgcacttcagcggccacgtggcccacctggagctgcagatccgggtgcgctgtgatgagaactactacagcgccacctgcaacaagttctgccggcccagaaatgacttcttcggccactacacctgtgaccagtatggcaacaaggcctgcatggatggctggatgggcaaggagtgcaaggaggccgtgtgcaagcagggctgcaacctgctgcatggaggctgcaccgtgcctggagaatgtcgctgcagctatggctggcagggccgcttctgtgatgaatgtgtgccctacccaggctgtgtgcacggcagctgtgtggagccctggcagtgcaactgtgagaccaactggggcggcctgctgtgtgacaaggacctgaactactgcggcagccaccacccctgcaccaatggaggcacctgcatcaatgctgagccagaccagtaccgctgcacctgcccagatggctacagcggcaggaactgtgagaaggccgagcacgcctgcaccagcaacccctgtgccaacggcggcagctgccacgaggtgcccagcggctttgagtgccactgccccagcggctggagcggccccacctgtgccctggacattgatgaatgtgccagcaacccctgtgccgccggcggcacctgtgtggaccaggtggatggctttgagtgcatctgcccagagcagtgggtgggcgccacctgccagctggatgtgaatgactgccggggccagtgccagcacggcggcacctgcaaggacctggtgaatggctaccagtgtgtgtgcccccggggctttggaggccgccactgtgagctggagagagatgaatgtgccagcagcccctgccacagcggcggcctgtgtgaggacctggctgatggcttccactgccactgcccccagggcttcagcggccccctgtgtgaggtggatgtggacctgtgtgagcccagcccctgcagaaatggagcccgctgctacaacctggagggggactactactgtgcctgcccagatgactttggaggcaagaactgcagcgtgccccgggagccctgccctggaggagcctgccgggtgattgatggctgcggcagtgatgctggccctggcatgcctggaacagctgccagcggcgtgtgtggcccccacggccgctgtgtgtcccagcccggcggcaacttcagctgcatctgtgacagcggcttcaccggcacctactgccatgaaaatattgatgactgcctgggccagccctgcagaaatggaggcacctgcattgatgaggtggatgccttccgctgcttctgccccagcggctgggagggggagctgtgtgacaccaaccccaatgactgcctgcctgacccctgccacagccggggccgctgctatgacctggtgaatgacttctactgtgcctgtgatgatggctggaagggcaagacctgccacagccgggagttccagtgtgatgcctacacctgcagcaatggaggcacctgctatgacagcggggacaccttccgctgtgcctgccccccaggctggaagggcagcacctgtgctgtggccaagaacagcagctgcctgcccaacccctgtgtgaatggaggcacctgtgtgggcagcggggccagcttcagctgcatctgcagagatggctgggagggccgcacctgcacccacaacaccaatgactgcaaccccctgccctgctacaacggcggcatctgtgtggatggagtgaactggttccgctgtgaatgtgcccctggctttgctggccctgactgccgcatcaacattgatgagtgccagagcagcccctgtgcctacggggccacctgtgtggatgagatcaatggctaccgctgcagctgccccccaggccgggccggcccccgctgccaggaggtgattggcttcggccgcagctgctggagccggggcacccccttcccccacggcagctcctgggtggaggactgcaacagctgccgctgcctggatggccggcgggactgcagcaaggtgtggtgtggctggaagccctgcctgctggccggccagcctgaggccctgagcgcccagtgccccctgggccagcgctgcctggagaaggcccctggccagtgcctgcggcccccctgtgaggcctggggagaatgtggggctgaggagccccccagcaccccctgcctgcccaggagcggccacctggacaacaactgtgcccggctgaccctgcacttcaacagagaccacgtgccccagggcaccaccgtgggcgccatctgcagcggcatccgcagcctgcctgccaccagggctgtggcccgggaccggctgctggtgctgctgtgtgaccgggccagcagcggggccagcgctgtggaggtggccgtgtccttcagccctgcccgggacctgcctgacagcagcctcatccagggcgccgcccacgccatcgtggccgccatcacccagaggggcaacagcagcctgctgctggccgtgacagaggtgaaggtggagaccgtggtgactggaggcagcagcacaggcctgctggtgcctgtgctgtgtggggccttctctgtgctgtggctggcctgtgtggtgctgtgtgtgtggtggaccaggaagaggaggaaggagcgggagaggagccggctgccccgggaggagagcgccaacaaccagtgggcccccctgaaccccatccggaaccccatcgagaggcctgggggccacaaggatgtgctgtaccagtgcaagaacttcaccccacctccaagaagagcagatgaggccctgcccggccctgctggccacgccgctgtgcgggaggatgaagaagatgaggacctgggccgcggggaggaggacagcctggaggccgagaagttcctgagccacaagttcaccaaggaccccggccgcagccctggccggcctgcccactgggccagcggccccaaggtggacaacagagctgtgcgcagcatcaatgaggcccgctatgccggcaaggagtag

SEQ ID NO: 156665 - DNA, 3465 bp, Artificial Sequence
  Description of Artificial Sequence: Synthetic coding sequence
atgcagtacctgaacatcaaggaggactgcaatgccatggccttctgtgccaagatgaggagcagcaagaagacagaggtgaacctggaggcccctgagcccggggtggaggtgatcttctacctgagtgaccgggagcccctgcggctgggcagcggggagtacacagctgaggagctgtgcatccgggccgcccaggcctgccgcatcagccccctgtgccacaacctgtttgccctgtatgatgagaacaccaagctgtggtacgcccccaacagaaccatcaccgtggatgacaagatgagcctgcggctgcactacaggatgaggttctacttcaccaactggcacggcaccaatgacaatgagcagagcgtgtggaggcacagccccaagaagcagaagaatggctatgagaagaagaagatcccagatgccacccccctgctggatgccagcagcctggagtacctgtttgcccagggccagtatgacctggtgaagtgcctggcccccatccgggaccccaagacagagcaggacggccatgacattgaaaatgaatgtctgggcatggctgtgctggccatcagccactacgccatgatgaagaagatgcagctgcctgagctgcccaaggacatctcctacaagcgctacatccctgagaccctgaacaagagcatccggcagaggaacctgctgaccaggatgaggatcaacaacgtgttcaaggacttcctgaaggagttcaacaacaagaccatctgtgacagctctgtgtccacccatgacctgaaggtgaagtacctggccaccctggagaccctgaccaagcactatggagctgagatctttgagacctccatgctgctgatcagcagtgaaaatgagatgaactggttccacagcaatgatggcggcaatgtgctgtactatgaggtgatggtgacaggcaacctgggcatccagtggaggcacaagcccaacgtggtgtctgtggagaaggagaagaacaagctgaagaggaagaagctggagaacaagcacaagaaggatgaggagaagaacaagatccgggaggagtggaacaacttctcctacttccctgagatcacccacatcgtcatcaaggagagcgtggtgtccatcaacaagcaggacaacaagaagatggagctgaagctgagcagccatgaggaggccctgagctttgtgtccctggtggatggctacttccggctgacagcagatgcccaccactacctgtgcacagatgtggcccctcctctcatcgtgcacaacatccagaatggctgccacggccccatctgcacagaatatgccatcaacaagctgcggcaggagggcagcgaggagggcatgtatgtgctgcgctggagctgcacagactttgacaacatcctgatgacagtgacctgctttgagaagtctgagcaggtgcagggcgcccagaagcagttcaagaacttccagatcgaggtgcagaagggccgctacagcctgcacggcagtgaccgctccttccccagcctgggggacctgatgagccacctgaagaagcagatcctgaggacagacaacatctccttcatgctgaagcgctgctgccagcccaagccccgggagatcagcaacctgctggtggccaccaagaaggcccaggagtggcagcctgtgtaccccatgagccagctgagctttgaccgcatcctgaagaaggacctggtgcagggcgagcacctgggccggggcaccaggacccacatctacagcggcaccctgatggactacaaggatgatgagggcaccagcgaggagaagaagatcaaggtgatcctgaaggtgctggaccccagccaccgggacatcagcctggccttctttgaggccgcctccatgatgaggcaggtgagccacaagcacatcgtgtacctgtatggagtgtgtgtgagagatgtggagaacatcatggtggaggagtttgtggagggcggccccctggacctcttcatgcacaggaagagtgatgtgctgaccaccccctggaagttcaaggtggccaagcagctggccagcgccctgagctacctggaggacaaggacctggtgcacggcaatgtgtgcaccaagaacctgctgctggcccgggagggcattgattctgaatgtggccccttcatcaagctgagtgaccccggcatccccatcaccgtgctgagccggcaggagtgcatcgagcgcatcccctggatcgccccagaatgtgtggaggacagcaagaacctgtctgtggccgctgacaagtggagctttggcaccaccctgtgggagatctgctacaatggagagatccccctgaaggacaagaccctcatcgagaaggagcgcttctatgagagccgctgcaggcctgtgacccccagctgcaaggagctggccgacctgatgacccgctgcatgaactatgaccccaaccagaggcccttcttccgggccatcatgagggacatcaacaagctggaggagcagaacccagacatcgtgtctgagaagaagccagccacagaggtggaccccacccactttgagaagcgcttcctgaagaggatccgggacctgggggagggccactttgggaaggtggagctgtgccgctatgaccctgagggggacaacacaggagagcaggtggccgtgaagagcctgaagccagagagcggcggcaaccacatcgctgacctgaagaaggagattgagatcctgaggaacctgtaccatgaaaatattgtgaagtacaagggcatctgcacagaagatggcggcaatggcatcaagctgatcatggagttcctgcccagcggcagcctgaaggagtacctgcccaagaacaagaacaagatcaacctgaagcagcagctgaagtatgctgtgcagatctgcaagggcatggactacctgggcagccggcagtatgtgcaccgggacctggccgccagaaatgtgctggtggagagcgagcaccaggtgaagattggagactttggcctgaccaaggccatcgagacagacaaggagtactacacagtgaaggatgaccgggacagccctgtgttctggtacgccccagaatgtctgatgcagagcaagttctacatcgccagtgatgtgtggagctttggagtgaccctgcacgagctgctgacctactgtgacagcgacagcagccccatggccctcttcctgaagatgattggccccacccacggccagatgacagtgacccggctggtgaacaccctgaaggagggcaagaggctgccctgcccccccaactgcccagatgaggtgtaccagctgatgaggaagtgctgggagttccagcccagcaacagaaccagcttccagaacctgattgagggctttgaggccctgctgaagtag

SEQ ID NO: 156666 - DNA, 1860 bp, Artificial Sequence
  Description of Artificial Sequence: Synthetic coding sequence
atggcccctccttctgaggagacccccctcatcccccagaggagctgcagcctgctgagcacagaagctggggccctgcacgtgctgctgcctgcccggggccctggccccccccagaggctgtccttctcctttggagaccacctggccgaggacctgtgtgtgcaggccgccaaggccagcggcatcctgcctgtgtaccacagcctgtttgccctggccacagaggacctgagctgctggttcccccccagccacatcttctctgtggaggatgccagcacccaggtgctgctgtaccgcatccgcttctacttccccaactggtttggcctggagaagtgccaccgcttcggcctgaggaaggacctggccagcgccatcctggacctgcctgtgctggagcacctgtttgcccagcacagaagtgacctggtgtctggccgcctgcctgtgggcctgagcctgaaggagcagggagaatgtctgagcctggccgtgctggacctggccaggatggcccgggagcaggcccagaggcctggagagctgctgaagacagtgtcctacaaggcctgcctgccccccagcctgcgggacctgatccagggcctgagctttgtgacccggcggcgcatccggaggacagtgcggcgggccctgcggcgggtggccgcctgccaggccgacagacacagcctgatggccaagtacatcatggacctggagcggctggaccctgctggagctgctgagaccttccacgtgggcctgcccggggccctgggcggccatgatggcctgggcctgctgcgggtggccggagatggcggcatcgcctggacccagggcgagcaggaggtgctgcagcccttctgtgacttccctgagatcgtggacatcagcatcaagcaggccccccgggtgggccctgctggggagcaccggctggtgacagtgaccaggacagacaaccagatcctggaggccgagttccctggcctgcctgaggccctgagctttgtggccctggtggatggctacttccggctgaccacagacagccagcacttcttctgcaaggaggtggccccaccccggctgctggaggaggtggccgagcagtgccacggccccatcaccctggactttgccatcaacaagctgaagacaggaggcagccggcccggcagctatgtgctgcggcgcagcccccaggactttgacagcttcctgctgactgtgtgtgtgcagaaccccctgggccctgactacaagggctgcctgatcagaagaagccccaccggcaccttcctgctggtgggcctgagccggccccacagcagcctgcgggagctgctggccacctgctgggatggcggcctgcacgtggatggagtggccgtgaccctgaccagctgctgcatcccccggcccaaggagaagagcaacctgattgtggtgcagaggggccacagcccccccaccagcagcctggtgcagccccagagccagtaccagctgagccagatgaccttccacaagatcccagctgacagcctggagtggcatgagaacctgggccacggcagcttcaccaagatctaccggggctgcagacatgaggtggtggatggagaggccaggaagacagaggtgctgctgaaggtgatggatgccaagcacaagaactgcatggagagcttcctggaggccgccagcctgatgagccaggtgtcctaccgccacctggtgctgctgcacggcgtgtgcatggccggggacagcgagagccccccacccacccaccccaccccagccagccccaagagccgcctcttcttccccccactcttctag

SEQ ID NO: 156667 - DNA, 3375 bp, Artificial Sequence
  Description of Artificial Sequence: Synthetic coding sequence
atggcccctccttctgaggagacccccctcatcccccagaggagctgcagcctgctgagcacagaagctggggccctgcacgtgctgctgcctgcccggggccctggccccccccagaggctgtccttctcctttggagaccacctggccgaggacctgtgtgtgcaggccgccaaggccagcggcatcctgcctgtgtaccacagcctgtttgccctggccacagaggacctgagctgctggttcccccccagccacatcttctctgtggaggatgccagcacccaggtgctgctgtaccgcatccgcttctacttccccaactggtttggcctggagaagtgccaccgcttcggcctgaggaaggacctggccagcgccatcctggacctgcctgtgctggagcacctgtttgcccagcacagaagtgacctggtgtctggccgcctgcctgtgggcctgagcctgaaggagcagggagaatgtctgagcctggccgtgctggacctggccaggatggcccgggagcaggcccagaggcctggagagctgctgaagacagtgtcctacaaggcctgcctgccccccagcctgcgggacctgatccagggcctgagctttgtgacccggcggcgcatccggaggacagtgcggcgggccctgcggcgggtggccgcctgccaggccgacagacacagcctgatggccaagtacatcatggacctggagcggctggaccctgctggagctgctgagaccttccacgtgggcctgcccggggccctgggcggccatgatggcctgggcctgctgcgggtggccggagatggcggcatcgcctggacccagggcgagcaggaggtgctgcagcccttctgtgacttccctgagatcgtggacatcagcatcaagcaggccccccgggtgggccctgctggggagcaccggctggtgacagtgaccaggacagacaaccagatcctggaggccgagttccctggcctgcctgaggccctgagctttgtggccctggtggatggctacttccggctgaccacagacagccagcacttcttctgcaaggaggtggccccaccccggctgctggaggaggtggccgagcagtgccacggccccatcaccctggactttgccatcaacaagctgaagacaggaggcagccggcccggcagctatgtgctgcggcgcagcccccaggactttgacagcttcctgctgactgtgtgtgtgcagaaccccctgggccctgactacaagggctgcctgatcagaagaagccccaccggcaccttcctgctggtgggcctgagccggccccacagcagcctgcgggagctgctggccacctgctgggatggcggcctgcacgtggatggagtggccgtgaccctgaccagctgctgcatcccccggcccaaggagaagagcaacctgattgtggtgcagaggggccacagcccccccaccagcagcctggtgcagccccagagccagtaccagctgagccagatgaccttccacaagatcccagctgacagcctggagtggcatgagaacctgggccacggcagcttcaccaagatctaccggggctgcagacatgaggtggtggatggagaggccaggaagacagaggtgctgctgaaggtgatggatgccaagcacaagaactgcatggagagcttcctggaggccgccagcctgatgagccaggtgtcctaccgccacctggtgctgctgcacggcgtgtgcatggccggggacagcaccatggtgcaggagtttgtgcacctgggcgccatcgacatgtacctgaggaagaggggccacctggtgcctgcctcctggaagctgcaggtggtgaagcagctggcctatgccctgaactacctggaggacaagggcctgccccatggaaatgtgtctgccaggaaggtgctgctggcccgggagggcgcagatggcagcccccccttcatcaagctgagtgaccccggggtgtccccagctgtgctgagcctggagatgctgacagaccgcatcccctgggtggcccctgagtgcctgcgggaggcccagaccctgagcctggaggccgacaagtggggctttggagccaccgtgtgggaggtgttcagcggcgtgaccatgcccatcagcgccctggaccctgccaagaagctgcagttctatgaagatcggcagcagctgcctgcccccaagtggacagagctggccctgctgatccagcagtgcatggcctatgagcctgtgcagaggcccagcttccgggccgtcatccgggacctgaacagcctcatcagcagtgactatgagctgctgagtgaccccacccctggggccctggcccccagagatggcctgtggaatggagcccagctgtatgcctgccaggaccccaccatctttgaggagcggcacctgaagtacatcagccagctgggcaagggcaactttggatctgtggagctgtgccgctatgaccccctgggggacaacacaggagccctggtggccgtgaagcagctgcagcacagcggccctgaccagcagagggacttccagcgggagatccagatcctgaaggccctgcacagcgacttcatcgtgaagtaccggggcgtgtcctatggccctggccggcagagcctgcggctggtgatggagtacctgcccagcggctgcctgcgggacttcctgcagaggcaccgggcccggctggatgccagccggctgctgctgtacagcagccagatctgcaagggcatggagtacctgggcagcagaagatgtgtgcaccgggacctggccgccaggaacatcctggtggagagcgaggcccacgtgaagattgctgactttggcctggccaagctgctgcccctggacaaggactactacgtggtgcgggagcccggccagagccccatcttctggtacgcccctgagagcctgagtgacaacatcttcagccggcagagtgatgtgtggagctttggagtggtgctgtatgagctgttcacctactgtgacaagagctgcagccccagcgctgagttcctgaggatgatgggctgtgaaagagatgtgcctgccctgtgccgcctgctggagctgctggaggagggccagaggctgcctgcccccccagcctgcccagctgaggtgcatgagctgatgaagctgtgctgggcccccagcccccaggaccggcccagcttcagcgccctgggcccccagctggacatgctgtggagcggcagccggggctgtgagacccacgccttcaccgcccaccctgagggcaagcaccacagcctgtccttctcctag

SEQ ID NO: 156668 - DNA, 3375 bp, Artificial Sequence; identical to SEQ ID NO: 156667
  Description of Artificial Sequence: Synthetic coding sequence

SEQ ID NO: 156669 - DNA, 3285 bp, Artificial Sequence
  Description of Artificial Sequence: Synthetic coding sequence
atggcccctccttctgaggagacccccctcatcccccagaggagctgcagcctgctgagcacagaagctggggccctgcacgtgctgctgcctgcccggggccctggccccccccagaggctgtccttctcctttggagaccacctggccgaggacctgtgtgtgcaggccgccaaggccagcggcatcctgcctgtgtaccacagcctgtttgccctggccacagaggacctgagctgctggttcccccccagccacatcttctctgtggaggatgccagcacccaggtgctgctgtaccgcatccgcttctacttccccaactggtttggcctggagaagtgccaccgcttcggcctgaggaaggacctggccagcgccatcctggacctgcctgtgctggagcacctgtttgcccagcacagaagtgacctggtgtctggccgcctgcctgtgggcctgagcctgaaggagcagggagaatgtctgagcctggccgtgctggacctggccaggatggcccgggagcaggcccagaggcctggagagctgctgaagacagtgtcctacaaggcctgcctgccccccagcctgcgggacctgatccagggcctgagctttgtgacccggcggcgcatccggaggacagtgcggcgggccctgcggcgggtggccgcctgccaggccgacagacacagcctgatggccaagtacatcatggacctggagcggctggaccctgctggagctgctgagaccttccacgtgggcctgcccggggccctgggcggccatgatggcctgggcctgctgcgggtggccggagatggcggcatcgcctggacccagggcgagcaggaggtgctgcagcccttctgtgacttccctgagatcgtggacatcagcatcaagcaggccccccgggtgggccctgctggggagcaccggctggtgacagtgaccaggacagacaaccagatcctggaggccgagttccctggcctgcctgaggccctgagctttgtggccctggtggatggctacttccggctgaccacagacagccagcacttcttctgcaaggaggtggccccaccccggctgctggaggaggtggccgagcagtgccacggccccatcaccctggactttgccatcaacaagctgaagacaggaggcagccggcccggcagctatgtgctgcggcgcagcccccaggactttgacagcttcctgctgactgtgtgtgtgcagaaccccctgggccctgactacaagggctgcctgatcagaagaagccccaccggcaccttcctgctggtgggcctgagccggccccacagcagcctgcgggagctgctggccacctgctgggatggcggcctgcacgtggatggagtggccgtgaccctgaccagctgctgcatcccccggcccaaggagaagagcaacctgattgtggtgcagaggggccacagcccccccaccagcagcctggtgcagccccagagccagtaccagctgagccagatgaccttccacaagatcccagctgacagcctggagtggcatgagaacctgggccacggcagcttcaccaagatctaccggggctgcagacatgaggtggtggatggagaggccaggaagacagaggtgctgctgaaggtgatggatgccaagcacaagaactgcatggagagcttcctggaggccgccagcctgatgagccaggtgtcctaccgccacctggtgctgctgcacggcgtgtgcatggccggggacagcaccatggtgcaggagtttgtgcacctgggcgccatcgacatgtacctgaggaagaggggccacctggtgcctgcctcctggaagctgcaggtggtgaagcagctggcctatgccctgaactacctggaggacaagggcctgccccatggaaatgtgtctgccaggaaggtgctgctggcccgggagggcgcagatggcagcccccccttcatcaagctgagtgaccccggggtgtccccagctgtgctgagcctggagatgctgacagaccgcatcccctgggtggcccctgagtgcctgcgggaggcccagaccctgagcctggaggccgacaagtggggctttggagccaccgtgtgggaggtgttcagcggcgtgaccatgcccatcagcgccctggaccctgccaagaagctgcagttctatgaagatcggcagcagctgcctgcccccaagtggacagagctggccctgctgatccagcagtgcatggcctatgagcctgtgcagaggcccagcttccgggccgtcatccgggacctgaacagcctcatcagcagtgactatgagctgctgagtgaccccacccctggggccctggcccccagagatggcctgtggaatggagcccagctgtatgcctgccaggaccccaccatctttgaggagcggcacctgaagtacatcagccagctgggcaagggcaactttggatctgtggagctgtgccgctatgaccccctgggggacaacacaggagccctggtggccgtgaagcagctgcagcacagcggccctgaccagcagagggacttccagcgggagatccagatcctgaaggccctgcacagcgacttcatcgtgaagtaccggggcgtgtcctatggccctggccggcagagcctgcggctggtgatggagtacctgcccagcggctgcctgcgggacttcctgcagaggcaccgggcccggctggatgccagccggctgctgctgtacagcagccagatctgcaagggcatggagtacctgggcagcagaagatgtgtgcaccgggacctggccgccaggaacatcctggtggagagcgaggcccacgtgaagattgctgactttggcctggccaagctgctgcccctggacaaggactactacgtggtgcgggagcccggccagagccccatcttctggtacgcccctgagagcctgagtgacaacatcttcagccggcagagtgatgtgtggagctttggagtggtgctgtatgagctgttcacctactgtgacaagagctgcagccccagcgctgagttcctgaggatgatgggctgtgaaagagatgtgcctgccctgtgccgcctgctggagctgctggaggagggccagaggctgcctgcccccccagcctgcccagctgaggtgtctgctgctggcctggcctctgtgtcccagagcgtggactgggccggcgtgtctgggaagccagctggggcctag

SEQ ID NO: 156670 - DNA, 1575 bp, Artificial Sequence
  Description of Artificial Sequence: Synthetic coding sequence
atgtctgggaagaggaagagggtggtgctgaccatcaaggacaagctggacatcatcaagaagctggaggatggcggcagcagcaagcagctggccgtcatctatggaattggagagaccaccgtgcgggacatcaggaagaacaaggagaagatcatcacctacgccagcagcagtgacagcaccagcctgctggccaagaggaagtccatgaagcccagcatgtatgaggagctggaccgggccatgctggagtggttcaaccagcagagggccaagggcaaccccatcagcggccccatctgtgccaagagagctgagttcttcttctacgccctgggcatggatggagacttcaaccccagcgctggctggctgacccgcttcaagcagaggcacagcatccgggagatcaacatcagaaatgaaaggctgaatggagatgaaacagctgtggaggacttctgcaacaacttccgggacttcatcgagcgggagaacctgcagcctgagcagatctacaatgctgatgaaacaggcctcttctggaagtgcctgcccagccgcatcagcgtcatcaagggcaagtgcaccgtgcccggccacaagagcattgaggagcgggtgaccatcatgtgctgtgccaatgccaccggcctgcacaagctgaagctgtgtgtggtgggcaaggccaagaagcccaggagcttcaagagcacagacaccctgaacctgcctgtgtcctacttcagccagaagggggcctggatggacctgagcatcttccggcagtggtttgacaagatctttgtgccccaggtgcgggagtacctgcggagcaagggcctgcaggagaaggctgtgctgctgctggacaacagccccacccaccccaatgaaaatgtgctgcggagtgatgatggccagatctttgccaagtacctgccccccaacgtggccagcctcatccagcccagcgaccagggcgtgattgccaccatgaagaggaactaccgggccggcctgctgcagaacaacctggaggagggcaatgacctgaagagcttctggaagaagctgaccctgctggatgccctgtatgaaattgccatggcctggaacctggtgaagcctgtgaccatcagccgggcctggaagaagatcctgcccatggtggaggagaaggagagcctggactttgatgtggaggacatctctgtggccaccgtggccgccatcctgcagcacaccaagggcctggagaatgtgaccacagagaacctggagaagtggctggaggtggacagcacagagcccggctatgaggtgctgacagattctgagatcatcagaagagcccagggccaggctgatgagagcagtgaaaatgaggaggaggagattgagctgatccctgagaagcacatcaaccacgccgccgccctgcagtggacagagaacctgctggactacctggagcagcagggcgacatgatcctgcctgaccggctggtgatcaggaagctgcgggccaccatccggaacaagcagaagatgaccaagagcagccagtag

SEQ ID NO: 156671 - DNA, 1575 bp, Artificial Sequence; identical to SEQ ID NO: 156670
  Description of Artificial Sequence: Synthetic coding sequence

SEQ ID NO: 156672 - DNA, 1251 bp, Artificial Sequence
  Description of Artificial Sequence: Synthetic coding sequence
atggccggggacacccactgcccagctgagcccctggcccgggagggcaccctgtgggaggccctgcgggccctgctgccccacagcaaagaagacctgaagctggacctgggggagaaggtggagaggtctgtggtgaccctgctgcagagggccacagagctgttctatgagggcagaagagatgaatgtctgcagagcagcgaggtgatcctggactacagctgggagaagctgaacacaggcacctggcaggatgtggacaaggactggaggagagtgtatgccatcggctgcctgctgaaggccctgtgcctgtgccaggccccagaagatgccaacacagtggccgccgccctgcgggtgtgtgacatgggcctgctgatgggcgccgccatcctgggggacatcctgctgaaggtggccgccatcctgcagacccacctgcccgggaagaggcctgcccggggcagcctgcctgagcagccctgcaccaagaaggcccgggctgaccacggcctcatcccagatgtgaagctggagaagacagtgccccggctgcaccggcccagcctgcagcacttccgggagcagttcctggtgcccggccggcctgtgatcctgaagggcgtggccgaccactggccctgcatgcagaagtggagcctggagtacatccaggagattgctggctgcaggacagtgcctgtggaggtgggcagccgctacacagatgaggagtggagccagaccctgatgacagtgaatgagttcatcagcaagtacatcgtgaatgagcccagagatgtgggctacctggcccagcaccagctgtttgaccagatccctgagctgaagcaggacatcagcatcccagactactgcagcctgggagatggagaggaggaggagatcaccatcaatgcctggtttggcccccagggcaccatcagccccctgcaccaggacccccagcagaacttcctggtgcaggtgatgggcaggaagtacatccggctgtacagcccccaggagagcggggccctgtacccccatgacacccacctgctgcacaacaccagccaggtggatgtggagaacccagacctggagaagttccccaagtttgccaaggcccccttcctgagctgcatcctgagccctggagagatcctcttcatccctgtgaagtactggcactacgtgcgggccctggacctgtccttctctgtgtccttctggtggagctag

SEQ ID NO: 156673 - DNA, 663 bp, Artificial Sequence
  Description of Artificial Sequence: Synthetic coding sequence
atggccggggacacccactgcccagctgagcccctggcccgggagggcaccctgtgggaggccctgcgggccctgctgccccacagcaaagaagacctgaagctggacctgggggagaaggtggagaggtctgtggtgaccctgctgcagagggccacagagctgttctatgagggcagaagagatgaatgtctgcagagcagcgaggtgatcctggactacagctgggagaagctgaacacaggcacctggcaggatgtggacaaggactggaggagagtgtatgccatcggctgcctgctgaaggccctgtgcctgtgccaggccccagaagatgccaacacagtggccgccgccctgcgggtgtgtgacatgggcctgctgatgggcgccgccatcctgggggacatcctgctgaaggtggccgccatcctgcagacccacctgcccgggaagaggcctgcccggggcagcctgcctgagcagccctgcaccaaggtggatgtggagaacccagacctggagaagttccccaagtttgccaaggcccccttcctgagctgcatcctgagccctggagagatcctcttcatccctgtgaagtactggcactacgtgcgggccctggacctgtccttctctgtgtccttctggtggagctag

SEQ ID NO: 156674 - DNA, 1365 bp, Artificial Sequence
  Description of Artificial Sequence: Synthetic coding sequence
atgagccgggagaagtgcagccctggagagggcgctgaggagggccggggcagcgaggccagcggcctgaaggccagcgctggccatggaacagagcctgctgggggcggccccatggccggggacacccactgcccagctgagcccctggcccgggagggcaccctgtgggaggccctgcgggccctgctgccccacagcaaagaagacctgaagctggacctgggggagaaggtggagaggtctgtggtgaccctgctgcagagggccacagagctgttctatgagggcagaagagatgaatgtctgcagagcagcgaggtgatcctggactacagctgggagaagctgaacacaggcacctggcaggatgtggacaaggactggaggagagtgtatgccatcggctgcctgctgaaggccctgtgcctgtgccaggccccagaagatgccaacacagtggccgccgccctgcgggtgtgtgacatgggcctgctgatgggcgccgccatcctgggggacatcctgctgaaggtggccgccatcctgcagacccacctgcccgggaagaggcctgcccggggcagcctgcctgagcagccctgcaccaagaaggcccgggctgaccacggcctcatcccagatgtgaagctggagaagacagtgccccggctgcaccggcccagcctgcagcacttccgggagcagttcctggtgcccggccggcctgtgatcctgaagggcgtggccgaccactggccctgcatgcagaagtggagcctggagtacatccaggagattgctggctgcaggacagtgcctgtggaggtgggcagccgctacacagatgaggagtggagccagaccctgatgacagtgaatgagttcatcagcaagtacatcgtgaatgagcccagagatgtgggctacctggcccagcaccagctgtttgaccagatccctgagctgaagcaggacatcagcatcccagactactgcagcctgggagatggagaggaggaggagatcaccatcaatgcctggtttggcccccagggcaccatcagccccctgcaccaggacccccagcagaacttcctggtgcaggtgatgggcaggaagtacatccggctgtacagcccccaggagagcggggccctgtacccccatgacacccacctgctgcacaacaccagccaggtggatgtggagaacccagacctggagaagttccccaagtttgccaaggcccccttcctgagctgcatcctgagccctggagagatcctcttcatccctgtgaagtactggcactacgtgcgggccctggacctgtccttctctgtgtccttctggtggagctag

SEQ ID NO: 156675 - DNA, 441 bp, Artificial Sequence
  Description of Artificial Sequence: Synthetic coding sequence
atgacagtgaatgagttcatcagcaagtacatcgtgaatgagcccagagatgtgggctacctggcccagcaccagctgtttgaccagatccctgagctgaagcaggacatcagcatcccagactactgcagcctgggagatggagaggaggaggagatcaccatcaatgcctggtttggcccccagggcaccatcagccccctgcaccaggacccccagcagaacttcctggtgcaggtgatgggcaggaagtacatccggctgtacagcccccaggagagcggggccctgtacccccatgacacccacctgctgcacaacaccagccaggtggatgtggagaacccagacctggagaagttccccaagtttgccaaggcccccttcctgagctgcatcctgagccctggagagatcctcttcatccctgtgaagtactag

SEQ ID NO: 156676 - DNA, 1119 bp, Artificial Sequence
  Description of Artificial Sequence: Synthetic coding sequence
atgaaccacaagagcaagaagaggatccgggaggccaagaggtctgcccggcctgagctgaaggacagcctggactggaccaggcacaactactatgagagcttcagcctgagccctgctgctgtggccgacaacgtggagcgggcagatgccctgcagctgtctgtggaggagtttgtggagagatatgagcggccctacaagcctgtggtgctgctgaatgcccaggagggctggagcgcccaggagaagtggaccctggagcggctgaagaggaagtacagaaaccagaagttcaagtgtggagaagataatgatggctacagcgtgaagatgaagatgaagtactacatcgagtacatggagagcaccagagatgacagccccctgtacatctttgacagcagctatggagagcaccccaagaggaggaagctgctggaggactacaaggtgcccaagttcttcacagatgacctcttccagtatgctggggagaagaggcggcccccctaccgctggtttgtgatgggccccccaagaagtggcaccggcatccacatcgaccccctgggcaccagcgcctggaatgccctggtgcagggccacaagcgctggtgcctcttccccaccagcaccccccgggagctgatcaaggtgaccagagatgaaggaggcaaccagcaggatgaggccatcacctggttcaacgtcatctaccccaggacccagctgcccacctggcccccagagttcaagcccctggagatcctgcagaagccaggagagaccgtgtttgtgcctgggggctggtggcacgtggtgctgaacctggacaccaccatcgccatcacccagaactttgccagcagcaccaacttccctgtggtgtggcacaagacagtgcggggccggcccaagctgagcaggaagtggtaccgcatcctgaagcaggagcaccctgagctggccgtgctggccgacagcgtggacctgcaggagagcacaggcatcgccagtgacagcagcagtgacagcagcagcagcagcagcagcagcagcagtgacagcgacagcgagcgcatccgggacacctgtggcggccgggcccacccctag

SEQ ID NO: 156677 - DNA, 1212 bp, Artificial Sequence
  Description of Artificial Sequence: Synthetic coding sequence
atgaaccacaagagcaagaagaggatccgggaggccaagaggtctgcccggcctgagctgaaggacagcctggactggaccaggcacaactactatgagagcttcagcctgagccctgctgctgtggccgacaacgtggagcgggcagatgccctgcagctgtctgtggaggagtttgtggagagatatgagcggccctacaagcctgtggtgctgctgaatgcccaggagggctggagcgcccaggagaagtggaccctggagcggctgaagaggaagtacagaaaccagaagttcaagtgtggagaagataatgatggctacagcgtgaagatgaagatgaagtactacatcgagtacatggagagcaccagagatgacagccccctgtacatctttgacagcagctatggagagcaccccaagaggaggaagctgctggaggactacaaggtgcccaagttcttcacagatgacctcttccagtatgctggggagaagaggcggcccccctaccgctggtttgtgatgggccccccaagaagtggcaccggcatccacatcgaccccctgggcaccagcgcctggaatgccctggtgcagggccacaagcgctggtgcctcttccccaccagcaccccccgggagctgatcaaggtgaccagagatgaaggaggcaaccagcaggatgaggccatcacctggttcaacgtcatctaccccaggacccagctgcccacctggcccccagagttcaagcccctggagatcctgcagaagccaggagagaccgtgtttgtgcctgggggctggtggcacgtggtgctgaacctggacaccaccatcgccatcacccagaactttgccagcagcaccaacttccctgtggtgtggcacaagacagtgcggggccggcccaagctgagcaggaagtggtaccgcatcctgaagcaggagcaccctgagctggccgtgctggccgacagcgtggacctgcaggagagcacaggcatcgccagtgacagcagcagtgacagcagcagcagcagcagcagcagcagcagtgacagcgacagtgaatgtgagagcggctctgaaggagatggcaccgtgcacaggaggaagaagaggaggacctgcagcatggtgggcaatggagacaccaccagccaggatgactgtgtgtccaaggagaggagcagcagcaggtag

SEQ ID NO: 156678 - DNA, 1245 bp, Artificial Sequence
  Description of Artificial Sequence: Synthetic coding sequence
atgaaccacaagagcaagaagaggatccgggaggccaagaggtctgcccggcctgagctgaaggacagcctggactggaccaggcacaactactatgagagcttcagcctgagccctgctgctgtggccgacaacgtggagcgggcagatgccctgcagctgtctgtggaggagtttgtggagagatatgagcggccctacaagcctgtggtgctgctgaatgcccaggagggctggagcgcccaggagaagtggaccctggagcggctgaagaggaagtacagaaaccagaagttcaagtgtggagaagataatgatggctacagcgtgaagatgaagatgaagtactacatcgagtacatggagagcaccagagatgacagccccctgtacatctttgacagcagctatggagagcaccccaagaggaggaagctgctggaggactacaaggtgcccaagttcttcacagatgacctcttccagtatgctggggagaagaggcggcccccctaccgctggtttgtgatgggccccccaagaagtggcaccggcatccacatcgaccccctgggcaccagcgcctggaatgccctggtgcagggccacaagcgctggtgcctcttccccaccagcaccccccgggagctgatcaaggtgaccagagatgaaggaggcaaccagcaggatgaggccatcacctggttcaacgtcatctaccccaggacccagctgcccacctggcccccagagttcaagcccctggagatcctgcagaagccaggagagaccgtgtttgtgcctgggggctggtggcacgtggtgctgaacctggacaccaccatcgccatcacccagaactttgccagcagcaccaacttccctgtggtgtggcacaagacagtgcggggccggcccaagctgagcaggaagtggtaccgcatcctgaagcaggagcaccctgagctggccgtgctggccgacagcgtggacctgcaggagagcacaggcatcgccagtgacagcagcagtgacagcagcagcagcagcagcagcagcagcagtgacagcgacagtgaatgtgagagcggctctgaaggagatggcaccgtgcacaggaggaagaagaggaggacctgcagcatggtgggcaatggagacaccaccagccaggatgactgtgtgtccaaggagaggagcagcagccgcatccgggacacctgtggcggccgggcccacccctag

SEQ ID NO: 156679 - DNA, 441 bp, Artificial Sequence
  Description of Artificial Sequence: Synthetic coding sequence
atgctggccggggccggccggcccggcctgccccagggccgccacctgtgctggctgctgtgtgccttcaccctgaagctgtgccaggccgaggcccctgtgcaggaggagaagctgagcgccagcaccagcaacctgccctgctggctggtggaggagtttgtggtggccgaggagtgcagcccctgcagcaacttccgggccaagaccaccccagaatgtggccccaccggctacgtggagaagatcacctgcagcagcagcaagagaaatgagttcaagagctgccgcagcgccctgatggagcagaggctcttctggaagtttgaaggagctgtggtgtgtgtggccctgatctttgcctgcctggtgatcatccggcagaggcagctggacaggaaggccctggagaaggtgaggaagcagatcgagagcatctag

SEQ ID NO: 156680 - DNA, 354 bp, Artificial Sequence
  Description of Artificial Sequence: Synthetic coding sequence
atggcctggggctggcacctgtccttcctgagcgccagcaccagcaacctgccctgctggctggtggaggagtttgtggtggccgaggagtgcagcccctgcagcaacttccgggccaagaccaccccagaatgtggccccaccggctacgtggagaagatcacctgcagcagcagcaagagaaatgagttcaagagctgccgcagcgccctgatggagcagaggctcttctggaagtttgagggcgctgtggtgtgtgtggccctgatctttgcctgcctggtgatcatccggcagaggcagctggacaggaaggccctggagaaggtgaggaagcagatcgagagcatctag

SEQ ID NO: 156681 - DNA, 354 bp, Artificial Sequence; identical to SEQ ID NO: 156680
  Description of Artificial Sequence: Synthetic coding sequence

SEQ ID NO: 156682 - DNA, 354 bp, Artificial Sequence; identical to SEQ ID NO: 156680
  Description of Artificial Sequence: Synthetic coding sequence

SEQ ID NO: 156683 - DNA, 1044 bp, Artificial Sequence
  Description of Artificial Sequence: Synthetic coding sequence
atggagacccccttctatggagatgaggccctgagcggcctgggcggcggggccagcggcagcggcggcagctttgccagccctggccgcctcttccctggggccccacccacagctgctgctggctccatgatgaagaaggatgccctgaccctgagcctgtctgagcaggtggccgccgccctgaagccagctgctgcccccccacccacccccctgcgggcagatggagcccccagcgctgcccccccagatggcctgctggccagcccagacctgggcctgctgaagctggccagccctgagctggagcggctcatcatccagagcaatggcctggtgaccaccacccccaccagcagccagttcctgtaccccaaggtggccgccagcgaggagcaggagtttgctgagggctttgtgaaggccctggaggacctgcacaagcagaaccagctgggcgctggagctgctgctgctgctgctgctgctgctgctgggggccccagcggcacagccaccggcagcgcccctcctggagagctggccccagctgctgctgcccctgaggcccctgtgtatgccaacctgagcagctatgccggcggggccggcggggccggcggggccgccaccgtggcctttgctgctgagcctgtgcccttccccccacctcctcctcctggggccctgggccccccccggctggccgccctgaaggatgagccccagacagtgcctgatgtgcccagctttggagagagcccccccctgagccccatcgacatggacacccaggagcgcatcaaggccgagaggaagaggctgaggaacagaattgctgccagcaagtgcaggaagaggaagctggagcgcatcagccggctggaggagaaggtgaagaccctgaagagccagaacacagagctggccagcacagccagcctgctgcgggagcaggtggcccagctgaagcagaaggtgctgagccacgtgaacagcggctgccagctgctgccccagcaccaggtgcctgcctactag

SEQ ID NO: 156684 - DNA, 2934 bp, Artificial Sequence
  Description of Artificial Sequence: Synthetic coding sequence
atgagctttgccctggaggagaccctggagagtgactgggtggccgtgcggccccacgtgtttgatgagcgggagaagcacaagtttgtgttcatcgtggcctggaatgaaattgagggcaagtttgccatcacctgccacaacagaacagcccagaggcagaggagcggcagccgggagcaggccggggcccggggcggcgctgaggccggcggggccgccagtgatggcagccggggccctggcagccctgctggccggggccggcctgaggccacagccagcgccaccctggtgcgcagccctggccccaggaggagcagcgcctgggccgagggcggcagccccaggagcaccaggagcctgctgggggacccccggctgcggagccctggcagcaaaggagctgagagccggctgcggagccctgtgcgggccaagcccatccctggccagaagaccagcgaggctgatgatgctgctggagctgctgctgctgctgcccggcctgccccccgggaggcccaggtgtcctctgtgcgcatcgtgtctgccagcggcaccgtgtctgaggagattgaggtgctggagatggtgaaggaggatgaggcccccctggccctgagtgatgctgagcagcccccaccagccacagagctggagagccctgctgaggagtgctcctgggccggcctcttctccttccaggacctgcgggctgtgcaccagcagctgtgcagcgtgaacagccagctggagccctgcctgcctgtgtttcctgaggagcccagcggcatgtggacagtgctgtttggaggagcccctgagatgacagagcaggagattgacaccctgtgctaccagctgcaggtgtacctgggccacggcctggacacctgtggctggaagatcctgagccaggtgctcttcacagaaacagatgatcctgaggagtactatgagagcctgtctgagctgcggcagaagggctatgaggaggtgctgcagagggccaggaagaggatccaggagctgctggacaagcacaagaacacagagagcatggtggagctgctggacctgtaccagatggaggatgaggcctacagcagcctggccgaggccaccacagagctgtaccagtacctgctgcagcccttccgggacatgagggagctggccatgctgcggcggcagcagatcaagatctccatggagaatgactacctgggccccaggagaattgagagcctgcagaaggaggatgctgactggcagaggaaggcccacatggctgtgctgagcatccaggacctgactgtgaagtactttgagatcacagccaaggcccagaaggctgtgtatgacaggatgagagctgaccagaagaagtttgggaaggcctcctgggccgctgctgctgagaggatggagaagctgcagtatgctgtgtccaaggagaccctgcagatgatgagggccaaggagatctgcctggagcagaggaagcacgccctgaaggaggagatgcagagcctgcggggcggcacagaggccatcgcccggctggaccagctggaggccgactactatgacctgcagctgcagctgtatgaggtgcagtttgagatcctgaagtgtgaggagctgctgctgacagcccagctggagagcatcaagaggctcatcagcgagaagagagatgaggtggtgtactatgacacctatgagagcatggaggccatgctggagaaggaggagatggccgccagcgcctacctgcagcgggaggagctgcagaagctgcagcagaaggcccggcagctggaggcccggcggggccgggtgtctgccaagaagagctacctgaggaacaagaaggagatctgcatcgccaagcacaatgagaagatccagcagaggaccagaattgaagatgagtaccgcacccaccacacagtgcagctgaagcgggagaagctgcatgatgaggaggagaggaagagcgcctgggtgtcccaggagcggcagaggaccctggaccggctgcggaccttcaagcagcgctacccaggccaggtgatcctgaagagcacccggctgcggctggcccacgcccggaggaaaggagctgccagccctgtgctgcaggaggaccactgtgacagcctgcccagcgtgctgcaggtggaggagaagacagaggaggtgggggagggccgggtgaagaggggccccagccagaccacagagccccagagcctggtgcagctggaggacaccagcctgacccagctggaggccaccagcctgcccctgagcggcgtgaccagcgagctgccccccaccatcagcctgcccctgctgaacaacaacctggagccctgcagcgtgaccatcaaccccctgcccagccccctgccccccaccccacctccacccctgcctgtggccaaggacagcggccctgagaccctggagaaggacctgcccaggaaggagggcaatgagaagaggatccccaagagcgccagcgcccccagcgcccacctgtttgacagcagccagctggtgtctgccaggaagaagctgaggaagacagctgagggcctgcagaggcggcgggtgagcagccccatggatgaggtgctggccagcctgaagaggggcagcttccacctgaagaaggtggagcagaggaccctgccccccttcccagatgaagatgacagcaacaacatcctggcccagatcaggaagggcgtgaagctgaagaaggtgcagaaggatgtgctgcgggagagcttcaccctgctgcctgacacagaccccctgaccaggagcatccacgaggccctgcggcgcatcaaggaggccagccctgagagtgaagatgaggaggaggccctgccctgcacagactgggagaactag

SEQ ID NO: 156685 - DNA, 2967 bp, Artificial Sequence
  Description of Artificial Sequence: Synthetic coding sequence
atgagctttgccctggaggagaccctggagagtgactgggtggccgtgcggccccacgtgtttgatgagcgggagaagcacaagtttgtgttcatcgtggcctggaatgaaattgagggcaagtttgccatcacctgccacaacagaacagcccagaggcagaggagcggcagccgggagcaggccggggcccggggcggcgctgaggccggcggggccgccagtgatggcagccggggccctggcagccctgctggccggggccggcctgaggccacagccagcgccaccctggtgcgcagccctggccccaggaggagcagcgcctgggccgagggcggcagccccaggagcaccaggagcctgctgggggacccccggctgcggagccctggcagcaaaggagctgagagccggctgcggagccctgtgcgggccaagcccatccctggccagaagaccagcgaggctgatgatgctgctggagctgctgctgctgctgcccggcctgccccccgggaggcccaggtgtcctctgtgcgcatcgtgtctgccagcggcaccgtgtctgaggagattgaggtgctggagatggtgaaggaggatgaggcccccctggccctgagtgatgctgagcagcccccaccagccacagagctggagagccctgctgaggagtgctcctgggccggcctcttctccttccaggacctgcgggctgtgcaccagcagctgtgcagcgtgaacagccagctggagccctgcctgcctgtgtttcctgaggagcccagcggcatgtggacagtgctgtttggaggagcccctgagatgacagagcaggagattgacaccctgtgctaccagctgcaggtgtacctgggccacggcctggacacctgtggctggaagatcctgagccaggtgctcttcacagaaacagatgatcctgaggagtactatgagagcctgtctgagctgcggcagaagggctatgaggaggtgctgcagagggccaggaagaggatccaggagctgctggacaagcacaagaacacagagagcatggtggagctgctggacctgtaccagatggaggatgaggcctacagcagcctggccgaggccaccacagagctgtaccagtacctgctgcagcccttccgggacatgagggagctggccatgctgcggcggcagcagatcaagatctccatggagaatgactacctgggccccaggagaattgagagcctgcagaaggaggatgctgactggcagaggaaggcccacatggctgtgctgagcatccaggacctgactgtgaagtactttgagatcacagccaaggcccagaaggctgtgtatgacaggatgagagctgaccagaagaagtttgggaaggcctcctgggccgctgctgctgagaggatggagaagctgcagtatgctgtgtccaaggagaccctgcagatgatgagggccaaggagatctgcctggagcagaggaagcacgccctgaaggaggagatgcagagcctgcggggcggcacagaggccatcgcccggctggaccagctggaggccgactactatgacctgcagctgcagctgtatgaggtgcagtttgagatcctgaagtgtgaggagctgctgctgacagcccagctggagagcatcaagaggctcatcagcgagaagagagatgaggtggtgtactatgacacctatgagagcatggaggccatgctggagaaggaggagatggccgccagcgcctacctgcagcgggaggagctgcagaagctgcagcagaaggcccggcagctggaggcccggcggggccgggtgtctgccaagaagagctacctgaggaacaagaaggagatctgcatcgccaagcacaatgagaagatccagcagaggaccagaattgaagatgagtaccgcacccaccacacagtgcagctgaagcgggagaagctgcatgatgaggaggagaggaagagcgcctgggtgtcccaggagcggcagaggaccctggaccggctgcggaccttcaagcagcgctacccaggccaggtgatcctgaagagcacccggctgcggctggcccacgcccggaggaaaggagctgccagccctgtgctgcaggaggaccactgtgacagcctgcccagcgtgctgcaggtggaggagaagacagaggaggtgggggagggccgggtgaagaggggccccagccagaccacagagccccagagcctggtgcagctggaggacaccagcctgacccagctggaggccaccagcctgcccctgagcggcgtgaccagcgagctgccccccaccatcagcctgcccctgctgaacaacaacctggagccctgcagcgtgaccatcaaccccctgcccagccccctgccccccaccccacctcctcctcctcctcctcctcctcctcctcctcctccacccctgcctgtggccaaggacagcggccctgagaccctggagaaggacctgcccaggaaggagggcaatgagaagaggatccccaagagcgccagcgcccccagcgcccacctgtttgacagcagccagctggtgtctgccaggaagaagctgaggaagacagctgagggcctgcagaggagaagagtgagcagccccatggatgaggtgctggccagcctgaagaggggcagcttccacctgaagaaggtggagcagaggaccctgccccccttcccagatgaagatgacagcaacaacatcctggcccagatcagaaaaggagtgaagctgaagaaggtgcagaaggatgtgctgcgggagagcttcaccctgctgcctgacacagaccccctgaccaggagcatccacgaggccctgcggcgcatcaaggaggccagccctgagagtgaagatgaggaggaggccctgccctgcacagactgggagaactag

SEQ ID NO: 156686 - DNA, 2238 bp, Artificial Sequence
  Description of Artificial Sequence: Synthetic coding sequence
atggaggtgatgaacctgatggagcagcccatcaaggtgacagagtggcagcagacctacacctatgacagcggcatccacagcggggccaacacctgtgtgcccagcgtgagcagcaagggcatcatggaggaggatgaggcctgtggccggcagtacaccctgaagaagaccaccacctacacccagggcgtgccccccagccagggcgacctggagtaccagatgagcaccacagcccgggccaagagggtgcgggaggccatgtgccctggggtgtctggagaggacagcagcctgctgctggccacccaggtggagggccaggccaccaacctgcagaggctggccgagcccagccagctgctgaagagcgccatcgtgcacctgatcaactaccaggatgatgctgagctggccacccgggccctgcctgagctgaccaagctgctgaatgatgaggaccctgtggtggtgaccaaggccgccatgattgtgaaccagctgagcaagaaggaggccagccggcgggccctgatgggcagcccccagctggtggccgctgtggtgaggaccatgcagaacaccagtgacctggacacagcccgctgcaccaccagcatcctgcacaacctgagccaccaccgggagggcctgctggccatcttcaagagcggcggcatcccagccctggtgaggatgctgagcagccctgtggagagcgtgctcttctacgccatcaccaccctgcacaacctgctgctgtaccaggagggcgccaagatggctgtgcggctggctgatggcctgcagaagatggtgcccctgctgaacaagaacaaccccaagttcctggccatcaccacagactgcctgcagctgctggcctacggcaaccaggagagcaagctgatcatcctggccaatggaggcccccaggccctggtgcagatcatgaggaactacagctatgagaagctgctgtggaccaccagccgggtgctgaaggtgctgtctgtgtgccccagcaacaagccagccatcgtggaggccggcggcatgcaggccctgggcaagcacctgaccagcaacagcccccggctggtgcagaactgcctgtggaccctgaggaacctgagtgatgtggccaccaagcaggagggcctggagagcgtgctgaagatcctggtgaaccagctgtctgtggatgatgtgaatgtgctgacctgtgccaccggcaccctgagcaacctgacctgcaacaacagcaagaacaagaccctggtgacccagaacagcggcgtggaggccctgatccacgccatcctgcgggccggggacaaggatgacatcacagagcctgctgtgtgtgccctgcggcacctgaccagccgccaccctgaggccgagatggcccagaacagcgtgcggctgaactacggcatcccagccatcgtgaagctgctgaaccagcccaaccagtggcccctggtgaaggccaccatcggcctcatccggaacctggccctgtgcccagccaaccacgcccccctgcaggaggccgccgtcatcccccggctggtgcagctgctggtgaaggcccaccaggatgcccagagacatgtggccgccggcacccagcagccctacacagatggagtgaggatggaggagatcgtggagggctgcaccggggccctgcacatcctggcccgggaccccatgaacaggatggagatcttccggctgaacaccatccccctgtttgtgcagctgctgtacagctctgtggagaacatccagagggtggccgccggcgtgctgtgtgagctggcccaggacaaggaggccgcagatgccattgatgctgagggcgccagcgcccccctgatggagctgctgcacagcagaaatgaaggaacagccacctatgctgctgctgtgctcttccgcatcagcgaggacaagaacccagactacaggaagagggtgtctgtggagctgaccaacagcctcttcaagcatgaccctgctgcctgggaggccgcccagagcatgatccccatcaatgagccctatggagatgacatggatgccacctaccggcccatgtacagcagtgatgtgcccctggaccccctggagatgcacatggacatggatggagactaccccatcgacacctacagtgatggcctgcggcccccctaccccacagctgaccacatgctggcctag

SEQ ID NO: 156687 - DNA, 2238 bp, Artificial Sequence; identical to SEQ ID NO: 156686
  Description of Artificial Sequence: Synthetic coding sequence

SEQ ID NO: 156688 - DNA, 2238 bp, Artificial Sequence; identical to SEQ ID NO: 156686
  Description of Artificial Sequence: Synthetic coding sequence

SEQ ID NO: 156689 - DNA, 834 bp, Artificial Sequence
  Description of Artificial Sequence: Synthetic coding sequence
atggaggtgatgaacctgatggagcagcccatcaaggtgacagagtggcagcagacctacacctatgacagcggcatccacagcggggccaacacctgtgtgcccagcgtgagcagcaagggcatcatggaggaggatgaggcctgtggccggcagtacaccctgaagaagaccaccacctacacccagggcgtgccccccagccagggcgacctggagtaccagatgagcaccacagcccgggccaagagggtgcgggaggccatgtgccctggggtgtctggagaggacagcagcctgctgctggccacccaggtggagggccaggccaccaacctgcagaggctggccgagcccagccagctgctgaagagcgccatcgtgcacctgatcaactaccaggatgatgctgagctggccacccgggccctgcctgagctgaccaagctgctgaatgatgaggaccctgtggtggtgaccaaggccgccatgattgtgaaccagctgagcaagaaggaggccagccggcgggccctgatgggcagcccccagctggtggccgctgtggtgaggaccatgcagaacaccagtgacctggacacagcccgctgcaccaccagcatcctgcacaacctgagccaccaccgggagggcctgctggccatcttcaagagcggcggcatcccagccctggtgaggatgctgagcagccctgtggagagcgtgctcttctacgccatcaccaccctgcacaacctgctgctgtaccaggagggcgccaagatggctgtgcggctggctgatggcctgcagaagatggtgcccctgctgtag

SEQ ID NO: 156690 - DNA, 708 bp, Artificial Sequence
  Description of Artificial Sequence: Synthetic coding sequence
atggaggtgatgaacctgatggagcagcccatcaaggtgacagagtggcagcagacctacacctatgacagcggcatccacagcggggccaacacctgtgtgcccagcgtgagcagcaagggcatcatggaggaggatgaggcctgtggccggcagtacaccctgaagaagaccaccacctacacccagggcgtgccccccagccagggcgacctggagtaccagatgagcaccacagcccgggccaagagggtgcgggaggccatgtgccctggggtgtctggagaggacagcagcctgctgctggccacccaggtggagggccaggccaccaacctgcagaggctggccgagcccagccagctgctgaagagcgccatcgtgcacctgatcaactaccaggatgatgctgagctggccacccgggccctgcctgagctgaccaagctgctgaatgatgaggaccctgtggtggtgaccaaggccgccatgattgtgaaccagctgagcaagaaggaggccagccggcgggccctgatgggcagcccccagctggtggccgctgtggtgaggaccatgcagaacaccagtgacctggacacagcccgctgcaccaccagcatcctgcacaacctgagccaccaccgggagggcctgctggccatcttcaagagcggcggcatcccagccctggtgaggatgctgtag

SEQ ID NO: 156691 - DNA, 891 bp, Artificial Sequence
  Description of Artificial Sequence: Synthetic coding sequence
atggaggtgatgaacctgatggagcagcccatcaaggtgacagagtggcagcagacctacacctatgacagcggcatccacagcggggccaacacctgtgtgcccagcgtgagcagcaagggcatcatggaggaggatgaggcctgtggccggcagtacaccctgaagaagaccaccacctacacccagggcgtgccccccagccagggcgacctggagtaccagatgagcaccacagcccgggccaagagggtgcgggaggccatgtgccctggggtgtctggagaggacagcagcctgctgctggccacccaggtggagggccaggccaccaacctgcagaggctggccgagcccagccagctgctgaagagcgccatcgtgcacctgatcaactaccaggatgatgctgagctggccacccgggccctgcctgagctgaccaagctgctgaatgatgaggaccctgtggtggtgaccaaggccgccatgattgtgaaccagctgagcaagaaggaggccagccggcgggccctgatgggcagcccccagctggtggccgctgtggtgaggaccatgcagaacaccagtgacctggacacagcccgctgcaccaccagcatcctgcacaacctgagccaccaccgggagggcctgctggccatcttcaagagcggcggcatcccagccctggtgaggatgctgagcagccctgtggagagcgtgctcttctacgccatcaccaccctgcacaacctgctgctgtaccaggagggcgccaagatggctgtgcggctggctgatggcctgcagaagatggtgcccctgctgaacaagaacaaccccaagttcctggccatcaccacagactgcctgcagctgctggcctag

SEQ ID NO: 156692 - DNA, 261 bp, Artificial Sequence
  Description of Artificial Sequence: Synthetic coding sequence
atggaggtgatgaacctgatggagcagcccatcaaggtgacagagtggcagcagacctacacctatgacagcggcatccacagcggggccaacacctgtgtgcccagcgtgagcagcaagggcatcatggaggaggatgaggcctgtggccggcagtacaccctgaagaagaccaccacctacacccagggcgtgccccccagccagggcgacctggagtaccagatgagcaccacagcccgggccaagagggtgaggtag

SEQ ID NO: 156693 - DNA, 897 bp, Artificial Sequence
  Description of Artificial Sequence: Synthetic coding sequence
atggaggtgatgaacctgatggagcagcccatcaaggtgacagagtggcagcagacctacacctatgacagcggcatccacagcggggccaacacctgtgtgcccagcgtgagcagcaagggcatcatggaggaggatgaggcctgtggccggcagtacaccctgaagaagaccaccacctacacccagggcgtgccccccagccagggcgacctggagtaccagatgagcaccacagcccgggccaagagggtgcgggaggccatgtgccctggggtgtctggagaggacagcagcctgctgctggccacccaggtggagggccaggccaccaacctgcagaggctggccgagcccagccagctgctgaagagcgccatcgtgcacctgatcaactaccaggatgatgctgagctggccacccgggccctgcctgagctgaccaagctgctgaatgatgaggaccctgtggtggtgaccaaggccgccatgattgtgaaccagctgagcaagaaggaggccagccggcgggccctgatgggcagcccccagctggtggccgctgtggtgaggaccatgcagaacaccagtgacctggacacagcccgctgcaccaccagcatcctgcacaacctgagccaccaccgggagggcctgctggccatcttcaagagcggcggcatcccagccctggtgaggatgctgagcagccctgtggagagcgtgctcttctacgccatcaccaccctgcacaacctgctgctgtaccaggagggcgccaagatggctgtgcggctggctgatggcctgcagaagatggtgcccctgctgaacaagaacaaccccaagttcctggccatcaccacagactgcctgcagctgctggcctatggatag

SEQ ID NO: 156694 - DNA, 1776 bp, Artificial Sequence
  Description of Artificial Sequence: Synthetic coding sequence
atggaggtgatgaacctgatggagcagcccatcaaggtgacagagtggcagcagacctacacctatgacagcggcatccacagcggggccaacacctgtgtgcccagcgtgagcagcaagggcatcatggaggaggatgaggcctgtggccggcagtacaccctgaagaagaccaccacctacacccagggcgtgccccccagccagggcgacctggagtaccagatgagcaccacagcccgggccaagagggtgcgggaggccatgtgccctggggtgtctggagaggacagcagcctgctgctggccacccaggtggagggccaggccaccaacctgcagaggctggccgagcccagccagctgctgaagagcgccatcgtgcacctgatcaactaccaggatgatgctgagctggccacccgggccctgcctgagctgaccaagctgctgaatgatgaggaccctgtggtggtgaccaaggccgccatgattgtgaaccagctgagcaagaaggaggccagccggcgggccctgatgggcagcccccagctggtggccgctgtggtgaggaccatgcagaacaccagtgacctggacacagcccgctgcaccaccagcatcctgcacaacctgagccaccaccgggagggcctgctggccatcttcaagagcggcggcatcccagccctggtgaggatgctgagcagccctgtggagagcgtgctcttctacgccatcaccaccctgcacaacctgctgctgtaccaggagggcgccaagatggctgtgcggctggctgatggcctgcagaagatggtgcccctgctgaacaagaacaaccccaagttcctggccatcaccacagactgcctgcagctgctggcctacggcaaccaggagagcaagatcctgacagccaccgtggacaatgccaacatcctgctgcagattgacaatgcccggctggccgcagatgacttccgcaccaagtttgaaacagagcaggccctgcggctgtctgtggaggccgacatcaatggcctgcggcgggtgctggatgagctgaccctggcccgggctgacctggagatgcagatcgagaacctgaaggaggagctggcctacctgaagaagaaccacgaggaggagatgaatgccctgcggggccaggtgggcggggagatcaacgtggagatggatgctgcccctggggtggacctgagccgcatcctgaatgagatgagggaccagtatgagaagatggccgagaagaacaggaaggatgctgaggactggttcttcagcaagacagaggagctgaaccgggaggtggccaccaacagcgagctggtgcagagcggcaagtctgagatcagcgagctgcggaggaccatgcaggccctggagattgagctgcagagccagctgtccatgaaggccagcctggagggcaacctggccgagacagaaaatcgctactgtgtgcagctgagccagatccagggcctgattggctctgtggaggagcagctggcccagctgcgctgtgagatggagcagcagaaccaggagtacaagatcctgctggatgtgaagacccggctggagcaggagatcgccacctaccgccgcctgctggagggggaggatgcccacctgacccagtacaagaaggagcctgtgaccacccggcaggtgaggaccatcgtggaggaggtgcaggacggcaaggtgatcagcagccgggagcaggtgcaccagaccaccaggtag

SEQ ID NO: 156695 - DNA, 897 bp, Artificial Sequence
  Description of Artificial Sequence: Synthetic coding sequence
atggcccggcgcagccgccaccggctgctgctgctgctgctgcgctacctggtggtggccctgggctaccacaaggcctacggcttcagcgcccccaaggaccagcaggtggtgacagctgtggagtaccaggaggccatcctggcctgcaagacccccaagaagacagtgagcagccggctggagtggaagaagctgggccgctctgtgtcctttgtgtactaccagcagaccctgcagggcgacttcaagaacagagctgagatgattgacttcaacatccgcatcaagaatgtgaccaggagtgatgctgggaagtaccgctgtgaggtgtctgcccccagcgagcagggccagaacctggaggaggacacagtgaccctggaggtgctggtggccccagctgtgcccagctgtgaggtgcccagcagcgccctgtctggaacagtggtggagctgcgctgccaggacaaggagggcaacccagcccctgagtacacctggttcaaggatggcatccggctgctggagaacccccggctgggcagccagagcaccaacagcagctacaccatgaacaccaagacaggcaccctgcagttcaacacagtgtccaagctggacacaggagagtacagctgtgaggccagaaattctgtgggctaccgccgctgccctgggaagaggatgcaggtggatgacctgaacatcagcggcatcatcgctgctgtggtggtggtggccctggtgatctctgtgtgtggcctgggcgtgtgctacgcccagaggaagggctacttcagcagcaagtacatgttcatgaagagcaacagcagcagcaaggccaccaccatgtctgaaaatgacttcaagcacaccaagagcttcatcatctag

SEQ ID NO: 156696 - DNA, 789 bp, Artificial Sequence
  Description of Artificial Sequence: Synthetic coding sequence
atggcccggcgcagccgccaccggctgctgctgctgctgctgcgctacctggtggtggccctgggctaccacaaggcctacggcttcagcgcccccaaggaccagcaggtggtgacagctgtggagtaccagggcgacttcaagaacagagctgagatgattgacttcaacatccgcatcaagaatgtgaccaggagtgatgctgggaagtaccgctgtgaggtgtctgcccccagcgagcagggccagaacctggaggaggacacagtgaccctggaggtgctggtggccccagctgtgcccagctgtgaggtgcccagcagcgccctgtctggaacagtggtggagctgcgctgccaggacaaggagggcaacccagcccctgagtacacctggttcaaggatggcatccggctgctggagaacccccggctgggcagccagagcaccaacagcagctacaccatgaacaccaagacaggcaccctgcagttcaacacagtgtccaagctggacacaggagagtacagctgtgaggccagaaattctgtgggctaccgccgctgccctgggaagaggatgcaggtggatgacctgaacatcagcggcatcatcgctgctgtggtggtggtggccctggtgatctctgtgtgtggcctgggcgtgtgctacgcccagaggaagggctacttcagcaaggagaccagcttccagaagagcaacagcagcagcaaggccaccaccatgtctgaaaatgacttcaagcacaccaagagcttcatcatctag

SEQ ID NO: 156697 - DNA, 897 bp, Artificial Sequence
  Description of Artificial Sequence: Synthetic coding sequence
atggcccggcgcagccgccaccggctgctgctgctgctgctgcgctacctggtggtggccctgggctaccacaaggcctacggcttcagcgcccccaaggaccagcaggtggtgacagctgtggagtaccaggaggccatcctggcctgcaagacccccaagaagacagtgagcagccggctggagtggaagaagctgggccgctctgtgtcctttgtgtactaccagcagaccctgcagggcgacttcaagaacagagctgagatgattgacttcaacatccgcatcaagaatgtgaccaggagtgatgctgggaagtaccgctgtgaggtgtctgcccccagcgagcagggccagaacctggaggaggacacagtgaccctggaggtgctggtggccccagctgtgcccagctgtgaggtgcccagcagcgccctgtctggaacagtggtggagctgcgctgccaggacaaggagggcaacccagcccctgagtacacctggttcaaggatggcatccggctgctggagaacccccggctgggcagccagagcaccaacagcagctacaccatgaacaccaagacaggcaccctgcagttcaacacagtgtccaagctggacacaggagagtacagctgtgaggccagaaattctgtgggctaccgccgctgccctgggaagaggatgcaggtggatgacctgaacatcagcggcatcatcgctgctgtggtggtggtggccctggtgatctctgtgtgtggcctgggcgtgtgctacgcccagaggaagggctacttcagcaaggagaccagcttccagaagagcaacagcagcagcaaggccaccaccatgtctgaaaatgacttcaagcacaccaagagcttcatcatctag

SEQ ID NO: 156698 - DNA, 939 bp, Artificial Sequence
  Description of Artificial Sequence: Synthetic coding sequence
atggcccggcgcagccgccaccggctgctgctgctgctgctgcgctacctggtggtggccctgggctaccacaaggcctacggcttcagcgcccccaaggaccagcaggtggtgacagctgtggagtaccaggaggccatcctggcctgcaagacccccaagaagacagtgagcagccggctggagtggaagaagctgggccgctctgtgtcctttgtgtactaccagcagaccctgcagggcgacttcaagaacagagctgagatgattgacttcaacatccgcatcaagaatgtgaccaggagtgatgctgggaagtaccgctgtgaggtgtctgcccccagcgagcagggccagaacctggaggaggacacagtgaccctggaggtgctggtggccccagctgtgcccagctgtgaggtgcccagcagcgccctgtctggaacagtggtggagctgcgctgccaggacaaggagggcaacccagcccctgagtacacctggttcaaggatggcatccggctgctggagaacccccggctgggcagccagagcaccaacagcagctacaccatgaacaccaagacaggcaccctgcagttcaacacagtgtccaagctggacacaggagagtacagctgtgaggccagaaattctgtgggctaccgccgctgccctgggaagaggatgcaggtggatgacctgaacatcagcggcatcatcgctgctgtggtggtggtggccctggtgatctctgtgtgtggcctgggcgtgtgctacgcccagaggaagggctacttcagcaaggagaccagcttccagaagagcaacagcagcagcaaggccaccaccatgtctgaaaatgtgcagtggctgacccctgtgatcccagccctgtggaaggctgctgctgggggcagccggggccaggagttctag

SEQ ID NO: 156699 - DNA, 933 bp, Artificial Sequence
  Description of Artificial Sequence: Synthetic coding sequence
atggccctgcggcggcccccccggctgcggctgtgtgcccggctgcctgacttcttcctgctgctgctcttccggggctgcctgattggagctgtgaacctgaagagcagcaacagaacacctgtggtgcaggagtttgagagcgtggagctgagctgcatcatcacagacagccagaccagtgaccccagaattgagtggaagaagatccaggatgagcagaccacctacgtgttctttgacaacaagatccagggcgacctggccggccgggcagagatcctgggcaagaccagcctgaagatctggaatgtgacccggcgggacagcgccctgtaccgctgtgaggtggtggccagaaatgacaggaaggagattgatgaaattgtgattgagctgactgtgcaggtgaagcctgtgacccctgtgtgccgggtgcccaaggctgtgcctgtgggcaagatggccaccctgcactgccaggagagcgagggccacccccggccccactacagctggtacagaaatgatgtgcccctgcccacagacagccgggccaacccccgcttcaggaacagcagcttccacctgaacagcgagaccggcaccctggtgttcaccgctgtgcacaaggatgacagcggccagtactactgcatcgccagcaatgatgctggcagcgcccgctgtgaggagcaggagatggaggtgtatgacctgaacatcggcggcatcatcggcggcgtgctggtggtgctggccgtgctggccctgatcaccctgggcatctgctgtgcctaccgccggggctacttcatcaacaacaagcaggatggagagagctacaagaaccctgggaagccagatggagtgaactacatcagaacagatgaggagggggacttccgccacaagagcagctttgtgatctag

SEQ ID NO: 156700 - DNA, 780 bp, Artificial Sequence
  Description of Artificial Sequence: Synthetic coding sequence
atggccctgcggcggcccccccggctgcggctgtgtgcccggctgcctgacttcttcctgctgctgctcttccggggctgcctgattggagctgtgaacctgaagagcagcaacagaacacctgtggtgcaggagtttgagagcgtggagctgagctgcatcatcacagacagccagaccagtgaccccagaattgagtggaagaagatccaggatgagcagaccacctacgtgttctttgacaacaagatccaggtgaagcctgtgacccctgtgtgccgggtgcccaaggctgtgcctgtgggcaagatggccaccctgcactgccaggagagcgagggccacccccggccccactacagctggtacagaaatgatgtgcccctgcccacagacagccgggccaacccccgcttcaggaacagcagcttccacctgaacagcgagaccggcaccctggtgttcaccgctgtgcacaaggatgattctggccagtactactgcatcgccagcaatgatgctggcagcgcccgctgtgaggagcaggagatggaggtgtatgacctgaacattggaggcatcattggaggagtgctggtggtgctggccgtgctggccctgatcaccctgggcatctgctgtgcctacagaagaggctacttcatcaacaacaagcaggatggagagagctacaagaaccctgggaagccagatggagtgaactacatcagaacagatgaggagggggacttccgccacaagagcagctttgtgatctag

SEQ ID NO: 156701 - DNA, 1068 bp, Artificial Sequence
  Description of Artificial Sequence: Synthetic coding sequence
atggtgcctgcccggctgggccctgctgtggccatggtgactggagctggccggcgggtgctggccggctgggcccacgcccggggggactacaagccccggcgggctgctgctggccccagcgccaccctggacatggccctgcggcggcccccccggctgcggctgtgtgcccggctgcctgacttcttcctgctgctgctcttccggggctgcctgattggagctgtgaacctgaagagcagcaacagaacacctgtggtgcaggagtttgaatctgtggagctgagctgcatcatcacagacagccagaccagtgacccccgcatcgagtggaagaagatccaggatgagcagaccacctacgtgttctttgacaacaagatccagggcgacctggccggccgggcagagatcctgggcaagaccagcctgaagatctggaatgtgacccggcgggacagcgccctgtaccgctgtgaggtggtggccagaaatgacaggaaggagattgatgagatcgtcatcgagctgactgtgcaggtgaagcctgtgacccctgtgtgccgggtgcccaaggctgtgcctgtgggcaagatggccaccctgcactgccaggagagcgagggccacccccggccccactacagctggtacagaaatgatgtgcccctgcccacagacagccgggccaacccccgcttcaggaacagcagcttccacctgaacagcgagaccggcaccctggtgttcaccgctgtgcacaaggatgattctggccagtactactgcatcgccagcaatgatgctggcagcgcccgctgtgaggagcaggagatggaggtgtatgacctgaacattggaggcatcattggaggagtgctggtggtgctggccgtgctggccctgatcaccctgggcatctgctgtgcctacagaagaggctacttcatcaacaacaagcaggatggagagagctacaagaaccctgggaagccagatggagtgaactacatcagaacagatgaggagggggacttccgccacaagagcagctttgtgatctag

SEQ ID NO: 156702 - DNA, 1986 bp, Artificial Sequence
  Description of Artificial Sequence: Synthetic coding sequence
atgactggaggccgctttgattttgatgatggcggcacctactgcggcggctgggaggagggcaaggcccacggccacggcatctgcaccggccccaagggccagggcgagtacagcggctcctggagccacggctttgaggtggtgggcggctacacctggcccagcggcaacacctaccagggctactgggcccagggcaagagacatggcctgggcgtggagaccaagggcaagtggatgtacagaggagagtggagccacggcttcaagggccgctatggagtgcggcagagcctgtgcaccccagcccgctatgagggcacctggagcaatggcctgcaggacggctacggcgtggagacctatggagatggcggcacctaccagggccagtgggccggcggcatgagacatggctatggagtgcggcagagcgtgccctacggcatggccaccgtcatccgcagccccctgcggaccagcctggccagcctgcggtctgagcagagcaatggatctgtgctgcatgatgctgctgctgctgctgacagccctgctggcacccggggcggctttgtgctgaacttccacgcagatgctgagctggccggcaagaagaagggcggcctcttcagaagaggcagcctgctgggctccatgaagctgaggaagtctgagagcaagagcagcatcagcagcaagaggagctctgtgcggagtgatgctgccatgagccgcatcagcagcagtgatgccaacagcaccatcagctttggagatgtggactgtgacttctgccctgtggaggaccacgtggatgccaccaccacagagacctacatgggagagtggaagaatgacaagagaaatggatttggagtgtctgagaggagcaatggcatgaagtatgaaggagagtgggccaacaacaagagacatggctacggctgcaccgtcttcccagatggcagcaaggaggagggcaagtacaagaacaacatcctggtgcggggcatcaggaagcagctgatccccatccgccacaccaagacccgggagaaggtggaccgggccatcgagggcgcccagagagctgctgccatggcccggaccaaggtggagatcgccaacagcaggacagcccacgcccgggccaaggcagatgctgctgaccaggccgccctggccgcccggcaggagtgtgacatcgcccgggctgtggcccgggagctgagcccagacttctaccagcccggccctgactatgtgaagcagcgcttccaggagggcgtggatgccaaggagaaccctgaggagaaggtgcctgagaagccacccacccccaaggagagcccccacttctacaggaagggcaccaccccacccaggagccctgaggccagccccaagcacagccacagccctgccagcagccccaagcccctgaagaagcagaaccccagcagcggggcccggctgaaccaggacaagaggtctgtggctgatgagcaggtgacagccatcgtgaacaagcccctgatgagcaaggcccccaccaaggaggccggggctgtggtgccccagagcaagtacagcggccgccaccacatccccaaccccagcaatggagagctgcacagccagtaccacggctactacgtgaagctgaatgccccccagcacccccctgtggatgtggaggatggagatggcagcagccagagcagcagcgccctggtgcacaagcccagcgccaacaagtggagccccagcaagtctgtgaccaagcctgtggccaaggagagcaaggccgagcccaaggccaagaagtctgagctggccatccccaagaacccagccagcaatgacagctgcccagccctggagaaggaggccaacagcggccccaacagcatcatgattgtgctggtgatgctgctgaacatcggcctggccatcctgtttgtgcacttcctgacctag

SEQ ID NO: 156703 - DNA, 390 bp, Artificial Sequence
  Description of Artificial Sequence: Synthetic coding sequence
atgtctgggggccgctttgattttgatgatggaggagcctactgcggcggctgggagggcggcaaggcccacggccacggcctgtgcaccggccccaagggccagggcgagtacagcggctcctggaactttggatttgaggtggccggcgtgtacacctggcccagcggcaacacctttgagggctactggagccagggcaagagacatggcctgggcatcgagaccaagggccgctggctgtacaagggggagtggacccacggcttcaagggccgctatggcatccggcagagcagcagcagcggggccaagtatgagggcacctggaacaacggcctgcaggacggctacggcacagagacctatgcagatggcggcatgtgctag

SEQ ID NO: 156704 - DNA, 2091 bp, Artificial Sequence
  Description of Artificial Sequence: Synthetic coding sequence
atgtctgggggccgctttgattttgatgatggaggagcctactgcggcggctgggagggcggcaaggcccacggccacggcctgtgcaccggccccaagggccagggcgagtacagcggctcctggaactttggatttgaggtggccggcgtgtacacctggcccagcggcaacacctttgagggctactggagccagggcaagagacatggcctgggcatcgagaccaagggccgctggctgtacaagggggagtggacccacggcttcaagggccgctatggcatccggcagagcagcagcagcggggccaagtatgagggcacctggaacaacggcctgcaggacggctacggcacagagacctatgcagatggcggcacctaccagggccagttcaccaacggcatgagacatggctatggagtgcggcagagcgtgccctacggcatggctgtggtggtgcgcagccccctgcggaccagcctgagcagcctgcggtctgagcacagcaatggcaccgtggccccagacagccctgccagccctgccagtgatggccctgccctgcccagccctgccatcccccggggcggctttgccctgagcctgctggccaatgctgaggccgccgcccgggcccccaagggcggcggcctcttccagagaggagccctgctgggcaagctgcggcgggcagagagcaggacctctgtgggcagccagaggagccgggtgtccttcctgaagagtgacctgagcagcggggccagtgatgctgccagcacagccagcctgggggaggccgctgagggcgcagatgaggccgccccctttgaagctgacattgatgccaccaccacagagacctacatgggagagtggaagaatgacaagaggagcggctttggagtgtctgagaggagcagcggcctgcgctatgaaggagagtggctggacaacctgcggcacggctacggctgcaccaccctgcctgatggccaccgggaggagggcaagtaccgccacaacgtgctggtgaaggacaccaagaggaggatgctgcagctgaagagcaacaaggtgcggcagaaggtggagcacagcgtggagggcgcccagagagctgctgccatcgcccggcagaaggccgagattgctgccagcaggaccagccacgccaaggccaaggccgaggccgctgagcaggccgccctggccgccaaccaggagagcaacatcgcccggaccctggcccgggagctggccccagacttctaccagcccggccctgagtaccagaagaggcggctgctgcaggagatcctggagaacagcgagagcctgctggagcccccagacagaggagctggagctgctggcctgccccagcccccccgggagagcccccagctgcacgagcgggagacccccaggcctgagggcggcagccccagccctgctggcaccccaccccagcccaagaggcccaggcctggggtgtccaaggatggcctgctgagccctggggcctggaatggagagcccagcggggagggcagccgctctgtgaccccatctgagggcgccggccgccgcagccctgcccggcctgccacagagaggatggccatcgaggccctgcaggcccccccagcccccagccgggagcctgaggtggccctgtaccagggctaccacagctatgctgtgaggaccaccccacctgagcccccaccatttgaggaccagcctgagcctgaggtgtctggcagcgagagcgcccccagcagccctgccacagcccccctgcaggcccccaccctgcggggccctgagcccgcccgggagaccccagccaagctggagcccaagcccatcatccccaaggccgagccccgggccaaggccaggaagacagaggcccggggcctgaccaaggccggggccaagaagaaggccaggaaggaggccgccctggccgctgaggccgaggtggaggtggaggaggtgcccaacaccatcctgatctgcatggtgatcctgctgaacatcggcctggccatcctgtttgtgcacctgctgacctag

SEQ ID NO: 156705 - DNA, 2247 bp, Artificial Sequence
  Description of Artificial Sequence: Synthetic coding sequence
atgagcagcggcggccgcttcaactttgatgatggcggcagctactgcggcggctgggaggatggcaaggcccacggccatggagtgtgcaccggccccaagggccagggcgagtacacaggctcctggagccacggctttgaggtgctgggcgtgtacacctggcccagcggcaacacctaccagggcacctgggcccagggcaagagacatggaattggcctggagagcaagggcaagtgggtgtacaagggggagtggacccacggcttcaagggccgctatggagtgagagaatgtgctggaaatggagccaagtatgagggcacctggagcaatggcctgcaggacggctatggaacagagacctacagtgatggcggcacctaccagggccagtgggtgggcggcatgaggcagggctacggcgtgcggcagagcgtgccctacggcatggccgccgtcatccgcagccccctgcggaccagcatcaacagcctgcggtctgagcacaccaatggaacagccctgcacccagatgccagccctgctgtggccggcagccctgctgtgtcccggggcggctttgtgctggtggcccacagcgacagcgagatcctgaagagcaagaagaagggcctcttccgccgcagcctgctgagcggcctgaagctgaggaagtctgagagcaagagcagcctggccagccagaggagcaagcagagcagcttccgctctgaggccggcatgagcacagtgagcagcacagccagtgacatccacagcaccatcagcctgggggaggccgaggccgagctggccgtgattgaagatgacattgatgccaccaccacagagacctacgtgggggagtggaagaatgacaagaggagcggcttcggcgtgtcccagaggagtgatggcctgaagtatgaaggagagtgggccagcaacagaagacatggctacggctgcatgaccttcccagatggcaccaaggaggagggcaagtacaagcagaacatcctggtgggcggcaagaggaagaacctgatccccctgcgggccagcaagatccgggagaaggtggacagagctgtggaggccgctgagagagctgccaccatcgccaagcagaaggccgagattgctgccagcaggaccagccacagccgggccaaggccgaggccgccctgacagctgcccagaaggcccaggaggaggccagaattgcccgcatcacagccaaggagttcagccccagcttccagcacagagaaaatggcctggagtaccagaggcccaagaggcagaccagctgtgatgacatcgaggtgctgagcacaggcacccccctgcagcaggagagccctgagctgtacaggaagggcaccacccccagcgacctgaccccagatgacagccccctgcagagcttccccaccagccctgctgccaccccacctccagccccagctgccaggaacaaggtggcccacttcagccggcaggtgtctgtggatgaggagcggggcggggacatccagatgctgctggagggccgggccggggactgtgcccggagctcctggggcgaggagcaggccggcggcagcagaggagtgcgcagcggggccctgcggggcggcctgctggtggatgacttccgcacccggggcagcggcaggaagcagcccggcaaccccaagccccgggagaggagaacagagagcccccctgtgttcacctggaccagccaccaccgggccagcaaccacagccctgggggcagccggctgctggagctgcaggaggagaagctgagcaactacaggatggagatgaagcccctgctgaggatggagacccacccccagaagaggcgctacagcaagggcggggcctgccggggcctgggagatgaccacaggcctgaggaccggggcttcggcgtgcagaggctgcggagcaaggcccagaacaaggagaacttccggcctgccagcagcgctgagcctgctgtgcagaagctggccagcctgcggctgggcggcgctgagccccggctgctgcgctgggacctgaccttcagccccccccagaagagcctgcctgtggccctggagagtgatgaagaaaatggagatgagctgaagagcagcacaggcagcgcccccatcctggtggtgatggtgatcctgctgaacattggagtggccatcctcttcatcaacttcttcatctag

SEQ ID NO: 156706 - DNA, 561 bp, Artificial Sequence
  Description of Artificial Sequence: Synthetic coding sequence
atgagcagcggcggccgcttcaactttgatgatggcggcagctactgcggcggctgggaggatggcaaggcccacggccatggagtgtgcaccggccccaagggccagggcgagtacacaggctcctggagccacggctttgaggtgctgggcgtgtacacctggcccagcggcaacacctaccagggcacctgggcccagggcaagagacatggaattggcctggagagcaagggcaagtgggtgtacaagggggagtggacccacggcttcaagggccgctatggagtgagagaatgtgctggaaatggagccaagtatgagggcacctggagcaatggcctgcaggacggctatggaacagagacctacagtgatggagatgccacagccttcggggctgagcccggccctgaggcccgggagctgcctgctgctgctgctgctgctgctgctgctgctgctgctgctgtgcgctggttcctgtgccgggagccctggccagccctgcagctgcctgcctgcctggacagccccatcagcaccccccagtgcacctag

SEQ ID NO: 156707 - DNA, 96 bp, Artificial Sequence
  Description of Artificial Sequence: Synthetic coding sequence
atgccaccccacagcggccagagccggggcaggaagccaggcagctgcctgctgctgctgctgctgctgctgctgctgctgctgctgctgctgtag

SEQ ID NO: 156708 - DNA, 1836 bp, Artificial Sequence
  Description of Artificial Sequence: Synthetic coding sequence
atgaggcagggctatggagtgcggcagagcgtgccctacggcatggctgctgtgatccgcagccccctgcggaccagcatcaacagcctgcggtctgagcacaccaacggcacagccctgcacccagatgccagccctgctgtggccggcagccctgctgtgtccagaggaggctttgtgctggtggcccacagcgacagcgagatcctgaagagcaagaagaagggcctcttcagaagaagcctgctgagcggcctgaagctgaggaagtctgagagcaagagcagcctggccagccagaggagcaagcagagcagcttccgctctgaggccggcatgagcacagtgagcagcacagccagtgacatccacagcaccatcagcctgggggaggccgaggccgagctggccgtgattgaagatgacattgatgccaccaccacagagacctacgtgggggagtggaagaatgacaagaggagcggctttggagtgtcccagaggagtgatggcctgaagtatgaaggagagtgggccagcaacagaagacatggctacggctgcatgaccttcccagatggcaccaaggaggagggcaagtacaagcagaacatcctggtgggcggcaagaggaagaacctgatccccctgcgggccagcaagatccgggagaaggtggacagagctgtggaggccgctgagcgggccgccaccatcgccaagcagaaggccgagattgctgccagcaggaccagccacagccgggccaaggccgaggccgccctgacagctgcccagaaggcccaggaggaggcccgcatcgcccgcatcacagccaaggagttcagccccagcttccagcaccgggagaatggcctggagtaccagaggcccaagaggcagaccagctgtgatgacatcgaggtgctgagcacaggcacccccctgcagcaggagagccctgagctgtacaggaagggcaccacccccagcgacctgaccccagatgacagccccctgcagagcttccccaccagccctgctgccaccccacctccagccccagctgccaggaacaaggtggcccacttcagccggcaggtgtctgtggatgaggagcggggcggggacatccagatgctgctggagggccgggccggggactgtgcccggagctcctggggcgaggagcaggccggcggcagccggggcgtgcgcagcggggccctgcggggcggcctgctggtggatgacttccgcacccggggcagcggcaggaagcagcccggcaaccccaagccccgggagaggagaacagagagcccccctgtgttcacctggaccagccaccaccgggccagcaaccacagccctgggggcagccggctgctggagctgcaggaggagaagctgagcaactacaggatggagatgaagcccctgctgaggatggagacccacccccagaagaggcgctacagcaaaggaggagcctgccggggcctgggagatgaccacaggccagaagatcggggctttggagtgcagaggctgcggagcaaggcccagaacaaggagaacttccggcctgccagcagcgctgagcctgctgtgcagaagctggccagcctgcggctgggcggcgctgagccccggctgctgcgctgggacctgaccttcagccccccccagaagagcctgcctgtggccctggagagtgatgaggagaatggagatgagctgaagagcagcactggaagtgcccccatcctggtggtgatggtgatcctgctgaacatcggcgtggccatcctcttcatcaacttcttcatctag

SEQ ID NO: 156709 - DNA, 1347 bp, Artificial Sequence
  Description of Artificial Sequence: Synthetic coding sequence
atgaccagcagctgctgcgtgaccaacaacctgcaggccagcctgaagagctgccccaggcctgcctctgtgtgcagcagtggagtgaactgcaggcctgagctgtgcctgggctacgtgtgccagcccatggcctgcctgcccagcgtgtgcctgcccaccaccttccggcctgccagctgcctgagcaagacctacctgagcagcagctgccaggccgccagcggcatcagcggctccatgggccctggctcctggtacagcgagggcgccttcaatggaaatgagaaggagaccatgcagttcctgaatgaccggctggccagctacctgaccagggtgcggcagctggagcaggagaatgctgagctggagagccgcatccaggaggccagccacagccaggtgctgaccatgaccccagactaccagagccacttccgcaccatcgaggagctgcagcagaagatcctgtgcaccaaggcagaaaatgccaggatggtggtgaacatcgacaatgccaagctggccgcagatgacttccgggccaagtatgaagctgagctggccatgaggcagctggtggaggccgacatcaatggcctgcggcgcatcctggatgacctgaccctgtgcaaggctgacctggaggcccaggtggagagcctgaaggaggagctgatgtgcctgaagaagaaccacgaggaggaggtgggcagcctgcgctgccagctgggggaccggctgaacatcgaggtggatgctgcccctcctgtggacctgaccagggtgctggaggagatgcgctgccagtatgaggccatggtggaggccaacagaagagatgtggaggagtggttcaacatgcagatggaggagctgaaccagcaggtggccaccagcagcgagcagctgcagaactaccagagcgacatcatcgacctgcggaggacagtgaacaccctggagattgagctgcaggcccagcacagcctgcgggacagcctggagaacaccctgacagaaagtgaggcccgctacagcagccagctggcccagatgcagtgcatgatcaccaacgtggaggcccagctggccgagatccgggctgacctggagcggcagaaccaggagtaccaggtgctgctggatgtgcgggcccggctggagggggagatcaacacctaccgcagcctgctggagaatgaagactgcaagctgccctgcaacccctgcagcacccccagctgcaccacctgtgtgcccagcccctgtgtgcccaggacagtgtgtgtgcccaggacagtgggcatgccctgcagcccctgcccccagggccgctactag

SEQ ID NO: 156710 - DNA, 1641 bp, Artificial Sequence
  Description of Artificial Sequence: Synthetic coding sequence
atggccgaggtggtgtcccctgtgcctggagctggaagaagagagcccggggaggtgggccgggcccggggcccccctgtggccgaccccggggtggccctgagcccccagggcgagatcatcgagggctgccgcctgcctgtgctgcggaggaaccaggacaatgaagatgagtggcccctggccgagatcctgtctgtgaaggacatcagcggcaggaagctgttctacgtgcactacatcgacttcaacaagaggctggatgagtgggtgacccatgagcggctggacctgaagaagatccagttccccaagaaggaggccaagacccccaccaagaatggcctgcccggcagcaggcctggcagccctgagcgggaggtgcctgccagcgcccaggccagcggcaagaccctgcccatccctgtgcagatcaccctgcgcttcaacctgcccaaggagcgggaggccatccctggaggagagccagaccagcccctgagcagcagcagctgcctgcagcccaaccacaggagcaccaagaggaaggtggaggtggtgtccccagccacccctgtgcccagcgagacagccccagcctctgtgttcccccagaatggagctgcccggcgggctgtggccgcccagcccggcaggaagaggaagagcaactgcctgggcacagatgaggacagccaggacagcagtgatggcatccccagcgcccccaggatgacaggcagcctggtgtctgacaggagccatgatgacatcgtgaccaggatgaagaacatcgagtgcatcgagctgggccgccaccggctgaagccctggtacttcagcccctacccccaggagctgaccaccctgcctgtgctgtacctgtgtgagttctgcctgaagtatggccgcagcctgaagtgcctgcagaggcacctgaccaagtgtgacctgcggcaccccccaggaaatgagatctacaggaagggcaccatctccttctttgaaattgatggcaggaagaacaagagctacagccagaacctgtgcctgctggccaagtgcttcctggaccacaagaccctgtactatgacacagaccccttcctgttctacgtgatgacagaatatgactgcaagggcttccacatcgtgggctacttcagcaaggagaaggagagcacagaggactacaacgtggcctgcatcctgaccctgcccccctaccagaggcggggctacggcaagctgctgattgagttctcctatgagctgagcaaggtggagggcaagacaggcaccccagagaagcccctgagtgacctgggcctgctgagctaccgcagctactggagccagaccatcctggagatcctgatgggcctgaagtctgagagcggggagcggccccagatcaccatcaatgagatcagcgagatcaccagcatcaagaaggaggatgtgatcagcaccctgcagtacctgaacctgatcaactactacaagggccagtacatcctgaccctgtctgaagatattgtggatggccacgagcgggccatgctgaagaggctgctgagaattgacagcaagtgcctgcacttcacccccaaggactggagcaagaggggcaagtggtag

SEQ ID NO: 156711 - DNA, 1386 bp, Artificial Sequence
  Description of Artificial Sequence: Synthetic coding sequence
atggccgaggtgggggagatcatcgagggctgccgcctgcctgtgctgcggaggaaccaggacaatgaagatgagtggcccctggccgagatcctgtctgtgaaggacatcagcggcaggaagctgttctacgtgcactacatcgacttcaacaagaggctggatgagtgggtgacccatgagcggctggacctgaagaagatccagttccccaagaaggaggccaagacccccaccaagaatggcctgcccggcagccggcccggcagccctgagcgggaggtgaagaggaaggtggaggtggtgtccccagccacccctgtgcccagcgagacagccccagccagcgtcttcccccagaatggagctgccaggagagctgtggccgcccagcccggcaggaagaggaagagcaactgcctgggcacagatgaggacagccaggacagcagtgatggcatccccagcgcccccaggatgacaggcagcctggtgtctgacaggagccatgatgacatcgtgaccaggatgaagaacattgaatgtattgagctgggccgccaccggctgaagccctggtacttcagcccctacccccaggagctgaccaccctgcctgtgctgtacctgtgtgagttctgcctgaagtatggccgcagcctgaagtgcctgcagaggcacctgaccaagtgtgacctgcggcaccccccaggaaatgagatctacaggaagggcaccatctccttctttgaaattgatggcaggaagaacaagagctacagccagaacctgtgcctgctggccaagtgcttcctggaccacaagaccctgtactatgacacagaccccttcctgttctacgtgatgacagaatatgactgcaagggcttccacatcgtgggctacttcagcaaggagaaggagagcacagaggactacaacgtggcctgcatcctgaccctgcccccctaccagaggcggggctacggcaagctgctgattgagttctcctatgagctgagcaaggtggagggcaagacaggcaccccagagaagcccctgagtgacctgggcctgctgagctaccgcagctactggagccagaccatcctggagatcctgatgggcctgaagtctgagagcggggagcggccccagatcaccatcaatgagatcagcgagatcaccagcatcaagaaggaggatgtgatcagcaccctgcagtacctgaacctgatcaactactacaagggccagtacatcctgaccctgtctgaggacatcgtggatggccacgagcgggccatgctgaagaggctgctgagaattgacagcaagtgcctgcacttcacccccaaggactggagcaagaggggcaagtggtag

SEQ ID NO: 156712 - DNA, 1542 bp, Artificial Sequence
  Description of Artificial Sequence: Synthetic coding sequence
atggccgaggtgggggagatcatcgagggctgccgcctgcctgtgctgcggaggaaccaggacaatgaagatgagtggcccctggccgagatcctgtctgtgaaggacatcagcggcaggaagctgttctacgtgcactacatcgacttcaacaagaggctggatgagtgggtgacccatgagcggctggacctgaagaagatccagttccccaagaaggaggccaagacccccaccaagaatggcctgcccggcagccggcccggcagccctgagcgggaggtgcctgccagcgcccaggccagcggcaagaccctgcccatccctgtgcagatcaccctgcgcttcaacctgcccaaggagcgggaggccatccctggaggagagccagaccagcccctgagcagcagcagctgcctgcagcccaaccacaggagcaccaagaggaaggtggaggtggtgtccccagccacccctgtgcccagcgagacagccccagccagcgtcttcccccagaatggagctgccaggagagctgtggccgcccagcccggcaggaagaggaagagcaactgcctgggcacagatgaggacagccaggacagcagtgatggcatccccagcgcccccaggatgacaggcagcctggtgtctgacaggagccatgatgacatcgtgaccaggatgaagaacattgaatgtattgagctgggccgccaccggctgaagccctggtacttcagcccctacccccaggagctgaccaccctgcctgtgctgtacctgtgtgagttctgcctgaagtatggccgcagcctgaagtgcctgcagaggcacctgaccaagtgtgacctgcggcaccccccaggaaatgagatctacaggaagggcaccatctccttctttgaaattgatggcaggaagaacaagagctacagccagaacctgtgcctgctggccaagtgcttcctggaccacaagaccctgtactatgacacagaccccttcctgttctacgtgatgacagaatatgactgcaagggcttccacatcgtgggctacttcagcaaggagaaggagagcacagaggactacaacgtggcctgcatcctgaccctgcccccctaccagaggcggggctacggcaagctgctgattgagttctcctatgagctgagcaaggtggagggcaagacaggcaccccagagaagcccctgagtgacctgggcctgctgagctaccgcagctactggagccagaccatcctggagatcctgatgggcctgaagtctgagagcggggagcggccccagatcaccatcaatgagatcagcgagatcaccagcatcaagaaggaggatgtgatcagcaccctgcagtacctgaacctgatcaactactacaagggccagtacatcctgaccctgtctgaggacatcgtggatggccacgagcgggccatgctgaagaggctgctgagaattgacagcaagtgcctgcacttcacccccaaggactggagcaagaggggcaagtggtag

SEQ ID NO: 156713 - DNA, 1485 bp, Artificial Sequence
  Description of Artificial Sequence: Synthetic coding sequence
atggccgaggtggtgtcccctgtgcctggagctggaagaagagagcccggggaggtgggccgggcccggggcccccctgtggccgaccccggggtggccctgagcccccagggcgagatcatcgagggctgccgcctgcctgtgctgcggaggaaccaggacaatgaagatgagtggcccctggccgagatcctgtctgtgaaggacatcagcggcaggaagctgttctacgtgcactacatcgacttcaacaagaggctggatgagtgggtgacccatgagcggctggacctgaagaagatccagttccccaagaaggaggccaagacccccaccaagaatggcctgcccggcagcaggcctggcagccctgagcgggaggtgaagaggaaggtggaggtggtgtccccagccacccctgtgcccagcgagacagccccagcctctgtgttcccccagaatggagctgcccggcgggctgtggccgcccagcccggcaggaagaggaagagcaactgcctgggcacagatgaggacagccaggacagcagtgatggcatccccagcgcccccaggatgacaggcagcctggtgtctgacaggagccatgatgacatcgtgaccaggatgaagaacatcgagtgcatcgagctgggccgccaccggctgaagccctggtacttcagcccctacccccaggagctgaccaccctgcctgtgctgtacctgtgtgagttctgcctgaagtatggccgcagcctgaagtgcctgcagaggcacctgaccaagtgtgacctgcggcaccccccaggaaatgagatctacaggaagggcaccatctccttctttgaaattgatggcaggaagaacaagagctacagccagaacctgtgcctgctggccaagtgcttcctggaccacaagaccctgtactatgacacagaccccttcctgttctacgtgatgacagaatatgactgcaagggcttccacatcgtgggctacttcagcaaggagaaggagagcacagaggactacaacgtggcctgcatcctgaccctgcccccctaccagaggcggggctacggcaagctgctgattgagttctcctatgagctgagcaaggtggagggcaagacaggcaccccagagaagcccctgagtgacctgggcctgctgagctaccgcagctactggagccagaccatcctggagatcctgatgggcctgaagtctgagagcggggagcggccccagatcaccatcaatgagatcagcgagatcaccagcatcaagaaggaggatgtgatcagcaccctgcagtacctgaacctgatcaactactacaagggccagtacatcctgaccctgtctgaagatattgtggatggccacgagcgggccatgctgaagaggctgctgagaattgacagcaagtgcctgcacttcacccccaaggactggagcaagaggggcaagtggtag

SEQ ID NO: 156714 - DNA, 6222 bp, Artificial Sequence
  Description of Artificial Sequence: Synthetic coding sequence
atggtgaagctggccaaccccctgtacacagagtggatcctggaggccatccagaagatcaagaagcagaagcagaggcccagcgaggagcgcatctgccacgctgtgtccaccagccacggcctggacaagaagacagtgtctgagcagctggagctgtctgtgcaggacggctctgtgctgaaggtgaccaacaagggcctggccagctacaaggaccctgacaaccctggccgcttcagctctgtgaagccaggcaccttccccaagagcgccaagggcagccggggcagctgcaatgacctgagaaatgtggactggaacaagctgctgcggcgggccatcgagggcctggaggagcccaacggcagcagcctgaagaacatcgagaagtacctgcggagccagagcgacctgaccagcaccaccaacaacccagccttccagcagaggctgcggctgggcgccaagagagctgtgaacaacggccgcctgctgaaggatggcccccagtacagagtgaactacggcagcctggatggcaagggggccccccagtaccccagcgccttccccagcagcctgccccctgtgtccctgctgccccatgagaaggaccagcccagggctgaccccatccccatctgcagcttctgcctgggcaccaaggagagcaaccgggagaagaagccagaggagctgctgagctgtgccgactgtggcagcagcggccaccccagctgcctgaagttctgcccagagctgaccaccaacgtgaaggccctgcgctggcagtgcatcgagtgcaagacctgcagcgcctgccgggtgcagggcagaaatgctgacaacatgctgttctgtgacagctgtgaccggggcttccacatggagtgctgtgacccccccctgagcaggatgcccaagggcatgtggatctgccaggtgtgccggcccaagaagaagggcaggaagctgctgcacgagaaggccgcccagatcaagagaagatatgccaagcccatcggccggcccaagaacaagctgaagcagaggctgctgtctgtgaccagtgatgagggctccatgaatgccttcaccggccggggcagccctggccggggccagaagaccaaggtgtgcaccacccccagcagcggccatgctgccagcggcaaggacagcagcagccggctggccgtgacagaccccaccaggcctggggccaccaccaagatcaccaccaccagcacctacatcagcgccagcaccctgaaggtgaacaagaagaccaagggcctgattgatggcctgaccaagttcttcacccccagcccagatggaagaagaagcagaggagagatcatcgacttcagcaagcactaccggcccaggaagaaggtgtcccagaagcagagctgcaccagccacgtgctggccaccggcaccacccagaagctgaagcccccacccagcagcctgcccccacccacccccatcagcggccagagccccagcagccagaagagcagcacagccaccagcagccccagcccccagagcagcagcagccagtgcagcgtgcccagcctgagcagcctgaccaccaacagccagctgaaggccctgtttgatggcctgagccacatctacaccacccagggccagagcaggaagaagggccaccccagctatgccccacccaagaggatgaggaggaagacagagctgagcagcacagccaagagcaaggcccacttcttcggcaagagggacatccgcagccgcttcatcagccacagcagcagcagctcctggggcatggcccggggcagcatcttcaaggccatcgcccacttcaagaggaccaccttcctgaagaagcacaggatgctgggccgcctgaagtacaaggtgaccccccagatgggcacccccagccctgggaagggcagcctgacagatggccgcatcaagccagaccaggatgatgacacagagatcaagatcaacatcaagcaggagagcgcagatgtgaatgtcatcggcaacaaggatgtggtgacagaggaggacctggatgtgttcaagcaggcccaggagctgtcctgggagaagattgaatgtgagagcggcgtggaggactgtggccgctaccccagcgtgattgaatttgggaagtatgagatccagacctggtacagcagcccctacccccaggagtatgcccggctgcccaagctgtacctgtgtgagttctgcctgaagtacatgaagagcaagaacatcctgctgcggcacagcaagaagtgtggctggttccaccccccagccaatgagatctacagaaggaaggacctgtctgtgtttgaggtggatggcaacatgagcaagatctactgccagaacctgtgcctgctggccaagctgttcctggaccacaagaccctgtactatgatgtggagcccttcctgttctacgtgctgaccaagaatgatgagaagggctgccacctggtgggctacttcagcaaggagaagctgtgccagcagaagtacaacgtgtcctgcatcatgatcatgccccagcaccagaggcagggcttcggccgcttcctgattgacttctcctacctgctgagccggcgggagggccaggccggcagccctgagaagcccctgagtgacctgggccgcctgagctacctggcctactggaagagcgtcatcctggagtacctgtaccaccaccacgagcggcacatcagcatcaaggccatcagccgggccaccggcatgtgcccccatgacatcgccaccaccctgcagcacctgcacatgattgacaagagagatggccgctttgtgatcatcagaagagagaagctgatcctgagccacatggagaagctgaagacctgcagccgggccaatgagctggaccctgacagcctgcgctggacccccatcctgatcagcaatgctgctgtgtctgaggaggagcgggaggccgagaaggaggccgagcggctgatggagcaggccagctgctgggagaaggaggagcaggagatcctgagcacccgggccaacagccggcagagccctgccaaggtgcagagcaagaacaagtacctgcacagccctgagagcaggcctgtgactggagagcggggccagctgctggagctgagcaaggagagcagcgaggaggaggaggaggaggaggatgaggaggaggaggaggaggaggaggaggaggaggaggatgaggaggaggaggaggaggaggaggaggaggaggaggaggagaacatccagagcagccccccccggctgaccaagccccagagcgtggccatcaagaggaagaggccctttgtgctgaagaagaagaggggcaggaagagaagacgcatcaacagctctgtgaccacagagaccatcagcgagaccacagaggtgctgaatgagccctttgacaacagtgatgaggagcggcccatgccccagctggagcccacctgtgaaattgaggtggaggaggatggcaggaagcctgtgctgaggaaggccttccagcaccagcccgggaagaagaggcagacagaggaggaggagggcaaggacaaccactgcttcaagaatgctgacccctgcaggaacaacatgaatgatgacagcagcaacctgaaggagggcagcaaggacaaccctgagcccctgaagtgcaagcaggtgtggcccaagggcaccaagaggggcctgagcaagtggaggcagaacaaggagaggaagacaggcttcaagctgaacctgtacaccccacctgagacccccatggagccagatgagcaggtgacagtggaggagcagaaggagaccagcgagggcaagaccagccccagccccatcagaattgaggaggaggtgaaggagaccggggaggccctgctgccccaggaggagaacagaagagaggagacctgtgcccctgtgagccccaacaccagccctggagagaagccagaagatgacctgatcaagccagaggaggaggaggaggaggaggaggaggaggaggaggaggaggaggaggaggagggggaggaggaggagggcggcggcaatgtggagaaggaccctgatggagccaagagccaggagaaggaggagcctgagatcagcacagagaaggaggacagcgcccggctggatgaccacgaggaggaggaggaggaggatgaggagcccagccacaatgaagatcatgatgctgatgatgaagatgacagccacatggagagcgctgaggtggagaaggaggagctgccccgggagagcttcaaggaggtgctggagaaccaggagaccttcctggacctgaatgtgcagcccggccacagcaaccctgaggtgctgatggactgtggggtggacctgacagccagctgcaacagcgagcccaaggagctggccggggaccctgaggccgtgcctgagagtgatgaggagcccccacctggagagcaggcccagaagcaggaccagaagaacagcaaggaggtggacacagagttcaaggagggcaacccagccaccatggagattgattctgaaacagtgcaggccgtgcagagcctgacccaggagagcagcgagcaggatgacaccttccaggactgtgccgagacccaggaggcctgccgcagcctgcagaactacaccagggctgaccagagcccccagatcgccaccaccctggatgactgccagcagagcgaccacagcagccctgtgtcctctgtgcacagccaccctggccagagcgtgcgctctgtgaacagccccagcgtgcctgccctggagaacagctatgcccagatcagcccagaccagagcgccatctctgtgcccagcctgcagaacatggagaccagccccatgatggatgtgcccagcgtgtctgaccacagccagcaggtggtggacagcggcttcagtgacctgggcagcattgagagcaccacagagaactatgagaaccccagcagctatgacagcaccatgggcggcagcatctgtggaaatggcagcagccagaacagctgcagctacagcaacctgaccagcagcagcctgacccagagcagctgtgctgtgacccagcagatgagcaacatcagcggcagctgcagcatgctgcagcagaccagcatcagcagcccccccacctgcagcgtgaagagcccccagggctgtgtggtggagaggcctcccagcagcagccagcagctggcccagtgcagcatggccgccaacttcaccccacccatgcagctggccgagatccctgagaccagcaatgccaacatcggcctgtatgaaagaatgggccagagcgactttggagctggccactacccccagcccagcgccaccttcagcctggccaagctgcagcagctgaccaacaccctgattgaccacagcctgccctacagccacagcgctgctgtgaccagctatgccaacagcgccagcctgagcacccccctgagcaacacaggcctggtgcagctgagccagagcccccacagcgtgcctgggggcccccaggcccaggccaccatgaccccaccacccaacctgaccccaccacccatgaacctgcccccacccctgctgcagaggaacatggccgccagcaacatcggcatcagccacagccagaggctgcagacccagatcgccagcaagggccacatctccatgaggaccaagagcgccagcctgagccctgctgctgccacccaccagagccagatctacggccgcagccagacagtggccatgcagggccctgcccggaccctgaccatgcagaggggcatgaacatgtctgtgaacctgatgcctgccccagcctacaacgtgaacagcgtgaacatgaacatgaacaccctgaatgccatgaatggctacagcatgagccagcccatgatgaacagcggctaccacagcaaccacggctacatgaaccagaccccccagtaccccatgcagatgcagatgggcatgatgggcacccagccctatgcccagcagcccatgcagaccccacctcatggcaacatgatgtacacagcccctggccaccacggctacatgaacacaggcatgagcaagcagagcctgaatggcagctacatgagaagatag

SEQ ID NO: 156715 - DNA, 5673 bp, Artificial Sequence
  Description of Artificial Sequence: Synthetic coding sequence
atggtgaagctggccaaccccctgtacacagagtggatcctggaggccatccagaagatcaagaagcagaagcagaggcccagcgaggagcgcatctgccacgctgtgtccaccagccacggcctggacaagaagacagtgtctgagcagctggagctgtctgtgcaggacggctctgtgctgaaggtgaccaacaagggcctggccagctacaaggaccctgacaaccctggccgcttcagctctgtgaagccaggcaccttccccaagagcgccaagggcagccggggcagctgcaatgacctgagaaatgtggactggaacaagctgctgcggcgggccatcgagggcctggaggagcccaacggcagcagcctgaagaacatcgagaagtacctgcggagccagagcgacctgaccagcaccaccaacaacccagccttccagcagaggctgcggctgggcgccaagagagctgtgaacaacggccgcctgctgaaggatggcccccagtacagagtgaactacggcagcctggatggcaagggggccccccagtaccccagcgccttccccagcagcctgccccctgtgtccctgctgccccatgagaaggaccagcccagggctgaccccatccccatctgcagcttctgcctgggcaccaaggagagcaaccgggagaagaagccagaggagctgctgagctgtgccgactgtggcagcagcggccaccccagctgcctgaagttctgcccagagctgaccaccaacgtgaaggccctgcgctggcagtgcatcgagtgcaagacctgcagcgcctgccgggtgcagggcagaaatgctgacaacatgctgttctgtgacagctgtgaccggggcttccacatggagtgctgtgacccccccctgagcaggatgcccaagggcatgtggatctgccaggtgtgccggcccaagaagaagggcaggaagctgctgcacgagaaggccgcccagatcaagagaagatatgccaagcccatcggccggcccaagaacaagctgaagcagaggctgctgtctgtgaccagtgatgagggctccatgaatgccttcaccggccggggcagccctggccggggccagaagaccaaggtgtgcaccacccccagcagcggccatgctgccagcggcaaggacagcagcagccggctggccgtgacagaccccaccaggcctggggccaccaccaagatcaccaccaccagcacctacatcagcgccagcaccctgaaggtgaacaagaagaccaagggcctgattgatggcctgaccaagttcttcacccccagcccagatggaagaagaagcagaggagagatcatcgacttcagcaagcactaccggcccaggaagaaggtgtcccagaagcagagctgcaccagccacgtgctggccacagacacagagatcaagatcaacatcaagcaggagagcgcagatgtgaatgtgattggcaacaaggatgtggtgacagaggaggacctggatgtgttcaagcaggcccaggagctgtcctgggagaagattgaatgtgagagcggcgtggaggactgtggccgctaccccagcgtcatcgagtttgggaagtatgagatccagacctggtacagcagcccctacccccaggagtatgcccggctgcccaagctgtacctgtgtgagttctgcctgaagtacatgaagagcaagaacatcctgctgcggcacagcaagaagtgtggctggttccaccccccagccaatgagatctacagaaggaaggacctgtctgtgtttgaggtggatggcaacatgagcaagatctactgccagaacctgtgcctgctggccaagctgttcctggaccacaagaccctgtactatgatgtggagcccttcctgttctacgtgctgaccaagaatgatgagaagggctgccacctggtgggctacttcagcaaggagaagctgtgccagcagaagtacaacgtgtcctgcatcatgatcatgccccagcaccagaggcagggcttcggccgcttcctgattgacttctcctacctgctgagcagaagagagggccaggccggcagccctgagaagcccctgagtgacctgggccgcctgagctacctggcctactggaagagcgtcatcctggagtacctgtaccaccaccacgagcggcacatcagcatcaaggccatcagccgggccaccggcatgtgcccccatgacatcgccaccaccctgcagcacctgcacatgattgacaagagagatggccgcttcgtcatcatccggcgggagaagctgatcctgagccacatggagaagctgaagacctgcagccgggccaatgagctggaccctgacagcctgcgctggacccccatcctgatcagcaatgctgctgtgtctgaggaggagcgggaggccgagaaggaggccgagcggctgatggagcaggccagctgctgggagaaggaggagcaggagatcctgagcacccgggccaacagccggcagagccctgccaaggtgcagagcaagaacaagtacctgcacagccctgagagcaggcctgtgactggagagcggggccagctgctggagctgagcaaggagagcagcgaggaggaggaggaggaggaggatgaggaggaggaggaggaggaggaggaggaggaggaggatgaggaggaggaggaggaggaggaggaggaggaggaggaggagaacatccagagcagccccccccggctgaccaagccccagagcgtggccatcaagaggaagaggccctttgtgctgaagaagaagaggggcaggaagagaagacgcatcaacagctctgtgaccacagagaccatcagcgagaccacagaggtgctgaatgagccctttgacaacagtgatgaggagcggcccatgccccagctggagcccacctgtgaaattgaggtggaggaggatggcaggaagcctgtgctgaggaaggccttccagcaccagcccgggaagaagaggcagacagaggaggaggagggcaaggacaaccactgcttcaagaatgctgacccctgcaggaacaacatgaatgatgacagcagcaacctgaaggagggcagcaaggacaaccctgagcccctgaagtgcaagcaggtgtggcccaagggcaccaagaggggcctgagcaagtggaggcagaacaaggagaggaagacaggcttcaagctgaacctgtacaccccacctgagacccccatggagccagatgagcaggtgacagtggaggagcagaaggagaccagcgagggcaagaccagccccagccccatccgcatcgaggaggaggtgaaggagactggagaggccctgctgccccaggaggagaacagaagagaggagacctgtgcccctgtgagccccaacaccagccctggagagaagccagaagatgacctgatcaagccagaggaggaggaggaggaggaggaggaggaggaggaggaggaggaggaggaggagggggaggaggaggagggcggcggcaatgtggagaaggaccctgatggagccaagagccaggagaaggaggagcctgagatcagcacagagaaggaggacagcgcccggctggatgaccacgaggaggaggaggaggaggatgaggagcccagccacaatgaagatcatgatgctgatgatgaagatgacagccacatggagagcgctgaggtggagaaggaggagctgccccgggagagcttcaaggaggtgctggagaaccaggagaccttcctggacctgaatgtgcagcccggccacagcaaccctgaggtgctgatggactgtggggtggacctgacagccagctgcaacagcgagcccaaggagctggccggggaccctgaggccgtgcctgagagtgatgaggagcccccacctggagagcaggcccagaagcaggaccagaagaacagcaaggaggtggacacagagttcaaggagggcaacccagccaccatggagattgacagcgagaccgtgcaggccgtgcagagcctgacccaggagagcagcgagcaggatgacaccttccaggactgtgccgagacccaggaggcctgccgcagcctgcagaactacaccagggctgaccagagcccccagatcgccaccaccctggatgactgccagcagagcgaccacagcagccctgtgtcctctgtgcacagccaccctggccagagcgtgcgctctgtgaacagccccagcgtgcctgccctggagaacagctatgcccagatcagcccagaccagagcgccatctctgtgcccagcctgcagaacatggagaccagccccatgatggatgtgcccagcgtgtctgaccacagccagcaggtggtggacagcggcttcagtgacctgggcagcattgagagcaccacagaaaattatgagaaccccagcagctatgacagcaccatgggcggcagcatctgtggaaatggcagcagccagaacagctgcagctacagcaacctgaccagcagcagcctgacccagagcagctgtgctgtgacccagcagatgagcaacatcagcggcagctgcagcatgctgcagcagaccagcatcagcagcccccccacctgcagcgtgaagagcccccagggctgtgtggtggagcggccccccagcagcagccagcagctggcccagtgcagcatggccgccaacttcaccccacccatgcagctggccgagatccctgagaccagcaatgccaacatcggcctgtatgaaagaatgggccagagcgactttggagctggccactacccccagcccagcgccaccttcagcctggccaagctgcagcagctgaccaacaccctgattgaccacagcctgccctacagccacagcgctgctgtgaccagctatgccaacagcgccagcctgagcacccccctgagcaacacaggcctggtgcagctgagccagagcccccacagcgtgcctgggggcccccaggcccaggccaccatgaccccaccacccaacctgaccccaccacccatgaacctgcccccacccctgctgcagaggaacatggccgccagcaacatcggcatcagccacagccagaggctgcagacccagatcgccagcaagggccacatctccatgaggaccaagagcgccagcctgagccctgctgctgccacccaccagagccagatctacggccgcagccagacagtggccatgcagggccctgcccggaccctgaccatgcagaggggcatgaacatgtctgtgaacctgatgcctgccccagcctacaacgtgaacagcgtgaacatgaacatgaacaccctgaatgccatgaatggctacagcatgagccagcccatgatgaacagcggctaccacagcaaccacggctacatgaaccagaccccccagtaccccatgcagatgcagatgggcatgatgggcacccagccctatgcccagcagcccatgcagaccccaccccacggcaacatgatgtacacagcccctggccaccacggctacatgaacacaggcatgagcaagcagagcctgaatggcagctacatgagaagatag

SEQ ID NO: 156716 - DNA, 5346 bp, Artificial Sequence
  Description of Artificial Sequence: Synthetic coding sequence
atggtgaagctggccaaccccctgtacacagagtggatcctggaggccatccagaagatcaagaagcagaagcagaggcccagcgaggagcgcatctgccacgctgtgtccaccagccacggcctggacaagaagacagtgtctgagcagctggagctgtctgtgcaggacggctctgtgctgaaggtgaccaacaagggcctggccagctacaaggaccctgacaaccctggccgcttcagctctgtgaagccaggcaccttccccaagagcgccaagggcagccggggcagctgcaatgacctgagaaatgtggactggaacaagctgctgcggcgggccatcgagggcctggaggagcccaacggcagcagcctgaagaacatcgagaagtacctgcggagccagagcgacctgaccagcaccaccaacaacccagccttccagcagaggctgcggctgggcgccaagagagctgtgaacaacggccgcctgctgaaggatggcccccagtacagagtgaactacggcagcctggatggcaagggggccccccagtaccccagcgccttccccagcagcctgccccctgtgtccctgctgccccatgagaaggaccagcccagggctgaccccatccccatctgcagcttctgcctgggcaccaaggagagcaaccgggagaagaagccagaggagctgctgagctgtgccgactgtggcagcagcggccaccccagctgcctgaagttctgcccagagctgaccaccaacgtgaaggccctgcgctggcagtgcatcgagtgcaagacctgcagcgcctgccgggtgcagggcagaaatgctgacaacatgctgttctgtgacagctgtgaccggggcttccacatggagtgctgtgacccccccctgagcaggatgcccaagggcatgtggatctgccaggtgtgccggcccaagaagaagggcaggaagctgctgcacgagaaggccgcccagatcaagagaagatatgccaagcccatcggccggcccaagaacaagctgaagcagaggctgctgtctgtgaccagtgatgagggctccatgaatgccttcaccggccggggcagcccagacacagagatcaagatcaacatcaagcaggagagcgcagatgtgaatgtcatcggcaacaaggatgtggtgacagaggaggacctggatgtgttcaagcaggcccaggagctgtcctgggagaagattgaatgtgagagcggcgtggaggactgtggccgctaccccagcgtgattgaatttgggaagtatgagatccagacctggtacagcagcccctacccccaggagtatgcccggctgcccaagctgtacctgtgtgagttctgcctgaagtacatgaagagcaagaacatcctgctgcggcacagcaagaagtgtggctggttccaccccccagccaatgagatctacagaaggaaggacctgtctgtgtttgaggtggatggcaacatgagcaagatctactgccagaacctgtgcctgctggccaagctgttcctggaccacaagaccctgtactatgatgtggagcccttcctgttctacgtgctgaccaagaatgatgagaagggctgccacctggtgggctacttcagcaaggagaagctgtgccagcagaagtacaacgtgtcctgcatcatgatcatgccccagcaccagaggcagggcttcggccgcttcctgattgacttctcctacctgctgagccggcgggagggccaggccggcagccctgagaagcccctgagtgacctgggccgcctgagctacctggcctactggaagagcgtcatcctggagtacctgtaccaccaccacgagcggcacatcagcatcaaggccatcagccgggccaccggcatgtgcccccatgacatcgccaccaccctgcagcacctgcacatgattgacaagagagatggccgctttgtgatcatcagaagagagaagctgatcctgagccacatggagaagctgaagacctgcagccgggccaatgagctggaccctgacagcctgcgctggacccccatcctgatcagcaatgctgctgtgtctgaggaggagcgggaggccgagaaggaggccgagcggctgatggagcaggccagctgctgggagaaggaggagcaggagatcctgagcacccgggccaacagccggcagagccctgccaaggtgcagagcaagaacaagtacctgcacagccctgagagcaggcctgtgactggagagcggggccagctgctggagctgagcaaggagagcagcgaggaggaggaggaggaggaggatgaggaggaggaggaggaggaggaggaggaggaggaggatgaggaggaggaggaggaggaggaggaggaggaggaggaggagaacatccagagcagccccccccggctgaccaagccccagagcgtggccatcaagaggaagaggccctttgtgctgaagaagaagaggggcaggaagagaagacgcatcaacagctctgtgaccacagagaccatcagcgagaccacagaggtgctgaatgagccctttgacaacagtgatgaggagcggcccatgccccagctggagcccacctgtgaaattgaggtggaggaggatggcaggaagcctgtgctgaggaaggccttccagcaccagcccgggaagaagaggcagacagaggaggaggagggcaaggacaaccactgcttcaagaatgctgacccctgcaggaacaacatgaatgatgacagcagcaacctgaaggagggcagcaaggacaaccctgagcccctgaagtgcaagcaggtgtggcccaagggcaccaagaggggcctgagcaagtggaggcagaacaaggagaggaagacaggcttcaagctgaacctgtacaccccacctgagacccccatggagccagatgagcaggtgacagtggaggagcagaaggagaccagcgagggcaagaccagccccagccccatcagaattgaggaggaggtgaaggagaccggggaggccctgctgccccaggaggagaacagaagagaggagacctgtgcccctgtgagccccaacaccagccctggagagaagccagaagatgacctgatcaagccagaggaggaggaggaggaggaggaggaggaggaggaggaggaggaggaggaggagggggaggaggaggagggcggcggcaatgtggagaaggaccctgatggagccaagagccaggagaaggaggagcctgagatcagcacagagaaggaggacagcgcccggctggatgaccacgaggaggaggaggaggaggatgaggagcccagccacaatgaagatcatgatgctgatgatgaagatgacagccacatggagagcgctgaggtggagaaggaggagctgccccgggagagcttcaaggaggtgctggagaaccaggagaccttcctggacctgaatgtgcagcccggccacagcaaccctgaggtgctgatggactgtggggtggacctgacagccagctgcaacagcgagcccaaggagctggccggggaccctgaggccgtgcctgagagtgatgaggagcccccacctggagagcaggcccagaagcaggaccagaagaacagcaaggaggtggacacagagttcaaggagggcaacccagccaccatggagattgattctgaaacagtgcaggccgtgcagagcctgacccaggagagcagcgagcaggatgacaccttccaggactgtgccgagacccaggaggcctgccgcagcctgcagaactacaccagggctgaccagagcccccagatcgccaccaccctggatgactgccagcagagcgaccacagcagccctgtgtcctctgtgcacagccaccctggccagagcgtgcgctctgtgaacagccccagcgtgcctgccctggagaacagctatgcccagatcagcccagaccagagcgccatctctgtgcccagcctgcagaacatggagaccagccccatgatggatgtgcccagcgtgtctgaccacagccagcaggtggtggacagcggcttcagtgacctgggcagcattgagagcaccacagagaactatgagaaccccagcagctatgacagcaccatgggcggcagcatctgtggaaatggcagcagccagaacagctgcagctacagcaacctgaccagcagcagcctgacccagagcagctgtgctgtgacccagcagatgagcaacatcagcggcagctgcagcatgctgcagcagaccagcatcagcagcccccccacctgcagcgtgaagagcccccagggctgtgtggtggagaggcctcccagcagcagccagcagctggcccagtgcagcatggccgccaacttcaccccacccatgcagctggccgagatccctgagaccagcaatgccaacatcggcctgtatgaaagaatgggccagagcgactttggagctggccactacccccagcccagcgccaccttcagcctggccaagctgcagcagctgaccaacaccctgattgaccacagcctgccctacagccacagcgctgctgtgaccagctatgccaacagcgccagcctgagcacccccctgagcaacacaggcctggtgcagctgagccagagcccccacagcgtgcctgggggcccccaggcccaggccaccatgaccccaccacccaacctgaccccaccacccatgaacctgcccccacccctgctgcagaggaacatggccgccagcaacatcggcatcagccacagccagaggctgcagacccagatcgccagcaagggccacatctccatgaggaccaagagcgccagcctgagccctgctgctgccacccaccagagccagatctacggccgcagccagacagtggccatgcagggccctgcccggaccctgaccatgcagaggggcatgaacatgtctgtgaacctgatgcctgccccagcctacaacgtgaacagcgtgaacatgaacatgaacaccctgaatgccatgaatggctacagcatgagccagcccatgatgaacagcggctaccacagcaaccacggctacatgaaccagaccccccagtaccccatgcagatgcagatgggcatgatgggcacccagccctatgcccagcagcccatgcagaccccacctcatggcaacatgatgtacacagcccctggccaccacggctacatgaacacaggcatgagcaagcagagcctgaatggcagctacatgagaagatag

SEQ ID NO: 156717 - DNA, 5346 bp, Artificial Sequence; identical to SEQ ID NO: 156716
  Description of Artificial Sequence: Synthetic coding sequence

SEQ ID NO: 156718 - DNA, 5346 bp, Artificial Sequence; identical to SEQ ID NO: 156716
  Description of Artificial Sequence: Synthetic coding sequence

SEQ ID NO: 156719 - DNA, 4992 bp, Artificial Sequence
  Description of Artificial Sequence: Synthetic coding sequence
atgacagaccgcttctgggaccagtggtacctgtggtacctgcggctgctgcggctgctggaccggggcagcttcagaaatgatggcctgaaggccagtgatgtgctgcccatcctgaaggagaaggtggcctttgtgtctgggggccgggacaagaggggcggccccatcctgaccttccctgcccggagcaaccacgaccgcatccggcaggaggacctgaggaagctggtgacctacctggcctctgtgcccagtgaagatgtgtgcaagaggggcttcaccgtcatcatcgacatgaggggcagcaagtgggacctgatcaagcccctgctgaagaccctgcaggaggccttccctgctgagatccacgtggccctgatcatcaagccagacaacttctggcagaagcagaagaccaactttggcagcagcaagttcatctttgagacctccatggtgtctgtggagggcctgaccaagctggtggaccccagccagctgacagaggagtttgatggcagcctggactacaaccacgaggagtggattgagctgcggctgagcctggaggagttcttcaacagcgctgtgcacctgctgagccggctggaggacctgcaggagatgctggccaggaaggagttccctgtggatgtggagggcagccggcggctgattgatgagcacacccagctgaagaagaaggtgctgaaggcccctgtggaggagctggaccgggagggccagaggctgctgcagtgcatccgctgcagtgatggcttctctggaagaaactgcatccctggcagcgctgacttccagagcctggtgcccaagatcaccagcctgctggacaagctgcacagcacccggcagcacctgcaccagatgtggcacgtgaggaagctgaagctggaccagtgcttccagctgcggctgtttgagcaggatgctgagaagatgtttgactggatcagccacaacaaggagctgttcctgcagagccacacagaaattggagtgtcctaccagtatgccctggacctgcagacccagcacaaccactttgccatgaacagcatgaatgcctacgtgaacatcaaccgcatcatgtctgtggccagccggctgtctgaggccggccactacgccagccagcagatcaagcagatcagcacccagctggaccaggagtggaagagctttgctgctgccctggatgagaggagcaccatcctggccatgtctgctgtgttccaccagaaggccgagcagttcctgtctggagtggatgcctggtgcaagatgtgcagcgagggcggcctgcccagcgagatgcaggacctggagctggccatccaccaccaccagaccctgtatgagcaggtgacccaggcctacacagaggtgtcccaggacggcaaggccctgctggatgtgctgcagaggcccctgagccctggcaacagcgagagcctgacagccacagccaactacagcaaggctgtgcaccaggtgctggatgtggtgcatgaggtgctgcaccaccagaggcggctggagagcatctggcagcacaggaaggtgcggctgcaccagaggctgcagctgtgtgtgttccagcaggatgtgcagcaggtgctggactggattgaaaatcatggagaggccttcctgagcaagcacactggagtgggcaagagcctgcaccgggcccgggccctgcagaagagacatgatgactttgaggaggtggcccagaacacctacaccaatgctgacaagctgctggaggccgctgagcagctggcccagacaggagaatgtgaccctgaggagatctacaaggccgcccggcacctggaggtgcgcatccaggactttgtgagaagagtggagcagaggaagctgctgctggacatgtctgtgtccttccacacccacaccaaggagctgtggacctggatggaggacctgcagaaggagatgctggaggatgtgtgtgccgacagcgtggatgctgtgcaggagctgatcaagcagttccagcagcagcagacagccaccctggatgccaccctgaatgtcatcaaggagggggaggacctgatccagcagctgcggagcgccccacccagcctgggggagcccagcgaggcccgggacagcgctgtgagcaacaacaagaccccccacagcagcagcatcagccacatcgagagcgtgctgcagcagctggatgatgcccaggtgcagatggaggagctgttccacgagaggaagatcaagctggacatcttcctgcagctgcgcatctttgagcagtacaccatcgaggtgacagctgagctggatgcctggaatgaagacctgctgcggcagatgaatgacttcaacacagaggacctgaccctggccgagcagaggctgcagaggcacacagagaggaagctggccatgaacaacatgacctttgaggtgatccagcagggccaggacctgcaccagtacatcacagaggtgcaggccagcggcatcgagctgatctgtgagaaggacatcgacctggccgcccaggtgcaggagctgctggagttcctgcacgagaagcagcacgagctggagctgaatgctgagcagacccacaagaggctggagcagtgcctgcagctgcggcacctgcaggccgaggtgaagcaggtgctgggctggatcagaaatggagagagcatgctgaatgccagcctggtgaatgccagcagcctgtctgaggccgagcagctgcagcgggagcacgagcagttccagctggccatcgagagcctcttccacgccaccagcctgcagaagacccaccagagcgccctgcaggtgcagcagaaggccgaggtgctgctgcaggccggccactatgatgctgatgccatcagagaatgtgccgagaaggtggccctgcactggcagcagctgatgctgaagatggaggaccggctgaagctggtgaatgcctctgtggccttctacaagaccagcgagcaggtgtgcagcgtgctggagagcctggagcaggagtacagaagagatgaggactggtgtggcggccgggacaagctgggccctgctgctgagattgaccacgtgatccccctcatcagcaagcacctggagcagaaggaggccttcctgaaggcctgcaccctggccaggagaaatgctgaggtgttcctgaagtacatccacaggaacaacgtgtccatgcccagcgtggccagccacacccggggccctgagcagcaggtgaaggccatcctgtctgagctgctgcagcgggagaacagagtgctgcacttctggaccctgaagaagaggcggctggaccagtgccagcagtatgtggtgtttgagaggtctgccaagcaggccctggactggatccaggagactggagagttctacctgagcacccacaccagcactggagagaccacagaggagacccaggagctgctgaaggagtatggagagttccgggtgcctgccaagcagaccaaggagaaggtgaagctgctgatccagctggccgacagctttgtggagaagggccacatccacgccacagagatcaggaagtgggtgaccaccgtggacaagcactacagagacttcagcctgaggatgggcaagtaccgctacagcctggagaaggccctgggcgtgaacacagaggacaacaaggacctggagctggacatcatcccagccagcctgagtgaccgggaggtgaagctgagagatgccaaccacgaggtgaatgaggagaagaggaagagcgccaggaagaaggagttcatcatggccgagctgctgcagacagagaaggcctacgtgcgggacctgcacgagtgcctggagacctacctgtgggagatgaccagcggcgtggaggagatccccccaggcatcctgaacaaggagcacatcatcttcggcaacatccaggagatctatgacttccacaacaacatcttcctgaaggagctggagaagtatgagcagctgcctgaagatgtgggccactgctttgtgacctgggccgacaagttccagatgtatgtgacctactgcaagaacaagccagacagcaaccagctgatcctggagcacgccggcaccttctttgatgagatccagcagagacatggcctggccaacagcatcagcagctacctgatcaagcctgtgcagaggatcaccaagtaccagctgctgctgaaggagctgctgacctgctgtgaggagggcaagggggagctgaaggatggcctggaggtgatgctgtctgtgcccaagaaggccaatgatgccatgcacgtgtccatgctggagggctttgatgagaacctggatgtgcagggcgagctgatcctgcaggatgccttccaggtgtgggaccccaagagcctcatcaggaagggccgggagcggcacctgttcctgtttgagatcagcctggtgttcagcaaggagatcaaggacagcagcggccacaccaagtatgtgtacaagaacaagctgctgaccagcgagctgggcgtgacagagcacgtggagggggacccctgcaagtttgccctgtggagcggccgcacccccagcagtgacaacaagacagtgctgaaggccagcaacatcgagaccaagcaggagtggatcaagaacatccgggaggtgatccaggagcgcatcatccacctgaagggggccctgaaggagcccctgcagctgcccaagaccccagccaagcagaggaacaacagcaagagagatggagtggaggacatcgacagccagggagatggcagcagccagcctgacaccatcagcatcgccagcaggaccagccagaacacagtggacagcgacaaggatggcaacctggtgccccgctggcacctgggccctggggaccccttcagcacctacgtgtag

SEQ ID NO: 156720 - DNA, 3870 bp, Artificial Sequence
  Description of Artificial Sequence: Synthetic coding sequence
atgaagggcggggaccgggcctacacccggggccccagcctgggctggctgtttgccaagtgctgctgctgcttcccctgcagagatgcctacagccacagcagcagtgaaaatggaggcaagtctgagagcgtggccaacctgcaggcccagcccagcctgaacagcatccacagcagccctggccccaagaggagcaccaacaccctgaagaagtggctgaccagccctgtgcggcggctgaacagcggcaaggcagatggcaacatcaagaagcagaagaaggtgagagatggcaggaagagctttgacctgggcagccccaagccaggagatgagaccaccccccagggcgacagcgcagatgagaagagcaagaagggctggggagaagatgagccagatgaggagagccacacccccctgcccccacccatgaagatctttgacaatgaccccacccaggatgagatgagcagcagcctgctggccgcccggcaggccagcacagaggtgcccacagctgctgacctggtgaatgccatcgagaagctggtgaagaacaagctgagcctggagggcagcagctaccggggcagcctgaaggaccctgctggctgcctgaatgaaggcatggccccacccaccccacccaagaaccctgaggaggagcagaaggccaaggccctgcggggccgcatgtttgtgctgaatgagctggtgcagacagagaaggactatgtgaaggacctgggcatcgtggtggagggcttcatgaagagaattgaggagaagggcgtgcctgaggacatgaggggcaaggacaagatcgtgtttggaaacatccaccagatctatgactggcacaaggacttcttcctggccgagctggagaagtgcatccaggagcaggaccggctggcccagctgttcatcaagcatgagaggaagctgcacatctacgtgtggtactgccagaacaagcccaggtctgagtacatcgtggccgagtatgatgcctactttgaggaggtgaagcaggagatcaaccagaggctgaccctgagtgacttcctgatcaagcccatccagaggatcaccaagtaccagctgctgctgaaggacttcctgcgctacagcgagaaggccggcctggagtgcagcgacatcgagaaggctgtggagctgatgtgcctggtgcccaagcgctgcaatgacatgatgaacctgggccgcctgcagggctttgagggcaccctgacagcccagggcaagctgctgcagcaggacaccttctacgtgattgagctggatgctggcatgcagagcaggaccaaggagcggcgggtcttcctgtttgagcagatcgtcatcttcagcgagctgctgaggaagggcagcctgaccccaggctacatgttcaagaggagcatcaagatgaactacctggtgctggaggagaatgtggacaatgacccctgcaagtttgccctgatgaaccgggagaccagcgagcgggtggtgctgcaggccgccaatgctgacatccagcaggcctgggtgcaggacatcaaccaggtgctggagacccagagggacttcctgaatgccctgcagagccccatcgagtaccagaggaaggagaggagcacagctgtgatgaggagccagcctgcccggctgccccaggccagcccccggccctacagctctgtgcctgctggcagcgagaagccacccaagggcagcagctacaacccccccctgccccccctgaagatcagcaccagcaatggcagccctggctttgagtaccaccagcccggggacaagtttgaggccagcaagcagaatgacctgggcggctgcaatggcaccagctccatggccgtcatcaaggactactatgccctgaaggaaaatgagatctgtgtgtcccagggcgaggtggtgcaggtgctggccgtgaaccagcagaacatgtgcctggtgtaccagcctgccagtgaccacagccctgctgctgagggctgggtgcccggcagcatcctggcccccctgaccaaggccacagctgctgagagcagtgatggcagcatcaagaagagctgctcctggcacaccctgaggatgaggaagagagctgaggtggagaacacaggcaagaatgaggccaccggccccaggaagcccaaggacatcctgggcaacaaggtgtctgtgaaggagaccaacagcagcgaggagagtgaatgtgatgacctggaccccaacacctccatggagatcctgaaccccaacttcatccaggaggtggcccctgagttcctggtgcccctggtggatgtgacctgcctgctgggggacaccgtcatcctgcagtgcaaggtgtgtggccggcccaagcccaccatcacctggaagggccctgaccagaacatcctggacacagacaacagcagcgccacctacacagtgagcagctgtgacagcggggagatcaccctgaagatctgcaacctgatgccccaggacagcggcatctacacctgcatcgccaccaatgaccacggcaccaccagcaccagcgccaccgtgaaggtgcagggcgtgcctgctgcccccaaccggcccatcgcccaggagaggagctgcaccagcgtcatcctgcgctggctgccccccagcagcacaggcaactgcaccatcagcggctacacagtggagtaccgggaggagggcagccagatctggcagcagagcgtggccagcaccctggacacctacctggtgattgaggacctgagccctggctgcccctaccagttccgggtgtctgccagcaacccctggggcatcagcctgcccagcgagcccagcgagtttgtgcggctgcctgaatatgatgctgctgctgatggagccaccatctcctggaaggaaaattttgattctgcctacacagagctgaatgaaattggccggggccgcttcagcatcgtgaagaagtgcatccacaaggccaccaggaaggatgtggccgtgaagtttgtgtccaagaagatgaagaagaaggagcaggccgcccacgaggccgccctgctgcagcacctgcagcacccccagtacatcaccctgcatgacacctatgagagccccaccagctacatcctgatcctggagctgatggatgatggccgcctgctggactacctgatgaaccatgatgagctgatggaggagaaggtggccttctacatccgggacatcatggaggccctgcagtacctgcacaactgccgggtggcccacctggacatcaagccagagaacctgctgattgacctgcgcatccctgtgccccgggtgaagctgattgacctggaggatgctgtgcagatcagcggccacttccacatccaccacctgctgggcaaccctgagtttgctgcccctgaggtgatccagggcatccctgtgtccctgggcacagacatctggagcattggagtgctgacctacgtgatgctgagcggcgtgagccccttcctggatgagagcaaggaggagacctgcatcaacgtgtgccgggtggacttctccttcccccatgagtacttctgtggggtgtccaatgctgcccgggacttcatcaacgtcatcctgcaggaggacttcagaagaagacccacagctgccacctgcctgcagcacccctggctgcagccccacaacggcagctacagcaagatccccctggacaccagccggctggcctgcttcatcgagaggaggaagcaccagaatgatgtgcggcccatccccaacgtgaagagctacatcgtgaacagagtgaaccagggcacctag

SEQ ID NO: 156721 - DNA, 8961 bp, Artificial Sequence
  Description of Artificial Sequence: Synthetic coding sequence
atgacagaccgcttctgggaccagtggtacctgtggtacctgcggctgctgcggctgctggaccggggcagcttcagaaatgatggcctgaaggccagtgatgtgctgcccatcctgaaggagaaggtggcctttgtgtctgggggccgggacaagaggggcggccccatcctgaccttccctgcccggagcaaccacgaccgcatccggcaggaggacctgaggaagctggtgacctacctggcctctgtgcccagtgaagatgtgtgcaagaggggcttcaccgtcatcatcgacatgaggggcagcaagtgggacctgatcaagcccctgctgaagaccctgcaggaggccttccctgctgagatccacgtggccctgatcatcaagccagacaacttctggcagaagcagaagaccaactttggcagcagcaagttcatctttgagacctccatggtgtctgtggagggcctgaccaagctggtggaccccagccagctgacagaggagtttgatggcagcctggactacaaccacgaggagtggattgagctgcggctgagcctggaggagttcttcaacagcgctgtgcacctgctgagccggctggaggacctgcaggagatgctggccaggaaggagttccctgtggatgtggagggcagccggcggctgattgatgagcacacccagctgaagaagaaggtgctgaaggcccctgtggaggagctggaccgggagggccagaggctgctgcagtgcatccgctgcagtgatggcttctctggaagaaactgcatccctggcagcgctgacttccagagcctggtgcccaagatcaccagcctgctggacaagctgcacagcacccggcagcacctgcaccagatgtggcacgtgaggaagctgaagctggaccagtgcttccagctgcggctgtttgagcaggatgctgagaagatgtttgactggatcagccacaacaaggagctgttcctgcagagccacacagaaattggagtgtcctaccagtatgccctggacctgcagacccagcacaaccactttgccatgaacagcatgaatgcctacgtgaacatcaaccgcatcatgtctgtggccagccggctgtctgaggccggccactacgccagccagcagatcaagcagatcagcacccagctggaccaggagtggaagagctttgctgctgccctggatgagaggagcaccatcctggccatgtctgctgtgttccaccagaaggccgagcagttcctgtctggagtggatgcctggtgcaagatgtgcagcgagggcggcctgcccagcgagatgcaggacctggagctggccatccaccaccaccagaccctgtatgagcaggtgacccaggcctacacagaggtgtcccaggacggcaaggccctgctggatgtgctgcagaggcccctgagccctggcaacagcgagagcctgacagccacagccaactacagcaaggctgtgcaccaggtgctggatgtggtgcatgaggtgctgcaccaccagaggcggctggagagcatctggcagcacaggaaggtgcggctgcaccagaggctgcagctgtgtgtgttccagcaggatgtgcagcaggtgctggactggattgaaaatcatggagaggccttcctgagcaagcacactggagtgggcaagagcctgcaccgggcccgggccctgcagaagagacatgatgactttgaggaggtggcccagaacacctacaccaatgctgacaagctgctggaggccgctgagcagctggcccagacaggagaatgtgaccctgaggagatctacaaggccgcccggcacctggaggtgcgcatccaggactttgtgagaagagtggagcagaggaagctgctgctggacatgtctgtgtccttccacacccacaccaaggagctgtggacctggatggaggacctgcagaaggagatgctggaggatgtgtgtgccgacagcgtggatgctgtgcaggagctgatcaagcagttccagcagcagcagacagccaccctggatgccaccctgaatgtcatcaaggagggggaggacctgatccagcagctgcggagcgccccacccagcctgggggagcccagcgaggcccgggacagcgctgtgagcaacaacaagaccccccacagcagcagcatcagccacatcgagagcgtgctgcagcagctggatgatgcccaggtgcagatggaggagctgttccacgagaggaagatcaagctggacatcttcctgcagctgcgcatctttgagcagtacaccatcgaggtgacagctgagctggatgcctggaatgaagacctgctgcggcagatgaatgacttcaacacagaggacctgaccctggccgagcagaggctgcagaggcacacagagaggaagctggccatgaacaacatgacctttgaggtgatccagcagggccaggacctgcaccagtacatcacagaggtgcaggccagcggcatcgagctgatctgtgagaaggacatcgacctggccgcccaggtgcaggagctgctggagttcctgcacgagaagcagcacgagctggagctgaatgctgagcagacccacaagaggctggagcagtgcctgcagctgcggcacctgcaggccgaggtgaagcaggtgctgggctggatcagaaatggagagagcatgctgaatgccagcctggtgaatgccagcagcctgtctgaggccgagcagctgcagcgggagcacgagcagttccagctggccatcgagagcctcttccacgccaccagcctgcagaagacccaccagagcgccctgcaggtgcagcagaaggccgaggtgctgctgcaggccggccactatgatgctgatgccatcagagaatgtgccgagaaggtggccctgcactggcagcagctgatgctgaagatggaggaccggctgaagctggtgaatgcctctgtggccttctacaagaccagcgagcaggtgtgcagcgtgctggagagcctggagcaggagtacagaagagatgaggactggtgtggcggccgggacaagctgggccctgctgctgagattgaccacgtgatccccctcatcagcaagcacctggagcagaaggaggccttcctgaaggcctgcaccctggccaggagaaatgctgaggtgttcctgaagtacatccacaggaacaacgtgtccatgcccagcgtggccagccacacccggggccctgagcagcaggtgaaggccatcctgtctgagctgctgcagcgggagaacagagtgctgcacttctggaccctgaagaagaggcggctggaccagtgccagcagtatgtggtgtttgagaggtctgccaagcaggccctggactggatccaggagactggagagttctacctgagcacccacaccagcactggagagaccacagaggagacccaggagctgctgaaggagtatggagagttccgggtgcctgccaagcagaccaaggagaaggtgaagctgctgatccagctggccgacagctttgtggagaagggccacatccacgccacagagatcaggaagtgggtgaccaccgtggacaagcactacagagacttcagcctgaggatgggcaagtaccgctacagcctggagaaggccctgggcgtgaacacagaggacaacaaggacctggagctggacatcatcccagccagcctgagtgaccgggaggtgaagctgagagatgccaaccacgaggtgaatgaggagaagaggaagagcgccaggaagaaggagttcatcatggccgagctgctgcagacagagaaggcctacgtgcgggacctgcacgagtgcctggagacctacctgtgggagatgaccagcggcgtggaggagatccccccaggcatcctgaacaaggagcacatcatcttcggcaacatccaggagatctatgacttccacaacaacatcttcctgaaggagctggagaagtatgagcagctgcctgaagatgtgggccactgctttgtgacctgggccgacaagttccagatgtatgtgacctactgcaagaacaagccagacagcaaccagctgatcctggagcacgccggcaccttctttgatgagatccagcagagacatggcctggccaacagcatcagcagctacctgatcaagcctgtgcagaggatcaccaagtaccagctgctgctgaaggagctgctgacctgctgtgaggagggcaagggggagctgaaggatggcctggaggtgatgctgtctgtgcccaagaaggccaatgatgccatgcacgtgtccatgctggagggctttgatgagaacctggatgtgcagggcgagctgatcctgcaggatgccttccaggtgtgggaccccaagagcctcatcaggaagggccgggagcggcacctgttcctgtttgagatcagcctggtgttcagcaaggagatcaaggacagcagcggccacaccaagtatgtgtacaagaacaagctgctgaccagcgagctgggcgtgacagagcacgtggagggggacccctgcaagtttgccctgtggagcggccgcacccccagcagtgacaacaagacagtgctgaaggccagcaacatcgagaccaagcaggagtggatcaagaacatccgggaggtgatccaggagcgcatcatccacctgaagggggccctgaaggagcccctgcagctgcccaagaccccagccaagcagaggaacaacagcaagagagatggagtggaggacatcgacagccagggagatggcagcagccagcctgacaccatcagcatcgccagcaggaccagccagaacacagtggacagcgacaagctgagcggcggctgtgagctgactgtggtgctgcaggacttctctgctggccacagcagcgagctgaccatccaggtgggccagacagtggagctgctggagcggcccagcgagaggcctggctggtgcctggtgaggaccacagagaggagcccccccctggagggcctggtgcccagcagcgccctgtgcatcagccacagccgcagctctgtggagatggactgcttcttccccctggtgaaggatgcctacagccacagcagcagtgaaaatggaggcaagtctgagagcgtggccaacctgcaggcccagcccagcctgaacagcatccacagcagccctggccccaagaggagcaccaacaccctgaagaagtggctgaccagccctgtgcggcggctgaacagcggcaaggcagatggcaacatcaagaagcagaagaaggtgagagatggcaggaagagctttgacctgggcagccccaagccaggagatgagaccaccccccagggcgacagcgcagatgagaagagcaagaagggctggggagaagatgagccagatgaggagagccacacccccctgcccccacccatgaagatctttgacaatgaccccacccaggatgagatgagcagcagcctgctggccgcccggcaggccagcacagaggtgcccacagctgctgacctggtgaatgccatcgagaagctggtgaagaacaagctgagcctggagggcagcagctaccggggcagcctgaaggaccctgctggctgcctgaatgaaggcatggccccacccaccccacccaagaaccctgaggaggagcagaaggccaaggccctgcggggccgcatgtttgtgctgaatgagctggtgcagacagagaaggactatgtgaaggacctgggcatcgtggtggagggcttcatgaagagaattgaggagaagggcgtgcctgaggacatgaggggcaaggacaagatcgtgtttggaaacatccaccagatctatgactggcacaaggacttcttcctggccgagctggagaagtgcatccaggagcaggaccggctggcccagctgttcatcaagcatgagaggaagctgcacatctacgtgtggtactgccagaacaagcccaggtctgagtacatcgtggccgagtatgatgcctactttgaggaggtgaagcaggagatcaaccagaggctgaccctgagtgacttcctgatcaagcccatccagaggatcaccaagtaccagctgctgctgaaggacttcctgcgctacagcgagaaggccggcctggagtgcagcgacatcgagaaggctgtggagctgatgtgcctggtgcccaagcgctgcaatgacatgatgaacctgggccgcctgcagggctttgagggcaccctgacagcccagggcaagctgctgcagcaggacaccttctacgtgattgagctggatgctggcatgcagagcaggaccaaggagaggagggtcttcctgtttgagcagatcgtcatcttcagcgagctgctgaggaagggcagcctgaccccaggctacatgttcaagaggagcatcaagatgaactacctggtgctggaggagaatgtggacaatgacccctgcaagtttgccctgatgaaccgggagaccagcgagcgggtggtgctgcaggccgccaatgctgacatccagcaggcctgggtgcaggacatcaaccaggtgctggagacccagagggacttcctgaatgccctgcagagccccatcgagtaccagaggaaggagaggagcacagctgtgatgaggagccagcctgcccggctgccccaggccagcccccggccctacagctctgtgcctgctggcagcgagaagccacccaagggcagcagctacaacccccccctgccccccctgaagatcagcaccagcaatggcagccctggctttgagtaccaccagcccggggacaagtttgaggccagcaagcagaatgacctgggcggctgcaatggcaccagctccatggctgtgatcaaggactactatgccctgaaggaaaatgagatctgtgtgtcccagggcgaggtggtgcaggtgctggccgtgaaccagcagaacatgtgcctggtgtaccagcctgccagtgaccacagccctgctgctgagggctgggtgcccggcagcatcctggcccccctgaccaaggccacagctgctgagagcagtgatggcagcatcaagaagagctgctcctggcacaccctgaggatgaggaagagagctgaggtggagaacacaggcaagaatgaggccaccggccccaggaagcccaaggacatcctgggcaacaaggtgtctgtgaaggagaccaacagcagcgaggagagtgaatgtgatgacctggaccccaacacctccatggagatcctgaaccccaacttcatccaggaggtggcccctgagttcctggtgcccctggtggatgtgacctgcctgctgggggacaccgtcatcctgcagtgcaaggtgtgtggccggcccaagcccaccatcacctggaagggccctgaccagaacatcctggacacagacaacagcagcgccacctacacagtgagcagctgtgacagcggggagatcaccctgaagatctgcaacctgatgccccaggacagcggcatctacacctgcatcgccaccaatgaccacggcaccaccagcaccagcgccaccgtgaaggtgcagggcgtgcctgctgcccccaaccggcccatcgcccaggagaggagctgcaccagcgtcatcctgcgctggctgccccccagcagcactggaaactgcaccatcagcggctacacagtggagtaccgggaggagggcagccagatctggcagcagagcgtggccagcaccctggacacctacctggtgattgaggacctgagccctggctgcccctaccagttccgggtgtctgccagcaacccctggggcatcagcctgcccagcgagcccagcgagtttgtgcggctgcctgaatatgatgctgctgctgatggagccaccatctcctggaaggagaactttgacagcgcctacacagagctgaatgagatcggccggggccgcttcagcatcgtgaagaagtgcatccacaaggccaccaggaaggatgtggccgtgaagtttgtgtccaagaagatgaagaagaaggagcaggccgcccatgaagctgccctgctgcagcacctgcagcacccccagtacatcaccctgcatgacacctatgagagccccaccagctacatcctgatcctggagctgatggatgatggccgcctgctggactacctgatgaaccatgatgagctgatggaggagaaggtggccttctacatccgggacatcatggaggccctgcagtacctgcacaactgccgggtggcccacctggacatcaagccagagaacctgctgattgacctgcgcatccctgtgccccgggtgaagctgattgacctggaggatgctgtgcagatcagcggccacttccacatccaccacctgctgggcaaccctgagtttgctgcccctgaggtgatccagggcatccctgtgtccctgggcacagacatctggagcattggagtgctgacctacgtgatgctgtctggagtgagccccttcctggatgagagcaaggaggagacctgcatcaacgtgtgccgggtggacttctccttcccccatgagtacttctgtggggtgtccaatgctgcccgggacttcatcaacgtcatcctgcaggaggacttcagaagaagacccacagctgccacctgcctgcagcacccctggctgcagccccacaacggcagctacagcaagatccccctggacaccagccggctggcctgcttcattgaaagaaggaagcaccagaatgatgtgcggcccatccccaacgtgaagagctacatcgtgaacagagtgaaccagggcacctag

SEQ ID NO: 156722 - DNA, 3774 bp, Artificial Sequence
  Description of Artificial Sequence: Synthetic coding sequence
atgaagggcggggaccgggcctacacccggggccccagcctgggctggctgtttgccaagtgctgctgctgcttcccctgcagagatgcctacagccacagcagcagtgaaaatggaggcaagtctgagagcgtggccaacctgcaggcccagcccagcctgaacagcatccacagcagccctggccccaagaggagcaccaacaccctgaagaagtggctgaccagccctgtgcggcggctgaacagcggcaaggcagatggcaacatcaagaagcagaagaaggtgagagatggcaggaagagctttgacctgggcagccccaagccaggagatgagaccaccccccagggcgacagcgcagatgagaagagcaagaagggctggggagaagatgagccagatgaggagagccacacccccctgcccccacccatgaagatctttgacaatgaccccacccaggatgagatgagcctggagggcagcagctaccggggcagcctgaaggaccctgctggctgcctgaatgaaggcatggccccacccaccccacccaagaaccctgaggaggagcagaaggccaaggccctgcggggccgcatgtttgtgctgaatgagctggtgcagacagagaaggactatgtgaaggacctgggcatcgtggtggagggcttcatgaagagaattgaggagaagggcgtgcctgaggacatgaggggcaaggacaagatcgtgtttggaaacatccaccagatctatgactggcacaaggacttcttcctggccgagctggagaagtgcatccaggagcaggaccggctggcccagctgttcatcaagcatgagaggaagctgcacatctacgtgtggtactgccagaacaagcccaggtctgagtacatcgtggccgagtatgatgcctactttgaggaggtgaagcaggagatcaaccagaggctgaccctgagtgacttcctgatcaagcccatccagaggatcaccaagtaccagctgctgctgaaggacttcctgcgctacagcgagaaggccggcctggagtgcagcgacatcgagaaggctgtggagctgatgtgcctggtgcccaagcgctgcaatgacatgatgaacctgggccgcctgcagggctttgagggcaccctgacagcccagggcaagctgctgcagcaggacaccttctacgtgattgagctggatgctggcatgcagagcaggaccaaggagcggcgggtcttcctgtttgagcagatcgtcatcttcagcgagctgctgaggaagggcagcctgaccccaggctacatgttcaagaggagcatcaagatgaactacctggtgctggaggagaatgtggacaatgacccctgcaagtttgccctgatgaaccgggagaccagcgagcgggtggtgctgcaggccgccaatgctgacatccagcaggcctgggtgcaggacatcaaccaggtgctggagacccagagggacttcctgaatgccctgcagagccccatcgagtaccagaggaaggagaggagcacagctgtgatgaggagccagcctgcccggctgccccaggccagcccccggccctacagctctgtgcctgctggcagcgagaagccacccaagggcagcagctacaacccccccctgccccccctgaagatcagcaccagcaatggcagccctggctttgagtaccaccagcccggggacaagtttgaggccagcaagcagaatgacctgggcggctgcaatggcaccagctccatggccgtcatcaaggactactatgccctgaaggaaaatgagatctgtgtgtcccagggcgaggtggtgcaggtgctggccgtgaaccagcagaacatgtgcctggtgtaccagcctgccagtgaccacagccctgctgctgagggctgggtgcccggcagcatcctggcccccctgaccaaggccacagctgctgagagcagtgatggcagcatcaagaagagctgctcctggcacaccctgaggatgaggaagagagctgaggtggagaacacaggcaagaatgaggccaccggccccaggaagcccaaggacatcctgggcaacaaggtgtctgtgaaggagaccaacagcagcgaggagagtgaatgtgatgacctggaccccaacacctccatggagatcctgaaccccaacttcatccaggaggtggcccctgagttcctggtgcccctggtggatgtgacctgcctgctgggggacaccgtcatcctgcagtgcaaggtgtgtggccggcccaagcccaccatcacctggaagggccctgaccagaacatcctggacacagacaacagcagcgccacctacacagtgagcagctgtgacagcggggagatcaccctgaagatctgcaacctgatgccccaggacagcggcatctacacctgcatcgccaccaatgaccacggcaccaccagcaccagcgccaccgtgaaggtgcagggcgtgcctgctgcccccaaccggcccatcgcccaggagaggagctgcaccagcgtcatcctgcgctggctgccccccagcagcacaggcaactgcaccatcagcggctacacagtggagtaccgggaggagggcagccagatctggcagcagagcgtggccagcaccctggacacctacctggtgattgaggacctgagccctggctgcccctaccagttccgggtgtctgccagcaacccctggggcatcagcctgcccagcgagcccagcgagtttgtgcggctgcctgaatatgatgctgctgctgatggagccaccatctcctggaaggaaaattttgattctgcctacacagagctgaatgaaattggccggggccgcttcagcatcgtgaagaagtgcatccacaaggccaccaggaaggatgtggccgtgaagtttgtgtccaagaagatgaagaagaaggagcaggccgcccacgaggccgccctgctgcagcacctgcagcacccccagtacatcaccctgcatgacacctatgagagccccaccagctacatcctgatcctggagctgatggatgatggccgcctgctggactacctgatgaaccatgatgagctgatggaggagaaggtggccttctacatccgggacatcatggaggccctgcagtacctgcacaactgccgggtggcccacctggacatcaagccagagaacctgctgattgacctgcgcatccctgtgccccgggtgaagctgattgacctggaggatgctgtgcagatcagcggccacttccacatccaccacctgctgggcaaccctgagtttgctgcccctgaggtgatccagggcatccctgtgtccctgggcacagacatctggagcattggagtgctgacctacgtgatgctgagcggcgtgagccccttcctggatgagagcaaggaggagacctgcatcaacgtgtgccgggtggacttctccttcccccatgagtacttctgtggggtgtccaatgctgcccgggacttcatcaacgtcatcctgcaggaggacttcagaagaagacccacagctgccacctgcctgcagcacccctggctgcagccccacaacggcagctacagcaagatccccctggacaccagccggctggcctgcttcatcgagaggaggaagcaccagaatgatgtgcggcccatccccaacgtgaagagctacatcgtgaacagagtgaaccagggcacctag

SEQ ID NO: 156723 - DNA, 4965 bp, Artificial Sequence
  Description of Artificial Sequence: Synthetic coding sequence
atgacagaccgcttctgggaccagtggtacctgtggtacctgcggctgctgcggctgctggaccggggcagcttcagaaatgatggcctgaaggccagtgatgtgctgcccatcctgaaggagaaggtggcctttgtgtctgggggccgggacaagaggggcggccccatcctgaccttccctgcccggagcaaccacgaccgcatccggcaggaggacctgaggaagctggtgacctacctggcctctgtgcccagtgaagatgtgtgcaagaggggcttcaccgtcatcatcgacatgaggggcagcaagtgggacctgatcaagcccctgctgaagaccctgcaggaggccttccctgctgagatccacgtggccctgatcatcaagccagacaacttctggcagaagcagaagaccaactttggcagcagcaagttcatctttgagacctccatggtgtctgtggagggcctgaccaagctggtggaccccagccagctgacagaggagtttgatggcagcctggactacaaccacgaggagtggattgagctgcggctgagcctggaggagttcttcaacagcgctgtgcacctgctgagccggctggaggacctgcaggagatgctggccaggaaggagttccctgtggatgtggagggcagccggcggctgattgatgagcacacccagctgaagaagaaggtgctgaaggcccctgtggaggagctggaccgggagggccagaggctgctgcagtgcatccgctgcagtgatggcttctctggaagaaactgcatccctggcagcgctgacttccagagcctggtgcccaagatcaccagcctgctggacaagctgcacagcacccggcagcacctgcaccagatgtggcacgtgaggaagctgaagctggaccagtgcttccagctgcggctgtttgagcaggatgctgagaagatgtttgactggatcagccacaacaaggagctgttcctgcagagccacacagaaattggagtgtcctaccagtatgccctggacctgcagacccagcacaaccactttgccatgaacagcatgaatgcctacgtgaacatcaaccgcatcatgtctgtggccagccggctgtctgaggccggccactacgccagccagcagatcaagcagatcagcacccagctggaccaggagtggaagagctttgctgctgccctggatgagaggagcaccatcctggccatgtctgctgtgttccaccagaaggccgagcagttcctgtctggagtggatgcctggtgcaagatgtgcagcgagggcggcctgcccagcgagatgcaggacctggagctggccatccaccaccaccagaccctgtatgagcaggtgacccaggcctacacagaggtgtcccaggacggcaaggccctgctggatgtgctgcagaggcccctgagccctggcaacagcgagagcctgacagccacagccaactacagcaaggctgtgcaccaggtgctggatgtggtgcatgaggtgctgcaccaccagaggcggctggagagcatctggcagcacaggaaggtgcggctgcaccagaggctgcagctgtgtgtgttccagcaggatgtgcagcaggtgctggactggattgaaaatcatggagaggccttcctgagcaagcacactggagtgggcaagagcctgcaccgggcccgggccctgcagaagagacatgatgactttgaggaggtggcccagaacacctacaccaatgctgacaagctgctggaggccgctgagcagctggcccagacaggagaatgtgaccctgaggagatctacaaggccgcccggcacctggaggtgcgcatccaggactttgtgagaagagtggagcagaggaagctgctgctggacatgtctgtgtccttccacacccacaccaaggagctgtggacctggatggaggacctgcagaaggagatgctggaggatgtgtgtgccgacagcgtggatgctgtgcaggagctgatcaagcagttccagcagcagcagacagccaccctggatgccaccctgaatgtcatcaaggagggggaggacctgatccagcagctgcggagcgccccacccagcctgggggagcccagcgaggcccgggacagcgctgtgagcaacaacaagaccccccacagcagcagcatcagccacatcgagagcgtgctgcagcagctggatgatgcccaggtgcagatggaggagctgttccacgagaggaagatcaagctggacatcttcctgcagctgcgcatctttgagcagtacaccatcgaggtgacagctgagctggatgcctggaatgaagacctgctgcggcagatgaatgacttcaacacagaggacctgaccctggccgagcagaggctgcagaggcacacagagaggaagctggccatgaacaacatgacctttgaggtgatccagcagggccaggacctgcaccagtacatcacagaggtgcaggccagcggcatcgagctgatctgtgagaaggacatcgacctggccgcccaggtgcaggagctgctggagttcctgcacgagaagcagcacgagctggagctgaatgctgagcagacccacaagaggctggagcagtgcctgcagctgcggcacctgcaggccgaggtgaagcaggtgctgggctggatcagaaatggagagagcatgctgaatgccagcctggtgaatgccagcagcctgtctgaggccgagcagctgcagcgggagcacgagcagttccagctggccatcgagaagacccaccagagcgccctgcaggtgcagcagaaggccgaggtgctgctgcaggccggccactatgatgctgatgccatccgggagtgtgccgagaaggtggccctgcactggcagcagctgatgctgaagatggaggaccggctgaagctggtgaatgcctctgtggccttctacaagaccagcgagcaggtgtgcagcgtgctggagagcctggagcaggagtacagaagagatgaggactggtgtggcggccgggacaagctgggccctgctgctgagattgaccacgtgatccccctcatcagcaagcacctggagcagaaggaggccttcctgaaggcctgcaccctggccaggagaaatgctgaggtgttcctgaagtacatccacagaaataatgtgtccatgcccagcgtggccagccacacccggggccctgagcagcaggtgaaggccatcctgtctgagctgctgcagagagaaaatagagtgctgcacttctggaccctgaagaagaggcggctggaccagtgccagcagtatgtggtgtttgagaggtctgccaagcaggccctggactggatccaggagaccggggagttctacctgagcacccacaccagcactggagagaccacagaggagacccaggagctgctgaaggagtatggagagttccgggtgcctgccaagcagaccaaggagaaggtgaagctgctgatccagctggccgacagctttgtggagaagggccacatccacgccacagagatcaggaagtgggtgaccaccgtggacaagcactacagagacttcagcctgaggatgggcaagtaccgctacagcctggagaaggccctgggcgtgaacacagaggacaacaaggacctggagctggacatcatcccagccagcctgagtgaccgggaggtgaagctgagagatgccaaccacgaggtgaatgaggagaagaggaagagcgccaggaagaaggagttcatcatggccgagctgctgcagacagagaaggcctacgtgcgggacctgcatgaatgtctggagacctacctgtgggagatgaccagcggcgtggaggagatccccccaggcatcctgaacaaggagcacatcatctttggaaacatccaggagatctatgacttccacaacaacatcttcctgaaggagctggagaagtatgagcagctgcctgaagatgtgggccactgctttgtgacctgggccgacaagttccagatgtatgtgacctactgcaagaacaagccagacagcaaccagctgatcctggagcacgccggcaccttctttgatgagatccagcagagacatggcctggccaacagcatcagcagctacctgatcaagcctgtgcagaggatcaccaagtaccagctgctgctgaaggagctgctgacctgctgtgaggagggcaaaggagagctgaaggatggcctggaggtgatgctgtctgtgcccaagaaggccaatgatgccatgcacgtgtccatgctggagggctttgatgagaacctggatgtgcagggcgagctgatcctgcaggatgccttccaggtgtgggaccccaagagcctcatcaggaagggccgggagcggcacctgttcctgtttgagatcagcctggtgttcagcaaggagatcaaggacagcagcggccacaccaagtatgtgtacaagaacaagctgctgaccagcgagctgggcgtgacagaacatgtggagggggacccctgcaagtttgccctgtggagcggccgcacccccagcagtgacaacaagacagtgctgaaggccagcaacatcgagaccaagcaggagtggatcaagaacatccgggaggtgatccaggagcgcatcatccacctgaagggggccctgaaggagcccctgcagctgcccaagaccccagccaagcagaggaacaacagcaagagagatggagtggaggacatcgacagccagggagatggcagcagccagcctgacaccatcagcatcgccagcaggaccagccagaacacagtggacagcgacaaggatggcaacctggtgccccgctggcacctgggccctggggaccccttcagcacctacgtgtag

SEQ ID NO: 156724 - DNA, 789 bp, Artificial Sequence
  Description of Artificial Sequence: Synthetic coding sequence
atgtggttcctggtgctgtgcctggccctgagcctgggcggcactggagctgccccacccatccagagcagaattgtgggcggctgggagtgtgagcagcacagccagccctggcaggccgccctgtaccacttcagcaccttccagtgtggcggcatcctggtgcaccggcagtgggtgctgacagctgcccactgcatcagtgacaactaccagctgtggctgggccgccacaacctgtttgatgatgagaacacagcccagtttgtgcacgtgtctgagagcttcccccaccctggcttcaacatgagcctgctggagaaccacacccggcaggctgatgaggactacagccatgacctgatgctgctgcggctgacagagcctgctgacaccatcacagatgctgtgaaggtggtggagctgcccacagaggagcctgaggtgggcagcacctgcctggccagcggctggggcagcattgagcctgagaacttctccttcccagatgacctgcagtgtgtggacctgaagatcctgcccaatgatgagtgcaagaaggcccacgtgcagaaggtgacagacttcatgctgtgtgtgggccacctggagggcggcaaggacacctgtgtgggggacagcggcggccccctgatgtgtgatggagtgctgcagggcgtgacctcctggggctacgtgccctgtggcacccccaacaagcccagcgtggccgtgcgggtgctgtcctatgtgaagtggattgaggacaccatcgccgagaacagctag

SEQ ID NO: 156725 - DNA, 483 bp, Artificial Sequence
  Description of Artificial Sequence: Synthetic coding sequence
atgagcctgctggagaaccacacccggcaggctgatgaggactacagccatgacctgatgctgctgcggctgacagagcctgctgacaccatcacagatgctgtgaaggtggtggagctgcccacagaggagcctgaggtgggcagcacctgcctggccagcggctggggcagcattgagcctgagaacttctccttcccagatgacctgcagtgtgtggacctgaagatcctgcccaatgatgagtgcaagaaggcccacgtgcagaaggtgacagacttcatgctgtgtgtgggccacctggagggcggcaaggacacctgtgtgggggacagcggcggccccctgatgtgtgatggagtgctgcagggcgtgacctcctggggctacgtgccctgtggcacccccaacaagcccagcgtggccgtgcgggtgctgtcctatgtgaagtggattgaggacaccatcgccgagaacagctag

SEQ ID NO: 156726 - DNA, 1917 bp, Artificial Sequence
  Description of Artificial Sequence: Synthetic coding sequence
atgatcctcttcaagcaggccacctacttcatcagcctgtttgccaccgtgtcctgtggctgcctgacccagctgtatgaaaatgccttcttcagaggaggagatgtggcctccatgtacaccccaaatgcccagtactgccagatgcgctgcaccttccacccccgctgcctgctcttctccttcctgcctgccagcagcatcaatgacatggagaagagatttggctgcttcctgaaggacagcgtgacaggcaccctgcccaaggtgcacaggactggagctgtgtctggccacagcctgaagcagtgtggccaccagatcagcgcctgccaccgggacatctacaagggcgtggacatgagaggagtgaacttcaacgtgtccaaggtgtcctctgtggaggagtgccagaagcgctgcaccagcaacatccgctgccagttcttctcctatgccacccagaccttccacaaggccgagtacagaaacaactgcctgctgaagtacagccctgggggcacccccacagccatcaaggtgctgagcaatgtggagagcggcttcagcctgaagccctgtgccctgtctgaaattggctgccacatgaacatcttccagcacctggccttcagtgatgtggatgtggcccgggtgctgaccccagatgcctttgtgtgcaggaccatctgcacctaccaccccaactgcctcttcttcaccttctacaccaacgtgtggaagattgagagccagagaaatgtgtgcctgctgaagaccagcgagagcggcacccccagcagcagcaccccccaggagaacaccatcagcggctacagcctgctgacctgcaagaggaccctgcctgagccctgccacagcaagatctacccaggagtggactttggaggagaggagctgaatgtgacctttgtgaagggcgtgaatgtgtgccaggagacctgcaccaagatgatccgctgccagttcttcacctacagcctgctgcctgaggactgcaaggaggagaagtgcaagtgcttcctgcggctgtccatggatggcagccccacccgcatcgcctacggcacccagggcagcagcggctacagcctgcggctgtgcaacacaggagacaacagcgtgtgcaccaccaagaccagcaccagaattgtgggcggcaccaacagctcctggggcgagtggccctggcaggtgtccctgcaggtgaagctgacagcccagaggcacctgtgtggcggcagcctcatcggccaccagtgggtgctgacagctgcccactgctttgatggcctgcccctgcaggatgtgtggaggatctacagcggcatcctgaacctgagtgacatcaccaaggacacccccttcagccagatcaaggagatcatcatccaccagaactacaaggtgtctgagggcaaccacgacatcgccctgatcaagctgcaggcccccctgaactacacagagttccagaagcccatctgcctgcccagcaaaggagacaccagcaccatctacaccaactgctgggtgacaggctggggcttcagcaaggagaagggggagatccagaacatcctgcagaaggtgaacatccccctggtgaccaatgaggagtgccagaagcgctaccaggactacaagatcacccagaggatggtgtgtgccggctacaaggagggcggcaaggatgcctgcaagggggacagcggcggccccctggtgtgcaagcacaacggcatgtggaggctggtgggcatcacctcctggggcgagggctgtgcccggcgggagcagcccggggtgtacaccaaggtggccgagtacatggactggatcctggagaagacccagagcagtgatggcaaggcccagatgcagagccctgcctag

SEQ ID NO: 156727 - DNA, 1545 bp, Artificial Sequence
  Description of Artificial Sequence: Synthetic coding sequence
atgtacaccccaaatgcccagtactgccagatgcgctgcaccttccacccccgctgcctgctcttctccttcctgcctgccagcagcatcaatgacatggagaagagatttggctgcttcctgaaggacagcgtgacaggcaccctgcccaaggtgcacaggactggagctgtgtctggccacagcctgaagcagtgtggccaccagatcagcgcctgccaccgggacatctacaagggcgtggacatgagaggagtgaacttcaacgtgtccaaggtgtcctctgtggaggagtgccagaagcgctgcaccagcaacatccgctgccagttcttctcctatgccacccagaccttccacaaggccgagtacagaaacaactgcctgctgaagtacagccctgggggcacccccacagccatcaaggtgctgagcaatgtggagagcggcttcagcctgaagccctgtgccctgtctgaaattggctgccacatgaacatcttccagcacctggccttcagtgatgtggatgtggcccgggtgctgaccccagatgcctttgtgtgcaggaccatctgcacctaccaccccaactgcctcttcttcaccttctacaccaacgtgtggaagattgagagccagagaaatgtgtgcctgctgaagaccagcgagagcggcacccccagcagcagcaccccccaggagaacaccatcagcggctacagcctgctgacctgcaagaggaccctgcctgagccctgccacagcaagatctacccaggagtggactttggaggagaggagctgaatgtgacctttgtgaagggcgtgaatgtgtgccaggagacctgcaccaagatgatccgctgccagttcttcacctacagcctgctgcctgaggactgcaaggaggagaagtgcaagtgcttcctgcggctgtccatggatggcagccccacccgcatcgcctacggcacccagggcagcagcggctacagcctgcggctgtgcaacacaggagacaacagcgtgtgcaccaccaagaccagcaccagaattgtgggcggcaccaacagctcctggggcgagtggccctggcaggtgtccctgcaggtgaagctgacagcccagaggcacctgtgtggcggcagcctcatcggccaccagtgggtgctgacagctgcccactgctttgatggcctgcccctgcaggatgtgtggaggatctacagcggcatcctgaacctgagtgacatcaccaaggacacccccttcagccagatcaaggagatcatcatccaccagaactacaaggtgtctgagggcaaccacgacatcgccctgatcaagctgcaggcccccctgaactacacagagttccagaagcccatctgcctgcccagcaaaggagacaccagcaccatctacaccaactgctgggtgacaggctggggcttcagcaaggagaagggccgcttccgctggagcctgagcctgcagacccagtggaatgtggcctttggaggccaccaccagctgggctag

SEQ ID NO: 156728 - DNA, 447 bp, Artificial Sequence
  Description of Artificial Sequence: Synthetic coding sequence
atgatcctcttcaagcaggccacctacttcatcagcctgtttgccaccgtgtcctgtggctgcctgacccagctgtatgaaaatgccttcttcagaggaggagatgtggcctccatgtacaccccaaatgcccagtactgccagatgcgctgcaccttccacccccgctgcctgctcttctccttcctgcctgccagcagcatcaatgacatggagaagagatttggctgcttcctgaaggacagcgtgacaggcaccctgcccaaggtgcacaggactggagctgtgtctggccacagcctgaagcagtgtggccaccagatcagcgcctgccaccgggacatctacaagggcgtggacatgagaggagtgaacttcaacgtgtccaaggtgtcctctgtggaggagtgccagaagcgctgcaccagcaacatccgctgccagtag

SEQ ID NO: 156729 - DNA, 753 bp, Artificial Sequence
  Description of Artificial Sequence: Synthetic coding sequence
atgaggatcctgcagctgatcctgctggccctggccaccggcctggtgggcggggagacccgcatcatcaagggctttgagtgcaagccccacagccagccctggcaggccgccctgtttgagaagacccggctgctgtgtggggccaccctcatcgccccccgctggctgctgacagctgcccactgcctgaagccccgctacatcgtgcacctgggccagcacaacctgcagaaggaggagggctgtgagcagaccaggacagccacagagagcttcccccaccctggcttcaacaacagcctgcccaacaaggaccacagaaatgacatcatgctggtgaagatggccagccctgtgtccatcacctgggccgtgcggcccctgaccctgagcagccgctgtgtgacagctggcaccagctgcctgatcagcggctggggcagcaccagcagcccccagctgcggctgccccacaccctgcgctgtgccaacatcaccatcatcgagcaccagaagtgtgaaaatgcctacccaggcaacatcacagacaccatggtgtgtgcctctgtgcaggagggcggcaaggacagctgccagggcgacagcggcggccccctggtgtgcaaccagagcctgcagggcatcatctcctggggccaggacccctgtgccatcaccaggaagccaggagtgtacaccaaggtgtgcaagtatgtggactggatccaggagaccatgaagaacaactag

SEQ ID NO: 156730 - DNA, 849 bp, Artificial Sequence
  Description of Artificial Sequence: Synthetic coding sequence
atgcagaggctgcgctggctgcgggactggaagagcagcggccggggcctgacagctgccaaggagcccggggcccggagcagccccctgcaggccatgaggatcctgcagctgatcctgctggccctggccaccggcctggtgggcggggagacccgcatcatcaagggctttgagtgcaagccccacagccagccctggcaggccgccctgtttgagaagacccggctgctgtgtggggccaccctcatcgccccccgctggctgctgacagctgcccactgcctgaagccccgctacatcgtgcacctgggccagcacaacctgcagaaggaggagggctgtgagcagaccaggacagccacagagagcttcccccaccctggcttcaacaacagcctgcccaacaaggaccacagaaatgacatcatgctggtgaagatggccagccctgtgtccatcacctgggccgtgcggcccctgaccctgagcagccgctgtgtgacagctggcaccagctgcctgatcagcggctggggcagcaccagcagcccccagctgcggctgccccacaccctgcgctgtgccaacatcaccatcatcgagcaccagaagtgtgaaaatgcctacccaggcaacatcacagacaccatggtgtgtgcctctgtgcaggagggcggcaaggacagctgccagggcgacagcggcggccccctggtgtgcaaccagagcctgcagggcatcatctcctggggccaggacccctgtgccatcaccaggaagccaggagtgtacaccaaggtgtgcaagtatgtggactggatccaggagaccatgaagaacaactag

SEQ ID NO: 156731 - DNA, 828 bp, Artificial Sequence
  Description of Artificial Sequence: Synthetic coding sequence
atgaggatcctgcagctgatcctgctggccctggccaccggcctggtgggcggggagacccgcatcatcaagggctttgagtgcaagccccacagccagccctggcaggccgccctgtttgagaagacccggctgctgtgtggggccaccctcatcgccccccgctggctgctgacagctgcccactgcctgaagccctgggtgtccctgaccagccccacccacgtgtccccagacctgagcagcagcaactactgcctgagccacctgagccgctacatcgtgcacctgggccagcacaacctgcagaaggaggagggctgtgagcagaccaggacagccacagagagcttcccccaccctggcttcaacaacagcctgcccaacaaggaccacagaaatgacatcatgctggtgaagatggccagccctgtgtccatcacctgggccgtgcggcccctgaccctgagcagccgctgtgtgacagctggcaccagctgcctgatcagcggctggggcagcaccagcagcccccagctgcggctgccccacaccctgcgctgtgccaacatcaccatcatcgagcaccagaagtgtgaaaatgcctacccaggcaacatcacagacaccatggtgtgtgcctctgtgcaggagggcggcaaggacagctgccagggcgacagcggcggccccctggtgtgcaaccagagcctgcagggcatcatctcctggggccaggacccctgtgccatcaccaggaagccaggagtgtacaccaaggtgtgcaagtatgtggactggatccaggagaccatgaagaacaactag

SEQ ID NO: 156732 - DNA, 753 bp, Artificial Sequence; identical to SEQ ID NO: 156729
  Description of Artificial Sequence: Synthetic coding sequence

SEQ ID NO: 156733 - DNA, 849 bp, Artificial Sequence; identical to SEQ ID NO: 156730
  Description of Artificial Sequence: Synthetic coding sequence

SEQ ID NO: 156734 - DNA, 765 bp, Artificial Sequence
  Description of Artificial Sequence: Synthetic coding sequence
atgggcctgagcatcttcctgctgctgtgtgtgctgggcctgagccaggccgccacccccaagatcttcaacggcacagaatgtggcaggaacagccagccctggcaggtgggcctgtttgagggcaccagcctgcgctgtggcggcgtgctgattgaccaccgctgggtgctgacagctgcccactgcagcggcagccgctactgggtgcggctgggggagcacagcctgagccagctggactggacagagcagatccgccacagcggcttctctgtgacccaccctggctacctgggcgccagcaccagccatgaacatgacctgcggctgctgcggctgcggctgcctgtgcgggtgaccagctctgtgcagcccctgcccctgcccaatgactgtgccacagctggaacagaatgtcatgtgtctggctggggcatcaccaaccaccccaggaaccccttcccagacctgctgcagtgcctgaacctgagcatcgtgtcccatgccacctgccacggcgtgtacccaggccgcatcaccagcaacatggtgtgtgccggcggcgtgcccggccaggatgcctgccagggcgacagcggcggccccctggtgtgtggcggcgtgctgcagggcctggtgtcctggggctctgtgggcccctgtggccaggacggcatccctggggtgtacacctacatctgcaacagcaccctggtgggcctgggcacctcctggaacttcaacagctgccagcccttctag

SEQ ID NO: 156735 - DNA, 435 bp, Artificial Sequence
  Description of Artificial Sequence: Synthetic coding sequence
atggccctgtctgtgggcgtgacccacagccggggccgctggggctgcctgcgggccccagcctgtgccgccggcgtgtccctgctgaccactggaggcagcagccagaggctgacagctgctgctgaccccttcccagacctgctgcagtgcctgaacctgagcatcgtgtcccatgccacctgccacggcgtgtacccaggccgcatcaccagcaacatggtgtgtgccggcggcgtgcccggccaggatgcctgccagggcgacagcggcggccccctggtgtgtggcggcgtgctgcagggcctggtgtcctggggctctgtgggcccctgtggccaggacggcatccctggggtgtacacctacatctgcaacagcaccctggtgggcctgggcacctcctggaacttcaacagctgccagcccttctag

SEQ ID NO: 156736 - DNA, 747 bp, Artificial Sequence
  Description of Artificial Sequence: Synthetic coding sequence
atgggcctgagcatcttcctgctgctgtgtgtgctgggcctgagccaggccgccacccccaagatcttcaacggcacagaatgtggcaggaacagccagccctggcaggtgggcctgtttgagggcaccagcctgcgctgtggcggcgtgctgattgaccaccgctgggtgctgacagctgcccactgcagcggcagccgctactgggtgcggctgggggagcacagcctgagccagctggactggacagagcagatccgccacagcggcttctctgtgacccaccctggctacctgggcgccagcaccagccatgaacatgacctgcggctgctgcggctgcggctgcctgtgcgggtgaccagctctgtgcagcccctgcccctgcccaatgactgtgccacagctggaacagaatgtcatgtgtctggctggggcatcaccaaccaccccaggaaccccttcccagacctgctgcagtgcctgaacctgagcatcgtgtcccatgccacctgccacggcgtgtacccaggccgcatcaccagcaacatggtgtgtgccggcggcgtgcccggccaggatgcctgccagggcgacagcggcggccccctggtgtgtggcggcgtgctgcagggcctggtgtcctggggctctgtgggcccctgtggccaggacggcatccctggggtgtacacctacatctgcaagtatgtggactggatccgcatgatcatgaggaacaactag

SEQ ID NO: 156737 - DNA, 747 bp, Artificial Sequence; identical to SEQ ID NO: 156736
  Description of Artificial Sequence: Synthetic coding sequence

SEQ ID NO: 156738 - DNA, 336 bp, Artificial Sequence
  Description of Artificial Sequence: Synthetic coding sequence
atgggcctgagcatcttcctgctgctgtgtgtgctgggcctgagccaggccgccacccccaagatcttcaacggcacagaatgtggcaggaacagccagccctggcaggtgggcctgtttgagggcaccagcctgcgctgtggcggcgtgctgattgaccaccgctgggtgctgacagctgcccactgcagcggccggcccatccctggcagcgcccctgtgccccagcccctgcaccggctgccctgccacctgccctggtgtgtgtcccgggagaaccacgagcagcacggcgtgtgcagaagaagacctggggccggctgcctgcccggctag

SEQ ID NO: 156739 - DNA, 834 bp, Artificial Sequence
  Description of Artificial Sequence: Synthetic coding sequence
atgtggcccctggccctggtgattgccagcctgaccctggccctgagcggcggcgtgtcccaggagagcagcaaggtgctgaacaccaacggcaccagcggcttcctgcccggcggctacacctgcttcccccacagccagccctggcaggccgccctgctggtgcagggccgcctgctgtgtggcggcgtgctggtgcaccccaagtgggtgctgacagctgcccactgcctgaaggagggcctgaaggtgtacctgggcaagcacgccctgggccgggtggaggccggggagcaggtgcgggaggtggtgcacagcatcccccaccctgagtacagaagaagccccacccacctgaaccacgaccatgacatcatgctgctggagctgcagagccctgtgcagctgaccggctacatccagaccctgcccctgagccacaacaaccggctgaccccaggcaccacctgccgggtgtctggctggggcaccaccaccagcccccaggtgaactaccccaagaccctgcagtgtgccaacatccagctgcggagtgatgaggagtgccggcaggtgtacccaggcaagatcacagacaacatgctgtgtgccggcaccaaggagggcggcaaggacagctgtgagggggacagcggcggccccctggtgtgcaacagaaccctgtatggaattgtgtcctggggagacttcccctgtggccagcctgacaggcctggggtgtacaccagggtgagccgctacgtgctgtggatccgggagaccatcagaaaatatgagacccagcagcagaagtggctgaagggcccccagtag

SEQ ID NO: 156740 - DNA, 378 bp, Artificial Sequence
  Description of Artificial Sequence: Synthetic coding sequence
atgtggcccctggccctggtgattgccagcctgaccctggccctgagcggcgtgaactaccccaagaccctgcagtgtgccaacatccagctgcggagtgatgaggagtgccggcaggtgtacccaggcaagatcacagacaacatgctgtgtgccggcaccaaggagggcggcaaggacagctgtgagggggacagcggcggccccctggtgtgcaacagaaccctgtatggaattgtgtcctggggagacttcccctgtggccagcctgacaggcctggggtgtacaccagggtgagccgctacgtgctgtggatccgggagaccatcagaaaatatgagacccagcagcagaagtggctgaagggcccccagtag

SEQ ID NO: 156741 - DNA, 297 bp, Artificial Sequence
  Description of Artificial Sequence: Synthetic coding sequence
atgggcctcatctacaagtgcctgcctgagaaggtgacagtgaacatcgagacccgctgcctgcccggggtcttccagggcagccagcaccagtgggaccagtgggtgagcccccgctggctgcacctgctgccccccctgagcgccctggccggctgccccaccagcgcccgggccgccaccctgtggggcagccctggccccccccagatgggcccccactgcaggaccctgagcaagggcggggcccagagcctgccccggcaggcccggccccgggcctgtggctcctggtag

SEQ ID NO: 156742 - DNA, 282 bp, Artificial Sequence
  Description of Artificial Sequence: Synthetic coding sequence
atgtggcccctggccctggtgattgccagcctgaccctggccctgtctggaggagaggacttcaaggagcccagccagggccccagagatgtgatggccgccagcaggcctgaggccttccccaagggcctgaccctggagcccaggcctgagaagggcggcatctgtggctgcctggcccctggcaccatcctgggcctgaaggtgggctggctgttcagcagcggggacaccccctggatccacgcccgggccaccccagagtgccacaccctgggctag

SEQ ID NO: 156743 - DNA, 834 bp, Artificial Sequence; identical to SEQ ID NO: 156739
  Description of Artificial Sequence: Synthetic coding sequence

SEQ ID NO: 156744 - DNA, 804 bp, Artificial Sequence
  Description of Artificial Sequence: Synthetic coding sequence
atgagcctgcgggtgctgggcagcggcacctggcccagcgcccccaagatgttcctgctgctgacagccctgcaggtgctggccatcgccatgacccagagccaggaggatgagaacaagatcatcggcggccacacctgcaccaggagcagccagccctggcaggccgccctgctggccggcccccggcggcgcttcctgtgtggcggggccctgctgagcggccagtgggtgatcacagctgcccactgcggccggcccatcctgcaggtggccctgggcaagcacaacctgcggcgctgggaggccacccagcaggtgctgcgggtggtgcggcaggtgacccaccccaactacaacagcaggacccatgacaatgacctgatgctgctgcagctgcagcagcctgccagaattggccgggctgtgcggcccatcgaggtgacccaggcctgtgccagccctggcaccagctgccgggtgtctggctggggcaccatcagcagccccatcgcccgctacccagccagcctgcagtgtgtgaacatcaacatcagcccagatgaggtgtgccagaaggcctaccccaggaccatcaccccaggcatggtgtgtgccggcgtgccccagggcggcaaggacagctgccagggcgacagcggcggccccctggtgtgccggggccagctgcagggcctggtgtcctggggcatggagcgctgtgccctgcccggctacccaggagtgtacaccaacctgtgcaagtaccgctcctggattgaggagaccatgagggacaagtag

SEQ ID NO: 156745 - DNA, 804 bp, Artificial Sequence; identical to SEQ ID NO: 156744
  Description of Artificial Sequence: Synthetic coding sequence

SEQ ID NO: 156746 - DNA, 804 bp, Artificial Sequence; identical to SEQ ID NO: 156744
  Description of Artificial Sequence: Synthetic coding sequence

SEQ ID NO: 156747 - DNA, 486 bp, Artificial Sequence
  Description of Artificial Sequence: Synthetic coding sequence
atgtggctgctgctgaccctgtccttcctgctggccagcacagctgcccaggatggagacaagctgctggagggagatgaatgtgccccccacagccagccctggcaggtggccctgtatgaaagaggccgcttcaactgtggggccagcctcatcagcccccactgggtgctgtctgctgcccactgccagagccgcttcatgagggtgcggctgggggagcacaacctgaggaagagagatggccctgagcagctgcggaccaccagcagggtcatcccccaccccaggtatgaggcccggagccacagaaatgacatcatgctgctgcggctggtgcagcctgcccggctgaacccccaggtgcggcctgctgtgctgcccacccgctgcccccaccctggagaggcctgtgtggtgtctggctggggcctggtgagccacaatgaacctggaacagctggcagccccaggagccagggctag

SEQ ID NO: 156748 - DNA, 771 bp, Artificial Sequence
  Description of Artificial Sequence: Synthetic coding sequence
atgtggctgctgctgaccctgtccttcctgctggccagcacagctgcccaggatggagacaagctgctggagggagatgaatgtgccccccacagccagccctggcaggtggccctgtatgaaagaggccgcttcaactgtggggccagcctcatcagcccccactgggtgctgtctgctgcccactgccagagccgcttcatgagggtgcggctgggggagcacaacctgaggaagagagatggccctgagcagctgcggaccaccagcagggtcatcccccaccccaggtatgaggcccggagccacagaaatgacatcatgctgctgcggctggtgcagcctgcccggctgaacccccaggtgcggcctgctgtgctgcccacccgctgcccccaccctggagaggcctgtgtggtgtctggctggggcctggtgagccacaatgaacctggaacagctggcagccccaggagccaggtgtccctgcctgacaccctgcactgtgccaacatcagcatcatcagtgacaccagctgtgacaagagctacccaggccgcctgaccaacaccatggtgtgtgccggggctgagggccgcggggctgagagctgtgagggggacagcggcggccccctggtgtgtggcggcatcctgcagggcatcgtgtcctggggagatgtgccctgtgacaacaccaccaagccaggagtgtacaccaaggtgtgccactacctggagtggatccgggagaccatgaagagaaattag

SEQ ID NO: 156749 - DNA, 516 bp, Artificial Sequence
  Description of Artificial Sequence: Synthetic coding sequence
atgtggctgctgctgaccctgtccttcctgctggccagcacagctgcccaggatggagacaagctgctggagggagatgaatgtgccccccacagccagccctggcaggtggccctgtatgaaagaggccgcttcaactgtggggccagcctcatcagcccccactgggtgctgtctgctgcccactgccagagccgcttcatgagggtgcggctgggggagcacaacctgaggaagagagatggccctgagcagctgcggaccaccagcagggtcatcccccaccccaggtatgaggcccggagccacagaaatgacatcatgctgctgcggctggtgcagcctgcccggctgaacccccagggcgacagcggcggccccctggtgtgtggcggcatcctgcagggcatcgtgtcctggggagatgtgccctgtgacaacaccaccaagccaggagtgtacaccaaggtgtgccactacctggagtggatccgggagaccatgaagaggaactag

SEQ ID NO: 156750 - DNA, 489 bp, Artificial Sequence
  Description of Artificial Sequence: Synthetic coding sequence
atgtggctgctgctgaccctgtccttcctgctggccagcacagctgcccaggatggagacaagctgctggagggagatgaatgtgccccccacagccagccctggcaggtggccctgtatgaaagaggccgcttcaactgtggggccagcctcatcagcccccactgggtgctgtctgctgcccactgccagagccgcttcatgagggtgcggctgggggagcacaacctgaggaagagagatggccctgagcagctgcggaccaccagcagggtcatcccccaccccaggtatgaggcccggagccacagaaatgacatcatgctgctgcggctggtgcagcctgcccggctgaacccccaggtgcggcctgctgtgctgcccacccgctgcccccaccctggagaggcctgtgtggtgtctggctggggcctggtgagccacaatgaacctggaacagctggcagccccaggagccagggcgcctag

SEQ ID NO: 156751 - DNA, 771 bp, Artificial Sequence; identical to SEQ ID NO: 156748
  Description of Artificial Sequence: Synthetic coding sequence

SEQ ID NO: 156752 - DNA, 786 bp, Artificial Sequence
  Description of Artificial Sequence: Synthetic coding sequence
atgtgggacctggtgctgagcatcgccctgtctgtgggctgcacaggagctgtgcccctcatccagagcagaattgtgggcggctgggagtgtgagaagcacagccagccctggcaggtggccgtgtacagccacggctgggcccactgcggcggcgtgctggtgcacccccagtgggtgctgacagctgcccactgcctgaagaagaacagccaggtgtggctgggccgccacaacctgtttgagcctgaggacaccggccagagggtgcctgtgagccacagcttcccccaccccctgtacaacatgagcctgctgaagcaccagagcctgcggccagatgaggacagcagccatgacctgatgctgctgcggctgtctgagcccgccaagatcacagatgtggtgaaggtgctgggcctgcccacccaggagcccgccctgggcaccacctgctacgccagcggctggggcagcattgagcctgaggagttcctgcggcccaggagcctgcagtgtgtgtccctgcacctgctgagcaatgacatgtgtgcccgggcctacagcgagaaggtgacagagttcatgctgtgtgccggcctgtggacaggaggcaaggacacctgtggcggggacagcggcggccccctggtgtgcaatggagtgctgcagggcatcacctcctggggccctgagccctgtgccctgcctgagaagccagctgtgtacaccaaggtggtgcactacaggaagtggatcaaggacaccatcgccgccaacccctag

SEQ ID NO: 156753 - DNA, 672 bp, Artificial Sequence
  Description of Artificial Sequence: Synthetic coding sequence
atgtgggacctggtgctgagcatcgccctgtctgtgggctgcacaggagctgtgcccctcatccagagcagaattgtgggcggctgggagtgtgagaagcacagccagccctggcaggtggccgtgtacagccacggctgggcccactgcggcggcgtgctggtgcacccccagtgggtgctgacagctgcccactgcctgaagaagaacagccaggtgtggctgggccgccacaacctgtttgagcctgaggacaccggccagagggtgcctgtgagccacagcttcccccaccccctgtacaacatgagcctgctgaagcaccagagcctgcggccagatgaggacagcagccatgacctgatgctgctgcggctgtctgagcccgccaagatcacagatgtggtgaaggtgctgggcctgcccacccaggagcccgccctgggcaccacctgctacgccagcggctggggcagcattgagcctgaggagttcctgcggcccaggagcctgcagtgtgtgtccctgcacctgctgagcaatgacatgtgtgcccgggcctacagcgagaaggtgacagagttcatgctgtgtgccggcctgtggacaggaggcaaggacacctgtggggtgagccacccctacagccagcacctggagggcaagggctag

SEQ ID NO: 156754 - DNA, 480 bp, Artificial Sequence
  Description of Artificial Sequence: Synthetic coding sequence
atgagcctgctgaagcaccagagcctgcggccagatgaggacagcagccatgacctgatgctgctgcggctgtctgagcccgccaagatcacagatgtggtgaaggtgctgggcctgcccacccaggagcccgccctgggcaccacctgctacgccagcggctggggcagcattgagcctgaggagttcctgcggcccaggagcctgcagtgtgtgtccctgcacctgctgagcaatgacatgtgtgcccgggcctacagcgagaaggtgacagagttcatgctgtgtgccggcctgtggacaggaggcaaggacacctgtggcggggacagcggcggccccctggtgtgcaatggagtgctgcagggcatcacctcctggggccctgagccctgtgccctgcctgagaagccagctgtgtacaccaaggtggtgcactacaggaagtggatcaaggacaccatcgccgccaacccctag

SEQ ID NO: 156755 - DNA, 786 bp, Artificial Sequence
  Description of Artificial Sequence: Synthetic coding sequence
atgtgggtgcctgtggtgttcctgaccctgtctgtgacctggattggagctgcccccctcatcctgagcagaattgtgggcggctgggagtgtgagaagcacagccagccctggcaggtgctggtggccagccggggccgggctgtgtgtggcggcgtgctggtgcacccccagtgggtgctgacagctgcccactgcatccggaacaagagcgtcatcctgctgggccgccacagcctcttccaccctgaggacaccggccaggtgttccaggtgagccacagcttcccccaccccctgtatgacatgagcctgctgaagaaccgcttcctgcggcctggagatgacagcagccatgacctgatgctgctgcggctgtctgagcctgctgagctgacagatgctgtgaaggtgatggacctgcccacccaggagcccgccctgggcaccacctgctacgccagcggctggggcagcattgagcctgaggagttcctgacccccaagaagctgcagtgtgtggacctgcacgtgatcagcaatgatgtgtgtgcccaggtgcacccccagaaggtgaccaagttcatgctgtgtgccggccgctggacaggaggcaagagcacctgcagcggggacagcggcggccccctggtgtgcaatggagtgctgcagggcatcacctcctggggcagcgagccctgtgccctgcctgagcggcccagcctgtacaccaaggtggtgcactacaggaagtggatcaaggacaccatcgtggccaacccctag

SEQ ID NO: 156756 - DNA, 663 bp, Artificial Sequence
  Description of Artificial Sequence: Synthetic coding sequence
atgtgggtgcctgtggtgttcctgaccctgtctgtgacctggattggagctgcccccctcatcctgagcagaattgtgggcggctgggagtgtgagaagcacagccagccctggcaggtgctggtggccagccggggccgggctgtgtgtggcggcgtgctggtgcacccccagtgggtgctgacagctgcccactgcatccggaacaagagcgtcatcctgctgggccgccacagcctcttccaccctgaggacaccggccaggtgttccaggtgagccacagcttcccccaccccctgtatgacatgagcctgctgaagaaccgcttcctgcggcctggagatgacagcagcattgagcctgaggagttcctgacccccaagaagctgcagtgtgtggacctgcacgtgatcagcaatgatgtgtgtgcccaggtgcacccccagaaggtgaccaagttcatgctgtgtgccggccgctggacaggaggcaagagcacctgcagcggggacagcggcggccccctggtgtgcaatggagtgctgcagggcatcacctcctggggcagcgagccctgtgccctgcctgagcggcccagcctgtacaccaaggtggtgcactacaggaagtggatcaaggacaccatcgtggccaacccctag

SEQ ID NO: 156757 - DNA, 717 bp, Artificial Sequence
  Description of Artificial Sequence: Synthetic coding sequence
atgtgggtgcctgtggtgttcctgaccctgtctgtgacctggattggagctgcccccctcatcctgagcagaattgtgggcggctgggagtgtgagaagcacagccagccctggcaggtgctggtggccagccggggccgggctgtgtgtggcggcgtgctggtgcacccccagtgggtgctgacagctgcccactgcatccggaacaagagcgtcatcctgctgggccgccacagcctcttccaccctgaggacaccggccaggtgttccaggtgagccacagcttcccccaccccctgtatgacatgagcctgctgaagaaccgcttcctgcggcctggagatgacagcagccatgacctgatgctgctgcggctgtctgagcctgctgagctgacagatgctgtgaaggtgatggacctgcccacccaggagcccgccctgggcaccacctgctacgccagcggctggggcagcattgagcctgaggagttcctgacccccaagaagctgcagtgtgtggacctgcacgtgatcagcaatgatgtgtgtgcccaggtgcacccccagaaggtgaccaagttcatgctgtgtgccggccgctggacaggaggcaagagcacctgctcctgggtgatcctgatcacagagctgaccatgcctgccctgcccatggtgctgcacggcagcctggtgccctggagaggaggagtgtag

SEQ ID NO: 156758 - DNA, 657 bp, Artificial Sequence
  Description of Artificial Sequence: Synthetic coding sequence
atgtgggtgcctgtggtgttcctgaccctgtctgtgacctggattggagctgcccccctcatcctgagcagaattgtgggcggctgggagtgtgagaagcacagccagccctggcaggtgctggtggccagccggggccgggctgtgtgtggcggcgtgctggtgcacccccagtgggtgctgacagctgcccactgcatcaggaagccaggagatgacagcagccatgacctgatgctgctgcggctgtctgagcctgctgagctgacagatgctgtgaaggtgatggacctgcccacccaggagcccgccctgggcaccacctgctacgccagcggctggggcagcattgagcctgaggagttcctgacccccaagaagctgcagtgtgtggacctgcacgtgatcagcaatgatgtgtgtgcccaggtgcacccccagaaggtgaccaagttcatgctgtgtgccggccgctggacaggaggcaagagcacctgcagcggggacagcggcggccccctggtgtgcaatggagtgctgcagggcatcacctcctggggcagcgagccctgtgccctgcctgagcggcccagcctgtacaccaaggtggtgcactacaggaagtggatcaaggacaccatcgtggccaacccctag

SEQ ID NO: 156759 - DNA, 210 bp, Artificial Sequence
  Description of Artificial Sequence: Synthetic coding sequence
atgtgggtgcctgtggtgttcctgaccctgtctgtgacctggattggagctgcccccctcatcctgagcagaattgtgggcggctgggagtgtgagaagcacagccagccctggcaggtgctggtggccagccggggccgggctgtgtgtggcggcgtgctggtgcacccccagtgggtgctgacagctgcccactgcatcaggaagtag

SEQ ID NO: 156760 - DNA, 765 bp, Artificial Sequence
  Description of Artificial Sequence: Synthetic coding sequence
atggccacagctggcaacccctggggctggttcctgggctacctgatcctgggcgtggccggcagcctggtgtctggcagctgcagccagatcatcaatggagaggactgcagcccccacagccagccctggcaggccgccctggtgatggagaatgagctgttctgcagcggcgtgctggtgcacccccagtgggtgctgtctgctgcccactgcttccagaacagctacaccatcggcctgggcctgcacagcctggaggccgaccaggagcccggcagccagatggtggaggccagcctgtctgtgcgccaccctgagtacaaccggcccctgctggccaatgacctgatgctgatcaagctggatgaatctgtgtctgagagtgacaccatccgcagcatcagcatcgccagccagtgccccacagctggcaacagctgcctggtgtctggctggggcctgctggccaacggccgcatgcccaccgtgctgcagtgtgtgaatgtgtctgtggtgtctgaggaggtgtgcagcaagctgtatgaccccctgtaccaccccagcatgttctgtgccggcggcggccatgaccagaaggacagctgcaatggagacagcggcggccccctcatctgcaatggctacctgcagggcctggtgtcctttgggaaggccccctgtggccaggtgggcgtgcctggggtgtacaccaacctgtgcaagttcacagagtggattgagaagacagtgcaggccagctag

SEQ ID NO: 156761 - DNA, 333 bp, Artificial Sequence
  Description of Artificial Sequence: Synthetic coding sequence
atggagaatgaactcttctgcagcggcgtgctggtgcacccccagtgggtgctgtctgctgcccactgcttccagaacagctacaccatcggcctgggcctgcacagcctggaggccgaccaggagcccggcagccagatggtggaggccagcctgtctgtgcgccaccctgagtacaaccggcccctgctggccaatgacctgatgctgatcaagctggatgagagcgtgtctgagagtgacaccatccgcagcatcagcatcgccagccagtgccccacagctggcaacagctgcctggtgtctggctggggcctgctggccaatggatag

SEQ ID NO: 156762 - DNA, 735 bp, Artificial Sequence
  Description of Artificial Sequence: Synthetic coding sequence
atgaagaagctgatggtggtgctgagcctgattgctgctgcctgggccgaggagcagaacaagctggtgcacggcggcccctgtgacaagaccagccacccctaccaggccgccctgtacaccagcggccacctgctgtgtggcggcgtgctgatccaccccctgtgggtgctgacagctgcccactgcaagaagcccaacctgcaggtgttcctgggcaagcacaacctgcggcagcgggagagcagccaggagcagagctctgtggtgcgggccgtcatccacccagactatgatgctgccagccatgaccaggacatcatgctgctgcggctggcccggcctgccaagctgtctgagctgatccagcccctgcccctggagcgggactgcagcgccaacaccaccagctgccacatcctgggctggggcaagacagcagatggagacttcccagacaccatccagtgtgcctacatccacctggtgtcccgggaggagtgtgagcacgcctacccaggccagatcacccagaacatgctgtgtgctggagatgagaagtatggcaaggacagctgccagggcgacagcggcggccccctggtgtgtggggaccacctgcggggcctggtgtcctggggcaacatcccctgtggcagcaaggagaagccaggagtgtacaccaacgtgtgccgctacaccaactggatccagaagaccatccaggccaagtag

SEQ ID NO: 156763 - DNA, 735 bp, Artificial Sequence; identical to SEQ ID NO: 156762
  Description of Artificial Sequence: Synthetic coding sequence

SEQ ID NO: 156764 - DNA, 363 bp, Artificial Sequence
  Description of Artificial Sequence: Synthetic coding sequence
atgaagaagctgatggtggtgctgagcctgattgctgctgcctgggccgaggagcagaacaagctggtgcacggcggcccctgtgacaagaccagccacccctaccaggccgccctgtacaccagcggccacctgctgtgtggcggcgtgctgatccaccccctgtgggtgctgacagctgcccactgcaagaagcctgtgatcctgggcgtgcgctggtacgtggagaccaccagcgaggccctgtgccacggcgtgaccagccctgtggaccagaggaggagccaggagagcacccccaccagcgctgacaccaggacaggcagcaagaagcccttccggcccagcgaccctgacatgtag

SEQ ID NO: 156765 - DNA, 414 bp, Artificial Sequence
  Description of Artificial Sequence: Synthetic coding sequence
atgctgctgcggctggcccggcctgccaagctgtctgagctgatccagcccctgcccctggagcgggactgcagcgccaacaccaccagctgccacatcctgggctggggcaagacagcagatggagacttcccagacaccatccagtgtgcctacatccacctggtgtcccgggaggagtgtgaacatgcctacccaggccagatcacccagaacatgctgtgtgctggagatgagaagtatggcaaggacagctgccagggcgacagcggcggccccctggtgtgtggggaccacctgcggggcctggtgtcctggggcaacatcccctgtggcagcaaggagaagccaggagtgtacaccaacgtgtgccgctacaccaactggatccagaagaccatccaggccaagtag

SEQ ID NO: 156766 - DNA, 123 bp, Artificial Sequence
  Description of Artificial Sequence: Synthetic coding sequence
atgaagaagctgatggtggtgctgagcctgattgctgctggcatcttccgcagctcctggggcagcatcaccttcggcaagggccgggtgcccaggagccgggtgctgctgagcggcctgtag

SEQ ID NO: 156767 - DNA, 414 bp, Artificial Sequence; identical to SEQ ID NO: 156765
  Description of Artificial Sequence: Synthetic coding sequence

SEQ ID NO: 156768 - DNA, 783 bp, Artificial Sequence
  Description of Artificial Sequence: Synthetic coding sequence
atgggccggccccggccccgggccgccaagacctggatgttcctgctgctgctgggcggggcctgggccggccacagccgggcccaggaggacaaggtgctgggcggccacgagtgccagccccacagccagccctggcaggccgccctcttccagggccagcagctgctgtgtggcggcgtgctggtgggcggcaactgggtgctgacagctgcccactgcaagaagcccaagtacacagtgcggctgggggaccacagcctgcagaacaaggatggccctgagcaggagatccctgtggtgcagagcatcccccacccctgctacaacagcagtgatgtggaggaccacaaccacgacctgatgctgctgcagctgcgggaccaggccagcctgggcagcaaggtgaagcccatcagcctggccgaccactgcacccagcccggccagaagtgcaccgtgtctggctggggcaccgtgaccagcccccgggagaacttcccagacaccctgaactgtgccgaggtgaagatcttcccccagaagaagtgtgaagatgcctacccaggccagatcacagatggcatggtgtgtgccggcagcagcaaaggagctgacacctgccagggcgacagcggcggccccctggtgtgtgatggagccctgcagggcatcacctcctggggcagtgacccctgtggccgcagtgacaagccaggagtgtacaccaacatctgccgctacctggactggatcaagaagatcatcggcagcaaaggatag

SEQ ID NO: 156769 - DNA, 99 bp, Artificial Sequence
  Description of Artificial Sequence: Synthetic coding sequence
atgggccggccccggccccgggccgccaagacctggatgttcctgctgctgctgggcggggcctgggccggccgcttctggaggcctcctggggtgtag

SEQ ID NO: 156770 - DNA, 360 bp, Artificial Sequence
  Description of Artificial Sequence: Synthetic coding sequence
atgggccggccccggccccgggccgccaagacctggatgttcctgctgctgctgggcggggcctgggccgagaacttcccagacaccctgaactgtgccgaggtgaagatcttcccccagaagaagtgtgaagatgcctacccaggccagatcacagatggcatggtgtgtgccggcagcagcaaaggagctgacacctgccagggcgacagcggcggccccctggtgtgtgatggagccctgcagggcatcacctcctggggcagtgacccctgtggccgcagtgacaagccaggagtgtacaccaacatctgccgctacctggactggatcaagaagatcatcggcagcaagggctag

SEQ ID NO: 156771 - DNA, 918 bp, Artificial Sequence
  Description of Artificial Sequence: Synthetic coding sequence
atgggccggccccggccccgggccgccaagacctggatgttcctgctgctgctgggcggggcctgggccgcctgtggcagcctggacctgctgaccaagctgtatgcagagaacctgccctgtgtgcacctgaacccccagtggcccagccagcccagccactgcccccggggctggaggagcaaccccctgcccccagctgctggccacagccgggcccaggaggacaaggtgctgggcggccacgagtgccagccccacagccagccctggcaggccgccctcttccagggccagcagctgctgtgtggcggcgtgctggtgggcggcaactgggtgctgacagctgcccactgcaagaagcccaagtacacagtgcggctgggggaccacagcctgcagaacaaggatggccctgagcaggagatccctgtggtgcagagcatcccccacccctgctacaacagcagtgatgtggaggaccacaaccacgacctgatgctgctgcagctgcgggaccaggccagcctgggcagcaaggtgaagcccatcagcctggccgaccactgcacccagcccggccagaagtgcaccgtgtctggctggggcaccgtgaccagcccccgggagaacttcccagacaccctgaactgtgccgaggtgaagatcttcccccagaagaagtgtgaagatgcctacccaggccagatcacagatggcatggtgtgtgccggcagcagcaaaggagctgacacctgccagggcgacagcggcggccccctggtgtgtgatggagccctgcagggcatcacctcctggggcagtgacccctgtggccgcagtgacaagccaggagtgtacaccaacatctgccgctacctggactggatcaagaagatcatcggcagcaagggctag

SEQ ID NO: 156772 - DNA, 783 bp, Artificial Sequence; identical to SEQ ID NO: 156768
  Description of Artificial Sequence: Synthetic coding sequence

SEQ ID NO: 156773 - DNA, 753 bp, Artificial Sequence
  Description of Artificial Sequence: Synthetic coding sequence
atgaagctgggcctgctgtgtgccctgctgagcctgctggccggccacggctgggccgacacccgggccatcggggctgaggagtgccggcccaacagccagccctggcaggccggcctcttccacctgaccaggctcttctgtggggccaccctcatcagtgaccgctggctgctgacagctgcccactgcaggaagccctacctgtgggtgcggctgggggagcaccacctgtggaagtgggagggccctgagcagctgttccgggtgacagacttcttcccccaccctggcttcaacaaggacctgagcgccaatgaccacaatgatgacatcatgctgatccggctgccccggcaggcccggctgagccctgctgtgcagcccctgaacctgagccagacctgtgtgtccccaggcatgcagtgcctgatcagcggctggggcgctgtgagcagccccaaggccctcttccctgtgaccctgcagtgtgccaacatcagcatcctggagaacaagctgtgccactgggcctacccaggccacatcagtgacagcatgctgtgtgccggcctgtgggagggcggccggggcagctgccagggcgacagcggcggccccctggtgtgcaatggcaccctggccggcgtggtgtctggaggagctgagccctgcagccggcccaggaggcctgctgtgtacacctctgtgtgccactacctggactggatccaggagatcatggagaactag

SEQ ID NO: 156774 - DNA, 753 bp, Artificial Sequence; identical to SEQ ID NO: 156773
  Description of Artificial Sequence: Synthetic coding sequence

SEQ ID NO: 156775 - DNA, 186 bp, Artificial Sequence
  Description of Artificial Sequence: Synthetic coding sequence
atgaagctgggcctgctgtgtgccctgctgagcctgctggccggcatctgtggcagcgccctggagagcaccaccagcggaaatggccgggtgcgcagcagctgcagcggcctgcggaccagcagccccaccctggccagcaccaggaccagcgcccccatgaccaccatgatgaccagctgctag

SEQ ID NO: 156776 - DNA, 2043 bp, Artificial Sequence
  Description of Artificial Sequence: Synthetic coding sequence
atggtgcctggggtgcctggagctgtgctgaccctgtgcctgtggctggccgccagcagcggctgcctggccgccggccctggagctgctgctgcccggcggctggatgagagcctgtctgctggctctgtgcagagggcccgctgtgccagccgctgcctgagcctgcagatcacccgcatcagcgccttcttccagcacttccagaacaacggcagcctggtgtggtgccagaaccacaagcagtgcagcaagtgcctggagccctgcaaggagagcggggacctgaggaagcaccagtgccagagcttctgtgagcccctcttccccaagaagagctatgaatgtctgaccagctgtgagttcctgaagtacatcctgctggtgaagcagggcgactgcccagcccctgagaaggccagcggctttgctgctgcctgtgtggagagctgtgaggtggacaatgaatgttctggagtgaagaagtgctgcagcaatggctgcggccacacctgccaggtgcccaagaccctgtacaagggcgtgcccctgaagcccaggaaggagctgcgcttcacagagctgcagagcggccagctggaggtgaagtggagcagcaagttcaacatcagcattgagcccgtcatctacgtggtgcagaggcgctggaactacggcatccaccccagtgaagatgatgccacccactggcagacagtggcccagaccacagatgagcgggtgcagctgacagacatccggcccagccgctggtaccagttccgggtggccgctgtgaatgtgcacggcacccggggcttcaccgcccccagcaagcacttccgcagcagcaaggaccccagcgcccccccagccccagccaacctgcggctggccaacagcacagtgaacagtgatggctctgtgacagtgaccatcgtgtgggacctgcctgaggagccagacatccctgtgcaccactacaaggtgttctggagctggatggtgagcagcaagagcctggtgcccaccaagaagaagaggaggaagaccacagatggcttccagaacagcgtcatcctggagaagctgcagcctgactgtgactatgtggtggagctgcaggccatcacctactggggccagacccggctgaagagcgccaaggtgtccctgcacttcaccagcacccacgccaccaacaacaaggagcagctggtgaagaccaggaaaggaggcatccagacccagctgcccttccagaggagaagacccacccggcccctggaggtgggcgcccccttctaccaggacggccagctgcaggtgaaggtgtactggaagaagacagaggaccccaccgtgaaccgctaccacgtgcgctggttccctgaggcctgtgcccacaacagaaccactggaagtgaggccagcagcggcatgacccatgagaactacatcatcctgcaggacctgtccttcagctgcaagtacaaggtgacagtgcagcccatccggcccaagagccacagcaaggccgaggccgtgttcttcaccaccccaccctgcagcgccctgaagggcaagagccacaagcctgtgggctgcctgggggaggccggccacgtgctgagcaaggtgctggccaagccagagaacctgagcgccagcttcatcgtgcaggatgtgaacatcaccggccacttctcctggaagatggccaaggccaacctgtaccagcccatgacaggcttccaggtgacctgggccgaggtgaccacagagagccggcagaacagcctgcccaacagcatcatcagccagagccagatcctgcccagcgaccactacgtgctgactgtgcccaacctgcggcccagcaccctgtaccgcctggaggtgcaggtgctgaccccaggaggagagggccctgccaccatcaagaccttccgcaccccagagctgccccccagcagcgcccacaggagccacctgaagcaccgccacccccaccactacaagcccagccctgagcgctactag

SEQ ID NO: 156777 - DNA, 2631 bp, Artificial Sequence
  Description of Artificial Sequence: Synthetic coding sequence
atggagctgatcaccatcctggagaagacagtgtccccagaccggctggagctggaggccgcccagaagttcctggagagagctgctgtggagaacctgcccaccttcctggtggagctgagccgggtgctggccaaccctggcaacagccaggtggcccgggtggccgccggcctgcagatcaagaacagcctgaccagcaaggaccctgacatcaaggcccagtaccagcagcgctggctggccattgatgccaatgcccggcgggaggtgaagaactacgtgctgcagaccctgggcacagagacctaccggcccagcagcgccagccagtgtgtggccggcatcgcctgtgccgagatccctgtgaaccagtggccagagctgatcccccagctggtggccaacgtgaccaaccccaacagcacagagcacatgaaggagagcaccctggaggccatcggctacatctgccaggacattgatcctgagcagctgcaggacaagagcaatgagatcctgacagccatcatccagggcatgaggaaggaggagcccagcaacaacgtgaagctggccgccaccaatgccctgctgaacagcctggagttcaccaaggccaactttgacaaggagagcgagcggcacttcatcatgcaggtggtgtgtgaggccacccagtgcccagacaccagggtgcgggtggccgccctgcagaacctggtgaagatcatgagcctgtactaccagtacatggagacctacatgggccctgccctgtttgccatcaccatcgaggccatgaagagtgacattgatgaggtggccctgcagggcatcgagttctggagcaatgtgtgtgatgaggagatggacctggccatcgaggccagcgaggccgctgagcagggccggcccccagagcacaccagcaagttctacgccaagggggccctgcagtacctggtgcccatcctgacccagaccctgaccaagcaggatgaaaatgatgatgatgatgactggaacccctgcaaggccgccggcgtgtgcctgatgctgctggccacctgctgtgaagatgacatcgtgccccacgtgctgcccttcatcaaggagcacatcaagaacccagactggagatacagagatgctgctgtgatggccttcggctgcatcctggagggccctgagcccagccagctgaagcccctggtgatccaggccatgcccaccctcatcgagctgatgaaggaccccagcgtggtggtgcgggacacagctgcctggacagtgggccgcatctgtgagctgctgcctgaggccgccatcaatgatgtgtacctggcccccctgctgcagtgcctgattgagggcctgtctgctgagccccgggtggccagcaatgtgtgctgggccttcagcagcctggccgaggccgcctatgaggccgcagatgtggctgatgaccaggaggagcccgccacctactgcctgagcagcagctttgagctgattgtgcagaagctgctggagaccacagacagaccagatggccaccagaacaacctgcggagcagcgcctatgagagcctgatggagatcgtgaagaacagcgccaaggactgctacccagctgtgcagaagaccaccctggtgatcatggagcggctgcagcaggtgctgcagatggagagccacatccagagcaccagtgaccgcatccagttcaatgacctgcagagcctgctgtgtgccaccctgcagaatgtgctgaggaaggtgcagcaccaggatgccctgcagatcagtgatgtggtgatggccagcctgctgaggatgttccagagcacagctggcagcggaggagtgcaggaggatgccctgatggctgtgtccaccctggtggaggtgctgggcggggagttcctgaagtacatggaggccttcaagcccttcctgggcatcggcctgaagaactatgcagagtaccaggtgtgcctggccgctgtgggcctggtgggggacctgtgccgggccctgcagagcaacatcatccccttctgtgatgaggtgatgcagctgctgctggagaacctgggcaatgaaaatgtgcacaggtctgtgaagccccagatcctgtctgtgtttggagacatcgccctggccatcggcggggagttcaagaagtacctggaggtggtgctgaacaccctgcagcaggccagccaggcccaggtggacaagagtgactatgacatggtggactacctgaatgagctgcgggagagctgcctggaggcctacacaggcatcgtgcagggcctgaagggggaccaggagaatgtgcacccagatgtgatgctggtgcagccccgggtggagttcatcctgtccttcatcgaccacatcgctggagatgaggaccacacagatggagtggtggcctgtgccgccggcctcatcggggacctgtgcacagccttcggcaaggatgtgctgaagctggtggaggcccggcccatgatccacgagctgctgacagagggcagaagaagcaagaccaacaaggccaagaccctggccacctgggccaccaaggagctgaggaagctgaagaaccaggcctag

SEQ ID NO: 156778 - DNA, 2196 bp, Artificial Sequence
  Description of Artificial Sequence: Synthetic coding sequence
atgaaggagagcaccctggaggccatcggctacatctgccaggacatcgaccctgagcagctgcaggacaagagcaatgagatcctgacagccatcatccagggcatgaggaaggaggagcccagcaacaacgtgaagctggccgccaccaatgccctgctgaacagcctggagttcaccaaggccaactttgacaaggagagcgagcggcacttcatcatgcaggtggtgtgtgaggccacccagtgcccagacaccagggtgcgggtggccgccctgcagaacctggtgaagatcatgagcctgtactaccagtacatggagacctacatgggccctgccctgtttgccatcaccatcgaggccatgaagagtgacattgatgaggtggccctgcagggcatcgagttctggagcaatgtgtgtgatgaggagatggacctggccatcgaggccagcgaggccgctgagcagggccggcccccagagcacaccagcaagttctacgccaagggggccctgcagtacctggtgcccatcctgacccagaccctgaccaagcaggatgaaaatgatgatgatgatgactggaacccctgcaaggctgctggggtgtgcctgatgctgctggccacctgctgtgaagatgacatcgtgccccacgtgctgcccttcatcaaggagcacatcaagaacccagactggagatacagagatgctgctgtgatggccttcggctgcatcctggagggccctgagcccagccagctgaagcccctggtgatccaggccatgcccaccctgattgagctgatgaaggaccccagcgtggtggtgcgggacacagctgcctggacagtgggccgcatctgtgagctgctgcctgaggccgccatcaatgatgtgtacctggcccccctgctgcagtgcctgattgagggcctgtctgctgagccccgggtggccagcaatgtgtgctgggccttcagcagcctggccgaggccgcctatgaagctgctgatgtggctgatgaccaggaggagcccgccacctactgcctgagcagcagctttgagctgattgtgcagaagctgctggagaccacagacagaccagatggccaccagaacaacctgcggagcagcgcctatgagagcctgatggagatcgtgaagaacagcgccaaggactgctacccagctgtgcagaagaccaccctggtgatcatggagcggctgcagcaggtgctgcagatggagagccacatccagagcaccagtgaccgcatccagttcaatgacctgcagagcctgctgtgtgccaccctgcagaatgtgctgaggaaggtgcagcaccaggatgccctgcagatcagtgatgtggtgatggccagcctgctgaggatgttccagagcacagctggcagcggcggcgtgcaggaggatgccctgatggctgtgtccaccctggtggaggtgctgggcggggagttcctgaagtacatggaggccttcaagcccttcctgggcatcggcctgaagaactatgcagagtaccaggtgtgcctggccgctgtgggcctggtgggggacctgtgccgggccctgcagagcaacatcatccccttctgtgatgaggtgatgcagctgctgctggagaacctgggcaatgaaaatgtgcacaggtctgtgaagccccagatcctgtctgtgtttggagacatcgccctggccatcggcggggagttcaagaagtacctggaggtggtgctgaacaccctgcagcaggccagccaggcccaggtggacaagagtgactatgacatggtggactacctgaatgagctgcgggagagctgcctggaggcctacacaggaattgtgcagggcctgaagggggaccaggagaatgtgcacccagatgtgatgctggtgcagccccgggtggagttcatcctgtccttcatcgaccacatcgctggagatgaggaccacacagatggagtggtggcctgtgccgccggcctgattggagacctgtgcacagccttcggcaaggatgtgctgaagctggtggaggcccggcccatgattcatgagctgctgacagagggccgccgcagcaagaccaacaaggccaagaccctggccacctgggccaccaaggagctgaggaagctgaagaaccaggcctag

SEQ ID NO: 156779 - DNA, 1983 bp, Artificial Sequence
  Description of Artificial Sequence: Synthetic coding sequence
atgaaggagagcaccctggaggccatcggctacatctgccaggacatcgaccctgagcagctgcaggacaagagcaatgagatcctgacagccatcatccagggcatgaggaaggaggagcccagcaacaacgtgaagctggccgccaccaatgccctgctgaacagcctggagttcaccaaggccaactttgacaaggagagcgagcggcacttcatcatgcaggtggtgtgtgaggccacccagtgcccagacaccagggtgcgggtggccgccctgcagaacctggtgaagatcatgagcctgtactaccagtacatggagacctacatgggccctgccctgtttgctgatgaaaatgatgatgatgatgactggaacccctgcaaggccgccggcgtgtgcctgatgctgctggccacctgctgtgaagatgacatcgtgccccacgtgctgcccttcatcaaggagcacatcaagaacccagactggagatacagagatgctgctgtgatggccttcggctgcatcctggagggccctgagcccagccagctgaagcccctggtgatccaggccatgcccaccctcatcgagctgatgaaggaccccagcgtggtggtgcgggacacagctgcctggacagtgggccgcatctgtgagctgctgcctgaggccgccatcaatgatgtgtacctggcccccctgctgcagtgcctgattgagggcctgtctgctgagccccgggtggccagcaatgtgtgctgggccttcagcagcctggccgaggccgcctatgaggccgcagatgtggctgatgaccaggaggagcccgccacctactgcctgagcagcagctttgagctgattgtgcagaagctgctggagaccacagacagaccagatggccaccagaacaacctgcggagcagcgcctatgagagcctgatggagatcgtgaagaacagcgccaaggactgctacccagctgtgcagaagaccaccctggtgatcatggagcggctgcagcaggtgctgcagatggagagccacatccagagcaccagtgaccgcatccagttcaatgacctgcagagcctgctgtgtgccaccctgcagaatgtgctgaggaaggtgcagcaccaggatgccctgcagatcagtgatgtggtgatggccagcctgctgaggatgttccagagcacagctggcagcggaggagtgcaggaggatgccctgatggctgtgtccaccctggtggaggtgctgggcggggagttcctgaagtacatggaggccttcaagcccttcctgggcatcggcctgaagaactatgcagagtaccaggtgtgcctggccgctgtgggcctggtgggggacctgtgccgggccctgcagagcaacatcatccccttctgtgatgaggtgatgcagctgctgctggagaacctgggcaatgaaaatgtgcacaggtctgtgaagccccagatcctgtctgtgtttggagacatcgccctggccatcggcggggagttcaagaagtacctggaggtggtgctgaacaccctgcagcaggccagccaggcccaggtggacaagagtgactatgacatggtggactacctgaatgagctgcgggagagctgcctggaggcctacacaggcatcgtgcagggcctgaagggggaccaggagaatgtgcacccagatgtgatgctggtgcagccccgggtggagttcatcctgtccttcatcgaccacatcgctggagatgaggaccacacagatggagtggtggcctgtgccgccggcctcatcggggacctgtgcacagccttcggcaaggatgtgctgaagctggtggaggcccggcccatgatccacgagctgctgacagagggcagaagaagcaagaccaacaaggccaagaccctggccacctgggccaccaaggagctgaggaagctgaagaaccaggcctag

SEQ ID NO: 156780 - DNA, 2196 bp, Artificial Sequence; identical to SEQ ID NO: 156778
  Description of Artificial Sequence: Synthetic coding sequence

SEQ ID NO: 156781 - DNA, 1617 bp, Artificial Sequence
  Description of Artificial Sequence: Synthetic coding sequence
atgaccacccctgggaaggagaacttccggctgaagagctacaagaacaagagcctgaacccagatgagatgagaagaagaagagaggaggagggcctgcagctgaggaagcagaagcgggaggagcagctgttcaagagaagaaatgtggccacagctgaggaggagacagaggaggaggtgatgtctgatggcggcttccacgaggcccagatcagcaacatggagatggcccctggaggagtcatcaccagtgacatgattgagatgatcttcagcaagagccctgagcagcagctgagcgccacccagaagttcaggaagctgctgagcaaggagcccaacccccccattgatgaagtcatcagcaccccaggagtggtggccaggtttgtggagttcctgaagaggaaagaaaactgcaccctgcagtttgaaagtgcctgggtgctgaccaacatcgccagcggcaacagcctgcagacccgcatcgtcatccaggccggggctgtgcccatcttcatcgagctgctgagcagcgagtttgaagatgtgcaggagcaggccgtgtgggccctgggcaacattgctggggacagcaccatgtgccgggactatgtgctggactgcaacatcctgccccccctgctgcagctgttcagcaagcagaaccggctgaccatgaccagaaatgctgtgtgggccctgagcaacctgtgccggggcaagagccccccacctgagtttgccaaggtgagcccctgcctgaatgtgctgtcctggctgctgtttgtgtctgacacagatgtgctggctgatgcctgctgggccctgagctacctgagtgatggccccaatgacaagatccaggccgtgattgatgctggggtgtgccggcggctggtggagctgctgatgcacaatgactacaaggtggtgtccccagccctgcgggctgtgggcaacatcgtgactggagatgacatccagacccaggtgatcctgaactgcagcgccctgcagagcctgctgcacctgctgagcagccccaaggagagcatcaagaaggaggcctgctggaccatcagcaacatcacagctggcaacagagcccagatccagacagtgattgatgccaacatcttccctgccctgatcagcatcctgcagacagctgagttccgcaccaggaaggaggccgcctgggccatcaccaatgccaccagcggcggcagcgctgagcagatcaagtacctggtggagctgggctgcatcaagcccctgtgtgacctgctgactgtgatggacagcaagatcgtgcaggtggccctgaatggcctggagaacatcctgcggctgggggagcaggaggccaagagaaatggaacaggcatcaacccctactgtgccctgattgaggaggcctacggcctggacaagattgagttcctgcagagccatgagaaccaggagatctaccagaaggcctttgacctgattgagcactacttcggcacagaagatgaggacagcagcatcgccccccaggtggacctgaaccagcagcagtacatcttccagcagtgtgaggcccccatggagggcttccagctgtag

SEQ ID NO: 156782 - DNA, 987 bp, Artificial Sequence
  Description of Artificial Sequence: Synthetic coding sequence
atgaccacccctgggaaggagaacttccggctgaagagctacaagaacaagagcctgaacccagatgagatgagaagaagaagagaggaggagggcctgcagctgaggaagcagaagcgggaggagcagctgttcaagagaagaaatgtggccacagctgaggaggagacagaggaggaggtgatgtctgatggcggcttccacgaggcccagatcagcaacatggagatggcccctggaggagtcatcaccagtgacatgattgagatgatcttcagcaagagccctgagcagcagctgagcgccacccagaagttcaggaagctgctgagcaaggagcccaacccccccattgatgaagtcatcagcaccccaggagtggtggccaggtttgtggagttcctgaagaggaaagaaaactgcaccctgcagtttgaaagtgcctgggtgctgaccaacatcgccagcggcaacagcctgcagacccgcatcgtcatccaggccggggctgtgcccatcttcatcgagctgctgagcagcgagtttgaagatgtgcaggagcaggccgtgtgggccctgggcaacattgctggggacagcaccatgtgccgggactatgtgctggactgcaacatcctgccccccctgctgcagctgttcagcaagcagaaccggctgaccatgaccagaaatgctgtgtgggccctgagcaacctgtgccggggcaagagccccccacctgagtttgccaaggtgagcccctgcctgaatgtgctgtcctggctgctgtttgtgtctgacacagatgtgctggctgatgcctgctgggccctgagctacctgagtgatggccccaatgacaagatccaggccgtgattgatgctggggtgtgccggcggctggtggagctgctgatgcacaatgactacaaggtggtgtccccagccctgcgggctgtgggcaacatcgtgactggagatgactag

SEQ ID NO: 156783 - DNA, 648 bp, Artificial Sequence
  Description of Artificial Sequence: Synthetic coding sequence
atgaccacccctgggaaggagaacttccggctgaagagctacaagaacaagagcctgaacccagatgagatgagaagaagaagagaggaggagggcctgcagctgaggaagcagaagcgggaggagcagctgttcaagagaagaaatgtggccacagctgaggaggagacagaggaggaggtgatgtctgatggcggcttccacgaggcccagatcagcaacatggagatggcccctggaggagtcatcaccagtgacatgattgagatgatcttcagcaagagccctgagcagcagctgagcgccacccagaagttcaggaagctgctgagcaaggagcccaacccccccattgatgaagtcatcagcaccccaggagtggtggccaggtttgtggagttcctgaagaggaaagaaaactgcaccctgcagtttgaaagtgcctgggtgctgaccaacatcgccagcggcaacagcctgcagacccgcatcgtcatccaggccggggctgtgcccatcttcatcgagctgctgagcagcgagtttgaagatgtgcaggagcaggccgtgtgggccctgggcaacattgctggggacagcaccatgtgccgggactatgtgctggactgcaacatcctgcccccatag

SEQ ID NO: 156784 - DNA, 525 bp, Artificial Sequence
  Description of Artificial Sequence: Synthetic coding sequence
atgaccacccctgggaaggagaacttccggctgaagagctacaagaacaagagcctgaacccagatgagatgagaagaagaagagaggaggagggcctgcagctgaggaagcagaagcgggaggagcagctgttcaagagaagaaatgtggccacagctgaggaggagacagaggaggaggtgatgtctgatggcggcttccacgaggcccagatcagcaacatggagatggcccctggaggagtcatcaccagtgacatgattgagatgatcttcagcaagagccctgagcagcagctgagcgccacccagaagttcaggaagctgctgagcaaggagcccaacccccccattgatgaagtcatcagcaccccaggagtggtggccaggtttgtggagttcctgaagaggaaagaaaactgcaccctgcagtttgaaagtgcctgggtgctgaccaacatcgccagcggcaacagcctgcagacccgcatcgtcatccaggccggggctgtgcccatcttctag

SEQ ID NO: 156785 - DNA, 1566 bp, Artificial Sequence
  Description of Artificial Sequence: Synthetic coding sequence
atggccgagaaccccagcctggagaaccaccgcatcaagagcttcaagaacaagggcagagatgtggagaccatgaggaggcacagaaatgaggtgacagtggagctgaggaagaacaagagagatgagcacctgctgaagaagagaaatgtgccccaggaggagagcctggaggacagtgatgtggatgctgacttcaaggcccagaatgtgaccctggaggccatcctgcagaatgccaccagtgacaaccctgtggtgcagctgtctgctgtgcaggccgccaggaagctgctgagcagtgacagaaatccacccattgatgacctgatcaagagcggcatcctgcccatcctggtgaagtgcctggagagagatgacaaccccagcctgcagtttgaagctgcctgggccctgaccaacatcgccagcggcaccagcgcccagacccaggccgtggtgcagagcaatgctgtgcccctcttcctgcggctgctgcggagcccccaccagaatgtgtgtgagcaggccgtgtgggccctgggcaacatcattggagatggcccccagtgccgggactatgtgatcagcctgggcgtggtgaagcccctgctgtccttcatcagccccagcatccccatcaccttcctgagaaatgtgacctgggtgattgtgaacctgtgcaggaacaaggaccccccaccacccatggagaccgtgcaggagatcctgcctgccctgtgtgtgctgatctaccacacagacatcaacatcctggtggacacagtgtgggccctgagctacctgacagatggcggcaatgagcagatccagatggtgattgattctggagtggtgcccttcctggtgcccctgctgagccaccaggaggtgaaggtgcagacagctgccctgcgggctgtgggcaacatcgtgactggaacagatgagcagacccaggtggtgctgaactgtgatgtgctgagccacttccccaacctgctgagccaccccaaggagaagatcaacaaggaggccgtgtggttcctgagcaacatcacagctggcaaccagcagcaggtgcaggccgtgattgatgctggcctcatccccatgatcatccaccagctggccaagggggactttggcacccagaaggaggccgcctgggccatcagcaacctgaccatcagcggcaggaaggaccaggtggagtacctggtgcagcagaatgtcatcccccccttctgcaacctgctgtctgtgaaggacagccaggtggtgcaggtggtgctggatggcctgaagaacatcctgatcatggctggagatgaggccagcaccatcgccgagatcattgaagaatgtggcggcctggagaagattgaggtgctgcagcagcatgaaaatgaagacatctacaagctggcctttgagatcatcgaccagtacttctctggagatgacattgatgaggacccctgcctgatccctgaggccacccagggcggcacctacaactttgaccccacagccaacctgcagaccaaggagttcaacttctag

SEQ ID NO: 156786 - DNA, 1566 bp, Artificial Sequence
  Description of Artificial Sequence: Synthetic coding sequence
atggctgacaatgagaagctggacaaccagaggctgaagaacttcaagaacaagggccgggacctggagaccatgaggcggcagagaaatgaggtggtggtggagctgaggaagaacaagagagatgagcacctgctgaagagaagaaatgtgccccatgaggacatctgtgaggacagcgacattgatggagactacagagtgcagaacaccagcctggaggccatcgtgcagaatgccagcagtgacaaccagggcatccagctgtctgctgtgcaggccgccaggaagctgctgagcagtgacagaaatccacccattgatgacctgatcaagagcggcatcctgcccatcctggtgcactgcctggagagagatgacaaccccagcctgcagtttgaagctgcctgggccctgaccaacatcgccagcggcaccagcgagcagacccaggccgtggtgcagagcaatgctgtgcccctcttcctgcggctgctgcacagcccccaccagaatgtgtgtgagcaggccgtgtgggccctgggcaacatcattggagatggcccccagtgccgggactatgtgatcagcctgggcgtggtgaagcccctgctgtccttcatcagccccagcatccccatcaccttcctgagaaatgtgacctgggtgatggtgaacctgtgccgccacaaggaccccccaccacccatggagaccatccaggagatcctgcctgccctgtgtgtgctgatccaccacacagatgtgaacatcctggtggacacagtgtgggccctgagctacctgacagatgctggaaatgagcagatccagatggtgattgattctggaattgtgccccacctggtgcccctgctgagccaccaggaggtgaaggtgcagacagctgccctgcgggctgtgggcaacatcgtgactggaacagatgagcagacccaggtggtgctgaactgtgatgccctgagccacttccctgccctgctgacccaccccaaggagaagatcaacaaggaggccgtgtggttcctgagcaacatcacagctggcaaccagcagcaggtgcaggccgtgattgatgccaacctggtgcccatgatcatccacctgctggacaagggggactttggcacccagaaggaggccgcctgggccatcagcaacctgaccatcagcggcaggaaggaccaggtggcctacctgatccagcagaatgtcatcccccccttctgcaacctgctgactgtgaaggatgcccaggtggtgcaggtggtgctggatggcctgagcaacatcctgaagatggctgaagatgaggccgagaccatcggcaacctgattgaagaatgtggcggcctggagaagattgagcagctgcagaaccatgaaaatgaagacatctacaagctggcctatgagatcatcgaccagttcttcagcagtgatgacattgatgaggaccccagcctggtgcctgaggccatccagggcggcaccttcggcttcaacagcagcgccaacgtgcccacagagggcttccagttctag

SEQ ID NO: 156787 - DNA, 1551 bp, Artificial Sequence
  Description of Artificial Sequence: Synthetic coding sequence
atgcccaccctggatgcccctgaggagaggaggaggaagttcaagtaccggggcaaggatgtgtccctgcggcggcagcagaggatggctgtgtccctggagctgaggaaggccaagaaggatgagcagaccctgaagagaagaaacatcaccagcttctgcccagacaccccatctgagaagacagccaagggcgtggccgtgtccctgaccctgggggagatcatcaagggcgtgaacagcagtgaccctgtgctgtgcttccaggccacccagacagccaggaagatgctgagccaggagaagaacccccccctgaagctggtgattgaggccggcctcatccccaggatggtggagttcctgaagagcagcctgtacccctgcctgcagtttgaggccgcctgggccctgaccaacatcgccagcggcaccagcgagcagaccagggctgtggtggagggcggggccatccagcccctcatcgagctgctgagcagcagcaatgtggccgtgtgtgagcaggccgtgtgggccctgggcaacattgctggagatggccctgagttccgggacaacgtcatcaccagcaatgccatcccccacctgctggccctgatcagccccaccctgcccatcaccttcctgaggaacatcacctggaccctgagcaacctgtgcaggaacaagaacccctacccctgtgacacagctgtgaagcagatcctgcctgccctgctgcacctgctgcagcaccaggacagcgaggtgctgagtgatgcctgctgggccctgagctacctgacagatggcagcaacaagagaattggccaggtggtgaacacaggagtgctgccccggctggtggtgctgatgaccagcagcgagctgaatgtgctgacccccagcctgaggacagtgggcaacatcgtgactggaacagatgagcagacccagatggccattgatgctggcatgctgaatgtgctgccccagctgctgcagcacaacaagcccagcatccagaaggaggccgcctgggccctgagcaatgtggccgccggcccctgccaccacatccagcagctgctggcctatgatgtgctgccccccctggtggccctgctgaagaatggagagttcaaggtgcagaaggaggccgtgtggatggtggccaactttgccaccggggccaccatggaccagctgatccagctggtgcacagcggcgtgctggagcccctggtgaacctgctgacagccccagatgtgaagatcgtgctgatcatcctggatgtgatcagctgcatcctgcaggccgctgagaagaggtctgagaaggagaacctgtgcctgctgattgaggagctgggcggcatcgacagaattgaggccctgcagctgcacgagaaccggcagatcggccagagcgccctgaacatcatcgagaagcactttggagaggaggaggatgagagccagaccctgctgagccaggtgattgaccaggactatgagttcatcgactatgaatgtctggccaagaagtag

SEQ ID NO: 156788 - DNA, 3318 bp, Artificial Sequence
  Description of Artificial Sequence: Synthetic coding sequence
atggccgccatggccccagccctgacagatgctgctgctgaggcccaccacatccgcttcaagctggccccacccagcagcaccctgagccctggcagcgcagaaaataatggaaatgccaacatcctgattgctgccaacggcaccaagaggaaggccatcgctgctgaggaccccagcctggacttcaggaacaaccccaccaaggaggacctgggcaagctgcagcccctggtggccagctacctgtgcagtgatgtgacctctgtgcccagcaaggagagcctgaagctgcagggcgtcttcagcaagcagacagtgctgaagagccaccccctgctgagccagagctatgagctgcgggcagagctgctgggccggcagcctgtgctggagttcagcctggagaacctgcggaccatgaacaccagcggccagacagccctgccccaggcccctgtgaatggcctggccaagaagctgaccaagagcagcacccacagcgaccatgacaacagcaccagcctgaatggaggcaagagggccctgaccagcagcgccctgcatggaggagagatgggcggcagcgagagcggggacctgaagggcggcatgaccaactgcaccctgccccacaggagcctggatgtggagcacaccaccctgtacagcaacaacagcacagccaacaagagctctgtgaacagcatggagcagcctgccctgcagggcagcagccggctgagccctggaacagacagcagcagcaacctgggcggcgtgaagctggagggcaagaagagccccctgagcagcatcctcttcagcgccctggacagcgacacccgcatcacagccctgctgcggcggcaggccgacatcgagagccgggcccggcggctgcagaagaggctgcaggtggtgcaggccaagcaggtggagcggcacatccagcaccagctgggcggcttcctggagaagaccctgagcaagctgcccaacctggagagcctgcggcccaggagccagctgatgctgaccaggaaggccgaggccgccctgaggaaggccgccagcgagaccaccaccagcgagggcctgagcaacttcctgaagagcaacagcatcagcgaggagctggagcgcttcaccgccagcggcatcgccaacctgcgctgcagcgagcaggcctttgacagtgatgtgacagacagcagcagtggaggagagagtgacatcgaggaggaggagctgaccagggctgaccctgagcagagacatgtgcccctgcggcggcgctctgagtggaagtgggccgctgacagagctgccatcgtgagccgctggaactggctgcaggcccacgtgtctgacctggagtaccgcatccggcagcagacagacatctacaagcagatccgggccaacaagggcctcatcgtgctgggggaggtgcccccacctgagcacaccacagacctcttcctgcccctgagcagcgaggtgaagacagaccacggcacagacaagctgattgagagcgtgtcccagcccctggagaaccacggggcccgcatcatcggccacatcagcgagagcctgagcaccaagagctgtggggccctgcggcctgtgaatggagtcatcaacaccctgcagcctgtgctggccgaccacatccctggggacagcagtgatgctgaggagcagctgcacaagaagcagaggctgaacctggtgagcagcagcagtgatggcacctgtgtggccgcccggaccaggcctgtgctgagctgcaagaagaggcggctggtgcggcccaacagcatcgtgcccctgagcaagaaggtgcacaggaacagcaccatccggcccggctgtgatgtgaaccccagctgtgccctgtgtggcagcggcagcatcaacaccatgcctcctgagatccactatgaggcccccctgctggagcggctgagccagctggacagctgtgtgcaccctgtgctggccttcccagatgatgtgcccaccagcctgcacttccagagcatgctgaagagccagtggcagaacaagccctttgacaagatcaagccacccaagaagctgagcctgaagcaccgggcccccatgcctggcagcctgcctgacagcgccaggaaggacagacacaagctggtgtcctccttcctgaccacagccaagctgagccaccaccagaccaggccagacaggacccaccggcagcacctggatgatgtgggcgctgtgcccatggtggagcgggtgacagcccccaaggccgagcggctgctgaaccccccacctcctgtgcatgaccccaaccacagcaagatgaggctgcgggaccacagcagcgagaggtctgaggtgctgaagcaccacacagacatgagcagcagcagctacctggccgccacccaccaccccccccacagccccctggtgcggcagctgagcaccagcagtgacagccctgccccagccagcagcagcagccaggtgacagccagcaccagccagcagcctgtgagaagaagaagaggagagagcagctttgacatcaacaacatcgtcatccccatgtctgtggccgccaccaccagggtggagaagctgcagtacaaggagatcctgacccccagctggagggaggtggacctgcagagcctgaagggcagcccagatgaagaaaatgaggagattgaggacctgagtgatgctgcctttgctgccctgcacgccaagtgtgaggagatggagcgggcccgctggctgtggaccacctctgtgcccccccagaggcggggcagccgcagctaccgcagcagtgatggccgcaccaccccccagctgggcagcgccaaccccagcaccccccagcctgccagcccagatgtgagcagcagccacagcctgtctgagtacagccacggccagagccccaggagccccatcagccctgagctgcacagcgcccccctgacccctgtggcccgggacacccccaggcacctggccagcgaggacacccgctgcagcaccccagagctgggcctggatgagcagagcgtgcagccctgggagaggaggaccttccccctggcccacagcccccaggctgaatgtgaggaccagctggatgcccaggagcgggccgcccgctgcaccaggaggaccagcggcagcaagacaggccgggagacagaggccgcccccaccagcccccccatcgtgcccctgaagagccgccacctggtggccgccgccacagcccagaggcccacccacaggtag

SEQ ID NO: 156789 - DNA, 1200 bp, Artificial Sequence
  Description of Artificial Sequence: Synthetic coding sequence
atgcctcctgagatccactatgaggcccccctgctggagcggctgagccagctggacagctgtgtgcaccctgtgctggccttcccagatgatgtgcccaccagcctgcacttccagagcatgctgaagagccagtggcagaacaagccctttgacaagatcaagccacccaagaagctgagcctgaagcaccgggcccccatgcctggcagcctgcctgattctgccaggaaggacagacacaagctggtgagcagcttcctgaccacagccatgctgaagcaccacacagacatgagcagcagcagctacctggccgccacccaccaccccccccacagccccctggtgcggcagctgagcaccagcagtgacagccctgccccagccagcagcagcagccaggtgacagccagcaccagccagcagcctgtgagaagaagaagaggagagagcagctttgacatcaacaacatcgtcatccccatgtctgtggccgccaccaccagggtggagaagctgcagtacaaggagatcctgacccccagctggagggaggtggacctgcagagcctgaagggcagcccagatgaagaaaatgaggagattgaggacctgagtgatgctgcctttgctgccctgcacgccaagtgtgaggagatggagcgggcccgctggctgtggaccacctctgtgcccccccagaggcggggcagccgcagctaccgcagcagtgatggccgcaccaccccccagctgggcagcgccaaccccagcaccccccagcctgccagcccagatgtgagcagcagccacagcctgtctgagtacagccacggccagagccccaggagccccatcagccctgagctgcacagcgcccccctgacccctgtggcccgggacacccccaggcacctggccagcgaggacacccgctgcagcaccccagagctgggcctggatgagcagagcgtgcagccctgggagaggaggaccttccccctggcccacagcccccaggctgaatgtgaggaccagctggatgcccaggagcgggccgcccgctgcaccaggaggaccagcggcagcaagacaggccgggagacagaggccgcccccaccagcccccccatcgtgcccctgaagagccgccacctggtggccgccgccacagcccagaggcccacccacaggtag

SEQ ID NO: 156790 - DNA, 3318 bp, Artificial Sequence; identical to SEQ ID NO: 156788
  Description of Artificial Sequence: Synthetic coding sequence

SEQ ID NO: 156791 - DNA, 3318 bp, Artificial Sequence; identical to SEQ ID NO: 156788
  Description of Artificial Sequence: Synthetic coding sequence

SEQ ID NO: 156792 - DNA, 3318 bp, Artificial Sequence; identical to SEQ ID NO: 156788
  Description of Artificial Sequence: Synthetic coding sequence

SEQ ID NO: 156793 - DNA, 936 bp, Artificial Sequence
  Description of Artificial Sequence: Synthetic coding sequence
atgagcctgctgatgatcagtgaaaatgtgaagctggcccgggagtatgccctgctgggcaactatgacagcgccatggtgtactaccagggcgtgctggaccagatgaacaagtacctgtacagcgtgaaggacacctacctgcagcagaagtggcagcaggtgtggcaggagatcaacgtggaggccaagcacgtgaaggacatcatgaagaccctggagagcttcaagctggacagcacccccctgaaggccgcccagcacgacctgcctgccagcgagggggaggtgtggagcatgcctgtgcctgtggagcggcggcccagccctggccccaggaagaggcagagcagccagtacagcgaccccaagagccacggcaaccggcccagcaccaccgtgcgggtgcacaggagcagcgcccagaatgtgcacaatgaccggggcaaggctgtgcgctgccgggagaagaaggagcagaacaagggccgggaggagaagggcgtgctgatggtgggccccccaggcaccgggaagaccctgctggccaaggctgtggccacagagtgcaagaccaccttcttcaacgtgagcagcagcaccctgaccagcaagtacagaggagagagcgagaagctggtgcggctgctgtttgagatggcccgcttctacagccctgccaccatcttcattgatgaaattgacagcatctgcagccggcggggcaccagcgaggagcacgaggccagcagaagagtgaaggccgagctgctggtgcagatggatggagtgggcggcaccagtgaaaatgatgaccccagcaagatggtgatggtgctggccgccaccaacttcccctgggacattgatgaggccctgcggcggcggctggagaagaggatctacatccccctgcccagcggcatgaggccctag

SEQ ID NO: 156794 - DNA, 1476 bp, Artificial Sequence
  Description of Artificial Sequence: Synthetic coding sequence
atgagcctgctgatgatcagtgaaaatgtgaagctggcccgggagtatgccctgctgggcaactatgacagcgccatggtgtactaccagggcgtgctggaccagatgaacaagtacctgtacagcgtgaaggacacctacctgcagcagaagtggcagcaggtgtggcaggagatcaacgtggaggccaagcacgtgaaggacatcatgaagaccctggagagcttcaagctggacagcacccccctgaaggccgcccagcacgacctgcctgccagcgagggggaggtgtggagcatgcctgtgcctgtggagcggcggcccagccctggccccaggaagaggcagagcagccagtacagcgaccccaagagccacggcaaccggcccagcaccaccgtgcgggtgcacaggagcagcgcccagaatgtgcacaatgaccggggcaaggctgtgcgctgccgggagaagaaggagcagaacaagggccgggaggagaagaacaagagccctgctgctgtgacagagcctgagaccaacaagtttgacagcacaggctatgacaaggacctggtggaggccctggagcgggacatcatcagccagaaccccaacgtgcgctgggatgacattgctgacctggtggaggccaagaagctgctgaaggaggccgtggtgctgcccatgtggatgcctgagttcttcaagggcatcagaagaccctggaagggcgtgctgatggtgggccccccaggcaccgggaagaccctgctggccaaggctgtggccacagagtgcaagaccaccttcttcaacgtgagcagcagcaccctgaccagcaagtacagaggagagagcgagaagctggtgcggctgctgtttgagatggcccgcttctacagccctgccaccatcttcattgatgaaattgacagcatctgcagccggcggggcaccagcgaggagcacgaggccagcagaagagtgaaggccgagctgctggtgcagatggatggagtgggcggcaccagtgaaaatgatgaccccagcaagatggtgatggtgctggccgccaccaacttcccctgggacattgatgaggccctgcggcggcggctggagaagaggatctacatccccctgcccagcgccaagggccgggaggagctgctgcgcatcagcctgcgggagctggagctggctgatgatgtggacctggccagcattgctgagaacatggagggctacagcggggctgacatcaccaacgtgtgcagagatgccagcctgatggccatgagaagaagaattgagggcctgaccccagaggagatccggaacctgagcaaggaggagatgcacatgcccaccaccatggaggactttgagatggccctgaagaaggtgtccaagtctgtgtctgctgctgacatcgagagatatgagaagtggatctttgaatttggcagctgctag

SEQ ID NO: 156795 - DNA, 1476 bp, Artificial Sequence; identical to SEQ ID NO: 156794
  Description of Artificial Sequence: Synthetic coding sequence

SEQ ID NO: 156796 - DNA, 636 bp, Artificial Sequence
  Description of Artificial Sequence: Synthetic coding sequence
atgagcctgctgatgatcagtgaaaatgtgaagctggcccgggagtatgccctgctgggcaactatgacagcgccatggtgtactaccagggcgtgctggaccagatgaacaagtacctgtacagcgtgaaggacacctacctgcagcagaagtggcagcaggtgtggcaggagatcaacgtggaggccaagcacgtgaaggacatcatgaagaccctggagagcttcaagctggacagcacccccctgaaggccgcccagcacgacctgcctgccagcgagggggaggtgtggagcatgcctgtgcctgtggagcggcggcccagccctggccccaggaagaggcagagcagccagtacagcgaccccaagagccacggcaaccggcccagcaccaccgtgcgggtgcacaggagcagcgcccagaatgtgcacaatgaccggggcaaggctgtgcgctgccgggagaagaaggagcagaacaagggccgggaggagaagaacaagagccctgctgctgtgacagagcctgagaccaacaagtttgacagcacaggctatgacaaggacctggtggaggccctggagcgggacatcatcagccagaaccccaacgtgcgctgggatgacatctag

SEQ ID NO: 156797 - DNA, 843 bp, Artificial Sequence
  Description of Artificial Sequence: Synthetic coding sequence
atgagcctgctgatgatcagtgaaaatgtgaagctggcccgggagtatgccctgctgggcaactatgacagcgccatggtgtactaccagggcgtgctggaccagatgaacaagtacctgtacagcgtgaaggacacctacctgcagcagaagtggcagcaggtgtggcaggagatcaacgtggaggccaagcacgtgaaggacatcatgaagaccctggagagcttcaagctggacagcacccccctgaaggccgcccagcacgacctgcctgccagcgagggggaggtgtggagcatgcctgtgcctgtggagcggcggcccagccctggccccaggaagaggcagagcagccagtacagcgaccccaagagccacggcaaccggcccagcaccaccgtgcgggtgcacaggagcagcgcccagaatgtgcacaatgaccggggcaaggctgtgcgctgccgggagaagaaggagcagaacaagggccgggaggagaagaacaagagccctgctgctgtgacagagcctgagaccaacaagtttgacagcacaggctatgacaaggacctggtggaggccctggagcgggacatcatcagccagaaccccaacgtgcgctgggatgacattgctgacctggtggaggccaagaagctgctgaaggaggccgtggtgctgcccatgtggatgcctgagttcttcaagggcatcagaagaccctggaagggcgtgctgatggtgggccccccaggcaccgggaagaccctgctggccaaggctgtggccacagagtgcaagaccaccttcttcaacgtgagcagcagcaccctgaccagctag

SEQ ID NO: 156798 - DNA, 429 bp, Artificial Sequence
  Description of Artificial Sequence: Synthetic coding sequence
atgaactgcagcgagagccagaggctgcggaccctgctgagccggctgctgctggagctgcaccacagaggaaatgccagcggcctgggcgccggcccccggcccagcatgggcatgggcgtggtgcctgacccctttgtgggccgggaggtgaccagcgccaagggagatgatgcctacctgtacatcctgctgatcatgatcttctacgcctgcctggccggcggcctcatcctggcctacaccaggagcaggaagctggtggaggccaaggatgagcccagccaggcctgtgccgagcacgagtgggcccctggaggagccctgacagcagatgctgaggccgctgctggcagccaggccgagggccggcggcagctggccagcgagggcctgcctgccctggcccagggcgctgagcgggtgtag

SEQ ID NO: 156799 - DNA, 1509 bp, Artificial Sequence
  Description of Artificial Sequence: Synthetic coding sequence
atgtttggcaccctgctgctgtactgcttcttcctggccaccgtgcctgccctggccgagactggaggagagcggcagctgagccctgagaagtctgagatctggggccctggcctgaaggcagatgtggtgctgcctgcccgctacttctacatccaggccgtggacaccagcggcaacaagttcaccagcagccctggagagaaggtgttccaggtgaaggtgtctgcccctgaggagcagttcaccagggtgggcgtgcaggtgctggacaggaaggatggcagcttcatcgtgcgctacaggatgtatgccagctacaagaacctgaaggtggagatcaagttccagggccagcacgtggccaagagcccctacatcctgaagggccctgtgtaccacgagaactgtgactgccccctgcaggacagcgctgcctggctgcgggagatgaactgcccagagaccatcgcccagatccagagggacctggcccacttccctgctgtggaccctgagaagattgctgtggagatccccaagagatttggccagaggcagagcctgtgccactacaccctgaaggacaacaaggtgtacatcaagacccacggggagcacgtgggcttccgcatcttcatggatgccatcctgctgagcctgaccaggaaggtgaagatgccagatgtggagctgtttgtgaacctgggggactggcccctggagaagaagaagagcaacagcaacatccaccccatcttctcctggtgtggcagcacagacagcaaggacatcgtgatgcccacctatgacctgacagattctgtgctggagaccatgggccgggtgtccctggacatgatgtctgtgcaggccaacacaggccccccctgggagagcaagaacagcacagctgtgtggaggggccgggacagcaggaaggagcggctggagctggtgaagctgagcaggaagcaccctgagctgattgatgctgccttcaccaacttcttcttcttcaagcatgatgagaacctgtatggccccatcgtgaagcacatctccttctttgacttcttcaagcacaagtaccagatcaacattgatggcaccgtggccgcctaccgcctgccctacctgctggtgggggacagcgtggtgctgaagcaggacagcatctactatgagcacttctacaatgagctgcagccctggaagcactacatccctgtgaagagcaacctgagtgacctgctggagaagctgaagtgggccaaggaccatgatgaggaggccaagaagatcgccaaggccggccaggagtttgccaggaacaacctgatgggagatgacatcttctgctactacttcaagctgttccaggagtatgccaacctgcaggtgtctgagccccagatccgggagggcatgaagagggtggagccccagacagaagatgacctcttcccctgcacctgccacaggaagaagaccaaggatgagctgtag

SEQ ID NO: 156800 - DNA, 1065 bp, Artificial Sequence
  Description of Artificial Sequence: Synthetic coding sequence
atgtctgctgggggcggccgggcctttgcctggcaggtgtttcctcccatgcccacctgccgggtgtatggaacagtggcccaccaggacggccacctgctggtgctgggcggctgcggccgggccggcctgcccctggacacagctgagaccctggacatggccagccacacctggctggccctggcccccctgcccacagcccgggccggggctgctgctgtggtgctgggcaagcaggtgctggtggtgggcggcgtggatgaggtgcagagccctgtggccgctgtggaggccttcctgatggatgagggccgctgggagcggcgggccaccctgccccaggccgccatgggcgtggccaccgtggagagagatggcatggtgtatgccctgggcggcatgggccctgacacagccccccaggcccaggtgcgggtgtatgagccccggcgggactgctggctgagcctgcccagcatgcccaccccctgctacggggccagcaccttcctgcacggcaacaagatctacgtgctgggcggccggcagggcaagctgcctgtgacagcctttgaggcctttgacctggaggcccggacctggaccaggcaccccagcctgcccagcagaagagcctttgctggctgtgccatggccgagggctctgtgttcagcctgggcggcctgcagcagcccggcccccacaacttctacagccggccccactttgtgaacacagtggagatgtttgacctggagcacggctcctggaccaagctgcccaggagcctgaggatgagggacaagagagctgactttgtggtgggcagcctgggcggccacatcgtggccatcggcggcctgggcaaccagccctgccccctgggctctgtggagagcttcagcctggcccggcggcgctgggaggccctgcctgccatgcccacagcccgctgcagctgcagcagcctgcaggccggccccaggctcttcgtcatcggcggcgtggcccagggccccagccaggccgtggaggccctgtgcctgagagatggagtgtag

SEQ ID NO: 156801 - DNA, 417 bp, Artificial Sequence
  Description of Artificial Sequence: Synthetic coding sequence
atgtttgacctggagcacggctcctggaccaagctgcccaggagcctgaggatgagggacaagagagctgactttgtggtgggcagcctgggcggccacatcgtggccatcggcggcctgggcaaccagccctgccccctgggctctgtggagagcttcagcctggcccggcggcgctgggaggccctgcctgccatgcccacagcccgctgcagctgcagcagcctgcaggccggcccccggctgtttgtgattggaggagtggcccagggccccagccaggccgtggaggccctgtgcctgagagatggagagggcctggtgggcgctgtgcactggagcagcagcctgcctgaggccgccatctccatggccccctttgctgctgaggacacccactgcggctctgtgggctag

SEQ ID NO: 156802 - DNA, 1821 bp, Artificial Sequence
  Description of Artificial Sequence: Synthetic coding sequence
atggacagccagcgggagctggccgaggagctgcggctgtaccagagcaccctgctgcaggacggcctgaaggacctgctggatgagaagaagttcatcgactgcaccctgaaggccggggacaagagcctgccctgccacaggctcatcctgagcgcctgcagcccctacttccgggagtacttcctgtctgaaattgatgaggccaagaagaaggaggtggtgctggacaacgtggaccctgccatcctggacctgatcatcaagtacctgtacagcgccagcattgacctgaatgatggaaatgtgcaggacatctttgccctggccagccgcttccagatccccagcgtcttcaccgtgtgtgtgtcctacctgcagaagaggctggcccctggcaactgcctggccatcctgcggctgggcctgctgctggactgcccccggctggccatcagcgcccgggagtttgtgtctgacagatttgtgcagatctgcaaggaggaggacttcatgcagctgagcccccaggagctgatcagcgtcatcagcaatgacagcctgaatgtggagaaggaggaggccgtgtttgaagctgtgatgaagtgggtgaggacagacaaggaaaatagagtgaagaacctgtctgaggtgtttgactgcatccgcttccggctgatgacagagaagtacttcaaggaccacgtggagaaggatgacatcatcaagagcaacccagacctgcagaagaagatcaaggtgctgaaggatgcctttgctgggaagctgcctgagcccagcaagaatgctgccaagacaggagctggggaggtgaatggagatgtgggagatgaggacctgctgcccggctacctgaatgacatccccaggcatggcatgtttgtgaaggacctgatcctgctggtgaatgacacagctgctgtggcctatgaccccacagaaaatgaatgctacctgacagccctggccgagcagatccccaggaaccacagcagcatcgtgacccagcagaaccagatctacgtggtgggcggcctgtatgtggatgaggagaacaaggaccagcccctgcagagctacttcttccagctggacagcatcgccagcgagtgggtgggcctgccccccctgcccagcgcccgctgcctgtttggcctgggggaggtggatgacaagatctacgtggtggccggcaaggacctgcagacagaggccagcctggacagcgtgctgtgctatgaccctgtggccgccaagtggaatgaggtgaagaagctgcccatcaaggtgtatggccacaacgtcatcagccacaagggcatgatctactgcctgggcggcaagacagatgacaagaagtgcaccaacagagtcttcatcttcaaccccaagaagggggactggaaggacctggcccccatgaagatccccaggtccatgtttggagtggccgtgcacaagggcaagatcgtgattgctgggggcgtgacagaagatggcctgagcgcctctgtggaggcctttgacctgaccaccaacaagtgggatgtgatgacagagttcccccaggagaggagcagcatcagcctggtgtccctggccggcagcctgtatgccatcggcggctttgccatgatccagctggagagcaaggagtttgcccccacagaggtgaatgacatctggaagtatgaagatgacaagaaggagtgggccggcatgctgaaggagatccgctatgccagcggggccagctgcctggccacccggctgaacctcttcaagctgagcaagctgtag

SEQ ID NO: 156803 - DNA, 1377 bp, Artificial Sequence
  Description of Artificial Sequence: Synthetic coding sequence
atggcccggggcccccagaccctggtgcaggtgtgggtgggcggccagctgttccaggccgaccgggccctgctggtggagcactgcggcttcttccggggcctcttccgcagcggcatgagggagaccagggctgctgaggtgcggctgggcgtgctgtctgctgggggcttccgggccaccctgcaggtgctgcggggggacaggcctgccctggccgcagaagatgagctgctgcaggccgtggagtgtgccgccttcctgcaggccccagccctggcccgcttcctggagcacaacctgaccagtgacaactgtgccctgctgtgtgatgctgctgctgccttcggcctgagagatgtgttccacagcgctgccctcttcatctgtgatggagagcgggagctggccgctgagctggccctgcctgaggcccgggcctacgtggccgccctgcggcccagcagctatgctgctgtgtccacccacaccccagcccctggcttcctggaggatgccagcaggaccctgtgctacctggatgaggaggaggatgcctggaggaccctggccgccctgcccctggaggccagcaccctgctggccggcgtggccaccctgggcaacaagctgtacatcgtgggcggcgtgcggggggccagcaaggaggtggtggagctgggcttctgctatgaccctgatggcggcacctggcatgagttccccagcccccaccagcccaggtatgacacagccctggccggctttgatggccgcctgtatgccatcggcggggagttccagaggacccccatcagctctgtggagagatatgaccctgctgctggctgctggagctttgtggccgacctgccccagcctgctgctggggtgccctgtgcccaggcctgtggccgcctgtttgtgtgcctgtggaggcctgctgacaccacagctgtggtggagtatgctgtgaggacagatgcctggctgcctgtggccgagctgcggcggccccagagctatggccactgcatggtggcccaccgggacagcctgtatgtggtgagaaatggccccagtgatgacttcctgcactgtgccatcgactgcctgaacctggccaccggccagtggacagccctgcccggccagtttgtgaacagcaagggggccctcttcaccgctgtggtgcggggggacacagtgtacacagtgaacaggatgttcaccctgctgtatgccatcgagggcggcacctggaggctgctgcgggagaaggccggcttccccaggcctggcagcctgcagaccttcctgctgcggctgcccccaggggcccctggccctgtgaccagcaccacagctgagctgtag

SEQ ID NO: 156804 - DNA, 2247 bp, Artificial Sequence
  Description of Artificial Sequence: Synthetic coding sequence
atgagcggcagcggcaggaaggactttgatgtgaagcacatcctgcggctgcgctggaagctgttcagccaccccagccccagcactggaggccctgctgggggcggctgcctgcagcaggacggcagcggcagctttgagcactggggccccagccagagccggctgctgaagagccaggagaggtctggagtgtccaccttctggaagaagcccagcagcagcagcagcagcagcagcagccccagcagcagcagcagcagcttcaaccccctgaatggcaccctgctgcctgtggccacccggctgcagcagggcgcccctggccagggcacccagcagcctgcccggaccctcttctacgtggagagcctggaggaggaggtggtgcccggcatggacttccctggcccccatgagaagggcctggtgctgcaggagctgaaggtggagccagacaacagcagccaggccactggagagggctgcggccaccggctgagcagcacaggccacagcatgaccccccagagcgacctggacagcagcagcagcgaggagttctaccaggccgtgcaccacgccgagcagaccttcaggaagatggagagctacctgaagcagcagcagctgtgtgatgtgatcctgattgtgggcaacaggaagatcccagcccaccggctggtgctgagctctgtgtctgactactttgctgccatgttcaccagtgatgtgtgtgaggccaagcaggaggagatcaagatggagggcatcgaccccaatgccctgtgggacctggtgcagtttgcctacacaggctgcctggagctgaaggaggacaccatcgagaacctgctggccgccgcctgcctgctgcagctgccccaggtggtggaggtgtgctgccacttcctgatgaagctgctgcaccccagcaactgcctgggcatccgggcctttgctgatgcccagggctgcatcgagctgatgaaggtggcccacagctacaccatggagaacatcatggaggtgatccggaaccaggagttcctgctgctgcctgctgaggagctgcacaagctgctggccagtgatgatgtgaatgtgcctgatgaggagaccatcttccacgccctgatgatgtgggtgaagtatgacatgcagagccgctgcaatgacctgtccatgctgctggccttcatccggctgcccctgctgcccccccagatcctggccgacctggagaaccacgccctcttcaagaatgacctggagtgccagaagctgatcctggaggccatgaagtaccacctgctgcctgagaggaggaccctgatgcagagccccaggaccaagcccaggaagagcacagtgggcaccctgtatgctgtgggcggcatggacaacaacaagggggccaccaccatcgagaagtatgacctgcggaccaacctgtggatccaggccggcatgatgaatggaagaaggctgcagtttggagtggccgtgattgatgacaagctgtttgtgattggaggaagagatggcctgaagaccctgaacacagtggagtgctacaaccccaagaccaagacctggacagtgctgccccccatgagcacccaccgccacggcctgggcgtgacagtgctggagggccccatctatgctgtgggcggccatgatggctggagctacctgaacacagtggagcgctgggacccccagagccagcagtggacctttgtggcctccatgagcatcgcccggagcacagtgggcgtggccgccctgaatggcaagctgtacagcgtgggcggcagagatggcagcagctgcctgagctccatggagtactatgacccccacaccaacaagtggaacatgtgtgcccccatgtgcaagaggcggggcggcgtgggcgtggccacctgtgatggcttcctgtatgctgtgggcggccatgatgccccagccagcaaccactgcagccggctgctggactatgtggagagatatgaccccaagacagacacctggaccatggtggcccccctgtccatgcccagagatgctgtgggcgtgtgcctgctgggggaccggctgtatgctgtgggcggctatgatggccagacctacctgaacaccatggagagctatgacccccagaccaatgagtggacccagatggccagcctgaacatcggccgggccggggcctgtgtggtggtgatcaagcagccctag

SEQ ID NO: 156805 - DNA, 1668 bp, Artificial Sequence
  Description of Artificial Sequence: Synthetic coding sequence
atggacttccctggcccccatgagaagggcctggtgctgcaggagctgaaggtggagccagacaacagcagccaggccactggagagggctgcggccaccggctggtgctgagctctgtgtctgactactttgctgccatgttcaccagtgatgtgtgtgaggccaagcaggaggagatcaagatggagggcatcgaccccaatgccctgtgggacctggtgcagtttgcctacacaggctgcctggagctgaaggaggacaccatcgagaacctgctggccgccgcctgcctgctgcagctgccccaggtggtggaggtgtgctgccacttcctgatgaagctgctgcaccccagcaactgcctgggcatccgggcctttgctgatgcccagggctgcatcgagctgatgaaggtggcccacagctacaccatggagaacatcatggaggtgatccggaaccaggagttcctgctgctgcctgctgaggagctgcacaagctgctggccagtgatgatgtgaatgtgcctgatgaggagaccatcttccacgccctgatgatgtgggtgaagtatgacatgcagagccgctgcaatgacctgtccatgctgctggccttcatccggctgcccctgctgcccccccagatcctggccgacctggagaaccacgccctcttcaagaatgacctggagtgccagaagctgatcctggaggccatgaagtaccacctgctgcctgagaggaggaccctgatgcagagccccaggaccaagcccaggaagagcacagtgggcaccctgtatgctgtgggcggcatggacaacaacaagggggccaccaccatcgagaagtatgacctgcggaccaacctgtggatccaggccggcatgatgaatggccggcggctgcagtttggagtggccgtgattgatgacaagctgtttgtgattggaggaagagatggcctgaagaccctgaacacagtggagtgctacaaccccaagaccaagacctggacagtgctgccccccatgagcacccacagacatggcctgggcgtgacagtgctggagggccccatctatgctgtgggcggccatgatggctggagctacctgaacacagtggagcgctgggacccccagagccagcagtggacctttgtggcctccatgagcatcgcccggagcacagtgggcgtggccgccctgaatggcaagctgtacagcgtgggcggcagagatggcagcagctgcctgagctccatggagtactatgacccccacaccaacaagtggaacatgtgtgcccccatgtgcaagagaagaggaggagtgggcgtggccacctgtgatggcttcctgtatgctgtgggcggccatgatgccccagccagcaaccactgcagccggctgctggactatgtggagagatatgaccccaagacagacacctggaccatggtggcccccctgtccatgcccagagatgctgtgggcgtgtgcctgctgggggaccggctgtatgctgtgggcggctatgatggccagacctacctgaacaccatggagagctatgacccccagaccaatgagtggacccagatggccagcctgaacatcggccgggccggggcctgtgtggtggtgatcaagcagccctag

SEQ ID NO: 156806 - DNA, 1167 bp, Artificial Sequence
  Description of Artificial Sequence: Synthetic coding sequence
atgagccgcagcggggacaggaccagcacctttgaccccagccacagcgacaacctgctgcacggcctgaacctgctgtggaggaagcagctgttctgtgatgtgaccctgacagcccagggccagcagttccactgccacaaggctgtgctggccagctgcagccagtacttccgcagcctcttcagcagccacccccccctgggcggcggcgtgggcggccaggacggcctgggcgcccccaaggaccagcagcagcccccccagcagcagcccagccagcagcagcagcccccaccccaggaggagcccggcacccccagcagcagcccagatgacaagctgctgaccagcccccgggccatcaacaacctggtgctgcagggctgcagcagcatcggcctgcggctggtgctggagtacctgtacacagccaacgtgaccctgagcctggacacagtggaggaggtgctgtctgtgtccaagatcctgcacatcccccaggtgaccaagctgtgtgtgcagttcctgaatgaccagatctctgtgcagaactacaagcaggtgtgcaagattgctgccctgcacggcctggaggagaccaagaagctggccaacaagtacctggtggaggatgtgctgctgctgaactttgaggagatgagggccctgctggacagcctgcccccacctgtggagagcgagctggccctcttccagatgtctgtgctgtggctggagcatgaccgggagaccaggatgcagtatgccccagacctgatgaagaggctgcgctttgccctgatcccagcccctgagctggtggagcgggtgcagagcgtggacttcatgaggacagatcctgtgtgccagaagctgctgctggatgccatgaactaccacctgatgcccttccggcagcactgccggcagagcctggccagccgcatccgcagcaacaagaagatgctgctgctggtgggcggcctgcccccaggccctgaccggctgcccagcaacctggtgcagtactatgatgatgagaagaagacctggaagatcctgaccatcaccggcccccaccccatcagcggcaagcaggagagcgccagcagccctgagttcagaagaaggaagacccgggagttcagcaacaacaccatgtag

SEQ ID NO: 156807 - DNA, 1887 bp, Artificial Sequence
  Description of Artificial Sequence: Synthetic coding sequence
atgagccgcagcggggacaggaccagcacctttgaccccagccacagcgacaacctgctgcacggcctgaacctgctgtggaggaagcagctgttctgtgatgtgaccctgacagcccagggccagcagttccactgccacaaggctgtgctggccagctgcagccagtacttccgcagcctcttcagcagccacccccccctgggcggcggcgtgggcggccaggacggcctgggcgcccccaaggaccagcagcagcccccccagcagcagcccagccagcagcagcagcccccaccccaggaggagcccggcacccccagcagcagcccagatgacaagctgctgaccagcccccgggccatcaacaacctggtgctgcagggctgcagcagcatcggcctgcggctggtgctggagtacctgtacacagccaacgtgaccctgagcctggacacagtggaggaggtgctgtctgtgtccaagatcctgcacatcccccaggtgaccaagctgtgtgtgcagttcctgaatgaccagatctctgtgcagaactacaagcaggtgtgcaagattgctgccctgcacggcctggaggagaccaagaagctggccaacaagtacctggtggaggatgtgctgctgctgaactttgaggagatgagggccctgctggacagcctgcccccacctgtggagagcgagctggccctcttccagatgtctgtgctgtggctggagcatgaccgggagaccaggatgcagtatgccccagacctgatgaagaggctgcgctttgccctgatcccagcccctgagctggtggagcgggtgcagagcgtggacttcatgaggacagatcctgtgtgccagaagctgctgctggatgccatgaactaccacctgatgcccttccggcagcactgccggcagagcctggccagccgcatccgcagcaacaagaagatgctgctgctggtgggcggcctgcccccaggccctgaccggctgcccagcaacctggtgcagtactatgatgatgagaagaagacctggaagatcctgaccatcatgccctacaacagcgcccaccactgtgtggtggaggtggagaacttcctgtttgtgctgggcggggaggaccagtggaaccccaacgggaagcacagcaccaactttgtgagccgctatgacccccgcttcaacagctggatccagctgccccccatgcaggagcggcgggccagcttctacgcctgccgcctggacaagcacctgtatgtgattggaggaagaaatgaaacaggctacctgagctctgtggagtgctacaacctggagaccaatgagtggaggtatgtgagcagcctgccccagcccctggccgcccatgctggagctgtgcacaacgggaagatctacatcagcggcggcgtgcacaatggagaatatgtgccctggctgtactgctatgaccctgtgatggatgtgtgggccaggaagcaggacatgaacaccaagagggccatccacaccctggccgtgatgaatgaccggctgtatgccatcggcggcaaccacctgaagggcttcagccacctggatgtgatgctggtggagtgctatgaccccaagggggaccagtggaacatcctgcagacccccatcctggagggccgcagcggccctggctgtgctgtgctggatgacagcatctacctggtgggcggctacagctggagcatgggcgcctacaagagcagcaccatctgctactgcccagagaagggcacctggacagagctggagggagatgtggccgagcccctggccggccctgcctgtgtgaccgtcatcctgcccagctgtgtgccctacaacaagtag

SEQ ID NO: 156808 - DNA, 1794 bp, Artificial Sequence
  Description of Artificial Sequence: Synthetic coding sequence
atggtgtggctggaggcccggccccagatcctgtttgtgtgcaccaagcagggccaccagaagcccctggacagcaaggatgacaacacagagaagcactgccctgtgacagtgaacccctggcacatgaagaaggccttcaaggtgatgaatgagctgcggagccagaacctgctgtgtgatgtgaccatcgtggccgaggacatggagatcagcgcccaccgggtggtgctggccgcctgcagcccctacttccacgccatgttcaccggggagatgtctgagagccgggccaagagggtgcgcatcaaggaggtggatggctggaccctgaggatgctgattgattatgtgtacacagctgagatccaggtgacagaggagaatgtgcaggtgctgctgcctgctgctggcctgctgcagctgcaggatgtgaagaagacctgctgtgagttcctggagagccagctgcaccctgtgaactgcctgggcatccgggcctttgctgacatgcacgcctgcacagacctgctgaacaaggccaacacctatgcagagcagcactttgctgatgtggtgctgtctgaggagttcctgaacctgggcatcgagcaggtgtgcagcctcatcagcagtgacaagctgaccatcagcagcgaggagaaggtgtttgaggccgtcatcgcctgggtgaaccacgacaaggatgtgcggcaggagttcatggcccggctgatggagcacgtgcggctgcccctgctgccccgggagtacctggtgcagagggtggaggaggaggccctggtgaagaacagcagcgcctgcaaggactacctgattgaggccatgaagtaccacctgctgcccacagagcagaggatcctgatgaagtctgtgaggacccggctgcggacccccatgaacctgcccaagctgatggtggtggtgggcggccaggcccccaaggccatccgctctgtggagtgctatgacttcaaggaggagcgctggcaccaggtggccgagctgcccagccgccgctgccgggccggcatggtgtacatggccggcctggtgtttgctgtgggcggcttcaacggcagcctgcgggtgaggacagtggacagctatgaccctgtgaaggaccagtggacctctgtggccaacatgagggacagaagaagcaccctgggcgctgctgtgctgaatggcctgctgtatgctgtgggcggctttgatggcagcacaggcctgagctctgtggaggcctacaacatcaagagcaatgagtggttccacgtggcccccatgaacacccggcgcagctctgtgggcgtgggcgtggtgggcggcctgctgtatgctgtgggcggctatgatggagccagccggcagtgcctgagcacagtggagtgctacaatgccaccaccaatgagtggacctacatcgccgagatgagcaccaggagaagtggagctggggtgggcgtgctgaacaacctgctgtatgctgtgggcggccatgatggccccctggtgaggaagtctgtggaggtgtatgaccccaccaccaatgcctggaggcaggtggccgacatgaacatgtgcagaagaaatgctggggtgtgtgctgtgaatggcctgctgtatgtggtgggcggagatgatggcagctgcaacctggcctctgtggagtactacaaccccaccacagacaagtggacagtggtgagcagctgcatgagcacaggccgctcctatgctggggtgacagtgattgacaagcccctgtag

SEQ ID NO: 156809 - DNA, 2640 bp, Artificial Sequence
  Description of Artificial Sequence: Synthetic coding sequence
atgaggctgcacctgctgctgctgctggccctgtgtggggccggcaccacagctgctgagctgagctacagcctgcggggcaactggagcatctgcaatggaaatggcagcctggagctgcctggagctgtgcccggctgtgtgcacagcgccctcttccagcagggcctcatccaggacagctactaccgcttcaatgacctgaactaccgctgggtgtccctggacaactggacctacagcaaggagttcaagatcccctttgagatcagcaagtggcagaaggtgaacctgatcctggagggcgtggacacagtgtccaagatcctcttcaatgaggtgaccatcggggagacagacaacatgttcaaccgctacagctttgacatcaccaacgtggtgagagatgtgaacagcattgagctgcgcttccagagcgctgtgctgtatgctgcccagcagagcaaggcccacacccgctaccaggtgcccccagactgcccccccctggtgcagaagggagaatgtcatgtgaactttgtgaggaaggagcagtgcagcttctcctgggactggggccccagcttccccacccagggcatctggaaggatgtgagaattgaggcctacaacatctgccacctgaactacttcaccttcagccccatctatgacaagagcgcccaggagtggaacctggagattgagagcacctttgatgtggtgagcagcaagcctgtgggcggccaggtgattgtggccatccccaagctgcagacccagcagacctacagcattgagctgcagcccgggaagagaattgtggagctgtttgtgaacatcagcaagaacatcaccgtggagacctggtggccccacggccacggcaaccagacaggctacaacatgacagtgctgtttgagctggatggcggcctgaacatcgagaagagcgccaaggtgtacttcagaacagtggagctgattgaggagcccatcaagggcagccctggcctgtccttctacttcaagatcaatggcttccccatcttcctgaagggcagcaactggatcccagctgacagcttccaggacagagtgaccagcgagctgctgcggctgctgctgcagagcgtggtggatgccaacatgaacaccctgcgggtgtggggcggcggcatctatgagcaggatgagttctatgagctgtgtgatgagctgggcatcatggtgtggcaggacttcatgtttgcctgtgccctgtaccccacagaccagggcttcctggacagcgtgacagctgaggtggcctaccagatcaagaggctgaagagccaccccagcatcatcatctggagcggcaacaatgaaaatgaggaggccctgatgatgaactggtaccacatctccttcacagaccggcccatctacatcaaggactatgtgaccctgtatgtgaagaacatccgggagctggtgctggccggggacaagagccggcccttcatcaccagcagccccaccaatggagctgagaccgtggccgaggcctgggtgtcccagaaccccaacagcaactactttggagatgtgcacttctatgactacatcagtgactgctggaactggaaggtgttccccaaggccaggtttgcctctgaatatggctaccagagctggcccagcttcagcaccctggagaaggtgagcagcacagaggactggagcttcaacagcaagttcagcctgcaccggcagcaccacgagggcggcaacaagcagatgctgtaccaggccggcctgcacttcaagctgccccagagcacagaccccctgcggaccttcaaggacaccatctacctgacccaggtgatgcaggcccagtgtgtgaagacagaaacagagttctaccgccgcagccgctctgagatcgtggaccagcagggccacaccatgggcgccctgtactggcagctgaatgacatctggcaggcccccagctgggccagcctggagtatggaggcaagtggaagatgctgcactactttgcccagaacttctttgcccccctgctgcctgtgggctttgaaaatgaaaacaccttctacatctatggagtgtctgacctgcacagcgactacagcatgaccctgtctgtgcgggtgcacacctggagcagcctggagcctgtgtgcagccgggtgacagaaagatttgtgatgaagggcggggaggccgtgtgcctgtatgaggagcctgtgtctgagctgctgcggcgctgtggcaactgcacccgggagagctgtgtggtgtccttctacctgtctgctgaccacgagctgctgagccccaccaactaccacttcctgagcagccccaaggaggccgtgggcctgtgcaaggcccagatcacagccatcatcagccagcagggcgacatctttgtgtttgacctggagaccagcgctgtggccccctttgtgtggctggatgtgggcagcatccctggccgcttcagtgacaatggcttcctgatgacagagaagaccaggaccatcctcttctacccctgggagcccaccagcaagaatgagctggagcagagcttccacgtgaccagcctgacagacatctactag

SEQ ID NO: 156810 - DNA, 1518 bp, Artificial Sequence
  Description of Artificial Sequence: Synthetic coding sequence
atgtctgagagccgggccaagagggtgcgcatcaaggaggtggatggctggaccctgaggatgctgattgattatgtgtacacagctgagatccaggtgacagaggagaatgtgcaggtgctgctgcctgctgctggcctgctgcagctgcaggatgtgaagaagacctgctgtgagttcctggagagccagctgcaccctgtgaactgcctgggcatccgggcctttgctgacatgcacgcctgcacagacctgctgaacaaggccaacacctatgcagagcagcactttgctgatgtggtgctgtctgaggagttcctgaacctgggcatcgagcaggtgtgcagcctcatcagcagtgacaagctgaccatcagcagcgaggagaaggtgtttgaggccgtcatcgcctgggtgaaccacgacaaggatgtgcggcaggagttcatggcccggctgatggagcacgtgcggctgcccctgctgccccgggagtacctggtgcagagggtggaggaggaggccctggtgaagaacagcagcgcctgcaaggactacctgattgaggccatgaagtaccacctgctgcccacagagcagaggatcctgatgaagtctgtgaggacccggctgcggacccccatgaacctgcccaagctgatggtggtggtgggcggccaggcccccaaggccatccgctctgtggagtgctatgacttcaaggaggagcgctggcaccaggtggccgagctgcccagccgccgctgccgggccggcatggtgtacatggccggcctggtgtttgctgtgggcggcttcaacggcagcctgcgggtgaggacagtggacagctatgaccctgtgaaggaccagtggacctctgtggccaacatgagggacagaagaagcaccctgggcgctgctgtgctgaatggcctgctgtatgctgtgggcggctttgatggcagcacaggcctgagctctgtggaggcctacaacatcaagagcaatgagtggttccacgtggcccccatgaacacccggcgcagctctgtgggcgtgggcgtggtgggcggcctgctgtatgctgtgggcggctatgatggagccagccggcagtgcctgagcacagtggagtgctacaatgccaccaccaatgagtggacctacatcgccgagatgagcaccaggagaagtggagctggggtgggcgtgctgaacaacctgctgtatgctgtgggcggccatgatggccccctggtgaggaagtctgtggaggtgtatgaccccaccaccaatgcctggaggcaggtggccgacatgaacatgtgcagaagaaatgctggggtgtgtgctgtgaatggcctgctgtatgtggtgggcggagatgatggcagctgcaacctggcctctgtggagtactacaaccccaccacagacaagtggacagtggtgagcagctgcatgagcacaggccgctcctatgctggggtgacagtgattgacaagcccctgtag

SEQ ID NO: 156811 - DNA, 1764 bp, Artificial Sequence
  Description of Artificial Sequence: Synthetic coding sequence
atggagggggagagcgtgaagctgagcagccagaccctcatccaggccggagatgatgagaagaaccagaggaccatcaccgtgaacccagcccacatgggcaaggccttcaaggtgatgaatgagctgcggagcaagcagctgctgtgtgatgtgatgattgtggctgaagatgtggagattgaggcccaccgggtggtgctggccgcctgcagcccctacttctgtgccatgttcaccggggacatgtctgagagcaaggccaagaagattgagatcaaggatgtggatggccagaccctgagcaagctgattgactacatctacacagctgagattgaggtgacagaggagaatgtgcaggtgctgctgcctgctgccagcctgctgcagctgatggatgtgcggcagaactgctgtgacttcctgcagagccagctgcaccccaccaactgcctgggcatccgggcctttgctgatgtgcacacctgcacagacctgctgcagcaggccaatgcctatgcagagcagcacttccctgaggtgatgctgggggaggagttcctgagcctgagcctggaccaggtgtgcagcctcatcagcagtgacaagctgactgtgtcctctgaggagaaggtgtttgaggccgtcatctcctggatcaactatgagaaggagacccggctggagcacatggccaagctgatggagcacgtgcggctgcccctgctgccccgggactacctggtgcagacagtggaggaggaggccctgatcaagaacaacaacacctgcaaggacttcctgattgaggccatgaagtaccacctgctgcccctggaccagaggctgctgatcaagaaccccaggaccaagcccaggacccctgtgtccctgcccaaggtgatgattgtggtgggcggccaggcccccaaggccatccgctctgtggagtgctatgactttgaggaggaccgctgggaccagattgctgagctgcccagccgccgctgccgggccggcgtggtgttcatggccggccacgtgtatgctgtgggcggcttcaacggcagcctgcgggtgaggacagtggatgtgtatgatggagtgaaggaccagtggaccagcatcgcctccatgcaggagaggaggagcaccctgggcgctgctgtgctgaatgacctgctgtatgctgtgggcggctttgatggcagcacaggcctggcctctgtggaggcctacagctacaagaccaatgagtggttctttgtggcccccatgaacacccggcgcagctctgtgggcgtgggcgtggtggagggcaagctgtatgctgtgggcggctatgatggagccagccggcagtgcctgagcacagtggagcagtacaacccagccaccaatgagtggatctacgtggccgacatgagcaccaggagaagtggagctggggtgggcgtgctgagcggccagctgtatgccactggaggccatgatggccccctggtgaggaagtctgtggaggtgtatgaccccggcaccaacacctggaagcaggtggccgacatgaacatgtgcagaagaaatgctggggtgtgtgctgtgaatggcctgctgtatgtggtgggcggagatgatggcagctgcaacctggcctctgtggagtactacaaccctgtgacagacaagtggaccctgctgcccaccaacatgagcacaggccgctcctatgctggggtggccgtcatccacaagagcctgtag

SEQ ID NO: 156812 - DNA, 906 bp, Artificial Sequence
  Description of Artificial Sequence: Synthetic coding sequence
atggagggggagagcgtgaagctgagcagccagaccctcatccaggccggagatgatgagaagaaccagaggaccatcaccgtgaacccagcccacatgggcaaggccttcaaggtgatgaatgagctgcggagcaagcagctgctgtgtgatgtgatgattgtggctgaagatgtggagattgaggcccaccgggtggtgctggccgcctgcagcccctacttctgtgccatgttcaccggggacatgtctgagagcaaggccaagaagattgagatcaaggatgtggatggccagaccctgagcaagctgattgactacatctacacagctgagattgaggtgacagaggagaatgtgcaggtgctgctgcctgctgccagcctgctgcagctgatggatgtgcggcagaactgctgtgacttcctgcagagccagctgcaccccaccaactgcctgggcatccgggcctttgctgatgtgcacacctgcacagacctgctgcagcaggccaatgcctatgcagagcagcacttccctgaggtgatgctgggggaggagttcctgagcctgagcctggaccaggtgtgcagcctcatcagcagtgacaagctgactgtgtcctctgaggagaaggtgtttgaggccgtcatctcctggatcaactatgagaaggagacccggctggagcacatggccaagctgatggagcacgtgcggctgcccctgctgccccgggactacctggtgcagacagtggaggaggaggccctgatcaagaacaacaacacctgcaaggacttcctgattgaggccatgaagtaccacctgctgcccctggaccagaggctgctgatcaagaaccccaggaccaagcccaggacccctgtgtccctgcccaagtag

SEQ ID NO: 156813 - DNA, 1518 bp, Artificial Sequence
  Description of Artificial Sequence: Synthetic coding sequence
atgtctgagagcaaggccaagaagattgagatcaaggatgtggatggccagaccctgagcaagctgattgactacatctacacagctgagattgaggtgacagaggagaatgtgcaggtgctgctgcctgctgccagcctgctgcagctgatggatgtgcggcagaactgctgtgacttcctgcagagccagctgcaccccaccaactgcctgggcatccgggcctttgctgatgtgcacacctgcacagacctgctgcagcaggccaatgcctatgcagagcagcacttccctgaggtgatgctgggggaggagttcctgagcctgagcctggaccaggtgtgcagcctcatcagcagtgacaagctgactgtgtcctctgaggagaaggtgtttgaggccgtcatctcctggatcaactatgagaaggagacccggctggagcacatggccaagctgatggagcacgtgcggctgcccctgctgccccgggactacctggtgcagacagtggaggaggaggccctgatcaagaacaacaacacctgcaaggacttcctgattgaggccatgaagtaccacctgctgcccctggaccagaggctgctgatcaagaaccccaggaccaagcccaggacccctgtgtccctgcccaaggtgatgattgtggtgggcggccaggcccccaaggccatccgctctgtggagtgctatgactttgaggaggaccgctgggaccagattgctgagctgcccagccgccgctgccgggccggcgtggtgttcatggccggccacgtgtatgctgtgggcggcttcaacggcagcctgcgggtgaggacagtggatgtgtatgatggagtgaaggaccagtggaccagcatcgcctccatgcaggagaggaggagcaccctgggcgctgctgtgctgaatgacctgctgtatgctgtgggcggctttgatggcagcacaggcctggcctctgtggaggcctacagctacaagaccaatgagtggttctttgtggcccccatgaacacccggcgcagctctgtgggcgtgggcgtggtggagggcaagctgtatgctgtgggcggctatgatggagccagccggcagtgcctgagcacagtggagcagtacaacccagccaccaatgagtggatctacgtggccgacatgagcaccaggagaagtggagctggggtgggcgtgctgagcggccagctgtatgccactggaggccatgatggccccctggtgaggaagtctgtggaggtgtatgaccccggcaccaacacctggaagcaggtggccgacatgaacatgtgcagaagaaatgctggggtgtgtgctgtgaatggcctgctgtatgtggtgggcggagatgatggcagctgcaacctggcctctgtggagtactacaaccctgtgacagacaagtggaccctgctgcccaccaacatgagcacaggccgctcctatgctggggtggccgtcatccacaagagcctgtag

SEQ ID NO: 156814 - DNA, 603 bp, Artificial Sequence
  Description of Artificial Sequence: Synthetic coding sequence
atgagccgctgctgcagccggcagcctgcctgctgcagctcctggatgtttggaagaacagctgtgaccagctgcagcctgagctgcatcccccccatcgcctgggcctctgtgcacctgcagatgtacaccccagccctgaccttctgcagccggcccatgcccacccagcacttccctgaggtgatgctgggggaggagttcctgagcctgagcctggaccaggtgtgcagcctcatcagcagtgacaagctgactgtgtcctctgaggagaaggtgtttgaggccgtcatctcctggatcaactatgagaaggagacccggctggagcacatggccaagctgatggagcacgtgcggctgcccctgctgccccgggactacctggtgcagacagtggaggaggaggccctgatcaagaacaacaacacctgcaaggacttcctgattgaggccatgaagtaccacctgctgcccctggaccagaggctgctgatcaagaaccccaggaccaagcccaggacccctgtgtccctgcccaagggcctggagtgcctggccgacagctgcaccccccaggtgggcatgatgggcctgtggtag

SEQ ID NO: 156815 - DNA, 1668 bp, Artificial Sequence
  Description of Artificial Sequence: Synthetic coding sequence
atgggcaaggccttcaaggtgatgaatgagctgcggagcaagcagctgctgtgtgatgtgatgattgtggctgaagatgtggagattgaggcccaccgggtggtgctggccgcctgcagcccctacttctgtgccatgttcaccggggacatgtctgagagcaaggccaagaagattgagatcaaggatgtggatggccagaccctgagcaagctgattgactacatctacacagctgagattgaggtgacagaggagaatgtgcaggtgctgctgcctgctgccagcctgctgcagctgatggatgtgcggcagaactgctgtgacttcctgcagagccagctgcaccccaccaactgcctgggcatccgggcctttgctgatgtgcacacctgcacagacctgctgcagcaggccaatgcctatgcagagcagcacttccctgaggtgatgctgggggaggagttcctgagcctgagcctggaccaggtgtgcagcctcatcagcagtgacaagctgactgtgtcctctgaggagaaggtgtttgaggccgtcatctcctggatcaactatgagaaggagacccggctggagcacatggccaagctgatggagcacgtgcggctgcccctgctgccccgggactacctggtgcagacagtggaggaggaggccctgatcaagaacaacaacacctgcaaggacttcctgattgaggccatgaagtaccacctgctgcccctggaccagaggctgctgatcaagaaccccaggaccaagcccaggacccctgtgtccctgcccaaggtgatgattgtggtgggcggccaggcccccaaggccatccgctctgtggagtgctatgactttgaggaggaccgctgggaccagattgctgagctgcccagccgccgctgccgggccggcgtggtgttcatggccggccacgtgtatgctgtgggcggcttcaacggcagcctgcgggtgaggacagtggatgtgtatgatggagtgaaggaccagtggaccagcatcgcctccatgcaggagaggaggagcaccctgggcgctgctgtgctgaatgacctgctgtatgctgtgggcggctttgatggcagcacaggcctggcctctgtggaggcctacagctacaagaccaatgagtggttctttgtggcccccatgaacacccggcgcagctctgtgggcgtgggcgtggtggagggcaagctgtatgctgtgggcggctatgatggagccagccggcagtgcctgagcacagtggagcagtacaacccagccaccaatgagtggatctacgtggccgacatgagcaccaggagaagtggagctggggtgggcgtgctgagcggccagctgtatgccactggaggccatgatggccccctggtgaggaagtctgtggaggtgtatgaccccggcaccaacacctggaagcaggtggccgacatgaacatgtgcagaagaaatgctggggtgtgtgctgtgaatggcctgctgtatgtggtgggcggagatgatggcagctgcaacctggcctctgtggagtactacaaccctgtgacagacaagtggaccctgctgcccaccaacatgagcacaggccgctcctatgctggggtggccgtcatccacaagagcctgtag

SEQ ID NO: 156816 - DNA, 1905 bp, Artificial Sequence
  Description of Artificial Sequence: Synthetic coding sequence
atggcccccaagaagaagatcgtgaagaagaacaagggggacatcaatgagatgaccatcatcgtggaggacagccccctgaacaagctgaatgccctgaatggcctgctggagggcggcaatggcctgagctgcatcagcagcgagctgacagatgccagctatggccccaacctgctggagggcctgagcaagatgaggcaggagaacttcctgtgtgacctggtgattggcaccaagaccaagagctttgatgtgcacaagtctgtgatggccagctgcagcgagtacttctacaacatcctgaagaaggaccccagcatccagagggtggacctgaatgacatcagccccctgggcctggccaccgtgattgcctatgcctacaccgggaagctgaccctgagcctgtacaccatcggcagcatcatctctgctgctgtgtacctgcagatccacaccctggtgaagatgtgcagcgacttcctgatccgggagatgtctgtggagaactgcatgtatgtggtgaacattgctgagacctacagcctgaagaatgccaaggccgccgcccagaagttcatccgggacaacttcctggagtttgctgagagtgaccagttcatgaagctgacctttgagcagatcaatgagctgctgattgatgatgacctgcagctgcccagcgagatcgtggccttccagatcgccatgaagtggctggagtttgaccagaagagggtgaagtatgctgctgacctgctgagcaacatccgcttcggcaccatcagcgcccaggacctggtgaactacgtgcagagcgtgcccaggatgatgcaggatgctgactgccaccggctgctggtggatgccatgaactaccacctgctgccctaccaccagaacaccctgcagagcaggaggacccgcatccggggcggctgccgggtgctggtgacagtgggcggccggcccggcctgacagagaagagcctgagccgggacatcctgtacagagatcctgaaaatggctggagcaagctgacagagatgcctgccaagagcttcaaccagtgtgtggccgtgatggatggcttcctgtatgtggccggaggagaggaccagaatgatgccaggaaccaggccaagcatgctgtgagcaacttctgccgctatgacccccgcttcaacacctggatccacctggcctccatgaaccagaagaggacccacttcagcctgtctgtgttcaacggcctggtgtatgctgctgggggcagaaatgctgagggcagcctggccagcctggagtgctacgtgcccagcaccaaccagtggcagcccaagacccccctggaggtggcccgctgctgccacgccagcgctgtggctgatggccgggtgctggtgactggaggctacatcgccaatgcctacagccgctctgtgtgtgcctatgaccctgccagtgacagctggcaggagctgcccaacctgagcaccccccggggctggcactgtgctgtgaccctgagtgacagagtgtatgtgatgggcggcagccagctgggccccagaggagagcgggtggatgtgctgactgtggagtgctacagccctgccaccggccagtggagctatgctgcccccctgcaggtgggcgtgtccacagctggggtgtctgccctgcacggccgggcctacctggtgggcggctggaatgaaggagagaagaagtacaagaagtgcatccagtgcttcagccctgagctgaatgagtggacagaagatgatgagctgcctgaggccaccgtgggcgtgtcctgctgcaccctgtccatgcccaacaacgtgacccgggagagccgggccagctctgtgtcctctgtgcctgtgtccatctag

SEQ ID NO: 156817 - DNA, 1905 bp, Artificial Sequence; identical to SEQ ID NO: 156816
  Description of Artificial Sequence: Synthetic coding sequence

SEQ ID NO: 156818 - DNA, 2313 bp, Artificial Sequence
  Description of Artificial Sequence: Synthetic coding sequence
atgaatgtcatctacttccccctgcacatctttgtggtgtacagccgggcctacaccagcctggtgctggtgggctgcaccaacctgtgtgctgtgctgtttgcccgctgcctggatgaccacctggtgtccctgaggatgagcggcagcaggaaggagtttgatgtgaagcagatcctgaagatccgctggcgctggtttggccaccaggccagcagccccaacagcacagtggacagccagcagggcgagttctggaacagaggccagacaggagccaacggcggcaggaagttcctggacccctgcagcctgcagctgcccctggccagcatcggctacagaagaagcagccagctggacttccagaacagccccagctggcccatggccagcaccagcgaggtgcctgcctttgagttcaccgctgaggactgtggcggggcccactggctggacaggcctgaggtggatgatggcaccagcgaggaggagaatgaaagtgacagcagcagctgcaggaccagcaacagcagccagaccctgagcagctgccacaccatggagccctgcaccagtgatgagttcttccaggccctgaaccacgccgagcagaccttcaagaagatggagaactacctgcggcacaagcagctgtgtgatgtgatcctggtggccggggaccggcgcatcccagcccaccggctggtgctgagctctgtgtctgactactttgctgccatgttcaccaatgatgtgcgggaggcccggcaggaggagatcaagatggagggcgtggagcccaacagcctgtggagcctcatccagtatgcctacacaggccgcctggagctgaaggaggacaacattgaatgtctgctgagcacagcctgcctgctgcagctgagccaggtggtggaggcctgctgcaagttcctgatgaagcagctgcaccccagcaactgcctgggcatccgcagctttgctgatgcccagggctgcacagacctgcacaaggtggcccacaactacaccatggagcacttcatggaggtgatccggaaccaggagtttgtgctgctgcctgccagcgagatcgccaagctgctggccagtgatgacatgaacatccccaatgaggagaccatcctgaatgccctgctgacctgggtgagacatgacctggagcagaggaggaaggacctgagcaagctgctggcctacatccggctgcccctgctggccccccagttcctggccgacatggagaacaacgtgctcttcagagatgacatcgagtgccagaagctgatcatggaggccatgaagtaccacctgctgcctgagcggcggcccatgctgcagagccccaggaccaagcccaggaagagcacagtgggcaccctgtttgctgtgggcggcatggacagcaccaagggggccaccagcattgagaagtatgacctgcggaccaacatgtggacccctgtggccaacatgaatggaagaaggctgcagtttggagtggccgtgctggatgacaagctgtatgtggtgggcggcagagatggcctgaagaccctgaacacagtggagtgctacaaccccaagaccaagacctggagcgtgatgccacccatgagcacccaccgccacggcctgggcgtggccgtgctggagggccccatgtatgctgtgggcggccatgatggctggagctacctgaacacagtggagcgctgggacccccaggcccggcagtggaactttgtggccaccatgagcacccccaggagcacagtgggcgtggccgtgctgagcggcaagctgtatgctgtgggcggcagagatggcagcagctgcctgaagtctgtggagtgctttgacccccacaccaacaagtggaccctgtgtgcccagatgagcaagaggcggggcggcgtgggcgtgaccacctggaatggcctgctgtatgccatcggcggccatgatgccccagccagcaacctgaccagccggctgagtgactgtgtggagagatatgaccccaagacagacatgtggacagctgtggcctccatgagcatcagcagagatgctgtgggcgtgtgcctgctgggggacaagctgtatgctgtgggcggctatgatggccaggcctacctgaacacagtggaggcctatgacccccagaccaatgagtggacccaggtgttcagccacacctttgaggacagcaaggaccacctggtggccatcaagcagaccatctggaggcagaacagcctgtctgaggagttccgcagccactag

SEQ ID NO: 156819 - DNA, 2274 bp, Artificial Sequence
  Description of Artificial Sequence: Synthetic coding sequence
atgaatgtcatctacttccccctgcacatctttgtggtgtacagccgggcctacaccagcctggtgctggtgggctgcaccaacctgtgtgctgtgctgtttgcccgctgcctggatgaccacctggtgtccctgaggatgagcggcagcaggaaggagtttgatgtgaagcagatcctgaagatccgctggcgctggtttggccaccaggccagcagccccaacagcacagtggacagccagcagggcgagttctggaacagaggccagacaggagccaacggcggcaggaagttcctggacccctgcagcctgcagctgcccctggccagcatcggctacagaagaagcagccagctggacttccagaacagccccagctggcccatggccagcaccagcgaggtgcctgcctttgagttcaccgctgaggactgtggcggggcccactggctggacaggcctgaggtggatgatggcaccagcgaggaggagaatgaaagtgacagcagcagctgcaggaccagcaacagcagccagaccctgagcagctgccacaccatggagccctgcaccagtgatgagttcttccaggccctgaaccacgccgagcagaccttcaagaagatggagaactacctgcggcacaagcagctgtgtgatgtgatcctggtggccggggaccggcgcatcccagcccaccggctggtgctgagctctgtgtctgactactttgctgccatgttcaccaatgatgtgcgggaggcccggcaggaggagatcaagatggagggcgtggagcccaacagcctgtggagcctcatccagtatgcctacacaggccgcctggagctgaaggaggacaacattgaatgtctgctgagcacagcctgcctgctgcagctgagccaggtggtggaggcctgctgcaagttcctgatgaagcagctgcaccccagcaactgcctgggcatccgcagctttgctgatgcccagggctgcacagacctgcacaaggtggcccacaactacaccatggagcacttcatggaggtgatccggaaccaggagtttgtgctgctgcctgccagcgagatcgccaagctgctggccagtgatgacatgaacatccccaatgaggagaccatcctgaatgccctgctgacctgggtgagacatgacctggagcagaggaggaaggacctgagcaagctgctggcctacatccggctgcccctgctggccccccagttcctggccgacatggagaacaacgtgctcttcagagatgacatcgagtgccagaagctgatcatggaggccatgaagtaccacctgctgcctgagcggcggcccatgctgcagagccccaggaccaagcccaggaagagcacagtgggcaccctgtttgctgtgggcggcatggacagcaccaagggggccaccagcattgagaagtatgacctgcggaccaacatgtggacccctgtggccaacatgaatggaagaaggctgcagtttggagtggccgtgctggatgacaagctgtatgtggtgggcggcagagatggcctgaagaccctgaacacagtggagtgctacaaccccaagaccaagacctggagcgtgatgccacccatgagcacccaccgccacggcctgggcgtggccgtgctggagggccccatgtatgctgtgggcggccatgatggctggagctacctgaacacagtggagcgctgggacccccaggcccggcagtggaactttgtggccaccatgagcacccccaggagcacagtgggcgtggccgtgctgagcggcaagctgtatgctgtgggcggcagagatggcagcagctgcctgaagtctgtggagtgctttgacccccacaccaacaagtggaccctgtgtgcccagatgagcaagaggcggggcggcgtgggcgtgaccacctggaatggcctgctgtatgccatcggcggccatgatgccccagccagcaacctgaccagccggctgagtgactgtgtggagagatatgaccccaagacagacatgtggacagctgtggcctccatgagcatcagcagagatgctgtgggcgtgtgcctgctgggggacaagctgtatgctgtgggcggctatgatggccaggcctacctgaacacagtggaggcctatgacccccagaccaatgagtggacccaggtgtggcacagctgcttcatcatcaccctgaccctcttcctgctgaagcagttcctgtggtag

SEQ ID NO: 156820 - DNA, 2268 bp, Artificial Sequence
  Description of Artificial Sequence: Synthetic coding sequence
atgaatgtcatctacttccccctgcacatctttgtggtgtacagccgggcctacaccagcctggtgctggtgggctgcaccaacctgtgtgctgtgctgtttgcccgctgcctggatgaccacctggtgtccctgaggatgagcggcagcaggaaggagtttgatgtgaagcagatcctgaagatccgctggcgctggtttggccaccaggccagcagccccaacagcacagtggacagccagcagggcgagttctggaacagaggccagacaggagccaacggcggcaggaagttcctggacccctgcagcctgcagctgcccctggccagcatcggctacagaagaagcagccagctggacttccagaacagccccagctggcccatggccagcaccagcgaggtgcctgcctttgagttcaccgctgaggactgtggcggggcccactggctggacaggcctgaggtggatgatggcaccagcgaggaggagaatgaaagtgacagcagcagctgcaggaccagcaacagcagccagaccctgagcagctgccacaccatggagccctgcaccagtgatgagttcttccaggccctgaaccacgccgagcagaccttcaagaagatggagaactacctgcggcacaagcagctgtgtgatgtgatcctggtggccggggaccggcgcatcccagcccaccggctggtgctgagctctgtgtctgactactttgctgccatgttcaccaatgatgtgcgggaggcccggcaggaggagatcaagatggagggcgtggagcccaacagcctgtggagcctcatccagtatgcctacacaggccgcctggagctgaaggaggacaacattgaatgtctgctgagcacagcctgcctgctgcagctgagccaggtggtggaggcctgctgcaagttcctgatgaagcagctgcaccccagcaactgcctgggcatccgcagctttgctgatgcccagggctgcacagacctgcacaaggtggcccacaactacaccatggagcacttcatggaggtgatccggaaccaggagtttgtgctgctgcctgccagcgagatcgccaagctgctggccagtgatgacatgaacatccccaatgaggagaccatcctgaatgccctgctgacctgggtgagacatgacctggagcagaggaggaaggacctgagcaagctgctggcctacatccggctgcccctgctggccccccagttcctggccgacatggagaacaacgtgctcttcagagatgacatcgagtgccagaagctgatcatggaggccatgaagtaccacctgctgcctgagcggcggcccatgctgcagagccccaggaccaagcccaggaagagcacagtgggcaccctgtttgctgtgggcggcatggacagcaccaagggggccaccagcattgagaagtatgacctgcggaccaacatgtggacccctgtggccaacatgaatggaagaaggctgcagtttggagtggccgtgctggatgacaagctgtatgtggtgggcggcagagatggcctgaagaccctgaacacagtggagtgctacaaccccaagaccaagacctggagcgtgatgccacccatgagcacccaccgccacggcctgggcgtggccgtgctggagggccccatgtatgctgtgggcggccatgatggctggagctacctgaacacagtggagcgctgggacccccaggcccggcagtggaactttgtggccaccatgagcacccccaggagcacagtgggcgtggccgtgctgagcggcaagctgtatgctgtgggcggcagagatggcagcagctgcctgaagtctgtggagtgctttgacccccacaccaacaagtggaccctgtgtgcccagatgagcaagaggcggggcggcgtgggcgtgaccacctggaatggcctgctgtatgccatcggcggccatgatgccccagccagcaacctgaccagccggctgagtgactgtgtggagagatatgaccccaagacagacatgtggacagctgtggcctccatgagcatcagcagagatgctgtgggcgtgtgcctgctgggggacaagctgtatgctgtgggcggctatgatggccaggcctacctgaacacagtggaggcctatgacccccagaccaatgagtggacccaggtggcccccctgtgcctgggccgggccggggcctgtgtggtgacagtgaagctgtag

SEQ ID NO: 156821 - DNA, 849 bp, Artificial Sequence
  Description of Artificial Sequence: Synthetic coding sequence
tgaagaaccaacatgtggacccctgtggccaacatgaatggaagaaggctgcagtttggagtggccgtgctggatgacaagctgtatgtggtgggcggcagagatggcctgaagaccctgaacacagtggagtgctacaaccccaagaccaagacctggagcgtgatgccacccatgagcacccaccgccacggcctgggcgtggccgtgctggagggccccatgtatgctgtgggcggccatgatggctggagctacctgaacacagtggagcgctgggacccccaggcccggcagtggaactttgtggccaccatgagcacccccaggagcacagtgggcgtggccgtgctgagcggcaagctgtatgctgtgggcggcagagatggcagcagctgcctgaagtctgtggagtgctttgacccccacaccaacaagtggaccctgtgtgcccagatgagcaagaggcggggcggcgtgggcgtgaccacctggaatggcctgctgtatgccatcggcggccatgatgccccagccagcaacctgaccagccggctgagtgactgtgtggagagatatgaccccaagacagacatgtggacagctgtggcctccatgagcatcagcagagatgctgtgggcgtgtgcctgctgggggacaagctgtatgctgtgggcggctatgatggccaggcctacctgaacacagtggaggcctatgacccccagaccaatgagtggacccaggtgttcagccacacctttgaggacagcaaggaccacctggtggccatcaagcagaccatctggaggcagaacagcctgtctgaggagttccgcagccactag

SEQ ID NO: 156822 - DNA, 2370 bp, Artificial Sequence
  Description of Artificial Sequence: Synthetic coding sequence
atgaggctgcccggccagggcctgggcgcccgggagggccccagcatccccctgagcagccctgccccagccccagccagccctgcccccccagcctggccacccaggcctgctgtgacccacggccgcctgcggagccccacccggcgggcctacaccagcctggtgctggtgggctgcaccaacctgtgtgctgtgctgtttgcccgctgcctggatgaccacctggtgtccctgaggatgagcggcagcaggaaggagtttgatgtgaagcagatcctgaagatccgctggcgctggtttggccaccaggccagcagccccaacagcacagtggacagccagcagggcgagttctggaacagaggccagacaggagccaacggcggcaggaagttcctggacccctgcagcctgcagctgcccctggccagcatcggctacagaagaagcagccagctggacttccagaacagccccagctggcccatggccagcaccagcgaggtgcctgcctttgagttcaccgctgaggactgtggcggggcccactggctggacaggcctgaggtggatgatggcaccagcgaggaggagaatgaaagtgacagcagcagctgcaggaccagcaacagcagccagaccctgagcagctgccacaccatggagccctgcaccagtgatgagttcttccaggccctgaaccacgccgagcagaccttcaagaagatggagaactacctgcggcacaagcagctgtgtgatgtgatcctggtggccggggaccggcgcatcccagcccaccggctggtgctgagctctgtgtctgactactttgctgccatgttcaccaatgatgtgcgggaggcccggcaggaggagatcaagatggagggcgtggagcccaacagcctgtggagcctcatccagtatgcctacacaggccgcctggagctgaaggaggacaacattgaatgtctgctgagcacagcctgcctgctgcagctgagccaggtggtggaggcctgctgcaagttcctgatgaagcagctgcaccccagcaactgcctgggcatccgcagctttgctgatgcccagggctgcacagacctgcacaaggtggcccacaactacaccatggagcacttcatggaggtgatccggaaccaggagtttgtgctgctgcctgccagcgagatcgccaagctgctggccagtgatgacatgaacatccccaatgaggagaccatcctgaatgccctgctgacctgggtgagacatgacctggagcagaggaggaaggacctgagcaagctgctggcctacatccggctgcccctgctggccccccagttcctggccgacatggagaacaacgtgctcttcagagatgacatcgagtgccagaagctgatcatggaggccatgaagtaccacctgctgcctgagcggcggcccatgctgcagagccccaggaccaagcccaggaagagcacagtgggcaccctgtttgctgtgggcggcatggacagcaccaagggggccaccagcattgagaagtatgacctgcggaccaacatgtggacccctgtggccaacatgaatggaagaaggctgcagtttggagtggccgtgctggatgacaagctgtatgtggtgggcggcagagatggcctgaagaccctgaacacagtggagtgctacaaccccaagaccaagacctggagcgtgatgccacccatgagcacccaccgccacggcctgggcgtggccgtgctggagggccccatgtatgctgtgggcggccatgatggctggagctacctgaacacagtggagcgctgggacccccaggcccggcagtggaactttgtggccaccatgagcacccccaggagcacagtgggcgtggccgtgctgagcggcaagctgtatgctgtgggcggcagagatggcagcagctgcctgaagtctgtggagtgctttgacccccacaccaacaagtggaccctgtgtgcccagatgagcaagaggcggggcggcgtgggcgtgaccacctggaatggcctgctgtatgccatcggcggccatgatgccccagccagcaacctgaccagccggctgagtgactgtgtggagagatatgaccccaagacagacatgtggacagctgtggcctccatgagcatcagcagagatgctgtgggcgtgtgcctgctgggggacaagctgtatgctgtgggcggctatgatggccaggcctacctgaacacagtggaggcctatgacccccagaccaatgagtggacccaggtggcccccctgtgcctgggccgggccggggcctgtgtggtgacagtgaagctgtag

SEQ ID NO: 156823 - DNA, 1050 bp, Artificial Sequence
  Description of Artificial Sequence: Synthetic coding sequence
aagaagcaccccagcacagtgatggtgccccagttcctggccgacatggagaacaacgtgctcttcagagatgacatcgagtgccagaagctgatcatggaggccatgaagtaccacctgctgcctgagcggcggcccatgctgcagagccccaggaccaagcccaggaagagcacagtgggcaccctgtttgctgtgggcggcatggacagcaccaagggggccaccagcattgagaagtatgacctgcggaccaacatgtggacccctgtggccaacatgaatggaagaaggctgcagtttggagtggccgtgctggatgacaagctgtatgtggtgggcggcagagatggcctgaagaccctgaacacagtggagtgctacaaccccaagaccaagacctggagcgtgatgccacccatgagcacccaccgccacggcctgggcgtggccgtgctggagggccccatgtatgctgtgggcggccatgatggctggagctacctgaacacagtggagcgctgggacccccaggcccggcagtggaactttgtggccaccatgagcacccccaggagcacagtgggcgtggccgtgctgagcggcaagctgtatgctgtgggcggcagagatggcagcagctgcctgaagtctgtggagtgctttgacccccacaccaacaagtggaccctgtgtgcccagatgagcaagaggcggggcggcgtgggcgtgaccacctggaatggcctgctgtatgccatcggcggccatgatgccccagccagcaacctgaccagccggctgagtgactgtgtggagagatatgaccccaagacagacatgtggacagctgtggcctccatgagcatcagcagagatgctgtgggcgtgtgcctgctgggggacaagctgtatgctgtgggcggctatgatggccaggcctacctgaacacagtggaggcctatgacccccagaccaatgagtggacccaggtggcccccctgtgcctgggccgggccggggcctgtgtggtgacagtgaagctgtag

SEQ ID NO: 156824 - DNA, 2130 bp, Artificial Sequence
  Description of Artificial Sequence: Synthetic coding sequence
atgagcggcagcaggaaggagtttgatgtgaagcagatcctgaagatccgctggcgctggtttggccaccaggccagcagccccaacagcacagtggacagccagcagggcgagttctggaacagaggccagacaggagccaacggcggcaggaagttcctggacccctgcagcctgcagctgcccctggccagcatcggctacagaagaagcagccagctggacttccagaacagccccagctggcccatggccagcaccagcgaggtgcctgcctttgagttcaccgctgaggactgtggcggggcccactggctggacaggcctgaggtggatgatggcaccagcgaggaggagaatgaaagtgacagcagcagctgcaggaccagcaacagcagccagaccctgagcagctgccacaccatggagccctgcaccagtgatgagttcttccaggccctgaaccacgccgagcagaccttcaagaagatggagaactacctgcggcacaagcagctgtgtgatgtgatcctggtggccggggaccggcgcatcccagcccaccggctggtgctgagctctgtgtctgactactttgctgccatgttcaccaatgatgtgcgggaggcccggcaggaggagatcaagatggagggcgtggagcccaacagcctgtggagcctcatccagtatgcctacacaggccgcctggagctgaaggaggacaacattgaatgtctgctgagcacagcctgcctgctgcagctgagccaggtggtggaggcctgctgcaagttcctgatgaagcagctgcaccccagcaactgcctgggcatccgcagctttgctgatgcccagggctgcacagacctgcacaaggtggcccacaactacaccatggagcacttcatggaggtgatccggaaccaggagtttgtgctgctgcctgccagcgagatcgccaagctgctggccagtgatgacatgaacatccccaatgaggagaccatcctgaatgccctgctgacctgggtgagacatgacctggagcagaggaggaaggacctgagcaagctgctggcctacatccggctgcccctgctggccccccagttcctggccgacatggagaacaacgtgctcttcagagatgacatcgagtgccagaagctgatcatggaggccatgaagtaccacctgctgcctgagcggcggcccatgctgcagagccccaggaccaagcccaggaagagcacagtgggcaccctgtttgctgtgggcggcatggacagcaccaagggggccaccagcattgagaagtatgacctgcggaccaacatgtggacccctgtggccaacatgaatggaagaaggctgcagtttggagtggccgtgctggatgacaagctgtatgtggtgggcggcagagatggcctgaagaccctgaacacagtggagtgctacaaccccaagaccaagacctggagcgtgatgccacccatgagcacccaccgccacggcctgggcgtggccgtgctggagggccccatgtatgctgtgggcggccatgatggctggagctacctgaacacagtggagcgctgggacccccaggcccggcagtggaactttgtggccaccatgagcacccccaggagcacagtgggcgtggccgtgctgagcggcaagctgtatgctgtgggcggcagagatggcagcagctgcctgaagtctgtggagtgctttgacccccacaccaacaagtggaccctgtgtgcccagatgagcaagaggcggggcggcgtgggcgtgaccacctggaatggcctgctgtatgccatcggcggccatgatgccccagccagcaacctgaccagccggctgagtgactgtgtggagagatatgaccccaagacagacatgtggacagctgtggcctccatgagcatcagcagagatgctgtgggcgtgtgcctgctgggggacaagctgtatgctgtgggcggctatgatggccaggcctacctgaacacagtggaggcctatgacccccagaccaatgagtggacccaggtggcccccctgtgcctgggccgggccggggcctgtgtggtgacagtgaagctgtag

SEQ ID NO: 156825 - DNA, 2085 bp, Artificial Sequence
  Description of Artificial Sequence: Synthetic coding sequence
atgaatgtcatctacttccccctgcacatctttgtggtgtacagccgggcctacaccagcctggtgctggtgggctgcaccaacctgtgtgctgtgctgtttgcccgctgcctggatgaccacctggtgtccctgaggatgagcggcagcaggaaggagtttgatgtgaagcagatcctgaagatccgctggcgctggtttggccaccaggccagcagccccaacagcacagtggacagccagcagggcgagttctggaacagaggccagacaggagccaacggcggcaggaagttcctggacccctgcagcctgcagctgcccctggccagcatcggctacagaagaagcagccagctggacttccagaacagccccagctggcccatggccagcaccagcgaggtgcctgcctttgagttcaccgctgaggactgtggcggggcccactggctggacaggcctgaggtggatgatggcaccagcgaggaggagaatgaaagtgacagcagcagctgccgcctggtgctgagctctgtgtctgactactttgctgccatgttcaccaatgatgtgcgggaggcccggcaggaggagatcaagatggagggcgtggagcccaacagcctgtggagcctcatccagtatgcctacacaggccgcctggagctgaaggaggacaacatcgagtgcctgctgagcacagcctgcctgctgcagctgagccaggtggtggaggcctgctgcaagttcctgatgaagcagctgcaccccagcaactgcctgggcatccgcagctttgctgatgcccagggctgcacagacctgcacaaggtggcccacaactacaccatggagcacttcatggaggtgatccggaaccaggagtttgtgctgctgcctgccagcgagatcgccaagctgctggccagtgatgacatgaacatccccaatgaggagaccatcctgaatgccctgctgacctgggtgagacatgacctggagcagaggaggaaggacctgagcaagctgctggcctacatccggctgcccctgctggccccccagttcctggccgacatggagaacaacgtgctcttcagagatgacatcgagtgccagaagctgatcatggaggccatgaagtaccacctgctgcctgagcggcggcccatgctgcagagccccaggaccaagcccaggaagagcacagtgggcaccctgtttgctgtgggcggcatggacagcaccaagggggccaccagcattgagaagtatgacctgcggaccaacatgtggacccctgtggccaacatgaatggccggcggctgcagtttggagtggccgtgctggatgacaagctgtatgtggtgggcggcagagatggcctgaagaccctgaacacagtggagtgctacaaccccaagaccaagacctggagcgtgatgccacccatgagcacccacagacatggcctgggcgtggccgtgctggagggccccatgtatgctgtgggcggccatgatggctggagctacctgaacacagtggagcgctgggacccccaggcccggcagtggaactttgtggccaccatgagcacccccaggagcacagtgggcgtggccgtgctgagcggcaagctgtatgctgtgggcggcagagatggcagcagctgcctgaagtctgtggagtgctttgacccccacaccaacaagtggaccctgtgtgcccagatgagcaagagaagaggaggagtgggcgtgaccacctggaatggcctgctgtatgccatcggcggccatgatgccccagccagcaacctgaccagccggctgagtgactgtgtggagagatatgaccccaagacagacatgtggacagctgtggcctccatgagcatcagcagagatgctgtgggcgtgtgcctgctgggggacaagctgtatgctgtgggcggctatgatggccaggcctacctgaacacagtggaggcctatgacccccagaccaatgagtggacccaggtggcccccctgtgcctgggccgggccggggcctgtgtggtgacagtgaagctgtag

SEQ ID NO: 156826 - DNA, 1707 bp, Artificial Sequence
  Description of Artificial Sequence: Synthetic coding sequence
atggagccctgcaccagtgatgagttcttccaggccctgaaccacgccgagcagaccttcaagaagatggagaactacctgcggcacaagcagctgtgtgatgtgatcctggtggccggggaccggcgcatcccagcccaccggctggtgctgagctctgtgtctgactactttgctgccatgttcaccaatgatgtgcgggaggcccggcaggaggagatcaagatggagggcgtggagcccaacagcctgtggagcctcatccagtatgcctacacaggccgcctggagctgaaggaggacaacatcgagtgcctgctgagcacagcctgcctgctgcagctgagccaggtggtggaggcctgctgcaagttcctgatgaagcagctgcaccccagcaactgcctgggcatccgcagctttgctgatgcccagggctgcacagacctgcacaaggtggcccacaactacaccatggagcacttcatggaggtgatccggaaccaggagtttgtgctgctgcctgccagcgagatcgccaagctgctggccagtgatgacatgaacatccccaatgaggagaccatcctgaatgccctgctgacctgggtgagacatgacctggagcagaggaggaaggacctgagcaagctgctggcctacatccggctgcccctgctggccccccagttcctggccgacatggagaacaacgtgctcttcagagatgacatcgagtgccagaagctgatcatggaggccatgaagtaccacctgctgcctgagcggcggcccatgctgcagagccccaggaccaagcccaggaagagcacagtgggcaccctgtttgctgtgggcggcatggacagcaccaagggggccaccagcattgagaagtatgacctgcggaccaacatgtggacccctgtggccaacatgaatggccggcggctgcagtttggagtggccgtgctggatgacaagctgtatgtggtgggcggcagagatggcctgaagaccctgaacacagtggagtgctacaaccccaagaccaagacctggagcgtgatgccacccatgagcacccacagacatggcctgggcgtggccgtgctggagggccccatgtatgctgtgggcggccatgatggctggagctacctgaacacagtggagcgctgggacccccaggcccggcagtggaactttgtggccaccatgagcacccccaggagcacagtgggcgtggccgtgctgagcggcaagctgtatgctgtgggcggcagagatggcagcagctgcctgaagtctgtggagtgctttgacccccacaccaacaagtggaccctgtgtgcccagatgagcaagagaagaggaggagtgggcgtgaccacctggaatggcctgctgtatgccatcggcggccatgatgccccagccagcaacctgaccagccggctgagtgactgtgtggagagatatgaccccaagacagacatgtggacagctgtggcctccatgagcatcagcagagatgctgtgggcgtgtgcctgctgggggacaagctgtatgctgtgggcggctatgatggccaggcctacctgaacacagtggaggcctatgacccccagaccaatgagtggacccaggtggcccccctgtgcctgggccgggccggggcctgtgtggtgacagtgaagctgtag

SEQ ID NO: 156827 - DNA, 1866 bp, Artificial Sequence
  Description of Artificial Sequence: Synthetic coding sequence
atgctgatggccggccagagaggagcctggaccatgggagatgtggtggagaagagcctggagggccccctggcccccagcacagatgagcccagccagaagacaggagacctggtggagatcctgaatggagagaaggtgaagtttgatgatgctggcctgagcctcatcctgcagaatggcctggagaccctgaggatggagaatgccctgacagatgtgatcctgtgtgtggacatccaggagttcagctgccaccgggtggtgctggccgccgccagcaactacttccgggccatgttctgcaatgacctgaaggagaagtatgagaagaggatcatcatcaagggcgtggatgctgagaccatgcacaccctgctggactacacctacaccagcaaggccctgatcaccaagcagaatgtgcagagggtgctggaggccgccaacctcttccagttcctgaggatggtggatgcctgtgccagcttcctgacagaggccctgaaccctgagaactgtgtgggcatcctgcggctggccgacacccacagcctggacagcctgaagaagcaggtgcagagctacatcatccagaactttgtgcagatcctgaacagcgaggagttcctggacctgcctgtggacaccctgcaccacatcctgaagagtgatgacctgtatgtgacagaggaggcccaggtgtttgagaccgtgatgtcctgggtgcgccacaagcccagcgagcggctgtgcctgctgccctacgtgctggagaatgtgcggctgcccctgctggacccctggtactttgtggagaccgtggaggccgaccccctcatccggcagtgcccagaggtgttccccctgctgcaggaggccaggatgtaccacctgtctggaaatgagatcatcagcgagaggaccaagcccaggatgcatgagttccagagcgaggtgttcatgatcatcggcggctgcaccaaggatgaaagatttgtggccgaggtgacctgcctggaccccctgcggcgcagccggctggaggtggccaagctgcccctgacagagcacgagctggagagcgagaacaagaagtgggtggagtttgcctgtgtgaccctgaagaatgaggtgtacatcagcggcggcaaggagacccagcatgatgtgtggaagtacaacagcagcatcaacaagtggatccagatcgagtacctgaacatcggccgctggaggcacaagatggtggtgctgggcggcaaggtgtatgtgattggaggctttgatggcctgcagaggatcaacaacgtggagacctatgaccccttccacaactgctggagcgaggccgcccccctgctggtgcacgtgagcagctttgctgccaccagccacaagaagaagctgtatgtgattggaggcggccccaacgggaagctggccacagacaagacccagtgctatgaccccagcaccaacaagtggagcctgaaggccgccatgcctgtggaggccaagtgcatcaatgctgtgtccttccgggaccgcatctacgtggtgggcggggccatgagggccctgtatgcctacagccccctggaggacagctggtgcctggtgacccagctgagccatgagcgggccagctgtggcatcgccccctgcaacaaccggctgtacatcactggaggaagagatgagaagaatgaggtgattgccaccgtgctgtgctgggaccctgaggcccagaagctgacagaagaatgtgtgctgccccggggcgtgagccaccacggctctgtgaccatcaggaagagctacacccacatccgccgcatcgtgcctggagctgtgtctgtgtag

SEQ ID NO: 156828 - DNA, 1695 bp, Artificial Sequence
  Description of Artificial Sequence: Synthetic coding sequence
atgctgggcggcacagactgcaggaccttcctgaccagccacatcaacctgaagaagaccctgtgtgatgtgatcctgatggtgcaggagaggaagatcccagcccaccgggtggtgctggccgccgccagccacttcttcaacctgatgttcaccaccaacatgctggagagcaagagctttgaggtggagctgaaggatgctgagccagacatcatcgagcagctggtggagtttgcctacacagcccgcatctctgtgaacagcaacaacgtgcagagcctgctggatgctgccaaccagtaccagatcgagcctgtgaagaagatgtgtgtggacttcctgaaggagcaggtggatgccagcaactgcctgggcatctctgtgctggccgagtgcctggactgcccagagctgaaggccacagcagatgacttcatccaccagcacttcacagaggtgtacaagacagatgagttcctgcagctggatgtgaagagggtgacccacctgctgaaccaggacaccctgactgtgcgggcagaggaccaggtgtatgatgctgctgtgcgctggctgaagtatgatgagcccaaccggcagcccttcatggtggacatcctggccaaggtgcgcttccccctcatcagcaagaacttcctgagcaagacagtgcaggccgagcccctcatccaggacaaccctgagtgcctgaagatggtgatcagcggcatgagataccacctgctgagcccagaagatcgggaggagctggtggatggcacccggcccaggaggaagaagcatgactacagaattgccctgtttggaggcagccagccccagagctgccgctacttcaaccccaaggactacagctggacagacatccgctgcccctttgagaagagaagagatgctgcctgtgtgttctgggacaacgtggtgtacatcctgggcggcagccagctgttccccatcaagaggatggactgctacaacgtggtgaaggacagctggtacagcaagctgggcccccccaccccccgggacagcctggccgcctgtgccgctgagggcaagatctacaccagcggcggcagcgaggtgggcaacagcgccctgtacctgtttgaatgttatgacaccaggacagagagctggcacaccaagcccagcatgctgacccagcgctgcagccacggcatggtggaggccaacggcctcatctacgtgtgtggcggcagcctgggcaacaacgtgtctggccgggtgctgaacagctgtgaggtgtatgaccctgccacagagacctggacagagctgtgccccatgattgaggccaggaagaaccacggcctggtgtttgtgaaggacaagatctttgctgtgggcggccagaatggcctgggcggcctggacaacgtggagtactatgacatcaagctgaatgagtggaagatggtgagccccatgccctggaagggcgtgacagtgaagtgtgccgctgtgggcagcatcgtgtatgtgctggccggcttccagggcgtgggccgcctgggccacatcctggagtacaacacagaaacagacaagtgggtggccaacagcaaggtgcgggccttccctgtgaccagctgcctgatctgtgtggtggacacctgtggggccaatgaggagaccctggagacctag

SEQ ID NO: 156829 - DNA, 1761 bp, Artificial Sequence
  Description of Artificial Sequence: Synthetic coding sequence
atggccgccagcggcgtggagaagagcagcaagaagaagacagagaagaagctggccgcccgggaggaggccaagctgctggccggcttcatgggcgtgatgaacaacatgaggaagcagaagaccctgtgtgatgtgatcctgatggtgcaggagaggaagatcccagcccaccgggtggtgctggccgccgccagccacttcttcaacctgatgttcaccaccaacatgctggagagcaagagctttgaggtggagctgaaggatgctgagccagacatcatcgagcagctggtggagtttgcctacacagcccgcatctctgtgaacagcaacaacgtgcagagcctgctggatgctgccaaccagtaccagatcgagcctgtgaagaagatgtgtgtggacttcctgaaggagcaggtggatgccagcaactgcctgggcatctctgtgctggccgagtgcctggactgcccagagctgaaggccacagcagatgacttcatccaccagcacttcacagaggtgtacaagacagatgagttcctgcagctggatgtgaagagggtgacccacctgctgaaccaggacaccctgactgtgcgggcagaggaccaggtgtatgatgctgctgtgcgctggctgaagtatgatgagcccaaccggcagcccttcatggtggacatcctggccaaggtgcgcttccccctcatcagcaagaacttcctgagcaagacagtgcaggccgagcccctcatccaggacaaccctgagtgcctgaagatggtgatcagcggcatgagataccacctgctgagcccagaagatcgggaggagctggtggatggcacccggcccaggaggaagaagcatgactacagaattgccctgtttggaggcagccagccccagagctgccgctacttcaaccccaaggactacagctggacagacatccgctgcccctttgagaagagaagagatgctgcctgtgtgttctgggacaacgtggtgtacatcctgggcggcagccagctgttccccatcaagaggatggactgctacaacgtggtgaaggacagctggtacagcaagctgggcccccccaccccccgggacagcctggccgcctgtgccgctgagggcaagatctacaccagcggcggcagcgaggtgggcaacagcgccctgtacctgtttgaatgttatgacaccaggacagagagctggcacaccaagcccagcatgctgacccagcgctgcagccacggcatggtggaggccaacggcctcatctacgtgtgtggcggcagcctgggcaacaacgtgtctggccgggtgctgaacagctgtgaggtgtatgaccctgccacagagacctggacagagctgtgccccatgattgaggccaggaagaaccacggcctggtgtttgtgaaggacaagatctttgctgtgggcggccagaatggcctgggcggcctggacaacgtggagtactatgacatcaagctgaatgagtggaagatggtgagccccatgccctggaagggcgtgacagtgaagtgtgccgctgtgggcagcatcgtgtatgtgctggccggcttccagggcgtgggccgcctgggccacatcctggagtacaacacagaaacagacaagtgggtggccaacagcaaggtgcgggccttccctgtgaccagctgcctgatctgtgtggtggacacctgtggggccaatgaggagaccctggagacctag

SEQ ID NO: 156830 - DNA, 1617 bp, Artificial Sequence
  Description of Artificial Sequence: Synthetic coding sequence
atggtgcaggagaggaagatcccagcccaccgggtggtgctggccgccgccagccacttcttcaacctgatgttcaccaccaacatgctggagagcaagagctttgaggtggagctgaaggatgctgagccagacatcatcgagcagctggtggagtttgcctacacagcccgcatctctgtgaacagcaacaacgtgcagagcctgctggatgctgccaaccagtaccagatcgagcctgtgaagaagatgtgtgtggacttcctgaaggagcaggtggatgccagcaactgcctgggcatctctgtgctggccgagtgcctggactgcccagagctgaaggccacagcagatgacttcatccaccagcacttcacagaggtgtacaagacagatgagttcctgcagctggatgtgaagagggtgacccacctgctgaaccaggacaccctgactgtgcgggcagaggaccaggtgtatgatgctgctgtgcgctggctgaagtatgatgagcccaaccggcagcccttcatggtggacatcctggccaaggtgcgcttccccctcatcagcaagaacttcctgagcaagacagtgcaggccgagcccctcatccaggacaaccctgagtgcctgaagatggtgatcagcggcatgagataccacctgctgagcccagaagatcgggaggagctggtggatggcacccggcccaggaggaagaagcatgactacagaattgccctgtttggaggcagccagccccagagctgccgctacttcaaccccaaggactacagctggacagacatccgctgcccctttgagaagagaagagatgctgcctgtgtgttctgggacaacgtggtgtacatcctgggcggcagccagctgttccccatcaagaggatggactgctacaacgtggtgaaggacagctggtacagcaagctgggcccccccaccccccgggacagcctggccgcctgtgccgctgagggcaagatctacaccagcggcggcagcgaggtgggcaacagcgccctgtacctgtttgaatgttatgacaccaggacagagagctggcacaccaagcccagcatgctgacccagcgctgcagccacggcatggtggaggccaacggcctcatctacgtgtgtggcggcagcctgggcaacaacgtgtctggccgggtgctgaacagctgtgaggtgtatgaccctgccacagagacctggacagagctgtgccccatgattgaggccaggaagaaccacggcctggtgtttgtgaaggacaagatctttgctgtgggcggccagaatggcctgggcggcctggacaacgtggagtactatgacatcaagctgaatgagtggaagatggtgagccccatgccctggaagggcgtgacagtgaagtgtgccgctgtgggcagcatcgtgtatgtgctggccggcttccagggcgtgggccgcctgggccacatcctggagtacaacacagaaacagacaagtgggtggccaacagcaaggtgcgggccttccctgtgaccagctgcctgatctgtgtggtggacacctgtggggccaatgaggagaccctggagacctag

SEQ ID NO: 156831 - DNA, 1161 bp, Artificial Sequence
  Description of Artificial Sequence: Synthetic coding sequence
atggccgccagcggcgtggagaagagcagcaagaagaagacagagaagaagctggccgcccgggaggaggccaagctgctggccggcttcatgggcgtgatgaacaacatgaggaagcagaagaccctgtgtgatgtgatcctgatggtgcaggagaggaagatcccagcccaccgggtggtgctggccgccgccagccacttcttcaacctgatgttcaccaccaacatgctggagagcaagagctttgaggtggagctgaaggatgctgagccagacatcatcgagcagctgctgcactacaagttcttcaagatgaagaacaggaaggatggccgggtgtctgtgtcctatgccatcctgatccagggcctgaagatctatgagatctacagcaccaacttccctgagcacttcacagaggtgtacaagacagatgagttcctgcagctggatgtgaagagggtgacccacctgctgaaccaggacaccctgactgtgcgggcagaggaccaggtgtatgatgctgctgtgcgctggctgaagtatgatgagcccaaccggcagcccttcatggtggacatcctggccaaggtgcgcttccccctcatcagcaagaacttcctgagcaagacagtgcaggccgagcccctcatccaggacaaccctgagtgcctgaagatggtgatcagcggcatgagataccacctgctgagcccagaagatcgggaggagctggtggatggcacccggcccaggaggaagaagcatgactacagaattgccctgtttggaggcagccagccccagagctgccgctacttcaaccccaaggactacagctggacagacatccgctgcccctttgagaagagaagagatgctgcctgtgtgttctgggacaacgtggtgtacatcctgggcggcagccagctgttccccatcaagaggatggactgctacaacgtggtgaaggacagctggtacagcaagctgggcccccccaccccccgggacagcctggccgcctgtgccgctgagggcaagatctacaccagcggcggcagcgaggtgggcaacagcgccctgtacctgttctgcctgatccctgtgaagttcatgatcctgccccagaagcacggcctgagctgtgtgcagtag

SEQ ID NO: 156832 - DNA, 1284 bp, Artificial Sequence
  Description of Artificial Sequence: Synthetic coding sequence
atggccgccagcggcgtggagaagagcagcaagaagaagacagagaagaagctggccgcccgggaggaggccaagctgctggccggcttcatgggcgtgatgaacaacatgaggaagcagaagaccctgtgtgatgtgatcctgatggtgcaggagaggaagatcccagcccaccgggtggtgctggccgccgccagccacttcttcaacctgatgttcaccaccaacatgctggagagcaagaacttcctgagcaagacagtgcaggccgagcccctcatccaggacaacccagaatgtctgaagatggtgatcagcggcatgagataccacctgctgagccctgaggaccgggaggagctggtggatggcacccggcccaggaggaagaagcatgactaccgcatcgccctgtttggaggcagccagccccagagctgccgctacttcaaccccaaggactacagctggacagacatccgctgcccctttgagaagagaagagatgctgcctgtgtgttctgggacaacgtggtgtacatcctgggcggcagccagctgttccccatcaagaggatggactgctacaacgtggtgaaggacagctggtacagcaagctgggcccccccaccccccgggacagcctggccgcctgtgccgctgagggcaagatctacaccagcggcggcagcgaggtgggcaacagcgccctgtacctgtttgagtgctatgacaccaggacagagagctggcacaccaagcccagcatgctgacccagcgctgcagccacggcatggtggaggccaacggcctcatctacgtgtgtggcggcagcctgggcaacaacgtgtctggccgggtgctgaacagctgtgaggtgtatgaccctgccacagagacctggacagagctgtgccccatgattgaggccaggaagaaccacggcctggtgtttgtgaaggacaagatctttgctgtgggcggccagaatggcctgggcggcctggacaacgtggagtactatgacatcaagctgaatgagtggaagatggtgagccccatgccctggaagggcgtgacagtgaagtgtgccgctgtgggcagcatcgtgtatgtgctggccggcttccagggcgtgggccgcctgggccacatcctggagtacaacacagaaacagacaagtgggtggccaacagcaaggtgcgggccttccctgtgaccagctgcctgatctgtgtggtggacacctgtggggccaatgaggagaccctggagacctag

SEQ ID NO: 156833 - DNA, 1533 bp, Artificial Sequence
  Description of Artificial Sequence: Synthetic coding sequence
atgctggagagcaagagctttgaggtggagctgaaggatgctgagccagacatcatcgagcagctggtggagtttgcctacacagcccgcatctctgtgaacagcaacaacgtgcagagcctgctggatgctgccaaccagtaccagatcgagcctgtgaagaagatgtgtgtggacttcctgaaggagcaggtggatgccagcaactgcctgggcatctctgtgctggccgagtgcctggactgcccagagctgaaggccacagcagatgacttcatccaccagcacttcacagaggtgtacaagacagatgagttcctgcagctggatgtgaagagggtgacccacctgctgaaccaggacaccctgactgtgcgggcagaggaccaggtgtatgatgctgctgtgcgctggctgaagtatgatgagcccaaccggcagcccttcatggtggacatcctggccaaggtgcgcttccccctcatcagcaagaacttcctgagcaagacagtgcaggccgagcccctcatccaggacaaccctgagtgcctgaagatggtgatcagcggcatgagataccacctgctgagcccagaagatcgggaggagctggtggatggcacccggcccaggaggaagaagcatgactacagaattgccctgtttggaggcagccagccccagagctgccgctacttcaaccccaaggactacagctggacagacatccgctgcccctttgagaagagaagagatgctgcctgtgtgttctgggacaacgtggtgtacatcctgggcggcagccagctgttccccatcaagaggatggactgctacaacgtggtgaaggacagctggtacagcaagctgggcccccccaccccccgggacagcctggccgcctgtgccgctgagggcaagatctacaccagcggcggcagcgaggtgggcaacagcgccctgtacctgtttgaatgttatgacaccaggacagagagctggcacaccaagcccagcatgctgacccagcgctgcagccacggcatggtggaggccaacggcctcatctacgtgtgtggcggcagcctgggcaacaacgtgtctggccgggtgctgaacagctgtgaggtgtatgaccctgccacagagacctggacagagctgtgccccatgattgaggccaggaagaaccacggcctggtgtttgtgaaggacaagatctttgctgtgggcggccagaatggcctgggcggcctggacaacgtggagtactatgacatcaagctgaatgagtggaagatggtgagccccatgccctggaagggcgtgacagtgaagtgtgccgctgtgggcagcatcgtgtatgtgctggccggcttccagggcgtgggccgcctgggccacatcctggagtacaacacagaaacagacaagtgggtggccaacagcaaggtgcgggccttccctgtgaccagctgcctgatctgtgtggtggacacctgtggggccaatgaggagaccctggagacctag

SEQ ID NO: 156834 - DNA, 1086 bp, Artificial Sequence
  Description of Artificial Sequence: Synthetic coding sequence
atggtggacatcctggccaaggtgcgcttccccctcatcagcaagaacttcctgagcaagacagtgcaggccgagcccctcatccaggacaacccagaatgtctgaagatggtgatcagcggcatgagataccacctgctgagccctgaggaccgggaggagctggtggatggcacccggcccaggaggaagaagcatgactaccgcatcgccctgtttggaggcagccagccccagagctgccgctacttcaaccccaaggactacagctggacagacatccgctgcccctttgagaagagaagagatgctgcctgtgtgttctgggacaacgtggtgtacatcctgggcggcagccagctgttccccatcaagaggatggactgctacaacgtggtgaaggacagctggtacagcaagctgggcccccccaccccccgggacagcctggccgcctgtgccgctgagggcaagatctacaccagcggcggcagcgaggtgggcaacagcgccctgtacctgtttgagtgctatgacaccaggacagagagctggcacaccaagcccagcatgctgacccagcgctgcagccacggcatggtggaggccaacggcctcatctacgtgtgtggcggcagcctgggcaacaacgtgtctggccgggtgctgaacagctgtgaggtgtatgaccctgccacagagacctggacagagctgtgccccatgattgaggccaggaagaaccacggcctggtgtttgtgaaggacaagatctttgctgtgggcggccagaatggcctgggcggcctggacaacgtggagtactatgacatcaagctgaatgagtggaagatggtgagccccatgccctggaagggcgtgacagtgaagtgtgccgctgtgggcagcatcgtgtatgtgctggccggcttccagggcgtgggccgcctgggccacatcctggagtacaacacagaaacagacaagtgggtggccaacagcaaggtgcgggccttccctgtgaccagctgcctgatctgtgtggtggacacctgtggggccaatgaggagaccctggagacctag

SEQ ID NO: 156835 - DNA, 1695 bp, Artificial Sequence; identical to SEQ ID NO: 156828
  Description of Artificial Sequence: Synthetic coding sequence

SEQ ID NO: 156836 - DNA, 432 bp, Artificial Sequence
  Description of Artificial Sequence: Synthetic coding sequence
atgctgggcggcacagactgcaggaccttcctgaccagccacatcaacctgaagaagaccctgtgtgatgtgatcctgatggtgcaggagaggaagatcccagcccaccgggtggtgctggccgccgccagccacttcttcaacctgatgttcaccaccaacatgctggagagcaagagctttgaggtggagctgaaggatgctgagccagacatcatcgagcagctggtggagtttgcctacacagcccgcatctctgtgaacagcaacaacgtgcagagcctgctggatgctgccaaccagtaccagatcgagcctgtgaagaagatgtgtgtggacttcctgaaggagcaggtggatgccagcaactgcctgggcaagaagtaccagatccctgtggtgtgcctcttctgcttcatcctgtacttctag

SEQ ID NO: 156837 - DNA, 501 bp, Artificial Sequence
  Description of Artificial Sequence: Synthetic coding sequence
atggccgccagcggcgtggagaagagcagcaagaagaagacagagaagaagctggccgcccgggaggaggccaagctgctggccggcttcatgggcgtgatgaacaacatgaggaagcagaagaccctgtgtgatgtgatcctgatggtgcaggagaggaagatcccagcccaccgggtggtgctggccgccgccagccacttcttcaacctgatgttcaccaccaacatgctggagagcaagagctttgaggtggagctgaaggatgctgagccagacatcatcgagcagctggtggagtttgcctacacagcccgcatctctgtgaacagcaacaacgtgcagagcctgctggatgctgccaaccagtaccagatcgagcctgtgaagaagatgtgtgtggacttcctgaaggagcaggtggatgccagcaactgcctgggggaggccgagaaggtggaccagagcctgcctgaatgtggcatgctgttcaccgtgtag

SEQ ID NO: 156838 - DNA, 1863 bp, Artificial Sequence
  Description of Artificial Sequence: Synthetic coding sequence
atggccagtgacagcatgagcagcaagcaggccaggaaccacatcaccaagggcaagaggcagcagcagcaccagcagatcaagaacagaagcagcatcagtgatggagatggagaagattccttcatctttgaggccaatgaggcctggaaggacttccacggcagcctgctgcgcttctatgaaaatggagagctgtgtgatgtgaccctgaaggtgggcagcaagctgatcagctgccacaagctggtgctggcctgtgtgatcccctacttccgggccatgttcctgtctgagatggccgaggccaagcagaccctcatcgagatccgggactttgatggagatgccatcgaggacctggtgaagtttgtgtacagcagccggctgaccctgactgtggacaacgtgcagcccctgctgtatgctgcctgcatcctgcaggtggagctggtggcccgggcctgctgtgagtacatgaagctgcacttccaccccagcaactgcctggccgtgcgggcctttgctgagagccacaacagaattgacctgatggacatggctgaccagtatgcctgtgaccacttcacagaggtggtggagtgtgaagattttgtgtctgtgagcccccagcacctgcacaagctgctgagcagcagtgacctgaacattgaaaatgagaagcaggtgtacaatgctgccatcaagtggctgctggccaacccccagcaccacagcaagtggctggatgagaccctggcccaggtgcggctgcccctgctgcctgtggacttcctgatgggcgtggtggccaaggagcagatcgtgaagcagaacctgaagtgccgggacctgctggatgaggccaggaactaccacctgcacctgagcagcagagctgtgcctgactttgagtacagcatccgcaccacccccaggaagcacacagctggggtgctcttctgtgtgggcggccggggcggcagcggggaccccttccgcagcattgagtgctacagcatcaacaagaacagctggttcttcggccctgagatgaacagcagaagaagacatgtgggcgtcatctctgtggagggcaaggtgtatgctgtgggcggccatgatggaaatgagcacctgggctccatggagatgtttgaccccctgaccaacaagtggatgatgaaggcctccatgaacaccaagagaagaggcatcgccctggccagcctgggcggccccatctatgccatcggcggcctggatgacaacacctgcttcaatgatgtggagagatatgacattgaaagtgaccagtggagcacagtggcccccatgaacaccccccggggcggcgtgggctctgtggccctggtgaaccacgtgtatgctgtgggcggcaatgatggcatggccagcctgagctctgtggagagatatgacccccacctggacaagtggattgaggtgaaggagatgggccagaggagagctggaaatggagtgtccaagctgcacggctgcctgtatgtggtgggcggctttgatgacaacagccccctgagctctgtggagagatatgaccccaggagcaacaagtgggactatgtggccgccctgaccaccccccggggcggcgtgggcatcgccaccgtgatgggcaagatctttgctgtgggcggccacaatggaaatgcctacctgaacacagtggaggcctttgatcctgtgctgaaccgctgggagctggtgggctctgtgagccactgccgggccggggccggcgtggccgtgtgcagctgcctgaccagccagatcagagatgtgggccacggcagcaacaacgtggtggactgcatgtag

SEQ ID NO: 156839 - DNA, 1863 bp, Artificial Sequence; identical to SEQ ID NO: 156838
  Description of Artificial Sequence: Synthetic coding sequence

SEQ ID NO: 156840 - DNA, 810 bp, Artificial Sequence
  Description of Artificial Sequence: Synthetic coding sequence
atgaacagcagaagaagacatgtgggcgtcatctctgtggagggcaaggtgtatgctgtgggcggccatgatggaaatgagcacctgggctccatggagatgtttgaccccctgaccaacaagtggatgatgaaggcctccatgaacaccaagaggcggggcatcgccctggccagcctgggcggccccatctatgccatcggcggcctggatgacaacacctgcttcaatgatgtggagagatatgacatcgagagtgaccagtggagcacagtggcccccatgaacaccccccggggcggcgtgggctctgtggccctggtgaaccacgtgtatgctgtgggcggcaatgatggcatggccagcctgagctctgtggagagatatgacccccacctggacaagtggattgaggtgaaggagatgggccagaggagagctggaaatggagtgtccaagctgcacggctgcctgtatgtggtgggcggctttgatgacaacagccccctgagctctgtggagagatatgaccccaggagcaacaagtgggactatgtggccgccctgaccaccccccggggcggcgtgggcatcgccaccgtgatgggcaagatctttgctgtgggcggccacaatggaaatgcctacctgaacacagtggaggcctttgatcctgtgctgaaccgctgggagctggtgggctctgtgagccactgcagagctggagctggggtggccgtgtgcagctgcctgaccagccagatcagagatgtgggccacggcagcaacaacgtggtggactgcatgtag

SEQ ID NO: 156841 - DNA, 1875 bp, Artificial Sequence
  Description of Artificial Sequence: Synthetic coding sequence
atgcagcctgacccccggcccagcggggccggggcctgctgccgcttcctgcccctgcagagccagtgcccagagggcgctggagatgctgtgatgtatgccagcacagagtgcaaggccgaggtgacccccagccagcacggcaacagaaccttctcctacaccctggaggaccacaccaagcaggccttcggcatcatgaatgagctgcggctgagccagcagctgtgtgatgtgaccctgcaggtgaagtaccaggatgccccagctgcccagttcatggcccacaaggtggtgctggccagcagcagccctgtgttcaaggccatgttcaccaacggcctgcgggagcagggcatggaggtggtgtccattgagggcatccaccccaaggtgatggagcggctgattgaatttgcctacacagccagcatctccatgggagagaagtgtgtgctgcacgtgatgaatggagctgtgatgtaccagattgacagcgtggtgcgggcctgcagcgacttcctggtgcagcagctggaccccagcaatgccatcggcatcgccaactttgctgagcagatcggctgtgtggagctgcaccagagggcccgggagtacatctacatgcactttggagaggtggccaagcaggaggagttcttcaacctgagccactgccagctggtgaccctcatcagcagagatgacctgaatgtgcgctgtgagagcgaggtgttccacgcctgcatcaactgggtgaagtatgactgtgagcagaggcgcttctacgtgcaggccctgctgcgggctgtgcgctgccacagcctgacccccaacttcctgcagatgcagctgcagaagtgtgagatcctgcagagcgacagccgctgcaaggactacctggtgaagatctttgaggagctgaccctgcacaagcccacccaggtgatgccctgccgggcccccaaggtgggccgcctcatctacacagctgggggctacttccggcagagcctgagctacctggaggcctacaaccccagtgatggcacctggctgcggctggccgacctgcaggtgcccaggagcggcctggccggctgtgtggtgggcggcctgctgtatgctgtgggcggcaggaacaacagcccagatggcaacacagacagcagcgccctggactgctacaaccccatgaccaaccagtggagcccctgtgcccccatgtctgtgcccaggaaccgcatcggcgtgggcgtgattgatggccacatctatgctgtgggcggcagccacggctgcatccaccacaacagcgtggagagatatgagcctgagagagatgagtggcacctggtggcccccatgctgaccaggagaattggagtgggcgtggccgtgctgaaccggctgctgtatgctgtgggcggctttgatggcaccaaccggctgaacagcgctgagtgctactacccagagagaaatgagtggaggatgatcacagccatgaacaccatccgcagcggggccggcgtgtgtgtgctgcacaactgcatctatgctgctgggggctatgatggccaggaccagctgaacagcgtggagagatatgatgtggagacagagacctggacctttgtggcccccatgaagcacagaagaagtgccctgggcatcaccgtgcaccagggccgcatctacgtgctgggcggctatgatggccacaccttcctggacagcgtggagtgctatgaccctgacacagacacctggagcgaggtgaccaggatgaccagcggccgcagcggcgtgggcgtggccgtgaccatggagccctgcaggaagcagattgaccagcagaactgcacctgctag

SEQ ID NO: 156842 - DNA, 1875 bp, Artificial Sequence; identical to SEQ ID NO: 156841
  Description of Artificial Sequence: Synthetic coding sequence

SEQ ID NO: 156843 - DNA, 2199 bp, Artificial Sequence
  Description of Artificial Sequence: Synthetic coding sequence
atggagggcggggaccagagcgaggaggagccccgggagaggagccaggccggcggcatgggcaccctgtggagccaggagagcaccccagaggagcggctgcctgtggagggcagccggccctgggccgtggcccggcgggtgctgacagccatcctgatcctgggcctgctgctgtgcttctctgtgctgctcttctacaacttccagaactgtggcccccggccctgtgagacctctgtgtgcctggacctgcgggaccactacctggccagcggcaacacctctgtggccccctgcacagacttcttctcctttgcctgtggccgggccaaggagaccaacaacagcttccaggagctggccaccaagaacaagaaccggctgcggcgcatcctggaggtgcagaacagctggcaccctggcagcggggaggagaaggccttccagttctacaacagctgcatggacaccctggccattgaagctgctggcaccggccccctgcggcaggtgattgaggagctgggcggctggaggatcagcggcaagtggaccagcctgaacttcaacagaaccctgcggctgctgatgagccagtatggccacttccccttcttccgggcctacctgggcccccacccagccagcccccacacccctgtgatccagattgaccagcctgagtttgatgtgcccctgaagcaggaccaggagcagaagatctatgcccagatcttccgggagtacctgacctacctgaaccagctgggcaccctgctgggcggggaccccagcaaggtgcaggagcacagcagcctgagcatcagcatcaccagccgcctcttccagttcctgcggcccctggagcagaggcgggcccagggcaagctgttccagatggtgaccatcgaccagctgaaggagatggccccagccatcgactggctgagctgcctgcaggccaccttcacccccatgagcctgagccccagccagagcctggtggtgcatgatgtggagtacctgaagaacatgagccagctggtggaggagatgctgctgaagcagagggacttcctgcagagccacatgatcctgggcctggtggtgaccctgagccctgccctggacagccagttccaggaggcccggaggaagctgagccagaagctgcgggagctgacagagcagccccccatgcctgcccggccccgctggatgaagtgtgtggaggagaccggcaccttctttgagcccaccctggccgccctgtttgtgcgggaggccttcggccccagcaccaggtctgctgccatgaagctgttcaccgccatcagagatgccctgatcacccggctgaggaacctgccctggatgaatgaggagacccagaacatggcccaggacaaggtggcccagctgcaggtggagatgggcgccagcgagtgggccctgaagccagagctggcccggcaggagtacaatgacatccagctgggcagcagcttcctgcagagcgtgctgagctgtgtgcgcagcctgcgggccagaattgtgcagagcttcctgcagccccacccccagcaccgctggaaggtgagcccctgggatgtgaatgcctactacagcgtgtctgaccacgtggtggtgtttcctgctggcctgctgcagccccccttcttccaccctggctaccccagggctgtgaactttggagctgctggcagcatcatggcccacgagctgctgcacatcttctaccagctgctgctgcccggcggctgcctggcctgtgacaaccacgccctgcaggaggcccacctgtgcctgaagaggcactacgccgccttccccctgcccagcaggaccagcttcaatgacagcctgaccttcctggagaatgctgctgatgtgggcggcctggccatcgccctgcaggcctacagcaagaggctgctgcggcaccacggggagaccgtgctgcccagcctggacctgagcccccagcagatcttcttccgctcctatgcccaggtgatgtgcaggaagcccagcccccaggacagccatgacacccacagccccccccacctgcgggtgcacggccccctgagcagcaccccagcctttgcccgctacttccgctgtgcccggggggccctgctgaaccccagcagccgctgccagctgtggtag

SEQ ID NO: 156844 - DNA, 1935 bp, Artificial Sequence
  Description of Artificial Sequence: Synthetic coding sequence
atgagccggcagttcagcagccgcagcggctacagaagtggcggcggcttcagcagcggcagcgctggcatcatcaactaccagaggaggaccaccagcagcagcaccaggagaagtggcggcggcggcggccgcttcagcagctgtggcggcggcggcggcagctttggagctgggggcggcttcggcagccgcagcctggtgaacctgggcggcagcaagagcatcagcatctctgtggcccggggcggcggccggggcagcggctttggaggcggctacggcggcggcggctttggaggcggcggctttggaggcggcggctttggaggcggcggcatcggcggcggcggctttggaggcttcggcagcggcggcggcggctttggaggcggcggctttggaggcggcggctatggaggcggctacggccctgtgtgccccccaggcggcatccaggaggtgaccatcaaccagagcctgctgcagcccctgaatgtggagattgatcctgagatccagaaggtgaagagccgggagcgggagcagatcaagagcctgaacaaccagtttgccagcttcatcgacaaggtgcgcttcctggagcagcagaaccaggtgctgcagaccaagtgggagctgctgcagcaggtggacaccagcaccaggacccacaacctggagccctactttgagagcttcatcaacaacctgcggcggcgggtggaccagctgaagagtgaccagagccggctggacagcgagctgaagaacatgcaggacatggtggaggactacagaaacaagtatgaagatgagatcaacaagaggaccaatgcagaaaatgaatttgtgaccatcaagaaggatgtggatggagcctacatgaccaaggtggacctgcaggccaagctggacaacctgcagcaggagattgacttcctgacagccctgtaccaggccgagctgagccagatgcagacccagatcagcgagaccaacgtcatcctgtccatggacaacaacagaagcctggacctggacagcatcatcgccgaggtgaaggcccagtatgaagatattgcccagaagagcaaggccgaggccgagagcctgtaccagagcaaatatgaggagctgcagatcacagctggaagacatggagacagcgtgaggaacagcaagattgagatcagcgagctgaacagagtcatccagaggctgcggagtgaaattgacaacgtgaagaagcagatcagcaacctgcagcagagcatcagtgatgctgagcagagaggagaaaatgccctgaaggatgccaagaacaagctgaatgacctggaggatgccctgcagcaggccaaggaggacctggcccggctgctgcgggactaccaggagctgatgaacaccaagctggccctggacctggagatcgccacctaccgcaccctgctggagggggaggagagcaggatgtctggagaatgtgcccccaacgtgtctgtgtctgtgtccaccagccacaccaccatcagcggcggcggcagcagaggaggcggcggcggcggctacggcagcggcggcagcagctatggcagcggcggcggcagctatggcagcggcggcggcggcggcggcggccggggcagctatggcagcggcggcagcagctatggcagcggcggcggcagctatggcagcggcggcggcggcggcggccacggcagctatggcagcggcagcagcagcggcggctacagaggaggcagcggcggcggcggcggcggcagcagcggcggccggggcagcggcggcggcagcagcggcggcagcattggaggccggggcagcagcagcggcggcgtgaagagcagcggcggcagcagctctgtgaagtttgtgtccaccacctacagcggcgtgaccaggtag

SEQ ID NO: 156845 - DNA, 1755 bp, Artificial Sequence
  Description of Artificial Sequence: Synthetic coding sequence
atgtctgtgcgctacagcagcagcaagcactacagcagcagccgcagcggcggcggcggcggcggcggcggctgcggcggcggcggcggcgtgagcagcctgcgcatcagcagcagcaagggcagcctgggcggcggcttcagcagcggcggcttcagcggcggcagcttcagccggggcagcagcggcggcggctgctttggaggcagcagcggcggctacggcggcctgggcggctttggaggcggcagcttccggggcagctatggcagcagcagctttggaggcagctatggaggcatctttggaggcggcagctttggaggcggcagctttggaggcggcagctttggaggcggcggctttggaggcggcggctttggaggcggctttggaggcggctttggaggagatggcggcctgctgtctggaaatgagaaggtgaccatgcagaacctgaatgaccggctggccagctacctggacaaggtgcgggccctggaggagagcaactatgagctggagggcaagatcaaggagtggtatgagaagcacggcaacagccaccagggcgagccccgggactacagcaagtactacaagaccattgatgacctgaagaaccagatcctgaacctgaccacagacaatgccaacatcctgctgcagattgacaatgcccggctggccgcagatgacttccggctgaagtatgaaaatgaggtggccctgcggcagagcgtggaggccgacatcaatggcctgcggcgggtgctggatgagctgaccctgaccaaggctgacctggagatgcagatcgagagcctgacagaggagctggcctacctgaagaagaaccacgaggaggagatgaaggacctgagaaatgtgtccactggagatgtgaatgtggagatgaatgctgcccctggggtggacctgacccagctgctgaacaacatgaggagccagtatgagcagctggccgagcagaacaggaaggatgctgaggcctggttcaatgagaagagcaaggagctgaccacagaaattgacaacaacatcgagcagatcagcagctacaagtctgagatcacagagctgcggagaaatgtgcaggccctggagattgagctgcagagccagctggccctgaagcagagcctggaggccagcctggccgagacagagggccgctactgtgtgcagctgagccagatccaggcccagatcagcgccctggaggagcagctgcagcagatccgggcagagacagagtgccagaacacagagtaccagcagctgctggacatcaagatccggctggagaatgagatccagacctaccgcagcctgctggagggggagggcagcagcggcggcggcggccggggcggcggcagctttggaggcggctatggaggcggcagcagcggcggcggcagcagcggcggcggccatggaggcggccatggaggcagcagcggcggcggctatggaggcggcagcagcggcggcggcagcagcggcggcggctatggaggcggcagcagcagcggcggccacggcggcagcagcagcggcggctacggcggcggcagcagcggcggcggcggcggcggctacggcggcggcagcagcggcggcggcagcagcagcggcggcggctatggaggcggcagcagcagcggcggccacaagagcagcagcagcggctctgtgggggagagcagcagcaagggcccccgctactag

SEQ ID NO: 156846 - DNA, 1485 bp, Artificial Sequence
  Description of Artificial Sequence: Synthetic coding sequence
atggacctgagcaacaacaccatgagcctgtctgtgaggaccccaggcctgagccggcggctgagcagccagagcgtgattggccggccccggggcatgtctgccagctctgtgggcagcggctacggcggcagcgcctttggatttggagccagctgtggcggcggcttctctgctgcctccatgtttggcagcagcagcggctttggaggcggcagcggcagctccatggccggcggcctgggcgccggctacggccgggccctgggcggcggcagctttggaggcctgggcatgggctttggaggcagccctgggggcggcagcctgggcatcctgtctggaaatgatggcggcctgctgagcggcagcgagaaggagaccatgcagaacctgaatgaccggctggccagctacctggacaaggtgcgggccctggaggaggccaacacagagctggagaacaagatccgggagtggtatgagacccggggcaccggcacagcagatgccagccagagcgactacagcaagtactaccccctgattgaggacctgaggaacaagatcatcagcgccagcattggaaatgcccagctgctgctgcagattgacaatgcccggctggccgctgaggacttcaggatgaagtatgaaaatgagctggccctgcggcagggcgtggaggccgacatcaatggcctgcggcgggtgctggatgagctgaccctgaccaggacagacctggagatgcagatcgagagcctgaatgaggagctggcctacatgaagaagaaccatgaagatgagctgcagagcttccgggtgggcggccctggagaggtgtctgtggagatggatgctgcccctggggtggacctgacccggctgctgaatgacatgagggcccagtatgagaccatcgccgagcagaacaggaaggatgctgaggcctggttcatcgagaagagcggggagctgaggaaggagatcagcaccaacacagagcagctgcagagcagcaagtctgaggtgacagacctgcggcgggccttccagaacctggagattgagctgcagagccagctggccatgaagaagagcctggaggacagcctggccgaggccgagggggactactgtgcccagctgagccaggtgcagcagctgatcagcaacctggaggcccagctgctgcaggtgcgggcagatgctgagcggcagaatgtggaccaccagaggctgctgaatgtgaaggcccggctggagctggagattgagacctaccgccgcctgctggatggagaggcccagggagatggcctggaggagagcctgtttgtgacagacagcaagagccaggcccagagcacagacagcagcaaggaccccaccaagaccaggaagatcaagacagtggtgcaggagatggtgaatggagaggtggtgagcagccaggtgcaggagattgaggagctgatgtag

SEQ ID NO: 156847 - DNA, 1068 bp, Artificial Sequence
  Description of Artificial Sequence: Synthetic coding sequence
atgagcctgcggctgcagagcagcagcgccagctatggaggcggctttggaggcggcagctgccagctgggcggcggccggggcgtgtccacctgcagcaccaggtttgtgtctgggggcagcgctgggggctatggaggcggcgtgtcctgtggctttggaggaggagctggcagcggctttggaggcggcctgggcggcggctttggaggcggctttgctgggggctttgtggactttggagcctgtgatggcggcctgctgactggaaatgagaagatcaccatgcagaacctgaatgaccggctggccagctacctggagaaggtgcgggccctggaggaggccaatgctgacctggaggtgaagatccgggactggcacctgaagcagagccctgccagccctgagcgggactacagcccctactacaagaccatcgaggagctgcgggacaagatcctgacagccaccatcgagaacaacagagtcatcctggagattgacaatgcccggctggccgcagatgacttccggctgaagtatgaaaatgagctggccctgcggcagagcgtggaggccgacatcaatggcctgcggcgggtgctggatgagctgaccctgagcaagacagacctggagatgcagatcgagagcctgaatgaggagctggcctacatgaagaagaaccacgaggaggagatgaaggagttcagcaaccaggtggtgggccaggtgaatgtggagatggatgccaccccaggcatcgacctgaccagggtgctggccgagatgagggagcagtatgaggccatggccgagaggaacagaagagatgctgaggagtggttccacaccaagtctgctgagctgaacaaggaggtgtccaccaacacagccatgatccagaccagcaagacagagatcacagagctgcggaggaccctgcagggcctggagattgagctgcagagccagctgtccatgaaggccggcctggagaacacagctgctgaccccggcacccaccagcagcaccggggccctgctgagcgggccccccagtag

SEQ ID NO: 156848 - DNA, 1377 bp, Artificial Sequence
  Description of Artificial Sequence: Synthetic coding sequence
atgagcctgcggctgcagagcagcagcgccagctatggaggcggctttggaggcggcagctgccagctgggcggcggccggggcgtgtccacctgcagcaccaggtttgtgtctgggggcagcgctgggggctatggaggcggcgtgtcctgtggctttggaggaggagctggcagcggctttggaggcggctatggaggcggcctgggcggcggctatggaggcggcctgggcggcggctttggaggcggctttgctgggggctttgtggactttggagcctgtgatggcggcctgctgactggaaatgagaagatcaccatgcagaacctgaatgaccggctggccagctacctggagaaggtgcgggccctggaggaggccaatgctgacctggaggtgaagatccgggactggcacctgaagcagagccctgccagccctgagcgggactacagcccctactacaagaccatcgaggagctgcgggacaagatcctgacagccaccatcgagaacaacagagtcatcctggagattgacaatgcccggctggccgcagatgacttccggctgaagtatgaaaatgagctggccctgcggcagagcgtggaggccgacatcaatggcctgcggcgggtgctggatgagctgaccctgagcaagacagacctggagatgcagatcgagagcctgaatgaggagctggcctacatgaagaagaaccacgaggaggagatgaaggagttcagcaaccaggtggtgggccaggtgaatgtggagatggatgccaccccaggcatcgacctgaccagggtgctggccgagatgagggagcagtatgaggccatggccgagaggaacagaagagatgctgaggagtggttccacaccaagtctgctgagctgaacaaggaggtgtccaccaacacagccatgatccagaccagcaagacagagatcacagagctgcggaggaccctgcagggcctggagattgagctgcagagccagctgtccatgaaggccggcctggagaacacagtggccgagacagaatgtagatatgccctgcagctgcagcagatccagggcctcatcagcagcattgaggcccagctgtctgagctgcggtctgagatggagtgccagaaccaggagtacaagatgctgctggacatcaagacccggctggagcaggagatcgccacctaccgcagcctgctggagggccaggatgccaagatgattggcttccccagcagcgctggctctgtgagccccaggagcacctctgtgaccaccaccagcagcgcctctgtgaccaccaccagcaatgccagcggccgccgcaccagtgatgtgcggcggccctag

SEQ ID NO: 156849 - DNA, 1263 bp, Artificial Sequence
  Description of Artificial Sequence: Synthetic coding sequence
atgagcctgcggctgcagagcagcagcgccagctatggaggcggctttggaggcggcagctgccagctgggcggcggccggggcgtgtccacctgcagcaccaggtttgtgtctgggggcagcgctgggggctatggaggcggcgtgtcctgtggctttggaggaggagctggcagcggctttggaggcggctatggaggcggcctgggcggcggctatggaggcggcctgggcggcggctttggaggcggctttgctgggggctttgtggactttggagcctgtgatggcggcctgctgactggaaatgagaagatcaccatgcagaacctgaatgaccggctggccagctacctggagaaggtgcgggccctggaggaggccaatgctgacctggaggtgaagatccgggactggcacctgaagcagagccctgccagccctgagcgggactacagcccctactacaagaccatcgaggagctgcgggacaagatcctgacagccaccatcgagaacaacagagtcatcctggagattgacaatgcccggctggccgcagatgacttccggctgaagtatgaaaatgagctggccctgcggcagagcgtggaggccgacatcaatggcctgcggcgggtgctggatgagctgaccctgagcaagacagacctggagatgcagatcgagagcctgaatgaggagctggcctacatgaagaagaaccacgaggaggagatgaaggagttcagcaaccaggtggtgggccaggtgaatgtggagatggatgccaccccaggcatcgacctgaccagggtgctggccgagatgagggagcagtatgaggccatggccgagaggaacagaagagatgctgaggagtggttccacaccaagtctgctgagctgaacaaggaggtgtccaccaacacagccatgatccagaccagcaagacagagatcacagagctgcggaggaccctgcagggcctggagattgagctgcagagccagctgtccatgaaggccggcctggagaacacagtggccgagacagaatgtagatatgccctgcagctgcagcagatccagggcctcatcagcagcattgaggcccagctgtctgagctgcggtctgagatggagtgccagaaccaggagtacaagatgctgctggacatcaagacccggctggagcaggagatcgccacctaccgcagcctgctggagggccaggatgccaagaagaggcagcccccatag

SEQ ID NO: 156850 - DNA, 1371 bp, Artificial Sequence
  Description of Artificial Sequence: Synthetic coding sequence
atgaccaccaccttcctgcagaccagcagcagcacctttggaggcggcagcacccggggcggcagcctgctggccggcggcggcggctttggaggcggcagcctgagcggcggcggcggcagccgcagcatcagcgccagcagcgccaggtttgtgagcagcggcagcggcggcggctacggcggcggcatgagggtgtgtggctttggaggaggagctggctctgtgtttggaggcggctttggaggcggcgtgggcggcggctttggaggcggctttggaggaggagatggcggcctgctgtctggaaatgagaagatcaccatgcagaacctgaatgaccggctggccagctacctggacaaggtgcgggccctggaggaggccaatgctgacctggaggtgaagatccatgactggtaccagaagcagacccccaccagcccagaatgtgactacagccagtacttcaagaccatcgaggagctgcgggacaagatcatggccaccaccatcgacaacagcagggtcatcctggagattgacaatgcccggctggccgcagatgacttccggctgaagtatgaaaatgagctggccctgcggcagggcgtggaggccgacatcaatggcctgcggcgggtgctggatgagctgaccctggccaggacagacctggagatgcagatcgagggcctgaatgaggagctggcctacctgaagaagaaccacgaggaggagatgaaggagttcagcagccagctggccggccaggtgaatgtggagatggatgctgcccctggggtggacctgaccagggtgctggccgagatgagggagcagtatgaggccatggccgagaagaacagaagagatgtggaggcctggttcttcagcaagacagaggagctgaacaaggaggtggccagcaacacagagatgatccagaccagcaagacagagatcacagacctgcggaggaccatgcaggagctggagattgagctgcagagccagctgtccatgaaggccggcctggagaacagcctggccgagacagagtgccgctatgccacccagctgcagcagatccagggcctcatcggcggcctggaggcccagctgtctgagctgcgctgtgagatggaggcccagaaccaggagtacaagatgctgctggacatcaagacccggctggagcaggagatcgccacctaccgcagcctgctggagggccaggatgccaagatggccggcatcgccatccgggaggccagcagcggcggcggcggcagcagcagcaacttccacatcaacgtggaggagagcgtggatggccaggtggtgagcagccacaagcgggagatctag

SEQ ID NO: 156851 - DNA, 876 bp, Artificial Sequence
  Description of Artificial Sequence: Synthetic coding sequence
atgacaggcaccaggagccggccccagcctgcccagaatgccaccacagccaacaccagccggcccctgaagagcagcggcaccaggtatgaaaatgagctggccctgcggcagggcgtggaggccgacatcaatggcctgcggcgggtgctggatgagctgaccctggccaggacagacctggagatgcagatcgagggcctgaatgaggagctggcctacctgaagaagaaccacgaggaggagatgaaggagttcagcagccagctggccggccaggtgaatgtggagatggatgctgcccctggggtggacctgaccagggtgctggccgagatgagggagcagtatgaggccatggccgagaagaacagaagagatgtggaggcctggttcttcagcaagacagaggagctgaacaaggaggtggccagcaacacagagatgatccagaccagcaagacagagatcacagacctgcggaggaccatgcaggagctggagattgagctgcagagccagctgtccatgaaggccggcctggagaacagcctggccgagacagaatgtagatatgccacccagctgcagcagatccagggcctgattggaggcctggaggcccagctgtctgagctgcgctgtgagatggaggcccagaaccaggagtacaagatgctgctggacatcaagacccggctggagcaggagatcgccacctaccgcagcctgctggagggccaggatgccaagatggccggcatcgccatccgggaggccagcagcggcggcggcggcagcagcagcaacttccacatcaacgtggaggagagcgtggatggccaggtggtgagcagccacaagcgggagatctag

SEQ ID NO: 156852 - DNA, 1371 bp, Artificial Sequence; identical to SEQ ID NO: 156850
  Description of Artificial Sequence: Synthetic coding sequence

SEQ ID NO: 156853 - DNA, 756 bp, Artificial Sequence
  Description of Artificial Sequence: Synthetic coding sequence
atgacaggcaccaggagccggccccagcctgcccagaatgccaccacagccaacaccagccggcccctgaagagcagcggcaccaggtatgaaaatgagctggccctgcggcagggcgtggaggccgacatcaatggcctgcggcgggtgctggatgagctgaccctggccaggacagacctggagatgcagatcgagggcctgaatgaggagctggcctacctgaagaagaaccacgaggaggagatgaaggagttcagcagccagctggccggccaggtgaatgtggagatggatgctgcccctggggtggacctgaccagggtgctggccgagatgagggagcagtatgaggccatggccgagaagaacagaagagatgtggaggcctggttcttcagcaagacagaggagctgaacaaggaggtggccagcaacacagagatgatccagaccagcaagacagagatcacagacctgcggaggaccatgcaggagctggagattgagctgcagagccagctgtccatgaaggccggcctggagaacagcctggccgagacagaatgtagatatgccacccagctgcagcagatccagggcctgattggaggcctggaggcccagctgtctgagctgcgctgtgagatggaggcccagaaccaggagtacaagatgctgctggacatcaagacccggctggagcaggagatcgccacctaccgcagcctgctggagggccaggatgccaagtag

SEQ ID NO: 156854 - DNA, 663 bp, Artificial Sequence
  Description of Artificial Sequence: Synthetic coding sequence
atgacaggcaccaggagccggccccagcctgcccagaatgccaccacagccaacaccagccggcccctgaagagcagcggcaccaggtatgaaaatgagctggccctgcggcagggcgtggaggccgacatcaatggcctgcggcgggtgctggatgagctgaccctggccaggacagacctggagatgcagatcgagggcctgaatgaggagctggcctacctgaagaagaaccacgaggaggagatgaaggagttcagcagccagctggccggccaggtgaatgtggagatggatgctgcccctggggtggacctgaccagggtgctggccgagatgagggagcagtatgaggccatggccgagaagaacagaagagatgtggaggcctggttcttcagcaagacagaggagctgaacaaggaggtggccagcaacacagagatgatccagaccagcaagacagagatcacagacctgcggaggaccatgcaggagctggagattgagctgcagagccagctgtccatgaaggccggcctggagaacagcctggccgagacagaatgtagatatgccacccagctgcagcagatccagggcctgattggaggcctggaggcccagctgtctgagctgcgctgtgagatggaggcccagtag

SEQ ID NO: 156855 - DNA, 1422 bp, Artificial Sequence
  Description of Artificial Sequence: Synthetic coding sequence
atgaccacctgcagccggcagttcaccagcagcagctccatgaagggcagctgtggcatcggcggcggcatcggcggcggcagcagccgcatcagctctgtgctggccggcggcagctgccgggcccccagcacctacggcggcggcctgtctgtgagcagccgcttcagcagcggcggggcctgtggcctgggcggcggctacggcggcggcttcagcagcagcagcagctttggcagcggctttggaggcggctacggcggcggcctgggcgccggctttggaggcggcctgggcgccggctttggaggcggctttgctggaggagatggcctgctggtgggcagcgagaaggtgaccatgcagaacctgaatgaccggctggccagctacctggacaaggtgcgggccctggaggaggccaatgctgacctggaggtgaagatccgggactggtaccagaggcagaggccttctgagatcaaggactacagcccctacttcaagaccatcgaggacctgaggaacaagatcatcgccgccaccattgaaaatgcccagcccatcctgcagattgacaatgcccggctggccgcagatgacttccgcaccaagtatgagcacgagctggccctgcggcagacagtggaggctgatgtgaatggcctgcggcgggtgctggatgagctgaccctggccaggacagacctggagatgcagatcgagggcctgaaggaggagctggcctacctgaggaagaaccacgaggaggagatgctggccctgcggggccagacaggaggagatgtgaatgtggagatggatgctgcccctggggtggacctgagccgcatcctgaatgagatgagggaccagtatgagcagatggccgagaagaacagaagagatgctgagacctggttcctgagcaagacagaggagctgaacaaggaggtggccagcaacagcgagctggtgcagagcagccgctctgaggtgacagagctgcggcgggtgctgcagggcctggagattgagctgcagagccagctgtccatgaaggccagcctggagaacagcctggaggagaccaagggccgctactgcatgcagctgagccagatccagggcctgattggctctgtggaggagcagctggcccagctgcgctgtgagatggagcagcagagccaggagtaccagatcctgctggatgtgaagacccggctggagcaggagatcgccacctaccgccgcctgctggagggggaggatgcccacctgagcagccagcaggccagcggccagagctacagcagccgggaggtgttcaccagcagcagcagcagcagcagccggcagacccggcccatcctgaaggagcagagcagcagcagcttcagccagggccagagcagctag

SEQ ID NO: 156856 - DNA, 1299 bp, Artificial Sequence
  Description of Artificial Sequence: Synthetic coding sequence
atgaccaccagcatccggcagttcaccagcagcagcagcatcaagggcagcagcggcctgggcggcggcagcagcaggaccagctgccgcctgagcggcggcctgggcgccggcagctgccgcctgggcagcgctgggggcctgggcagcaccctgggcggcagcagctacagcagctgctacagctttggaagtggcggcggctacggcagcagctttggaggagtggatggcctgctggccggcggggagaaggccaccatgcagaacctgaatgaccggctggccagctacctggacaaggtgcgggccctggaggaggccaacacagagctggaggtgaagatccgggactggtaccagaggcaggcccctggccctgcccgggactacagccagtactaccgcaccatcgaggagctgcagaacaagatcctgacagccaccgtggacaatgccaacatcctgctgcagattgacaatgcccggctggccgcagatgacttccgcaccaagtttgaaacagagcaggccctgcggctgtctgtggaggccgacatcaatggcctgcggcgggtgctggatgagctgaccctggcccgggctgacctggagatgcagatcgagaacctgaaggaggagctggcctacctgaagaagaaccacgaggaggagatgaatgccctgcggggccaggtgggcggggagatcaacgtggagatggatgctgcccctggggtggacctgagccgcatcctgaatgagatgagggaccagtatgagaagatggccgagaagaacaggaaggatgctgaggactggttcttcagcaagacagaggagctgaaccgggaggtggccaccaacagcgagctggtgcagagcggcaagtctgagatcagcgagctgcggaggaccatgcaggccctggagattgagctgcagagccagctgtccatgaaggccagcctggagggcaacctggccgagacagagaaccgctactgtgtgcagctgagccagatccagggcctcatcggctctgtggaggagcagctggcccagctgcgctgtgagatggagcagcagaaccaggagtacaagatcctgctggatgtgaagacccggctggagcaggagatcgccacctacagaaggctgctggagggagaagatgcccacctgacccagtacaagaaggagcctgtgaccacccggcaggtgaggaccatcgtggaggaggtgcaggacggcaaggtgatcagcagccgggagcaggtgcaccagaccaccaggtag

SEQ ID NO: 156857 - DNA, 1920 bp, Artificial Sequence
  Description of Artificial Sequence: Synthetic coding sequence
atgagctgccagatcagctgcaagagccggggccggggcggcggcggcggcggcttccggggcttcagcagcggcagcgctgtggtgtctgggggcagccgccgcagcaccagcagcttcagctgcctgagccgccacggcggcggcggcggcggctttggaggcggcggcttcggcagccgcagcctggtgggcctgggcggcaccaagagcatcagcatctctgtggccggcggcggcggcggctttggagctgctgggggctttggaggccggggcggcggctttggaggcggcagcagctttggaggcggcagcggcttcagcggcggcggctttggaggcggcggctttggaggcggccgctttggaggctttggaggccctggaggagtgggcggcctgggcggccctgggggctttggacctgggggctacccaggcggcatccacgaggtgtctgtgaaccagagcctgctgcagcccctgaatgtgaaggtggaccctgagatccagaatgtgaaggcccaggagcgggagcagatcaagaccctgaacaacaagtttgccagcttcatcgacaaggtgcgcttcctggagcagcagaaccaggtgctgcagaccaagtgggagctgctgcagcagatgaatgtgggcacccggcccatcaacctggagcccatcttccagggctacatcgacagcctgaagcgctacctggatggcctgacagctgagaggaccagccagaacagcgagctgaacaacatgcaggacctggtggaggactacaagaagaagtatgaagatgagatcaacaagaggacagctgctgaaaatgactttgtgaccctgaagaaggatgtggacaatgcctacatgatcaaggtggagctgcagagcaaggtggacctgctgaaccaggagattgagttcctgaaggtgctgtatgatgctgagatcagccagatccaccagagcgtgacagacaccaacgtcatcctgtccatggacaacagcaggaacctggacctggacagcatcatcgccgaggtgaaggcccagtatgaggagatcgcccagaggagcaaggaggaggccgaggccctgtaccacagcaaatatgaggagctgcaggtgacagtgggcagacatggagacagcctgaaggagatcaagattgagatcagcgagctgaacagagtcatccagaggctgcagggcgagatcgcccacgtgaagaagcagtgcaagaatgtgcaggatgccatcgcagatgctgagcagagaggagaacatgccctgaaggatgccaggaacaagctgaatgacctggaggaggccctgcagcaggccaaggaggacctggcccggctgctgcgggactaccaggagctgatgaatgtgaagctggccctggatgtggagatcgccacctacaggaagctgctggagggggaggagtgcaggatgtctggggacctgagcagcaatgtgacagtgtctgtgaccagcagcaccatcagcagcaatgtggccagcaaggccgccttcggcggcagcggcggccggggcagcagcagcggcggcggctacagcagcggcagcagcagctatggcagcggcggccggcagagcggcagccggggcggcagcggcggcggcggcagcatcagcggcggcggctacggcagcggcggcggcagcggcggccgctatggcagcggcggcggcagcaagggcggcagcatcagcggcggcggctacggcagcggcggcggcaagcacagcagcggcggcggcagccggggcggcagcagcagcggcggcggctacggcagcggcggcggcggcagcagctctgtgaagggcagcagcggggaggccttcggcagctctgtgaccttctccttcagatag

SEQ ID NO: 156858 - DNA, 1275 bp, Artificial Sequence
  Description of Artificial Sequence: Synthetic coding sequence
atggacttcagcagaagaagcttccacaggagcctgagcagcagcctgcaggcccctgtggtgtccacagtgggcatgcagaggctgggcaccacccccagcgtgtatggaggagctgggggccggggcatccgcatcagcaacagccgccacacagtgaactacggcagtgacctgaccggcggcggggacctgtttgtgggcaatgagaagatggccatgcagaacctgaatgaccggctggccagctacctggagaaggtgaggaccctggagcagagcaacagcaagctggaggtgcagatcaagcagtggtatgagaccaatgcccccagggctggccgggactacagcgcctactaccggcagatcgaggagctgcggagccagatcaaggatgcccagctgcagaatgcccgctgtgtgctgcagattgacaatgccaagctggccgctgaggacttccggctgaagtatgaaacagagcggggcatccggctgactgtggaggccgacctgcagggcctgaacaaggtgtttgatgacctgaccctgcacaagacagacctggagatccagatcgaggagctgaacaaggacctggccctgctgaagaaggagcaccaggaggaggtggatggcctgcacaagcacctgggcaacacagtgaatgtggaggtggatgctgcccctggcctgaacctgggcgtcatcatgaatgagatgaggcagaagtatgaggtgatggcccagaagaacctgcaggaggccaaggagcagtttgagcggcagacagctgtgctgcagcagcaggtgacagtgaacacagaggagctgaagggcacagaggtgcagctgacagagctgcggaggaccagccagagcctggagattgagctgcagagccacctgtccatgaaggagagcctggagcacaccctggaggagaccaaggcccgctacagcagccagctggccaacctgcagagcctgctgagcagcctggaggcccagctgatgcagatccgcagcaacatggagcggcagaacaatgagtaccacatcctgctggacatcaagacccggctggagcaggagatcgccacctacagaaggctgctggagggagaagatgtgaagaccacagagtaccagctgagcaccctggaggagcgggacatcaagaagaccaggaagatcaagacagtggtgcaggaggtggtggatggcaaggtggtgtcctctgaggtgaaggaggtggaggagaacatctag

SEQ ID NO: 156859 - DNA, 1578 bp, Artificial Sequence
  Description of Artificial Sequence: Synthetic coding sequence
atgagctgcagcagccgggccagcagcagccgggccggcggcagcagcagcgcccgggtgtctgctgggggcagcagcttcagcagcggcagccgctgtggcctgggcggcagcagcgcccagggcttccggggcggggccagcagctgcagcctgagcggcggcagcagcggggccttcggcggcagctttggaggcggcttcggcagctgcagcgtgggcggcggctttggaggagccagcggcagcggcactggatttggaggcggcagcagctttggaggagtgtctggcttcggccggggcagcggcttctgtggcagcagccgcttcagcagcggggccaccggcggcttctacagctatggaggcggcatgggcggcggcgtgggagatggcggcctcttctctggaggagagaagcagaccatgcagaacctgaatgaccggctggccaactacctggacaaggtgcgggccctggaggaggccaacacagacctggagaacaagatcaaggagtggtatgacaagtatggccctggcagcggagatggcggcagcggccgggactacagcaagtactacagcatcatcgaggacctgaggaaccagatcatcgccgccaccgtggagaatgccggcatcatcctgcacatcgacaatgcccggctggccgcagatgacttccggctgaagtatgaaaatgagctgtgcctgcggcagagcgtggaggccgacatcaatggcctgaggaaggtgctggatgacctgaccatgaccaggagtgacctggagatgcagatcgagagcttcacagaggagctggcctacctgaggaagaaccacgaggaggagatgaagaacatgcagggcagcagcggcggggaggtgacagtggagatgaatgctgcccctggaacagacctgaccaagctgctgaatgacatgagggcccagtatgaggagctggccgagcagaacagaagagaggccgaggagcgcttcaacaagcagagcgccagcctgcaggcccagatcagcacagatgctggagctgccaccagcgccaagaatgagatcacagagctgaagaggaccctgcaggccctggagattgagctgcagagccagctggccatgaagagcagcctggagggcaccctggccgacacagaggccggctacgtggcccagctgtctgagatccagacccagatcagcgccctggaggaggagatctgccagatctggggcgagaccaagtgccagaatgctgagtacaagcagctgctggacatcaagacccggctggaggtggagattgagacctaccgccgcctgctggatggagagggcggcggcagcagctttgctgagtttggaggcaggaacagcggctctgtgaacatgggcagccgggacctggtgtctggggacagccgcagcggcagctgcagcggccagggccgggacagcagcaagaccagggtgaccaagaccatcgtggaggagctggtggatggcaaggtggtgagcagccaggtgagcagcatcagcgaggtgaaggtgaagtag

SEQ ID NO: 156860 - DNA, 1890 bp, Artificial Sequence
  Description of Artificial Sequence: Synthetic coding sequence
atgagccggcaggccagcaagaccagcggcggcggcagccagggcttcagcggccgctctgctgtggtgtctggcagcagcaggatgagctgtgtggcccacagcggcggggccggcggcggggcctacggcttccgctctggagctgggggcttcggcagccgcagcctgtacaacctgggcggcaacaagagcatcagcatctctgtggccgccggcggcagcagagctgggggctttggaggcggccgcagcagctgtgcctttgctgggggctatggaggcggctttggaagtggctatggaggcggctttggaggcggctttggaggcggccggggcatgggcggcggctttggaggagctgggggctttggaggagctgggggctttggaggagctgggggctttggaggccctgggggctttggaggcagcggcggctttggaggccctggcagcctgggcagccctgggggctttggacctgggggcttccctgggggcatccaggaggtgaccatcaaccagagcctgctgcagcccctgaatgtggagattgacccccagatcggccaggtgaaggcccaggagcgggagcagatcaagaccctgaacaacaagtttgccagcttcatcgacaaggtgcgcttcctggagcagcagaacaaggtgctggagaccaagtggaacctgctgcagcagcagggcaccagcagcatcagcggcaccaacaacctggagcccctgtttgagaaccacatcaactacctgcggagctacctggacaacatcctgggggagcggggccgcctggacagcgagctgaagaacatggaggacctggtggaggacttcaagaagaagtatgaagatgagatcaacaagaggacagctgctgaaaatgaatttgtgaccctgaagaaggatgtggacagcgcctacatgaacaaggtggagctgcaggccaaggtggatgccctgattgatgaaattgacttcctgcggaccctgtatgatgctgagctgagccagatgcagagccacatcagtgacacctctgtggtgctgtccatggacaacaacagaagcctggacctggacagcatcatcgccgaggtgcgggcccagtatgaagatattgcccagaggagcaaggccgaggccgaggccctgtaccagaccaagctgggggagctgcagaccacagctggaagacatggagatgacctgaggaacaccaagtctgagatcatcgagctgaacaggatgatccagaggctgcgggcagaaattgagggcgtgaagaagcagaatgccaacctgcagacagccatcgccgaggccgagcagcacggggagatggccctgaaggatgccaatgccaagctgcaggagctgcaggccgccctgcagcaggccaaggatgacctggcccggctgctgcgggactaccaggagctgatgaatgtgaagctggccctggatgtggagatcgccacctacaggaagctgctggagggggaggagtacagcaggatgtctggagaatgtcccagcgctgtgtccatctctgtggtgagcagcagcaccaccagcgccagcgctgggggctatggaggcggctatggaggcggcatgggcggcggcctgggcggcggcttctctgctgggggcggcagcggcagcggcttcggccggggcggcggcggcggcattggaggcggctttggaggcggcagcagcggcttcagcggcggcagcggcttcggcagcatcagcggggcccgctatggagtgtctgggggcggcttcagcagcgccagcaacagaggaggcagcatcaagttcagccagagcagccagagcagccagcgctacagcaggtag

SEQ ID NO: 156861 - DNA, 1887 bp, Artificial Sequence
  Description of Artificial Sequence: Synthetic coding sequence
atgagccggcaggccagcaagaccagcggcggcggcagccagggcttcagcggccgctctgctgtggtgtctggcagcagcaggatgagctgtgtggcccacagcggcggggccggcggcggggcctacggcttccgctctggagctgggggcttcggcagccgcagcctgtacaacctgggcggcaacaagagcatcagcatctctgtggccgccggcggcagcagagctgggggctttggaggcggccgcagcagctgtgcctttgctgggggctatggaggcggctttggaagtggctatggaggcggctttggaggcggctttggaggcggccggggcatgggcggcggctttggaggagctgggggctttggaggagctgggggctttggaggagctgggggctttggaggccctgggggctttggaggcagcggcggctttggaggccctggcagcctgggcagccctgggggctttggacctgggggcttccctgggggcatccaggaggtgaccatcaaccagagcctgctgcagcccctgaatgtggagattgacccccagatcggccaggtgaaggcccaggagcgggagcagatcaagaccctgaacaacaagtttgccagcttcatcgacaaggtgcgcttcctggagcagcagaacaaggtgctggagaccaagtggaacctgctgcagcagcagggcaccagcagcatcagcggcaccaacaacctggagcccctgtttgagaaccacatcaactacctgcggagctacctggacaacatcctgggggagcggggccgcctggacagcgagctgaagaacatggaggacctggtggaggacttcaagaagaagtatgaagatgagatcaacaagaggacagctgctgaaaatgaatttgtgaccctgaagaaggatgtggacagcgcctacatgaacaaggtggagctgcaggccaaggtggatgccctgattgatgaaattgacttcctgcggaccctgtatgatgctgagctgagccagatgcagagccacatcagtgacacctctgtggtgctgtccatggacaacaacagaagcctggacctggacagcatcatcgccgaggtgcgggcccagtatgaagatattgcccagaggagcaaggccgaggccgaggccctgtaccagaccaagctgggggagctgcagaccacagctggaagacatggagatgacctgaggaacaccaagtctgagatcatcgagctgaacaggatgatccagaggctgcgggcagaaattgagggcgtgaagaagcagaatgccaacctgcagacagccatcgccgaggccgagcagcacggggagatggccctgaaggatgccaatgccaagctgcaggagctgcaggccgccctgcagcaggccaaggatgacctggcccggctgctgcgggactaccaggagctgatgaatgtgaagctggccctggatgtggagatcgccacctacaggaagctgctggagggggaggagtacaggatgtctggagagtgccccagcgctgtgtccatctctgtggtgagcagcagcaccaccagcgccagcgctgggggctacggcggcggctacggcggcggcatgggcggcggcctgggcggcggcttctctgctgggggcggcagcggcagcggcttcggccggggcggcggcggcggcatcggcggcggctttggaggcggcagcagcggcttcagcggcggcagcggcttcggcagcatcagcggggcccgctatggagtgtctgggggcggcttcagcagcgccagcaacagaggaggcagcatcaagttcagccagagcagccagagcagccagcgctacagcaggtag

SEQ ID NO: 156862 - DNA, 1251 bp, Artificial Sequence
  Description of Artificial Sequence: Synthetic coding sequence
atgccctacaacttctgcctgcccagcctgagctgcaggaccagctgcagcagccggccctgtgtgccccccagctgccacagctgcaccctgcccggggcctgcaacatcccagccaacgtgagcaactgcaactggttctgtgagggcagcttcaatggaagtgagaaggagaccatgcagttcctgaatgaccggctggccagctacctggagaaggtgcggcagctggagcgggacaatgctgagctggagaacctgatccgggagaggagccagcagcaggagcccctgctgtgccccagctaccagagctacttcaagaccatcgaggagctgcagcagaagatcctgtgcaccaagtcagaaaatgcccggctggtggtgcagattgacaatgccaagctggccgcagatgacttccgcaccaagtaccagacagagctgagcctgcggcagctggtggagagtgacatcaatggcctgcggcgcatcctggatgagctgaccctgtgcaagagtgacctggaggcccaggtggagagcctgaaggaggagctgctgtgcctgaagagcaaccacgagcaggaggtgaacaccctgcgctgccagctgggggaccggctgaatgtggaggtggatgctgcccccaccgtggacctgaacagagtgctgaatgagaccaggagccagtatgaggccctggtggagaccaacagaagagaggtggagcagtggttcaccacccagacagaggagctgaacaagcaggtggtgagcagcagcgagcagctgcagagctaccaggccgagatcatcgagctgcggaggacagtgaatgccctggagattgagctgcaggcccagcacaacctgcgggacagcctggagaacaccctgacagaaagtgaggcccgctacagcagccagctgagccaggtgcagagcctcatcaccaacgtggagagccagctggccgagatccgcagtgacctggagcggcagaaccaggagtaccaggtgctgctggatgtgcgggcccggctggagtgtgagatcaacacctaccgcagcctgctggagagcgaggactgcaacctgcccagcaacccctgtgccaccaccaatgcctgcagcaagcccatcggcccctgcctgagcaacccctgcaccagctgtgtgcccccagccccctgcaccccctgtgccccccggccccgctgtggcccctgcaacagctttgtgaggtag

SEQ ID NO: 156863 - DNA, 1674 bp, Artificial Sequence
  Description of Artificial Sequence: Synthetic coding sequence
atggtgtccaagctgaccagcctgcagcaggagctgctgagcgccctgctgagcagtggagtgaccaaggaggtgctggtgcaggccctggaggagctgctgcccagccccaactttggagtgaagctggagaccctgcccctgagccctggcagcggggctgagccagacaccaagcctgtgttccacaccctgaccaatggacatgccaagggccgcctgtctggagatgagggctctgaagatggagatgattatgacaccccacccatcctgaaggagctgcaggccctgaacacagaggaggccgctgagcagagagctgaggtggacaggatgctgtctgaggacccctggagggctgccaagatgatcaagggctacatgcagcagcacaacatcccccagcgggaggtggtggatgtgacaggcctgaaccagagccacctgagccagcacctgaacaagggcacccccatgaagacccagaagagagctgccctgtacacctggtacgtgaggaagcagcgggagatcctgcggcagttcaaccagacagtgcagagcagcggcaacatgacagacaagagcagccaggaccagctgctcttcctgtttcctgagttcagccagcagagccacggccctggccagagtgatgatgcctgcagcgagcccaccaacaagaagatgagaagaaaccgcttcaagtggggccctgccagccagcagatcctgtaccaggcctatgaccggcagaagaaccccagcaaggaggagcgggaggccctggtggaggagtgcaacagagctgagtgcctgcagaggggcgtgagccccagcaaggcccacggcctgggcagcaacctggtgacagaggtgcgggtgtacaactggtttgccaacagaaggaaggaggaggccttccggcagaagctggccatggatgcctacagcagcaaccagacccacagcctgaaccccctgctgagccacggcagcccccaccaccagcccagcagcagcccccccaacaagctgagcggcgtgcgctacagccagcagggcaacaatgagatcaccagcagcagcaccatcagccaccacggcaacagcgccatggtgaccagccagagcgtgctgcagcaggtgtccccagccagcctggaccccggccacaacctgctgagcccagatggcaagatgatctctgtgtctgggggcggcctgccccctgtgtccaccctgaccaacatccacagcctgagccaccacaacccccagcagagccagaacctgatcatgacccccctgtctggagtgatggccatcgcccagagcctgaacaccagccaggcccagagcgtgcctgtgatcaacagcgtggccggcagcctggccgccctgcagcctgtgcagttcagccagcagctgcacagcccccaccagcagcccctgatgcagcagagccctggcagccacatggcccagcagcccttcatggctgctgtgacccagctgcagaacagccacatgtatgcccacaagcaggagcccccccagtacagccacaccagccgcttccccagcgccatggtggtgacagacaccagcagcatcagcaccctgaccaacatgagcagcagcaagcagtgccccctgcaggcctggtag

SEQ ID NO: 156864 - DNA, 1215 bp, Artificial Sequence
  Description of Artificial Sequence: Synthetic coding sequence
atgagctacagctgtggcctgcccagcctgagctgcaggaccagctgcagcagccggccctgtgtgccccccagctgccacggctgcaccctgcccggggcctgcaacatcccagccaacgtgagcaactgcaactggttctgtgagggcagcttcaatggaagtgagaaggagaccatgcagttcctgaatgaccggctggccagctacctggagaaggtgcggcagctggagcgggacaatgctgagctggagaacctgatccgggagaggagccagcagcaggagcccctggtgtgtgccagctaccagagctacttcaagaccatcgaggagctgcagcagaagatcctgtgcagcaagtcagaaaatgcccggctggtggtgcagattgacaatgccaagctggccagtgatgacttccgcaccaagtatgaaacagagctgagcctgcggcagctggtggagagtgacatcaatggcctgcggcgcatcctggatgagctgaccctgtgccgcagtgacctggaggcccaggtggagagcctgaaggaggagctgctgtgcctgaagcagaaccacgagcaggaggtgaacaccctgcgctgccagctgggggaccggctgaatgtggaggtggatgctgcccccaccgtggacctgaaccaggtgctgaatgagaccaggagccagtatgaggccctggtggagaccaacagaagagaggtggagcagtggtttgccacccagacagaggagctgaacaagcaggtggtgagcagcagcgagcagctgcagagctaccaggccgagatcatcgagctgcggaggacagtgaatgccctggagattgagctgcaggcccagcacaacctgcgggacagcctggagaacaccctgacagaaagtgaggcccgctacagcagccagctgagccaggtgcagaggctcatcaccaacgtggagagccagctggccgagatccgcagtgacctggagcggcagaaccaggagtaccaggtgctgctggatgtgcgggcccggctggagtgtgagatcaacacctaccgcagcctgctggagagcgaggactgcaagctgcccagcaacccctgtgccaccaccaatgcctgtgacaagagcacaggcccctgcatcagcaacccctgtggcctgcgggcccgctgtggcccctgcaacaccttcggctactag

SEQ ID NO: 156865 - DNA, 1215 bp, Artificial Sequence
  Description of Artificial Sequence: Synthetic coding sequence
atgccctacaacttctgcctgcccagcctgagctgcaggaccagctgcagcagccggccctgtgtgccccccagctgccacggctacaccctgcccggggcctgcaacatcccagccaacgtgagcaactgcaactggttctgtgagggcagcttcaatggaagtgagaaggagaccatgcagttcctgaatgaccggctggccagctacctggagaaggtgcggcagctggagcgggacaatgctgagctggagaacctgatccgggagaggagccagcagcaggagcccctgctgtgccccagctaccagagctacttcaagaccatcgaggagctgcagcagaagatcctgtgcagcaagtcagaaaatgcccggctggtggtgcagattgacaatgccaagctggccgcagatgacttccgcaccaagtaccagacagagcagagcctgcggcagctggtggagagtgacatcaacagcctgcggcgcatcctggatgagctgaccctgtgccgcagtgacctggaggcccagatggagagcctgaaggaggagctgctgagcctgaagcagaaccacgagcaggaggtgaacaccctgcgctgccagctgggggaccggctgaatgtggaggtggatgctgccccagctgtggacctgaaccaggtgctgaatgagaccaggaaccagtatgaggccctggtggagaccaacagaagagaggtggagcagtggtttgccacccagacagaggagctgaacaagcaggtggtgagcagcagcgagcagctgcagagctaccaggccgagatcatcgagctgcggaggacagtgaatgccctggagattgagctgcaggcccagcacaacctgcgctacagcctggagaacaccctgacagaaagtgaggcccgctacagcagccagctgagccaggtgcagagcctcatcaccaacgtggagagccagctggccgagatccgcagtgacctggagcggcagaaccaggagtaccaggtgctgctggatgtgcgggcccggctggagtgtgagatcaacacctaccgcagcctgctggagagcgaggactgcaagctgcccagcaacccctgtgccaccaccaatgcctgtgagaagcccatcggcagctgtgtgaccaacccctgtggccccaggagccgctgtggcccctgcaacaccttcggctactag

SEQ ID NO: 156866 - DNA, 1311 bp, Artificial Sequence
  Description of Artificial Sequence: Synthetic coding sequence
atgctgtatgccaagcccccacccaccatcaatggcatcaagggcctgcagaggaaggagcggctgaagccagcccacatccacctgcagcagctgacctgcttcagcatcacctgcagcagcaccatgagctacagctgctgcctgcccagcctgggctgcaggaccagctgcagcagccggccctgtgtgccccccagctgccacggctacaccctgcccggggcctgcaacatcccagccaacgtgagcaactgcaactggttctgtgagggcagcttcaatggaagtgagaaggagaccatgcagttcctgaatgaccggctggccagctacctggagaaggtgcggcagctggagcgggacaatgctgagctggagaagctgatccaggagaggagccagcagcaggagcccctgctgtgccccagctaccagagctacttcaagaccatcgaggagctgcagcagaagatcctgtgtgccaaggcagaaaatgcccggctggtggtgaacatcgacaatgccaagctggccagtgatgacttccgcagcaagtaccagacagagcagagcctgcggctgctggtggagagtgacatcaacagcatccgccgcatcctggatgagctgaccctgtgcaagagtgacctggagagccaggtggagagcctgcgggaggagctgatctgcctgaagaagaaccacgaggaggaggtgaacaccctgcggagccagctgggggaccggctgaatgtggaggtggacacagcccccaccgtggacctgaaccaggtgctgaatgagaccaggagccagtatgaggccctggtggagatcaacagaagagaggtggagcagtggtttgccacccagacagaggagctgaacaagcaggtggtgagcagcagcgagcagctgcagagctgccaggccgagatcatcgagctgcggaggacagtgaatgccctggagattgagctgcaggcccagcacaacctgcgggacagcctggagaacaccctgacagaaagtgaggcccactacagcagccagctgagccaggtgcagagcctcatcaccaacgtggagagccagctggccgagatccgctgtgacctggagcggcagaaccaggagtaccaggtgctgctggatgtgcgggcccggctggagtgtgagatcaacacctaccgcagcctgctggagagcgaggactgcaagctgccctgcaacccctgtgccaccaccaatgccagcggcaacagctgtggcccctgtggcaccagccagaagggctgctgcaactag

SEQ ID NO: 156867 - DNA, 1185 bp, Artificial Sequence
  Description of Artificial Sequence: Synthetic coding sequence
atgagctacagctgctgcctgcccagcctgggctgcaggaccagctgcagcagccggccctgtgtgccccccagctgccacggctacaccctgcccggggcctgcaacatcccagccaacgtgagcaactgcaactggttctgtgagggcagcttcaatggaagtgagaaggagaccatgcagttcctgaatgaccggctggccagctacctggagaaggtgcggcagctggagcgggacaatgctgagctggagaagctgatccaggagaggagccagcagcaggagcccctgctgtgccccagctaccagagctacttcaagaccatcgaggagctgcagcagaagatcctgtgtgccaaggcagaaaatgcccggctggtggtgaacatcgacaatgccaagctggccagtgatgacttccgcagcaagtaccagacagagcagagcctgcggctgctggtggagagtgacatcaacagcatccgccgcatcctggatgagctgaccctgtgcaagagtgacctggagagccaggtggagagcctgcgggaggagctgatctgcctgaagaagaaccacgaggaggaggtgaacaccctgcggagccagctgggggaccggctgaatgtggaggtggacacagcccccaccgtggacctgaaccaggtgctgaatgagaccaggagccagtatgaggccctggtggagatcaacagaagagaggtggagcagtggtttgccacccagacagaggagctgaacaagcaggtggtgagcagcagcgagcagctgcagagctgccaggccgagatcatcgagctgcggaggacagtgaatgccctggagattgagctgcaggcccagcacaacctgcgggacagcctggagaacaccctgacagaaagtgaggcccactacagcagccagctgagccaggtgcagagcctcatcaccaacgtggagagccagctggccgagatccgctgtgacctggagcggcagaaccaggagtaccaggtgctgctggatgtgcgggcccggctggagtgtgagatcaacacctaccgcagcctgctggagagcgaggactgcaagctgccctgcaacccctgtgccaccaccaatgccagcggcaacagctgtggcccctgtggcaccagccagaagggctgctgcaactag

SEQ ID NO: 156868 - DNA, 1278 bp, Artificial Sequence
  Description of Artificial Sequence: Synthetic coding sequence
atgtacagcagcagcagctgcaagctgcccagcctgagccctgtggcccggagcttcagcgcctgcagcgtgggcctgggccgcagcagctaccgggccaccagctgcctgcctgccctgtgcctgcctgctgggggctttgccaccagctacagcggcggcggcggctggtttggagagggcatcctgactggaaatgagaaggagaccatgcagagcctgaatgaccggctggccggctacctggagaaggtgcggcagctggagcaggagaatgccagcctggagagccgcatccgggagtggtgtgagcagcaggtgccctacatgtgcccagactaccagagctacttccgcaccatcgaggagctgcagaagaagaccctgtgcagcaaggccgagaatgcccggctggtggtggagattgacaatgccaagctggccgcagatgacttccgcaccaagtatgaaacagaggtgtccctgcggcagctggtggagagtgacatcaatggcctgcggcgcatcctggatgacctgaccctgtgcaagagtgacctggaggcccaggtggagagcctgaaggaggagctgctgtgcctgaagaagaaccacgaggaggaggtgaacagcctgcgctgccagctgggggaccggctgaatgtggaggtggatgctgcccctcctgtggacctgaacagagtgctggaggagatgcgctgccagtatgagaccctggtggagaacaacagaagagatgctgaggactggctggacacccagagcgaggagctgaaccagcaggtggtgagcagcagcgagcagctgcagagctgccaggccgagatcatcgagctgcggaggacagtgaatgccctggagattgagctgcaggcccagcacagcatgagagatgccctggagagcaccctggccgagacagaggcccgctacagcagccagctggcccagatgcagtgcatgatcaccaacgtggaggcccagctggccgagatccgggctgacctggagcggcagaaccaggagtaccaggtgctgctggatgtgcgggcccggctggagtgtgagatcaacacctaccggggcctgctggagagcgaggacagcaagctgccctgcaacccctgtgccccagactacagccccagcaagagctgcctgccctgcctgcctgctgccagctgtggccccagcgctgcccggaccaactgcagcccccggcccatctgtgtgccctgccctgggggccgcttctag

SEQ ID NO: 156869 - DNA, 1368 bp, Artificial Sequence
  Description of Artificial Sequence: Synthetic coding sequence
atggccagcaagtgcctgaaggccggcttcagcagcggcagcctgaagagccctgggggcgccagcggcggcagcaccagggtgtctgccatgtacagcagcagcagctgcaagctgcccagcctgagccctgtggcccggagcttcagcgcctgcagcgtgggcctgggccgcagcagctaccgggccaccagctgcctgcctgccctgtgcctgcctgctgggggctttgccaccagctacagcggcggcggcggctggtttggagagggcatcctgactggaaatgagaaggagaccatgcagagcctgaatgaccggctggccggctacctggagaaggtgcggcagctggagcaggagaatgccagcctggagagccgcatccgggagtggtgtgagcagcaggtgccctacatgtgcccagactaccagagctacttccgcaccatcgaggagctgcagaagaagaccctgtgcagcaaggccgagaatgcccggctggtggtggagattgacaatgccaagctggccgcagatgacttccgcaccaagtatgaaacagaggtgtccctgcggcagctggtggagagtgacatcaatggcctgcggcgcatcctggatgacctgaccctgtgcaagagtgacctggaggcccaggtggagagcctgaaggaggagctgctgtgcctgaagaagaaccacgaggaggaggtgaacagcctgcgctgccagctgggggaccggctgaatgtggaggtggatgctgcccctcctgtggacctgaacagagtgctggaggagatgcgctgccagtatgagaccctggtggagaacaacagaagagatgctgaggactggctggacacccagagcgaggagctgaaccagcaggtggtgagcagcagcgagcagctgcagagctgccaggccgagatcatcgagctgcggaggacagtgaatgccctggagattgagctgcaggcccagcacagcatgagagatgccctggagagcaccctggccgagacagaggcccgctacagcagccagctggcccagatgcagtgcatgatcaccaacgtggaggcccagctggccgagatccgggctgacctggagcggcagaaccaggagtaccaggtgctgctggatgtgcgggcccggctggagtgtgagatcaacacctaccggggcctgctggagagcgaggacagcaagctgccctgcaacccctgtgccccagactacagccccagcaagagctgcctgccctgcctgcctgctgccagctgtggccccagcgctgcccggaccaactgcagcccccggcccatctgtgtgccctgccctgggggccgcttctag

SEQ ID NO: 156870 - DNA, 1404 bp, Artificial Sequence
  Description of Artificial Sequence: Synthetic coding sequence
atggccacccagacctgcacccccaccttcagcacaggcagcatcaagggcctgtgtggcacagctgggggcatcagccgggtgagcagcatccgctctgtgggcagctgccgggtgcccagcctggccggggccgccggctacatcagcagcgcccggagcggcctgagcggcctgggcagctgcctgcccggcagctacctgagcagcgagtgccacaccagcggctttgtgggcagcggcggctggttctgtgagggcagcttcaacggcagcgagaaggagaccatgcagttcctgaatgaccggctggccaactacctggagaaggtgcggcagctggagagagaaaatgctgagctggagagccgcatccaggagtggtatgagttccagatcccctacatctgcccagactaccagagctacttcaagaccatcgaggacttccagcagaagatcctgctgaccaagtcagaaaatgcccggctggtgctgcagattgacaatgccaagctggccgcagatgacttccgcaccaagtatgaaacagagctgagcctgcggcagctggtggaggccgacatcaatggcctgcggcgcatcctggatgagctgaccctgtgcaaggctgacctggaggcccaggtggagagcctgaaggaggagctgatgtgcctgaagaagaaccacgaggaggaggtgtctgtgctgcgctgccagctgggggaccggctgaatgtggaggtggatgctgcccctcctgtggacctgaacaagatcctggaggacatgcgctgccagtatgaggccctggtggagaacaacagaagagatgtggaggcctggttcaacacccagacagaggagctgaaccagcaggtggtgagcagcagcgagcagctgcagtgctgccagacagagatcatcgagctgcggaggacagtgaatgccctggagattgagctgcaggcccagcacagcatgaggaacagcctggagagcaccctggccgagacagaggcccgctacagcagccagctggcccagatgcagtgcctgatcagcaatgtggaggcccagctgtctgagatccgctgtgacctggagcggcagaaccaggagtaccaggtgctgctggatgtgaaggcccggctggagggggagatcgccacctaccgccacctgctggagggggaggactgcaagctgcccccccagccctgtgccacagcctgcaagcctgtgatccgggtgcccagcgtgccccctgtgccctgtgtgcccagcgtgccctgcaccccagccccccaggtgggcacccagatccgcaccatcacagaggagatcagagatggcaaggtgatcagcagccgggagcacgtgcagagccggcccctgtag

SEQ ID NO: 156871 - DNA, 1254 bp, Artificial Sequence
  Description of Artificial Sequence: Synthetic coding sequence
atgctgcggagcggcctgagcggcctgggcagctgcctgcccggcagctacctgagcagcgagtgccacaccagcggctttgtgggcagcggcggctggttctgtgagggcagcttcaacggcagcgagaaggagaccatgcagttcctgaatgaccggctggccaactacctggagaaggtgcggcagctggagagagaaaatgctgagctggagagccgcatccaggagtggtatgagttccagatcccctacatctgcccagactaccagagctacttcaagaccatcgaggacttccagcagaagatcctgctgaccaagtcagaaaatgcccggctggtgctgcagattgacaatgccaagctggccgcagatgacttccgcaccaagtatgaaacagagctgagcctgcggcagctggtggaggccgacatcaatggcctgcggcgcatcctggatgagctgaccctgtgcaaggctgacctggaggcccaggtggagagcctgaaggaggagctgatgtgcctgaagaagaaccacgaggaggaggtgtctgtgctgcgctgccagctgggggaccggctgaatgtggaggtggatgctgcccctcctgtggacctgaacaagatcctggaggacatgcgctgccagtatgaggccctggtggagaacaacagaagagatgtggaggcctggttcaacacccagacagaggagctgaaccagcaggtggtgagcagcagcgagcagctgcagtgctgccagacagagatcatcgagctgcggaggacagtgaatgccctggagattgagctgcaggcccagcacagcatgaggaacagcctggagagcaccctggccgagacagaggcccgctacagcagccagctggcccagatgcagtgcctgatcagcaatgtggaggcccagctgtctgagatccgctgtgacctggagcggcagaaccaggagtaccaggtgctgctggatgtgaaggcccggctggagggggagatcgccacctaccgccacctgctggagggggaggactgcaagctgcccccccagccctgtgccacagcctgcaagcctgtgatccgggtgcccagcgtgccccctgtgccctgtgtgcccagcgtgccctgcaccccagccccccaggtgggcacccagatccgcaccatcacagaggagatcagagatggcaaggtgatcagcagccgggagcacgtgcagagccggcccctgtag

SEQ ID NO: 156872 - DNA, 1200 bp, Artificial Sequence
  Description of Artificial Sequence: Synthetic coding sequence
atggcccggcgcttccaggaggagctggccgccttcctgtttgaatatgacacccccaggatggtgctggtgaggaacaagaaggtgggcgtcatcttccgcctcatccagctggtggtgctggtgtatgtgattggctgggtgttcctgtatgagaagggctaccagaccagcagcggcctcatcagctctgtgtctgtgaagctgaagggcctggccgtgacccagctgcccggcctgggcccccaggtgtgggatgtggccgactatgtgtttcctgcccagggcgacaacagctttgtggtgatgaccaacttcatcgtgacccccaagcagacccagggctactgtgccgagcaccctgagggcggcatctgcaaggaggacagcggctgcacccctgggaaggccaagaggaaggcccagggcatcagaactggaaaatgtgtggccttcaatgacacagtgaagacctgtgagatcttcggctggtgccctgtggaggtggatgatgacatccccaggcctgccctgctgcgggaggccgagaacttcaccctcttcatcaagaacagcatctccttcccccgcttcaaggtgaacagaagaaacctggtggaggaggtgaatgctgcccacatgaagacctgcctcttccacaagaccctgcaccccctgtgccctgtgttccagctgggctacgtggtgcaggagagcggccagaacttcagcaccctggccgagaagggcggcgtggtgggcatcaccatcgactggcactgtgacctggactggcacgtgcgccactgccggcccatctatgagttccacggcctgtatgaggagaagaacctgagccctggcttcaacttccgctttgcccggcactttgtggagaatggcaccaactaccgccacctgttcaaggtgtttggcatccgctttgacatcctggtggatggcaaggccggcaagtttgacatcatccccaccatgaccaccatcggcagcggcatcggcatcttcggcgtggccaccgtgctgtgtgacctgctgctgctgcacatcctgcccaagaggcactactacaagcagaagaagttcaagtatgcagaggacatgggccctggagctgctgagcgggacctggccgccaccagcagcaccctgggcctgcaggagaacatgaggaccagctag

SEQ ID NO: 156873 - DNA, 1371 bp, Artificial Sequence
  Description of Artificial Sequence: Synthetic coding sequence
atgaccagcagctacagcagcagcagctgccccctgggctgcaccatggcccctggggccagaaatgtgtctgtgagccccatcgacatcggctgccagcccggggctgaggccaacatcgcccccatgtgcctgctggccaacgtggcccacgccaacagagtgcgggtgggcagcacccccctgggccggcccagcctgtgcctgccccccacctgccacacagcctgccccctgcccggcacctgccacatccctggcaacatcggcatctgtggggcctatggagagaacaccctgaatggacatgagaaggagaccatgcagttcctgaatgaccggctggccaactacctggagaaggtgcggcagctggagcaggagaatgctgagctggaggccaccctgctggagaggagcaaatgtcatgagagcacagtgtgcccagactaccagagctacttccacaccatcgaggagctgcagcagaagatcctgtgcagcaaggcagaaaatgcccggctcatcgtgcagattgacaatgccaagctggccgcagatgacttccgcatcaagctggagagcgagaggagcctgcggcagctggtggaggccgacaagtgtggcacccagaagctgctggatgatgccaccctggccaaggctgacctggaggcccagcaggagagcctgaaggaggagcagctgagcctgaagagcaaccacgagcaggaggtgaagatcctgcggagccagctgggggagaagctgagaattgagctggacatcgagcccaccatcgacctgaacagagtgctgggggagatgagggcccagtatgaggccatgctggagaccaaccggcaggatgtggagcagtggttccaggcccagagcgagggcatcagcctgcaggacatgagctgcagcgaggagctgcagtgctgccagagcgagatcctggagctgcgctgcaccgtgaatgccctggaggtggagcggcaggcccagcacaccctgaaggactgcctgcagaacagcctgtgtgaggccgaggacagatttggaacagagctggcccagatgcagagcctcatcagcaatgtggaggagcagctgtctgagatccgggctgacctggagcggcagaaccaggagtaccaggtgctgctggatgtgaagacccggctggagaatgaaattgccacctacagaaacctgctggagagcgaggactgcaagctgccctgcaacccctgcagcaccagccccagctgtgtgacagccccctgtgccccccggcccagctgtggcccctgcaccacctgtggccccacctgtggggccagcaccaccggcagccgcttctag

SEQ ID NO: 156874 - DNA, 1785 bp, Artificial Sequence
  Description of Artificial Sequence: Synthetic coding sequence
atgacctctgtgggcgtcttcagtgacatgctgaatggctgtgggaaggatggcctggtgccccgggccaagcccagagatgtgtctgacttcagcctgtatgccccagccaccaagccctgctgcagcaggacctacaagagaagaaggctgcgggccccagccctgaccggcctgggccctgtgaccagcctcatcgcccccagcagcctgtctgctgccatgattgcccggcagcagtgtgtgcggggcggcccccggggcttcagctgtggcagcgccatcgtgggcggcggcaagagaggagccttcagctctgtgtccatgtctgggggcgccggccgctgcagcagcggcggcttcggcagccgcagcctgtacaacctgcggggcaacaagagcatctccatgtctgtggccggcagccggcagggcgcctgcttcggcggggccggcggcttcggcaccggcggctttggaggcggctttggaggcagcttcagcggcaagggcggccctggcttccctgtgtgcccagctgggggcatccaggaggtgaccatcaaccagagcctgctgacccccctgcacgtggagattgatcctgagatccagaaggtgaggacagaggagcgggagcagatcaagctgctgaacaacaagtttgccagcttcatcgacaaggtgcagttcctggagcagcagaacaaggtgctggagaccaagtggaacctgctgcagcagcagaccaccaccaccagcagcaagaacctggagcccctgtttgagacctacctgtctgtgctgaggaagcagctggacaccctgggcaatgacaagggccgcctgcagagcgagctgaagaccatgcaggacagcgtggaggacttcaagaccaagtatgaggaggagatcaacaagaggacagctgctgaaaatgactttgtggtgctgaagaaggatgtggatgctgcctacctgaacaaggtggagctggaggccaaggtggacagcctgaatgatgagatcaacttcctgaaggtgctgtatgatgctgagctgagccagatgcagacccacgtgtctgacacctctgtggtgctgtccatggacaacaacagaaacctggacctggacagcatcatcgccgaggtgcgggcccagtatgaggagatcgcccagaggagcaaggccgaggccgaggccctgtaccagaccaaggtgcagcagctgcagatctctgtggaccagcacggggacaacctgaagaacaccaagtcagaaattgctgagctgaacaggatgatccagaggctgcgggcagaaattgagaacatcaagaagcagtgccagaccctgcaggtgtctgtggctgatgctgagcagagaggagaaaatgccctgaaggatgcccacagcaagagggtggagctggaggccgccctgcagcaggccaaggaggagctggccaggatgctgcgggagtaccaggagctgatgtctgtgaagctggccctggacatcgagatcgccacctacaggaagctgctggagggggaggagtacaggatgtctggagagtgccagagcgctgtgtccatctctgtggtgtctggcagcaccagcactggaggcatcagcggcggcctgggcagcggcagcggcttcggcctgagcagcggcttcggcagcggcagcggcagcggcttcggctttggaggctctgtgtctggcagcagcagcagcaagatcatcagcaccaccaccctgaacaagagaagatag

SEQ ID NO: 156875 - DNA, 1503 bp, Artificial Sequence
  Description of Artificial Sequence: Synthetic coding sequence
atgattgcccggcagcagtgtgtgcggggcggcccccggggcttcagctgtggcagcgccatcgtgggcggcggcaagagaggagccttcagctctgtgtccatgtctgggggcgccggccgctgcagcagcggcggcttcggcagcaagggggcctgcttcggcggggccggcggcttcggcaccggcggctttggaggcggctttggaggcagcttcagcggcaagggcggccctggcttccctgtgtgcccagctgggggcatccaggaggtgaccatcaaccagagcctgctgacccccctgcacgtggagattgatcctgagatccagaaggtgaggacagaggagcgggagcagatcaagctgctgaacaacaagtttgccagcttcatcgacaaggtgcagttcctggagcagcagaacaaggtgctggagaccaagtggaacctgctgcagcagcagaccaccaccaccagcagcaagaacctggagcccctgtttgagacctacctgtctgtgctgaggaagcagctggacaccctgggcaatgacaagggccgcctgcagagcgagctgaagaccatgcaggacagcgtggaggacttcaagaccaagtatgaggaggagatcaacaagaggacagctgctgaaaatgactttgtggtgctgaagaaggatgtggatgctgcctacctgaacaaggtggagctggaggccaaggtggacagcctgaatgatgagatcaacttcctgaaggtgctgtatgatgctgagctgagccagatgcagacccacgtgtctgacacctctgtggtgctgtccatggacaacaacagaaacctggacctggacagcatcatcgccgaggtgcgggcccagtatgaggagatcgcccagaggagcaaggccgaggccgaggccctgtaccagaccaaggtgcagcagctgcagatctctgtggaccagcacggggacaacctgaagaacaccaagtcagaaattgctgagctgaacaggatgatccagaggctgcgggcagaaattgagaacatcaagaagcagtgccagaccctgcaggtgtctgtggctgatgctgagcagagaggagaaaatgccctgaaggatgcccacagcaagagggtggagctggaggccgccctgcagcaggccaaggaggagctggccaggatgctgcgggagtaccaggagctgatgtctgtgaagctggccctggacatcgagatcgccacctacaggaagctgctggagggggaggagtacaggatgtctggagagtgccagagcgctgtgtccatctctgtggtgtctggcagcaccagcactggaggcatcagcggcggcctgggcagcggcagcggcttcggcctgagcagcggcttcggcagcggcagcggcagcggcttcggctttggaggctctgtgtctggcagcagcagcagcaagatcatcagcaccaccaccctgaacaagagaagatag

SEQ ID NO: 156876 - DNA, 1563 bp, Artificial Sequence
  Description of Artificial Sequence: Synthetic coding sequence
atgattgcccggcagcagtgtgtgcggggcggcccccggggcttcagctgtggcagcgccatcgtgggcggcggcaagagaggagccttcagctctgtgtccatgtctgggggcgccggccgctgcagcagcggcggcttcggcagccgcagcctgtacaacctgcggggcaacaagagcatctccatgtctgtggccggcagccggcagggcgcctgcttcggcggggccggcggcttcggcaccggcggctttggaggcggctttggaggcagcttcagcggcaagggcggccctggcttccctgtgtgcccagctgggggcatccaggaggtgaccatcaaccagagcctgctgacccccctgcacgtggagattgatcctgagatccagaaggtgaggacagaggagcgggagcagatcaagctgctgaacaacaagtttgccagcttcatcgacaaggtgcagttcctggagcagcagaacaaggtgctggagaccaagtggaacctgctgcagcagcagaccaccaccaccagcagcaagaacctggagcccctgtttgagacctacctgtctgtgctgaggaagcagctggacaccctgggcaatgacaagggccgcctgcagagcgagctgaagaccatgcaggacagcgtggaggacttcaagaccaagtatgaggaggagatcaacaagaggacagctgctgaaaatgactttgtggtgctgaagaaggatgtggatgctgcctacctgaacaaggtggagctggaggccaaggtggacagcctgaatgatgagatcaacttcctgaaggtgctgtatgatgctgagctgagccagatgcagacccacgtgtctgacacctctgtggtgctgtccatggacaacaacagaaacctggacctggacagcatcatcgccgaggtgcgggcccagtatgaggagatcgcccagaggagcaaggccgaggccgaggccctgtaccagaccaaggtgcagcagctgcagatctctgtggaccagcacggggacaacctgaagaacaccaagtcagaaattgctgagctgaacaggatgatccagaggctgcgggcagaaattgagaacatcaagaagcagtgccagaccctgcaggtgtctgtggctgatgctgagcagagaggagaaaatgccctgaaggatgcccacagcaagagggtggagctggaggccgccctgcagcaggccaaggaggagctggccaggatgctgcgggagtaccaggagctgatgtctgtgaagctggccctggacatcgagatcgccacctacaggaagctgctggagggggaggagtacaggatgtctggagagtgccagagcgctgtgtccatctctgtggtgtctggcagcaccagcactggaggcatcagcggcggcctgggcagcggcagcggcttcggcctgagcagcggcttcggcagcggcagcggcagcggcttcggctttggaggctctgtgtctggcagcagcagcagcaagatcatcagcaccaccaccctgaacaagagaagatag

SEQ ID NO: 156877 - DNA, 1695 bp, Artificial Sequence
  Description of Artificial Sequence: Synthetic coding sequence
atggccagcaccagcaccaccatccgcagccacagcagcagcagaagaggcttcagcgccaacagcgcccggctgcccggggtgagccgcagcggcttcagctctgtgtctgtgagccgcagccggggcagcggcggcctgggcggggcctgtggcggggccggcttcggcagccgcagcctgtatggcctgggcggcagcaagaggatcagcatcggcggcggcagctgtgccatcagcggcggctacggcagcagagctgggggcagctatggctttggaggagctggcagcggcttcggctttggaggaggagctggcatcggcttcggcctgggcggcggggccggcctggccggcggctttggaggccctggcttccctgtgtgccccccaggcggcatccaggaggtgacagtgaaccagagcctgctgacccccctgaacctgcagattgaccccaccatccagagggtgcgggcagaggagcgggagcagatcaagaccctgaacaacaagtttgccagcttcatcgacaaggtgcgcttcctggagcagcagaacaaggtgctggagaccaagtggaccctgctgcaggagcagggcaccaagacagtgcggcagaacctggagcccctgtttgagcagtacatcaacaacctgcggcggcagctggacagcatcgtgggggagcggggccgcctggacagcgagctgcggggcatgcaggacctggtggaggacttcaagaacaagtatgaagatgagatcaacaagaggacagctgctgaaaatgaatttgtgaccctgaagaaggatgtggatgctgcctacatgaacaaggtggagctgcaggccaaggctgacaccctgacagatgagatcaacttcctgcgggccctgtatgatgctgagctgagccagatgcagacccacatcagtgacacctctgtggtgctgtccatggacaacaacagaaacctggacctggacagcatcatcgccgaggtgaaggcccagtatgaggagatcgcccagaggagcagagctgaggccgagagctggtaccagaccaagtatgaggagctgcaggtgacagctggaagacatggagatgacctgaggaacaccaagcaggagattgctgagatcaacaggatgatccagaggctgcggagtgaaattgaccacgtgaagaagcagtgtgccaacctgcaggccgccatcgcagatgctgagcagagaggagagatggccctgaaggatgccaagaacaagctggagggcctggaggatgccctgcagaaggccaagcaggacctggcccggctgctgaaggagtaccaggagctgatgaatgtgaagctggccctggatgtggagatcgccacctacaggaagctgctggagggggaggagtgccgcctgaatggagagggcgtgggccaggtgaacatctctgtggtgcagagcacagtgagcagcggctatggaggagccagcggcgtgggcagcggcctgggcctgggcggcggcagcagctacagctatggcagcggcctgggcgtgggcggcggcttcagcagcagcagcggccgggccatcggcggcggcctgagctctgtgggcggcggcagcagcaccatcaagtacaccaccaccagcagcagcagcaggaagagctacaagcactag

SEQ ID NO: 156878 - DNA, 1563 bp, Artificial Sequence
  Description of Artificial Sequence: Synthetic coding sequence
atggccagcaccagcaccaccatccgcagccacagcggcagccgcagcctgtatggcctgggcggcagcaagaggatcagcatcggcggcggcagctgtgccatcagcggcggctacggcagcagagctgggggcagctatggctttggaggagctggcagcggcttcggctttggaggaggagctggcatcggcttcggcctgggcggcggggccggcctggccggcggctttggaggccctggcttccctgtgtgccccccaggcggcatccaggaggtgacagtgaaccagagcctgctgacccccctgaacctgcagattgaccccaccatccagagggtgcgggcagaggagcgggagcagatcaagaccctgaacaacaagtttgccagcttcatcgacaaggtgcgcttcctggagcagcagaacaaggtgctggagaccaagtggaccctgctgcaggagcagggcaccaagacagtgcggcagaacctggagcccctgtttgagcagtacatcaacaacctgcggcggcagctggacagcatcgtgggggagcggggccgcctggacagcgagctgcggggcatgcaggacctggtggaggacttcaagaacaagtatgaagatgagatcaacaagaggacagctgctgaaaatgaatttgtgaccctgaagaaggatgtggatgctgcctacatgaacaaggtggagctgcaggccaaggctgacaccctgacagatgagatcaacttcctgcgggccctgtatgatgctgagctgagccagatgcagacccacatcagtgacacctctgtggtgctgtccatggacaacaacagaaacctggacctggacagcatcatcgccgaggtgaaggcccagtatgaggagatcgcccagaggagcagagctgaggccgagagctggtaccagaccaagtatgaggagctgcaggtgacagctggaagacatggagatgacctgaggaacaccaagcaggagattgctgagatcaacaggatgatccagaggctgcggagtgaaattgaccacgtgaagaagcagtgtgccaacctgcaggccgccatcgcagatgctgagcagagaggagagatggccctgaaggatgccaagaacaagctggagggcctggaggatgccctgcagaaggccaagcaggacctggcccggctgctgaaggagtaccaggagctgatgaatgtgaagctggccctggatgtggagatcgccacctacaggaagctgctggagggggaggagtgccgcctgaatggagagggcgtgggccaggtgaacatctctgtggtgcagagcacagtgagcagcggctatggaggagccagcggcgtgggcagcggcctgggcctgggcggcggcagcagctacagctatggcagcggcctgggcgtgggcggcggcttcagcagcagcagcggccgggccatcggcggcggcctgagctctgtgggcggcggcagcagcaccatcaagtacaccaccaccagcagcagcagcaggaagagctacaagcactag

SEQ ID NO: 156879 - DNA, 1695 bp, Artificial Sequence
  Description of Artificial Sequence: Synthetic coding sequence
atggccagcaccagcaccaccatccgcagccacagcagcagcagaagaggcttcagcgccaacagcgcccggctgcccggggtgagccgcagcggcttcagcagcatctctgtgagccgcagccggggcagcggcggcctgggcggggcctgtggcggggccggcttcggcagccgcagcctgtatggcctgggcggcagcaagaggatcagcatcggcggcggcagctgtgccatcagcggcggctacggcagcagagctgggggcagctatggctttggaggagctggcagcggcttcggctttggaggaggagctggcatcggcttcggcctgggcggcggggccggcctggccggcggctttggaggccctggcttccctgtgtgccccccaggcggcatccaggaggtgacagtgaaccagagcctgctgacccccctgaacctgcagattgatcctgccatccagagggtgcgggcagaggagcgggagcagatcaagaccctgaacaacaagtttgccagcttcatcgacaaggtgcgcttcctggagcagcagaacaaggtgctggacaccaagtggaccctgctgcaggagcagggcaccaagacagtgcggcagaacctggagcccctgtttgagcagtacatcaacaacctgcggcggcagctggacaacatcgtgggggagcggggccgcctggacagcgagctgaggaacatgcaggacctggtggaggacctgaagaacaagtatgaagatgagatcaacaagaggacagctgctgaaaatgaatttgtgaccctgaagaaggatgtggatgctgcctacatgaacaaggtggagctgcaggccaaggctgacaccctgacagatgagatcaacttcctgcgggccctgtatgatgctgagctgagccagatgcagacccacatcagtgacacctctgtggtgctgtccatggacaacaacagaaacctggacctggacagcatcatcgccgaggtgaaggcccagtatgaggagatcgcccagaggagcagagctgaggccgagagctggtaccagaccaagtatgaggagctgcagatcacagctggaagacatggagatgacctgaggaacaccaagcaggagattgctgagatcaacaggatgatccagaggctgcggagtgaaattgaccacgtgaagaagcagtgtgccaacctgcaggccgccatcgcagatgctgagcagagaggagagatggccctgaaggatgccaagaacaagctggagggcctggaggatgccctgcagaaggccaagcaggacctggcccggctgctgaaggagtaccaggagctgatgaatgtgaagctggccctggatgtggagatcgccacctacaggaagctgctggagggggaggagtgccgcctgaatggagagggcgtgggccaggtgaacatctctgtggtgcagagcacagtgagcagcggctatggaggagccagcggcgtgggcagcggcctgggcctgggcggcggcagcagctacagctatggcagcggcctgggcgtgggcggcggcttcagcagcagcagcggccgggccactggaggcggcctgagctctgtgggcggcggcagcagcaccatcaagtacaccaccaccagcagcagcagcaggaagagctacaagcactag

SEQ ID NO: 156880 - DNA, 1575 bp, Artificial Sequence
  Description of Artificial Sequence: Synthetic coding sequence
atggccagcaccagcaccaccatccgcagccacagcagcagcagaagaggcttcagcgccaacagcgcccggctgcccggggtgagccgcagcggcttcagcagcatctctgtgagccgcagccggggcagcggcggcctgggcggggcctgtggcggggccggcttcggcagccgcagcctgtatggcctgggcggcagcaagaggatcagcatcggcggcggcagctgtgccatcagcggcggctacggcagcagagctgggggcagctatggctttggaggagctggcagcggcttcggctttggaggaggagctggcatcggcttcggcctgggcggcggggccggcctggccggcggctttggaggccctggcttccctgtgtgccccccaggcggcatccaggaggtgacagtgaaccagagcctgctgacccccctgaacctgcagattgatcctgccatccagagggtgcgggcagaggagcgggagcagatcaagaccctgaacaacaagtttgccagcttcatcgacaaggtgcgcttcctggagcagcagaacaaggtgctggacaccaagtggaccctgctgcaggagcagggcaccaagacagtgcggcagaacctggagcccctgtttgagcagtacatcaacaacctgcggcggcagctggacaacatcgtgggggagcggggccgcctggacagcgagctgaggaacatgcaggacctggtggaggacctgaagaacaaggatgagatcaacttcctgcgggccctgtatgatgctgagctgagccagatgcagacccacatcagtgacacctctgtggtgctgtccatggacaacaacagaaacctggacctggacagcatcatcgccgaggtgaaggcccagtatgaggagatcgcccagaggagcagagctgaggccgagagctggtaccagaccaagtatgaggagctgcagatcacagctggaagacatggagatgacctgaggaacaccaagcaggagattgctgagatcaacaggatgatccagaggctgcggagtgaaattgaccacgtgaagaagcagtgtgccaacctgcaggccgccatcgcagatgctgagcagagaggagagatggccctgaaggatgccaagaacaagctggagggcctggaggatgccctgcagaaggccaagcaggacctggcccggctgctgaaggagtaccaggagctgatgaatgtgaagctggccctggatgtggagatcgccacctacaggaagctgctggagggggaggagtgccgcctgaatggagagggcgtgggccaggtgaacatctctgtggtgcagagcacagtgagcagcggctatggaggagccagcggcgtgggcagcggcctgggcctgggcggcggcagcagctacagctatggcagcggcctgggcgtgggcggcggcttcagcagcagcagcggccgggccactggaggcggcctgagctctgtgggcggcggcagcagcaccatcaagtacaccaccaccagcagcagcagcaggaagagctacaagcactag

SEQ ID NO: 156881 - DNA, 1695 bp, Artificial Sequence
  Description of Artificial Sequence: Synthetic coding sequence
atggccagcaccagcaccaccatccgcagccacagcagcagcagaagaggcttcagcgccaacagcgcccggctgcccggggtgagccgcagcggcttcagcagcatctctgtgagccgcagccggggcagcggcggcctgggcggggcctgtggcggggccggcttcggcagccgcagcctgtatggcctgggcggcagcaagaggatcagcatcggcggcggcagctgtgccatcagcggcggctacggcagcagagctgggggcagctatggctttggaggagctggcagcggcttcggctttggaggaggagctggcatcggcttcggcctgggcggcggggccggcctggccggcggctttggaggccctggcttccctgtgtgccccccaggcggcatccaggaggtgacagtgaaccagagcctgctgacccccctgaacctgcagattgatcctgccatccagagggtgcgggcagaggagcgggagcagatcaagaccctgaacaacaagtttgccagcttcatcgacaaggtgcgcttcctggagcagcagaacaaggtgctggacaccaagtggaccctgctgcaggagcagggcaccaagacagtgcggcagaacctggagcccctgtttgagcagtacatcaacaacctgcggcggcagctggacagcatcgtgggggagcggggccgcctggacagcgagctgaggaacatgcaggacctggtggaggacctgaagaacaagtatgaagatgagatcaacaagaggacagctgctgaaaatgaatttgtgaccctgaagaaggatgtggatgctgcctacatgaacaaggtggagctgcaggccaaggctgacaccctgacagatgagatcaacttcctgcgggccctgtatgatgctgagctgagccagatgcagacccacatcagtgacacctctgtggtgctgtccatggacaacaacagaaacctggacctggacagcatcatcgccgaggtgaaggcccagtatgaggagatcgcccagaggagcagagctgaggccgagagctggtaccagaccaagtatgaggagctgcaggtgacagctggaagacatggagatgacctgaggaacaccaagcaggagattgctgagatcaacaggatgatccagaggctgcggagtgaaattgaccacgtgaagaagcagtgtgccagcctgcaggccgccatcgcagatgctgagcagagaggagagatggccctgaaggatgccaagaacaagctggagggcctggaggatgccctgcagaaggccaagcaggacctggcccggctgctgaaggagtaccaggagctgatgaatgtgaagctggccctggatgtggagatcgccacctacaggaagctgctggagggggaggagtgccgcctgaatggagagggcgtgggccaggtgaatgtgtctgtggtgcagagcaccatcagcagcggctatggaggagccagcggcgtgggcagcggcctgggcctgggcggcggcagcagctacagctatggcagcggcctgggcattggaggcggcttcagcagcagcagcggccgggccatcggcggcggcctgagctctgtgggcggcggcagcagcaccatcaagtacaccaccaccagcagcagcagcaggaagagctacaagcactag

SEQ ID NO: 156882 - DNA, 1650 bp, Artificial Sequence
  Description of Artificial Sequence: Synthetic coding sequence
atggccagcaccagcaccaccatccgcagccacagcagcagccgcagcggcttcagcagcatctctgtgagccgcagccggggcagcggcggcctgggcggggcctgtggcggggccggcttcggcagccgcagcctgtatggcctgggcggcagcaagaggatcagcattggaggcggcagctgtgccatcagcggcggctacggcagccgggccggcggcagctatggctttggaggagctggcagcggctttggatttggaggaggagctggcattggatttggcctgggcggcggggccggcctggccggcggctttggaggccctggcttccctgtgtgccccccaggcggcatccaggaggtgacagtgaaccagagcctgctgacccccctgaacctgcagattgatcctgccatccagagggtgcgggcagaggagcgggagcagatcaagaccctgaacaacaagtttgccagcttcatcgacaaggtgcgcttcctggagcagcagaacaaggtgctggacaccaagtggaccctgctgcaggagcagggcaccaagacagtgcggcagaacctggagcccctgtttgagcagtacatcaacaacctgcggcggcagctggacagcatcgtgggggagcggggccgcctggacagcgagctgaggaacatgcaggacctggtggaggacctgaagaacaagtatgaagatgagatcaacaagaggacagctgctgaaaatgaatttgtgaccctgaagaaggatgtggatgctgcctacatgaacaaggtggagctgcaggccaaggctgacaccctgacagatgagatcaacttcctgcgggccctgtatgatgctgagctgagccagatgcagacccacatcagtgacacctctgtggtgctgtccatggacaacaacagaaacctggacctggacagcatcatcgccgaggtgaaggcccagtatgaggagatcgcccagaggagcagagctgaggccgagagctggtaccagaccaagtatgaggagctgcaggtgacagctggaagacatggagatgacctgaggaacaccaagcaggagattgctgagatcaacaggatgatccagaggctgcggagtgaaattgaccacgtgaagaagcagtgtgccagcctgcaggccgccatcgcagatgctgagcagagaggagagatggccctgaaggatgccaagaacaagctggagggcctggaggatgccctgcagaaggccaagcaggacctggcccggctgctgaaggagtaccaggagctgatgaatgtgaagctggccctggatgtggagatcgccacctacaggaagctgctggagggggaggagtgccgcctgaatggagaaggagtgggccaggtgaatgtgtctgtggtgcagagcaccatcagcagcggctacggcggggccagcggcgtgggcagcggcctgggcctgggcggcggcagcagctacagctatggcagcggcctgggcatcggcggcggcttcagcagcagcagcggccgggccatcggcggcggcctgagctctgtgggcggcggcagcagcaccatcaagtacaccaccaccagcagcagcagcaggaagagctacaagcactag

SEQ ID NO: 156883 - DNA, 1572 bp, Artificial Sequence
  Description of Artificial Sequence: Synthetic coding sequence
atgagccggcagttcacctgcaagtctggagctgctgccaagggcggcttcagcggctgcagcgctgtgctgagcggcggcagcagcagcagcttccgggccggcagcaagggcctgagcggcggcttcggcagccgcagcctgtacagcctgggcggcgtgcgcagcctgaatgtggccagcggcagcggcaagagcggcggctacggcttcggccggggccgggccagcggctttgctggctccatgtttggatctgtggccctgggccctgtgtgccccaccgtgtgccccccaggcggcatccaccaggtgacagtgaatgaaagcctgctggcccccctgaatgtggagctggaccctgagatccagaaggtgcgggcccaggagcgggagcagatcaaggccctgaacaacaagtttgccagcttcatcgacaaggtgcgcttcctggagcagcagaaccaggtgctggagaccaagtgggagctgctgcagcagctggacctgaacaactgcaagaacaacctggagcccatcctggagggctacatcagcaacctgaggaagcagctggagaccctgagcggggacagagtgcggctggacagcgagctgagaaatgtgagagatgtggtggaggactacaagaagagatatgaggaggagatcaacaagaggacagctgctgaaaatgaatttgtgctgctgaagaaggatgtggatgctgcctatgccaacaaggtggagctgcaggccaaggtggagagcatggaccaggagatcaagttcttccgctgcctgtttgaagctgagatcacccagatccagagccacatcagtgacatgtctgtcatcctgtccatggacaacaacagaaacctggacctggacagcatcattgatgaggtgaggacccagtatgaggagatcgccctgaagagcaaggccgaggccgaggccctgtaccagaccaagttccaggagctgcagctggccgccggcagacatggagatgacctgaagaacaccaagaatgagatcagcgagctgaccaggctcatccagaggatccgctcagaaattgaaaatgtgaagaagcaggccagcaacctggagacagccatcgcagatgctgagcagagaggagacaatgccctgaaggatgcccgggccaagctggatgagctggagggcgccctgcaccaggccaaggaggagctggccaggatgctgcgggagtaccaggagctgatgagcctgaagctggccctggacatggagatcgccacctacaggaagctgctggagagcgaggagtgcaggatgtctggagagttccccagccctgtgtccatcagcatcatcagcagcaccagcggcggctctgtgtatggcttccggcccagcatggtgtctgggggctacgtggccaacagcagcaactgcatctctggagtgtgcagcgtgcggggcggggagggccgcagccggggcagcgccaatgactacaaggacaccctgggcaagggcagcagcctgagcgcccccagcaagaagaccagcaggtag

SEQ ID NO: 156884 - DNA, 1536 bp, Artificial Sequence
  Description of Artificial Sequence: Synthetic coding sequence
atgagccggcagctgacccacttccccagaggagagcggctgggcttcagcggctgcagcgctgtgctgagcggcggcatcggcagcagcagcgccagcttccgggcccgggtgaagggcagcgccagctttggcagcaagagcctgagctgcctgggcggcagccgcagcctggccctgtctgctgctgccaggagaggaggcggccgcctgggcggctttgtgggcacagcctttggatctgctggcctgggccccaagtgccccagcgtgtgccccccaggcggcatcccccaggtgacagtgaacaagagcctgctggcccccctgaatgtggagatggaccctgagatccagagggtgcgggcccaggagcgggagcagatcaaggccctgaacaacaagtttgccagcttcatcgacaaggtgcgcttcctggagcagcagaaccaggtgctggagaccaagtggaacctgctgcagcagctggacctgaacaactgcaggaagaacctggagcccatctatgagggctacatcagcaacctgcagaagcagctggagatgctgtctggagatggagtgcggctggacagcgagctgaggaacatgcaggacctggtggaggactacaagaagagatatgaggtggagatcaacagaagaacagctgctgaaaatgaatttgtggtgctgaagaaggatgtggatgctgcctacatgaacaaggtggagctgcaggccaaggtggacagcctgacagatgagatcaagttcttcaagtgcctgtatgaaggagagatcacccagatccagagccacatcagtgacaccagcatcgtgctgtccatggacaacaacagagacctggacctggacagcatcatcgccgaggtgcgggcccagtatgaggagatcgccctgaagagcaaggccgaggccgagaccctgtaccagaccaagatccaggagctgcaggtgacagctggccagcacggagatgacctgaagctgaccaaggccgagatcagcgagctgaacagactcatccagaggatccgctcagaaattggaaatgtgaagaagcagtgtgccgacctggagacagccatcgcagatgctgagcagagaggagactgtgccctgaaggatgcccgggccaagctggatgagctggagggcgccctgcaccaggccaaggaggagctggccaggatgctgcgggagtaccaggagctggtgtccctgaagctggccctggacatggagatcgccacctacaggaagctgctggagagtgaagaatgtaggatgtctggagagtaccccaacagcgtgtccatcagcgtcatcagcagcaccaatgctggggccggcggggccggcttctccatgggctttggagccagcagcagctacagctacaagacagctgctgctgatgtgaagaccaagggcagctgtggcagcgagctgaaggaccccctggccaagaccagcggcagcagctgtgccaccaagaaggccagcaggtag

SEQ ID NO: 156885 - DNA, 1410 bp, Artificial Sequence
  Description of Artificial Sequence: Synthetic coding sequence
atgagccggcagctgacccacttccccagaggagagcggctgggcttcagcggctgcagcgctgtgctgagcggcggcatcggcagcagcagcgccagcttccgggcccgggtgaagggcagcgccagctttggcagcaagagcctgagctgcctgggcggcagccgcagcctggccctgtctgctgctgccaggagaggaggcggccgcctgggcggctttgtgggcacagcctttggatctgctggcctgggccccaagtgccccagcgtgtgccccccaggcggcatcccccaggtgacagtgaacaagagcctgctggcccccctgaatgtggagatggaccctgagatccagagggtgcgggcccaggagcgggagcagatcaaggccctgaacaacaagtttgccagcttcatcgacaaggtgcgcttcctggagcagcagaaccaggtgctggagaccaagtggaacctgctgcagcagctggacctgaacaactgcaggaagaacctggagcccatctatgagggctacatcagcaacctgcagaagcagctggagatgctgtctggagatggagtgcggctggacagcgagctgaggaacatgcaggacctggtggaggactacaagaagagatatgaggtggagatcaacagaagaacagctgctgaaaatgaatttgtggtgctgaagaaggatgtggatgctgcctacatgaacaaggtggagctgcaggccaaggtggacagcctgacagatgagatcaagttcttcaagtgcctgtatgaaggagagatcacccagatccagagccacatcagtgacaccagcatcgtgctgtccatggacaacaacagagacctggacctggacagcatcatcgccgaggtgcgggcccagtatgaggagatcgccctgaagagcaaggccgaggccgagaccctgtaccagaccaagtgtgccgacctggagacagccatcgcagatgctgagcagagaggagactgtgccctgaaggatgcccgggccaagctggatgagctggagggcgccctgcaccaggccaaggaggagctggccaggatgctgcgggagtaccaggagctggtgtccctgaagctggccctggacatggagatcgccacctacaggaagctgctggagagtgaagaatgtaggatgtctggagagtaccccaacagcgtgtccatcagcgtcatcagcagcaccaatgctggggccggcggggccggcttctccatgggctttggagccagcagcagctacagctacaagacagctgctgctgatgtgaagaccaagggcagctgtggcagcgagctgaaggaccccctggccaagaccagcggcagcagctgtgccaccaagaaggccagcaggtag

SEQ ID NO: 156886 - DNA, 972 bp, Artificial Sequence
  Description of Artificial Sequence: Synthetic coding sequence
atgctgtctggagatggagtgcggctggacagcgagctgaggaacatgcaggacctggtggaggactacaagaagagatatgaggtggagatcaacagaagaacagctgctgaaaatgaatttgtggtgctgaagaaggatgtggatgctgcctacatgaacaaggtggagctgcaggccaaggtggacagcctgacagatgagatcaagttcttcaagtgcctgtatgaaggagagatcacccagatccagagccacatcagtgacaccagcatcgtgctgtccatggacaacaacagagacctggacctggacagcatcatcgccgaggtgcgggcccagtatgaggagatcgccctgaagagcaaggccgaggccgagaccctgtaccagaccaagatccaggagctgcaggtgacagctggccagcacggagatgacctgaagctgaccaaggccgagatcagcgagctgaacagactcatccagaggatccgctcagaaattggaaatgtgaagaagcagtgtgccgacctggagacagccatcgcagatgctgagcagagaggagactgtgccctgaaggatgcccgggccaagctggatgagctggagggcgccctgcaccaggccaaggaggagctggccaggatgctgcgggagtaccaggagctggtgtccctgaagctggccctggacatggagatcgccacctacaggaagctgctggagagtgaagaatgtaggatgtctggagagtaccccaacagcgtgtccatcagcgtcatcagcagcaccaatgctggggccggcggggccggcttctccatgggctttggagccagcagcagctacagctacaagacagctgctgctgatgtgaagaccaagggcagctgtggcagcgagctgaaggaccccctggccaagaccagcggcagcagctgtgccaccaagaaggccagcaggtag

SEQ ID NO: 156887 - DNA, 1536 bp, Artificial Sequence; identical to SEQ ID NO: 156884
  Description of Artificial Sequence: Synthetic coding sequence

SEQ ID NO: 156888 - DNA, 1623 bp, Artificial Sequence
  Description of Artificial Sequence: Synthetic coding sequence
atgagccggcagttcacctacaagtctggagctgctgccaagggcggcttcagcggctgcagcgctgtgctgagcggcggcagcagcagcagctaccgggccggcggcaagggcctgagcggcggcttcagcagccgcagcctgtacagcctgggcggggcccggagcatctccttcaacgtggccagcggcagcggctgggccggcggctacggcttcggccggggccgggccagcggctttgctggctccatgtttggatctgtggccctgggctctgtgtgccccagcctgtgccccccaggcggcatccaccaggtgaccatcaacaagagcctgctggcccccctgaatgtggagctggaccctgagatccagaaggtgcgggcccaggagcgggagcagatcaaggtgctgaacaacaagtttgccagcttcatcgacaaggtgcgcttcctggagcagcagaaccaggtgctggagaccaagtgggagctgctgcagcagctggacctgaacaactgcaagaacaacctggagcccatcctggagggctacatcagcaacctgaggaagcagctggagaccctgagcggggacagagtgcggctggacagcgagctgcggtctgtgcgggaggtggtggaggactacaagaagagatatgaggaggagatcaacaagaggaccacagcagaaaatgaatttgtggtgctgaagaaggatgtggatgctgcctacaccagcaaggtggagctgcaggccaaggtggatgccctggatggagagatcaagttcttcaagtgcctgtatgaaggagaaacagcccagatccagagccacatcagtgacaccagcatcatcctgtccatggacaacaacagaaacctggacctggacagcatcatcgccgaggtgcgggcccagtatgaggagatcgccaggaagagcaaggccgaggccgaggccctgtaccagaccaagttccaggagctgcagctggccgccggcagacatggagatgacctgaagcacaccaagaatgagatcagcgagctgaccaggctcatccagaggctgcggagtgaaattgagagcgtgaagaagcagtgtgccaacctggagacagccatcgcagatgctgagcagagaggagactgtgccctgaaggatgcccgggccaagctggatgagctggagggcgccctgcagcaggccaaggaggagctggccaggatgctgcgggagtaccaggagctgctgtctgtgaagctgagcctggacattgaaattgccacctacaggaagctgctggagggggaggagtgcaggatgtctggagagtacaccaacagcgtgtccatcagcgtcatcaacagctccatggccggcatggccggcaccggggccggcttcggcttcagcaatgccggcacctacggctactggcccagctctgtgtctgggggctacagcatgctgcccggcggctgtgtgacaggcagcggcaactgcagccccagaggagaggcccggacccggctgggcagcgccagcgagttccgggacagccagggcaagaccctggccctgagcagccccaccaagaagaccatgaggtag

SEQ ID NO: 156889 - DNA, 1590 bp, Artificial Sequence
  Description of Artificial Sequence: Synthetic coding sequence
atgagccggcagctgaacatcaagagcagcggggacaagggcaacttctctgtgcacagcgctgtggtgcccaggaaggctgtgggcagcctggccagctactgtgccgccggcagaggagctggagctggcttcggcagccgcagcctgtacagcctgggcggcaacagacgcatctccttcaacgtggccggcggcggcgtgcgggccggcggctacggcttccggcccggcagcggctatggaggcggccgggccagcggctttgctggctccatgtttggatctgtggccctgggccctgcctgcctgtctgtgtgccccccaggcggcatccaccaggtgacagtgaacaagagcctgctggcccccctgaatgtggagctggaccctgagatccagaaggtgcgggcccaggagcgggagcagatcaaggtgctgaatgacaagtttgccagcttcatcgacaaggtgcgcttcctggagcagcagaaccaggtgctggagaccaagtgggagctgctgcagcagctggacctgaacaactgcaagaagaacctggagcccatcctggagggctacatcagcaacctgaggaagcagctggagaccctgagcggggacagagtgcggctggacagcgagctgcgctccatgagggacctggtggaggactacaagaagagatatgaggtggagatcaacagaaggaccacagcagaaaatgaatttgtggtgctgaagaaggatgctgatgctgcctatgctgtgaaggtggagctgcaggccaaggtggacagcctggacaaggagatcaagttcctgaagtgcctgtatgatgctgagatcgcccagatccagacccacgccagcgagaccagcgtcatcctgtccatggacaacaacagagacctggacctggacagcatcatcgccgaggtgaggatgcactatgaggagatcgccctgaagagcaaggccgaggccgaggccctgtaccagaccaagatccaggagctgcagctggccgccagcagacatggagatgacctgaagcacaccaggtctgagatggtggagctgaacagactcatccagaggatccgctgtgaaattggaaatgtgaagaagcagagggccagcctggagacagccatcgcagatgctgagcagagaggagacaatgccctgaaggatgcccaggccaagctggatgagctggagggcgccctgcaccaggccaaggaggagctggccaggatgctgcgggagtaccaggagctgatgagcctgaagctggccctggacatggagatcgccacctacaggaagctgctggagggggaggagtgcaggatgtctggagagaaccccagctctgtgtccatcagcgtcatcagcagcagcagctacagctaccaccaccccagcagcgctggggtggacctgggcgccagcgctgtggccggcagcagcggcagcacccagagcggccagaccaagaccacagaggcccggggcggggacctgaaggacacccagggcaagagcaccccagccagcatcccagccaggaaggccaccaggtag

SEQ ID NO: 156890 - DNA, 1656 bp, Artificial Sequence
  Description of Artificial Sequence: Synthetic coding sequence
atgagccggcagagcagcatcaccttccagagcggcagccggcggggcttcagcaccaccagcgccatcaccccagctgctggccgcagccgcttcagctctgtgtctgtggcccggtctgctgctggcagcggcggcctgggccgcatcagcagcgctggggccagctttggcagccgcagcctgtacaacctgggcggggccaagagggtgtccatcaatggctgcggcagcagctgccgcagcggctttggaggccgggccagcaaccgcttcggcgtgaacagcggcttcggctacggcggcggcgtgggcggcggcttcagcggccccagcttccctgtgtgccccccaggcggcatccaggaggtgacagtgaaccagagcctgctgacccccctgcacctgcagattgaccccaccatccagagggtgcgggcagaggagcgggagcagatcaagaccctgaacaacaagtttgccagcttcatcgacaaggtgcgcttcctggagcagcagaacaaggtgctggagaccaagtgggccctgctgcaggagcagggcagcaggacagtgcggcagaacctggagcccctgtttgacagctacaccagcgagctgcggcggcagctggagagcatcaccacagagcggggccgcctggaggccgagctgaggaacatgcaggatgtggtggaggacttcaaggtgcgctatgaagatgagatcaacaagaggacagctgctgaaaatgaatttgtggccctgaagaaggatgtggatgctgcctacatgaacaaggtggagctggaggccaaggtgaagagcctgcctgaggagatcaacttcatccacagcgtgtttgatgctgagctgagccagctgcagacccaggtgggggacacctctgtggtgctgtccatggacaacaacagaaacctggacctggacagcatcatcgccgaggtgaaggcccagtatgaggacatcgccaacagaagcagagctgaggccgagagctggtaccagaccaagtatgaggagctgcaggtgacagctggaagacatggagatgacctgaggaacaccaagcaggagatcagcgagatgaacaggatgatccagaggctgcgggcagaaattgattctgtgaagaagcagtgcagcagcctgcagacagccatcgcagatgctgagcagagaggagagctggccctgaaggatgcccgggccaagctggtggacctggaggaggccctgcagaaggccaagcaggacatggcccggctgctgcgggagtaccaggagctgatgaacatcaagctggccctggatgtggagatcgccacctacaggaagctgctggagggggaggagtgccgcctgtctggagagggcgtgtcccctgtgaacatctctgtggtgaccagcaccctgagcagcggctacggcagcggcagcagcattggaggcggcaacctgggcctgggcggcggcagcggctacagcttcaccaccagcggcggccacagcctgggcgccggcctgggcggcagcggcttcagcgccaccagcaacagaggcctgggcggcagcggcagctctgtgaagtttgtgtccaccaccagcagcagccagaagagctacacccactag

SEQ ID NO: 156891 - DNA, 1737 bp, Artificial Sequence
  Description of Artificial Sequence: Synthetic coding sequence
atgagccaccagttcagcagccagagcgccttcagctccatgagccggcgggtgtacagcaccagcagcagcgctggcagcggcggcggcagccctgctgtgggctctgtgtgctacgcccggggccgctgtggcggcggcggctacggcatccacggccggggcttcggcagccgcagcctgtacaacctgggcggcagccgcagcatcagcatcaacctgatgggccgcagcaccagcggcttctgccagggcggcggcgtgggcggctttggaggcggccggggctttggagtgggcagcactggagctgggggctttggaggcggcggctttggaggagctggcttcggcaccagcaactttggcctgggcggcttcggcccctactgccccccaggcggcatccaggaggtgaccatcaaccagagcctgctggagcccctgcacctggaggtggaccctgagatccagaggatcaagacccaggagcgggagcagatcatggtgctgaacaacaagtttgccagcttcatcgacaaggtgcgcttcctggagcagcagaaccaggtgctgcagaccaagtgggagctgctgcagcaggtgaacaccagcacaggcaccaacaacctggagcccctgctggagaactacatcggggacctgcggcggcaggtggacctgctgtctgctgagcagatgaggcagaatgctgaggtgcgctccatgcaggatgtggtggaggactacaagagcaaatatgaagatgagatcaacaagaggacaggctctgaaaatgactttgtggtgctgaagaaggatgtggatgctgcctacgtgtccaaggtggacctggagagccgggtggacaccctgactggagaggtgaacttcctgaagtacctgttcctgacagagctgagccaggtgcagacccacatcagtgacaccaacgtcatcctgtccatggacaacaacagaagcctggacctggacagcatcattgatgctgtgaggacccagtatgagctgattgcccagaggagcaaggatgaagctgaggccctgtaccagaccaagtaccaggagctgcagatcacagctggaagacatggagatgacctgaagaacagcaagatggagattgctgagctgaacagaacagtgcagaggctgcaggccgagatcagcaatgtgaagaagcagatcgagcagatgcagagcctcatcagtgatgctgaggagcggggggagcaggccctgcaggatgcctggcagaagctgcaggacctggaggaggccctgcagcagagcaaggaggagctggcccggctgctgcgggactaccaggccatgctgggcgtgaagctgagcctggatgtggagatcgccacctaccggcagctgctggagggggaggagagcaggatgtctggagagctgcagagccacgtgtccatctctgtgcagaacagccaggtgtctgtgaatggaggagctgggggcggcggcagctatggcagcggcggctatggaggcggcagcggcggcggctatggaggcggccgcagctacagaggaggaggagcccggggccgcagcggcggcggctacggcagcggctgcggcggcggcggcggcagctatggaggcagcggccgcagcggccggggcagcagccgggtgcagatcatccagaccagcaccaacaccagccaccggcgcatcctggagtag

SEQ ID NO: 156892 - DNA, 1038 bp, Artificial Sequence
  Description of Artificial Sequence: Synthetic coding sequence
atgaggcagaatgctgaggtgcgctccatgcaggatgtggtggaggactacaagagcaaatatgaagatgagatcaacaagaggactggaagtgaaaatgactttgtggtgctgaagaaggatgtggatgctgcctacgtgtccaaggtggacctggagagccgggtggacaccctgaccggggaggtgaacttcctgaagtacctgttcctgacagagctgagccaggtgcagacccacatcagtgacaccaacgtcatcctgtccatggacaacaacagaagcctggacctggacagcatcattgatgctgtgaggacccagtatgagctgattgcccagaggagcaaggatgaggccgaggccctgtaccagaccaagtaccaggagctgcagatcacagctggaagacatggagatgacctgaagaacagcaagatggagattgctgagctgaacagaacagtgcagaggctgcaggccgagatcagcaatgtgaagaagcagatcgagcagatgcagagcctcatcagtgatgctgaggagcggggggagcaggccctgcaggatgcctggcagaagctgcaggacctggaggaggccctgcagcagagcaaggaggagctggcccggctgctgcgggactaccaggccatgctgggcgtgaagctgagcctggatgtggagatcgccacctaccggcagctgctggagggggaggagagcaggatgtctggagagctgcagagccacgtgtccatctctgtgcagaacagccaggtgtctgtgaatggaggagctgggggcggcggcagctatggcagcggcggctacggcggcggcagcggcggcggctacggcggcggccgcagctaccggggcggcggggcccggggccgcagcggcggcggctacggcagcggctgcggcggcggcggcggcagctatggaggcagcggccgcagcggccggggcagcagccgggtgcagatcatccagaccagcaccaacaccagccaccggcgcatcctggagtag
